United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 20

SEQ ID NO: 859299 - RNA, 22 nt, Human
ugcaggaacugggagggauagu

SEQ ID NO: 859300 - RNA, 22 nt, Human
caaguaaagaaucacauuucuu

SEQ ID NO: 859301 - RNA, 20 nt, Human
uuucacagucccuguuuccu

SEQ ID NO: 859302 - RNA, 22 nt, Human
auuggcagaaacagcagggcca

SEQ ID NO: 859303 - RNA, 22 nt, Human
guauacagauacuuagacgugc

SEQ ID NO: 859304 - RNA, 19 nt, Human
uggagggguuugaaugugg

SEQ ID NO: 859305 - RNA, 22 nt, Human
aaucagaacgcucgaucuucgg

SEQ ID NO: 859306 - RNA, 22 nt, Human
gcccaguaguucaagguugcag

SEQ ID NO: 859307 - RNA, 22 nt, Human
ggagguggcagggaacauaauu

SEQ ID NO: 859308 - RNA, 22 nt, Human
acaacauucuuaaauacacuga

SEQ ID NO: 859309 - RNA, 22 nt, Human
caaugaaagcaacugccuauaa

SEQ ID NO: 859310 - RNA, 22 nt, Human
guucuucaggcugugcucuaga

SEQ ID NO: 859311 - RNA, 22 nt, Human
ugaaaugaaugugauucgauag

SEQ ID NO: 859312 - RNA, 22 nt, Human
uuucuucagccacuccaaacug

SEQ ID NO: 859313 - RNA, 22 nt, Human
aagauggaguaguguaaugguu

SEQ ID NO: 859314 - RNA, 22 nt, Human
gcauguguuauuuuauguauga

SEQ ID NO: 859315 - RNA, 22 nt, Human
ucagccagaggcuucuugguuu

SEQ ID NO: 859316 - RNA, 22 nt, Human
agaggggaggcgaaccagaguc

SEQ ID NO: 859317 - RNA, 22 nt, Human
cagguaaaaauaaauuugugag

SEQ ID NO: 859318 - RNA, 22 nt, Human
ucugggaagcugguccuguucu

SEQ ID NO: 859319 - RNA, 22 nt, Human
gcaggggcuaaggacacagaga

SEQ ID NO: 859320 - RNA, 22 nt, Human
aguaaacaguaucuuuaguguc

SEQ ID NO: 859321 - RNA, 22 nt, Human
uagaaauaaaucugcagcuggg

SEQ ID NO: 859322 - RNA, 23 nt, Human
cauaaaauauuaguaugguagca

SEQ ID NO: 859323 - RNA, 22 nt, Human
uaaaugaagaaauggagauugu

SEQ ID NO: 859324 - RNA, 22 nt, Human
ugaaauagucuaaaaaaccaga

SEQ ID NO: 859325 - RNA, 22 nt, Human
acuauacauaaaacauuugggu

SEQ ID NO: 859326 - RNA, 20 nt, Human
gucaggauuaguaaacucug

SEQ ID NO: 859327 - RNA, 22 nt, Human
agggcagcagcggcccaggccu

SEQ ID NO: 859328 - RNA, 22 nt, Human
guugaaagaugucuugguuccc

SEQ ID NO: 859329 - RNA, 21 nt, Human
auacauucuauuaagcauuua

SEQ ID NO: 859330 - RNA, 23 nt, Human
gaggcacucaggaaaugugagug

SEQ ID NO: 859331 - RNA, 22 nt, Human
aggacagcccuugagagcacau

SEQ ID NO: 859332 - RNA, 22 nt, Human
gggacgggcaguccaagggguc

SEQ ID NO: 859333 - RNA, 22 nt, Human
uuauuauagauuaugcaagauu

SEQ ID NO: 859334 - RNA, 22 nt, Human
uuaagcaacacacauuaauuau

SEQ ID NO: 859335 - RNA, 22 nt, Human
aggcaggcacuccggaaguguc

SEQ ID NO: 859336 - RNA, 22 nt, Human
ugaguuuuuucaacauaugaag

SEQ ID NO: 859337 - RNA, 22 nt, Human
gccaggagccagcuucuuagca

SEQ ID NO: 859338 - RNA, 22 nt, Human
aggcagauauuggggugaugug

SEQ ID NO: 859339 - RNA, 22 nt, Human
ucaggagacuuaugucacagug

SEQ ID NO: 859340 - RNA, 22 nt, Human
uuuuaagaugcuaguauuucag

SEQ ID NO: 859341 - RNA, 22 nt, Human
uuagccauauagaaaaagagcu

SEQ ID NO: 859342 - RNA, 22 nt, Human
uaaguccuaauggcagaagucu

SEQ ID NO: 859343 - RNA, 20 nt, Human
cccagugaagcauggaagag

SEQ ID NO: 859344 - RNA, 22 nt, Human
gcuauacagcaggagaauggaa

SEQ ID NO: 859345 - RNA, 17 nt, Human
aaggccauuuccaccca

SEQ ID NO: 859346 - RNA, 22 nt, Human
uggcuuaauauuucauauuuaa

SEQ ID NO: 859347 - RNA, 22 nt, Human
cccaggaccgcgcggcugagcg

SEQ ID NO: 859348 - RNA, 22 nt, Human
uaugucaaaguuaagaaauagg

SEQ ID NO: 859349 - RNA, 22 nt, Human
gagcagcuccagccgcaugacu

SEQ ID NO: 859350 - RNA, 22 nt, Human
cagcuucugcuaucgaacaucu

SEQ ID NO: 859351 - RNA, 22 nt, Human
uguccucuuccagugcuccuuc

SEQ ID NO: 859352 - RNA, 23 nt, Human
aggcccaacucugugagggcugc

SEQ ID NO: 859353 - RNA, 22 nt, Human
agaaaagaggcuuucuaagcau

SEQ ID NO: 859354 - RNA, 22 nt, Human
gcucccagacugaccagaggug

SEQ ID NO: 859355 - RNA, 22 nt, Human
ugcaacuuguuuggagagaaag

SEQ ID NO: 859356 - RNA, 20 nt, Human
cuguaucagguuacaaagua

SEQ ID NO: 859357 - RNA, 20 nt, Human
uuuuccagaaaguaucauug

SEQ ID NO: 859358 - RNA, 22 nt, Human
uuucuucucgacaccuuauccc

SEQ ID NO: 859359 - RNA, 22 nt, Human
gacggcagaaacucaugagguc

SEQ ID NO: 859360 - RNA, 22 nt, Human
uugaaauggaagugaaaauucu

SEQ ID NO: 859361 - RNA, 22 nt, Human
uaaaauguuugcaagagaccag

SEQ ID NO: 859362 - RNA, 22 nt, Human
aaugugaucgcuuuagaagcuu

SEQ ID NO: 859363 - RNA, 21 nt, Human
cauuuacaugacagauugguu

SEQ ID NO: 859364 - RNA, 22 nt, Human
ggagcggagggagggccacugu

SEQ ID NO: 859365 - RNA, 22 nt, Human
gcacaauaacagccaagguuau

SEQ ID NO: 859366 - RNA, 22 nt, Human
ugcauaguucuccuuccuccuc

SEQ ID NO: 859367 - RNA, 23 nt, Human
cuuuuaacuagaguaucagcugc

SEQ ID NO: 859368 - RNA, 22 nt, Human
ucagaaaagagaaaaucuuaua

SEQ ID NO: 859369 - RNA, 22 nt, Human
caggggaguuuuaugcaacaga

SEQ ID NO: 859370 - RNA, 21 nt, Human
uuccagagauuguuucaccug

SEQ ID NO: 859371 - RNA, 22 nt, Human
acccaggagacagguugcagug

SEQ ID NO: 859372 - RNA, 22 nt, Human
cuucagaauccagaaucagaau

SEQ ID NO: 859373 - RNA, 22 nt, Human
uucucugaguacguuucagugu

SEQ ID NO: 859374 - RNA, 21 nt, Human
uggcaggcagcuggaagcuug

SEQ ID NO: 859375 - RNA, 22 nt, Human
uggcuuuaggagcuauauaccu

SEQ ID NO: 859376 - RNA, 22 nt, Human
agaagucauuuauguuagauga

SEQ ID NO: 859377 - RNA, 22 nt, Human
uuuaggcaagggcaagauuauc

SEQ ID NO: 859378 - RNA, 22 nt, Human
auuguucaaagugcuuugcaug

SEQ ID NO: 859379 - RNA, 22 nt, Human
cuuaaagaugucaaggcuguuu

SEQ ID NO: 859380 - RNA, 22 nt, Human
gacccaggcccaaggcugccag

SEQ ID NO: 859381 - RNA, 22 nt, Human
caaauuccucagaaucagaaaa

SEQ ID NO: 859382 - RNA, 22 nt, Human
uaauuacagguccaaaacaauc

SEQ ID NO: 859383 - RNA, 22 nt, Human
uuugcagucaaauuugcuaaau

SEQ ID NO: 859384 - RNA, 22 nt, Human
cuuugaauuccaguacaauaac

SEQ ID NO: 859385 - RNA, 23 nt, Human
uugaaagguagcuggcagcuaga

SEQ ID NO: 859386 - RNA, 22 nt, Human
cccaggagguggaguucacagu

SEQ ID NO: 859387 - RNA, 22 nt, Human
ucucagucagccuugauguccc

SEQ ID NO: 859388 - RNA, 22 nt, Human
gacagugcauuuccuggcaugg

SEQ ID NO: 859389 - RNA, 22 nt, Human
aaauagauugcugaggcauuac

SEQ ID NO: 859390 - RNA, 22 nt, Human
ggcagcuuguccuggaggaugg

SEQ ID NO: 859391 - RNA, 22 nt, Human
gaaacaacuacuauugauuucu

SEQ ID NO: 859392 - RNA, 22 nt, Human
ugguuuaaccugucucuuauua

SEQ ID NO: 859393 - RNA, 22 nt, Human
auaaagauuuuuaggcauuucu

SEQ ID NO: 859394 - RNA, 22 nt, Human
uuuuaguguagucaccgugggu

SEQ ID NO: 859395 - RNA, 22 nt, Human
auuaggcacuagaaugucaauu

SEQ ID NO: 859396 - RNA, 22 nt, Human
cucuucucugcagccuuugaag

SEQ ID NO: 859397 - RNA, 22 nt, Human
uaggagggcccugaaaauggca

SEQ ID NO: 859398 - RNA, 22 nt, Human
ucccaggaucugagggcagaga

SEQ ID NO: 859399 - RNA, 22 nt, Human
aagcaauauacugauaugauua

SEQ ID NO: 859400 - RNA, 20 nt, Human
aaucagaaagugugagcucu

SEQ ID NO: 859401 - RNA, 22 nt, Human
ucuucagauggccaguuguccc

SEQ ID NO: 859402 - RNA, 22 nt, Human
aaggcaguagguguuucaaacu

SEQ ID NO: 859403 - RNA, 22 nt, Human
aggcggcuccgggagugugggc

SEQ ID NO: 859404 - RNA, 22 nt, Human
gccaucacauccaggcuaccuc

SEQ ID NO: 859405 - RNA, 22 nt, Human
aaagccauuacaaaauuucaua

SEQ ID NO: 859406 - RNA, 23 nt, Human
uucuucucaauuaguugauucag

SEQ ID NO: 859407 - RNA, 22 nt, Human
uaggagaggugaauggcacacu

SEQ ID NO: 859408 - RNA, 22 nt, Human
uuugaaagaaaccagugaguga

SEQ ID NO: 859409 - RNA, 22 nt, Human
ucagagaguuacacaaauuguu

SEQ ID NO: 859410 - RNA, 19 nt, Human
gaggagcuaucggagacag

SEQ ID NO: 859411 - RNA, 22 nt, Human
cguccuuacagagggucacagc

SEQ ID NO: 859412 - RNA, 22 nt, Human
agacgagggcccccaggacagc

SEQ ID NO: 859413 - RNA, 22 nt, Human
uccaggagaggccugaccaggu

SEQ ID NO: 859414 - RNA, 22 nt, Human
ccagauaaggcuuuuuaaaagc

SEQ ID NO: 859415 - RNA, 22 nt, Human
uuuccaaaaguuuguucugugc

SEQ ID NO: 859416 - RNA, 22 nt, Human
cuccuuagugccucugcacgag

SEQ ID NO: 859417 - RNA, 22 nt, Human
uuacaguuuaguccaagccaga

SEQ ID NO: 859418 - RNA, 22 nt, Human
uucuagaugauaaaccagcagc

SEQ ID NO: 859419 - RNA, 22 nt, Human
aaauuaguacauugcaaagucc

SEQ ID NO: 859420 - RNA, 22 nt, Human
aagacugucuuuucugagugac

SEQ ID NO: 859421 - RNA, 22 nt, Human
auuggcaggaaccgaggagggg

SEQ ID NO: 859422 - RNA, 22 nt, Human
ccaugagcuucaacugacacag

SEQ ID NO: 859423 - RNA, 22 nt, Human
gaggaggccaguggaaggaagc

SEQ ID NO: 859424 - RNA, 22 nt, Human
aguccuuagaacagugccuggg

SEQ ID NO: 859425 - RNA, 22 nt, Human
uguccuuagaagaagugaaaga

SEQ ID NO: 859426 - RNA, 22 nt, Human
acaacuuuaauggguuucagcu

SEQ ID NO: 859427 - RNA, 22 nt, Human
aaagcagagcagggcacuuaug

SEQ ID NO: 859428 - RNA, 22 nt, Human
gaagaauccaugcuaauuuacc

SEQ ID NO: 859429 - RNA, 22 nt, Human
uaagacuucauuaguaauaugg

SEQ ID NO: 859430 - RNA, 22 nt, Human
gcuucacacuaaaaauguuaaa

SEQ ID NO: 859431 - RNA, 22 nt, Human
uaucuguuaugggcugaauugc

SEQ ID NO: 859432 - RNA, 22 nt, Human
aguggcaggcggagauguagga

SEQ ID NO: 859433 - RNA, 19 nt, Human
acuggcaguuucugcaugg

SEQ ID NO: 859434 - RNA, 22 nt, Human
uagcccagaagagggaagcaac

SEQ ID NO: 859435 - RNA, 22 nt, Human
gcugccagccaacuugcugugc

SEQ ID NO: 859436 - RNA, 22 nt, Human
agaggggaguccuaaucugauu

SEQ ID NO: 859437 - RNA, 22 nt, Human
uuaaagggccgauuuccaggcc

SEQ ID NO: 859438 - RNA, 22 nt, Human
acccaggagguggaggcugcag

SEQ ID NO: 859439 - RNA, 21 nt, Human
gagugcagcaagguagagucu

SEQ ID NO: 859440 - RNA, 22 nt, Human
agcugcuacugcucugccagag

SEQ ID NO: 859441 - RNA, 23 nt, Human
cugcuguguuggucucgauggga

SEQ ID NO: 859442 - RNA, 22 nt, Human
ucugguaaccuuuaucccuccu

SEQ ID NO: 859443 - RNA, 22 nt, Human
acaaauaugguacucggagaaa

SEQ ID NO: 859444 - RNA, 22 nt, Human
guaggcagucucucaggugauc

SEQ ID NO: 859445 - RNA, 22 nt, Human
aggauuuacaaugauucuaggu

SEQ ID NO: 859446 - RNA, 20 nt, Human
gaaguccuguuauauccuuu

SEQ ID NO: 859447 - RNA, 22 nt, Human
cuuuacauccuguuucccguuu

SEQ ID NO: 859448 - RNA, 22 nt, Human
gugauuuaguguuaaguauguu

SEQ ID NO: 859449 - RNA, 22 nt, Human
cuguggaaauaaacaaugcuaa

SEQ ID NO: 859450 - RNA, 22 nt, Human
uagaaacagauguuuuugaaga

SEQ ID NO: 859451 - RNA, 22 nt, Human
acacuaaugagaaaggaauuaa

SEQ ID NO: 859452 - RNA, 22 nt, Human
agcuagccuaggcagagugcau

SEQ ID NO: 859453 - RNA, 22 nt, Human
agucucugcugguugugccuau

SEQ ID NO: 859454 - RNA, 22 nt, Human
ugaaugaauccuaacaaagaca

SEQ ID NO: 859455 - RNA, 23 nt, Human
uauuacaauuggucuuauuaaga

SEQ ID NO: 859456 - RNA, 22 nt, Human
uugcaaaggggaauaaagcaau

SEQ ID NO: 859457 - RNA, 22 nt, Human
uuccaaaccucaaauaauuaau

SEQ ID NO: 859458 - RNA, 22 nt, Human
ccaggcugugguuuagauagag

SEQ ID NO: 859459 - RNA, 22 nt, Human
uagaauucaagauucaacaggc

SEQ ID NO: 859460 - RNA, 22 nt, Human
gcuuuggaugugugccugaggu

SEQ ID NO: 859461 - RNA, 22 nt, Human
ugaggcagaaaauagcaguuca

SEQ ID NO: 859462 - RNA, 22 nt, Human
uaucagaacacagccacagcca

SEQ ID NO: 859463 - RNA, 22 nt, Human
cuacuucuaaguacauggugau

SEQ ID NO: 859464 - RNA, 22 nt, Human
caagaugggcaccccagcaccu

SEQ ID NO: 859465 - RNA, 22 nt, Human
gcccaggaguugguggcugcag

SEQ ID NO: 859466 - RNA, 22 nt, Human
uuuguaaaggccugaauuucag

SEQ ID NO: 859467 - RNA, 22 nt, Human
aagagggcugcaaucuuauugc

SEQ ID NO: 859468 - RNA, 22 nt, Human
auugugcaaauauuaucuguag

SEQ ID NO: 859469 - RNA, 22 nt, Human
uccaggagacacaagguacaua

SEQ ID NO: 859470 - RNA, 22 nt, Human
ccuccucugggaagauucagag

SEQ ID NO: 859471 - RNA, 22 nt, Human
ugaaugaaugaauuaauagagu

SEQ ID NO: 859472 - RNA, 22 nt, Human
uugauccaguugaaagugauga

SEQ ID NO: 859473 - RNA, 22 nt, Human
cgaggcagggaagcugcaaaag

SEQ ID NO: 859474 - RNA, 22 nt, Human
ccugucacgaugacugcacucu

SEQ ID NO: 859475 - RNA, 22 nt, Human
cagucaccaccagguggcagua

SEQ ID NO: 859476 - RNA, 22 nt, Human
gcuucccacagcuggacugggg

SEQ ID NO: 859477 - RNA, 22 nt, Human
uuuguuuagaaagagauuggug

SEQ ID NO: 859478 - RNA, 22 nt, Human
uccauacauugaaauaccauuc

SEQ ID NO: 859479 - RNA, 22 nt, Human
auccauuugaaagaacagucca

SEQ ID NO: 859480 - RNA, 19 nt, Human
augucuggguaacagcugc

SEQ ID NO: 859481 - RNA, 22 nt, Human
agacgagggccuggcacacagu

SEQ ID NO: 859482 - RNA, 23 nt, Human
cccuggaguaaauucuuggaagg

SEQ ID NO: 859483 - RNA, 22 nt, Human
guggcagcggugugcaaggagg

SEQ ID NO: 859484 - RNA, 22 nt, Human
cuuccaaagcacuuuauggacc

SEQ ID NO: 859485 - RNA, 22 nt, Human
uuagaaauauggugcugccgcc

SEQ ID NO: 859486 - RNA, 19 nt, Human
accaggagacagugagcuu

SEQ ID NO: 859487 - RNA, 22 nt, Human
uguacauacauagauauacaca

SEQ ID NO: 859488 - RNA, 22 nt, Human
aaacuuugguauguagcaaaac

SEQ ID NO: 859489 - RNA, 22 nt, Human
uucagggagagcgggacgggug

SEQ ID NO: 859490 - RNA, 22 nt, Human
uuaagauagaacccaguagucu

SEQ ID NO: 859491 - RNA, 22 nt, Human
cagaggcacaagaaagcaaggc

SEQ ID NO: 859492 - RNA, 22 nt, Human
uucaucaauguguuuaauaaug

SEQ ID NO: 859493 - RNA, 22 nt, Human
aggcagccaaucagaggcugac

SEQ ID NO: 859494 - RNA, 22 nt, Human
aaaaacuguaauuacuuuugca

SEQ ID NO: 859495 - RNA, 22 nt, Human
acauguaaaaggaacaugcaug

SEQ ID NO: 859496 - RNA, 22 nt, Human
acuauacagaagaggauaggaa

SEQ ID NO: 859497 - RNA, 22 nt, Human
ugaagaauaaaugguugagacu

SEQ ID NO: 859498 - RNA, 22 nt, Human
gagagaggccuccauguacuga

SEQ ID NO: 859499 - RNA, 22 nt, Human
caucaucaaaacaaauggaguc

SEQ ID NO: 859500 - RNA, 22 nt, Human
gcagcugcuggagggaggcagg

SEQ ID NO: 859501 - RNA, 20 nt, Human
aauaaacuacugagagaugu

SEQ ID NO: 859502 - RNA, 18 nt, Human
uaggagagaauuuauuua

SEQ ID NO: 859503 - RNA, 22 nt, Human
uccugagagcagcugcuuugga

SEQ ID NO: 859504 - RNA, 22 nt, Human
cugcugugcaggugccuaugau

SEQ ID NO: 859505 - RNA, 22 nt, Human
gaauuuuucuggaagcaauuau

SEQ ID NO: 859506 - RNA, 22 nt, Human
aaacugcuuuccacaguggcua

SEQ ID NO: 859507 - RNA, 22 nt, Human
cagaaaucauugugaugacagg

SEQ ID NO: 859508 - RNA, 18 nt, Human
aaguccuuccuuugcuuu

SEQ ID NO: 859509 - RNA, 22 nt, Human
uuacuuuggguccugcuuauaa

SEQ ID NO: 859510 - RNA, 22 nt, Human
ucauucuuuaccaaguugucac

SEQ ID NO: 859511 - RNA, 22 nt, Human
acuggauuccauugugcaaaga

SEQ ID NO: 859512 - RNA, 22 nt, Human
caagaaucuugcagcuuagacu

SEQ ID NO: 859513 - RNA, 22 nt, Human
aaauauagcaauuaugccuacu

SEQ ID NO: 859514 - RNA, 22 nt, Human
aggagggacaccaauauauguu

SEQ ID NO: 859515 - RNA, 22 nt, Human
uauuuuaaagacugccagccua

SEQ ID NO: 859516 - RNA, 17 nt, Human
gccaggagguuugagcu

SEQ ID NO: 859517 - RNA, 22 nt, Human
uuuaacuuaaucugcuugauga

SEQ ID NO: 859518 - RNA, 22 nt, Human
gaguccuuccagcaggcauuua

SEQ ID NO: 859519 - RNA, 22 nt, Human
agugauggugagugagaagcuc

SEQ ID NO: 859520 - RNA, 22 nt, Human
auucuuauuauaguaaaacagu

SEQ ID NO: 859521 - RNA, 17 nt, Human
ggcagccucaggcguuu

SEQ ID NO: 859522 - RNA, 22 nt, Human
cuucugcaauaaguuuuggucc

SEQ ID NO: 859523 - RNA, 22 nt, Human
acuuugaaagccuuggccccgg

SEQ ID NO: 859524 - RNA, 22 nt, Human
cuauuacauuucuggacauuca

SEQ ID NO: 859525 - RNA, 22 nt, Human
uggcagcuguguccagguagaa

SEQ ID NO: 859526 - RNA, 22 nt, Human
auuucaaggcuauuaauauaaa

SEQ ID NO: 859527 - RNA, 22 nt, Human
ugugaaagcaagucuaguucuc

SEQ ID NO: 859528 - RNA, 22 nt, Human
ugccgcagugcggggagggccc

SEQ ID NO: 859529 - RNA, 22 nt, Human
uguccuuauaagaaaaggaaau

SEQ ID NO: 859530 - RNA, 22 nt, Human
ggagaagggacagacucagcuu

SEQ ID NO: 859531 - RNA, 22 nt, Human
cccaggaguucgaggcuguagu

SEQ ID NO: 859532 - RNA, 22 nt, Human
uuuggaauauuaaaaugucuca

SEQ ID NO: 859533 - RNA, 22 nt, Human
uagggaggaggguuuucaaauc

SEQ ID NO: 859534 - RNA, 22 nt, Human
uaaggccagcaugaaugcagca

SEQ ID NO: 859535 - RNA, 22 nt, Human
gaggccagaguuccccgaguca

SEQ ID NO: 859536 - RNA, 22 nt, Human
ggcagcuauuccaagcagcacu

SEQ ID NO: 859537 - RNA, 22 nt, Human
agggagcucacaguccaguaga

SEQ ID NO: 859538 - RNA, 22 nt, Human
acuuugaaacuaaaauucauua

SEQ ID NO: 859539 - RNA, 22 nt, Human
caauuucacugacacccuggaa

SEQ ID NO: 859540 - RNA, 22 nt, Human
cucacugugaccucagcagaca

SEQ ID NO: 859541 - RNA, 23 nt, Human
aggcagcagguuguccaggguga

SEQ ID NO: 859542 - RNA, 22 nt, Human
gcaggagagccagcaggcuucc

SEQ ID NO: 859543 - RNA, 22 nt, Human
agucacuguucugucaugucaa

SEQ ID NO: 859544 - RNA, 22 nt, Human
cucaugauguagcgaaugagaa

SEQ ID NO: 859545 - RNA, 22 nt, Human
uauguuauuuucauacaacaga

SEQ ID NO: 859546 - RNA, 22 nt, Human
uacaucauaauaauacuuagaa

SEQ ID NO: 859547 - RNA, 22 nt, Human
ggcagcaucucuggcagcagcu

SEQ ID NO: 859548 - RNA, 22 nt, Human
aggagaggaaucauuauuacaa

SEQ ID NO: 859549 - RNA, 22 nt, Human
gauuuagagcaggaaugcaugg

SEQ ID NO: 859550 - RNA, 22 nt, Human
ugaaaugaagggcuuguucugg

SEQ ID NO: 859551 - RNA, 22 nt, Human
gcccaggaguugaaugcagcag

SEQ ID NO: 859552 - RNA, 22 nt, Human
acagaauuaucaggaaauguua

SEQ ID NO: 859553 - RNA, 22 nt, Human
cugcagagcaaguaacauccuc

SEQ ID NO: 859554 - RNA, 22 nt, Human
augaaaauacugugguugauag

SEQ ID NO: 859555 - RNA, 22 nt, Human
ucuuuccauggccacacagucu

SEQ ID NO: 859556 - RNA, 22 nt, Human
uuugaaaguucuucugacacua

SEQ ID NO: 859557 - RNA, 22 nt, Human
ugcuucuggaaacaguggcugu

SEQ ID NO: 859558 - RNA, 22 nt, Human
uaucaucuuguugucaugcagc

SEQ ID NO: 859559 - RNA, 22 nt, Human
caggguggggaaauagcgcccu

SEQ ID NO: 859560 - RNA, 22 nt, Human
ggaggagggguuuacauuggaa

SEQ ID NO: 859561 - RNA, 22 nt, Human
aaggagaaaugguagaugugca

SEQ ID NO: 859562 - RNA, 22 nt, Human
uuuuauguuccucuuuaugcga

SEQ ID NO: 859563 - RNA, 22 nt, Human
ugauuuuuagcuauucugaaga

SEQ ID NO: 859564 - RNA, 22 nt, Human
auggcauuugaaucugucuuuu

SEQ ID NO: 859565 - RNA, 22 nt, Human
uguacaauguggccaguguuaa

SEQ ID NO: 859566 - RNA, 22 nt, Human
caggcagcauuuacucugauga

SEQ ID NO: 859567 - RNA, 22 nt, Human
gucaggauguuuauucuccagu

SEQ ID NO: 859568 - RNA, 22 nt, Human
acaugcuucauauuauaaccaa

SEQ ID NO: 859569 - RNA, 22 nt, Human
cuuaggcaaccaggucaaugcu

SEQ ID NO: 859570 - RNA, 22 nt, Human
gugcuuuuaaaggcaauuagua

SEQ ID NO: 859571 - RNA, 22 nt, Human
cgaggcaggcaggcggaggaua

SEQ ID NO: 859572 - RNA, 22 nt, Human
ggcagcuggguuggccagaaac

SEQ ID NO: 859573 - RNA, 22 nt, Human
uuauuaaugaguacaaguuauu

SEQ ID NO: 859574 - RNA, 22 nt, Human
agguccagcuguugcagccucc

SEQ ID NO: 859575 - RNA, 22 nt, Human
uguggaaaagaauaagggagau

SEQ ID NO: 859576 - RNA, 22 nt, Human
cugggaaauggcuucgagcuca

SEQ ID NO: 859577 - RNA, 22 nt, Human
acuaaacugaagcaugaaaagg

SEQ ID NO: 859578 - RNA, 22 nt, Human
aaucauaauuguauacauucau

SEQ ID NO: 859579 - RNA, 22 nt, Human
gaaaggccagcucacagaugag

SEQ ID NO: 859580 - RNA, 22 nt, Human
ugaaaauggccugaagaagcaa

SEQ ID NO: 859581 - RNA, 20 nt, Human
aggagggaccuggauuggcg

SEQ ID NO: 859582 - RNA, 22 nt, Human
caggagaggaggcuacuucuua

SEQ ID NO: 859583 - RNA, 22 nt, Human
ggcagcugcaaaucugcucugu

SEQ ID NO: 859584 - RNA, 22 nt, Human
cauuucaagcauugacuucuau

SEQ ID NO: 859585 - RNA, 22 nt, Human
uucacagauuucccugcacaug

SEQ ID NO: 859586 - RNA, 22 nt, Human
ccucuucugcuucaggagcacu

SEQ ID NO: 859587 - RNA, 22 nt, Human
aauaauuuccagccaacuggaa

SEQ ID NO: 859588 - RNA, 22 nt, Human
cuuugcaaacugucacacuuuc

SEQ ID NO: 859589 - RNA, 22 nt, Human
caggcagcagccacucugguau

SEQ ID NO: 859590 - RNA, 21 nt, Human
uccaggagcacgggacuagga

SEQ ID NO: 859591 - RNA, 22 nt, Human
ucucucuuuuuaaucauguaau

SEQ ID NO: 859592 - RNA, 22 nt, Human
ggcaagaaggcuucagguagcu

SEQ ID NO: 859593 - RNA, 22 nt, Human
uuagccauuaaauuacaaggug

SEQ ID NO: 859594 - RNA, 21 nt, Human
auggauuuaaacaggccacaa

SEQ ID NO: 859595 - RNA, 22 nt, Human
agcccaggaaguugaggcuugc

SEQ ID NO: 859596 - RNA, 22 nt, Human
uagucaccuguugugugaugcc

SEQ ID NO: 859597 - RNA, 22 nt, Human
gggcacagaagucuaagacauc

SEQ ID NO: 859598 - RNA, 22 nt, Human
caggauggccccggggcugugc

SEQ ID NO: 859599 - RNA, 22 nt, Human
auacagaauacuaauuccugag

SEQ ID NO: 859600 - RNA, 20 nt, Human
auaaaauaacugccacaaga

SEQ ID NO: 859601 - RNA, 22 nt, Human
uaugcuguggaaaauacaaaga

SEQ ID NO: 859602 - RNA, 22 nt, Human
ggagcuguucaggacugcuuca

SEQ ID NO: 859603 - RNA, 22 nt, Human
acaugucuuuuaaagucuaaua

SEQ ID NO: 859604 - RNA, 23 nt, Human
accaggagaaaagcuuugcggga

SEQ ID NO: 859605 - RNA, 22 nt, Human
aggcacaguuucauccccgggc

SEQ ID NO: 859606 - RNA, 22 nt, Human
gggcaguuuauucuagaugguu

SEQ ID NO: 859607 - RNA, 20 nt, Human
cuucuucauuaacccuacug

SEQ ID NO: 859608 - RNA, 22 nt, Human
uuacagaaugugccauuugguc

SEQ ID NO: 859609 - RNA, 22 nt, Human
uaaggccaauuaacaaccaggg

SEQ ID NO: 859610 - RNA, 22 nt, Human
aaagacuuggcuuaugauuugc

SEQ ID NO: 859611 - RNA, 22 nt, Human
aggauuuagcaugaaaugugaa

SEQ ID NO: 859612 - RNA, 22 nt, Human
aggaucugugagugcugcagac

SEQ ID NO: 859613 - RNA, 22 nt, Human
aacaugcuuugauaaauaaaag

SEQ ID NO: 859614 - RNA, 22 nt, Human
aggcugcugccuuggagagugu

SEQ ID NO: 859615 - RNA, 22 nt, Human
uucuucaaugugcccuguuuuc

SEQ ID NO: 859616 - RNA, 22 nt, Human
gagggcaguagccucguacccu

SEQ ID NO: 859617 - RNA, 22 nt, Human
cagcugccccgcuggcugacca

SEQ ID NO: 859618 - RNA, 22 nt, Human
cucuucuuuaguccagaccauc

SEQ ID NO: 859619 - RNA, 22 nt, Human
cccaggagaugcacuccauugg

SEQ ID NO: 859620 - RNA, 22 nt, Human
ugcuguguucuccugacucacc

SEQ ID NO: 859621 - RNA, 22 nt, Human
ugcccaggaucuggcgaugcuc

SEQ ID NO: 859622 - RNA, 22 nt, Human
agaucaguuagauagcuugaug

SEQ ID NO: 859623 - RNA, 22 nt, Human
auggcagccugagcagaggaau

SEQ ID NO: 859624 - RNA, 22 nt, Human
agcugcccugguaagauugaug

SEQ ID NO: 859625 - RNA, 22 nt, Human
agagugcaaccgaaacaagcag

SEQ ID NO: 859626 - RNA, 22 nt, Human
caaauaguuuuucauguauuau

SEQ ID NO: 859627 - RNA, 22 nt, Human
uucucuuagcuguaaagucaau

SEQ ID NO: 859628 - RNA, 22 nt, Human
cucacugucuguacuagcugau

SEQ ID NO: 859629 - RNA, 22 nt, Human
gacauaauccuccucaccuacu

SEQ ID NO: 859630 - RNA, 22 nt, Human
cagaguggcacucugcuggaug

SEQ ID NO: 859631 - RNA, 22 nt, Human
gaggcugccccuuccucagcug

SEQ ID NO: 859632 - RNA, 22 nt, Human
ucugaagaacugaguaaacaug

SEQ ID NO: 859633 - RNA, 22 nt, Human
aauugcuaaagauuauguuuuc

SEQ ID NO: 859634 - RNA, 22 nt, Human
guaucacuuuugagagugagaa

SEQ ID NO: 859635 - RNA, 22 nt, Human
gucaacuuuaagaugaucuuuu

SEQ ID NO: 859636 - RNA, 22 nt, Human
aaucagaaaggcuaaggaagca

SEQ ID NO: 859637 - RNA, 22 nt, Human
uguacauagaucuugaaaauua

SEQ ID NO: 859638 - RNA, 22 nt, Human
agggagcugagcugugagcagc

SEQ ID NO: 859639 - RNA, 22 nt, Human
acauaauaggugccugaauauu

SEQ ID NO: 859640 - RNA, 22 nt, Human
aaucaaaaccuacagagguaau

SEQ ID NO: 859641 - RNA, 20 nt, Human
uucaggauucuagaccacac

SEQ ID NO: 859642 - RNA, 22 nt, Human
uggagaggagcaccauggccau

SEQ ID NO: 859643 - RNA, 22 nt, Human
ucagccaggccaccuucagcuu

SEQ ID NO: 859644 - RNA, 22 nt, Human
aaauugcagaugcuaaaugacu

SEQ ID NO: 859645 - RNA, 22 nt, Human
uacuaucucuucuaacuucaga

SEQ ID NO: 859646 - RNA, 22 nt, Human
gucaggauuaaugggaguaugc

SEQ ID NO: 859647 - RNA, 22 nt, Human
cccuggagguggagguugcagg

SEQ ID NO: 859648 - RNA, 22 nt, Human
cagcuggcuggucagugcacaa

SEQ ID NO: 859649 - RNA, 22 nt, Human
gcccaggaguugaagggcugac

SEQ ID NO: 859650 - RNA, 22 nt, Human
agucucugggcaugguugugac

SEQ ID NO: 859651 - RNA, 22 nt, Human
uaaaauugcggugaauauuucc

SEQ ID NO: 859652 - RNA, 22 nt, Human
gaggcagccucaguggaccucg

SEQ ID NO: 859653 - RNA, 22 nt, Human
uguaggccuauguccagcaauu

SEQ ID NO: 859654 - RNA, 22 nt, Human
uccauuuucaucucauguauaa

SEQ ID NO: 859655 - RNA, 22 nt, Human
uuaaggauguugugauuuauua

SEQ ID NO: 859656 - RNA, 22 nt, Human
aggagggaccuaggaauauugc

SEQ ID NO: 859657 - RNA, 22 nt, Human
agugcuuucuugcuccaucagu

SEQ ID NO: 859658 - RNA, 22 nt, Human
gguuugaacagcuuuggagaag

SEQ ID NO: 859659 - RNA, 22 nt, Human
ucagauggcacacagagccugc

SEQ ID NO: 859660 - RNA, 22 nt, Human
uuuccauauuuaaucaaaauaa

SEQ ID NO: 859661 - RNA, 22 nt, Human
uggcagcugccauguccacgug

SEQ ID NO: 859662 - RNA, 22 nt, Human
ugagacaaaauugacagacaaa

SEQ ID NO: 859663 - RNA, 19 nt, Human
ugcccaggccagguugggc

SEQ ID NO: 859664 - RNA, 22 nt, Human
aauaagauccugaagauauguu

SEQ ID NO: 859665 - RNA, 22 nt, Human
aauauaauuuuauuccuagagu

SEQ ID NO: 859666 - RNA, 22 nt, Human
auaaauaucacuguugucccuc

SEQ ID NO: 859667 - RNA, 20 nt, Human
guggcaggcagugaaggagc

SEQ ID NO: 859668 - RNA, 22 nt, Human
acauugcugcauucuccuuccc

SEQ ID NO: 859669 - RNA, 22 nt, Human
cuuuccaaugcauuuccaaugu

SEQ ID NO: 859670 - RNA, 22 nt, Human
cuucuucauguauugauagucu

SEQ ID NO: 859671 - RNA, 22 nt, Human
acacauuuacauguuuacguau

SEQ ID NO: 859672 - RNA, 22 nt, Human
auuuggcaacauuaauugaauc

SEQ ID NO: 859673 - RNA, 22 nt, Human
uaguccuuacuuacuagaauaa

SEQ ID NO: 859674 - RNA, 22 nt, Human
uucugggagagaaagggccuug

SEQ ID NO: 859675 - RNA, 22 nt, Human
cagaagaggacuggguagcuca

SEQ ID NO: 859676 - RNA, 22 nt, Human
aggcugcuucaauggauaagau

SEQ ID NO: 859677 - RNA, 22 nt, Human
agucucuuuaaucacagugucu

SEQ ID NO: 859678 - RNA, 22 nt, Human
agaggggaaguaaugaaugaua

SEQ ID NO: 859679 - RNA, 22 nt, Human
gcuccuucaggugguagcuguu

SEQ ID NO: 859680 - RNA, 22 nt, Human
aggcagcugcccucuccuuccu

SEQ ID NO: 859681 - RNA, 19 nt, Human
uucuccaggcugcagaggg

SEQ ID NO: 859682 - RNA, 22 nt, Human
ccagaucuucuuuucagugucu

SEQ ID NO: 859683 - RNA, 22 nt, Human
aagcuggaacaucuugaggaag

SEQ ID NO: 859684 - RNA, 22 nt, Human
acucuucuugcugcucauuaau

SEQ ID NO: 859685 - RNA, 22 nt, Human
cuuaacauccugcauuuuucuu

SEQ ID NO: 859686 - RNA, 22 nt, Human
agggaggucuuugaggggcuua

SEQ ID NO: 859687 - RNA, 22 nt, Human
gaaccucagugaaacuggaggu

SEQ ID NO: 859688 - RNA, 22 nt, Human
uuuccaaaaugaaucuaaugca

SEQ ID NO: 859689 - RNA, 22 nt, Human
cacauauuguaguucaccagga

SEQ ID NO: 859690 - RNA, 22 nt, Human
aaggagaguacaggaguuggua

SEQ ID NO: 859691 - RNA, 22 nt, Human
gcccaggagguugggcugugca

SEQ ID NO: 859692 - RNA, 22 nt, Human
guuaggcagugugguauagcag

SEQ ID NO: 859693 - RNA, 22 nt, Human
aguaccaugcuuccugacuggu

SEQ ID NO: 859694 - RNA, 22 nt, Human
caucagaaccagcugggugagg

SEQ ID NO: 859695 - RNA, 17 nt, Human
uuugaaaggaugucagu

SEQ ID NO: 859696 - RNA, 22 nt, Human
ucuuugaacuuggcugaucucu

SEQ ID NO: 859697 - RNA, 22 nt, Human
ccucaggggucacugugaggag

SEQ ID NO: 859698 - RNA, 22 nt, Human
augcuuuaaaugucuuuugcuu

SEQ ID NO: 859699 - RNA, 22 nt, Human
agggagugguuaagaaggugca

SEQ ID NO: 859700 - RNA, 22 nt, Human
cacaaugugguuugucaucuuu

SEQ ID NO: 859701 - RNA, 20 nt, Human
aaacauucauguacaaguga

SEQ ID NO: 859702 - RNA, 22 nt, Human
acagcagcuugcgugucugguc

SEQ ID NO: 859703 - RNA, 22 nt, Human
ugccuguguugauuacuuuguc

SEQ ID NO: 859704 - RNA, 22 nt, Human
cagggagggacaauugucaccu

SEQ ID NO: 859705 - RNA, 22 nt, Human
aucauucuaguccuuauggucu

SEQ ID NO: 859706 - RNA, 22 nt, Human
agaccuggauuccaauccuacc

SEQ ID NO: 859707 - RNA, 22 nt, Human
uagugcuuaauaaauuucagaa

SEQ ID NO: 859708 - RNA, 22 nt, Human
uuuccaaauaaggucacacuca

SEQ ID NO: 859709 - RNA, 22 nt, Human
uucaacuuuaugcauauguauu

SEQ ID NO: 859710 - RNA, 22 nt, Human
agucucugcaugccugcugugc

SEQ ID NO: 859711 - RNA, 22 nt, Human
aggccagcucuacccuuggacu

SEQ ID NO: 859712 - RNA, 22 nt, Human
agugcuuuagagaaauggugcu

SEQ ID NO: 859713 - RNA, 19 nt, Human
uuccuuagaggaggcggug

SEQ ID NO: 859714 - RNA, 22 nt, Human
caggcagcugaggacuuugcua

SEQ ID NO: 859715 - RNA, 22 nt, Human
cugcuguggugucaagcaucuc

SEQ ID NO: 859716 - RNA, 19 nt, Human
uaaggccaaaaguaagugu

SEQ ID NO: 859717 - RNA, 22 nt, Human
cucaggauauugggcuggagca

SEQ ID NO: 859718 - RNA, 23 nt, Human
ucuaauacaugaaaccuagaugu

SEQ ID NO: 859719 - RNA, 22 nt, Human
uugauacuauuaagcacugggc

SEQ ID NO: 859720 - RNA, 22 nt, Human
gaauauauuggugaaaauaguu

SEQ ID NO: 859721 - RNA, 22 nt, Human
ugcagucuccaccuccugggug

SEQ ID NO: 859722 - RNA, 22 nt, Human
ggucagagggugggcugccugu

SEQ ID NO: 859723 - RNA, 23 nt, Human
uuaagacuggcugaacuuaguag

SEQ ID NO: 859724 - RNA, 21 nt, Human
uaaauaauaaguugcugagau

SEQ ID NO: 859725 - RNA, 22 nt, Human
uucagaauauuuguuuuacaug

SEQ ID NO: 859726 - RNA, 22 nt, Human
uacaaaaaauugauacugacga

SEQ ID NO: 859727 - RNA, 22 nt, Human
uuucagaaccgcuaaaauaaau

SEQ ID NO: 859728 - RNA, 22 nt, Human
aggauuuaaauccuuaaccacu

SEQ ID NO: 859729 - RNA, 22 nt, Human
uaauaucuacuucauagaguuu

SEQ ID NO: 859730 - RNA, 22 nt, Human
uuaauucugccuuucauguaac

SEQ ID NO: 859731 - RNA, 18 nt, Human
gcagcugacacuggaguu

SEQ ID NO: 859732 - RNA, 22 nt, Human
ucagaaauacaaaacacuuacu

SEQ ID NO: 859733 - RNA, 22 nt, Human
uccaggaggacugagggggcug

SEQ ID NO: 859734 - RNA, 21 nt, Human
agaauucuuaaguauucuaau

SEQ ID NO: 859735 - RNA, 22 nt, Human
agaggggacagccaccugcccg

SEQ ID NO: 859736 - RNA, 19 nt, Human
ugugaaagcuaguguucuu

SEQ ID NO: 859737 - RNA, 22 nt, Human
uuagagucaagcugcauguucu

SEQ ID NO: 859738 - RNA, 22 nt, Human
ugaggcagcccacuuuccuuag

SEQ ID NO: 859739 - RNA, 22 nt, Human
uuucaaauagaaucuuuccaaa

SEQ ID NO: 859740 - RNA, 22 nt, Human
aaaucagucccucuuggaauuu

SEQ ID NO: 859741 - RNA, 22 nt, Human
cuguucucuggcgguggcuguu

SEQ ID NO: 859742 - RNA, 22 nt, Human
auacagaaaaugaugcagaguu

SEQ ID NO: 859743 - RNA, 22 nt, Human
ggcaagcucaggccucaggugu

SEQ ID NO: 859744 - RNA, 19 nt, Human
cccaggagcaguauugaug

SEQ ID NO: 859745 - RNA, 22 nt, Human
uaucuaaaggauuuaauuuagu

SEQ ID NO: 859746 - RNA, 22 nt, Human
cagaauaaagguacaauugagu

SEQ ID NO: 859747 - RNA, 22 nt, Human
uaggcagcagugcuaugauucu

SEQ ID NO: 859748 - RNA, 22 nt, Human
cugcccaggaaggagaggaugg

SEQ ID NO: 859749 - RNA, 22 nt, Human
cccuugcaucccauguguggcc

SEQ ID NO: 859750 - RNA, 22 nt, Human
uauuucagguauggugugaaau

SEQ ID NO: 859751 - RNA, 22 nt, Human
uucuucaaccaucuacauaaac

SEQ ID NO: 859752 - RNA, 22 nt, Human
ggauuugaauuguugaaaugau

SEQ ID NO: 859753 - RNA, 22 nt, Human
uagggauguccugagacuuggc

SEQ ID NO: 859754 - RNA, 18 nt, Human
auauguuaauuagguagg

SEQ ID NO: 859755 - RNA, 22 nt, Human
auguuauuaaaguacagauucu

SEQ ID NO: 859756 - RNA, 22 nt, Human
cucaacagcucugccauacucc

SEQ ID NO: 859757 - RNA, 22 nt, Human
guucuucaucauuuuagauagg

SEQ ID NO: 859758 - RNA, 22 nt, Human
ugcacauucacuuagguauugu

SEQ ID NO: 859759 - RNA, 22 nt, Human
auagaauagcauagaaaauuga

SEQ ID NO: 859760 - RNA, 22 nt, Human
acuauacaccaaaauauuaagg

SEQ ID NO: 859761 - RNA, 22 nt, Human
ucaacuuuaguguagcuauuua

SEQ ID NO: 859762 - RNA, 20 nt, Human
acaggggcagcacaauaaug

SEQ ID NO: 859763 - RNA, 22 nt, Human
cccaggaacagggcucagaccc

SEQ ID NO: 859764 - RNA, 22 nt, Human
uuuaggcaauagauggcagugu

SEQ ID NO: 859765 - RNA, 22 nt, Human
uuaaaauuauggcccauuugga

SEQ ID NO: 859766 - RNA, 22 nt, Human
aagggaggaggauuuauuguac

SEQ ID NO: 859767 - RNA, 22 nt, Human
gcucagagcuugaaguuccacu

SEQ ID NO: 859768 - RNA, 22 nt, Human
aguaaacacugucuuuauauau

SEQ ID NO: 859769 - RNA, 22 nt, Human
uaugauuuguagacauuugauu

SEQ ID NO: 859770 - RNA, 22 nt, Human
caggacagcucaacaccuccuc

SEQ ID NO: 859771 - RNA, 22 nt, Human
agucugucugucacuucugcag

SEQ ID NO: 859772 - RNA, 22 nt, Human
agcaccauugcaaauauggcag

SEQ ID NO: 859773 - RNA, 22 nt, Human
acaauauuguacccagaaguuu

SEQ ID NO: 859774 - RNA, 22 nt, Human
uaugaacuuuugaugugacaug

SEQ ID NO: 859775 - RNA, 22 nt, Human
aaugaacagauacacauaggca

SEQ ID NO: 859776 - RNA, 22 nt, Human
gugcauuugugcaugcacaugu

SEQ ID NO: 859777 - RNA, 22 nt, Human
acagccaggaggaacucaguga

SEQ ID NO: 859778 - RNA, 22 nt, Human
cagaguggcgacccccucagcu

SEQ ID NO: 859779 - RNA, 22 nt, Human
aaggccaacuaggaugagcuag

SEQ ID NO: 859780 - RNA, 22 nt, Human
guagaaauguaaccaggagaua

SEQ ID NO: 859781 - RNA, 22 nt, Human
uaagaaguacaaaaauuuucug

SEQ ID NO: 859782 - RNA, 22 nt, Human
cuggccagcugacagcagggcu

SEQ ID NO: 859783 - RNA, 22 nt, Human
agaucugaccuaaccccaccac

SEQ ID NO: 859784 - RNA, 22 nt, Human
uaucuguuguaguacagaugau

SEQ ID NO: 859785 - RNA, 22 nt, Human
agugcuuugguauagaacuauu

SEQ ID NO: 859786 - RNA, 22 nt, Human
uuaaauuccagccucauaauag

SEQ ID NO: 859787 - RNA, 22 nt, Human
aaagcagagguugcagugagcu

SEQ ID NO: 859788 - RNA, 20 nt, Human
uacuggauuagggcucaccc

SEQ ID NO: 859789 - RNA, 22 nt, Human
caggcaggucagugaagaagga

SEQ ID NO: 859790 - RNA, 22 nt, Human
acccaggacuuggcaaccucau

SEQ ID NO: 859791 - RNA, 17 nt, Human
gagacagcaggagcccc

SEQ ID NO: 859792 - RNA, 19 nt, Human
uuugcagugguuccuuugu

SEQ ID NO: 859793 - RNA, 22 nt, Human
gcaaacaaggacauacauccug

SEQ ID NO: 859794 - RNA, 22 nt, Human
agagacaaugccaaugcacacg

SEQ ID NO: 859795 - RNA, 22 nt, Human
cuucucaaaguugugaaucagg

SEQ ID NO: 859796 - RNA, 22 nt, Human
aucaggauucaguaucuccagc

SEQ ID NO: 859797 - RNA, 22 nt, Human
acaguggagaaggcaugaggcu

SEQ ID NO: 859798 - RNA, 18 nt, Human
gcagcuagccaggggggc

SEQ ID NO: 859799 - RNA, 22 nt, Human
auugaggcagcauaguucaggg

SEQ ID NO: 859800 - RNA, 22 nt, Human
cuugaaagaagggucuuuuaau

SEQ ID NO: 859801 - RNA, 22 nt, Human
aagugagugguaaggagcaugg

SEQ ID NO: 859802 - RNA, 22 nt, Human
ugcuuaauguacgugaguguac

SEQ ID NO: 859803 - RNA, 22 nt, Human
aagcagcuuuugaagagugagg

SEQ ID NO: 859804 - RNA, 22 nt, Human
acaugucuguaauuauuuuagg

SEQ ID NO: 859805 - RNA, 23 nt, Human
agcacacuuguacaaugcccuag

SEQ ID NO: 859806 - RNA, 22 nt, Human
uuaauuacaaaacacauagguu

SEQ ID NO: 859807 - RNA, 21 nt, Human
caaucaguuggcauuugagca

SEQ ID NO: 859808 - RNA, 22 nt, Human
acagucucuccacacugcaggg

SEQ ID NO: 859809 - RNA, 22 nt, Human
aggaagcucaaagccaugaugu

SEQ ID NO: 859810 - RNA, 22 nt, Human
uccaggagauucauuaggucau

SEQ ID NO: 859811 - RNA, 22 nt, Human
auuccaaagguuaaugcccauu

SEQ ID NO: 859812 - RNA, 22 nt, Human
acaucugaccauuacaagacau

SEQ ID NO: 859813 - RNA, 22 nt, Human
gccaggaggggagaguguguca

SEQ ID NO: 859814 - RNA, 22 nt, Human
gauuuccauuuucaacuccugc

SEQ ID NO: 859815 - RNA, 22 nt, Human
uagggaggcuacuucuuguagg

SEQ ID NO: 859816 - RNA, 20 nt, Human
gcucccagccugcagucccc

SEQ ID NO: 859817 - RNA, 22 nt, Human
uucacauaaugauacaaagcuu

SEQ ID NO: 859818 - RNA, 22 nt, Human
uauaaaauucucaguuuggggu

SEQ ID NO: 859819 - RNA, 22 nt, Human
aaucaugugggauagucugcuc

SEQ ID NO: 859820 - RNA, 22 nt, Human
uagugcuugagucucuccguac

SEQ ID NO: 859821 - RNA, 22 nt, Human
caauuucagaccuuuccuugga

SEQ ID NO: 859822 - RNA, 22 nt, Human
uucaccacagucucaucuacgc

SEQ ID NO: 859823 - RNA, 22 nt, Human
cuggaucaugggaaagggauca

SEQ ID NO: 859824 - RNA, 19 nt, Human
uccaggagcaaagccaguu

SEQ ID NO: 859825 - RNA, 22 nt, Human
agaauuucaaauggaaguuuua

SEQ ID NO: 859826 - RNA, 22 nt, Human
uaauuccaaguugagacaugca

SEQ ID NO: 859827 - RNA, 22 nt, Human
ugaguucuaguggcugcagauu

SEQ ID NO: 859828 - RNA, 22 nt, Human
augcuuuuccaggagaaauaua

SEQ ID NO: 859829 - RNA, 22 nt, Human
ggaggcgauccugggaaacacc

SEQ ID NO: 859830 - RNA, 22 nt, Human
auaaacucaugccaagaaauga

SEQ ID NO: 859831 - RNA, 22 nt, Human
uucauguguauggaacauuuuu

SEQ ID NO: 859832 - RNA, 22 nt, Human
uuguuaaaaauagauuuccagg

SEQ ID NO: 859833 - RNA, 22 nt, Human
uugauuaaucccaugugaguag

SEQ ID NO: 859834 - RNA, 22 nt, Human
cccaggaggcagagauagcagu

SEQ ID NO: 859835 - RNA, 22 nt, Human
acaagcaugggcuuugacauca

SEQ ID NO: 859836 - RNA, 21 nt, Human
ggagggcagcccagacuggcu

SEQ ID NO: 859837 - RNA, 22 nt, Human
aucaggaucaugcuggguggga

SEQ ID NO: 859838 - RNA, 22 nt, Human
ugaggggauacgguacacauug

SEQ ID NO: 859839 - RNA, 22 nt, Human
ucagaauuagagcucuucuuga

SEQ ID NO: 859840 - RNA, 22 nt, Human
gcaacuuuagggccagcaagua

SEQ ID NO: 859841 - RNA, 22 nt, Human
cuaacuuuagcuuagauuauca

SEQ ID NO: 859842 - RNA, 22 nt, Human
uauuacaauuuacauugcacuu

SEQ ID NO: 859843 - RNA, 22 nt, Human
caaauguauaaauguacuuucu

SEQ ID NO: 859844 - RNA, 22 nt, Human
ggcaggcugcuugggucauguc

SEQ ID NO: 859845 - RNA, 22 nt, Human
uaaggccaaguucauauacaac

SEQ ID NO: 859846 - RNA, 22 nt, Human
gaggcagcugggauacaaggga

SEQ ID NO: 859847 - RNA, 22 nt, Human
ucucuucucuagugagcaacug

SEQ ID NO: 859848 - RNA, 22 nt, Human
uuugaaguguuauuucuaucac

SEQ ID NO: 859849 - RNA, 23 nt, Human
gggcaguuauguuguccuuggcu

SEQ ID NO: 859850 - RNA, 22 nt, Human
cuugauguauaaguugauaugu

SEQ ID NO: 859851 - RNA, 17 nt, Human
cauuuguugaucaguug

SEQ ID NO: 859852 - RNA, 22 nt, Human
agauuuccuaugguaauuauag

SEQ ID NO: 859853 - RNA, 22 nt, Human
gucauauacacugcauguaauc

SEQ ID NO: 859854 - RNA, 22 nt, Human
cuuugaagagauuacugugcuc

SEQ ID NO: 859855 - RNA, 22 nt, Human
caguucuuuguggggaguucuc

SEQ ID NO: 859856 - RNA, 22 nt, Human
ucuucacaggagccugccugcc

SEQ ID NO: 859857 - RNA, 22 nt, Human
auaagcauguuagaauauuuga

SEQ ID NO: 859858 - RNA, 22 nt, Human
aaauucaauuaacuuucaugcu

SEQ ID NO: 859859 - RNA, 22 nt, Human
uaaguccuagaugauucacaga

SEQ ID NO: 859860 - RNA, 22 nt, Human
uuuucagaggccuaagagguuu

SEQ ID NO: 859861 - RNA, 22 nt, Human
guuauauauaguauuucucuga

SEQ ID NO: 859862 - RNA, 22 nt, Human
ucaucugucauccacaaagcug

SEQ ID NO: 859863 - RNA, 22 nt, Human
ugucaccaccggaagaaacugc

SEQ ID NO: 859864 - RNA, 22 nt, Human
aaguuucaugauguaauuauug

SEQ ID NO: 859865 - RNA, 22 nt, Human
gcuuugaagucugugucuuuug

SEQ ID NO: 859866 - RNA, 22 nt, Human
gacaauacagaaagggacaugc

SEQ ID NO: 859867 - RNA, 19 nt, Human
cauguuaugcuguaguauc

SEQ ID NO: 859868 - RNA, 23 nt, Human
uuaaacuucagugcagaacacuc

SEQ ID NO: 859869 - RNA, 22 nt, Human
cuucagagugcagaagauuggg

SEQ ID NO: 859870 - RNA, 20 nt, Human
agaggccaguuaggagucua

SEQ ID NO: 859871 - RNA, 22 nt, Human
gagucuuugguaaagucugcug

SEQ ID NO: 859872 - RNA, 22 nt, Human
ccauggcaauggucagucuauu

SEQ ID NO: 859873 - RNA, 22 nt, Human
aagggcagccugacucacgguc

SEQ ID NO: 859874 - RNA, 22 nt, Human
acaugcuuccaaauuauguugg

SEQ ID NO: 859875 - RNA, 22 nt, Human
uucuuaaaacuuauggacaggu

SEQ ID NO: 859876 - RNA, 22 nt, Human
aaagauuauggcauugaaauac

SEQ ID NO: 859877 - RNA, 22 nt, Human
guucuucagucacaucacagaa

SEQ ID NO: 859878 - RNA, 23 nt, Human
agaucugauguuaccaagaauug

SEQ ID NO: 859879 - RNA, 22 nt, Human
cuucuucauaggcaguccuguu

SEQ ID NO: 859880 - RNA, 22 nt, Human
acagauuuuugguaaauaauuu

SEQ ID NO: 859881 - RNA, 22 nt, Human
ugcuggaauaauuucauguuaa

SEQ ID NO: 859882 - RNA, 22 nt, Human
auuaggcagggcaugguggcuc

SEQ ID NO: 859883 - RNA, 22 nt, Human
gacccaggguauccagagcugc

SEQ ID NO: 859884 - RNA, 22 nt, Human
uguguuauugccacugaagacc

SEQ ID NO: 859885 - RNA, 22 nt, Human
auucacuggcagacagaacuca

SEQ ID NO: 859886 - RNA, 22 nt, Human
agucucuuuguggacucugccu

SEQ ID NO: 859887 - RNA, 22 nt, Human
ucaggaggccaccaggaccugu

SEQ ID NO: 859888 - RNA, 22 nt, Human
cugcugugccuuaaaaugcaag

SEQ ID NO: 859889 - RNA, 22 nt, Human
uguacaaucuuggucccuuuau

SEQ ID NO: 859890 - RNA, 22 nt, Human
uucagaaaucgaguuucauguc

SEQ ID NO: 859891 - RNA, 22 nt, Human
uuugaaagucaaccuuccaguu

SEQ ID NO: 859892 - RNA, 22 nt, Human
cauuguuauagcauuacacacc

SEQ ID NO: 859893 - RNA, 22 nt, Human
augcugugguagacagcauucc

SEQ ID NO: 859894 - RNA, 22 nt, Human
uuugaauagcauaggauuacau

SEQ ID NO: 859895 - RNA, 22 nt, Human
gaauuucauuuguuuccuacca

SEQ ID NO: 859896 - RNA, 22 nt, Human
ucagaauucuacaauagaucag

SEQ ID NO: 859897 - RNA, 18 nt, Human
ggcaucugcacagcagcc

SEQ ID NO: 859898 - RNA, 22 nt, Human
uccaugagggacacuggaugcu

SEQ ID NO: 859899 - RNA, 22 nt, Human
acgagagguccuuagaaucugu

SEQ ID NO: 859900 - RNA, 22 nt, Human
gcacaauaauucuuguuuugcu

SEQ ID NO: 859901 - RNA, 22 nt, Human
uuaaaaugaauauugauuagca

SEQ ID NO: 859902 - RNA, 22 nt, Human
agcugcccuguggggaggguug

SEQ ID NO: 859903 - RNA, 22 nt, Human
uuugaagucaggcuuucuaccc

SEQ ID NO: 859904 - RNA, 22 nt, Human
cuguguuugaugagaagccacc

SEQ ID NO: 859905 - RNA, 22 nt, Human
auggcuuugaaguaauguaauu

SEQ ID NO: 859906 - RNA, 18 nt, Human
ugaggcagucagugaugg

SEQ ID NO: 859907 - RNA, 20 nt, Human
agggcagcuugaggagccgg

SEQ ID NO: 859908 - RNA, 22 nt, Human
gccaggagcccugggcaaguuc

SEQ ID NO: 859909 - RNA, 22 nt, Human
uuuacagaugaggauacugagg

SEQ ID NO: 859910 - RNA, 22 nt, Human
cugccaggcacgugcagcauca

SEQ ID NO: 859911 - RNA, 18 nt, Human
gcacuucacccagcuagu

SEQ ID NO: 859912 - RNA, 22 nt, Human
gcugcccaggagagguggggcu

SEQ ID NO: 859913 - RNA, 22 nt, Human
uaagagaacuggauagauagga

SEQ ID NO: 859914 - RNA, 22 nt, Human
cacaaaugugcagaaaugugag

SEQ ID NO: 859915 - RNA, 22 nt, Human
ccagaggaaaaauaucucccua

SEQ ID NO: 859916 - RNA, 22 nt, Human
acauucacuauguccaaacucu

SEQ ID NO: 859917 - RNA, 21 nt, Human
acagcaagccuucacaugagu

SEQ ID NO: 859918 - RNA, 22 nt, Human
ugguuuuagaugccuuuacugc

SEQ ID NO: 859919 - RNA, 22 nt, Human
caggaugagaggcccagggaag

SEQ ID NO: 859920 - RNA, 22 nt, Human
uuccuuagcagaccugguaucc

SEQ ID NO: 859921 - RNA, 22 nt, Human
uagaacuacaagcauuaaaagu

SEQ ID NO: 859922 - RNA, 22 nt, Human
uagaaacagcauauauuagccc

SEQ ID NO: 859923 - RNA, 22 nt, Human
cugcugugugaccauggacagg

SEQ ID NO: 859924 - RNA, 19 nt, Human
acauuuaaauucagaucuc

SEQ ID NO: 859925 - RNA, 22 nt, Human
ggaggcagaauagagugugggu

SEQ ID NO: 859926 - RNA, 22 nt, Human
aacuggauuaacuggcucaaau

SEQ ID NO: 859927 - RNA, 22 nt, Human
gagaggcaggcgcugcaauggu

SEQ ID NO: 859928 - RNA, 18 nt, Human
cgaggcaggcggaucacg

SEQ ID NO: 859929 - RNA, 22 nt, Human
aucugcaggaaugugugcagag

SEQ ID NO: 859930 - RNA, 19 nt, Human
aauacaguguuauagaauu

SEQ ID NO: 859931 - RNA, 22 nt, Human
cugaaugaggaaaagagugagg

SEQ ID NO: 859932 - RNA, 22 nt, Human
aaaugcauggcuguuuuaaagc

SEQ ID NO: 859933 - RNA, 22 nt, Human
cucaggauggaagccuacagga

SEQ ID NO: 859934 - RNA, 22 nt, Human
gaaagaggaaggagauguauua

SEQ ID NO: 859935 - RNA, 22 nt, Human
uucacagagagaacucaaacca

SEQ ID NO: 859936 - RNA, 22 nt, Human
uuuguagaggguaauugacaga

SEQ ID NO: 859937 - RNA, 22 nt, Human
ugaggggagcuagcaugccuug

SEQ ID NO: 859938 - RNA, 22 nt, Human
cuuaagauuugagauaccuaau

SEQ ID NO: 859939 - RNA, 22 nt, Human
acaugaaacuguugcauuagaa

SEQ ID NO: 859940 - RNA, 22 nt, Human
agaaacauccugcuuuccauuu

SEQ ID NO: 859941 - RNA, 22 nt, Human
ugaacaguuucaagaaaacuuu

SEQ ID NO: 859942 - RNA, 22 nt, Human
ccucuucuagguuucagccugc

SEQ ID NO: 859943 - RNA, 22 nt, Human
ucucuucuaacacuagaaauuc

SEQ ID NO: 859944 - RNA, 22 nt, Human
ccucagaugucuuaaggcacug

SEQ ID NO: 859945 - RNA, 22 nt, Human
caguccuucauuccuccuuuga

SEQ ID NO: 859946 - RNA, 22 nt, Human
auguuucagauacagaucaaau

SEQ ID NO: 859947 - RNA, 22 nt, Human
auaaaacuuggguaugaucccu

SEQ ID NO: 859948 - RNA, 22 nt, Human
gcugauguaagacuuuugguuu

SEQ ID NO: 859949 - RNA, 22 nt, Human
auuacacuuguucaucaucacc

SEQ ID NO: 859950 - RNA, 22 nt, Human
cuuauacacccucuucccaggc

SEQ ID NO: 859951 - RNA, 22 nt, Human
aggcagcuucugauuagcagcg

SEQ ID NO: 859952 - RNA, 22 nt, Human
caucagaaugaauguucuggag

SEQ ID NO: 859953 - RNA, 22 nt, Human
ggcucagacucccaggcccucu

SEQ ID NO: 859954 - RNA, 22 nt, Human
ugugaauaccuugaauucauca

SEQ ID NO: 859955 - RNA, 22 nt, Human
agucucuuccuucaaggcuggu

SEQ ID NO: 859956 - RNA, 22 nt, Human
ugaaagcacaaguucuaacagg

SEQ ID NO: 859957 - RNA, 22 nt, Human
acuguugucaggcugcuuugga

SEQ ID NO: 859958 - RNA, 22 nt, Human
uaaacauuuguuauucuuguuu

SEQ ID NO: 859959 - RNA, 22 nt, Human
ucuuuaauucagcaugaugcgg

SEQ ID NO: 859960 - RNA, 22 nt, Human
uucagcaaauggacuguucagg

SEQ ID NO: 859961 - RNA, 22 nt, Human
aggaggcacucacucucagggu

SEQ ID NO: 859962 - RNA, 22 nt, Human
gcuuuaaugcaauuucaccuca

SEQ ID NO: 859963 - RNA, 22 nt, Human
uggaaauggaucugaugagucu

SEQ ID NO: 859964 - RNA, 22 nt, Human
uucuuacagaguuuacagagcc

SEQ ID NO: 859965 - RNA, 22 nt, Human
ggagcuguuggcagcuaucuug

SEQ ID NO: 859966 - RNA, 21 nt, Human
acucaggagacuaacuauguc

SEQ ID NO: 859967 - RNA, 19 nt, Human
ucaucucacagggccuggc

SEQ ID NO: 859968 - RNA, 22 nt, Human
gagggcauaguuaaauaggagg

SEQ ID NO: 859969 - RNA, 22 nt, Human
gcagcugccccgacugugaguc

SEQ ID NO: 859970 - RNA, 22 nt, Human
gcccaggauucuuucuuccuua

SEQ ID NO: 859971 - RNA, 22 nt, Human
uucacagacauugcagacugaa

SEQ ID NO: 859972 - RNA, 21 nt, Human
auggcuuuuuuaaagcuugug

SEQ ID NO: 859973 - RNA, 22 nt, Human
gaggccagcuaguccaggaagu

SEQ ID NO: 859974 - RNA, 22 nt, Human
uaagcugugggagauuggcaua

SEQ ID NO: 859975 - RNA, 22 nt, Human
guccaugauucugugacacccu

SEQ ID NO: 859976 - RNA, 22 nt, Human
ugaaaugagcauuuauucuuua

SEQ ID NO: 859977 - RNA, 22 nt, Human
ugaaggccacuuccugugagcu

SEQ ID NO: 859978 - RNA, 22 nt, Human
ucaggaugguguggaggaaaua

SEQ ID NO: 859979 - RNA, 22 nt, Human
cauuguuaauugguaucuuaca

SEQ ID NO: 859980 - RNA, 22 nt, Human
uugaagagugccuuccagacau

SEQ ID NO: 859981 - RNA, 22 nt, Human
uuugaagauuaugccagaguga

SEQ ID NO: 859982 - RNA, 22 nt, Human
uuuacaaccucauauucugaug

SEQ ID NO: 859983 - RNA, 22 nt, Human
aagcagagcaagcguauuuauu

SEQ ID NO: 859984 - RNA, 22 nt, Human
aguuacagugaccauuuauuua

SEQ ID NO: 859985 - RNA, 22 nt, Human
aaauuucaguuggaaugagcuc

SEQ ID NO: 859986 - RNA, 22 nt, Human
uaauuuacuugcaaauaacaau

SEQ ID NO: 859987 - RNA, 22 nt, Human
cuucagaagccugcagccuuug

SEQ ID NO: 859988 - RNA, 22 nt, Human
aacauuggauauuuauuaaaag

SEQ ID NO: 859989 - RNA, 22 nt, Human
uucucagaggagucgggagcug

SEQ ID NO: 859990 - RNA, 22 nt, Human
aggcaagcgcagaagcggagga

SEQ ID NO: 859991 - RNA, 22 nt, Human
uacacauguauuuauguguaca

SEQ ID NO: 859992 - RNA, 22 nt, Human
auauucuuccaaaacaucauuu

SEQ ID NO: 859993 - RNA, 22 nt, Human
uggcagcugaauggcuggaugg

SEQ ID NO: 859994 - RNA, 22 nt, Human
cugaauaauuuucuguuguaug

SEQ ID NO: 859995 - RNA, 22 nt, Human
auuaaaauuccaagguaugcca

SEQ ID NO: 859996 - RNA, 22 nt, Human
gaggauggaggugugagcuaug

SEQ ID NO: 859997 - RNA, 22 nt, Human
uaaaaugaucucucauguucuu

SEQ ID NO: 859998 - RNA, 22 nt, Human
uuucacauuuaggcgugaauug

SEQ ID NO: 859999 - RNA, 22 nt, Human
uuucuucauagaccuugucuug

SEQ ID NO: 860000 - RNA, 22 nt, Human
ucagagaguuagugucuuagcu

SEQ ID NO: 860001 - RNA, 22 nt, Human
aauucacaaaaguuagauccau

SEQ ID NO: 860002 - RNA, 18 nt, Human
caauuucauccuuaagcc

SEQ ID NO: 860003 - RNA, 22 nt, Human
uugcugaaaucuaugacauccu

SEQ ID NO: 860004 - RNA, 22 nt, Human
augaaaauugacagcggaagua

SEQ ID NO: 860005 - RNA, 22 nt, Human
uagcacaucuggcgcuuauagg

SEQ ID NO: 860006 - RNA, 21 nt, Human
agccuguugguuuacugcuca

SEQ ID NO: 860007 - RNA, 22 nt, Human
uuuuuugucuugaagaaauggu

SEQ ID NO: 860008 - RNA, 22 nt, Human
uggcuguguuaccacuucaugu

SEQ ID NO: 860009 - RNA, 22 nt, Human
uucaauucaauucuaaauauau

SEQ ID NO: 860010 - RNA, 22 nt, Human
cacauauuugaugaagcuuugu

SEQ ID NO: 860011 - RNA, 22 nt, Human
aaaucaguuguuauauuaaaga

SEQ ID NO: 860012 - RNA, 22 nt, Human
uuuauuguuaucaugggugagu

SEQ ID NO: 860013 - RNA, 22 nt, Human
acaaauguggacauggauaaug

SEQ ID NO: 860014 - RNA, 22 nt, Human
uccaggagguugagacugcagu

SEQ ID NO: 860015 - RNA, 22 nt, Human
uucucuuuucaccaguugcuaa

SEQ ID NO: 860016 - RNA, 22 nt, Human
cuggcugugcugcaggcuuugg

SEQ ID NO: 860017 - RNA, 19 nt, Human
aucugagauuauaaacaga

SEQ ID NO: 860018 - RNA, 22 nt, Human
ucacaucucccuggaggacaca

SEQ ID NO: 860019 - RNA, 22 nt, Human
cuuaggcaagcagagcccaucc

SEQ ID NO: 860020 - RNA, 22 nt, Human
ucuggcaggcaaucggcucugg

SEQ ID NO: 860021 - RNA, 22 nt, Human
uuucaguucaguuuauuauauc

SEQ ID NO: 860022 - RNA, 22 nt, Human
ucuuuggaucccaacuggcugg

SEQ ID NO: 860023 - RNA, 22 nt, Human
uauuuucuguggaggaccagau

SEQ ID NO: 860024 - RNA, 22 nt, Human
guuaggcaugaguguguauuaa

SEQ ID NO: 860025 - RNA, 22 nt, Human
uaaguccuaacagacugggggc

SEQ ID NO: 860026 - RNA, 22 nt, Human
aagggaggccagagguuuugca

SEQ ID NO: 860027 - RNA, 22 nt, Human
uuccuuagcuccucauggccug

SEQ ID NO: 860028 - RNA, 22 nt, Human
cugaauaauacagacuagcuuc

SEQ ID NO: 860029 - RNA, 22 nt, Human
auggaaagggaagcaaggaaca

SEQ ID NO: 860030 - RNA, 22 nt, Human
uuguuugaggucacugauauuu

SEQ ID NO: 860031 - RNA, 22 nt, Human
aggaagcuagagccaccggacu

SEQ ID NO: 860032 - RNA, 20 nt, Human
aggaggcauagucuggaaag

SEQ ID NO: 860033 - RNA, 22 nt, Human
aucagaaaaacauaauguuauu

SEQ ID NO: 860034 - RNA, 22 nt, Human
ugaaggccagcucuuuaucagc

SEQ ID NO: 860035 - RNA, 22 nt, Human
uauuuguugaguuguuaugucu

SEQ ID NO: 860036 - RNA, 22 nt, Human
guuucacagaugguguucauau

SEQ ID NO: 860037 - RNA, 22 nt, Human
augaaaauguacauguguauaa

SEQ ID NO: 860038 - RNA, 22 nt, Human
uucauucuuugaaucugaggua

SEQ ID NO: 860039 - RNA, 22 nt, Human
acagcauugagagcuaaauuua

SEQ ID NO: 860040 - RNA, 22 nt, Human
gauuuacagguuagguccugua

SEQ ID NO: 860041 - RNA, 22 nt, Human
ggcagcuucucccaggcuguuu

SEQ ID NO: 860042 - RNA, 22 nt, Human
gcaaguuauuuccauuuaaagc

SEQ ID NO: 860043 - RNA, 22 nt, Human
uuauccaacaugacuuaugucc

SEQ ID NO: 860044 - RNA, 22 nt, Human
aaaguccuguuaacuguuaaca

SEQ ID NO: 860045 - RNA, 22 nt, Human
acucaggaagaaagcagcuggu

SEQ ID NO: 860046 - RNA, 22 nt, Human
uuugcagugauucuugcaguga

SEQ ID NO: 860047 - RNA, 22 nt, Human
cugacuguaauucuguucuuaa

SEQ ID NO: 860048 - RNA, 22 nt, Human
auaaaauuugcuacuguuaaau

SEQ ID NO: 860049 - RNA, 22 nt, Human
ccuauacaggcuucuuuacaug

SEQ ID NO: 860050 - RNA, 22 nt, Human
aauggccagcaacaggagugaa

SEQ ID NO: 860051 - RNA, 22 nt, Human
aaaacauguccauacagaaacu

SEQ ID NO: 860052 - RNA, 22 nt, Human
cugcuguggguuaagacacugu

SEQ ID NO: 860053 - RNA, 22 nt, Human
cccaggugcugcgugaagccuc

SEQ ID NO: 860054 - RNA, 22 nt, Human
uagggauguaaacauaguaauu

SEQ ID NO: 860055 - RNA, 22 nt, Human
uaugaacucuggagucugagug

SEQ ID NO: 860056 - RNA, 22 nt, Human
aauguuaauuuacugucuucau

SEQ ID NO: 860057 - RNA, 22 nt, Human
caucagucuagauucuaguacc

SEQ ID NO: 860058 - RNA, 22 nt, Human
ucacagacacagggagaagcau

SEQ ID NO: 860059 - RNA, 17 nt, Human
cucacggaggaugaauc

SEQ ID NO: 860060 - RNA, 22 nt, Human
ucacaaauauuuuaacaguagg

SEQ ID NO: 860061 - RNA, 22 nt, Human
ugcagggcccucauuccugucc

SEQ ID NO: 860062 - RNA, 22 nt, Human
agggaguuagaaauccaggaua

SEQ ID NO: 860063 - RNA, 21 nt, Human
acuuuaauauacaugaggagg

SEQ ID NO: 860064 - RNA, 22 nt, Human
auagaauuauggaaagcaucuu

SEQ ID NO: 860065 - RNA, 22 nt, Human
gaggucaggcuugcagcagggu

SEQ ID NO: 860066 - RNA, 22 nt, Human
ggcagccuugacuagugacuua

SEQ ID NO: 860067 - RNA, 22 nt, Human
aucaggauagucuguaaauugu

SEQ ID NO: 860068 - RNA, 22 nt, Human
gcucaggaaaacagucuaguaa

SEQ ID NO: 860069 - RNA, 22 nt, Human
gcucaggaucccaggggugugc

SEQ ID NO: 860070 - RNA, 22 nt, Human
aaucagaacuccuaccacagag

SEQ ID NO: 860071 - RNA, 22 nt, Human
gaggcagcgggucaggaccgug

SEQ ID NO: 860072 - RNA, 22 nt, Human
ucucaggaagugauauugagac

SEQ ID NO: 860073 - RNA, 22 nt, Human
acuuucugcaguguuggaaaug

SEQ ID NO: 860074 - RNA, 22 nt, Human
auguucuuucagccagugcauc

SEQ ID NO: 860075 - RNA, 22 nt, Human
gugaauaagaccuaaggaugaa

SEQ ID NO: 860076 - RNA, 20 nt, Human
ucacaucuggcagcugauga

SEQ ID NO: 860077 - RNA, 22 nt, Human
aucagaaaucuaggauucagaa

SEQ ID NO: 860078 - RNA, 17 nt, Human
agaggcagauacuugga

SEQ ID NO: 860079 - RNA, 20 nt, Human
gaguuccccauuucuccugg

SEQ ID NO: 860080 - RNA, 22 nt, Human
uugcaggaaacugagugugagc

SEQ ID NO: 860081 - RNA, 22 nt, Human
agcugccccaugagaggcaggu

SEQ ID NO: 860082 - RNA, 22 nt, Human
aguccuuagaacacuguaucug

SEQ ID NO: 860083 - RNA, 22 nt, Human
cuucaggauuuaggaagaugaa

SEQ ID NO: 860084 - RNA, 22 nt, Human
uuuaauauuucuuuccugaagc

SEQ ID NO: 860085 - RNA, 17 nt, Human
aagacagaagccaugag

SEQ ID NO: 860086 - RNA, 22 nt, Human
agaggaggaagagcuuuaaaau

SEQ ID NO: 860087 - RNA, 18 nt, Human
agaggggagguaagucug

SEQ ID NO: 860088 - RNA, 18 nt, Human
gcaggcuuuuccuggguc

SEQ ID NO: 860089 - RNA, 22 nt, Human
cauggcuuguaauaaauuuaua

SEQ ID NO: 860090 - RNA, 22 nt, Human
ggggcagcucccgagggcagga

SEQ ID NO: 860091 - RNA, 22 nt, Human
aaucaguguggugacuugucug

SEQ ID NO: 860092 - RNA, 22 nt, Human
uggcauuucuggccauuugugu

SEQ ID NO: 860093 - RNA, 22 nt, Human
aggcagcucuguggccucccag

SEQ ID NO: 860094 - RNA, 22 nt, Human
uuugcauaaaggagcauuucuc

SEQ ID NO: 860095 - RNA, 22 nt, Human
aagacauugucauuuuauaauu

SEQ ID NO: 860096 - RNA, 22 nt, Human
uugguacagaugagguauucuc

SEQ ID NO: 860097 - RNA, 22 nt, Human
gcaccugauugauuucacugcu

SEQ ID NO: 860098 - RNA, 22 nt, Human
uccaggagcucauccacgucaa

SEQ ID NO: 860099 - RNA, 22 nt, Human
auuccaaacuuaccccagagga

SEQ ID NO: 860100 - RNA, 22 nt, Human
gaagugaagguuacucuagauu

SEQ ID NO: 860101 - RNA, 22 nt, Human
auuacaguaacagcuacaaugc

SEQ ID NO: 860102 - RNA, 20 nt, Human
agaaaaaguguggaaauuuc

SEQ ID NO: 860103 - RNA, 22 nt, Human
caugucuguguacacaugcaca

SEQ ID NO: 860104 - RNA, 22 nt, Human
guugaaagcuuuucauuuaguu

SEQ ID NO: 860105 - RNA, 22 nt, Human
ucagccucucugaguccagacc

SEQ ID NO: 860106 - RNA, 22 nt, Human
gccaggagggaaaggacaauuu

SEQ ID NO: 860107 - RNA, 22 nt, Human
acaaaauuuuuagacaaggcuu

SEQ ID NO: 860108 - RNA, 23 nt, Human
auugaugacuugauuacacuuuu

SEQ ID NO: 860109 - RNA, 22 nt, Human
uuuccaagagcuuauuucugaa

SEQ ID NO: 860110 - RNA, 22 nt, Human
gaggaacccagcugggguugcc

SEQ ID NO: 860111 - RNA, 22 nt, Human
uggcagcucuguucaacaugag

SEQ ID NO: 860112 - RNA, 22 nt, Human
gaggaaccacucugagaagcca

SEQ ID NO: 860113 - RNA, 22 nt, Human
gcagcuccuccugggcuggaga

SEQ ID NO: 860114 - RNA, 22 nt, Human
gcucucuuuuuccagugguggu

SEQ ID NO: 860115 - RNA, 23 nt, Human
ucagagagcuguugagagcugcc

SEQ ID NO: 860116 - RNA, 22 nt, Human
gaggcagcagaacauggaagag

SEQ ID NO: 860117 - RNA, 22 nt, Human
ucauuucaaugauacuacuaag

SEQ ID NO: 860118 - RNA, 23 nt, Human
uggaggaaacacaucagaagacc

SEQ ID NO: 860119 - RNA, 22 nt, Human
uuauagugggcccaacauggcg

SEQ ID NO: 860120 - RNA, 22 nt, Human
cauagaaaguauuauggaauuu

SEQ ID NO: 860121 - RNA, 22 nt, Human
cuccaggaaagccugaggcccg

SEQ ID NO: 860122 - RNA, 22 nt, Human
uuaaaugaggcugauguagauu

SEQ ID NO: 860123 - RNA, 16 nt, Human
ccccaggacuuggcac

SEQ ID NO: 860124 - RNA, 22 nt, Human
ugaaguuauauauguugaaaau

SEQ ID NO: 860125 - RNA, 22 nt, Human
acuaagugauucuaagcaucuu

SEQ ID NO: 860126 - RNA, 22 nt, Human
cccaggaggcagagguugcagu

SEQ ID NO: 860127 - RNA, 22 nt, Human
auuugcaaagucguaucuguga

SEQ ID NO: 860128 - RNA, 22 nt, Human
ucaugcuuauugcauauuugga

SEQ ID NO: 860129 - RNA, 22 nt, Human
uccagccuaggggaacagcugc

SEQ ID NO: 860130 - RNA, 23 nt, Human
uguaacaauucccagccuuugcc

SEQ ID NO: 860131 - RNA, 22 nt, Human
ucagagaggcaauacuguuuaa

SEQ ID NO: 860132 - RNA, 22 nt, Human
gcuucacaggcaaguuaagccu

SEQ ID NO: 860133 - RNA, 21 nt, Human
uacagaaugcgcuucagucug

SEQ ID NO: 860134 - RNA, 22 nt, Human
acuucaugcagaagagagcugu

SEQ ID NO: 860135 - RNA, 22 nt, Human
aggcagcuuuaacugguaguag

SEQ ID NO: 860136 - RNA, 22 nt, Human
cuuaggcaguuuaggaaagaga

SEQ ID NO: 860137 - RNA, 22 nt, Human
acccaggacaaaauaaccaggu

SEQ ID NO: 860138 - RNA, 22 nt, Human
ucauggauggccgggaggugau

SEQ ID NO: 860139 - RNA, 22 nt, Human
gaggagcuugaggcuaggagcc

SEQ ID NO: 860140 - RNA, 22 nt, Human
uugauguacagaauuguucaca

SEQ ID NO: 860141 - RNA, 22 nt, Human
guuguuuugcaggauccuuaca

SEQ ID NO: 860142 - RNA, 22 nt, Human
guacauuucucuuguucuuauu

SEQ ID NO: 860143 - RNA, 22 nt, Human
auggguuucccucugaaauuau

SEQ ID NO: 860144 - RNA, 22 nt, Human
cagaaccaggaacugauggaga

SEQ ID NO: 860145 - RNA, 22 nt, Human
aucagaaauagucauguuacuu

SEQ ID NO: 860146 - RNA, 21 nt, Human
caagccagaccaauagcagcc

SEQ ID NO: 860147 - RNA, 22 nt, Human
ggaggcaggaaagacagguuca

SEQ ID NO: 860148 - RNA, 22 nt, Human
gccaggaggucagccccucaac

SEQ ID NO: 860149 - RNA, 22 nt, Human
ccauaauauuaaaugcuuuugu

SEQ ID NO: 860150 - RNA, 22 nt, Human
auauaauacaaccugcuaagug

SEQ ID NO: 860151 - RNA, 22 nt, Human
caggcagcucaaccuugggagc

SEQ ID NO: 860152 - RNA, 22 nt, Human
ucccuucacagaugcgauguuu

SEQ ID NO: 860153 - RNA, 22 nt, Human
cacagacccagaagggaugaag

SEQ ID NO: 860154 - RNA, 22 nt, Human
guuuacauguacucauuauacu

SEQ ID NO: 860155 - RNA, 22 nt, Human
aggcacaggccucagcacccag

SEQ ID NO: 860156 - RNA, 17 nt, Human
gaggagcuccaguaggu

SEQ ID NO: 860157 - RNA, 22 nt, Human
aggaugaauaacugaaauggug

SEQ ID NO: 860158 - RNA, 22 nt, Human
cauauaauguuugaagaugugg

SEQ ID NO: 860159 - RNA, 22 nt, Human
uuugacauggaauaacucauuu

SEQ ID NO: 860160 - RNA, 21 nt, Human
aggcagcuggaaggccuggcu

SEQ ID NO: 860161 - RNA, 23 nt, Human
ugaaggccuggaggacgcguugu

SEQ ID NO: 860162 - RNA, 22 nt, Human
uucaccgugaaccgauuccuca

SEQ ID NO: 860163 - RNA, 22 nt, Human
ggcugaaggaugaaagcugcag

SEQ ID NO: 860164 - RNA, 17 nt, Human
uucucugagcuguauug

SEQ ID NO: 860165 - RNA, 22 nt, Human
uggugguuaugcgcuuuguggg

SEQ ID NO: 860166 - RNA, 22 nt, Human
acauuuaaccaaacuguuuaau

SEQ ID NO: 860167 - RNA, 22 nt, Human
gguuuaauggagauauuucaga

SEQ ID NO: 860168 - RNA, 22 nt, Human
ucugucuccucugaggugccag

SEQ ID NO: 860169 - RNA, 22 nt, Human
uuacagaaagguugugggauag

SEQ ID NO: 860170 - RNA, 22 nt, Human
cccaguuucaacuuuccagugg

SEQ ID NO: 860171 - RNA, 22 nt, Human
gaugggauuuuuuauguguuca

SEQ ID NO: 860172 - RNA, 22 nt, Human
ugucaccaguuccaggaaauaa

SEQ ID NO: 860173 - RNA, 22 nt, Human
ucucucuucaacccuuaacuag

SEQ ID NO: 860174 - RNA, 22 nt, Human
aggcagcagugauaagauagga

SEQ ID NO: 860175 - RNA, 22 nt, Human
uguagggaggaaggguuggaaa

SEQ ID NO: 860176 - RNA, 22 nt, Human
aaauuucaguuaccuuuacguu

SEQ ID NO: 860177 - RNA, 20 nt, Human
uccaugaguuagagacuaua

SEQ ID NO: 860178 - RNA, 22 nt, Human
uggcuuuaaaucuguauucaua

SEQ ID NO: 860179 - RNA, 22 nt, Human
gagguggucgaggagggguacc

SEQ ID NO: 860180 - RNA, 22 nt, Human
gauuucuuuaugaaguacagaa

SEQ ID NO: 860181 - RNA, 22 nt, Human
auugaaagaguuuucugcugca

SEQ ID NO: 860182 - RNA, 22 nt, Human
uuugaaaggguuaugagacuga

SEQ ID NO: 860183 - RNA, 22 nt, Human
agugcugucaguuuuauagaua

SEQ ID NO: 860184 - RNA, 22 nt, Human
acuuugcagggcuugauaucca

SEQ ID NO: 860185 - RNA, 19 nt, Human
ugaguucugugguucucaa

SEQ ID NO: 860186 - RNA, 22 nt, Human
aauuucaaugcacucaugguug

SEQ ID NO: 860187 - RNA, 22 nt, Human
uuugacauugccaauuugcuca

SEQ ID NO: 860188 - RNA, 22 nt, Human
augcugugucaggaauuugaua

SEQ ID NO: 860189 - RNA, 22 nt, Human
uucucacuauguauguagauug

SEQ ID NO: 860190 - RNA, 22 nt, Human
caagaauccuguucuugaagau

SEQ ID NO: 860191 - RNA, 22 nt, Human
cagucucuugcuucauuaguug

SEQ ID NO: 860192 - RNA, 22 nt, Human
caagauggguguugugaugguu

SEQ ID NO: 860193 - RNA, 22 nt, Human
caggagagcccggguccgggcu

SEQ ID NO: 860194 - RNA, 22 nt, Human
uggcuauugagugaucucuaga

SEQ ID NO: 860195 - RNA, 22 nt, Human
aaguccuuggagaauagaaagg

SEQ ID NO: 860196 - RNA, 22 nt, Human
gagggucccugcucagggccag

SEQ ID NO: 860197 - RNA, 22 nt, Human
uaaagccauacugaaagccacu

SEQ ID NO: 860198 - RNA, 22 nt, Human
uaauuccaccuuuuuccaacuu

SEQ ID NO: 860199 - RNA, 22 nt, Human
aaucagcuaaauaaacuaguca

SEQ ID NO: 860200 - RNA, 20 nt, Human
cucaggauugucuagccccu

SEQ ID NO: 860201 - RNA, 22 nt, Human
uggcaaggccacaggugcaguu

SEQ ID NO: 860202 - RNA, 22 nt, Human
gagggagucugugcaaagaauu

SEQ ID NO: 860203 - RNA, 22 nt, Human
agaaucugguagaaccaaggau

SEQ ID NO: 860204 - RNA, 22 nt, Human
auauauaaccuggauaaggcuu

SEQ ID NO: 860205 - RNA, 22 nt, Human
auacagaagccuguauuucugg

SEQ ID NO: 860206 - RNA, 22 nt, Human
ugguaauuaauuugauagguuc

SEQ ID NO: 860207 - RNA, 22 nt, Human
accaggaguuuugaccaggggc

SEQ ID NO: 860208 - RNA, 22 nt, Human
ucuuugcagaauuuaacuuugc

SEQ ID NO: 860209 - RNA, 22 nt, Human
ggcauuaagaauaucauuaaaa

SEQ ID NO: 860210 - RNA, 22 nt, Human
caacauuugaguaaagaaaugg

SEQ ID NO: 860211 - RNA, 22 nt, Human
aaguccuugaagaaacaguucu

SEQ ID NO: 860212 - RNA, 19 nt, Human
agcuuccauauucucuagu

SEQ ID NO: 860213 - RNA, 19 nt, Human
cuggccaggccaggggccc

SEQ ID NO: 860214 - RNA, 22 nt, Human
gacuaugugaagugugaauagg

SEQ ID NO: 860215 - RNA, 20 nt, Human
caucagaaauccugacccac

SEQ ID NO: 860216 - RNA, 22 nt, Human
gauggcaggcaggugaguagag

SEQ ID NO: 860217 - RNA, 22 nt, Human
ucuggcaggucaaucauucuuu

SEQ ID NO: 860218 - RNA, 22 nt, Human
cauuuguauagugcuuagacca

SEQ ID NO: 860219 - RNA, 22 nt, Human
ucucugaguaagugacaguuca

SEQ ID NO: 860220 - RNA, 22 nt, Human
uuuacagaauguugaauuuggg

SEQ ID NO: 860221 - RNA, 22 nt, Human
uggcagcuggaucccaaggcag

SEQ ID NO: 860222 - RNA, 22 nt, Human
cacucaggguacaauggagggc

SEQ ID NO: 860223 - RNA, 22 nt, Human
uuagccauuuuauacaagugua

SEQ ID NO: 860224 - RNA, 22 nt, Human
gagagggagccagccaggaacc

SEQ ID NO: 860225 - RNA, 22 nt, Human
uuuucaguaaugucuacauaau

SEQ ID NO: 860226 - RNA, 22 nt, Human
gccaggagcaugucauuguuga

SEQ ID NO: 860227 - RNA, 22 nt, Human
ugcuguguggaugugaagaauc

SEQ ID NO: 860228 - RNA, 22 nt, Human
aguaaacauuucagauuuauuu

SEQ ID NO: 860229 - RNA, 22 nt, Human
ucacaguuauagucuguagaau

SEQ ID NO: 860230 - RNA, 22 nt, Human
cagagggcacaugguuuccuca

SEQ ID NO: 860231 - RNA, 22 nt, Human
auauaugcauguguacuuaugu

SEQ ID NO: 860232 - RNA, 22 nt, Human
ccacaucucgguccccucuuug

SEQ ID NO: 860233 - RNA, 22 nt, Human
auucaacggguagaagggucuu

SEQ ID NO: 860234 - RNA, 22 nt, Human
ggaggaggcggcagaaguuccu

SEQ ID NO: 860235 - RNA, 22 nt, Human
acuggcagagacccugauggcc

SEQ ID NO: 860236 - RNA, 22 nt, Human
cagugcugggcagaggagagcg

SEQ ID NO: 860237 - RNA, 22 nt, Human
auucuucaguauguguggauug

SEQ ID NO: 860238 - RNA, 22 nt, Human
ucacagaacaauguuuaguucu

SEQ ID NO: 860239 - RNA, 22 nt, Human
cuugcugucccuugguaugaac

SEQ ID NO: 860240 - RNA, 22 nt, Human
uaucugagaaagaagcaccaga

SEQ ID NO: 860241 - RNA, 22 nt, Human
aaaucaguuggaacacaagcag

SEQ ID NO: 860242 - RNA, 22 nt, Human
agauuuacuggagucuuuggug

SEQ ID NO: 860243 - RNA, 20 nt, Human
augugagggguugaaguggg

SEQ ID NO: 860244 - RNA, 22 nt, Human
aucuaucccaguuuaacucauu

SEQ ID NO: 860245 - RNA, 22 nt, Human
ucaacuuugaaaccauagugaa

SEQ ID NO: 860246 - RNA, 22 nt, Human
gagaggaguuacuauuuccgag

SEQ ID NO: 860247 - RNA, 22 nt, Human
gcccaggaguucaaggcugcag

SEQ ID NO: 860248 - RNA, 22 nt, Human
acacaaacugcuagaaaauugg

SEQ ID NO: 860249 - RNA, 22 nt, Human
uccacauccauugcuugacuuu

SEQ ID NO: 860250 - RNA, 22 nt, Human
augcuguggccagaguucaacu

SEQ ID NO: 860251 - RNA, 22 nt, Human
aggaagcuaaccagggagugag

SEQ ID NO: 860252 - RNA, 22 nt, Human
aagauauacuauuaaguaccau

SEQ ID NO: 860253 - RNA, 22 nt, Human
aagguucuaagggaagccaugc

SEQ ID NO: 860254 - RNA, 22 nt, Human
augugcuuuauuaaguaaaaau

SEQ ID NO: 860255 - RNA, 22 nt, Human
ucagucucuggggcuucuguuu

SEQ ID NO: 860256 - RNA, 22 nt, Human
cagaaucagcccuugcuauuaa

SEQ ID NO: 860257 - RNA, 23 nt, Human
uacagaaggaguagucacuaaga

SEQ ID NO: 860258 - RNA, 22 nt, Human
agaaaugaagcaggaguuauua

SEQ ID NO: 860259 - RNA, 22 nt, Human
acacaaauuguaggauaauugc

SEQ ID NO: 860260 - RNA, 22 nt, Human
caguggagagacuuuuacucuu

SEQ ID NO: 860261 - RNA, 22 nt, Human
ucuuuaaugugauuguaauuau

SEQ ID NO: 860262 - RNA, 23 nt, Human
guaaaauacgcagugcaguguga

SEQ ID NO: 860263 - RNA, 19 nt, Human
augcuuuauguuauuucuu

SEQ ID NO: 860264 - RNA, 22 nt, Human
uguuuuaaagccauugccuuuc

SEQ ID NO: 860265 - RNA, 22 nt, Human
aggauuuaccuccagcuaggcu

SEQ ID NO: 860266 - RNA, 22 nt, Human
ccaugagacagcaacugaaagu

SEQ ID NO: 860267 - RNA, 22 nt, Human
acagaauuuacacaucucuaaa

SEQ ID NO: 860268 - RNA, 22 nt, Human
aaacauuugcaacucgguuugg

SEQ ID NO: 860269 - RNA, 22 nt, Human
ucuucauuuuauagcaucugug

SEQ ID NO: 860270 - RNA, 22 nt, Human
caacuuuucugugaauuuaagu

SEQ ID NO: 860271 - RNA, 23 nt, Human
acuauaaaguuguucugauuuac

SEQ ID NO: 860272 - RNA, 22 nt, Human
agauucuacucuagauccaugg

SEQ ID NO: 860273 - RNA, 22 nt, Human
guguguuuagcauuagcagggg

SEQ ID NO: 860274 - RNA, 19 nt, Human
guuccaaaggccagaccuu

SEQ ID NO: 860275 - RNA, 22 nt, Human
ggcagcacugcagcuuguuggg

SEQ ID NO: 860276 - RNA, 22 nt, Human
gagugcaggccugagcaccauc

SEQ ID NO: 860277 - RNA, 22 nt, Human
uggaggggcaauggagcgcgga

SEQ ID NO: 860278 - RNA, 22 nt, Human
uaugaaacauucauacaaauaa

SEQ ID NO: 860279 - RNA, 22 nt, Human
auguauccuuauacacauuuau

SEQ ID NO: 860280 - RNA, 22 nt, Human
auuucacaaaccauccugauuu

SEQ ID NO: 860281 - RNA, 21 nt, Human
gcugcccaacccugcaucucc

SEQ ID NO: 860282 - RNA, 22 nt, Human
ccucaggaaccacauugcugcu

SEQ ID NO: 860283 - RNA, 22 nt, Human
guuuuaguggguggccacugau

SEQ ID NO: 860284 - RNA, 22 nt, Human
gugguaauagagcuccaaacua

SEQ ID NO: 860285 - RNA, 22 nt, Human
ccaaagcaagucacaugaucaa

SEQ ID NO: 860286 - RNA, 22 nt, Human
gucuucaacaauaacuaccacu

SEQ ID NO: 860287 - RNA, 20 nt, Human
caucaucacaugagccaauu

SEQ ID NO: 860288 - RNA, 22 nt, Human
aggguagggcccggagacagac

SEQ ID NO: 860289 - RNA, 22 nt, Human
ccaggaaaauaccaagcuuuaa

SEQ ID NO: 860290 - RNA, 22 nt, Human
uaauuauuugaagacauuagag

SEQ ID NO: 860291 - RNA, 22 nt, Human
uuuaaagagaaugugaaggagu

SEQ ID NO: 860292 - RNA, 20 nt, Human
ggcaggcuuuauauggaggg

SEQ ID NO: 860293 - RNA, 20 nt, Human
gccaggagggugugaugagc

SEQ ID NO: 860294 - RNA, 22 nt, Human
acaacuuuguagcaauuccacg

SEQ ID NO: 860295 - RNA, 22 nt, Human
cuagaaaugcucaagagaaagu

SEQ ID NO: 860296 - RNA, 22 nt, Human
acagaauugauggaaaucucag

SEQ ID NO: 860297 - RNA, 21 nt, Human
cccaggaggagcuccggcucc

SEQ ID NO: 860298 - RNA, 20 nt, Human
acuugcugggcuuuguuacc

SEQ ID NO: 860299 - RNA, 22 nt, Human
uagaagcaguaauagaaauagg

SEQ ID NO: 860300 - RNA, 22 nt, Human
aaauaauguuaggccuuugcuc

SEQ ID NO: 860301 - RNA, 22 nt, Human
acacauauauacauauuugugc

SEQ ID NO: 860302 - RNA, 22 nt, Human
aauaaugucuuuggcuugacca

SEQ ID NO: 860303 - RNA, 22 nt, Human
gaggcgagaagcuggagauggu

SEQ ID NO: 860304 - RNA, 22 nt, Human
aaaucauguuggcacaauaaaa

SEQ ID NO: 860305 - RNA, 22 nt, Human
ggcagcuggggcagugcccugu

SEQ ID NO: 860306 - RNA, 22 nt, Human
cggagccugcuuguugcagcug

SEQ ID NO: 860307 - RNA, 22 nt, Human
guucucucugcuuccaagaugg

SEQ ID NO: 860308 - RNA, 22 nt, Human
guaaacauuacugugcuguaua

SEQ ID NO: 860309 - RNA, 22 nt, Human
uaucuguuaggaucagagcugg

SEQ ID NO: 860310 - RNA, 22 nt, Human
cugcgcagcaaucagagaggag

SEQ ID NO: 860311 - RNA, 22 nt, Human
acagagagaaacaaucagcagc

SEQ ID NO: 860312 - RNA, 22 nt, Human
uuauuucauugauuucuaagac

SEQ ID NO: 860313 - RNA, 20 nt, Human
cccaggaguuugcucuuacu

SEQ ID NO: 860314 - RNA, 22 nt, Human
gcaaaauuaaacuuagcaucau

SEQ ID NO: 860315 - RNA, 22 nt, Human
guuauaaaaugcacaguuguuu

SEQ ID NO: 860316 - RNA, 22 nt, Human
uucuacagacuauaacugugau

SEQ ID NO: 860317 - RNA, 22 nt, Human
uucuugcaggucacucacugag

SEQ ID NO: 860318 - RNA, 22 nt, Human
aggcaguggaugucaggaaugg

SEQ ID NO: 860319 - RNA, 22 nt, Human
ucagucuuugcuuaugacaaua

SEQ ID NO: 860320 - RNA, 22 nt, Human
uugauacaggcucuauuucauc

SEQ ID NO: 860321 - RNA, 22 nt, Human
auagaauucuuugaaauuuaug

SEQ ID NO: 860322 - RNA, 19 nt, Human
ucccaggaagcaaauguca

SEQ ID NO: 860323 - RNA, 22 nt, Human
cauggcuuuuuagcauauucaa

SEQ ID NO: 860324 - RNA, 22 nt, Human
aaugcaaagcaagcagagauuu

SEQ ID NO: 860325 - RNA, 22 nt, Human
ucccaggaauugaagccagugu

SEQ ID NO: 860326 - RNA, 22 nt, Human
uacccaggaggaaacugaggcu

SEQ ID NO: 860327 - RNA, 21 nt, Human
uucaaaaugguguguuugucu

SEQ ID NO: 860328 - RNA, 22 nt, Human
gcauaauauacaugcuugaucc

SEQ ID NO: 860329 - RNA, 22 nt, Human
gaggccaaguuggagaccaggu

SEQ ID NO: 860330 - RNA, 22 nt, Human
guagaaaugguguguuucuucu

SEQ ID NO: 860331 - RNA, 22 nt, Human
gaaaauagcagauagaccaaug

SEQ ID NO: 860332 - RNA, 22 nt, Human
ggauuuccucuugacucuaaag

SEQ ID NO: 860333 - RNA, 20 nt, Human
aggcagcuggccaggcaggu

SEQ ID NO: 860334 - RNA, 22 nt, Human
uuuacagaaugucaauuucuau

SEQ ID NO: 860335 - RNA, 22 nt, Human
gaucauuugcaggaaacauuaa

SEQ ID NO: 860336 - RNA, 23 nt, Human
accaggaguugucucaggaaaca

SEQ ID NO: 860337 - RNA, 22 nt, Human
auuuucagagacaucuggacuu

SEQ ID NO: 860338 - RNA, 22 nt, Human
gucaggaugagggaugaggagu

SEQ ID NO: 860339 - RNA, 22 nt, Human
acagaauugaaaguauaaucug

SEQ ID NO: 860340 - RNA, 22 nt, Human
cauuaaaauaucucaugguguu

SEQ ID NO: 860341 - RNA, 22 nt, Human
auagaauuugcacuaaaucugc

SEQ ID NO: 860342 - RNA, 22 nt, Human
uacuuguagcagguggcauuua

SEQ ID NO: 860343 - RNA, 22 nt, Human
ccugcugugaccggggagcagg

SEQ ID NO: 860344 - RNA, 22 nt, Human
caggaggggguggaguuucgcc

SEQ ID NO: 860345 - RNA, 22 nt, Human
aaauugcauuuuaaagguagau

SEQ ID NO: 860346 - RNA, 22 nt, Human
aguuauuacucuuuaacauauu

SEQ ID NO: 860347 - RNA, 22 nt, Human
aaccauuugccauuaucuuaag

SEQ ID NO: 860348 - RNA, 19 nt, Human
aggcaggugcagagguccc

SEQ ID NO: 860349 - RNA, 22 nt, Human
augaauaaguaaacuccuuugg

SEQ ID NO: 860350 - RNA, 22 nt, Human
ucaggagagagaaauuggggcu

SEQ ID NO: 860351 - RNA, 22 nt, Human
acauuucuaguuguucaucucc

SEQ ID NO: 860352 - RNA, 22 nt, Human
cagaggcagugggguugcuccu

SEQ ID NO: 860353 - RNA, 22 nt, Human
ucuuugcaaauguuauuaucuu

SEQ ID NO: 860354 - RNA, 22 nt, Human
uguguucuggaaagcucacuga

SEQ ID NO: 860355 - RNA, 22 nt, Human
acccaggagagagcuauaaaau

SEQ ID NO: 860356 - RNA, 22 nt, Human
ucaguaaaguucuuucuugcug

SEQ ID NO: 860357 - RNA, 22 nt, Human
aaagaaucagaagucucaaaca

SEQ ID NO: 860358 - RNA, 22 nt, Human
gcaggcaguuauuuaguagaau

SEQ ID NO: 860359 - RNA, 22 nt, Human
uuccucuagcuucucacuaaca

SEQ ID NO: 860360 - RNA, 22 nt, Human
ucaaauaaugccauucaucauc

SEQ ID NO: 860361 - RNA, 22 nt, Human
caggauggucucgaucuccuga

SEQ ID NO: 860362 - RNA, 22 nt, Human
acaaagucaaauugcagccgcc

SEQ ID NO: 860363 - RNA, 22 nt, Human
uaaguccuagcuuugguaggaa

SEQ ID NO: 860364 - RNA, 20 nt, Human
uuucaagucagcaauucuca

SEQ ID NO: 860365 - RNA, 22 nt, Human
aauuauauuguggugugaaugu

SEQ ID NO: 860366 - RNA, 22 nt, Human
uauccaaaguuucucagaaacu

SEQ ID NO: 860367 - RNA, 22 nt, Human
auuaggcagugccauuguacgg

SEQ ID NO: 860368 - RNA, 22 nt, Human
auucauaaguaaaugauuaccu

SEQ ID NO: 860369 - RNA, 22 nt, Human
auucuucauuuacuguuacuug

SEQ ID NO: 860370 - RNA, 20 nt, Human
guaaaauauggucuuugggu

SEQ ID NO: 860371 - RNA, 20 nt, Human
acaggagaucugaggaaagg

SEQ ID NO: 860372 - RNA, 22 nt, Human
aggcagacugugcgggaagagu

SEQ ID NO: 860373 - RNA, 22 nt, Human
aguucucaagacaauuaccugu

SEQ ID NO: 860374 - RNA, 22 nt, Human
gaggccaggggccuggagauga

SEQ ID NO: 860375 - RNA, 22 nt, Human
cuaauuauguuguuauaaucaa

SEQ ID NO: 860376 - RNA, 22 nt, Human
uuccacaauguaugaauaagau

SEQ ID NO: 860377 - RNA, 22 nt, Human
aggcagaucacuugaggccagg

SEQ ID NO: 860378 - RNA, 22 nt, Human
caggagaaauguggcugcuacc

SEQ ID NO: 860379 - RNA, 22 nt, Human
gaagaggaugacaggagccggu

SEQ ID NO: 860380 - RNA, 22 nt, Human
ugaaagggguugaguuacagcu

SEQ ID NO: 860381 - RNA, 22 nt, Human
aguuauaugugaaaacacguau

SEQ ID NO: 860382 - RNA, 22 nt, Human
aauauaaugcuguuuuaugcca

SEQ ID NO: 860383 - RNA, 22 nt, Human
acagaaauaacuuuuuauguuu

SEQ ID NO: 860384 - RNA, 22 nt, Human
auggcauuccaagucuucuuuu

SEQ ID NO: 860385 - RNA, 22 nt, Human
ugaagaaucccagggaauuugg

SEQ ID NO: 860386 - RNA, 22 nt, Human
uggcagcugaggggaggcuuug

SEQ ID NO: 860387 - RNA, 22 nt, Human
gaguccuuggcaucaucaguac

SEQ ID NO: 860388 - RNA, 22 nt, Human
aagagaggacauggugaaccug

SEQ ID NO: 860389 - RNA, 22 nt, Human
caauuucaagauucuguucuuu

SEQ ID NO: 860390 - RNA, 22 nt, Human
aagcagaguccccuucccaugg

SEQ ID NO: 860391 - RNA, 22 nt, Human
uugauagguuuuauguauaguu

SEQ ID NO: 860392 - RNA, 22 nt, Human
cugacccauauaagaguggagg

SEQ ID NO: 860393 - RNA, 22 nt, Human
aucuaaacagguguucuuuaga

SEQ ID NO: 860394 - RNA, 22 nt, Human
aaagaaggggucuacauccaau

SEQ ID NO: 860395 - RNA, 16 nt, Human
cuuccucuucacuggc

SEQ ID NO: 860396 - RNA, 22 nt, Human
ggccagagaauaugccuuacgu

SEQ ID NO: 860397 - RNA, 22 nt, Human
caaguccuaaauguauuuguug

SEQ ID NO: 860398 - RNA, 22 nt, Human
ccagaucuaaguccaaaguacu

SEQ ID NO: 860399 - RNA, 22 nt, Human
aucacaaaggucucagagcaca

SEQ ID NO: 860400 - RNA, 22 nt, Human
uggcauuuuguucaguauaugg

SEQ ID NO: 860401 - RNA, 22 nt, Human
aagcaccuggguuauaucuuag

SEQ ID NO: 860402 - RNA, 22 nt, Human
uucuaugccauguucagcuacu

SEQ ID NO: 860403 - RNA, 22 nt, Human
ccaggagaugggaaaguagcag

SEQ ID NO: 860404 - RNA, 23 nt, Human
caguggagacucaugcuuccuua

SEQ ID NO: 860405 - RNA, 22 nt, Human
gaggcagcaucuauggugggaa

SEQ ID NO: 860406 - RNA, 22 nt, Human
gaaaggcaguacagcugagccu

SEQ ID NO: 860407 - RNA, 22 nt, Human
guuuaauaauguugaauuacua

SEQ ID NO: 860408 - RNA, 22 nt, Human
ucucaagaucucaagauggccc

SEQ ID NO: 860409 - RNA, 22 nt, Human
gaaggccacuuuguguugagaa

SEQ ID NO: 860410 - RNA, 22 nt, Human
agccagcugugggcucaggcgg

SEQ ID NO: 860411 - RNA, 22 nt, Human
gguggagcuggaccaggagagg

SEQ ID NO: 860412 - RNA, 22 nt, Human
cucuucuugccugaugaggcag

SEQ ID NO: 860413 - RNA, 22 nt, Human
gaaguccucaaugcauugucuu

SEQ ID NO: 860414 - RNA, 22 nt, Human
aaugucugccagaacugaucau

SEQ ID NO: 860415 - RNA, 22 nt, Human
ugaggcagguggauuacaaggu

SEQ ID NO: 860416 - RNA, 22 nt, Human
caaagcaccacaaaccagguga

SEQ ID NO: 860417 - RNA, 22 nt, Human
gaugaaaaaagacgagcauaua

SEQ ID NO: 860418 - RNA, 22 nt, Human
agcuggcagucauccuagugag

SEQ ID NO: 860419 - RNA, 22 nt, Human
acaugcuuuaacuuauuuugau

SEQ ID NO: 860420 - RNA, 22 nt, Human
aauauuaucaaaagcuuuuuca

SEQ ID NO: 860421 - RNA, 22 nt, Human
auauacaaagggcaaccucgcu

SEQ ID NO: 860422 - RNA, 22 nt, Human
gcucccagcaauugaggcagcc

SEQ ID NO: 860423 - RNA, 22 nt, Human
auucuacaacccaauaauaauu

SEQ ID NO: 860424 - RNA, 22 nt, Human
auuauucuuaugucaucauggc

SEQ ID NO: 860425 - RNA, 22 nt, Human
aggcaggcucaggcccaugcuu

SEQ ID NO: 860426 - RNA, 22 nt, Human
uuauucuuuaaacauauauguu

SEQ ID NO: 860427 - RNA, 19 nt, Human
cuucuggcccugagccacc

SEQ ID NO: 860428 - RNA, 22 nt, Human
uuguuuuaucuuucuacagacu

SEQ ID NO: 860429 - RNA, 22 nt, Human
augugaggcagcacggagauua

SEQ ID NO: 860430 - RNA, 22 nt, Human
caaacuggcuaugggaaucuug

SEQ ID NO: 860431 - RNA, 23 nt, Human
ggauuuaguggaugagcugagug

SEQ ID NO: 860432 - RNA, 22 nt, Human
caggaaugaggucguaaguguc

SEQ ID NO: 860433 - RNA, 22 nt, Human
ugcuuuggaucuauuugcugag

SEQ ID NO: 860434 - RNA, 22 nt, Human
caaagucagcugccagucccaa

SEQ ID NO: 860435 - RNA, 19 nt, Human
agccuggcuuugcucugcu

SEQ ID NO: 860436 - RNA, 22 nt, Human
agaaaugaaaccaaagccuaga

SEQ ID NO: 860437 - RNA, 22 nt, Human
ggagggacccacucuagaggug

SEQ ID NO: 860438 - RNA, 22 nt, Human
agagggagcccagucauagcug

SEQ ID NO: 860439 - RNA, 22 nt, Human
uucagaaaugaauauugguauu

SEQ ID NO: 860440 - RNA, 22 nt, Human
gcgcaggagccgcggagggccg

SEQ ID NO: 860441 - RNA, 22 nt, Human
aguagaauagauggauacuauu

SEQ ID NO: 860442 - RNA, 22 nt, Human
uuguccaaaguaacacaucuag

SEQ ID NO: 860443 - RNA, 22 nt, Human
uuucaaaccuacuuguauguuu

SEQ ID NO: 860444 - RNA, 22 nt, Human
cuauacagagcauccuuaacuu

SEQ ID NO: 860445 - RNA, 22 nt, Human
aauaauuagugggacagagaac

SEQ ID NO: 860446 - RNA, 22 nt, Human
ucuggcuuucauuuguuuaaag

SEQ ID NO: 860447 - RNA, 22 nt, Human
uauacuuuccugcaacuuugau

SEQ ID NO: 860448 - RNA, 22 nt, Human
uaucagaaaugccuuaaauugg

SEQ ID NO: 860449 - RNA, 22 nt, Human
ccaggagagcgcccucccggcc

SEQ ID NO: 860450 - RNA, 22 nt, Human
aaggcagccuuuugaguugauu

SEQ ID NO: 860451 - RNA, 22 nt, Human
uuuaggcaugcaguucuauuua

SEQ ID NO: 860452 - RNA, 22 nt, Human
gaaggccaagaggcuccaagau

SEQ ID NO: 860453 - RNA, 22 nt, Human
agugagggaugaagaacugcgg

SEQ ID NO: 860454 - RNA, 22 nt, Human
gaucagaauuuacuuauaauug

SEQ ID NO: 860455 - RNA, 22 nt, Human
uaaacauggauucugaucacag

SEQ ID NO: 860456 - RNA, 22 nt, Human
caggcagcugacugucagauau

SEQ ID NO: 860457 - RNA, 23 nt, Human
aguaaagcaauuguuggcgagag

SEQ ID NO: 860458 - RNA, 22 nt, Human
caguuucuuggaugccaauuuc

SEQ ID NO: 860459 - RNA, 22 nt, Human
ucugggaaugaauaagaccugu

SEQ ID NO: 860460 - RNA, 22 nt, Human
ccagaauucagaaagggcauaa

SEQ ID NO: 860461 - RNA, 22 nt, Human
ucuuccaagguugcacacuauc

SEQ ID NO: 860462 - RNA, 22 nt, Human
uucaauucuaaacuaauauucu

SEQ ID NO: 860463 - RNA, 22 nt, Human
uuuuaucuucauuccuaucuac

SEQ ID NO: 860464 - RNA, 22 nt, Human
gggcagcuccuguggaauccac

SEQ ID NO: 860465 - RNA, 22 nt, Human
cugcugugccucuuuucacgug

SEQ ID NO: 860466 - RNA, 22 nt, Human
cauuuccacuucugaaaacugg

SEQ ID NO: 860467 - RNA, 22 nt, Human
uccuucuuucccccuagucauu

SEQ ID NO: 860468 - RNA, 22 nt, Human
uuucaggguacauggagcaaau

SEQ ID NO: 860469 - RNA, 22 nt, Human
ugaaggcccuaucuccauauac

SEQ ID NO: 860470 - RNA, 22 nt, Human
cauuuuaaaugauuuaagccaa

SEQ ID NO: 860471 - RNA, 22 nt, Human
uuaacacuccuaacuacagucu

SEQ ID NO: 860472 - RNA, 22 nt, Human
aaggcagcccuggcucagccug

SEQ ID NO: 860473 - RNA, 22 nt, Human
gagacaggauuuaaccaaagcu

SEQ ID NO: 860474 - RNA, 22 nt, Human
uugcugaaguuaaugcuugcaa

SEQ ID NO: 860475 - RNA, 22 nt, Human
uuuguuuacucauucauugaug

SEQ ID NO: 860476 - RNA, 22 nt, Human
gugguuuugccauuacaaguaa

SEQ ID NO: 860477 - RNA, 22 nt, Human
uccaggagggauugggcugugg

SEQ ID NO: 860478 - RNA, 21 nt, Human
ggcagcucagcagauggggac

SEQ ID NO: 860479 - RNA, 22 nt, Human
gagggccagcagccucagcaug

SEQ ID NO: 860480 - RNA, 22 nt, Human
agaggccagguccagaguuugu

SEQ ID NO: 860481 - RNA, 22 nt, Human
uuucuucacaggguauugggug

SEQ ID NO: 860482 - RNA, 22 nt, Human
aaugaaauguagcuuauccaua

SEQ ID NO: 860483 - RNA, 22 nt, Human
gaggcaucugggcacagaagug

SEQ ID NO: 860484 - RNA, 22 nt, Human
augcugugucaccuuaggauuu

SEQ ID NO: 860485 - RNA, 22 nt, Human
uuccaagaguaaauucaaauug

SEQ ID NO: 860486 - RNA, 22 nt, Human
uuaugauuugccacagauuggu

SEQ ID NO: 860487 - RNA, 22 nt, Human
cuucugugcuucacaguugcca

SEQ ID NO: 860488 - RNA, 22 nt, Human
cagcuucugucugauuagcaag

SEQ ID NO: 860489 - RNA, 22 nt, Human
uaaugucaaggugauagauuug

SEQ ID NO: 860490 - RNA, 22 nt, Human
auccaaacauguaccacacuaa

SEQ ID NO: 860491 - RNA, 22 nt, Human
auuuccagugcacugaauagaa

SEQ ID NO: 860492 - RNA, 22 nt, Human
ugcccaggguuucuaagagcag

SEQ ID NO: 860493 - RNA, 22 nt, Human
cacucaggcugugucaggagga

SEQ ID NO: 860494 - RNA, 22 nt, Human
aggcagccaucugcaggaagga

SEQ ID NO: 860495 - RNA, 22 nt, Human
ccccggaggcggagguugcagu

SEQ ID NO: 860496 - RNA, 22 nt, Human
cccaggaggcgcagguugcggu

SEQ ID NO: 860497 - RNA, 22 nt, Human
auacauauaugguacuuccugg

SEQ ID NO: 860498 - RNA, 22 nt, Human
cuauaauuaugcucaaaaugua

SEQ ID NO: 860499 - RNA, 21 nt, Human
uaauaauuccacuacagagua

SEQ ID NO: 860500 - RNA, 22 nt, Human
aucauuacuccuguaaaauugu

SEQ ID NO: 860501 - RNA, 22 nt, Human
ucaauaauggcaggauaaauuu

SEQ ID NO: 860502 - RNA, 22 nt, Human
uuccaugaaagugaaauggagc

SEQ ID NO: 860503 - RNA, 22 nt, Human
uacauaguauucacauuguuuu

SEQ ID NO: 860504 - RNA, 22 nt, Human
ucuggaucuccagcacuuauca

SEQ ID NO: 860505 - RNA, 22 nt, Human
ugaggcagcauucuucaagaca

SEQ ID NO: 860506 - RNA, 22 nt, Human
auacuguuucucuucuacauga

SEQ ID NO: 860507 - RNA, 22 nt, Human
ugaaggccuaacuuccagugcu

SEQ ID NO: 860508 - RNA, 22 nt, Human
agucaccaggguuugcuggguu

SEQ ID NO: 860509 - RNA, 22 nt, Human
uauggcuuuucauuccuaugug

SEQ ID NO: 860510 - RNA, 22 nt, Human
ucuuugaauccuuuacaucuga

SEQ ID NO: 860511 - RNA, 22 nt, Human
guuuaaucagaggaauuauaga

SEQ ID NO: 860512 - RNA, 22 nt, Human
augacaaaagaagacaugaggu

SEQ ID NO: 860513 - RNA, 22 nt, Human
auggaaagugcauggaagucau

SEQ ID NO: 860514 - RNA, 22 nt, Human
auuaggcagacaacguagccgg

SEQ ID NO: 860515 - RNA, 22 nt, Human
uuaauuaugcaaaaggccccau

SEQ ID NO: 860516 - RNA, 22 nt, Human
gacagcuguggagaggcaugug

SEQ ID NO: 860517 - RNA, 22 nt, Human
aggcaagcugcagagaguccuu

SEQ ID NO: 860518 - RNA, 22 nt, Human
ugucucaguacacuccgauguu

SEQ ID NO: 860519 - RNA, 22 nt, Human
cccaggagagaggccaguuggc

SEQ ID NO: 860520 - RNA, 22 nt, Human
uugaaaggugaacaugaugcac

SEQ ID NO: 860521 - RNA, 22 nt, Human
agaaaugcucaggucaacuuaa

SEQ ID NO: 860522 - RNA, 22 nt, Human
aauucuaaauguaauuuagaau

SEQ ID NO: 860523 - RNA, 22 nt, Human
uucauuaauucauucagugacu

SEQ ID NO: 860524 - RNA, 18 nt, Human
augggaggggccaagaga

SEQ ID NO: 860525 - RNA, 22 nt, Human
ccauuguaaauucuguggaagu

SEQ ID NO: 860526 - RNA, 22 nt, Human
cuucugugauuugguuaggaua

SEQ ID NO: 860527 - RNA, 22 nt, Human
gagcagcucugugccuggagac

SEQ ID NO: 860528 - RNA, 22 nt, Human
uuagaaaugcacccaagaccua

SEQ ID NO: 860529 - RNA, 22 nt, Human
gcauguuauguaucugcccagc

SEQ ID NO: 860530 - RNA, 22 nt, Human
ucaguucugcuagaaaaacagu

SEQ ID NO: 860531 - RNA, 17 nt, Human
agagagagcaugccacc

SEQ ID NO: 860532 - RNA, 22 nt, Human
gaucuguuucauucacagucug

SEQ ID NO: 860533 - RNA, 22 nt, Human
aggcaguuuaggcagcgauuua

SEQ ID NO: 860534 - RNA, 22 nt, Human
ugagacaaccuaauuaaacacc

SEQ ID NO: 860535 - RNA, 22 nt, Human
cugcugugcagacagacucucu

SEQ ID NO: 860536 - RNA, 22 nt, Human
ucacaaauagcuauauuaagga

SEQ ID NO: 860537 - RNA, 22 nt, Human
aaaccgcaauuacuuuugcguc

SEQ ID NO: 860538 - RNA, 22 nt, Human
ucauacaucuguccuggagcuc

SEQ ID NO: 860539 - RNA, 22 nt, Human
gagugucugaauuagagcacaa

SEQ ID NO: 860540 - RNA, 22 nt, Human
auuaggcauuauggggauaagg

SEQ ID NO: 860541 - RNA, 22 nt, Human
gucuucuuguuuugaaggaaau

SEQ ID NO: 860542 - RNA, 22 nt, Human
aggcaguuuauccccagagccu

SEQ ID NO: 860543 - RNA, 22 nt, Human
aagaaugagcucaaagaucuua

SEQ ID NO: 860544 - RNA, 22 nt, Human
uugagaagaauguguugaguuu

SEQ ID NO: 860545 - RNA, 22 nt, Human
cugguacaaaaugcugauauca

SEQ ID NO: 860546 - RNA, 22 nt, Human
aaaauugaagugaucaggaacu

SEQ ID NO: 860547 - RNA, 22 nt, Human
ugaaaggugacauuucuuggau

SEQ ID NO: 860548 - RNA, 22 nt, Human
uggaaggaagccaaggaagguu

SEQ ID NO: 860549 - RNA, 22 nt, Human
aaucagaaucaguugacacagc

SEQ ID NO: 860550 - RNA, 22 nt, Human
cuggaguuagaguagacacuga

SEQ ID NO: 860551 - RNA, 23 nt, Human
cuugcagggcuggaggcuuagaa

SEQ ID NO: 860552 - RNA, 22 nt, Human
uaaaaguauacuuucaaaggag

SEQ ID NO: 860553 - RNA, 22 nt, Human
auccaugaucaauuuauuacua

SEQ ID NO: 860554 - RNA, 22 nt, Human
gaggcagcuggguccggucggg

SEQ ID NO: 860555 - RNA, 22 nt, Human
gagagggauacugaguuuuggu

SEQ ID NO: 860556 - RNA, 22 nt, Human
acauaauagguaccugaauaau

SEQ ID NO: 860557 - RNA, 22 nt, Human
aggaaagguagcgugccagcag

SEQ ID NO: 860558 - RNA, 20 nt, Human
uauggcuuggcaaagcuuca

SEQ ID NO: 860559 - RNA, 22 nt, Human
uuucaacauauaccauaaugcc

SEQ ID NO: 860560 - RNA, 22 nt, Human
gaggccagggaugcaaugagag

SEQ ID NO: 860561 - RNA, 22 nt, Human
uccaggagugauaaggccacug

SEQ ID NO: 860562 - RNA, 22 nt, Human
caugcuuuuuucuaguauaaau

SEQ ID NO: 860563 - RNA, 22 nt, Human
guuaggcaauaccucuuacacc

SEQ ID NO: 860564 - RNA, 22 nt, Human
uuauuacacugaaagaauugcg

SEQ ID NO: 860565 - RNA, 22 nt, Human
uauugaugcuuggauugggcca

SEQ ID NO: 860566 - RNA, 22 nt, Human
cuuuggcaaugucauuuucaau

SEQ ID NO: 860567 - RNA, 22 nt, Human
guuguuuuuguucucuauagcu

SEQ ID NO: 860568 - RNA, 22 nt, Human
cccaggaugucgaggcugcagu

SEQ ID NO: 860569 - RNA, 22 nt, Human
agagagcauugaggaaaucuuc

SEQ ID NO: 860570 - RNA, 22 nt, Human
uuaauucuaguuuaacacuuag

SEQ ID NO: 860571 - RNA, 22 nt, Human
agggagcuucuggccucagccu

SEQ ID NO: 860572 - RNA, 22 nt, Human
cuuagaaaucgaacucagguua

SEQ ID NO: 860573 - RNA, 22 nt, Human
uuuaaauuuagaagaaacacug

SEQ ID NO: 860574 - RNA, 22 nt, Human
aggcaguggagcuggaauaggc

SEQ ID NO: 860575 - RNA, 22 nt, Human
caguccuugcucaaagucuaca

SEQ ID NO: 860576 - RNA, 22 nt, Human
uuucaagaacaacauucauuca

SEQ ID NO: 860577 - RNA, 22 nt, Human
uaagaaucugcauuuuaacaag

SEQ ID NO: 860578 - RNA, 20 nt, Human
aggaagcugagauguagagg

SEQ ID NO: 860579 - RNA, 22 nt, Human
ccccaggacacauggaccaagu

SEQ ID NO: 860580 - RNA, 22 nt, Human
uaauuucaauagcuugcauaau

SEQ ID NO: 860581 - RNA, 22 nt, Human
uggaaggagacugggaagugug

SEQ ID NO: 860582 - RNA, 22 nt, Human
aauacaguaauuuugaugaguu

SEQ ID NO: 860583 - RNA, 22 nt, Human
uaugaaaauuuagcugaagcau

SEQ ID NO: 860584 - RNA, 22 nt, Human
aggcagugcaugcaaaggucgg

SEQ ID NO: 860585 - RNA, 22 nt, Human
ucugggaacugagcuccccuag

SEQ ID NO: 860586 - RNA, 20 nt, Human
guaaugaauguaaacaguaa

SEQ ID NO: 860587 - RNA, 22 nt, Human
auggcauuugaccgcuuugugg

SEQ ID NO: 860588 - RNA, 22 nt, Human
gcagaggauagcauaugaaccu

SEQ ID NO: 860589 - RNA, 22 nt, Human
ucagaauugucuggggaauguu

SEQ ID NO: 860590 - RNA, 22 nt, Human
agagugucugguagcugcucug

SEQ ID NO: 860591 - RNA, 22 nt, Human
guacagaaaguacccauagaag

SEQ ID NO: 860592 - RNA, 22 nt, Human
auuuguagugaagugaaaauaa

SEQ ID NO: 860593 - RNA, 22 nt, Human
cugcuguguggauucaauggcu

SEQ ID NO: 860594 - RNA, 22 nt, Human
uaaaguuuguagcaauugauau

SEQ ID NO: 860595 - RNA, 22 nt, Human
uauccaaaggaacaaucacagc

SEQ ID NO: 860596 - RNA, 17 nt, Human
acucaggaucugggagu

SEQ ID NO: 860597 - RNA, 22 nt, Human
gcccaggagguggaggugcagu

SEQ ID NO: 860598 - RNA, 22 nt, Human
gcuauacaaguguagaauagag

SEQ ID NO: 860599 - RNA, 22 nt, Human
ucuauacacacaaagaaugcuu

SEQ ID NO: 860600 - RNA, 22 nt, Human
aauauaugugguauugaccagc

SEQ ID NO: 860601 - RNA, 22 nt, Human
ggcuuugccuggaauuuccuug

SEQ ID NO: 860602 - RNA, 22 nt, Human
gguggaaggccuggaaggaggc

SEQ ID NO: 860603 - RNA, 20 nt, Human
cugcugugauucccuccucc

SEQ ID NO: 860604 - RNA, 22 nt, Human
ucaggagaguguucaguggagg

SEQ ID NO: 860605 - RNA, 22 nt, Human
uguaacaauuucuuacuauugu

SEQ ID NO: 860606 - RNA, 22 nt, Human
guugacagcuggugagcugcua

SEQ ID NO: 860607 - RNA, 22 nt, Human
agacucaagcagauaggaauua

SEQ ID NO: 860608 - RNA, 20 nt, Human
ggcagcuugggcagcaguua

SEQ ID NO: 860609 - RNA, 22 nt, Human
cugugcagcuggcuuccuggaa

SEQ ID NO: 860610 - RNA, 22 nt, Human
uaauacuuuugccuuguauuca

SEQ ID NO: 860611 - RNA, 22 nt, Human
guaaacauuuucaucugugccc

SEQ ID NO: 860612 - RNA, 19 nt, Human
gaaguccucuaguaaauuu

SEQ ID NO: 860613 - RNA, 22 nt, Human
uagaaaucagcaggcauaugua

SEQ ID NO: 860614 - RNA, 22 nt, Human
auguuucaccaguuuuauaaga

SEQ ID NO: 860615 - RNA, 22 nt, Human
acugcuuuaucugagaaguccu

SEQ ID NO: 860616 - RNA, 22 nt, Human
uuucaguuuccagcuuugucau

SEQ ID NO: 860617 - RNA, 22 nt, Human
aagcuggagaguuaggugaaua

SEQ ID NO: 860618 - RNA, 23 nt, Human
uugcacauuggagcuggucuucu

SEQ ID NO: 860619 - RNA, 22 nt, Human
uucuuauagaagcaaccauugu

SEQ ID NO: 860620 - RNA, 22 nt, Human
caacugcugacaccaucacucc

SEQ ID NO: 860621 - RNA, 22 nt, Human
auuuucaaaacaucugcugugu

SEQ ID NO: 860622 - RNA, 22 nt, Human
aguucacauaucuguuuuauuu

SEQ ID NO: 860623 - RNA, 22 nt, Human
ccagguaggagagagggauccu

SEQ ID NO: 860624 - RNA, 22 nt, Human
aagucacccacaggcagcagaa

SEQ ID NO: 860625 - RNA, 22 nt, Human
auugauggcggccucuccauau

SEQ ID NO: 860626 - RNA, 22 nt, Human
uauacagaaagaauucaagucu

SEQ ID NO: 860627 - RNA, 22 nt, Human
ugcugcuguauccuuaguguca

SEQ ID NO: 860628 - RNA, 16 nt, Human
ccuggauccccugugg

SEQ ID NO: 860629 - RNA, 22 nt, Human
uaagaaucgauguuuauuuaga

SEQ ID NO: 860630 - RNA, 22 nt, Human
ugucauaacuuagugacaaauc

SEQ ID NO: 860631 - RNA, 22 nt, Human
aguccagugaacuguaaauagg

SEQ ID NO: 860632 - RNA, 22 nt, Human
uugauggcugugauuuacucag

SEQ ID NO: 860633 - RNA, 22 nt, Human
aguaaagcagaguugcaguaca

SEQ ID NO: 860634 - RNA, 22 nt, Human
auaucaaacgaaguuauuuuaa

SEQ ID NO: 860635 - RNA, 22 nt, Human
ugaauaauuccuuuuugucaag

SEQ ID NO: 860636 - RNA, 22 nt, Human
ugucaccaugccagcuucugcc

SEQ ID NO: 860637 - RNA, 22 nt, Human
uuucuaggucuuccauacugcc

SEQ ID NO: 860638 - RNA, 22 nt, Human
auuucucuuagcaagacauuac

SEQ ID NO: 860639 - RNA, 22 nt, Human
acugccauuggucaaaugagug

SEQ ID NO: 860640 - RNA, 22 nt, Human
cauuguuaccaucuuuuaccua

SEQ ID NO: 860641 - RNA, 22 nt, Human
aauugcaauuuucuuaaggucu

SEQ ID NO: 860642 - RNA, 22 nt, Human
aggcagcuuucagugucucuca

SEQ ID NO: 860643 - RNA, 22 nt, Human
ucugcaggaggcuggcugcagg

SEQ ID NO: 860644 - RNA, 22 nt, Human
ucagagagccucaggcacugcc

SEQ ID NO: 860645 - RNA, 22 nt, Human
cugcccaggaaccagaggggca

SEQ ID NO: 860646 - RNA, 22 nt, Human
aggugagggugccagugcaugg

SEQ ID NO: 860647 - RNA, 22 nt, Human
agggaagcuuguuacugagaag

SEQ ID NO: 860648 - RNA, 18 nt, Human
aggcaggcuggagugacu

SEQ ID NO: 860649 - RNA, 22 nt, Human
uugcauuugagaaaguucuccu

SEQ ID NO: 860650 - RNA, 22 nt, Human
ggaggcagaacuucccgucagu

SEQ ID NO: 860651 - RNA, 22 nt, Human
aauaucaacaguguccuucuaa

SEQ ID NO: 860652 - RNA, 22 nt, Human
ggcaugcugcguacagaugaac

SEQ ID NO: 860653 - RNA, 22 nt, Human
ugaggcaggaggauugcaggau

SEQ ID NO: 860654 - RNA, 22 nt, Human
auggcuuuccugggacaugggc

SEQ ID NO: 860655 - RNA, 17 nt, Human
gcugacccuggagaagu

SEQ ID NO: 860656 - RNA, 22 nt, Human
ggugagggaguggaacgaggug

SEQ ID NO: 860657 - RNA, 22 nt, Human
uguccauggauagagcugcucg

SEQ ID NO: 860658 - RNA, 22 nt, Human
uggggcuccuccuggcaggagg

SEQ ID NO: 860659 - RNA, 23 nt, Human
gugagucuugccuuugcugugga

SEQ ID NO: 860660 - RNA, 22 nt, Human
ucuucagaggaagucagucuuu

SEQ ID NO: 860661 - RNA, 22 nt, Human
cauuuguaggaugcuucuuguu

SEQ ID NO: 860662 - RNA, 22 nt, Human
uugcugaaaacaguggguauug

SEQ ID NO: 860663 - RNA, 22 nt, Human
agccagcuguucuggggcagca

SEQ ID NO: 860664 - RNA, 19 nt, Human
cagaaauagcgaaguguaa

SEQ ID NO: 860665 - RNA, 22 nt, Human
auacagaauucacuacaguuuc

SEQ ID NO: 860666 - RNA, 22 nt, Human
cucuuaguaaugccaugaagca

SEQ ID NO: 860667 - RNA, 22 nt, Human
caucagaauuacuuggggagcu

SEQ ID NO: 860668 - RNA, 21 nt, Human
ggacagcugcgcgcagggcuc

SEQ ID NO: 860669 - RNA, 22 nt, Human
gagucaccuuggccgcuguccc

SEQ ID NO: 860670 - RNA, 22 nt, Human
ccaggaaauggcuugcuucuuu

SEQ ID NO: 860671 - RNA, 22 nt, Human
cuggcuuuaacccuacaaaccu

SEQ ID NO: 860672 - RNA, 22 nt, Human
aagaaaucugauauuuguuuca

SEQ ID NO: 860673 - RNA, 22 nt, Human
ggaucugauuaauaagguggac

SEQ ID NO: 860674 - RNA, 22 nt, Human
aaacaaacauagguuugaaagu

SEQ ID NO: 860675 - RNA, 22 nt, Human
ggugguggagccagcugggagu

SEQ ID NO: 860676 - RNA, 22 nt, Human
ugaaucaguauaaauucucaaa

SEQ ID NO: 860677 - RNA, 22 nt, Human
auaaaaguucaagagaguacag

SEQ ID NO: 860678 - RNA, 22 nt, Human
ugcuuugggucucucuaguuuc

SEQ ID NO: 860679 - RNA, 22 nt, Human
caggaugagaagggcucuuacg

SEQ ID NO: 860680 - RNA, 22 nt, Human
acacauuucucuuuuuguaagu

SEQ ID NO: 860681 - RNA, 22 nt, Human
acccaggaugauaauguucaca

SEQ ID NO: 860682 - RNA, 17 nt, Human
ugauaguucauuuuaag

SEQ ID NO: 860683 - RNA, 22 nt, Human
aaggcagcaccgccuccugaaa

SEQ ID NO: 860684 - RNA, 22 nt, Human
guagccauuggcaaugaagccu

SEQ ID NO: 860685 - RNA, 22 nt, Human
gucaggauuauuuuauuaaaag

SEQ ID NO: 860686 - RNA, 22 nt, Human
ugaaauagacacagugcuauac

SEQ ID NO: 860687 - RNA, 17 nt, Human
uaaagccagucaaguca

SEQ ID NO: 860688 - RNA, 22 nt, Human
uggcagcugugcuucauucuuu

SEQ ID NO: 860689 - RNA, 22 nt, Human
ccaagaugaucuuuacaguguu

SEQ ID NO: 860690 - RNA, 22 nt, Human
ggugaagguggaacgcagagca

SEQ ID NO: 860691 - RNA, 22 nt, Human
aaaggugacacucugccagcug

SEQ ID NO: 860692 - RNA, 22 nt, Human
caugguuuugagccuauuaugc

SEQ ID NO: 860693 - RNA, 22 nt, Human
uacugcaugguggaguggagcu

SEQ ID NO: 860694 - RNA, 22 nt, Human
uauuucaagaacuucuauccau

SEQ ID NO: 860695 - RNA, 22 nt, Human
uccuuagagacaagaccaguuu

SEQ ID NO: 860696 - RNA, 22 nt, Human
uuucagacagauucuucucagu

SEQ ID NO: 860697 - RNA, 22 nt, Human
ucaggaugaccacgagccucua

SEQ ID NO: 860698 - RNA, 22 nt, Human
aauucucagguaaaaguuaagu

SEQ ID NO: 860699 - RNA, 19 nt, Human
uucaggauugacccuacug

SEQ ID NO: 860700 - RNA, 22 nt, Human
uguuugaauuuugcuaacgugu

SEQ ID NO: 860701 - RNA, 22 nt, Human
cccaggaggcagauguugcagu

SEQ ID NO: 860702 - RNA, 22 nt, Human
aggacagggauucaaacuccca

SEQ ID NO: 860703 - RNA, 22 nt, Human
augaaauaucuugaagaaauuc

SEQ ID NO: 860704 - RNA, 22 nt, Human
gaaggccauugcguccugggau

SEQ ID NO: 860705 - RNA, 22 nt, Human
aacaucuacuaagugccaggca

SEQ ID NO: 860706 - RNA, 22 nt, Human
caaauguaaauucuuuugaagc

SEQ ID NO: 860707 - RNA, 17 nt, Human
uagcuguguuucagcua

SEQ ID NO: 860708 - RNA, 22 nt, Human
uguguacacagauaguaauggc

SEQ ID NO: 860709 - RNA, 22 nt, Human
ccaggcugggcuacaaguugag

SEQ ID NO: 860710 - RNA, 22 nt, Human
cccaggaggacauuccauaccc

SEQ ID NO: 860711 - RNA, 21 nt, Human
aucauucuggaaaauucaagc

SEQ ID NO: 860712 - RNA, 22 nt, Human
gaggcagaaguugcagugagca

SEQ ID NO: 860713 - RNA, 22 nt, Human
gcuggauccugauucgucuuug

SEQ ID NO: 860714 - RNA, 22 nt, Human
auauuaaauggauuuugggagc

SEQ ID NO: 860715 - RNA, 22 nt, Human
gucagagagggcacgugcacac

SEQ ID NO: 860716 - RNA, 22 nt, Human
uggauuagguacuaugaauaua

SEQ ID NO: 860717 - RNA, 22 nt, Human
cuugcuucauuagugucuuagu

SEQ ID NO: 860718 - RNA, 22 nt, Human
agccauuuuccugaaauauaac

SEQ ID NO: 860719 - RNA, 22 nt, Human
uuggcaggaauauugcagaggu

SEQ ID NO: 860720 - RNA, 22 nt, Human
gucaggauuugaacucaggucu

SEQ ID NO: 860721 - RNA, 22 nt, Human
ggcagaggaggggugaauuugc

SEQ ID NO: 860722 - RNA, 22 nt, Human
uucagaaacccauugggucucu

SEQ ID NO: 860723 - RNA, 22 nt, Human
ucugcaggcuguacaggaagca

SEQ ID NO: 860724 - RNA, 22 nt, Human
ucccaggaugugcgugccgccg

SEQ ID NO: 860725 - RNA, 19 nt, Human
uuccaaaaucaggauuuga

SEQ ID NO: 860726 - RNA, 22 nt, Human
uaaagucaucuuuacaucuuug

SEQ ID NO: 860727 - RNA, 22 nt, Human
ugacccauggucugaucauagg

SEQ ID NO: 860728 - RNA, 22 nt, Human
uucagaaaaagaccauugcaau

SEQ ID NO: 860729 - RNA, 22 nt, Human
uuaauaaacaggugcagcugaa

SEQ ID NO: 860730 - RNA, 22 nt, Human
agagagagggaaacugcuaaac

SEQ ID NO: 860731 - RNA, 20 nt, Human
ccagaagagaugaucaucca

SEQ ID NO: 860732 - RNA, 22 nt, Human
aagauaaacucuugauuucuga

SEQ ID NO: 860733 - RNA, 22 nt, Human
uuuaaauggcauuuucccagau

SEQ ID NO: 860734 - RNA, 22 nt, Human
ugaggcaguugagcuuccugag

SEQ ID NO: 860735 - RNA, 22 nt, Human
gugcugugugauccaugcuggc

SEQ ID NO: 860736 - RNA, 22 nt, Human
uuuaaauuauaguuaaugucug

SEQ ID NO: 860737 - RNA, 22 nt, Human
aaaaagguugauccagauuagg

SEQ ID NO: 860738 - RNA, 22 nt, Human
ggagaggagauuguggcauuuu

SEQ ID NO: 860739 - RNA, 22 nt, Human
uagcuuuccuuguugccugugc

SEQ ID NO: 860740 - RNA, 22 nt, Human
cagaguucaaagccugcuggga

SEQ ID NO: 860741 - RNA, 19 nt, Human
ugagaggcuuaaggcagcu

SEQ ID NO: 860742 - RNA, 22 nt, Human
auucuucacaaauauauagaag

SEQ ID NO: 860743 - RNA, 22 nt, Human
aucacaaaggcugcuucaugau

SEQ ID NO: 860744 - RNA, 22 nt, Human
uuauucuucuucucuugccagg

SEQ ID NO: 860745 - RNA, 22 nt, Human
cagucuucuaaccuagcagccu

SEQ ID NO: 860746 - RNA, 22 nt, Human
auacacauguguaugugcaugc

SEQ ID NO: 860747 - RNA, 22 nt, Human
agccuuguuggucugaguuugg

SEQ ID NO: 860748 - RNA, 22 nt, Human
uaaggccauuauggugggcccg

SEQ ID NO: 860749 - RNA, 23 nt, Human
agggugagcaagcuauggagacc

SEQ ID NO: 860750 - RNA, 22 nt, Human
ucucagucuuugcaaggaugcu

SEQ ID NO: 860751 - RNA, 22 nt, Human
ugcuguggcaguuuauguauag

SEQ ID NO: 860752 - RNA, 22 nt, Human
caaauguauucucacuucaggg

SEQ ID NO: 860753 - RNA, 22 nt, Human
uuucacuagaacguucuuguuu

SEQ ID NO: 860754 - RNA, 22 nt, Human
acaacaaagacacuugaaauga

SEQ ID NO: 860755 - RNA, 22 nt, Human
uaauacagaaguguauuaaaau

SEQ ID NO: 860756 - RNA, 22 nt, Human
ugucaccacauuugucaauauc

SEQ ID NO: 860757 - RNA, 22 nt, Human
uuugagauggagucuugcucug

SEQ ID NO: 860758 - RNA, 22 nt, Human
cuugcaggauuuugcugcugua

SEQ ID NO: 860759 - RNA, 22 nt, Human
uccaaauacauuuacuguauuu

SEQ ID NO: 860760 - RNA, 22 nt, Human
cucaggauguacuacagaaggc

SEQ ID NO: 860761 - RNA, 22 nt, Human
ucucugaguauccugaacugcc

SEQ ID NO: 860762 - RNA, 22 nt, Human
gcuggcaggagccuuucccuuu

SEQ ID NO: 860763 - RNA, 21 nt, Human
uucugggaaaugagcuggggc

SEQ ID NO: 860764 - RNA, 22 nt, Human
acaaagaucuugcuuuccuacu

SEQ ID NO: 860765 - RNA, 22 nt, Human
ucacaauuuggauacagcuaug

SEQ ID NO: 860766 - RNA, 22 nt, Human
gucuucuuuucagucugcuugu

SEQ ID NO: 860767 - RNA, 22 nt, Human
ggcaggcucagcagccaaggag

SEQ ID NO: 860768 - RNA, 22 nt, Human
uuucuucagagagagcuuuccc

SEQ ID NO: 860769 - RNA, 22 nt, Human
ugaggcagugauguuuaagcac

SEQ ID NO: 860770 - RNA, 22 nt, Human
gauggcuuugugcaccaugauu

SEQ ID NO: 860771 - RNA, 23 nt, Human
ucucuuucaagagcuuaaugugc

SEQ ID NO: 860772 - RNA, 22 nt, Human
gauuuuauauggcauacugugg

SEQ ID NO: 860773 - RNA, 22 nt, Human
ucccaggacccaggcauucaca

SEQ ID NO: 860774 - RNA, 20 nt, Human
uuugucuguuaaguguuucu

SEQ ID NO: 860775 - RNA, 22 nt, Human
auggcuuugcucaaguuuagcc

SEQ ID NO: 860776 - RNA, 22 nt, Human
ugguaauuuacgcauuucugua

SEQ ID NO: 860777 - RNA, 22 nt, Human
caaguaaacaauaugugauuca

SEQ ID NO: 860778 - RNA, 22 nt, Human
gugucccaggccucuggaauua

SEQ ID NO: 860779 - RNA, 23 nt, Human
agaugagccaacaccuccaugcc

SEQ ID NO: 860780 - RNA, 22 nt, Human
auuucauacuaaggcucaaaaa

SEQ ID NO: 860781 - RNA, 22 nt, Human
ggaggggauuuaguagaugcua

SEQ ID NO: 860782 - RNA, 22 nt, Human
acacauauucauauguacuuac

SEQ ID NO: 860783 - RNA, 22 nt, Human
guuuuucuuugugugaagacaa

SEQ ID NO: 860784 - RNA, 22 nt, Human
aucagcuuuucucaucagaaau

SEQ ID NO: 860785 - RNA, 22 nt, Human
aagaacuuccuaauauauuuuc

SEQ ID NO: 860786 - RNA, 22 nt, Human
uggguuuaaacucaacucuaaa

SEQ ID NO: 860787 - RNA, 22 nt, Human
gcucacugccauucucuagaug

SEQ ID NO: 860788 - RNA, 22 nt, Human
ugcuggaggauuaaacaaguca

SEQ ID NO: 860789 - RNA, 22 nt, Human
cugcuguguuucacaccucugg

SEQ ID NO: 860790 - RNA, 22 nt, Human
ucuggaucggguuccucagguc

SEQ ID NO: 860791 - RNA, 22 nt, Human
agcuacccgaggacaggcuaag

SEQ ID NO: 860792 - RNA, 22 nt, Human
ccucacugaagaggugacauuu

SEQ ID NO: 860793 - RNA, 22 nt, Human
auuucaacacuuuuggaauuag

SEQ ID NO: 860794 - RNA, 22 nt, Human
uggcagcugauuagauggugcc

SEQ ID NO: 860795 - RNA, 22 nt, Human
ugaguuuugucuugcuagaagu

SEQ ID NO: 860796 - RNA, 22 nt, Human
gaggaggcuuccgggaggcacg

SEQ ID NO: 860797 - RNA, 22 nt, Human
uucucugaaggccaugcucacu

SEQ ID NO: 860798 - RNA, 22 nt, Human
uagaugcuguagaaauacuuau

SEQ ID NO: 860799 - RNA, 18 nt, Human
ucuuuggacaacuacugg

SEQ ID NO: 860800 - RNA, 22 nt, Human
aaucauaauucaaauaagcuua

SEQ ID NO: 860801 - RNA, 22 nt, Human
agagugaaguuuuugaaaguga

SEQ ID NO: 860802 - RNA, 22 nt, Human
aguacaauuauauuuagauggu

SEQ ID NO: 860803 - RNA, 17 nt, Human
uggcagcugaaagcucu

SEQ ID NO: 860804 - RNA, 22 nt, Human
cccaggaggugugcccaacucg

SEQ ID NO: 860805 - RNA, 22 nt, Human
ggaggggucucuagcgaggaga

SEQ ID NO: 860806 - RNA, 22 nt, Human
uuuaggcagaagcccugcugau

SEQ ID NO: 860807 - RNA, 18 nt, Human
caauuucaauggucugaa

SEQ ID NO: 860808 - RNA, 22 nt, Human
cccuggaggcaaagguugcagu

SEQ ID NO: 860809 - RNA, 22 nt, Human
uaaagccaacacuuuacugcuc

SEQ ID NO: 860810 - RNA, 22 nt, Human
uuugaauaaucacugggcauua

SEQ ID NO: 860811 - RNA, 22 nt, Human
augcugugcuggcuaaccaugg

SEQ ID NO: 860812 - RNA, 22 nt, Human
uuucaugaggggcaaaaucuca

SEQ ID NO: 860813 - RNA, 22 nt, Human
uagggcagagcuuguacacgau

SEQ ID NO: 860814 - RNA, 22 nt, Human
uccaggagugugugcuaauggg

SEQ ID NO: 860815 - RNA, 22 nt, Human
uauaagaaacaaggcaaauuuu

SEQ ID NO: 860816 - RNA, 22 nt, Human
cucacugacgaggaagcugaga

SEQ ID NO: 860817 - RNA, 22 nt, Human
uucugaaccauugagcacugcc

SEQ ID NO: 860818 - RNA, 22 nt, Human
aacuggauuuaggaacagagaa

SEQ ID NO: 860819 - RNA, 22 nt, Human
gaggcauggccugaggcuagga

SEQ ID NO: 860820 - RNA, 22 nt, Human
ggccagcugggccaccaggugc

SEQ ID NO: 860821 - RNA, 16 nt, Human
gcaacuuugggguuga

SEQ ID NO: 860822 - RNA, 22 nt, Human
aguaaaauuaauggaucagaag

SEQ ID NO: 860823 - RNA, 22 nt, Human
gaggagagccugcacuuugacc

SEQ ID NO: 860824 - RNA, 22 nt, Human
cccaggaaugaggggcggaggc

SEQ ID NO: 860825 - RNA, 22 nt, Human
auuauccagcaccaaugucaga

SEQ ID NO: 860826 - RNA, 22 nt, Human
gaaagccaucuggcugcuggga

SEQ ID NO: 860827 - RNA, 22 nt, Human
uuagaaaugauuucaccucuuu

SEQ ID NO: 860828 - RNA, 18 nt, Human
caagaaucucuaaagaag

SEQ ID NO: 860829 - RNA, 22 nt, Human
ugguuuaauuuccauuuccuug

SEQ ID NO: 860830 - RNA, 22 nt, Human
agaggccaugcuagaggccugg

SEQ ID NO: 860831 - RNA, 22 nt, Human
uucauucugggcucuaaggaac

SEQ ID NO: 860832 - RNA, 21 nt, Human
aacugguucaauucaacuaga

SEQ ID NO: 860833 - RNA, 22 nt, Human
uuauacuuuauacuacaucauu

SEQ ID NO: 860834 - RNA, 22 nt, Human
aaucuagucuccuuaagucuuu

SEQ ID NO: 860835 - RNA, 21 nt, Human
aaugaaguggcuauuuugagg

SEQ ID NO: 860836 - RNA, 22 nt, Human
aacuagucagugauucucagaa

SEQ ID NO: 860837 - RNA, 22 nt, Human
ucuuaaagagcgcaauuugagg

SEQ ID NO: 860838 - RNA, 19 nt, Human
cucucacucgccacauccu

SEQ ID NO: 860839 - RNA, 21 nt, Human
cuugaaagguagagucuacag

SEQ ID NO: 860840 - RNA, 20 nt, Human
cagaggcaaggagacuugga

SEQ ID NO: 860841 - RNA, 22 nt, Human
uuuaacagaugugaaauuuuca

SEQ ID NO: 860842 - RNA, 22 nt, Human
uuccuuagccugccuuccaggg

SEQ ID NO: 860843 - RNA, 22 nt, Human
cauggauugaauauaaauuaga

SEQ ID NO: 860844 - RNA, 22 nt, Human
acccaggagccgugagagguua

SEQ ID NO: 860845 - RNA, 18 nt, Human
caugucugcgccacaagg

SEQ ID NO: 860846 - RNA, 22 nt, Human
ggaguaggaguagaacucauca

SEQ ID NO: 860847 - RNA, 22 nt, Human
auuuccaguccuaaugaucugg

SEQ ID NO: 860848 - RNA, 22 nt, Human
aauaucaguauauuguaucagu

SEQ ID NO: 860849 - RNA, 22 nt, Human
acuuugaaucucagauaaccaa

SEQ ID NO: 860850 - RNA, 22 nt, Human
uuucuuguaagauguuuauuaa

SEQ ID NO: 860851 - RNA, 22 nt, Human
cuacccaggcuggagugcagua

SEQ ID NO: 860852 - RNA, 22 nt, Human
agggggugucucugauuggguu

SEQ ID NO: 860853 - RNA, 22 nt, Human
aagcagggcuuuaagcgguuuu

SEQ ID NO: 860854 - RNA, 22 nt, Human
acccaggaaaacauggugcaga

SEQ ID NO: 860855 - RNA, 22 nt, Human
agaggcggagcuugcagugagc

SEQ ID NO: 860856 - RNA, 22 nt, Human
uacagaaguaaauaccaaaagc

SEQ ID NO: 860857 - RNA, 22 nt, Human
ugaaucauggauaaauagcuua

SEQ ID NO: 860858 - RNA, 22 nt, Human
gaccauuucuaggaaucagacu

SEQ ID NO: 860859 - RNA, 22 nt, Human
uagcccagcaugagcagagcug

SEQ ID NO: 860860 - RNA, 22 nt, Human
gaggcaugcagagcuggagcag

SEQ ID NO: 860861 - RNA, 22 nt, Human
uucaggauuauacucucuuccc

SEQ ID NO: 860862 - RNA, 22 nt, Human
gaggucagucagaccaggguuu

SEQ ID NO: 860863 - RNA, 22 nt, Human
uuguaaaugaccuuuucuaauu

SEQ ID NO: 860864 - RNA, 22 nt, Human
aaauuauaggugccaccuugga

SEQ ID NO: 860865 - RNA, 22 nt, Human
aaguccuuuccaguccugugau

SEQ ID NO: 860866 - RNA, 22 nt, Human
uacaaaguagaaauucaguaaa

SEQ ID NO: 860867 - RNA, 22 nt, Human
ucccaggaaaacacucgaggac

SEQ ID NO: 860868 - RNA, 22 nt, Human
agggagcuaggauccugaaggu

SEQ ID NO: 860869 - RNA, 22 nt, Human
uccauuuucuaaguaucacuua

SEQ ID NO: 860870 - RNA, 22 nt, Human
gauaauaagcacagcaggaugu

SEQ ID NO: 860871 - RNA, 22 nt, Human
acauuccaaaaacuagcagaua

SEQ ID NO: 860872 - RNA, 22 nt, Human
cucccaggacucagaggagaag

SEQ ID NO: 860873 - RNA, 22 nt, Human
aaaucucacuguagucaaagug

SEQ ID NO: 860874 - RNA, 22 nt, Human
aggggaugauccucccgcagcg

SEQ ID NO: 860875 - RNA, 22 nt, Human
aggcaguggaaggagaaagcaa

SEQ ID NO: 860876 - RNA, 22 nt, Human
aaaaugaugcuguaauuuggca

SEQ ID NO: 860877 - RNA, 22 nt, Human
ucugcaggcuuggaguggcagc

SEQ ID NO: 860878 - RNA, 22 nt, Human
cuggauuuuagaaggcuuccua

SEQ ID NO: 860879 - RNA, 22 nt, Human
cuucucagcaugguuacuguga

SEQ ID NO: 860880 - RNA, 22 nt, Human
cuaauacacccuauugcuuguu

SEQ ID NO: 860881 - RNA, 22 nt, Human
gggaagcaggugcagcucgccu

SEQ ID NO: 860882 - RNA, 22 nt, Human
uuuucuuaggugcuccaaguag

SEQ ID NO: 860883 - RNA, 22 nt, Human
auguuuccgugagcauccuuga

SEQ ID NO: 860884 - RNA, 22 nt, Human
cagaccucaguccucaguagga

SEQ ID NO: 860885 - RNA, 17 nt, Human
gcgcagcuccuggcgcg

SEQ ID NO: 860886 - RNA, 22 nt, Human
cucucuguuaugcuuucaugaa

SEQ ID NO: 860887 - RNA, 22 nt, Human
uguauacaggcauaagagauac

SEQ ID NO: 860888 - RNA, 22 nt, Human
ucaccgucgggggucgcugucu

SEQ ID NO: 860889 - RNA, 22 nt, Human
ucugcugucacucauuugcuuc

SEQ ID NO: 860890 - RNA, 23 nt, Human
uguugaaguaacuguuacauaga

SEQ ID NO: 860891 - RNA, 22 nt, Human
ggagaggauguuuuaguaacuu

SEQ ID NO: 860892 - RNA, 19 nt, Human
agcauuuggaauucuacac

SEQ ID NO: 860893 - RNA, 22 nt, Human
aggcagacaaggacacaguggg

SEQ ID NO: 860894 - RNA, 22 nt, Human
gaaggaggugucaguuggacug

SEQ ID NO: 860895 - RNA, 22 nt, Human
aaugagacacgugaagcagaug

SEQ ID NO: 860896 - RNA, 22 nt, Human
ugaggcaggaguuaaugugcuc

SEQ ID NO: 860897 - RNA, 22 nt, Human
gaaauauuucucuugagccccu

SEQ ID NO: 860898 - RNA, 22 nt, Human
uggcuuaagcgcaacucugucu

SEQ ID NO: 860899 - RNA, 22 nt, Human
gaagaaucaagcaguaauuugu

SEQ ID NO: 860900 - RNA, 23 nt, Human
gggcagcuuaagcuuguuuuucu

SEQ ID NO: 860901 - RNA, 21 nt, Human
gauugaaaccauggcagugag

SEQ ID NO: 860902 - RNA, 22 nt, Human
uggaagggagugacagucagag

SEQ ID NO: 860903 - RNA, 22 nt, Human
gaucagaaucuucauuuucagu

SEQ ID NO: 860904 - RNA, 18 nt, Human
gagucuuuguuacugcug

SEQ ID NO: 860905 - RNA, 19 nt, Human
ggcagcuugggaagguagc

SEQ ID NO: 860906 - RNA, 22 nt, Human
cauuuguuuagaagucuuuaua

SEQ ID NO: 860907 - RNA, 22 nt, Human
gaucauuuacuuguucuggacu

SEQ ID NO: 860908 - RNA, 15 nt, Human
aaucagaaguguggc

SEQ ID NO: 860909 - RNA, 22 nt, Human
aucagaaaggugggcaagcaga

SEQ ID NO: 860910 - RNA, 22 nt, Human
uuugcauaggauggacauuuua

SEQ ID NO: 860911 - RNA, 22 nt, Human
ugaggcagugcugggaagccug

SEQ ID NO: 860912 - RNA, 22 nt, Human
gauuuuaauuauaggagguccu

SEQ ID NO: 860913 - RNA, 22 nt, Human
cauuuccugucuggaggucaaa

SEQ ID NO: 860914 - RNA, 22 nt, Human
auacagaaguuuuccacuuauu

SEQ ID NO: 860915 - RNA, 22 nt, Human
aguggcagagguugacugcagu

SEQ ID NO: 860916 - RNA, 22 nt, Human
ccucuucuaggacguccuugug

SEQ ID NO: 860917 - RNA, 22 nt, Human
uuucaaagaguuguaaauuacu

SEQ ID NO: 860918 - RNA, 22 nt, Human
uuccuuaggggacagggggaua

SEQ ID NO: 860919 - RNA, 17 nt, Human
agaacuguaguagcucc

SEQ ID NO: 860920 - RNA, 22 nt, Human
cuucagaggggacucaaaguca

SEQ ID NO: 860921 - RNA, 22 nt, Human
cuggcuuucauuucaagcacgu

SEQ ID NO: 860922 - RNA, 22 nt, Human
caaugugguggcagaugucagu

SEQ ID NO: 860923 - RNA, 22 nt, Human
uuugaaaucuaaucaaggaaca

SEQ ID NO: 860924 - RNA, 22 nt, Human
uucuuaacucaaauauauaucc

SEQ ID NO: 860925 - RNA, 22 nt, Human
ugauugaagaggugaggaaguu

SEQ ID NO: 860926 - RNA, 22 nt, Human
gggcagcucggaagugggaaag

SEQ ID NO: 860927 - RNA, 22 nt, Human
ggcucagagaccugcgaucuga

SEQ ID NO: 860928 - RNA, 22 nt, Human
ucccaggaauccguccucuaga

SEQ ID NO: 860929 - RNA, 22 nt, Human
ggagagugggagcaacuguugc

SEQ ID NO: 860930 - RNA, 22 nt, Human
ugugaaggagaugaagggagug

SEQ ID NO: 860931 - RNA, 22 nt, Human
cauuucaaacaguuacagcugc

SEQ ID NO: 860932 - RNA, 22 nt, Human
ggugaagggccuuaggagacag

SEQ ID NO: 860933 - RNA, 22 nt, Human
auucauuuagguauucacuuac

SEQ ID NO: 860934 - RNA, 22 nt, Human
acagugcuggcuacaacccugg

SEQ ID NO: 860935 - RNA, 22 nt, Human
cuguauuucccacauucucuau

SEQ ID NO: 860936 - RNA, 22 nt, Human
gcccaggaguucaagucuagug

SEQ ID NO: 860937 - RNA, 16 nt, Human
gcccaggacgggaggc

SEQ ID NO: 860938 - RNA, 22 nt, Human
aggcaccuugcgguccagugaa

SEQ ID NO: 860939 - RNA, 22 nt, Human
uaaauuguuuucuagaaguugu

SEQ ID NO: 860940 - RNA, 22 nt, Human
ugcauguguuugccacagugag

SEQ ID NO: 860941 - RNA, 22 nt, Human
ucuuuaaucauaaccaagaugg

SEQ ID NO: 860942 - RNA, 22 nt, Human
aaggaguuuggguagucauaca

SEQ ID NO: 860943 - RNA, 22 nt, Human
cuauagaaaauuguaucacacg

SEQ ID NO: 860944 - RNA, 22 nt, Human
cucccagagagcaggugggccg

SEQ ID NO: 860945 - RNA, 22 nt, Human
uucauaaucaccaaaaacugga

SEQ ID NO: 860946 - RNA, 22 nt, Human
aauauuguuucaagaucacaga

SEQ ID NO: 860947 - RNA, 22 nt, Human
gcaagcugaugugauagugaaa

SEQ ID NO: 860948 - RNA, 22 nt, Human
uggcaauuuuaggugguuuagu

SEQ ID NO: 860949 - RNA, 22 nt, Human
uugcaucuagggcaacccagag

SEQ ID NO: 860950 - RNA, 22 nt, Human
uuuauuuggcauccagggagaa

SEQ ID NO: 860951 - RNA, 22 nt, Human
agcacauaccagaaccacaggu

SEQ ID NO: 860952 - RNA, 22 nt, Human
uguuugaacugaauaacauagu

SEQ ID NO: 860953 - RNA, 22 nt, Human
ucuuugcaggccaaauuguuaa

SEQ ID NO: 860954 - RNA, 22 nt, Human
auuacagaaugcaguuccuuau

SEQ ID NO: 860955 - RNA, 22 nt, Human
uucccucucacuuaaagcuugg

SEQ ID NO: 860956 - RNA, 22 nt, Human
cucccaggggaacuaucaagua

SEQ ID NO: 860957 - RNA, 23 nt, Human
uagaauucaaucuguuccacauc

SEQ ID NO: 860958 - RNA, 22 nt, Human
caggcagcaucagucugcugua

SEQ ID NO: 860959 - RNA, 22 nt, Human
gcaagcugcucuuauguggagg

SEQ ID NO: 860960 - RNA, 22 nt, Human
uggagaauuuugucaccagaca

SEQ ID NO: 860961 - RNA, 22 nt, Human
uuaacauuguccuuagcagauu

SEQ ID NO: 860962 - RNA, 22 nt, Human
guuaggcauuugccuuaauuuu

SEQ ID NO: 860963 - RNA, 22 nt, Human
ggaggacaggggcugcagcaca

SEQ ID NO: 860964 - RNA, 22 nt, Human
aauuuuaaucaguggugcugag

SEQ ID NO: 860965 - RNA, 22 nt, Human
ucugggaaccagugcggcuggg

SEQ ID NO: 860966 - RNA, 22 nt, Human
gguacaauggaccauaaaagcu

SEQ ID NO: 860967 - RNA, 22 nt, Human
accaggaggccuggagcacaaa

SEQ ID NO: 860968 - RNA, 22 nt, Human
auggcuuucucuaaugugguau

SEQ ID NO: 860969 - RNA, 22 nt, Human
gggaggugauggcaagcagcgg

SEQ ID NO: 860970 - RNA, 22 nt, Human
ugaaggaaugaguauacuguuu

SEQ ID NO: 860971 - RNA, 22 nt, Human
ggcaauuucaugugguuuaaac

SEQ ID NO: 860972 - RNA, 22 nt, Human
aaggcagccagauccuuugggu

SEQ ID NO: 860973 - RNA, 22 nt, Human
cauuuccagcuccugcaucaug

SEQ ID NO: 860974 - RNA, 21 nt, Human
gugcuuuuccuuaauguucuu

SEQ ID NO: 860975 - RNA, 22 nt, Human
uuuaggcaaauuucagaugugc

SEQ ID NO: 860976 - RNA, 19 nt, Human
gcagcugcuugaaaagaaa

SEQ ID NO: 860977 - RNA, 22 nt, Human
agucaccagguuuuagagaccu

SEQ ID NO: 860978 - RNA, 22 nt, Human
cauggagauaaacugaaauauu

SEQ ID NO: 860979 - RNA, 22 nt, Human
uuggcaguaaaagaaaaugcuu

SEQ ID NO: 860980 - RNA, 19 nt, Human
agggaguuuauauuugcac

SEQ ID NO: 860981 - RNA, 22 nt, Human
uugguccacugugaaauuggga

SEQ ID NO: 860982 - RNA, 22 nt, Human
cauagagugauguaagguaugu

SEQ ID NO: 860983 - RNA, 22 nt, Human
gcauguguggaggagaugugcu

SEQ ID NO: 860984 - RNA, 22 nt, Human
cagcagagaaauuaaacuucug

SEQ ID NO: 860985 - RNA, 22 nt, Human
cauuuguacagaacagcuuuau

SEQ ID NO: 860986 - RNA, 22 nt, Human
ugaaucugauuucccuggaggc

SEQ ID NO: 860987 - RNA, 22 nt, Human
aucuuucuccauauacaucuuu

SEQ ID NO: 860988 - RNA, 22 nt, Human
uuuaggcaagaacucacugaga

SEQ ID NO: 860989 - RNA, 22 nt, Human
uuggaaagcaagcuggacauac

SEQ ID NO: 860990 - RNA, 22 nt, Human
uacaauacuuaaccuauuuugc

SEQ ID NO: 860991 - RNA, 22 nt, Human
aggaugagaagauuggaaucuu

SEQ ID NO: 860992 - RNA, 22 nt, Human
caaguccuaggucugauugaac

SEQ ID NO: 860993 - RNA, 17 nt, Human
gagagcugcugcuuccg

SEQ ID NO: 860994 - RNA, 22 nt, Human
uaaaacuuaacuauccagauua

SEQ ID NO: 860995 - RNA, 22 nt, Human
cuggccagaguuggagggugug

SEQ ID NO: 860996 - RNA, 22 nt, Human
auaguuugaaggcuguucuacu

SEQ ID NO: 860997 - RNA, 22 nt, Human
uuucaacuuguuugcuuccaua

SEQ ID NO: 860998 - RNA, 22 nt, Human
uacugcauaacuggcauguggg

SEQ ID NO: 860999 - RNA, 22 nt, Human
cauuucaaugccuucaacauag

SEQ ID NO: 861000 - RNA, 22 nt, Human
aguuggagugaacaugagauug

SEQ ID NO: 861001 - RNA, 22 nt, Human
uuuccagagcaugucugcucag

SEQ ID NO: 861002 - RNA, 22 nt, Human
cuagaaaucucuguuuacauca

SEQ ID NO: 861003 - RNA, 22 nt, Human
auacuuucugaccaauuaauug

SEQ ID NO: 861004 - RNA, 22 nt, Human
ugaauaguccuuggaauaacug

SEQ ID NO: 861005 - RNA, 22 nt, Human
caugcuuuucaaucuaucuuaa

SEQ ID NO: 861006 - RNA, 22 nt, Human
auauacaggugguauguguaaa

SEQ ID NO: 861007 - RNA, 22 nt, Human
ucuucucucauguaggagggaa

SEQ ID NO: 861008 - RNA, 22 nt, Human
gcugcccauuccacuggauggu

SEQ ID NO: 861009 - RNA, 22 nt, Human
gggcagcucugcccaucagagg

SEQ ID NO: 861010 - RNA, 22 nt, Human
gaugaaaaucuugagaugucga

SEQ ID NO: 861011 - RNA, 22 nt, Human
uagggcagaguccaggaugggc

SEQ ID NO: 861012 - RNA, 22 nt, Human
aguggcagagugcacucaggca

SEQ ID NO: 861013 - RNA, 22 nt, Human
ggaggggaggauuaaugacaaa

SEQ ID NO: 861014 - RNA, 22 nt, Human
uucuucaaauagcagggaguca

SEQ ID NO: 861015 - RNA, 22 nt, Human
uuuaggcacagggaguugguuu

SEQ ID NO: 861016 - RNA, 22 nt, Human
agaggcagaaguguucaaaccc

SEQ ID NO: 861017 - RNA, 22 nt, Human
ucuucuucccaucccucaaaug

SEQ ID NO: 861018 - RNA, 22 nt, Human
gaaauauugggacucagagcuu

SEQ ID NO: 861019 - RNA, 22 nt, Human
aucuauacucagaguuaauauc

SEQ ID NO: 861020 - RNA, 22 nt, Human
caucagaagauggcucuggaaa

SEQ ID NO: 861021 - RNA, 22 nt, Human
uaagagaauguuguggcuaggu

SEQ ID NO: 861022 - RNA, 22 nt, Human
aaugucugcucuacucaggagg

SEQ ID NO: 861023 - RNA, 22 nt, Human
uucaacuaauguuuauuuuaug

SEQ ID NO: 861024 - RNA, 22 nt, Human
cuacagaaaccuuuuucauaca

SEQ ID NO: 861025 - RNA, 22 nt, Human
uuuagaaguucacacauuuaaa

SEQ ID NO: 861026 - RNA, 22 nt, Human
aaauuagucgguuuaggaauuu

SEQ ID NO: 861027 - RNA, 22 nt, Human
aaugguuuucuagaacaugaaa

SEQ ID NO: 861028 - RNA, 22 nt, Human
ugaggcaggaugcuugcacagg

SEQ ID NO: 861029 - RNA, 20 nt, Human
uucuucucuaguuaucuuca

SEQ ID NO: 861030 - RNA, 22 nt, Human
aggcaacuuuuggggaugaugg

SEQ ID NO: 861031 - RNA, 22 nt, Human
aaaguccuagcgauccacagaa

SEQ ID NO: 861032 - RNA, 22 nt, Human
ucaucucaaaacccaaggggca

SEQ ID NO: 861033 - RNA, 22 nt, Human
aauuauccuuaaugcaguaagc

SEQ ID NO: 861034 - RNA, 22 nt, Human
uucaaacaguguagaauauaug

SEQ ID NO: 861035 - RNA, 22 nt, Human
ugaguaauaaacugucuugcuc

SEQ ID NO: 861036 - RNA, 22 nt, Human
agauaaaaugguucaaaggcua

SEQ ID NO: 861037 - RNA, 22 nt, Human
agacaguguguguauauauggu

SEQ ID NO: 861038 - RNA, 22 nt, Human
auacaacagaaaaugauuauuc

SEQ ID NO: 861039 - RNA, 22 nt, Human
cuagccugggauuugaacuuau

SEQ ID NO: 861040 - RNA, 22 nt, Human
ucacauucucagcaucuauaca

SEQ ID NO: 861041 - RNA, 22 nt, Human
ucuuagcacagcuauauaaguu

SEQ ID NO: 861042 - RNA, 22 nt, Human
aaucuguucuacucuauucaga

SEQ ID NO: 861043 - RNA, 22 nt, Human
cagcagagggagccauugaaau

SEQ ID NO: 861044 - RNA, 22 nt, Human
acaucucaugaaugauaaauca

SEQ ID NO: 861045 - RNA, 22 nt, Human
uucacagaugccugaugugugg

SEQ ID NO: 861046 - RNA, 22 nt, Human
gcguuaauaacauuaauaaugc

SEQ ID NO: 861047 - RNA, 22 nt, Human
gaauuucaaaagccagaacggg

SEQ ID NO: 861048 - RNA, 22 nt, Human
gaaauauacauugcaggaagag

SEQ ID NO: 861049 - RNA, 22 nt, Human
cugcuguguugccagugucacc

SEQ ID NO: 861050 - RNA, 22 nt, Human
ugcccaggcuggaaugcagugg

SEQ ID NO: 861051 - RNA, 22 nt, Human
gaguucuaaaggcagaacauaa

SEQ ID NO: 861052 - RNA, 22 nt, Human
cugcccaggcugaaggaacauc

SEQ ID NO: 861053 - RNA, 22 nt, Human
ugcuuuaacauaagauaucuuu

SEQ ID NO: 861054 - RNA, 22 nt, Human
auccuuaguuaagaacaggagu

SEQ ID NO: 861055 - RNA, 22 nt, Human
auuauccucagaaaacauguga

SEQ ID NO: 861056 - RNA, 23 nt, Human
cagcccuuccugcauguuuuugu

SEQ ID NO: 861057 - RNA, 22 nt, Human
agucaccauuuucaccugccuc

SEQ ID NO: 861058 - RNA, 19 nt, Human
ggcagcuggacgcuguuca

SEQ ID NO: 861059 - RNA, 22 nt, Human
gaggccaggaagcccaagauca

SEQ ID NO: 861060 - RNA, 18 nt, Human
cauuguacaaugcuuuau

SEQ ID NO: 861061 - RNA, 22 nt, Human
ugaggcagccugcauuaaagag

SEQ ID NO: 861062 - RNA, 22 nt, Human
gaguccuucuggcuggcaggau

SEQ ID NO: 861063 - RNA, 22 nt, Human
gucacuguuuccuauuauauuu

SEQ ID NO: 861064 - RNA, 17 nt, Human
cccacggaggugugaaa

SEQ ID NO: 861065 - RNA, 22 nt, Human
ugaggcaguauucuccauucca

SEQ ID NO: 861066 - RNA, 22 nt, Human
uccaggaguuugaccugugggc

SEQ ID NO: 861067 - RNA, 22 nt, Human
caauuucaugccauguauugcu

SEQ ID NO: 861068 - RNA, 22 nt, Human
aaaggccacuugaaggauuuuu

SEQ ID NO: 861069 - RNA, 22 nt, Human
uuuggaauuggaaagugcugug

SEQ ID NO: 861070 - RNA, 22 nt, Human
ggcauuuagagggcuuuucuga

SEQ ID NO: 861071 - RNA, 22 nt, Human
uacuauaccauguaagauauga

SEQ ID NO: 861072 - RNA, 22 nt, Human
auccuuagaagggagugaggac

SEQ ID NO: 861073 - RNA, 22 nt, Human
uacuagaaccucacaacaaucc

SEQ ID NO: 861074 - RNA, 22 nt, Human
gaauuucaacaguccucaaaug

SEQ ID NO: 861075 - RNA, 20 nt, Human
agauuauuccuaagauuucu

SEQ ID NO: 861076 - RNA, 21 nt, Human
acagcauguuuguguguuugc

SEQ ID NO: 861077 - RNA, 22 nt, Human
uaagaacuucggacauguuauc

SEQ ID NO: 861078 - RNA, 19 nt, Human
gcuuuggagggagguucua

SEQ ID NO: 861079 - RNA, 22 nt, Human
caguaaauacauaucagagaag

SEQ ID NO: 861080 - RNA, 22 nt, Human
aaucaagucaaccaucaugugc

SEQ ID NO: 861081 - RNA, 22 nt, Human
gcccaggaagugacucagaugu

SEQ ID NO: 861082 - RNA, 22 nt, Human
ucacagaagaugcuggauguug

SEQ ID NO: 861083 - RNA, 22 nt, Human
cugcuguguaucauuuuagaug

SEQ ID NO: 861084 - RNA, 22 nt, Human
uggaaggaaagguagcagagaa

SEQ ID NO: 861085 - RNA, 22 nt, Human
uccaggaguccuggguggcccc

SEQ ID NO: 861086 - RNA, 22 nt, Human
auacuaaaguauagaacuuagu

SEQ ID NO: 861087 - RNA, 22 nt, Human
uagugcuuuaaguuuacagaga

SEQ ID NO: 861088 - RNA, 22 nt, Human
aaagaaucuauauaucaccacc

SEQ ID NO: 861089 - RNA, 21 nt, Human
caaguccuuugccaaagugcu

SEQ ID NO: 861090 - RNA, 22 nt, Human
auagcuuucuuaaauauauaaa

SEQ ID NO: 861091 - RNA, 22 nt, Human
agggcagccucucagccuaggu

SEQ ID NO: 861092 - RNA, 22 nt, Human
agaucuauuagcaaacugccau

SEQ ID NO: 861093 - RNA, 22 nt, Human
cagauaaaggcuuacuaguagu

SEQ ID NO: 861094 - RNA, 22 nt, Human
ccuucauugcaucuuuaagaga

SEQ ID NO: 861095 - RNA, 22 nt, Human
gcagcugagagaagaacagggc

SEQ ID NO: 861096 - RNA, 22 nt, Human
cccaugagguggagguugcagu

SEQ ID NO: 861097 - RNA, 22 nt, Human
uuagagucaaaauggcauguua

SEQ ID NO: 861098 - RNA, 22 nt, Human
gggagcugaauggcaauggaga

SEQ ID NO: 861099 - RNA, 22 nt, Human
gcucaggagcucuugguggcgc

SEQ ID NO: 861100 - RNA, 22 nt, Human
auuugcuuaucuccacaguugu

SEQ ID NO: 861101 - RNA, 22 nt, Human
acccaggacaugggcacccgug

SEQ ID NO: 861102 - RNA, 22 nt, Human
aguuuucacacucaccaaaagg

SEQ ID NO: 861103 - RNA, 22 nt, Human
uuaaagauucugaggcugauua

SEQ ID NO: 861104 - RNA, 22 nt, Human
cccaggcagugugugcaugcgu

SEQ ID NO: 861105 - RNA, 22 nt, Human
caucagaauguuauggggggcu

SEQ ID NO: 861106 - RNA, 22 nt, Human
ucucuucuauuugagacuauuu

SEQ ID NO: 861107 - RNA, 22 nt, Human
caauuucacuaauaauauuuac

SEQ ID NO: 861108 - RNA, 22 nt, Human
gcugcccaggguggagccggcu

SEQ ID NO: 861109 - RNA, 23 nt, Human
uccuuccuuugagaggcuccauc

SEQ ID NO: 861110 - RNA, 22 nt, Human
uuccaagagcuuuaauuguuga

SEQ ID NO: 861111 - RNA, 22 nt, Human
agcccagggaaccaggaagugg

SEQ ID NO: 861112 - RNA, 21 nt, Human
uuucacaaaaguaugugacaa

SEQ ID NO: 861113 - RNA, 22 nt, Human
uagaugcuacaauuuuguacuc

SEQ ID NO: 861114 - RNA, 22 nt, Human
agaccauggccauccuaggaaa

SEQ ID NO: 861115 - RNA, 22 nt, Human
ccagaggaggggggucuuucug

SEQ ID NO: 861116 - RNA, 22 nt, Human
uacccaggagaaacagcagggc

SEQ ID NO: 861117 - RNA, 22 nt, Human
cccaggagaccugugaaaggac

SEQ ID NO: 861118 - RNA, 22 nt, Human
gcagaauuuucuguuuucuaga

SEQ ID NO: 861119 - RNA, 21 nt, Human
uguaaguuucaucugaauugg

SEQ ID NO: 861120 - RNA, 22 nt, Human
ucagaaauagucuuuaaaauga

SEQ ID NO: 861121 - RNA, 22 nt, Human
cagaggauucccuagugaccug

SEQ ID NO: 861122 - RNA, 22 nt, Human
acucaggaauggggcugggacu

SEQ ID NO: 861123 - RNA, 21 nt, Human
ggcagccugacccccagagag

SEQ ID NO: 861124 - RNA, 22 nt, Human
ucugcuguauuagguugaacug

SEQ ID NO: 861125 - RNA, 22 nt, Human
aaauauagugacacuuauaguc

SEQ ID NO: 861126 - RNA, 22 nt, Human
ucacacagguuugcaaugauuu

SEQ ID NO: 861127 - RNA, 23 nt, Human
uuuauccaacucuguaaucucuc

SEQ ID NO: 861128 - RNA, 22 nt, Human
ggacuucuaagugccagacacu

SEQ ID NO: 861129 - RNA, 22 nt, Human
ccauggcuuucuuucauuguaa

SEQ ID NO: 861130 - RNA, 22 nt, Human
uauggcuuuaaacaacuuaggu

SEQ ID NO: 861131 - RNA, 22 nt, Human
agcccaggucucaaaguacagg

SEQ ID NO: 861132 - RNA, 22 nt, Human
uagcucuucauuucaucugauu

SEQ ID NO: 861133 - RNA, 22 nt, Human
uucuuucucaacaugaauguuu

SEQ ID NO: 861134 - RNA, 22 nt, Human
uuuggaauuggcauucuauucu

SEQ ID NO: 861135 - RNA, 22 nt, Human
ugaaacaaugugaaguugcuga

SEQ ID NO: 861136 - RNA, 22 nt, Human
cuucuucaaccugaaaguuuca

SEQ ID NO: 861137 - RNA, 23 nt, Human
uuccagaguccacaucugccacc

SEQ ID NO: 861138 - RNA, 22 nt, Human
uuggaucacucugaagccuuac

SEQ ID NO: 861139 - RNA, 23 nt, Human
acagacaacacugaugagagaaa

SEQ ID NO: 861140 - RNA, 22 nt, Human
aguuugaaauguuggcaauauu

SEQ ID NO: 861141 - RNA, 22 nt, Human
uggauuuaguucuucacaggcc

SEQ ID NO: 861142 - RNA, 22 nt, Human
ucccaggaaggauucggcauuu

SEQ ID NO: 861143 - RNA, 22 nt, Human
aauacauauggaauuccauguu

SEQ ID NO: 861144 - RNA, 22 nt, Human
accauccugaaaccuucaugcu

SEQ ID NO: 861145 - RNA, 22 nt, Human
auacagaacaagccucaccucc

SEQ ID NO: 861146 - RNA, 22 nt, Human
augaguucaauuguuucaguca

SEQ ID NO: 861147 - RNA, 22 nt, Human
ucaaaauuuuauuucucaagga

SEQ ID NO: 861148 - RNA, 22 nt, Human
uggcagcugcguuguguuucug

SEQ ID NO: 861149 - RNA, 23 nt, Human
uacaugcuauaauuucacccuca

SEQ ID NO: 861150 - RNA, 22 nt, Human
gaggagagaagcuaacggugcu

SEQ ID NO: 861151 - RNA, 18 nt, Human
uggcagcuagguaaagaa

SEQ ID NO: 861152 - RNA, 22 nt, Human
aguaaaauuguauuggaaaaca

SEQ ID NO: 861153 - RNA, 22 nt, Human
uugaagaggacuuugcagcugu

SEQ ID NO: 861154 - RNA, 22 nt, Human
uuucaucuucccagagaccuug

SEQ ID NO: 861155 - RNA, 22 nt, Human
ggacaagccugugaguggguuu

SEQ ID NO: 861156 - RNA, 22 nt, Human
agagggcaaguguaguccagua

SEQ ID NO: 861157 - RNA, 22 nt, Human
uuuauacauggagaauuuuugc

SEQ ID NO: 861158 - RNA, 17 nt, Human
cccaugagcccacuccc

SEQ ID NO: 861159 - RNA, 22 nt, Human
gccccagcguggcuguguuagg

SEQ ID NO: 861160 - RNA, 22 nt, Human
cggagaggaccugcaacucgcu

SEQ ID NO: 861161 - RNA, 22 nt, Human
ucugggaagcugcgugccuguu

SEQ ID NO: 861162 - RNA, 20 nt, Human
cauuuguuagcuuucuacug

SEQ ID NO: 861163 - RNA, 22 nt, Human
ggaucugagagcaagcaggacc

SEQ ID NO: 861164 - RNA, 22 nt, Human
uuuggacuuagccugcagaauu

SEQ ID NO: 861165 - RNA, 22 nt, Human
guccaugauucuguguaguaga

SEQ ID NO: 861166 - RNA, 21 nt, Human
aaaggccauaaucacggagca

SEQ ID NO: 861167 - RNA, 22 nt, Human
cuuaaagaaauugaggagagga

SEQ ID NO: 861168 - RNA, 22 nt, Human
ccagcuauugcuguguaacagu

SEQ ID NO: 861169 - RNA, 22 nt, Human
uauaauuaguaaauggcagauu

SEQ ID NO: 861170 - RNA, 22 nt, Human
uuucacaacugcuuauuugaga

SEQ ID NO: 861171 - RNA, 22 nt, Human
guggaaugaauagauuugcauu

SEQ ID NO: 861172 - RNA, 22 nt, Human
uugaaaguccuucuugaguuac

SEQ ID NO: 861173 - RNA, 22 nt, Human
gaggggcagagguagagaacaa

SEQ ID NO: 861174 - RNA, 22 nt, Human
ggaagaggcugaggccaugcug

SEQ ID NO: 861175 - RNA, 22 nt, Human
aucacuguguauguauaugcag

SEQ ID NO: 861176 - RNA, 22 nt, Human
cuggcugugcagucuuccagaa

SEQ ID NO: 861177 - RNA, 22 nt, Human
caucagaaaccuugaggaaacu

SEQ ID NO: 861178 - RNA, 22 nt, Human
cucacugugccuuuucccaaac

SEQ ID NO: 861179 - RNA, 21 nt, Human
ggcagccucuguggaagggga

SEQ ID NO: 861180 - RNA, 22 nt, Human
ucaggagacuggcagugcccac

SEQ ID NO: 861181 - RNA, 22 nt, Human
agggcagcagcuccuccuagcu

SEQ ID NO: 861182 - RNA, 22 nt, Human
auuuugaugcuaucuaaugaau

SEQ ID NO: 861183 - RNA, 22 nt, Human
guacagaaggagcuuuggauuc

SEQ ID NO: 861184 - RNA, 22 nt, Human
gaggcugauucggggaacagca

SEQ ID NO: 861185 - RNA, 22 nt, Human
aaauggauggaaagcaauuuuu

SEQ ID NO: 861186 - RNA, 22 nt, Human
ucacacauucuagguauguuga

SEQ ID NO: 861187 - RNA, 22 nt, Human
acccaggauaaucuguguaucu

SEQ ID NO: 861188 - RNA, 22 nt, Human
gugguuuucuccaacccagaac

SEQ ID NO: 861189 - RNA, 22 nt, Human
cucuggcuucuaccuugcaguu

SEQ ID NO: 861190 - RNA, 22 nt, Human
aaggcagcucagcucauggcag

SEQ ID NO: 861191 - RNA, 22 nt, Human
guucuucaucauuaacacucug

SEQ ID NO: 861192 - RNA, 22 nt, Human
gaccauuuguugaaaagauuau

SEQ ID NO: 861193 - RNA, 19 nt, Human
ugcauaaauuauauacuuu

SEQ ID NO: 861194 - RNA, 22 nt, Human
auauauuugagaauauucauga

SEQ ID NO: 861195 - RNA, 18 nt, Human
uugcuuuguaagcuugca

SEQ ID NO: 861196 - RNA, 22 nt, Human
ggcuuggaaauugcaggacaca

SEQ ID NO: 861197 - RNA, 23 nt, Human
uugcauagacauccucauagauu

SEQ ID NO: 861198 - RNA, 22 nt, Human
uuucaaguguccugauuaaugg

SEQ ID NO: 861199 - RNA, 19 nt, Human
gagcgcagagggcagggga

SEQ ID NO: 861200 - RNA, 22 nt, Human
ggcuuggaaaugguaaugagcu

SEQ ID NO: 861201 - RNA, 22 nt, Human
gcagcuucaguaggugaagaca

SEQ ID NO: 861202 - RNA, 22 nt, Human
caucagaaggaaggacgauuau

SEQ ID NO: 861203 - RNA, 22 nt, Human
ccccaggaagccucagauuugc

SEQ ID NO: 861204 - RNA, 21 nt, Human
uuacagaauccaugggaaguc

SEQ ID NO: 861205 - RNA, 22 nt, Human
aauuucaagucuugaagaagua

SEQ ID NO: 861206 - RNA, 22 nt, Human
caaagucauggggaugcagguc

SEQ ID NO: 861207 - RNA, 22 nt, Human
aggcagcuggaggcagagacua

SEQ ID NO: 861208 - RNA, 22 nt, Human
aaggcagcacagcaacugcuca

SEQ ID NO: 861209 - RNA, 22 nt, Human
guuaauauuuaccugucaagaa

SEQ ID NO: 861210 - RNA, 22 nt, Human
gcccaggagaggccagggcuga

SEQ ID NO: 861211 - RNA, 22 nt, Human
uuuacagaugaggaaacugaga

SEQ ID NO: 861212 - RNA, 22 nt, Human
auugaaagcauggauuuggauu

SEQ ID NO: 861213 - RNA, 22 nt, Human
uaauuucaaauuucuuagcgug

SEQ ID NO: 861214 - RNA, 22 nt, Human
ccaggagagcucucguucagug

SEQ ID NO: 861215 - RNA, 22 nt, Human
aaggcagcagaggaaaggugcu

SEQ ID NO: 861216 - RNA, 22 nt, Human
cauuuuaagaugaccugguuuc

SEQ ID NO: 861217 - RNA, 22 nt, Human
cccaggagguggagguugcagc

SEQ ID NO: 861218 - RNA, 22 nt, Human
ucaggagagaguuggguaggcu

SEQ ID NO: 861219 - RNA, 22 nt, Human
cagcuuucaucagugacacuca

SEQ ID NO: 861220 - RNA, 22 nt, Human
gaaauuauugcuagagacugca

SEQ ID NO: 861221 - RNA, 22 nt, Human
uacugccuggagcauuggugcu

SEQ ID NO: 861222 - RNA, 22 nt, Human
caguaucugucaguaaucaggu

SEQ ID NO: 861223 - RNA, 22 nt, Human
augaggcaguacacacaaagcc

SEQ ID NO: 861224 - RNA, 22 nt, Human
auuuccauagagcgucucacag

SEQ ID NO: 861225 - RNA, 22 nt, Human
cucaggauucucgacacucaca

SEQ ID NO: 861226 - RNA, 20 nt, Human
cagaggcauuuucagacucu

SEQ ID NO: 861227 - RNA, 22 nt, Human
augcaucuauucccaagggcag

SEQ ID NO: 861228 - RNA, 22 nt, Human
aauguaaacagcaagagaaggg

SEQ ID NO: 861229 - RNA, 22 nt, Human
agggaagcccuggcugagaccc

SEQ ID NO: 861230 - RNA, 18 nt, Human
aaacuggcuuggccugug

SEQ ID NO: 861231 - RNA, 22 nt, Human
uuuugaauaauucagaaacagc

SEQ ID NO: 861232 - RNA, 22 nt, Human
aaauauaauuucugccucaaua

SEQ ID NO: 861233 - RNA, 22 nt, Human
cccaggaaccuaccagcucgag

SEQ ID NO: 861234 - RNA, 22 nt, Human
acacauuucuaaauuuuuaccg

SEQ ID NO: 861235 - RNA, 22 nt, Human
gaugauaacagcauuucaacug

SEQ ID NO: 861236 - RNA, 19 nt, Human
aggcagcaggccagggaug

SEQ ID NO: 861237 - RNA, 22 nt, Human
uuacagaaucuacucgugguga

SEQ ID NO: 861238 - RNA, 22 nt, Human
cuucucaguugcaagugucaga

SEQ ID NO: 861239 - RNA, 19 nt, Human
ugcugaaguugucagucug

SEQ ID NO: 861240 - RNA, 22 nt, Human
cugcauuagucaugcuuugcag

SEQ ID NO: 861241 - RNA, 22 nt, Human
caauacuuccuuguuagaggca

SEQ ID NO: 861242 - RNA, 23 nt, Human
ugaguucucaucuuggcuucuau

SEQ ID NO: 861243 - RNA, 22 nt, Human
caguuucuacgaaggucaaccc

SEQ ID NO: 861244 - RNA, 22 nt, Human
uugaaaguagcagcugcauaug

SEQ ID NO: 861245 - RNA, 19 nt, Human
uauggcaggccgaggcacu

SEQ ID NO: 861246 - RNA, 22 nt, Human
gggcagcucucacagcagccaa

SEQ ID NO: 861247 - RNA, 22 nt, Human
uauuuucuggacagucuugcuu

SEQ ID NO: 861248 - RNA, 22 nt, Human
cauuuguuaaccaguguggauu

SEQ ID NO: 861249 - RNA, 22 nt, Human
gaggaggcacuugagcagaugu

SEQ ID NO: 861250 - RNA, 22 nt, Human
acauaauaccuaggacaguuug

SEQ ID NO: 861251 - RNA, 22 nt, Human
ggcagaagauaggacagggaau

SEQ ID NO: 861252 - RNA, 17 nt, Human
caagagagaugacugga

SEQ ID NO: 861253 - RNA, 22 nt, Human
gucaggauuuuaaaaucccagu

SEQ ID NO: 861254 - RNA, 22 nt, Human
agcacauucugccuugcuuugc

SEQ ID NO: 861255 - RNA, 22 nt, Human
augaaauauuucagagcagagu

SEQ ID NO: 861256 - RNA, 22 nt, Human
auccaugauuaguaggauaaag

SEQ ID NO: 861257 - RNA, 22 nt, Human
aaaggaagauugagcuuuucca

SEQ ID NO: 861258 - RNA, 22 nt, Human
uggcagucuggguuggcaguua

SEQ ID NO: 861259 - RNA, 22 nt, Human
uuggaauucaaguuguagcuua

SEQ ID NO: 861260 - RNA, 22 nt, Human
aggcaagcauuuaaccacucau

SEQ ID NO: 861261 - RNA, 22 nt, Human
acuuugaaggggaacauuuuaa

SEQ ID NO: 861262 - RNA, 22 nt, Human
ugaaaugaaacagaacauauca

SEQ ID NO: 861263 - RNA, 22 nt, Human
auccaugaagguacuucucagg

SEQ ID NO: 861264 - RNA, 23 nt, Human
uggaaagcggaccuggggcagag

SEQ ID NO: 861265 - RNA, 22 nt, Human
gcccaggaucugcucagaucau

SEQ ID NO: 861266 - RNA, 20 nt, Human
gcccaggaucucugaggcau

SEQ ID NO: 861267 - RNA, 22 nt, Human
uagcacaucuucuuggccugca

SEQ ID NO: 861268 - RNA, 22 nt, Human
uuuccaaagcugaguugagcaa

SEQ ID NO: 861269 - RNA, 19 nt, Human
uggcagggagaguuugaag

SEQ ID NO: 861270 - RNA, 22 nt, Human
ucaguaaaugguugcuguuauu

SEQ ID NO: 861271 - RNA, 22 nt, Human
cugcuuugacuguuaagaacca

SEQ ID NO: 861272 - RNA, 22 nt, Human
aguggcaguagaugagcugguu

SEQ ID NO: 861273 - RNA, 22 nt, Human
ccaggagagcauugcacagagg

SEQ ID NO: 861274 - RNA, 22 nt, Human
aguccuuaugugguggagagag

SEQ ID NO: 861275 - RNA, 22 nt, Human
uucugugaaucuuuuuucccac

SEQ ID NO: 861276 - RNA, 22 nt, Human
uauuucuaagagauaucuguac

SEQ ID NO: 861277 - RNA, 22 nt, Human
gcugcccacaaugauuacaugg

SEQ ID NO: 861278 - RNA, 22 nt, Human
uuucccaguucccugcucuaua

SEQ ID NO: 861279 - RNA, 22 nt, Human
uggcagcugucagaaugcaaau

SEQ ID NO: 861280 - RNA, 22 nt, Human
ucaggagacaaagggugcggag

SEQ ID NO: 861281 - RNA, 23 nt, Human
augaaugaauaaggcaggaaagc

SEQ ID NO: 861282 - RNA, 22 nt, Human
cugcuuugauuagaagaguaca

SEQ ID NO: 861283 - RNA, 22 nt, Human
aaguaaaauguuuccuuuauua

SEQ ID NO: 861284 - RNA, 22 nt, Human
auucuucaccugagucagucua

SEQ ID NO: 861285 - RNA, 22 nt, Human
agagcagcugugacauggacag

SEQ ID NO: 861286 - RNA, 22 nt, Human
aaagcagaacugagagagcugg

SEQ ID NO: 861287 - RNA, 22 nt, Human
auguuucaccagcaaauuaccu

SEQ ID NO: 861288 - RNA, 20 nt, Human
cuguggaauuuuaccaugcg

SEQ ID NO: 861289 - RNA, 22 nt, Human
uagaauaaguugaugauauaug

SEQ ID NO: 861290 - RNA, 17 nt, Human
guccuacccauggucua

SEQ ID NO: 861291 - RNA, 22 nt, Human
aaggcaguaaaaucuaccuugc

SEQ ID NO: 861292 - RNA, 19 nt, Human
guuaggcaggguggggagu

SEQ ID NO: 861293 - RNA, 22 nt, Human
uauuuccaaaagccuauuauga

SEQ ID NO: 861294 - RNA, 22 nt, Human
uucacagaauggcaaguuaugg

SEQ ID NO: 861295 - RNA, 22 nt, Human
cagaucuguuugccagaucagc

SEQ ID NO: 861296 - RNA, 22 nt, Human
aaggcaguuaauuuggcuagaa

SEQ ID NO: 861297 - RNA, 22 nt, Human
uacuaaauaguuuaauuccuca

SEQ ID NO: 861298 - RNA, 22 nt, Human
caucucaugggcaugccaagcu

SEQ ID NO: 861299 - RNA, 22 nt, Human
caaauucaaauuucaucagugu

SEQ ID NO: 861300 - RNA, 23 nt, Human
acugucugauauguuuuccauca

SEQ ID NO: 861301 - RNA, 22 nt, Human
cuguggaaggccuguccugaaa

SEQ ID NO: 861302 - RNA, 22 nt, Human
uguauacaauucacacuuccca

SEQ ID NO: 861303 - RNA, 22 nt, Human
cuugcugucuugcauuuagagc

SEQ ID NO: 861304 - RNA, 22 nt, Human
ucccaggaaugucugaaaguga

SEQ ID NO: 861305 - RNA, 22 nt, Human
agauggagaccuuggaugaacu

SEQ ID NO: 861306 - RNA, 22 nt, Human
uucauucugcaguucucagcuc

SEQ ID NO: 861307 - RNA, 22 nt, Human
cuguuaaucugcuugcaugaug

SEQ ID NO: 861308 - RNA, 22 nt, Human
augcugugccuucucugugcca

SEQ ID NO: 861309 - RNA, 22 nt, Human
ucuaaacagccucuuaccaacu

SEQ ID NO: 861310 - RNA, 22 nt, Human
uuucacaaaugucuuuaacuug

SEQ ID NO: 861311 - RNA, 22 nt, Human
acuggcaggcugcuggccggcg

SEQ ID NO: 861312 - RNA, 22 nt, Human
guccaaauuuuucacauguaga

SEQ ID NO: 861313 - RNA, 23 nt, Human
agaggggagcaucugcuggcuga

SEQ ID NO: 861314 - RNA, 22 nt, Human
uugcucagcacuggagccagcu

SEQ ID NO: 861315 - RNA, 23 nt, Human
uuucaacuccugccauuauuucu

SEQ ID NO: 861316 - RNA, 22 nt, Human
agucccuguacuuuccacugcc

SEQ ID NO: 861317 - RNA, 20 nt, Human
ugaaggccagcagcauaggg

SEQ ID NO: 861318 - RNA, 22 nt, Human
aggcugcucaguagauggagcu

SEQ ID NO: 861319 - RNA, 22 nt, Human
aaaauuauucauggcuuuugga

SEQ ID NO: 861320 - RNA, 22 nt, Human
cucaggauuuacuaauuucaag

SEQ ID NO: 861321 - RNA, 22 nt, Human
aaggcagccucugccagccggg

SEQ ID NO: 861322 - RNA, 19 nt, Human
ugaggggaggagaggccug

SEQ ID NO: 861323 - RNA, 22 nt, Human
cguauacaugaagacauugcug

SEQ ID NO: 861324 - RNA, 22 nt, Human
gcaggcuccaaggccugggaga

SEQ ID NO: 861325 - RNA, 17 nt, Human
uuucaucugggaccacc

SEQ ID NO: 861326 - RNA, 22 nt, Human
ugcuuuaaccaucuuguuugga

SEQ ID NO: 861327 - RNA, 22 nt, Human
uuuccuaggagauugaucacau

SEQ ID NO: 861328 - RNA, 22 nt, Human
uuauuauuccccaagucauuau

SEQ ID NO: 861329 - RNA, 19 nt, Human
uggcauuuggaggcaaccu

SEQ ID NO: 861330 - RNA, 22 nt, Human
caauuuuuguacuuauaguacu

SEQ ID NO: 861331 - RNA, 22 nt, Human
acagaacugggggcacagauag

SEQ ID NO: 861332 - RNA, 22 nt, Human
cuggacucugcagagaaaagua

SEQ ID NO: 861333 - RNA, 22 nt, Human
uuccauaauaggcuuaagugaa

SEQ ID NO: 861334 - RNA, 22 nt, Human
uuccuuaguguuagauucugug

SEQ ID NO: 861335 - RNA, 17 nt, Human
aggccagaugaggcaag

SEQ ID NO: 861336 - RNA, 22 nt, Human
ugauuuccuaggucuggagaag

SEQ ID NO: 861337 - RNA, 22 nt, Human
ucagauggguuuugaaggaugu

SEQ ID NO: 861338 - RNA, 22 nt, Human
gacccaggagugcagagagugg

SEQ ID NO: 861339 - RNA, 22 nt, Human
caguccuuucugaaauccuaua

SEQ ID NO: 861340 - RNA, 22 nt, Human
gccuaauaacuagcuguguaac

SEQ ID NO: 861341 - RNA, 22 nt, Human
auuuagccucauuuuugacaua

SEQ ID NO: 861342 - RNA, 22 nt, Human
aggcagaggagaaugaucuucc

SEQ ID NO: 861343 - RNA, 22 nt, Human
cucuaauccuuugucccugggu

SEQ ID NO: 861344 - RNA, 22 nt, Human
cucaggaugucggugacuauug

SEQ ID NO: 861345 - RNA, 22 nt, Human
auugaaagagaauguagcucuu

SEQ ID NO: 861346 - RNA, 22 nt, Human
ggcuuggaccagucacaguggu

SEQ ID NO: 861347 - RNA, 23 nt, Human
ucuugaaaagccuacagcaguuc

SEQ ID NO: 861348 - RNA, 22 nt, Human
uuuaaaaucagaugggaguugg

SEQ ID NO: 861349 - RNA, 22 nt, Human
uuuugcuugagugcacaaaaug

SEQ ID NO: 861350 - RNA, 22 nt, Human
agcaccugucacaagcagaagg

SEQ ID NO: 861351 - RNA, 22 nt, Human
uacaguaagaugaaauagcaau

SEQ ID NO: 861352 - RNA, 22 nt, Human
uggcagcuggagggcaauggcc

SEQ ID NO: 861353 - RNA, 22 nt, Human
uggcagcagccauggaaggccc

SEQ ID NO: 861354 - RNA, 22 nt, Human
aaauaguucagcuuguaaaccc

SEQ ID NO: 861355 - RNA, 23 nt, Human
ucucaagaggaagcagggcucau

SEQ ID NO: 861356 - RNA, 22 nt, Human
uuucacaucagagguagauuag

SEQ ID NO: 861357 - RNA, 22 nt, Human
acuuuagaccaucuuccacagu

SEQ ID NO: 861358 - RNA, 21 nt, Human
gauuugcagaaacuagacagg

SEQ ID NO: 861359 - RNA, 22 nt, Human
gaggccuggagccgccuaggcg

SEQ ID NO: 861360 - RNA, 22 nt, Human
auugaaagauuuugggcucaug

SEQ ID NO: 861361 - RNA, 22 nt, Human
aguucucagcuuaguaugcugu

SEQ ID NO: 861362 - RNA, 22 nt, Human
guagaaauuccauuuacuuuga

SEQ ID NO: 861363 - RNA, 22 nt, Human
gccaggagaaugcuagcagagg

SEQ ID NO: 861364 - RNA, 22 nt, Human
acuauacaagauuagggauuug

SEQ ID NO: 861365 - RNA, 22 nt, Human
ccacugaggcaggcaguaucua

SEQ ID NO: 861366 - RNA, 21 nt, Human
ucuauucauuacaguuauuug

SEQ ID NO: 861367 - RNA, 22 nt, Human
uugguacaaaaguaacuguggu

SEQ ID NO: 861368 - RNA, 20 nt, Human
uuucugugagaaacacuguu

SEQ ID NO: 861369 - RNA, 22 nt, Human
ucacuucacacccacuaucaug

SEQ ID NO: 861370 - RNA, 22 nt, Human
accgaaggaaacuggaaccguu

SEQ ID NO: 861371 - RNA, 22 nt, Human
aacugcuguggccuaguacuua

SEQ ID NO: 861372 - RNA, 22 nt, Human
gaucauuuugaugcccuuuuag

SEQ ID NO: 861373 - RNA, 22 nt, Human
ggaggaugccaagcugugcaca

SEQ ID NO: 861374 - RNA, 22 nt, Human
aggguggcaccuggaagggaug

SEQ ID NO: 861375 - RNA, 20 nt, Human
uucacagaggacucagguca

SEQ ID NO: 861376 - RNA, 22 nt, Human
gguuauauaauucagugcuuuc

SEQ ID NO: 861377 - RNA, 22 nt, Human
cuccaggaaaauagggaaugag

SEQ ID NO: 861378 - RNA, 22 nt, Human
caguccagcccccugcuaaaag

SEQ ID NO: 861379 - RNA, 22 nt, Human
ugccauuuugagauguuaauga

SEQ ID NO: 861380 - RNA, 22 nt, Human
cagcugacccagugaggaggca

SEQ ID NO: 861381 - RNA, 22 nt, Human
cugccaggcagggagauggcug

SEQ ID NO: 861382 - RNA, 22 nt, Human
cccaggagacugagcuguaacc

SEQ ID NO: 861383 - RNA, 22 nt, Human
auuguuaugaaaauaagauguu

SEQ ID NO: 861384 - RNA, 22 nt, Human
gucuucuguaagaugagguccc

SEQ ID NO: 861385 - RNA, 22 nt, Human
cucaggaaaggccaugcaaggg

SEQ ID NO: 861386 - RNA, 22 nt, Human
acacaauacagggcucaaaaua

SEQ ID NO: 861387 - RNA, 22 nt, Human
cucugcaugccuugcucagaca

SEQ ID NO: 861388 - RNA, 22 nt, Human
caaggccaaagggccacuguca

SEQ ID NO: 861389 - RNA, 22 nt, Human
cagagauuauuauaacuaauua

SEQ ID NO: 861390 - RNA, 21 nt, Human
ggcagcguguggacaggaagg

SEQ ID NO: 861391 - RNA, 22 nt, Human
uuugaaaggugucgagaugugu

SEQ ID NO: 861392 - RNA, 22 nt, Human
cagcaggaggugaguagcaggu

SEQ ID NO: 861393 - RNA, 22 nt, Human
aacacuuucuauuauuaugguu

SEQ ID NO: 861394 - RNA, 22 nt, Human
auuuaucucuggaaacuaagca

SEQ ID NO: 861395 - RNA, 21 nt, Human
aaagaaucauggguaauuuca

SEQ ID NO: 861396 - RNA, 22 nt, Human
auaaagucuaccguauuaaaga

SEQ ID NO: 861397 - RNA, 22 nt, Human
ggaggcugagaaguccaagauc

SEQ ID NO: 861398 - RNA, 22 nt, Human
gcaaacaagcugccugaagauu

SEQ ID NO: 861399 - RNA, 22 nt, Human
aggaaacuccccuacaucucaa

SEQ ID NO: 861400 - RNA, 22 nt, Human
aagauuauuuaagacaggaacc

SEQ ID NO: 861401 - RNA, 22 nt, Human
cagucucucagcuuucagcugu

SEQ ID NO: 861402 - RNA, 22 nt, Human
cagaaagcuuaggcaaguugga

SEQ ID NO: 861403 - RNA, 22 nt, Human
uggcagcuagauaguguguuua

SEQ ID NO: 861404 - RNA, 22 nt, Human
aaggcagccaugugcuuugggu

SEQ ID NO: 861405 - RNA, 22 nt, Human
cucaggaugaaagucaugguga

SEQ ID NO: 861406 - RNA, 22 nt, Human
ucucaggaaauaggauuugagu

SEQ ID NO: 861407 - RNA, 19 nt, Human
aaaauugcguauuuugagg

SEQ ID NO: 861408 - RNA, 22 nt, Human
uggcuuuagguugcauguuucu

SEQ ID NO: 861409 - RNA, 22 nt, Human
ggggggugcugaucaguggagc

SEQ ID NO: 861410 - RNA, 22 nt, Human
ugaaggccagcagagugaaggc

SEQ ID NO: 861411 - RNA, 22 nt, Human
agaaaugacaagacugaucagg

SEQ ID NO: 861412 - RNA, 23 nt, Human
auguuauuauuagcagucuugcc

SEQ ID NO: 861413 - RNA, 22 nt, Human
cuucuucacacuggucugaagc

SEQ ID NO: 861414 - RNA, 22 nt, Human
aucaggaugacuauaaggcugc

SEQ ID NO: 861415 - RNA, 22 nt, Human
aucacauuguuagcauagacug

SEQ ID NO: 861416 - RNA, 22 nt, Human
ucugcaggcucuagaugagguu

SEQ ID NO: 861417 - RNA, 22 nt, Human
ugaggcaggagaauggcgggaa

SEQ ID NO: 861418 - RNA, 22 nt, Human
cuaaagaagcuagcaaucuaua

SEQ ID NO: 861419 - RNA, 22 nt, Human
auucuucaccauggauaauuug

SEQ ID NO: 861420 - RNA, 22 nt, Human
gagaggugaaggcugcccuggg

SEQ ID NO: 861421 - RNA, 22 nt, Human
ggcagcuucuuaauauggagac

SEQ ID NO: 861422 - RNA, 22 nt, Human
gucaggaugacaagugcuuuca

SEQ ID NO: 861423 - RNA, 22 nt, Human
cuuugaagauggcaaauuuaga

SEQ ID NO: 861424 - RNA, 22 nt, Human
gauuucuugaccccugucucag

SEQ ID NO: 861425 - RNA, 22 nt, Human
cauuucaauuauuugcucuucu

SEQ ID NO: 861426 - RNA, 17 nt, Human
aagagaggcugagcugg

SEQ ID NO: 861427 - RNA, 22 nt, Human
acagaaugggauuugaauauuu

SEQ ID NO: 861428 - RNA, 22 nt, Human
ugauugaacugagcuucaagau

SEQ ID NO: 861429 - RNA, 22 nt, Human
uuuauccaaggguuuuaacugu

SEQ ID NO: 861430 - RNA, 22 nt, Human
uuccaugaaauguguuaugcuu

SEQ ID NO: 861431 - RNA, 21 nt, Human
uucuucaaagaagaaggcaca

SEQ ID NO: 861432 - RNA, 22 nt, Human
uuuuugcugauaagcagaauuc

SEQ ID NO: 861433 - RNA, 22 nt, Human
acuuauuagcugugugaccuug

SEQ ID NO: 861434 - RNA, 22 nt, Human
gcagaauucuacagaugauaaa

SEQ ID NO: 861435 - RNA, 22 nt, Human
aaaaauugcugagaacggaauu

SEQ ID NO: 861436 - RNA, 22 nt, Human
cagugauggauauggagaaguc

SEQ ID NO: 861437 - RNA, 22 nt, Human
agccuauuccaggaugagcuca

SEQ ID NO: 861438 - RNA, 22 nt, Human
cugcugugacagcugccguguu

SEQ ID NO: 861439 - RNA, 22 nt, Human
uggcagcugcaggccuccugag

SEQ ID NO: 861440 - RNA, 22 nt, Human
gaggcagcauucgcauagacag

SEQ ID NO: 861441 - RNA, 22 nt, Human
aaguuugcauagauuaagcauu

SEQ ID NO: 861442 - RNA, 22 nt, Human
uuuucaguuccaucucugcucu

SEQ ID NO: 861443 - RNA, 21 nt, Human
uggagacucugguucuuugug

SEQ ID NO: 861444 - RNA, 22 nt, Human
ugucaccagcugcuccucagga

SEQ ID NO: 861445 - RNA, 22 nt, Human
gaggaaccaaucugugauauuc

SEQ ID NO: 861446 - RNA, 22 nt, Human
caauuuuuuccaugcucuuaca

SEQ ID NO: 861447 - RNA, 22 nt, Human
ucaggagaaucagggcuguccu

SEQ ID NO: 861448 - RNA, 19 nt, Human
caggaaggggcgaaucugg

SEQ ID NO: 861449 - RNA, 22 nt, Human
auuuuacuuugugaauauugac

SEQ ID NO: 861450 - RNA, 22 nt, Human
gaacuguaguuaauacuacaca

SEQ ID NO: 861451 - RNA, 22 nt, Human
gauuuuauuagcccaaacuuug

SEQ ID NO: 861452 - RNA, 22 nt, Human
aggcaguuucugggacagcaua

SEQ ID NO: 861453 - RNA, 23 nt, Human
uuuuccagaaucgacucuguaga

SEQ ID NO: 861454 - RNA, 22 nt, Human
cagauauuaggagcucaauaau

SEQ ID NO: 861455 - RNA, 22 nt, Human
ccaugagcuuccuauauagggu

SEQ ID NO: 861456 - RNA, 22 nt, Human
cacaauuuguuuuaucaguauu

SEQ ID NO: 861457 - RNA, 22 nt, Human
aaauggaucuguggaauacauu

SEQ ID NO: 861458 - RNA, 21 nt, Human
uccaggaguucuaauaggugu

SEQ ID NO: 861459 - RNA, 22 nt, Human
cauuuguaucauauguaucuua

SEQ ID NO: 861460 - RNA, 22 nt, Human
uacaacauuguguugcuucaua

SEQ ID NO: 861461 - RNA, 22 nt, Human
gagccagcuauguagcaagagg

SEQ ID NO: 861462 - RNA, 22 nt, Human
aagucacccuagggccuggacu

SEQ ID NO: 861463 - RNA, 23 nt, Human
agaauuccaguuucuuaugucac

SEQ ID NO: 861464 - RNA, 22 nt, Human
agaccaagacuauaaugagagg

SEQ ID NO: 861465 - RNA, 22 nt, Human
ugucaccaugcgaggcuaauuu

SEQ ID NO: 861466 - RNA, 22 nt, Human
gguacaauucugggguaugcuc

SEQ ID NO: 861467 - RNA, 22 nt, Human
aggcagauuuaggagaaaagaa

SEQ ID NO: 861468 - RNA, 22 nt, Human
uuuaacagguaaaguaaaugug

SEQ ID NO: 861469 - RNA, 22 nt, Human
cauugcuguuaauugucucuag

SEQ ID NO: 861470 - RNA, 22 nt, Human
aauaauaagauacuaagggagu

SEQ ID NO: 861471 - RNA, 22 nt, Human
agugcuuugaacgaaaggcuga

SEQ ID NO: 861472 - RNA, 22 nt, Human
auuucagaugaccaaauggaaa

SEQ ID NO: 861473 - RNA, 22 nt, Human
caccagacagguguaugcauau

SEQ ID NO: 861474 - RNA, 22 nt, Human
ccucaugguacuuacuguagcu

SEQ ID NO: 861475 - RNA, 22 nt, Human
cauuuucagcacccaucugaaa

SEQ ID NO: 861476 - RNA, 21 nt, Human
gggcagcucuguuuuauuuuc

SEQ ID NO: 861477 - RNA, 22 nt, Human
gauggcuucacuuacauggcug

SEQ ID NO: 861478 - RNA, 22 nt, Human
uuuuagcacuaagugauaugcu

SEQ ID NO: 861479 - RNA, 22 nt, Human
cauuuguaguaucuguuuauau

SEQ ID NO: 861480 - RNA, 22 nt, Human
ggauggagguucucagaugcuc

SEQ ID NO: 861481 - RNA, 22 nt, Human
uaguccuuuccggcugcuauaa

SEQ ID NO: 861482 - RNA, 22 nt, Human
ucauucuugaucacuaguuagu

SEQ ID NO: 861483 - RNA, 22 nt, Human
ucaauucugguccucaggaacu

SEQ ID NO: 861484 - RNA, 22 nt, Human
cagggagggaggaaaauuugcu

SEQ ID NO: 861485 - RNA, 19 nt, Human
uggggcuguguuuugaccc

SEQ ID NO: 861486 - RNA, 22 nt, Human
uuauuugcccauguuuagcaga

SEQ ID NO: 861487 - RNA, 22 nt, Human
ccuggagagagaggccaacugc

SEQ ID NO: 861488 - RNA, 22 nt, Human
gacagcugugcaggagaagggg

SEQ ID NO: 861489 - RNA, 22 nt, Human
uucugugauugacauguggcuu

SEQ ID NO: 861490 - RNA, 22 nt, Human
cggagaggugggggcagcaucu

SEQ ID NO: 861491 - RNA, 22 nt, Human
gacagaggcuggagcaccuccu

SEQ ID NO: 861492 - RNA, 22 nt, Human
acaauuccacauggcaugcagg

SEQ ID NO: 861493 - RNA, 22 nt, Human
uucuauacaaagauuucucaca

SEQ ID NO: 861494 - RNA, 23 nt, Human
uuucuucagaagccuugcgaggc

SEQ ID NO: 861495 - RNA, 22 nt, Human
caggcagcguccugcuuccugu

SEQ ID NO: 861496 - RNA, 22 nt, Human
ccuauacagccucagcugagau

SEQ ID NO: 861497 - RNA, 22 nt, Human
acccaggacacagagaugaccc

SEQ ID NO: 861498 - RNA, 22 nt, Human
uugaauaauguguauguuguua

SEQ ID NO: 861499 - RNA, 22 nt, Human
aaugaaacuguauauagacugu

SEQ ID NO: 861500 - RNA, 22 nt, Human
uuuuuuaguuaggucagaaugu

SEQ ID NO: 861501 - RNA, 20 nt, Human
gaagcagcuucauguagaca

SEQ ID NO: 861502 - RNA, 22 nt, Human
auugaaaauaaggccagaaaca

SEQ ID NO: 861503 - RNA, 22 nt, Human
aauacaguagguaauaguucau

SEQ ID NO: 861504 - RNA, 22 nt, Human
auauucuugugauuauaaagua

SEQ ID NO: 861505 - RNA, 21 nt, Human
ccauaccuaccucaccugguu

SEQ ID NO: 861506 - RNA, 22 nt, Human
auucuucaucagagaugcacua

SEQ ID NO: 861507 - RNA, 17 nt, Human
uaaguccuaguuauuuu

SEQ ID NO: 861508 - RNA, 22 nt, Human
uggcuuaagauuuaugcuuuua

SEQ ID NO: 861509 - RNA, 22 nt, Human
agacccagaaagcagcugcauu

SEQ ID NO: 861510 - RNA, 22 nt, Human
aguccaugguucugacucaucu

SEQ ID NO: 861511 - RNA, 22 nt, Human
aaauauaguaaaugcauaguuc

SEQ ID NO: 861512 - RNA, 22 nt, Human
caggcagcucgaugccuuguug

SEQ ID NO: 861513 - RNA, 20 nt, Human
ucuggcaggugaacgagcug

SEQ ID NO: 861514 - RNA, 22 nt, Human
augcuuaacucuguacauaguu

SEQ ID NO: 861515 - RNA, 22 nt, Human
agcagccuuugaucaucuggga

SEQ ID NO: 861516 - RNA, 22 nt, Human
caaggccaagguuuugugaacu

SEQ ID NO: 861517 - RNA, 22 nt, Human
accaggagggacccugguggcc

SEQ ID NO: 861518 - RNA, 22 nt, Human
acucaggaaaugaagacugguu

SEQ ID NO: 861519 - RNA, 19 nt, Human
ugcuuaauuccuaguaggu

SEQ ID NO: 861520 - RNA, 22 nt, Human
uucaggauaguggugaguggca

SEQ ID NO: 861521 - RNA, 22 nt, Human
uuagccauugucagcacauggc

SEQ ID NO: 861522 - RNA, 22 nt, Human
ugagaacugaggauuugaauuc

SEQ ID NO: 861523 - RNA, 22 nt, Human
cugcugugcacccaggaaggcu

SEQ ID NO: 861524 - RNA, 20 nt, Human
uuccaacucacaucucuaca

SEQ ID NO: 861525 - RNA, 22 nt, Human
auguuucaaugcacuuuagccu

SEQ ID NO: 861526 - RNA, 22 nt, Human
ccuggauccaugaaaaggcuac

SEQ ID NO: 861527 - RNA, 22 nt, Human
uaagaaucuauuaggaauaugu

SEQ ID NO: 861528 - RNA, 22 nt, Human
uuuggacaaguuacugguuucc

SEQ ID NO: 861529 - RNA, 22 nt, Human
aaaacaguuuaggcaucacagu

SEQ ID NO: 861530 - RNA, 22 nt, Human
uucaggauccccuugaugggcu

SEQ ID NO: 861531 - RNA, 22 nt, Human
caaagccaggcuuucuaaugua

SEQ ID NO: 861532 - RNA, 22 nt, Human
auugcuaggaacagguugcacc

SEQ ID NO: 861533 - RNA, 22 nt, Human
cagugaaaucacaacuuuaguu

SEQ ID NO: 861534 - RNA, 22 nt, Human
cugcuucugggaugauggagua

SEQ ID NO: 861535 - RNA, 22 nt, Human
acaaauauuuacugaauccacu

SEQ ID NO: 861536 - RNA, 22 nt, Human
uccaggaguggggcagaggucu

SEQ ID NO: 861537 - RNA, 22 nt, Human
gcauguguugguuuaugcaugu

SEQ ID NO: 861538 - RNA, 22 nt, Human
ugccaggauauaagagugcgau

SEQ ID NO: 861539 - RNA, 22 nt, Human
uuauuuaaugugaucugaagag

SEQ ID NO: 861540 - RNA, 23 nt, Human
cauuucaacgaauuuuccuucug

SEQ ID NO: 861541 - RNA, 23 nt, Human
auauggcuguuguguguuaacau

SEQ ID NO: 861542 - RNA, 22 nt, Human
ccaggacagugaacauguaaga

SEQ ID NO: 861543 - RNA, 22 nt, Human
uucagaaagguaaauggauuuc

SEQ ID NO: 861544 - RNA, 22 nt, Human
cauagcuuagggguuaaacuca

SEQ ID NO: 861545 - RNA, 22 nt, Human
cagaauaaaagucccaaggcau

SEQ ID NO: 861546 - RNA, 22 nt, Human
uuugcacuagcauuuguccaug

SEQ ID NO: 861547 - RNA, 22 nt, Human
gcagagaacccagcagauuggc

SEQ ID NO: 861548 - RNA, 22 nt, Human
gaggccaggacaugaaagcuga

SEQ ID NO: 861549 - RNA, 22 nt, Human
aucuauacuacaaauggcuggu

SEQ ID NO: 861550 - RNA, 23 nt, Human
gaaucaguggcuaacaaggaaac

SEQ ID NO: 861551 - RNA, 22 nt, Human
guucuucaaagugacaacuaaa

SEQ ID NO: 861552 - RNA, 22 nt, Human
uggauuuaccacagggccacag

SEQ ID NO: 861553 - RNA, 22 nt, Human
acagaauuuaaagcucuagacu

SEQ ID NO: 861554 - RNA, 19 nt, Human
uagaggagaagggaagugg

SEQ ID NO: 861555 - RNA, 22 nt, Human
ggcauuuacauaaucuuauuua

SEQ ID NO: 861556 - RNA, 22 nt, Human
ucaaaauuagugaccaaaggca

SEQ ID NO: 861557 - RNA, 22 nt, Human
auagaaauguauuuuggacuag

SEQ ID NO: 861558 - RNA, 22 nt, Human
cagagggaaaaggggaguaaua

SEQ ID NO: 861559 - RNA, 23 nt, Human
uuuaacuuuccaauaauucauug

SEQ ID NO: 861560 - RNA, 22 nt, Human
ugucucugggugauucaguccu

SEQ ID NO: 861561 - RNA, 22 nt, Human
gggcagcuggccagguauucug

SEQ ID NO: 861562 - RNA, 22 nt, Human
cuggcuugcagcucaucauaaa

SEQ ID NO: 861563 - RNA, 22 nt, Human
guggcaggagagacacagccau

SEQ ID NO: 861564 - RNA, 22 nt, Human
gagaggauccacaaaccaggaa

SEQ ID NO: 861565 - RNA, 22 nt, Human
ucugaaagaagggcagucuuuu

SEQ ID NO: 861566 - RNA, 22 nt, Human
uggauuuauuagguuggugaaa

SEQ ID NO: 861567 - RNA, 20 nt, Human
aagcacauuucuacaauaau

SEQ ID NO: 861568 - RNA, 19 nt, Human
gaggucagcaagaaguauu

SEQ ID NO: 861569 - RNA, 22 nt, Human
agaaaacuugucacagcucuca

SEQ ID NO: 861570 - RNA, 22 nt, Human
ccaggagagcucuaaauggcug

SEQ ID NO: 861571 - RNA, 15 nt, Human
uggcagcuuguuaag

SEQ ID NO: 861572 - RNA, 22 nt, Human
uuuaucuuuaggacuuugcaga

SEQ ID NO: 861573 - RNA, 19 nt, Human
gccaggagggcucuggcug

SEQ ID NO: 861574 - RNA, 22 nt, Human
guuccaaacaagucauaaagua

SEQ ID NO: 861575 - RNA, 22 nt, Human
ucaccgccuugcccggccgggc

SEQ ID NO: 861576 - RNA, 22 nt, Human
auauuguugacuauaagaguaa

SEQ ID NO: 861577 - RNA, 22 nt, Human
cagcucccgccaucgggaggca

SEQ ID NO: 861578 - RNA, 22 nt, Human
uugaauaauauguucaggagga

SEQ ID NO: 861579 - RNA, 22 nt, Human
uuuaacagaugcuaugucuacc

SEQ ID NO: 861580 - RNA, 22 nt, Human
agaggcaggagguugacuugag

SEQ ID NO: 861581 - RNA, 22 nt, Human
aggucagcaugaguagaaggua

SEQ ID NO: 861582 - RNA, 22 nt, Human
gaggcaacacauuuggaaagca

SEQ ID NO: 861583 - RNA, 22 nt, Human
auucaaauuaaguuaauucagc

SEQ ID NO: 861584 - RNA, 22 nt, Human
ucuucagagugaaagucuguga

SEQ ID NO: 861585 - RNA, 21 nt, Human
auaagcaugcugauuacauuu

SEQ ID NO: 861586 - RNA, 22 nt, Human
uucuucaaaacaacacuggccu

SEQ ID NO: 861587 - RNA, 22 nt, Human
aaagccagagcaagcugucaca

SEQ ID NO: 861588 - RNA, 22 nt, Human
agauaaugaaugccaugacauu

SEQ ID NO: 861589 - RNA, 22 nt, Human
auggagacgcaagggaccuagg

SEQ ID NO: 861590 - RNA, 22 nt, Human
cucaucugauaaaucacucuua

SEQ ID NO: 861591 - RNA, 22 nt, Human
acagaauucuaguauguggcuu

SEQ ID NO: 861592 - RNA, 22 nt, Human
cccaugagauucugaauuuggc

SEQ ID NO: 861593 - RNA, 20 nt, Human
auccaugagagucuggauuc

SEQ ID NO: 861594 - RNA, 18 nt, Human
aggcagacacuagagguc

SEQ ID NO: 861595 - RNA, 22 nt, Human
agaauaaucacugaaguucaaa

SEQ ID NO: 861596 - RNA, 23 nt, Human
gaggcagcuccugcagugcccug

SEQ ID NO: 861597 - RNA, 22 nt, Human
ggcaggcagaggcugagacagg

SEQ ID NO: 861598 - RNA, 22 nt, Human
agaggaugauuuuaaggacacu

SEQ ID NO: 861599 - RNA, 22 nt, Human
ucaggauguccaaaauccagcc

SEQ ID NO: 861600 - RNA, 23 nt, Human
uuagagaugauuaaaaaaucuug

SEQ ID NO: 861601 - RNA, 22 nt, Human
gugacagucaaagacaugacuu

SEQ ID NO: 861602 - RNA, 22 nt, Human
gcagcugaauguccauugcugc

SEQ ID NO: 861603 - RNA, 22 nt, Human
gauggcagcagcagccagggau

SEQ ID NO: 861604 - RNA, 22 nt, Human
cauagaaaagaguagguaaugu

SEQ ID NO: 861605 - RNA, 22 nt, Human
gcccaggaaagauagggccuca

SEQ ID NO: 861606 - RNA, 22 nt, Human
auuccaaagccugaauaaugga

SEQ ID NO: 861607 - RNA, 22 nt, Human
aaggcagcaggauuuggugacu

SEQ ID NO: 861608 - RNA, 22 nt, Human
uucaggauggaguaccuuuuau

SEQ ID NO: 861609 - RNA, 22 nt, Human
cugcugugaguuuggaggucua

SEQ ID NO: 861610 - RNA, 22 nt, Human
uaaagcaguguugggucggacg

SEQ ID NO: 861611 - RNA, 23 nt, Human
uggcagcuguguaagagaaagca

SEQ ID NO: 861612 - RNA, 22 nt, Human
aguaaacauagaauguucuucc

SEQ ID NO: 861613 - RNA, 22 nt, Human
agcugaugccauguggaacagu

SEQ ID NO: 861614 - RNA, 22 nt, Human
uaucagaaacucuggggcaggg

SEQ ID NO: 861615 - RNA, 22 nt, Human
ggccuuuaagcaauugaaaaga

SEQ ID NO: 861616 - RNA, 22 nt, Human
aaaggagacuucagaucuccuu

SEQ ID NO: 861617 - RNA, 22 nt, Human
cuacagaagaaacuaucacuau

SEQ ID NO: 861618 - RNA, 22 nt, Human
gaggccaggagugcuguaaguu

SEQ ID NO: 861619 - RNA, 22 nt, Human
gaaggccauuuuuagguagaau

SEQ ID NO: 861620 - RNA, 20 nt, Human
cugcccagccacugagggau

SEQ ID NO: 861621 - RNA, 22 nt, Human
uucccaugccuggccccuaucc

SEQ ID NO: 861622 - RNA, 22 nt, Human
acaacuuugacccuuguucuua

SEQ ID NO: 861623 - RNA, 22 nt, Human
uucuucuuuaucucaguauccu

SEQ ID NO: 861624 - RNA, 22 nt, Human
uaucuaaauggaauauuccaga

SEQ ID NO: 861625 - RNA, 22 nt, Human
agagggauaauauguauuguaa

SEQ ID NO: 861626 - RNA, 22 nt, Human
aaguauaagcuauucuucauga

SEQ ID NO: 861627 - RNA, 22 nt, Human
uuaauaaaguaugaauuggaaa

SEQ ID NO: 861628 - RNA, 22 nt, Human
acccaggagcaggcugggcagu

SEQ ID NO: 861629 - RNA, 22 nt, Human
cccagcaguaaccaguggaaau

SEQ ID NO: 861630 - RNA, 22 nt, Human
gcugcaggcauuuuccugggca

SEQ ID NO: 861631 - RNA, 22 nt, Human
gggcagcucuuugguauccuuc

SEQ ID NO: 861632 - RNA, 22 nt, Human
auuucaacauucucaguuguag

SEQ ID NO: 861633 - RNA, 22 nt, Human
uggccaggcagguagaacggcc

SEQ ID NO: 861634 - RNA, 22 nt, Human
gaauacaugauacaugaacugc

SEQ ID NO: 861635 - RNA, 22 nt, Human
acuucacagaaauuuuaugagg

SEQ ID NO: 861636 - RNA, 22 nt, Human
agucucagaaaagaagcaugga

SEQ ID NO: 861637 - RNA, 22 nt, Human
gcaucuaaauaaacgugggagu

SEQ ID NO: 861638 - RNA, 22 nt, Human
cuggcuuuggucaugugaucau

SEQ ID NO: 861639 - RNA, 20 nt, Human
caguccaaucagaggccacc

SEQ ID NO: 861640 - RNA, 22 nt, Human
gcagggaagaucuuggagcugc

SEQ ID NO: 861641 - RNA, 22 nt, Human
auuucaacguuagauguaauag

SEQ ID NO: 861642 - RNA, 17 nt, Human
uugaacugcugagucag

SEQ ID NO: 861643 - RNA, 22 nt, Human
acauaauaaaaauaacagcuca

SEQ ID NO: 861644 - RNA, 22 nt, Human
aucugcagaggacaggcgagga

SEQ ID NO: 861645 - RNA, 22 nt, Human
aggccagcgcugcuagcucccg

SEQ ID NO: 861646 - RNA, 23 nt, Human
aggauguaggauguauggcagag

SEQ ID NO: 861647 - RNA, 20 nt, Human
uaggcagcuugacccuuggu

SEQ ID NO: 861648 - RNA, 22 nt, Human
ccaggacaaguguggccauggc

SEQ ID NO: 861649 - RNA, 22 nt, Human
augcugugccuggaaagcggcu

SEQ ID NO: 861650 - RNA, 22 nt, Human
uguucauuuggcccuuuuguau

SEQ ID NO: 861651 - RNA, 22 nt, Human
ucaggauguuaauauagcauua

SEQ ID NO: 861652 - RNA, 22 nt, Human
gugcauuugacgaauacucacu

SEQ ID NO: 861653 - RNA, 22 nt, Human
uccagaaacuuuuccagucuca

SEQ ID NO: 861654 - RNA, 22 nt, Human
aaacuuuguucgucugaugugg

SEQ ID NO: 861655 - RNA, 22 nt, Human
uagauauaucugucauacuggu

SEQ ID NO: 861656 - RNA, 22 nt, Human
uaaacauguugacaucuuaccu

SEQ ID NO: 861657 - RNA, 23 nt, Human
aaucuauacuuaggcugguaaua

SEQ ID NO: 861658 - RNA, 22 nt, Human
uuaaauauuauguugucugcaa

SEQ ID NO: 861659 - RNA, 22 nt, Human
uaucagaaggcacauggagucu

SEQ ID NO: 861660 - RNA, 22 nt, Human
cagucaccuagacagaacuuac

SEQ ID NO: 861661 - RNA, 20 nt, Human
uuucaguugguuaauggcau

SEQ ID NO: 861662 - RNA, 22 nt, Human
aauauaugagggagcuauuuga

SEQ ID NO: 861663 - RNA, 22 nt, Human
caucagaaagaguccuggacuu

SEQ ID NO: 861664 - RNA, 22 nt, Human
uagcaucuguucuuucauuaaa

SEQ ID NO: 861665 - RNA, 22 nt, Human
uagcagaagaacaacaugaucu

SEQ ID NO: 861666 - RNA, 22 nt, Human
aggcaguuguagagagggcucu

SEQ ID NO: 861667 - RNA, 22 nt, Human
agggcagcccuucugggagggc

SEQ ID NO: 861668 - RNA, 22 nt, Human
ccagcagagucuaggaaggagg

SEQ ID NO: 861669 - RNA, 22 nt, Human
gagggagggccaggucccaacc

SEQ ID NO: 861670 - RNA, 22 nt, Human
uuauuuauggcccucaccugau

SEQ ID NO: 861671 - RNA, 22 nt, Human
uggcauuucuguuagacucuca

SEQ ID NO: 861672 - RNA, 22 nt, Human
agaggauguucuaggcacucau

SEQ ID NO: 861673 - RNA, 22 nt, Human
cugcuguguuagcagguuuagu

SEQ ID NO: 861674 - RNA, 22 nt, Human
auguagagcaguguuguccaau

SEQ ID NO: 861675 - RNA, 22 nt, Human
cuugaaagauuuggccucugug

SEQ ID NO: 861676 - RNA, 22 nt, Human
ccuggacucaggcugugggcac

SEQ ID NO: 861677 - RNA, 22 nt, Human
uucucagguagugcugaugcug

SEQ ID NO: 861678 - RNA, 22 nt, Human
gugcuuucugcugcauuccucu

SEQ ID NO: 861679 - RNA, 22 nt, Human
uaagaaacccaggaauuucuua

SEQ ID NO: 861680 - RNA, 22 nt, Human
gcugccagcuuuccuuggcuga

SEQ ID NO: 861681 - RNA, 22 nt, Human
uuacagaagugaaggccuuuaa

SEQ ID NO: 861682 - RNA, 22 nt, Human
gaccauuuuuacagagcauuca

SEQ ID NO: 861683 - RNA, 22 nt, Human
agcccagggacagggcggaugu

SEQ ID NO: 861684 - RNA, 22 nt, Human
ggacagcucugccaggagcuca

SEQ ID NO: 861685 - RNA, 22 nt, Human
ggaggacacuggcucugccuuc

SEQ ID NO: 861686 - RNA, 22 nt, Human
gucuuucuaugaugaacuguug

SEQ ID NO: 861687 - RNA, 22 nt, Human
agucaccaucuguggcagccug

SEQ ID NO: 861688 - RNA, 22 nt, Human
cugucauuuaagacauucugga

SEQ ID NO: 861689 - RNA, 22 nt, Human
caaggccagagccagcgauaag

SEQ ID NO: 861690 - RNA, 22 nt, Human
cugaauaauguucucuuguaug

SEQ ID NO: 861691 - RNA, 22 nt, Human
uugagaagaaauaguuugcaau

SEQ ID NO: 861692 - RNA, 22 nt, Human
gaccuggaggauccucuucuug

SEQ ID NO: 861693 - RNA, 22 nt, Human
gagucaccacacggugcugacu

SEQ ID NO: 861694 - RNA, 22 nt, Human
uuccuuagggaaagggauaagg

SEQ ID NO: 861695 - RNA, 18 nt, Human
uuugcaaaggaaguaugg

SEQ ID NO: 861696 - RNA, 22 nt, Human
acagcauugcuccaucucaaga

SEQ ID NO: 861697 - RNA, 22 nt, Human
ggccagaaguuggaaaagagcc

SEQ ID NO: 861698 - RNA, 22 nt, Human
acauacauauguuuaaaugcau

SEQ ID NO: 861699 - RNA, 22 nt, Human
auuucacaucuaucucagauuu

SEQ ID NO: 861700 - RNA, 22 nt, Human
ggagccuggucagguuggcucc

SEQ ID NO: 861701 - RNA, 22 nt, Human
uucauugugauucuuggcuagc

SEQ ID NO: 861702 - RNA, 22 nt, Human
auuaaagacagcagauggaugg

SEQ ID NO: 861703 - RNA, 22 nt, Human
guaaacaacacaaaucauuuga

SEQ ID NO: 861704 - RNA, 22 nt, Human
uuagacaagggcuccuuaaaag

SEQ ID NO: 861705 - RNA, 22 nt, Human
ccaaacaaauccccauucuuag

SEQ ID NO: 861706 - RNA, 22 nt, Human
uaucaauacauguuaucagugu

SEQ ID NO: 861707 - RNA, 22 nt, Human
agcgagggaggucugaggacag

SEQ ID NO: 861708 - RNA, 22 nt, Human
uacuuuuuagcacagugugugc

SEQ ID NO: 861709 - RNA, 22 nt, Human
uuaaagaauagugccccuauug

SEQ ID NO: 861710 - RNA, 22 nt, Human
cucauacauaugccauuccugc

SEQ ID NO: 861711 - RNA, 22 nt, Human
uggcuuuacacauccacugccu

SEQ ID NO: 861712 - RNA, 22 nt, Human
ccagugcuucuuugcuagcugg

SEQ ID NO: 861713 - RNA, 22 nt, Human
uggauuaguuaagaaauguuag

SEQ ID NO: 861714 - RNA, 22 nt, Human
uguacaaugccgagacuaacuc

SEQ ID NO: 861715 - RNA, 22 nt, Human
caaaugauaccuauuacuaggc

SEQ ID NO: 861716 - RNA, 22 nt, Human
gcuugaaaauucauagguauuu

SEQ ID NO: 861717 - RNA, 22 nt, Human
auuccaaacgccucgcggacuu

SEQ ID NO: 861718 - RNA, 22 nt, Human
cagaaaauaaaguuucuacgca

SEQ ID NO: 861719 - RNA, 22 nt, Human
cccuggaguccuggcaguugau

SEQ ID NO: 861720 - RNA, 22 nt, Human
auuugcuucugugaaaucaagu

SEQ ID NO: 861721 - RNA, 22 nt, Human
gaaggccacaaaaaaugucaua

SEQ ID NO: 861722 - RNA, 20 nt, Human
caggaugauuggacacgaug

SEQ ID NO: 861723 - RNA, 22 nt, Human
gugggagcuuuggcaucaggcu

SEQ ID NO: 861724 - RNA, 22 nt, Human
uuuccuaguucuaagaaaugua

SEQ ID NO: 861725 - RNA, 22 nt, Human
augcuuaaugaggguauauaug

SEQ ID NO: 861726 - RNA, 22 nt, Human
uuacagaaaggaaggacugacu

SEQ ID NO: 861727 - RNA, 22 nt, Human
augcuuaagcucaguuauauau

SEQ ID NO: 861728 - RNA, 22 nt, Human
auuccaaacucuuucccugucg

SEQ ID NO: 861729 - RNA, 22 nt, Human
ucagaauuuuuguuacccuuga

SEQ ID NO: 861730 - RNA, 22 nt, Human
gcuccucuucucccacugaaug

SEQ ID NO: 861731 - RNA, 22 nt, Human
aaugccaacuuggauauacauu

SEQ ID NO: 861732 - RNA, 22 nt, Human
cuuaggcagacugcugaugcag

SEQ ID NO: 861733 - RNA, 22 nt, Human
uuuggaaugguaccuucaguug

SEQ ID NO: 861734 - RNA, 22 nt, Human
uccaugagcuagggauucauca

SEQ ID NO: 861735 - RNA, 22 nt, Human
caaggccaguucaccaagggca

SEQ ID NO: 861736 - RNA, 22 nt, Human
cucaggaugcaauuccaucaag

SEQ ID NO: 861737 - RNA, 22 nt, Human
caggcagcuagauuuauaacaa

SEQ ID NO: 861738 - RNA, 23 nt, Human
auuugagaaaguauuuuuaagac

SEQ ID NO: 861739 - RNA, 22 nt, Human
uugcagcuuagugauguuaucu

SEQ ID NO: 861740 - RNA, 22 nt, Human
gacccaggcucgugggacggcu

SEQ ID NO: 861741 - RNA, 23 nt, Human
ccacagagcugccaauuccugug

SEQ ID NO: 861742 - RNA, 22 nt, Human
uccaugagcuagcuuuccaaag

SEQ ID NO: 861743 - RNA, 22 nt, Human
uccucagacuucccuuugugua

SEQ ID NO: 861744 - RNA, 22 nt, Human
aucuuucaguuucauaccaauu

SEQ ID NO: 861745 - RNA, 22 nt, Human
guuaucaugcuucaucaucacu

SEQ ID NO: 861746 - RNA, 22 nt, Human
gccagucugcucccacaaguuc

SEQ ID NO: 861747 - RNA, 22 nt, Human
ugcauguguguguauuuauaaa

SEQ ID NO: 861748 - RNA, 22 nt, Human
gcuggcagggacagcugcgugu

SEQ ID NO: 861749 - RNA, 22 nt, Human
cagucaccauagaauaaaacau

SEQ ID NO: 861750 - RNA, 18 nt, Human
auagaaaccuuuaaucag

SEQ ID NO: 861751 - RNA, 22 nt, Human
cuuuguagcugcuucugauuua

SEQ ID NO: 861752 - RNA, 22 nt, Human
uuucaacuugaagaauugauac

SEQ ID NO: 861753 - RNA, 22 nt, Human
auaucacaguaguuguuuaguu

SEQ ID NO: 861754 - RNA, 22 nt, Human
aggcagcuuaagcccuggccca

SEQ ID NO: 861755 - RNA, 22 nt, Human
uauuuccaagcugaauccaaug

SEQ ID NO: 861756 - RNA, 21 nt, Human
ucacaucuauguuaagcaaac

SEQ ID NO: 861757 - RNA, 18 nt, Human
uuccaugauuccuuucac

SEQ ID NO: 861758 - RNA, 22 nt, Human
auuuaaaugcuuaagaggguuu

SEQ ID NO: 861759 - RNA, 22 nt, Human
cagaaggcuggcagauugagau

SEQ ID NO: 861760 - RNA, 22 nt, Human
acaauacaggcuucuggacuua

SEQ ID NO: 861761 - RNA, 22 nt, Human
gauaaaauucuuauuuuacccg

SEQ ID NO: 861762 - RNA, 22 nt, Human
guucuucaggccauccucccag

SEQ ID NO: 861763 - RNA, 22 nt, Human
uauuucagcccuacuacuuggc

SEQ ID NO: 861764 - RNA, 22 nt, Human
uuucuuaguccuagagugauuu

SEQ ID NO: 861765 - RNA, 19 nt, Human
uuucagacucaucuccagc

SEQ ID NO: 861766 - RNA, 22 nt, Human
aggcaguggcugagaccagggg

SEQ ID NO: 861767 - RNA, 22 nt, Human
cuacagaaacacuggacaugug

SEQ ID NO: 861768 - RNA, 22 nt, Human
gcagagaagaugcccaggcuuc

SEQ ID NO: 861769 - RNA, 22 nt, Human
uacugaaauacuaagaaguuaa

SEQ ID NO: 861770 - RNA, 22 nt, Human
agaauucauaggaaguuuccua

SEQ ID NO: 861771 - RNA, 22 nt, Human
agcccaggugagggguucgaaa

SEQ ID NO: 861772 - RNA, 22 nt, Human
ugcacaaacuugugucccaggg

SEQ ID NO: 861773 - RNA, 22 nt, Human
uuuauuugaaucaggggagaau

SEQ ID NO: 861774 - RNA, 22 nt, Human
gcucaggacccaggugugaccu

SEQ ID NO: 861775 - RNA, 22 nt, Human
uuccaugaagggcagccucuca

SEQ ID NO: 861776 - RNA, 22 nt, Human
aaaauaacuucuacuauuugca

SEQ ID NO: 861777 - RNA, 18 nt, Human
guaggucaguaccaagca

SEQ ID NO: 861778 - RNA, 22 nt, Human
augaggcauuccacucaaacuc

SEQ ID NO: 861779 - RNA, 17 nt, Human
ucaggauguagcaguag

SEQ ID NO: 861780 - RNA, 22 nt, Human
ucaauaaaauuguuuuccuauc

SEQ ID NO: 861781 - RNA, 22 nt, Human
aaggcagcagugcacgacugau

SEQ ID NO: 861782 - RNA, 22 nt, Human
ggacagcugcuuucaggccaca

SEQ ID NO: 861783 - RNA, 22 nt, Human
ugcuauacggagcaucuucagg

SEQ ID NO: 861784 - RNA, 22 nt, Human
cauauaaauacaacauguguua

SEQ ID NO: 861785 - RNA, 21 nt, Human
agucccauccgguaagcaagc

SEQ ID NO: 861786 - RNA, 22 nt, Human
aggcaagcauugggaacagggc

SEQ ID NO: 861787 - RNA, 22 nt, Human
uuuccucauuuaucugcuggga

SEQ ID NO: 861788 - RNA, 22 nt, Human
uagucaccuuuggcaccugcaa

SEQ ID NO: 861789 - RNA, 22 nt, Human
gaggcagcaaaauauaucauaa

SEQ ID NO: 861790 - RNA, 20 nt, Human
uguuaaaggacacuugcuuu

SEQ ID NO: 861791 - RNA, 22 nt, Human
uuucauugcagagucugugugc

SEQ ID NO: 861792 - RNA, 22 nt, Human
aucaggauccaccuugagccug

SEQ ID NO: 861793 - RNA, 22 nt, Human
gcucaggaucagccaccucuuu

SEQ ID NO: 861794 - RNA, 18 nt, Human
uaaauauauuucccccuu

SEQ ID NO: 861795 - RNA, 22 nt, Human
aagcaccugcaguugacaaaaa

SEQ ID NO: 861796 - RNA, 22 nt, Human
auucaaguucuucugucuuugc

SEQ ID NO: 861797 - RNA, 22 nt, Human
uucacauuggugauauguuucu

SEQ ID NO: 861798 - RNA, 22 nt, Human
uugaaaguuaucuagauucuga

SEQ ID NO: 861799 - RNA, 22 nt, Human
agagggcagggcgguaaguccu

SEQ ID NO: 861800 - RNA, 22 nt, Human
cugcugugucagaguccagggg

SEQ ID NO: 861801 - RNA, 22 nt, Human
acauuguuugagaauacagaug

SEQ ID NO: 861802 - RNA, 22 nt, Human
agucaauuaucucuaggucauc

SEQ ID NO: 861803 - RNA, 22 nt, Human
gaggcagagugcaccccaggag

SEQ ID NO: 861804 - RNA, 22 nt, Human
gagccaaggguugccauggaga

SEQ ID NO: 861805 - RNA, 22 nt, Human
ggagaggguguggaaaguuauc

SEQ ID NO: 861806 - RNA, 22 nt, Human
cucuucuugaaagaggaauuca

SEQ ID NO: 861807 - RNA, 22 nt, Human
ccuggauucaagucuuucuuuc

SEQ ID NO: 861808 - RNA, 22 nt, Human
aaguccuucccaagcauguacc

SEQ ID NO: 861809 - RNA, 22 nt, Human
agcagagccugggcuaggggug

SEQ ID NO: 861810 - RNA, 22 nt, Human
aaucaguguguaaaguggcugc

SEQ ID NO: 861811 - RNA, 22 nt, Human
augaaggcuguguggagccccc

SEQ ID NO: 861812 - RNA, 22 nt, Human
gcaggagagucugugccagguu

SEQ ID NO: 861813 - RNA, 22 nt, Human
gcugaaugaauguauuuuaaaa

SEQ ID NO: 861814 - RNA, 22 nt, Human
cuguaugaggaucagacuggac

SEQ ID NO: 861815 - RNA, 22 nt, Human
cuugcacacauguacaugugua

SEQ ID NO: 861816 - RNA, 22 nt, Human
uuauuauuggugaguuaaggaa

SEQ ID NO: 861817 - RNA, 23 nt, Human
uguaacaauuucauauacaugca

SEQ ID NO: 861818 - RNA, 22 nt, Human
auguucuuguucaaaugucagu

SEQ ID NO: 861819 - RNA, 22 nt, Human
auaucagacagaaagcauugac

SEQ ID NO: 861820 - RNA, 22 nt, Human
gccaggaggcuuaacuggacag

SEQ ID NO: 861821 - RNA, 22 nt, Human
ugcuugugagaguuuuuucaga

SEQ ID NO: 861822 - RNA, 22 nt, Human
auaugcuugggacugauacagu

SEQ ID NO: 861823 - RNA, 22 nt, Human
ggguacuuaauauuuacggggu

SEQ ID NO: 861824 - RNA, 22 nt, Human
uagaauucauguuacuguuagc

SEQ ID NO: 861825 - RNA, 20 nt, Human
gcccaagguccagaaggggg

SEQ ID NO: 861826 - RNA, 22 nt, Human
ugaggcagugugagauaauaaa

SEQ ID NO: 861827 - RNA, 22 nt, Human
aaauuguugaucuacaguaagg

SEQ ID NO: 861828 - RNA, 22 nt, Human
auuauauaggacuugcccuucc

SEQ ID NO: 861829 - RNA, 18 nt, Human
agcuucccucugagaggg

SEQ ID NO: 861830 - RNA, 22 nt, Human
aagaggaggacgguucccagaa

SEQ ID NO: 861831 - RNA, 22 nt, Human
agagacagaggcaauauagcuu

SEQ ID NO: 861832 - RNA, 22 nt, Human
gcagggcaaacccagguguuca

SEQ ID NO: 861833 - RNA, 22 nt, Human
aaacauguuuucugaauauuuu

SEQ ID NO: 861834 - RNA, 22 nt, Human
agaaaugaagagagucaagguu

SEQ ID NO: 861835 - RNA, 22 nt, Human
uucaggauuguguuuuuccuga

SEQ ID NO: 861836 - RNA, 17 nt, Human
agauggcaggaggcaga

SEQ ID NO: 861837 - RNA, 22 nt, Human
aucuucucauguguaaugaggu

SEQ ID NO: 861838 - RNA, 22 nt, Human
cugcaucacagcaggaggcaca

SEQ ID NO: 861839 - RNA, 22 nt, Human
gaaggggacuggcagcugcaga

SEQ ID NO: 861840 - RNA, 22 nt, Human
ggagguggcagagggacauucu

SEQ ID NO: 861841 - RNA, 22 nt, Human
aacaugcugccuuucuacgagu

SEQ ID NO: 861842 - RNA, 22 nt, Human
ggccagcucugcacagcagcug

SEQ ID NO: 861843 - RNA, 22 nt, Human
uggcagcuccggguaggggcug

SEQ ID NO: 861844 - RNA, 22 nt, Human
uuugacaucuaagaauucuuac

SEQ ID NO: 861845 - RNA, 15 nt, Human
uucaggauaugacuc

SEQ ID NO: 861846 - RNA, 22 nt, Human
uucuucuuuccuauaauuaauu

SEQ ID NO: 861847 - RNA, 18 nt, Human
ugaaacaagaauggugca

SEQ ID NO: 861848 - RNA, 20 nt, Human
uguuccaagcuaaugaauga

SEQ ID NO: 861849 - RNA, 23 nt, Human
auucuucauuaucuucuagaaaa

SEQ ID NO: 861850 - RNA, 22 nt, Human
uuccuuagacagagguggucau

SEQ ID NO: 861851 - RNA, 22 nt, Human
ucacauaaauuauacaauuuca

SEQ ID NO: 861852 - RNA, 22 nt, Human
cuggcugggagcgagcugcuca

SEQ ID NO: 861853 - RNA, 22 nt, Human
augcuguguccuagugaaagaa

SEQ ID NO: 861854 - RNA, 22 nt, Human
gcccaggagccuggagaugugu

SEQ ID NO: 861855 - RNA, 22 nt, Human
agucaauucuuuucaacucaag

SEQ ID NO: 861856 - RNA, 22 nt, Human
ccugccugcaccuucucugggg

SEQ ID NO: 861857 - RNA, 22 nt, Human
gaaacugugaucguguucuggg

SEQ ID NO: 861858 - RNA, 22 nt, Human
ucuuagaaguucauguuccagc

SEQ ID NO: 861859 - RNA, 22 nt, Human
cauacuuugggauaagagugga

SEQ ID NO: 861860 - RNA, 18 nt, Human
uacagauuauagauacau

SEQ ID NO: 861861 - RNA, 22 nt, Human
aggcggcugguguccugcaggu

SEQ ID NO: 861862 - RNA, 22 nt, Human
acauuuuuuagagucccacauu

SEQ ID NO: 861863 - RNA, 23 nt, Human
gugcugugagccccuuggccucc

SEQ ID NO: 861864 - RNA, 22 nt, Human
uucaaguuuugccuccccaucc

SEQ ID NO: 861865 - RNA, 20 nt, Human
aagagaggaaguuauacuag

SEQ ID NO: 861866 - RNA, 22 nt, Human
aaaggugacugcagcagcuauu

SEQ ID NO: 861867 - RNA, 22 nt, Human
auuuacugagguaaauaaacug

SEQ ID NO: 861868 - RNA, 22 nt, Human
guuuucaaggggauuuaacuga

SEQ ID NO: 861869 - RNA, 22 nt, Human
acugguuuuccagguuacuucu

SEQ ID NO: 861870 - RNA, 22 nt, Human
uggcaaggcugugggggcagag

SEQ ID NO: 861871 - RNA, 22 nt, Human
cugcuguguuggcauuggauag

SEQ ID NO: 861872 - RNA, 22 nt, Human
cccaagagcuucuaggacgcug

SEQ ID NO: 861873 - RNA, 22 nt, Human
uuuauucaucaucuguucauau

SEQ ID NO: 861874 - RNA, 22 nt, Human
gcauucuuuuuaggagguuccu

SEQ ID NO: 861875 - RNA, 22 nt, Human
aaaauacuguggaguguugaaa

SEQ ID NO: 861876 - RNA, 22 nt, Human
uugcucaggcuggugugcagug

SEQ ID NO: 861877 - RNA, 22 nt, Human
aaucccagcuacucaggaaguu

SEQ ID NO: 861878 - RNA, 22 nt, Human
gaaauauuguacuggagauguu

SEQ ID NO: 861879 - RNA, 22 nt, Human
ucagcugcucaaauuuauguca

SEQ ID NO: 861880 - RNA, 22 nt, Human
uugcugugaaaccaugggaagu

SEQ ID NO: 861881 - RNA, 22 nt, Human
gauuucuuugcaagcuguguuc

SEQ ID NO: 861882 - RNA, 22 nt, Human
agaggacagguuuuccaugggc

SEQ ID NO: 861883 - RNA, 22 nt, Human
agcauauaaauggacauauuug

SEQ ID NO: 861884 - RNA, 22 nt, Human
cccaggaaaucaggcuuucuag

SEQ ID NO: 861885 - RNA, 22 nt, Human
ugaggcaggacauggacaacug

SEQ ID NO: 861886 - RNA, 22 nt, Human
agcccagguucuaaagccaaac

SEQ ID NO: 861887 - RNA, 18 nt, Human
agucuucugauccauuuu

SEQ ID NO: 861888 - RNA, 22 nt, Human
uuucugcugugcuuucuugcgu

SEQ ID NO: 861889 - RNA, 22 nt, Human
uuuuuguagucauuagaagagg

SEQ ID NO: 861890 - RNA, 22 nt, Human
cagagcucuauguucauggagg

SEQ ID NO: 861891 - RNA, 22 nt, Human
gggagucugggcuagacuccuu

SEQ ID NO: 861892 - RNA, 20 nt, Human
uccaggagaacugggagccg

SEQ ID NO: 861893 - RNA, 22 nt, Human
cugauacauaguagcaugucau

SEQ ID NO: 861894 - RNA, 22 nt, Human
guacagaaggauuucuaguagu

SEQ ID NO: 861895 - RNA, 15 nt, Human
cccaggaguucgaga

SEQ ID NO: 861896 - RNA, 22 nt, Human
uuaaaaucuaaagcaguugucu

SEQ ID NO: 861897 - RNA, 22 nt, Human
acuucacacagcaaauuuaucu

SEQ ID NO: 861898 - RNA, 22 nt, Human
gucuccugagccuugacugcaa

SEQ ID NO: 861899 - RNA, 22 nt, Human
caagaucagggugccagaaugg

SEQ ID NO: 861900 - RNA, 22 nt, Human
aagacuguacauuuuccagucu

SEQ ID NO: 861901 - RNA, 22 nt, Human
acauaauagcauuucuaauuug

SEQ ID NO: 861902 - RNA, 22 nt, Human
cagaaacauguauaaaguugua

SEQ ID NO: 861903 - RNA, 22 nt, Human
gcuuggcauugaccauuaucau

SEQ ID NO: 861904 - RNA, 22 nt, Human
augaaacagugaauuagucaag

SEQ ID NO: 861905 - RNA, 21 nt, Human
agggagcuggccacacagccu

SEQ ID NO: 861906 - RNA, 22 nt, Human
auuucaggauagccuaguuuug

SEQ ID NO: 861907 - RNA, 22 nt, Human
ucugucuucaucagcaugugau

SEQ ID NO: 861908 - RNA, 22 nt, Human
cagcugcuuuaguuuuccaucc

SEQ ID NO: 861909 - RNA, 22 nt, Human
augguuuugaagggaggucaaa

SEQ ID NO: 861910 - RNA, 22 nt, Human
ugguaaauauguccauucucuu

SEQ ID NO: 861911 - RNA, 22 nt, Human
uaauauauuucugcuaagcuca

SEQ ID NO: 861912 - RNA, 22 nt, Human
aggcagucuaguccccaggcaa

SEQ ID NO: 861913 - RNA, 21 nt, Human
auccuuagcacuuagaagagu

SEQ ID NO: 861914 - RNA, 22 nt, Human
ucagagagugcaaaauauagcu

SEQ ID NO: 861915 - RNA, 22 nt, Human
cauuuacaauguacagguugug

SEQ ID NO: 861916 - RNA, 21 nt, Human
uagggcaggcauuggaagaga

SEQ ID NO: 861917 - RNA, 22 nt, Human
cagucucucugaaguauuaaga

SEQ ID NO: 861918 - RNA, 22 nt, Human
uuacagaagagaaagaauucag

SEQ ID NO: 861919 - RNA, 22 nt, Human
auguguaugcaugcacuaagau

SEQ ID NO: 861920 - RNA, 22 nt, Human
uuucaaagucaauaucauuacc

SEQ ID NO: 861921 - RNA, 22 nt, Human
cuggcuuucuauuuggugcuau

SEQ ID NO: 861922 - RNA, 22 nt, Human
acaguuaucuuugaaauagaga

SEQ ID NO: 861923 - RNA, 22 nt, Human
uugaacaguccuaagagacccu

SEQ ID NO: 861924 - RNA, 22 nt, Human
uuccaugagcucugaguucaca

SEQ ID NO: 861925 - RNA, 22 nt, Human
auucuucaucacuaccuuguga

SEQ ID NO: 861926 - RNA, 22 nt, Human
gagcaccucaauuugcuauuug

SEQ ID NO: 861927 - RNA, 22 nt, Human
caaauucaaugaacauguuuaa

SEQ ID NO: 861928 - RNA, 22 nt, Human
ccuggaucagagccagagaagc

SEQ ID NO: 861929 - RNA, 22 nt, Human
ggugaguugggguucacagguc

SEQ ID NO: 861930 - RNA, 22 nt, Human
aggaagcuggugugaggaugaa

SEQ ID NO: 861931 - RNA, 22 nt, Human
agaccgagaaguucuccaggcc

SEQ ID NO: 861932 - RNA, 22 nt, Human
uucugaaagccaauucauugaa

SEQ ID NO: 861933 - RNA, 22 nt, Human
uuucucaguuacuagcuguggu

SEQ ID NO: 861934 - RNA, 22 nt, Human
ggcagcauauauucagugggca

SEQ ID NO: 861935 - RNA, 22 nt, Human
gcucacugcaaccucugcuucc

SEQ ID NO: 861936 - RNA, 22 nt, Human
ggauggcagucugcaugagaaa

SEQ ID NO: 861937 - RNA, 22 nt, Human
augugucuuugagacucugcua

SEQ ID NO: 861938 - RNA, 22 nt, Human
ccuugcugaccaucaccuuuga

SEQ ID NO: 861939 - RNA, 22 nt, Human
ccaggagaagcaucugagugua

SEQ ID NO: 861940 - RNA, 22 nt, Human
ucaguucaguauacacuauucu

SEQ ID NO: 861941 - RNA, 22 nt, Human
cagaauggcuuuuauggcucag

SEQ ID NO: 861942 - RNA, 22 nt, Human
cuuaagauuugcgauaccuaau

SEQ ID NO: 861943 - RNA, 22 nt, Human
acaaaugucuccucuuuuguua

SEQ ID NO: 861944 - RNA, 23 nt, Human
aaggccagaauuucaauggugcc

SEQ ID NO: 861945 - RNA, 22 nt, Human
gagggaggcaucaugaauccag

SEQ ID NO: 861946 - RNA, 19 nt, Human
uuugaaagaguuuuauugg

SEQ ID NO: 861947 - RNA, 22 nt, Human
cuuaggcagggcuggaagaucu

SEQ ID NO: 861948 - RNA, 22 nt, Human
uauuucaacguaugaaaagcug

SEQ ID NO: 861949 - RNA, 22 nt, Human
cugcugugggcaggguagcugg

SEQ ID NO: 861950 - RNA, 22 nt, Human
uaaauaugcauguauccuuauc

SEQ ID NO: 861951 - RNA, 22 nt, Human
uggauuuaauggaugaggggca

SEQ ID NO: 861952 - RNA, 22 nt, Human
uccauuuucuugcucuagguaa

SEQ ID NO: 861953 - RNA, 22 nt, Human
aaugggauaggucuucaggaau

SEQ ID NO: 861954 - RNA, 22 nt, Human
gcagcuaccacccaggaaggac

SEQ ID NO: 861955 - RNA, 21 nt, Human
uacugagaccucacagugugc

SEQ ID NO: 861956 - RNA, 22 nt, Human
uaacagaagaaaacauauugga

SEQ ID NO: 861957 - RNA, 22 nt, Human
uugaacugguaguuggaaaucu

SEQ ID NO: 861958 - RNA, 22 nt, Human
ucuucaauuagauuuaccaauu

SEQ ID NO: 861959 - RNA, 22 nt, Human
uuacagaaaagggguuguccuu

SEQ ID NO: 861960 - RNA, 22 nt, Human
cuggcaaguacugggccagcuc

SEQ ID NO: 861961 - RNA, 20 nt, Human
ugugcaggagagugaggcug

SEQ ID NO: 861962 - RNA, 22 nt, Human
ccugcucagagcgucuugugug

SEQ ID NO: 861963 - RNA, 22 nt, Human
ucuacccagagcuaugaccuga

SEQ ID NO: 861964 - RNA, 22 nt, Human
uggcagcuacagacagagguga

SEQ ID NO: 861965 - RNA, 22 nt, Human
ccuggaucagucacuguugcug

SEQ ID NO: 861966 - RNA, 22 nt, Human
ucugucucaaguucuugcacuc

SEQ ID NO: 861967 - RNA, 22 nt, Human
cugcaucaguggauaugauggu

SEQ ID NO: 861968 - RNA, 22 nt, Human
ugcuuauucuuuccacaauuca

SEQ ID NO: 861969 - RNA, 22 nt, Human
augcuguguggucaaguuaauu

SEQ ID NO: 861970 - RNA, 22 nt, Human
uaacagaaaggggacagaaaua

SEQ ID NO: 861971 - RNA, 22 nt, Human
uccaugagacagauacuguaag

SEQ ID NO: 861972 - RNA, 22 nt, Human
ccuugcugcgugcuagcacaga

SEQ ID NO: 861973 - RNA, 22 nt, Human
ucugcagggaugugagggguga

SEQ ID NO: 861974 - RNA, 23 nt, Human
cugcuguuuucuguaccugaagc

SEQ ID NO: 861975 - RNA, 22 nt, Human
gcucaggacuggaggagcgggg

SEQ ID NO: 861976 - RNA, 22 nt, Human
ugucuucagcaaaugccuuucu

SEQ ID NO: 861977 - RNA, 20 nt, Human
ucagaugggagugagccauc

SEQ ID NO: 861978 - RNA, 17 nt, Human
uaucagaauguguuuac

SEQ ID NO: 861979 - RNA, 22 nt, Human
uuggcagugucugcaaaaugga

SEQ ID NO: 861980 - RNA, 22 nt, Human
gaaugaaaaccuuggcucaaau

SEQ ID NO: 861981 - RNA, 23 nt, Human
aauaucaaggugauguucccaga

SEQ ID NO: 861982 - RNA, 22 nt, Human
cucuuucugauucgcugggacc

SEQ ID NO: 861983 - RNA, 22 nt, Human
cugcuuccauaaauaaugugcu

SEQ ID NO: 861984 - RNA, 22 nt, Human
acuuuaucaggaaucacacagc

SEQ ID NO: 861985 - RNA, 22 nt, Human
uuguugguggaauugaugcuag

SEQ ID NO: 861986 - RNA, 22 nt, Human
ucauagaaugaguuaaugaacu

SEQ ID NO: 861987 - RNA, 22 nt, Human
aaguuucauuguucauguaaca

SEQ ID NO: 861988 - RNA, 22 nt, Human
uuacagaaggaacacuacucag

SEQ ID NO: 861989 - RNA, 19 nt, Human
cauuuuaagcauccccagu

SEQ ID NO: 861990 - RNA, 22 nt, Human
uccuuguugcugcagucaccug

SEQ ID NO: 861991 - RNA, 22 nt, Human
caggcagcgcucguggccuggc

SEQ ID NO: 861992 - RNA, 22 nt, Human
ugaaaugagagcacagaauaaa

SEQ ID NO: 861993 - RNA, 22 nt, Human
cucucagacugaagggccugug

SEQ ID NO: 861994 - RNA, 22 nt, Human
uuaaauuuuagaaacagacucu

SEQ ID NO: 861995 - RNA, 22 nt, Human
ugggagcccaagggagcugccg

SEQ ID NO: 861996 - RNA, 22 nt, Human
ggugaaggucagagcaggaaaa

SEQ ID NO: 861997 - RNA, 22 nt, Human
cauuuguagcuauuuacuguau

SEQ ID NO: 861998 - RNA, 23 nt, Human
ugcaugugaauucauacuuguuu

SEQ ID NO: 861999 - RNA, 22 nt, Human
uuggaucauggaaugucugcuu

SEQ ID NO: 862000 - RNA, 22 nt, Human
aggcagucuaucucuggagccu

SEQ ID NO: 862001 - RNA, 18 nt, Human
ccucagggagagagacgc

SEQ ID NO: 862002 - RNA, 22 nt, Human
guuccaaauuuggaucuuuagg

SEQ ID NO: 862003 - RNA, 22 nt, Human
augguuuaguuagggcuuuuca

SEQ ID NO: 862004 - RNA, 22 nt, Human
aguccuuacucgggggcccaga

SEQ ID NO: 862005 - RNA, 22 nt, Human
gcuauacacauuucuugguagu

SEQ ID NO: 862006 - RNA, 22 nt, Human
uugaaggacauccuauuucuag

SEQ ID NO: 862007 - RNA, 22 nt, Human
uuaacagagugccuggcaugua

SEQ ID NO: 862008 - RNA, 22 nt, Human
aaauaucauuuauaacuuuuaa

SEQ ID NO: 862009 - RNA, 19 nt, Human
agcaaauacaucaaaauug

SEQ ID NO: 862010 - RNA, 21 nt, Human
uuucuuaggcucuaaaaugac

SEQ ID NO: 862011 - RNA, 22 nt, Human
caggaugggauguagugggccc

SEQ ID NO: 862012 - RNA, 22 nt, Human
gaauuucauugcucugcugugu

SEQ ID NO: 862013 - RNA, 22 nt, Human
gaggcugaggguuagagaguca

SEQ ID NO: 862014 - RNA, 22 nt, Human
cagcacagggacaauagcagau

SEQ ID NO: 862015 - RNA, 22 nt, Human
guuccaaagucucugagcugag

SEQ ID NO: 862016 - RNA, 22 nt, Human
acaaaugugucuaauugugccu

SEQ ID NO: 862017 - RNA, 19 nt, Human
uugaaauuguuugauaugg

SEQ ID NO: 862018 - RNA, 22 nt, Human
cuucccagaccuuagagugcag

SEQ ID NO: 862019 - RNA, 22 nt, Human
acucagaaccauuuacucugag

SEQ ID NO: 862020 - RNA, 22 nt, Human
gccuuaauuuuuuauaaucucu

SEQ ID NO: 862021 - RNA, 22 nt, Human
gcugguuuccuuaucuauaaag

SEQ ID NO: 862022 - RNA, 22 nt, Human
uccaggaggcaccuuuggacca

SEQ ID NO: 862023 - RNA, 22 nt, Human
ugaaauaauaucuggaucaauc

SEQ ID NO: 862024 - RNA, 22 nt, Human
cuuaggcauccaggguucuucc

SEQ ID NO: 862025 - RNA, 22 nt, Human
aacuuuguguguuuaauauggc

SEQ ID NO: 862026 - RNA, 22 nt, Human
uugacaauguccuuugaauuuc

SEQ ID NO: 862027 - RNA, 22 nt, Human
ugaauaauccacagucauucau

SEQ ID NO: 862028 - RNA, 23 nt, Human
uuugaaaguaucaacucgccuga

SEQ ID NO: 862029 - RNA, 22 nt, Human
agacugaauaacaagcaaauaa

SEQ ID NO: 862030 - RNA, 22 nt, Human
auugaaagcacaaagaacaagu

SEQ ID NO: 862031 - RNA, 22 nt, Human
ucauaauacaaagaguucugca

SEQ ID NO: 862032 - RNA, 22 nt, Human
cugccaggcgauggauuggcug

SEQ ID NO: 862033 - RNA, 22 nt, Human
cugcuguggccagccaggucaa

SEQ ID NO: 862034 - RNA, 22 nt, Human
auucuucacauggauaggaucu

SEQ ID NO: 862035 - RNA, 22 nt, Human
cuagccaugggcauuaaaggua

SEQ ID NO: 862036 - RNA, 22 nt, Human
uugagaagaggcuuuguaggaa

SEQ ID NO: 862037 - RNA, 21 nt, Human
aggcaucuaaagagaguagac

SEQ ID NO: 862038 - RNA, 22 nt, Human
gaggcagugucgguggcaggau

SEQ ID NO: 862039 - RNA, 22 nt, Human
uggcagcuguuaauguuuuguu

SEQ ID NO: 862040 - RNA, 22 nt, Human
cugcuguggaugcaggaccuca

SEQ ID NO: 862041 - RNA, 22 nt, Human
aggcaguguguagcuggaagag

SEQ ID NO: 862042 - RNA, 22 nt, Human
ggagaaugauauauagcucagu

SEQ ID NO: 862043 - RNA, 22 nt, Human
cacauacuuguguguacauaug

SEQ ID NO: 862044 - RNA, 22 nt, Human
gagugcagaugaacagaagauu

SEQ ID NO: 862045 - RNA, 22 nt, Human
gaaguacaguuuuaucuagcca

SEQ ID NO: 862046 - RNA, 22 nt, Human
uuucuaggcacagugucuuccc

SEQ ID NO: 862047 - RNA, 22 nt, Human
cacaauacuauuuuuaggucuu

SEQ ID NO: 862048 - RNA, 22 nt, Human
agugcuguaacaacuuauuugg

SEQ ID NO: 862049 - RNA, 20 nt, Human
uugauaggcagcuugucagg

SEQ ID NO: 862050 - RNA, 22 nt, Human
acucaggaaaugagaggcucuc

SEQ ID NO: 862051 - RNA, 21 nt, Human
cccaggaggcugagaagagca

SEQ ID NO: 862052 - RNA, 22 nt, Human
uuauuccauucaguucaacaag

SEQ ID NO: 862053 - RNA, 22 nt, Human
aaggaaccuggaguagagggag

SEQ ID NO: 862054 - RNA, 22 nt, Human
aaggcagccuuuguuugauuga

SEQ ID NO: 862055 - RNA, 22 nt, Human
guuuauaaggcccaauauuucu

SEQ ID NO: 862056 - RNA, 23 nt, Human
ggcagcucucaucugaugacuga

SEQ ID NO: 862057 - RNA, 22 nt, Human
uccauucauucauugaugaaca

SEQ ID NO: 862058 - RNA, 21 nt, Human
gggugggaggacacagcaggc

SEQ ID NO: 862059 - RNA, 22 nt, Human
agcauccaacaggagggaaggg

SEQ ID NO: 862060 - RNA, 21 nt, Human
cgcagagcgaacuugcggcgc

SEQ ID NO: 862061 - RNA, 22 nt, Human
cggcagcuccgcgccguaggac

SEQ ID NO: 862062 - RNA, 22 nt, Human
uggcagcuggcucugcgcaggc

SEQ ID NO: 862063 - RNA, 22 nt, Human
aggcuagcuuuggcucaguaaa

SEQ ID NO: 862064 - RNA, 22 nt, Human
ggcagacuguaauaggagaauu

SEQ ID NO: 862065 - RNA, 22 nt, Human
ccugcuguaaugugucuuuauu

SEQ ID NO: 862066 - RNA, 22 nt, Human
accaggagaggcacuugcaaug

SEQ ID NO: 862067 - RNA, 22 nt, Human
uccucagaaaccccugugaggu

SEQ ID NO: 862068 - RNA, 22 nt, Human
uuugcaaagugacuauuauaug

SEQ ID NO: 862069 - RNA, 22 nt, Human
caacuuucuguuaaauguuagu

SEQ ID NO: 862070 - RNA, 22 nt, Human
aagcgccaugguuccugcgcag

SEQ ID NO: 862071 - RNA, 22 nt, Human
aguuugaaaguauugacagaag

SEQ ID NO: 862072 - RNA, 22 nt, Human
caaaggcaggcccccugugcag

SEQ ID NO: 862073 - RNA, 22 nt, Human
uaacauuagguagacauaagcc

SEQ ID NO: 862074 - RNA, 17 nt, Human
ucauuuguugugacuag

SEQ ID NO: 862075 - RNA, 22 nt, Human
agaaaucaugucuuauuucuau

SEQ ID NO: 862076 - RNA, 22 nt, Human
uggcaggcagugugggagcugg

SEQ ID NO: 862077 - RNA, 22 nt, Human
caaaugauacuguuuuuagucu

SEQ ID NO: 862078 - RNA, 22 nt, Human
aggaagcuccaugaaggcagag

SEQ ID NO: 862079 - RNA, 22 nt, Human
ucuucacauggaacaugaagcu

SEQ ID NO: 862080 - RNA, 22 nt, Human
ugugauauuugaguauugucaa

SEQ ID NO: 862081 - RNA, 22 nt, Human
caguccuugcucugggaugaug

SEQ ID NO: 862082 - RNA, 22 nt, Human
aaugaacauauaaagagaucuu

SEQ ID NO: 862083 - RNA, 22 nt, Human
caaguccaucagauaagcaaga

SEQ ID NO: 862084 - RNA, 22 nt, Human
gaggagcugggucagggagaca

SEQ ID NO: 862085 - RNA, 22 nt, Human
uccaggagguaugaguggcccc

SEQ ID NO: 862086 - RNA, 22 nt, Human
gauggcagucaaccaggugagg

SEQ ID NO: 862087 - RNA, 22 nt, Human
ucaguucuuuauuucacaguga

SEQ ID NO: 862088 - RNA, 22 nt, Human
ugagccuguccugugcauguga

SEQ ID NO: 862089 - RNA, 22 nt, Human
gaaggccauuagagccugugcc

SEQ ID NO: 862090 - RNA, 22 nt, Human
cccaggaggguggccucugccc

SEQ ID NO: 862091 - RNA, 22 nt, Human
aaggcagcuucaccacagcauu

SEQ ID NO: 862092 - RNA, 22 nt, Human
cagcuacuccucccaugacuuc

SEQ ID NO: 862093 - RNA, 22 nt, Human
caguccuuucaauggugaccuu

SEQ ID NO: 862094 - RNA, 22 nt, Human
augccaaagcccaaguucauca

SEQ ID NO: 862095 - RNA, 22 nt, Human
uguccucagauaugucuacucu

SEQ ID NO: 862096 - RNA, 22 nt, Human
cccaggaaguggagguugcagu

SEQ ID NO: 862097 - RNA, 22 nt, Human
ucucuucuagcuucuugugguu

SEQ ID NO: 862098 - RNA, 23 nt, Human
cagaaaucugaaaucuagaaaug

SEQ ID NO: 862099 - RNA, 22 nt, Human
ucucacuggguauaaaugagua

SEQ ID NO: 862100 - RNA, 22 nt, Human
uuccuuagauccuucaaucacg

SEQ ID NO: 862101 - RNA, 22 nt, Human
caggagaucuuaggaauucuua

SEQ ID NO: 862102 - RNA, 22 nt, Human
uucacagacuuuccauagauug

SEQ ID NO: 862103 - RNA, 19 nt, Human
uccaggaggcugccauuga

SEQ ID NO: 862104 - RNA, 22 nt, Human
aauauuuguuaguguuuuaaug

SEQ ID NO: 862105 - RNA, 22 nt, Human
gagaggagguggcuaugacagc

SEQ ID NO: 862106 - RNA, 22 nt, Human
cccauugugguuguugaggaua

SEQ ID NO: 862107 - RNA, 22 nt, Human
cccaggagaucuggaucucguc

SEQ ID NO: 862108 - RNA, 22 nt, Human
ucuuuaauuguggaagagcagc

SEQ ID NO: 862109 - RNA, 22 nt, Human
ucauuuguucucauucucuacu

SEQ ID NO: 862110 - RNA, 21 nt, Human
ccaagacucccaucuaguggu

SEQ ID NO: 862111 - RNA, 22 nt, Human
agucuccuuggccucaaugccu

SEQ ID NO: 862112 - RNA, 22 nt, Human
gcuguguuggugaagcuguagc

SEQ ID NO: 862113 - RNA, 22 nt, Human
aggcacaggaaugucauccagu

SEQ ID NO: 862114 - RNA, 22 nt, Human
ucaggagaacuuccuucuaccc

SEQ ID NO: 862115 - RNA, 22 nt, Human
aaggccagacaggaccacaucu

SEQ ID NO: 862116 - RNA, 22 nt, Human
cacaauuuccuugcuucacuuu

SEQ ID NO: 862117 - RNA, 22 nt, Human
uggcauuuggcuuacuuauguu

SEQ ID NO: 862118 - RNA, 22 nt, Human
ucagaauucagagggagugggg

SEQ ID NO: 862119 - RNA, 22 nt, Human
aucuauacccaucaugauuuaa

SEQ ID NO: 862120 - RNA, 22 nt, Human
agcugcccagcuaggaagaagg

SEQ ID NO: 862121 - RNA, 22 nt, Human
ucagccaguuuguuuauuccgg

SEQ ID NO: 862122 - RNA, 22 nt, Human
gaguccuuuucauagcaguggg

SEQ ID NO: 862123 - RNA, 22 nt, Human
aggccagaaaugucagggagug

SEQ ID NO: 862124 - RNA, 22 nt, Human
aacauaauguggccaaagucac

SEQ ID NO: 862125 - RNA, 22 nt, Human
ccaugagccaggcugaggaagc

SEQ ID NO: 862126 - RNA, 22 nt, Human
aagcaaaggcaggagcuuguga

SEQ ID NO: 862127 - RNA, 22 nt, Human
uagcuaucuguguccagaucca

SEQ ID NO: 862128 - RNA, 22 nt, Human
agcaccugccugcauuggcuau

SEQ ID NO: 862129 - RNA, 22 nt, Human
acaaaauuaccuaguuauuuuc

SEQ ID NO: 862130 - RNA, 21 nt, Human
auggagggaccagggaagcag

SEQ ID NO: 862131 - RNA, 22 nt, Human
auucuucauacagacaaguccu

SEQ ID NO: 862132 - RNA, 22 nt, Human
ucaguguauggagugcuggauu

SEQ ID NO: 862133 - RNA, 22 nt, Human
uuuucagugggcaaugauguga

SEQ ID NO: 862134 - RNA, 22 nt, Human
uucuuaacuggaaaaugucaga

SEQ ID NO: 862135 - RNA, 22 nt, Human
ucuuuuggaaaugaugugcagg

SEQ ID NO: 862136 - RNA, 23 nt, Human
ucccaggaaucugcauuuuuaac

SEQ ID NO: 862137 - RNA, 21 nt, Human
gcaaauguucaggaaaaaaga

SEQ ID NO: 862138 - RNA, 22 nt, Human
gaagugaagagauuagaaauca

SEQ ID NO: 862139 - RNA, 22 nt, Human
uggaggaaguggcuggccagaa

SEQ ID NO: 862140 - RNA, 22 nt, Human
ggcagcuuucaauaggguuaug

SEQ ID NO: 862141 - RNA, 22 nt, Human
gaggacagagccgccuggcaag

SEQ ID NO: 862142 - RNA, 22 nt, Human
uucacacacagcuuccuauugu

SEQ ID NO: 862143 - RNA, 20 nt, Human
cuucuucaguaguuuguucu

SEQ ID NO: 862144 - RNA, 22 nt, Human
uuauccuggauuauauauguga

SEQ ID NO: 862145 - RNA, 22 nt, Human
auucuucacaccuguuccuguu

SEQ ID NO: 862146 - RNA, 22 nt, Human
cucuucuugucucugguuagaa

SEQ ID NO: 862147 - RNA, 22 nt, Human
cugcuuugggcagcuuuguggc

SEQ ID NO: 862148 - RNA, 22 nt, Human
ucaggagaaggcaauguggaaa

SEQ ID NO: 862149 - RNA, 22 nt, Human
agauauaauaauuuacaagugu

SEQ ID NO: 862150 - RNA, 21 nt, Human
aggcagcucaggcccagagag

SEQ ID NO: 862151 - RNA, 22 nt, Human
augaaaauucuaugcaggccag

SEQ ID NO: 862152 - RNA, 22 nt, Human
gaagaauccuguccucuuuagg

SEQ ID NO: 862153 - RNA, 22 nt, Human
uaucagaaggaagugccuuuaa

SEQ ID NO: 862154 - RNA, 22 nt, Human
uguccuuagggauauaaaauau

SEQ ID NO: 862155 - RNA, 22 nt, Human
gcugucccgcugacuuccagcu

SEQ ID NO: 862156 - RNA, 19 nt, Human
accaggaguaucagagcug

SEQ ID NO: 862157 - RNA, 22 nt, Human
auuucauugaaguuaauucuuc

SEQ ID NO: 862158 - RNA, 22 nt, Human
uccaggagggguaggcaguaug

SEQ ID NO: 862159 - RNA, 22 nt, Human
aguugcagacgcagagauguug

SEQ ID NO: 862160 - RNA, 22 nt, Human
ggauucagugucuguuaauagu

SEQ ID NO: 862161 - RNA, 22 nt, Human
ucagccaguuugauucuauuug

SEQ ID NO: 862162 - RNA, 22 nt, Human
cuacagaauggagggucagaga

SEQ ID NO: 862163 - RNA, 22 nt, Human
cuagaaauucugauucaguagg

SEQ ID NO: 862164 - RNA, 22 nt, Human
gaagcagcaaguauaggacagg

SEQ ID NO: 862165 - RNA, 22 nt, Human
agaggccacuuugccugugaug

SEQ ID NO: 862166 - RNA, 22 nt, Human
caaguccucaaagggcucugcu

SEQ ID NO: 862167 - RNA, 22 nt, Human
caugauuuugucuuguguuaau

SEQ ID NO: 862168 - RNA, 22 nt, Human
auacagaauuugcccuuuucau

SEQ ID NO: 862169 - RNA, 22 nt, Human
uuugcaguagacaucuuauuuu

SEQ ID NO: 862170 - RNA, 22 nt, Human
agaaaugaauauguagugguua

SEQ ID NO: 862171 - RNA, 18 nt, Human
uugagggaggggcagagu

SEQ ID NO: 862172 - RNA, 22 nt, Human
cagagccacuuggagaugagaa

SEQ ID NO: 862173 - RNA, 22 nt, Human
gggcagcucagccaccaugcag

SEQ ID NO: 862174 - RNA, 20 nt, Human
aggcucagcugagcucuugg

SEQ ID NO: 862175 - RNA, 22 nt, Human
cagaggcaaaagagguggaggu

SEQ ID NO: 862176 - RNA, 22 nt, Human
gauuucaaguaucuugggcgag

SEQ ID NO: 862177 - RNA, 22 nt, Human
gaaacuguauguaguuuuuggg

SEQ ID NO: 862178 - RNA, 22 nt, Human
gggagagguuacccgagcaacu

SEQ ID NO: 862179 - RNA, 22 nt, Human
aaagaaucguguguaguuugaa

SEQ ID NO: 862180 - RNA, 22 nt, Human
uaugccugauaacugugucucu

SEQ ID NO: 862181 - RNA, 22 nt, Human
ucucaggaucuaauacauggua

SEQ ID NO: 862182 - RNA, 22 nt, Human
uuuaaaauuuagaccucuccac

SEQ ID NO: 862183 - RNA, 22 nt, Human
uuagaaagcuuuccauagucaa

SEQ ID NO: 862184 - RNA, 21 nt, Human
agcagaggcugccuggugacu

SEQ ID NO: 862185 - RNA, 22 nt, Human
cagaggcaggauaagaacugcg

SEQ ID NO: 862186 - RNA, 22 nt, Human
aagcuggcaugucaccugagaa

SEQ ID NO: 862187 - RNA, 22 nt, Human
uaacagaagaugaaacuucuuu

SEQ ID NO: 862188 - RNA, 22 nt, Human
acagaauuaaugaaaauuacaa

SEQ ID NO: 862189 - RNA, 22 nt, Human
uuucaacguguaaucuuauuua

SEQ ID NO: 862190 - RNA, 22 nt, Human
uugaaaguuuauggagucugca

SEQ ID NO: 862191 - RNA, 22 nt, Human
uggcagcuagcuguuuucaugc

SEQ ID NO: 862192 - RNA, 23 nt, Human
ucucaggacacacaugucuauca

SEQ ID NO: 862193 - RNA, 22 nt, Human
cucagaagaacaaaggcucuac

SEQ ID NO: 862194 - RNA, 22 nt, Human
ugcugagaucugccaguagaug

SEQ ID NO: 862195 - RNA, 22 nt, Human
aacauucuauuuugcuaaaaca

SEQ ID NO: 862196 - RNA, 22 nt, Human
uuuauuauguacaggcacuaua

SEQ ID NO: 862197 - RNA, 21 nt, Human
agcagaggcagaauguaugca

SEQ ID NO: 862198 - RNA, 22 nt, Human
uuugaaugcaggacauacagaa

SEQ ID NO: 862199 - RNA, 22 nt, Human
cugucccuucauuauucacuac

SEQ ID NO: 862200 - RNA, 22 nt, Human
uuugcaaagaaauuauugcugu

SEQ ID NO: 862201 - RNA, 22 nt, Human
uuccaaacugccaauucagaag

SEQ ID NO: 862202 - RNA, 22 nt, Human
uuugcaaauaccaugaaacuug

SEQ ID NO: 862203 - RNA, 22 nt, Human
ugaaaugauuauaugguguuug

SEQ ID NO: 862204 - RNA, 22 nt, Human
uacucagagucauugcccuucu

SEQ ID NO: 862205 - RNA, 22 nt, Human
acaccauacucauguugguucc

SEQ ID NO: 862206 - RNA, 22 nt, Human
uuagaaaucugcugccaugcaa

SEQ ID NO: 862207 - RNA, 22 nt, Human
ggcauuuaauccaucugauuga

SEQ ID NO: 862208 - RNA, 22 nt, Human
gauuuccaggucauuaauaaag

SEQ ID NO: 862209 - RNA, 22 nt, Human
aaagcaguauauugguaguugu

SEQ ID NO: 862210 - RNA, 22 nt, Human
uuuucauuguuccucgagcauu

SEQ ID NO: 862211 - RNA, 22 nt, Human
uggucuuuaagguagcugucau

SEQ ID NO: 862212 - RNA, 22 nt, Human
ugaaagcagcaccaauaccauu

SEQ ID NO: 862213 - RNA, 22 nt, Human
aacauacauauuucagugucca

SEQ ID NO: 862214 - RNA, 22 nt, Human
aaaguccuuuuugccaugcaag

SEQ ID NO: 862215 - RNA, 22 nt, Human
ccagcugucagugugaaaauaa

SEQ ID NO: 862216 - RNA, 22 nt, Human
gagugcagaugccagccccagu

SEQ ID NO: 862217 - RNA, 22 nt, Human
auuaggcauucaugcagcuccu

SEQ ID NO: 862218 - RNA, 22 nt, Human
auacauacauguaugcacauac

SEQ ID NO: 862219 - RNA, 22 nt, Human
ugaaaugauguacaagaaggca

SEQ ID NO: 862220 - RNA, 22 nt, Human
augguuuaaagaguaugacuuu

SEQ ID NO: 862221 - RNA, 22 nt, Human
gccaggagagcuccuucagguu

SEQ ID NO: 862222 - RNA, 22 nt, Human
agacagcugggaaauggagugu

SEQ ID NO: 862223 - RNA, 22 nt, Human
uuugaaaguccuaggagagucc

SEQ ID NO: 862224 - RNA, 22 nt, Human
cuugaaagcuuugcgucuucua

SEQ ID NO: 862225 - RNA, 17 nt, Human
gccucugcuugugucau

SEQ ID NO: 862226 - RNA, 22 nt, Human
uaaucuaccacuauugcaauau

SEQ ID NO: 862227 - RNA, 22 nt, Human
aggcuucugcugauauuucauu

SEQ ID NO: 862228 - RNA, 22 nt, Human
auugaaaggcaaaguaggaagc

SEQ ID NO: 862229 - RNA, 22 nt, Human
cauuuauuggcauguaguaggu

SEQ ID NO: 862230 - RNA, 22 nt, Human
uguugagacugagggagucagc

SEQ ID NO: 862231 - RNA, 22 nt, Human
uuauggcauauuccucauugua

SEQ ID NO: 862232 - RNA, 21 nt, Human
ucauucacaggguauuguaua

SEQ ID NO: 862233 - RNA, 22 nt, Human
ccaggagagcaggcgugcagcu

SEQ ID NO: 862234 - RNA, 23 nt, Human
uaauucacauauacauugcuuca

SEQ ID NO: 862235 - RNA, 22 nt, Human
uuccuuagugccucuuccgcug

SEQ ID NO: 862236 - RNA, 22 nt, Human
agaggucagauuucuccuggug

SEQ ID NO: 862237 - RNA, 22 nt, Human
acuggcaguagagggagcgcau

SEQ ID NO: 862238 - RNA, 22 nt, Human
augugcuucauucuacaugaca

SEQ ID NO: 862239 - RNA, 19 nt, Human
acuguaaggcauuuuuuuc

SEQ ID NO: 862240 - RNA, 17 nt, Human
ggcagcugugugcaugc

SEQ ID NO: 862241 - RNA, 22 nt, Human
acuguagcugccacuggaugca

SEQ ID NO: 862242 - RNA, 22 nt, Human
ggcaggcugggugucauggagu

SEQ ID NO: 862243 - RNA, 20 nt, Human
cccagguaggugccaugagu

SEQ ID NO: 862244 - RNA, 22 nt, Human
gagcgauguggguauguagaag

SEQ ID NO: 862245 - RNA, 22 nt, Human
uaaucugaagaaacaggacuug

SEQ ID NO: 862246 - RNA, 22 nt, Human
uucuucuuucccccugugguac

SEQ ID NO: 862247 - RNA, 22 nt, Human
ucucuucuaauuuucccgagua

SEQ ID NO: 862248 - RNA, 22 nt, Human
accauguguuuuacacauggua

SEQ ID NO: 862249 - RNA, 20 nt, Human
ucauuucuugggguuccaag

SEQ ID NO: 862250 - RNA, 22 nt, Human
aaaggccacugcaagggaaggu

SEQ ID NO: 862251 - RNA, 22 nt, Human
ucugucccugagagcucaggag

SEQ ID NO: 862252 - RNA, 22 nt, Human
cccaggaaacccgaaggcgacc

SEQ ID NO: 862253 - RNA, 22 nt, Human
uauacagauuaacagauuuaaa

SEQ ID NO: 862254 - RNA, 22 nt, Human
ucuuuccaaggacucuguagca

SEQ ID NO: 862255 - RNA, 22 nt, Human
cuucagaagaaaagcagugugu

SEQ ID NO: 862256 - RNA, 22 nt, Human
ccuggaucuccucuauucauau

SEQ ID NO: 862257 - RNA, 22 nt, Human
aggguagguguaagauagcccu

SEQ ID NO: 862258 - RNA, 22 nt, Human
caggagaggcuguacguuucuc

SEQ ID NO: 862259 - RNA, 22 nt, Human
aaaacugaaauacgauccaaug

SEQ ID NO: 862260 - RNA, 22 nt, Human
ucuuugaauuucugacugucuu

SEQ ID NO: 862261 - RNA, 22 nt, Human
accaggaguugggggugggacc

SEQ ID NO: 862262 - RNA, 22 nt, Human
uucaggaucacuaaacccucca

SEQ ID NO: 862263 - RNA, 22 nt, Human
auucuaacacaugcucuaagaa

SEQ ID NO: 862264 - RNA, 22 nt, Human
aauuucaaagcucacuggcaua

SEQ ID NO: 862265 - RNA, 17 nt, Human
gcuguaguuugauaaga

SEQ ID NO: 862266 - RNA, 22 nt, Human
auucuucauaccuacugagguu

SEQ ID NO: 862267 - RNA, 22 nt, Human
caguaaauuaucucaucucugu

SEQ ID NO: 862268 - RNA, 22 nt, Human
ccuuuaauuuacaauguuaauu

SEQ ID NO: 862269 - RNA, 22 nt, Human
cuguuucaagugaagucagaca

SEQ ID NO: 862270 - RNA, 22 nt, Human
cuguaaauaugaagaauauaug

SEQ ID NO: 862271 - RNA, 22 nt, Human
uaauuauuaugacaacaauugc

SEQ ID NO: 862272 - RNA, 22 nt, Human
gcccaggacucagggugucgcg

SEQ ID NO: 862273 - RNA, 22 nt, Human
auucuucagcaggggacacuau

SEQ ID NO: 862274 - RNA, 22 nt, Human
uauuucagcaagaagaaugugg

SEQ ID NO: 862275 - RNA, 22 nt, Human
uggauuuauggagaccgaaagu

SEQ ID NO: 862276 - RNA, 22 nt, Human
ugugcaggugcaggaagggggc

SEQ ID NO: 862277 - RNA, 22 nt, Human
aaaguccagagggcacacugaa

SEQ ID NO: 862278 - RNA, 22 nt, Human
ugaucugagagcagaucaccau

SEQ ID NO: 862279 - RNA, 22 nt, Human
aagggcaggaaaagauggaugu

SEQ ID NO: 862280 - RNA, 22 nt, Human
ucaaaauuaaaccaacguccag

SEQ ID NO: 862281 - RNA, 22 nt, Human
gaaauagacacuuucuaugaau

SEQ ID NO: 862282 - RNA, 22 nt, Human
ugcugugagguugagaaggaag

SEQ ID NO: 862283 - RNA, 22 nt, Human
uggcagcuuuuuguuucaggcu

SEQ ID NO: 862284 - RNA, 22 nt, Human
ccagagagauugcuucuaaaga

SEQ ID NO: 862285 - RNA, 23 nt, Human
uugauuucaaaugcagagaacac

SEQ ID NO: 862286 - RNA, 22 nt, Human
ccuggaucuuuguuguaaauau

SEQ ID NO: 862287 - RNA, 22 nt, Human
ugcuuuaaauaugaauuagcau

SEQ ID NO: 862288 - RNA, 22 nt, Human
caugcuguguguuuuagcucca

SEQ ID NO: 862289 - RNA, 22 nt, Human
ggaggugggauuaggaccuaaa

SEQ ID NO: 862290 - RNA, 22 nt, Human
cuucagaaugggacuguguuug

SEQ ID NO: 862291 - RNA, 22 nt, Human
cuauacaguaaccacagugauu

SEQ ID NO: 862292 - RNA, 20 nt, Human
uuuacauuuugaaacaguga

SEQ ID NO: 862293 - RNA, 22 nt, Human
auacagauguugaauguuauau

SEQ ID NO: 862294 - RNA, 22 nt, Human
acuggcagcagcagcccuuggg

SEQ ID NO: 862295 - RNA, 22 nt, Human
cagagacauucaguaaauuauc

SEQ ID NO: 862296 - RNA, 22 nt, Human
aggaagcuuagugaaaggacca

SEQ ID NO: 862297 - RNA, 22 nt, Human
ccacuucaucagugcuccauuu

SEQ ID NO: 862298 - RNA, 22 nt, Human
uucacagaguuauuuuuaugcu

SEQ ID NO: 862299 - RNA, 22 nt, Human
acaggagaaaucuggucaaaag

SEQ ID NO: 862300 - RNA, 22 nt, Human
uugaauaggacucagcagugau

SEQ ID NO: 862301 - RNA, 22 nt, Human
cccaggagaccuagaucuguuu

SEQ ID NO: 862302 - RNA, 22 nt, Human
gaggcagcaggcugaggaggau

SEQ ID NO: 862303 - RNA, 22 nt, Human
gacagcuggcaguggaaaggug

SEQ ID NO: 862304 - RNA, 22 nt, Human
auuucagauucagaaauguagg

SEQ ID NO: 862305 - RNA, 22 nt, Human
uaaagaucuuaggaagauuuuc

SEQ ID NO: 862306 - RNA, 22 nt, Human
uggaggaaaaaaccaggcagag

SEQ ID NO: 862307 - RNA, 22 nt, Human
uacuuugaagacaauaucugga

SEQ ID NO: 862308 - RNA, 22 nt, Human
aggcagcccugugcuggaugcu

SEQ ID NO: 862309 - RNA, 19 nt, Human
ggcaggcuggauagagagg

SEQ ID NO: 862310 - RNA, 22 nt, Human
uuuaggcagaacauggacuuug

SEQ ID NO: 862311 - RNA, 22 nt, Human
uuuuccagagcugucucuugca

SEQ ID NO: 862312 - RNA, 22 nt, Human
auggcuuuguuccaauaaaacu

SEQ ID NO: 862313 - RNA, 22 nt, Human
agugagaguauuaaugugaacu

SEQ ID NO: 862314 - RNA, 23 nt, Human
accaggagccaagaucucccugg

SEQ ID NO: 862315 - RNA, 22 nt, Human
uucccaauauucugcuuuuaug

SEQ ID NO: 862316 - RNA, 22 nt, Human
gcagggcagaccuccagccuau

SEQ ID NO: 862317 - RNA, 19 nt, Human
uggagacugagagugagca

SEQ ID NO: 862318 - RNA, 22 nt, Human
uugcuguguaacuccuggccug

SEQ ID NO: 862319 - RNA, 22 nt, Human
gaugagcauuguuucauguguu

SEQ ID NO: 862320 - RNA, 22 nt, Human
aucauuucccuuuagaucacaa

SEQ ID NO: 862321 - RNA, 22 nt, Human
agucuuuccugcuugacuguuc

SEQ ID NO: 862322 - RNA, 22 nt, Human
aaggccagcuuguagggcuggu

SEQ ID NO: 862323 - RNA, 22 nt, Human
gugauuuugagaccuauauagu

SEQ ID NO: 862324 - RNA, 22 nt, Human
uuacagaaaauguguuuuaacu

SEQ ID NO: 862325 - RNA, 22 nt, Human
cuuaaauuggaugaguuaaguu

SEQ ID NO: 862326 - RNA, 22 nt, Human
uucaaauacauucuuugccacu

SEQ ID NO: 862327 - RNA, 22 nt, Human
aagggcaggagaagacggauau

SEQ ID NO: 862328 - RNA, 22 nt, Human
uauagccauuuccaguggcauc

SEQ ID NO: 862329 - RNA, 22 nt, Human
ucagaauugcagggagggcagg

SEQ ID NO: 862330 - RNA, 22 nt, Human
uuauuauugugguugcauuauc

SEQ ID NO: 862331 - RNA, 22 nt, Human
aggcaggcacacuuccuccagg

SEQ ID NO: 862332 - RNA, 22 nt, Human
cuuugaauugccguuucaucug

SEQ ID NO: 862333 - RNA, 22 nt, Human
uuacacaacaucuguauuauua

SEQ ID NO: 862334 - RNA, 22 nt, Human
cauuucaauacaguuuguaaau

SEQ ID NO: 862335 - RNA, 22 nt, Human
aagaauucacugguagagucaa

SEQ ID NO: 862336 - RNA, 22 nt, Human
ugcugaugcuguucuguuagga

SEQ ID NO: 862337 - RNA, 22 nt, Human
ucuuuucaucauuuaauaggua

SEQ ID NO: 862338 - RNA, 22 nt, Human
gcucaggaaauaguuuaguguu

SEQ ID NO: 862339 - RNA, 22 nt, Human
aggaagcugcuggaguagugug

SEQ ID NO: 862340 - RNA, 22 nt, Human
acacaaguucuaaagauugcgc

SEQ ID NO: 862341 - RNA, 22 nt, Human
uagggcaggggaggaaucugaa

SEQ ID NO: 862342 - RNA, 22 nt, Human
aagggcagaauagagaagaugg

SEQ ID NO: 862343 - RNA, 21 nt, Human
gcugcaucaaucuacccaggg

SEQ ID NO: 862344 - RNA, 22 nt, Human
ugaaauagaaaaacaggcuucu

SEQ ID NO: 862345 - RNA, 22 nt, Human
ugacaguuaagguauacauuca

SEQ ID NO: 862346 - RNA, 22 nt, Human
uucuccucuguuggccuucccu

SEQ ID NO: 862347 - RNA, 22 nt, Human
ugaaacauuugaugaucuuugg

SEQ ID NO: 862348 - RNA, 20 nt, Human
cagagccaagagcagcaucu

SEQ ID NO: 862349 - RNA, 22 nt, Human
ucugcugugggucuauauuuua

SEQ ID NO: 862350 - RNA, 22 nt, Human
aggccagcuuccagaggggcag

SEQ ID NO: 862351 - RNA, 22 nt, Human
uuuguaaauagcaguacucaug

SEQ ID NO: 862352 - RNA, 22 nt, Human
ggagugggaacaaugacauggu

SEQ ID NO: 862353 - RNA, 22 nt, Human
ucagguggcuuggagggggacg

SEQ ID NO: 862354 - RNA, 18 nt, Human
aggcaggugcuggaaguc

SEQ ID NO: 862355 - RNA, 21 nt, Human
cuacagaaucgagcauucugg

SEQ ID NO: 862356 - RNA, 22 nt, Human
auacaaagacaaaucucaaucu

SEQ ID NO: 862357 - RNA, 22 nt, Human
aaguucuaauuuugcauucagg

SEQ ID NO: 862358 - RNA, 22 nt, Human
guccaugacugugacucacaug

SEQ ID NO: 862359 - RNA, 22 nt, Human
cuugcaggccuuucuagcucua

SEQ ID NO: 862360 - RNA, 22 nt, Human
caauuucagucucagagaguuc

SEQ ID NO: 862361 - RNA, 22 nt, Human
ccacagcugaccgcaggugagc

SEQ ID NO: 862362 - RNA, 22 nt, Human
ucuccucucuuaccugguacaa

SEQ ID NO: 862363 - RNA, 22 nt, Human
cucaggaugcaggucacaggac

SEQ ID NO: 862364 - RNA, 22 nt, Human
aauauccacacugugucccugc

SEQ ID NO: 862365 - RNA, 22 nt, Human
caggcgagugaacagacucuca

SEQ ID NO: 862366 - RNA, 22 nt, Human
agagcagcuggggcagagacca

SEQ ID NO: 862367 - RNA, 22 nt, Human
cucuucuugcuagacugagugc

SEQ ID NO: 862368 - RNA, 22 nt, Human
gggcaguugauggaggucugga

SEQ ID NO: 862369 - RNA, 20 nt, Human
uuucaguuaucuugaccuuc

SEQ ID NO: 862370 - RNA, 22 nt, Human
auuacaagaugcauccauauuu

SEQ ID NO: 862371 - RNA, 20 nt, Human
augcuuucuugugugcugcu

SEQ ID NO: 862372 - RNA, 22 nt, Human
cagcuggcaaguggagcagggu

SEQ ID NO: 862373 - RNA, 22 nt, Human
uugacacagaucaauauucaac

SEQ ID NO: 862374 - RNA, 22 nt, Human
uaacaauaguguuugcuaguca

SEQ ID NO: 862375 - RNA, 22 nt, Human
caggauggagggagggcuguua

SEQ ID NO: 862376 - RNA, 22 nt, Human
aggcaggccccugagaauagac

SEQ ID NO: 862377 - RNA, 22 nt, Human
ugcuuuggccacuagaauucag

SEQ ID NO: 862378 - RNA, 20 nt, Human
caauuucaucauuuccugug

SEQ ID NO: 862379 - RNA, 22 nt, Human
caggcagcaggagcccugcucg

SEQ ID NO: 862380 - RNA, 22 nt, Human
gaggcugcuguuagcccugggc

SEQ ID NO: 862381 - RNA, 22 nt, Human
cuggcaguguccagcucgugau

SEQ ID NO: 862382 - RNA, 22 nt, Human
uccaggagauacacugcaccag

SEQ ID NO: 862383 - RNA, 22 nt, Human
ugaaaugagauagauaaucagg

SEQ ID NO: 862384 - RNA, 22 nt, Human
aaaguauucuugacuguuuuuc

SEQ ID NO: 862385 - RNA, 22 nt, Human
augaaacaguguguauagcaaa

SEQ ID NO: 862386 - RNA, 22 nt, Human
gaucugaaucaauagaauaacu

SEQ ID NO: 862387 - RNA, 22 nt, Human
acauuuaaauaccuauguuucu

SEQ ID NO: 862388 - RNA, 22 nt, Human
aggcagcuggcaaauucuagag

SEQ ID NO: 862389 - RNA, 22 nt, Human
acacagauuuuacauguuaugc

SEQ ID NO: 862390 - RNA, 20 nt, Human
gggugggagagucugagggu

SEQ ID NO: 862391 - RNA, 22 nt, Human
aagugaagaaauacaugagaau

SEQ ID NO: 862392 - RNA, 22 nt, Human
auggccuuagugaugauuaaua

SEQ ID NO: 862393 - RNA, 22 nt, Human
aauuuguuaaaagugagugaca

SEQ ID NO: 862394 - RNA, 22 nt, Human
uguauuuuuagaccuuuagacc

SEQ ID NO: 862395 - RNA, 22 nt, Human
cacauuuaauccuuuauaagua

SEQ ID NO: 862396 - RNA, 22 nt, Human
aggcagugcucaagacagcagc

SEQ ID NO: 862397 - RNA, 22 nt, Human
agucuucucauuucacaugcuu

SEQ ID NO: 862398 - RNA, 17 nt, Human
aaucuguuuacagucag

SEQ ID NO: 862399 - RNA, 22 nt, Human
uuacagaagaguaacuuggcaa

SEQ ID NO: 862400 - RNA, 22 nt, Human
ccaggaugacccccacuuuccu

SEQ ID NO: 862401 - RNA, 22 nt, Human
auuggcaguuagugacgaggcu

SEQ ID NO: 862402 - RNA, 22 nt, Human
uuugaagugggcauuagaaccu

SEQ ID NO: 862403 - RNA, 22 nt, Human
uuuuagauaguuuaacugcacu

SEQ ID NO: 862404 - RNA, 22 nt, Human
aagcagaggguauggccagguu

SEQ ID NO: 862405 - RNA, 22 nt, Human
acagaaauugggcaaauggaag

SEQ ID NO: 862406 - RNA, 22 nt, Human
gagggugggccagauaugaggg

SEQ ID NO: 862407 - RNA, 22 nt, Human
gaauuucacaaggugaggauaa

SEQ ID NO: 862408 - RNA, 22 nt, Human
augcuuuagugucaaguuuggg

SEQ ID NO: 862409 - RNA, 22 nt, Human
cauagaaaucaggugagaaucu

SEQ ID NO: 862410 - RNA, 22 nt, Human
cccaggaguuugaguucagcau

SEQ ID NO: 862411 - RNA, 22 nt, Human
cccaucacagacacuggguuau

SEQ ID NO: 862412 - RNA, 22 nt, Human
aaggagagguuguccguguugu

SEQ ID NO: 862413 - RNA, 22 nt, Human
guuaaauucgaugauggauaaa

SEQ ID NO: 862414 - RNA, 19 nt, Human
uggcaucuguaaaauggug

SEQ ID NO: 862415 - RNA, 19 nt, Human
uucauucucuuauuguugu

SEQ ID NO: 862416 - RNA, 22 nt, Human
aagcagaggaccgacggaggga

SEQ ID NO: 862417 - RNA, 22 nt, Human
aucacauucuuucaaagcaguc

SEQ ID NO: 862418 - RNA, 22 nt, Human
aggauuuacuagcaaggauucu

SEQ ID NO: 862419 - RNA, 22 nt, Human
aauuuacaguugcugaugguac

SEQ ID NO: 862420 - RNA, 22 nt, Human
caguaaagcauguaugucuuca

SEQ ID NO: 862421 - RNA, 22 nt, Human
auguacaaaauguuuugaaaug

SEQ ID NO: 862422 - RNA, 22 nt, Human
uuuacauuucccucugucaguu

SEQ ID NO: 862423 - RNA, 22 nt, Human
gggcagcuguaucugagcuuau

SEQ ID NO: 862424 - RNA, 17 nt, Human
cuuuuaauuuacuuccc

SEQ ID NO: 862425 - RNA, 22 nt, Human
uauuucagggagaauaaauuug

SEQ ID NO: 862426 - RNA, 22 nt, Human
agaauuccuccucugggacacu

SEQ ID NO: 862427 - RNA, 18 nt, Human
ggcagcuugacuagcaac

SEQ ID NO: 862428 - RNA, 20 nt, Human
uggcaucucucaauuguagg

SEQ ID NO: 862429 - RNA, 22 nt, Human
ugaacaaacugcauucuucacu

SEQ ID NO: 862430 - RNA, 22 nt, Human
caucagaauguuagagaaggga

SEQ ID NO: 862431 - RNA, 19 nt, Human
aguggcagaucuggaagua

SEQ ID NO: 862432 - RNA, 22 nt, Human
ugucucugauaaguaguucagu

SEQ ID NO: 862433 - RNA, 22 nt, Human
uugcaauagccuuauuuccaaa

SEQ ID NO: 862434 - RNA, 22 nt, Human
uuucacagguacaaacacuccu

SEQ ID NO: 862435 - RNA, 22 nt, Human
ugcuuucaaaggcuuucuagau

SEQ ID NO: 862436 - RNA, 22 nt, Human
cagaggcaggaagaugggcagu

SEQ ID NO: 862437 - RNA, 22 nt, Human
uaaauuauguuccauguccuuu

SEQ ID NO: 862438 - RNA, 20 nt, Human
augauuuugcacuaacuuca

SEQ ID NO: 862439 - RNA, 22 nt, Human
aggucagcaggccaggggcgaa

SEQ ID NO: 862440 - RNA, 22 nt, Human
uugaaaggaauacagaggccua

SEQ ID NO: 862441 - RNA, 20 nt, Human
cuucuucagccuaugcuuca

SEQ ID NO: 862442 - RNA, 22 nt, Human
auguuuccagguucuuccuaug

SEQ ID NO: 862443 - RNA, 22 nt, Human
ucauuugugugagugauuugac

SEQ ID NO: 862444 - RNA, 22 nt, Human
ucuucucuacaccagcagcccc

SEQ ID NO: 862445 - RNA, 22 nt, Human
gugaauaaaacaccugccaaga

SEQ ID NO: 862446 - RNA, 22 nt, Human
gcauuuccugugcuuggcauau

SEQ ID NO: 862447 - RNA, 22 nt, Human
acuugcugguggcauuuacagu

SEQ ID NO: 862448 - RNA, 22 nt, Human
uauuucuucgggauucaagcua

SEQ ID NO: 862449 - RNA, 22 nt, Human
ugcuuaauauugugauguaaua

SEQ ID NO: 862450 - RNA, 22 nt, Human
agugcuuuagcauccaacuguc

SEQ ID NO: 862451 - RNA, 22 nt, Human
auuaaauuggaucugcauaguu

SEQ ID NO: 862452 - RNA, 22 nt, Human
gauggcagguaguggucucauc

SEQ ID NO: 862453 - RNA, 22 nt, Human
cauuuguaguuaaaaaugucuc

SEQ ID NO: 862454 - RNA, 22 nt, Human
gcuggaucauauggugguucua

SEQ ID NO: 862455 - RNA, 22 nt, Human
caguccuuagucuggauggcuu

SEQ ID NO: 862456 - RNA, 22 nt, Human
uggcuuuauaaauccacugguu

SEQ ID NO: 862457 - RNA, 22 nt, Human
uuauccaaacuggugaaucauu

SEQ ID NO: 862458 - RNA, 22 nt, Human
aggguggcugaguagauggaag

SEQ ID NO: 862459 - RNA, 22 nt, Human
auggcuuucagauuucuauguu

SEQ ID NO: 862460 - RNA, 22 nt, Human
cuuaauuacccaaugugguagg

SEQ ID NO: 862461 - RNA, 22 nt, Human
aaaucaguaaauguucauuaac

SEQ ID NO: 862462 - RNA, 22 nt, Human
cccuguacagucucuguggcac

SEQ ID NO: 862463 - RNA, 22 nt, Human
uuaauuaaauucaugagcauug

SEQ ID NO: 862464 - RNA, 22 nt, Human
gccaggaguguguggcuauguu

SEQ ID NO: 862465 - RNA, 18 nt, Human
ugaauagggguuugcaga

SEQ ID NO: 862466 - RNA, 20 nt, Human
ugugaaagcaguagaaugac

SEQ ID NO: 862467 - RNA, 22 nt, Human
guucuucacauuucauugagga

SEQ ID NO: 862468 - RNA, 22 nt, Human
ugauuuccccagucuugcugcu

SEQ ID NO: 862469 - RNA, 22 nt, Human
uuugaagacauauuguuacaua

SEQ ID NO: 862470 - RNA, 22 nt, Human
ugaacuccaaauacugcugauu

SEQ ID NO: 862471 - RNA, 22 nt, Human
ugaauaaucuuggguauuaaua

SEQ ID NO: 862472 - RNA, 22 nt, Human
ugucugugaccucuuaggcaag

SEQ ID NO: 862473 - RNA, 22 nt, Human
uucaauucugcucugaucuuag

SEQ ID NO: 862474 - RNA, 22 nt, Human
uucauacucacuccaauaacug

SEQ ID NO: 862475 - RNA, 22 nt, Human
gugcagcugugguggagccagg

SEQ ID NO: 862476 - RNA, 22 nt, Human
cccagggaagccauuucugacu

SEQ ID NO: 862477 - RNA, 22 nt, Human
gauuucaaaaguagauccauca

SEQ ID NO: 862478 - RNA, 22 nt, Human
uuucaugagauuccuccacauc

SEQ ID NO: 862479 - RNA, 22 nt, Human
uaggaggguuagagggaaauau

SEQ ID NO: 862480 - RNA, 21 nt, Human
ucacagacuggucagugaggc

SEQ ID NO: 862481 - RNA, 22 nt, Human
uauuuuaaagugaagggucuug

SEQ ID NO: 862482 - RNA, 22 nt, Human
auuucaggagcaguuucagugg

SEQ ID NO: 862483 - RNA, 22 nt, Human
uggaguucauccaugacagcuu

SEQ ID NO: 862484 - RNA, 22 nt, Human
aaguccaugaucaagauguggc

SEQ ID NO: 862485 - RNA, 20 nt, Human
cccaggagcugugccccauc

SEQ ID NO: 862486 - RNA, 22 nt, Human
augacaguucuacacuuaaucu

SEQ ID NO: 862487 - RNA, 22 nt, Human
acucagaaugacugaugcugug

SEQ ID NO: 862488 - RNA, 22 nt, Human
ucuauacugaugggauacuauu

SEQ ID NO: 862489 - RNA, 22 nt, Human
auuauuauuguugauguuaggg

SEQ ID NO: 862490 - RNA, 22 nt, Human
cuggcagucugccucuucacug

SEQ ID NO: 862491 - RNA, 22 nt, Human
caggcagcucuaauggaaagug

SEQ ID NO: 862492 - RNA, 22 nt, Human
uucauucuugucuuuguauagu

SEQ ID NO: 862493 - RNA, 22 nt, Human
guuuucaauuauaagauggcuu

SEQ ID NO: 862494 - RNA, 22 nt, Human
auuuagaacuuuguuugccaau

SEQ ID NO: 862495 - RNA, 22 nt, Human
ggcagcucacgggcauggggug

SEQ ID NO: 862496 - RNA, 22 nt, Human
caggaaaggugugucaugaugg

SEQ ID NO: 862497 - RNA, 22 nt, Human
cccaagagguggagguugcagu

SEQ ID NO: 862498 - RNA, 22 nt, Human
cauuuaguuauacuaaaacauu

SEQ ID NO: 862499 - RNA, 22 nt, Human
cauggcuucuaagugauaacgu

SEQ ID NO: 862500 - RNA, 22 nt, Human
aggacaggauugagcugaacug

SEQ ID NO: 862501 - RNA, 22 nt, Human
aaugucugagucucuguauccc

SEQ ID NO: 862502 - RNA, 22 nt, Human
aggguggccaugagggagagau

SEQ ID NO: 862503 - RNA, 20 nt, Human
uuccuuaggcauuggaagaa

SEQ ID NO: 862504 - RNA, 22 nt, Human
acaacuuuagucuggagggaaa

SEQ ID NO: 862505 - RNA, 22 nt, Human
aguccuuaugagaugcugccuu

SEQ ID NO: 862506 - RNA, 20 nt, Human
ccucaggaugagggugagca

SEQ ID NO: 862507 - RNA, 20 nt, Human
ggaggguggaagaaagcaag

SEQ ID NO: 862508 - RNA, 22 nt, Human
agugcuguuagguuaauauagu

SEQ ID NO: 862509 - RNA, 22 nt, Human
uucaggaucauuuguuuuaucu

SEQ ID NO: 862510 - RNA, 22 nt, Human
guucuucaguaaaauuaaaugu

SEQ ID NO: 862511 - RNA, 22 nt, Human
auagaauucguguuuguaauuc

SEQ ID NO: 862512 - RNA, 22 nt, Human
uucuucucagggucccacaugg

SEQ ID NO: 862513 - RNA, 22 nt, Human
auauaggcuaacaacuauugag

SEQ ID NO: 862514 - RNA, 22 nt, Human
uuugcaguuucauugcugaaau

SEQ ID NO: 862515 - RNA, 22 nt, Human
uugcauuucccauugaguaaug

SEQ ID NO: 862516 - RNA, 22 nt, Human
acuuuugguucuguaacuguga

SEQ ID NO: 862517 - RNA, 22 nt, Human
aggcagcuuuguaguaaagcua

SEQ ID NO: 862518 - RNA, 22 nt, Human
aucuucucaagcagcauccugu

SEQ ID NO: 862519 - RNA, 22 nt, Human
aucaggauggguuuggcuuagg

SEQ ID NO: 862520 - RNA, 22 nt, Human
uaaguccuauuccaggucucuc

SEQ ID NO: 862521 - RNA, 22 nt, Human
gugauuuagauguugaaaguga

SEQ ID NO: 862522 - RNA, 22 nt, Human
ucagaauaugcuaaugacauuu

SEQ ID NO: 862523 - RNA, 22 nt, Human
uuugaagugcaaugaggauucu

SEQ ID NO: 862524 - RNA, 22 nt, Human
ucacugucugaaagaaauggcc

SEQ ID NO: 862525 - RNA, 22 nt, Human
auguauuucuauguagugaaga

SEQ ID NO: 862526 - RNA, 22 nt, Human
uugaaauaucaaguuauuagug

SEQ ID NO: 862527 - RNA, 23 nt, Human
uccaugagaugugggcuucuagu

SEQ ID NO: 862528 - RNA, 22 nt, Human
uagcacauuguugaccagaagg

SEQ ID NO: 862529 - RNA, 22 nt, Human
uacagaaaaacuggcauugaag

SEQ ID NO: 862530 - RNA, 22 nt, Human
uuucauaauacuguacaugaaa

SEQ ID NO: 862531 - RNA, 20 nt, Human
caccagucaugagucaauac

SEQ ID NO: 862532 - RNA, 22 nt, Human
auagacauagccguaauuuauu

SEQ ID NO: 862533 - RNA, 22 nt, Human
gauuuacagaucuaagggucac

SEQ ID NO: 862534 - RNA, 22 nt, Human
uuagccaugcccuagaagagga

SEQ ID NO: 862535 - RNA, 22 nt, Human
gauuucaauccagcuuucuucu

SEQ ID NO: 862536 - RNA, 22 nt, Human
ugccuugcacauaauauacauu

SEQ ID NO: 862537 - RNA, 22 nt, Human
aauagcucacugauuucucuuu

SEQ ID NO: 862538 - RNA, 22 nt, Human
cagggaggaugggcuguuuugc

SEQ ID NO: 862539 - RNA, 22 nt, Human
cccaggagaauauaauguucuu

SEQ ID NO: 862540 - RNA, 22 nt, Human
ccagcagagcauggggaggaag

SEQ ID NO: 862541 - RNA, 22 nt, Human
aauuccaaguagcaucccauca

SEQ ID NO: 862542 - RNA, 22 nt, Human
uauuuccaggccccacucuaga

SEQ ID NO: 862543 - RNA, 22 nt, Human
caacugugaauuuuaugauacc

SEQ ID NO: 862544 - RNA, 22 nt, Human
uuucucugcugccugugucgau

SEQ ID NO: 862545 - RNA, 22 nt, Human
ucucagaguuuagagcugagcc

SEQ ID NO: 862546 - RNA, 22 nt, Human
ucugaaggugcuagagaaagcu

SEQ ID NO: 862547 - RNA, 22 nt, Human
gacuucuauuaauaccucuacu

SEQ ID NO: 862548 - RNA, 22 nt, Human
uuucagacaggacuucauaugu

SEQ ID NO: 862549 - RNA, 22 nt, Human
aaauuuucagagcacuagagaa

SEQ ID NO: 862550 - RNA, 22 nt, Human
auucucuuuguauaacaucuug

SEQ ID NO: 862551 - RNA, 22 nt, Human
ucccaggacaggccacauggaa

SEQ ID NO: 862552 - RNA, 22 nt, Human
cauuuacauuuaagguuaauau

SEQ ID NO: 862553 - RNA, 22 nt, Human
ugaggcaguucuuacuuguauu

SEQ ID NO: 862554 - RNA, 22 nt, Human
cauuuacacacagaggugugcu

SEQ ID NO: 862555 - RNA, 22 nt, Human
uggcagcuccuggggccagcac

SEQ ID NO: 862556 - RNA, 22 nt, Human
caaugaaauugagauccagaga

SEQ ID NO: 862557 - RNA, 22 nt, Human
cuuccaaauguaaauaaguuuc

SEQ ID NO: 862558 - RNA, 22 nt, Human
auugaaaguccuaucuaaggga

SEQ ID NO: 862559 - RNA, 22 nt, Human
auguaaaucaagcagugcuggu

SEQ ID NO: 862560 - RNA, 18 nt, Human
acucaggaaaugaugaca

SEQ ID NO: 862561 - RNA, 22 nt, Human
ucucacuuuccagacuuuucaa

SEQ ID NO: 862562 - RNA, 22 nt, Human
auuaaacugagcaaauuaacau

SEQ ID NO: 862563 - RNA, 22 nt, Human
gagaaaugcaugcaugucauca

SEQ ID NO: 862564 - RNA, 22 nt, Human
cuugaaagcacuccuuugacug

SEQ ID NO: 862565 - RNA, 22 nt, Human
ugcaggaaauuccaggguggcc

SEQ ID NO: 862566 - RNA, 22 nt, Human
ucuucaucucagauuaacagga

SEQ ID NO: 862567 - RNA, 22 nt, Human
ucugggaacacacgucacuuca

SEQ ID NO: 862568 - RNA, 21 nt, Human
uucucagagucuauuacaguu

SEQ ID NO: 862569 - RNA, 22 nt, Human
cuagaaauauuuuacagucaag

SEQ ID NO: 862570 - RNA, 22 nt, Human
ggccagcagucacagggucaga

SEQ ID NO: 862571 - RNA, 22 nt, Human
aaggcagcaacuaauggaucuc

SEQ ID NO: 862572 - RNA, 22 nt, Human
aaguggacuaauacaaggacua

SEQ ID NO: 862573 - RNA, 22 nt, Human
uuuccauguuggugaaaugagg

SEQ ID NO: 862574 - RNA, 22 nt, Human
uuuguuaauucuuauguuagag

SEQ ID NO: 862575 - RNA, 22 nt, Human
gaggggaaagugugaggcugcg

SEQ ID NO: 862576 - RNA, 22 nt, Human
cugaacucuuuaugacagcuug

SEQ ID NO: 862577 - RNA, 22 nt, Human
cauaauuacugauaugcugauu

SEQ ID NO: 862578 - RNA, 22 nt, Human
gaguccuuuucucuguccacug

SEQ ID NO: 862579 - RNA, 22 nt, Human
uccaggagucagacagauggug

SEQ ID NO: 862580 - RNA, 22 nt, Human
agugcuuugugcucucacugca

SEQ ID NO: 862581 - RNA, 22 nt, Human
uaucuguuugcucacagguguu

SEQ ID NO: 862582 - RNA, 22 nt, Human
cagagagagucaaaucuuugcu

SEQ ID NO: 862583 - RNA, 22 nt, Human
aggcagcuuucuggugcaccau

SEQ ID NO: 862584 - RNA, 21 nt, Human
caauuucaugggaagauggga

SEQ ID NO: 862585 - RNA, 22 nt, Human
guaaaauagaauaacguggcua

SEQ ID NO: 862586 - RNA, 22 nt, Human
auacagaagaccccuccgucau

SEQ ID NO: 862587 - RNA, 22 nt, Human
uucuuuuccuacacagcgauuu

SEQ ID NO: 862588 - RNA, 22 nt, Human
uuuauauuucccaggauuggcc

SEQ ID NO: 862589 - RNA, 22 nt, Human
aauuaaauugguuuagagagga

SEQ ID NO: 862590 - RNA, 22 nt, Human
uucuucaguguagcaacuguau

SEQ ID NO: 862591 - RNA, 20 nt, Human
cucaggauacugcaaaguug

SEQ ID NO: 862592 - RNA, 22 nt, Human
acauauauuacuaguaaagaca

SEQ ID NO: 862593 - RNA, 22 nt, Human
gaugccucuuuuggcugaauua

SEQ ID NO: 862594 - RNA, 20 nt, Human
ggggcugcaugcagagaaga

SEQ ID NO: 862595 - RNA, 22 nt, Human
aggagaggguggcauuaaguuu

SEQ ID NO: 862596 - RNA, 22 nt, Human
ugaugaaacugagguuccaaga

SEQ ID NO: 862597 - RNA, 22 nt, Human
uacugaaaagccacaaggacca

SEQ ID NO: 862598 - RNA, 22 nt, Human
aggcagcuggaaaacuccaggc

SEQ ID NO: 862599 - RNA, 22 nt, Human
aagauggagcacgagcagaagc

SEQ ID NO: 862600 - RNA, 22 nt, Human
uuucaguuuuugcucgauguau

SEQ ID NO: 862601 - RNA, 22 nt, Human
uuuuccagauuggacuuagucc

SEQ ID NO: 862602 - RNA, 22 nt, Human
uugaaagucacaauggcauuaa

SEQ ID NO: 862603 - RNA, 22 nt, Human
uagaaaugaauguuuaaaaguc

SEQ ID NO: 862604 - RNA, 22 nt, Human
ugcauuuccagauuucuggagu

SEQ ID NO: 862605 - RNA, 22 nt, Human
auuucacucauucauguuacuu

SEQ ID NO: 862606 - RNA, 22 nt, Human
gaagcagcagcuggggacaguu

SEQ ID NO: 862607 - RNA, 22 nt, Human
ugcugcugaucauuuauagucu

SEQ ID NO: 862608 - RNA, 22 nt, Human
uuacagauggaucuagcaaaau

SEQ ID NO: 862609 - RNA, 22 nt, Human
ucagaaaugaucguuauucauu

SEQ ID NO: 862610 - RNA, 22 nt, Human
uucaggauucugugucugacaa

SEQ ID NO: 862611 - RNA, 22 nt, Human
aaaguccuguuugaaggaccug

SEQ ID NO: 862612 - RNA, 22 nt, Human
cugcugugagcacuccagccug

SEQ ID NO: 862613 - RNA, 20 nt, Human
gggcagcuccccucauucug

SEQ ID NO: 862614 - RNA, 22 nt, Human
gcccaggaaguugaggcugccg

SEQ ID NO: 862615 - RNA, 22 nt, Human
ggagugucagaaacaguguccu

SEQ ID NO: 862616 - RNA, 22 nt, Human
agugcuuuccuucuugugacau

SEQ ID NO: 862617 - RNA, 22 nt, Human
guacaauagucccuguuuggau

SEQ ID NO: 862618 - RNA, 22 nt, Human
aggagggagaugcccauccugg

SEQ ID NO: 862619 - RNA, 20 nt, Human
acaauacagguugugucuga

SEQ ID NO: 862620 - RNA, 22 nt, Human
cacaauuuccaagucauguuau

SEQ ID NO: 862621 - RNA, 22 nt, Human
aucauucuauuguugagcugcc

SEQ ID NO: 862622 - RNA, 22 nt, Human
aacauucugguucuaaaaaccu

SEQ ID NO: 862623 - RNA, 22 nt, Human
agaggagguccuuuucugaugu

SEQ ID NO: 862624 - RNA, 22 nt, Human
ugaggggagaagcagcagccug

SEQ ID NO: 862625 - RNA, 19 nt, Human
uucacaauuaugaaauuag

SEQ ID NO: 862626 - RNA, 22 nt, Human
uuauuuaaaagugguaagauuc

SEQ ID NO: 862627 - RNA, 19 nt, Human
ggucagcugggcuagaggc

SEQ ID NO: 862628 - RNA, 22 nt, Human
cuucucagaucucagcuuugag

SEQ ID NO: 862629 - RNA, 22 nt, Human
gguacaauccacuguggguuag

SEQ ID NO: 862630 - RNA, 22 nt, Human
cauuuguuggucagauuguagu

SEQ ID NO: 862631 - RNA, 22 nt, Human
cagcuggccaaucagggcgccc

SEQ ID NO: 862632 - RNA, 18 nt, Human
aagaggaggaaacccagg

SEQ ID NO: 862633 - RNA, 22 nt, Human
aucagaauaauuagauuucaga

SEQ ID NO: 862634 - RNA, 20 nt, Human
aggcagcugggaaaugaggg

SEQ ID NO: 862635 - RNA, 22 nt, Human
ugcauggacucaucagacaaga

SEQ ID NO: 862636 - RNA, 22 nt, Human
aacagaauaguugauguacagu

SEQ ID NO: 862637 - RNA, 22 nt, Human
cuugaaguugcaaaacauuaau

SEQ ID NO: 862638 - RNA, 22 nt, Human
cagaugaggcaaccucauugcu

SEQ ID NO: 862639 - RNA, 22 nt, Human
gaugaaaaauugcugugucaua

SEQ ID NO: 862640 - RNA, 22 nt, Human
cuuuuccacugagccucacaaa

SEQ ID NO: 862641 - RNA, 22 nt, Human
cuaaaauuaucaagauaauucc

SEQ ID NO: 862642 - RNA, 21 nt, Human
uaucagaagagaaagaaugau

SEQ ID NO: 862643 - RNA, 22 nt, Human
aaugauuuccccuacacagaag

SEQ ID NO: 862644 - RNA, 23 nt, Human
uccaggagaaccccugucugucc

SEQ ID NO: 862645 - RNA, 22 nt, Human
uuacagaaaagggcuuuaagag

SEQ ID NO: 862646 - RNA, 22 nt, Human
gcccaggaggucaaguagcuau

SEQ ID NO: 862647 - RNA, 22 nt, Human
guggcagcaaaugccuggacua

SEQ ID NO: 862648 - RNA, 22 nt, Human
guucuucagcauuagaagucau

SEQ ID NO: 862649 - RNA, 22 nt, Human
agacaaaugguaauuaugucua

SEQ ID NO: 862650 - RNA, 22 nt, Human
gugcauuuaggucacaugaugu

SEQ ID NO: 862651 - RNA, 21 nt, Human
aucacauuggcuguuauuauu

SEQ ID NO: 862652 - RNA, 17 nt, Human
ucccaggaacagggaau

SEQ ID NO: 862653 - RNA, 22 nt, Human
uggaaagcgaggaguuggcauu

SEQ ID NO: 862654 - RNA, 22 nt, Human
aagacuuucaaguaugcaugca

SEQ ID NO: 862655 - RNA, 20 nt, Human
uuacagaaaugauguuauuu

SEQ ID NO: 862656 - RNA, 22 nt, Human
acccaggaggcagagguugcag

SEQ ID NO: 862657 - RNA, 22 nt, Human
ucaaauaccagcaauuucaugu

SEQ ID NO: 862658 - RNA, 22 nt, Human
ucauuuuucacacagggucacc

SEQ ID NO: 862659 - RNA, 22 nt, Human
caguccuuggcaaguucucagu

SEQ ID NO: 862660 - RNA, 22 nt, Human
caguccuugcuaugacccugag

SEQ ID NO: 862661 - RNA, 22 nt, Human
gaaucucaguggaagcaggaag

SEQ ID NO: 862662 - RNA, 22 nt, Human
aaacugcugguugcuggccagc

SEQ ID NO: 862663 - RNA, 21 nt, Human
ugaggcaggggugcuuuuguc

SEQ ID NO: 862664 - RNA, 22 nt, Human
gaucuguuauaaucucuuuuau

SEQ ID NO: 862665 - RNA, 22 nt, Human
auguuaaaugguuuauuauuaa

SEQ ID NO: 862666 - RNA, 22 nt, Human
uuuacagagagagaacuggacu

SEQ ID NO: 862667 - RNA, 19 nt, Human
uacuaaacaugcauauugg

SEQ ID NO: 862668 - RNA, 22 nt, Human
gugguaauuuaauccuacacug

SEQ ID NO: 862669 - RNA, 22 nt, Human
agcuaccuggcuuaucacuguc

SEQ ID NO: 862670 - RNA, 22 nt, Human
ucauaaaaugcuccugauauug

SEQ ID NO: 862671 - RNA, 22 nt, Human
ucugcuguucauucuuuuagcu

SEQ ID NO: 862672 - RNA, 22 nt, Human
gccugcagauauauaggauggu

SEQ ID NO: 862673 - RNA, 22 nt, Human
caauauauaggaacaacuuagg

SEQ ID NO: 862674 - RNA, 22 nt, Human
cucagaagccuucagucuuggc

SEQ ID NO: 862675 - RNA, 22 nt, Human
aaaggccagguuggcugguauu

SEQ ID NO: 862676 - RNA, 22 nt, Human
acccaggacucucuuccaguag

SEQ ID NO: 862677 - RNA, 19 nt, Human
uuucccagcccuugcugug

SEQ ID NO: 862678 - RNA, 22 nt, Human
caauuucaucuugugcuucaau

SEQ ID NO: 862679 - RNA, 22 nt, Human
uuccagcaggcagacaggagau

SEQ ID NO: 862680 - RNA, 22 nt, Human
uuucuagugguuaagauuuaca

SEQ ID NO: 862681 - RNA, 22 nt, Human
cuacagaaaaucagccacaggc

SEQ ID NO: 862682 - RNA, 22 nt, Human
agucaccaacaugguucccagg

SEQ ID NO: 862683 - RNA, 22 nt, Human
aggcagcugaccacaguaugau

SEQ ID NO: 862684 - RNA, 22 nt, Human
guccucuguuagaaaugugcuu

SEQ ID NO: 862685 - RNA, 22 nt, Human
uucucagaauugacugggagca

SEQ ID NO: 862686 - RNA, 22 nt, Human
ucuuagaaguuuauggcacgga

SEQ ID NO: 862687 - RNA, 22 nt, Human
auauuucaugggguuccauacu

SEQ ID NO: 862688 - RNA, 22 nt, Human
cggcagcucgagggccacccgu

SEQ ID NO: 862689 - RNA, 22 nt, Human
auuuucaucauggguuuaacau

SEQ ID NO: 862690 - RNA, 22 nt, Human
cuggccaggcuugggacagaca

SEQ ID NO: 862691 - RNA, 22 nt, Human
ccaggagauuuuuccauagcac

SEQ ID NO: 862692 - RNA, 22 nt, Human
uuucaguguaucuuccaaaagc

SEQ ID NO: 862693 - RNA, 22 nt, Human
acucagaagauauaaugacuca

SEQ ID NO: 862694 - RNA, 19 nt, Human
gugcuuuuuaagagcucag

SEQ ID NO: 862695 - RNA, 22 nt, Human
auuuccaagaaagcuuuaggau

SEQ ID NO: 862696 - RNA, 22 nt, Human
ucaguaaacagguuuaaguccu

SEQ ID NO: 862697 - RNA, 22 nt, Human
gaaguccugguccucucauuca

SEQ ID NO: 862698 - RNA, 22 nt, Human
auagcuguuagauuggggucga

SEQ ID NO: 862699 - RNA, 22 nt, Human
aucuaaaaggagcucuuuaucu

SEQ ID NO: 862700 - RNA, 22 nt, Human
gcaguucuacuuauccauagac

SEQ ID NO: 862701 - RNA, 22 nt, Human
uucuacaauaugaauaaugaag

SEQ ID NO: 862702 - RNA, 22 nt, Human
ugaggggagguuggggcacauc

SEQ ID NO: 862703 - RNA, 22 nt, Human
caguugccuacuacauggcagg

SEQ ID NO: 862704 - RNA, 22 nt, Human
guuaggcaaauaacuguggagc

SEQ ID NO: 862705 - RNA, 23 nt, Human
cccaggagccugaguccucucug

SEQ ID NO: 862706 - RNA, 22 nt, Human
aaaacuaaauacgcuuugccuc

SEQ ID NO: 862707 - RNA, 20 nt, Human
agcugccccugggcacugcc

SEQ ID NO: 862708 - RNA, 21 nt, Human
auacagaacauugauccaaga

SEQ ID NO: 862709 - RNA, 22 nt, Human
uuccuuagaguuuccagaaagc

SEQ ID NO: 862710 - RNA, 22 nt, Human
uaaguaaauuuauaaugugauu

SEQ ID NO: 862711 - RNA, 22 nt, Human
augcuguguuugagaaccuagg

SEQ ID NO: 862712 - RNA, 22 nt, Human
cuagaaauacaggcacgugcca

SEQ ID NO: 862713 - RNA, 21 nt, Human
auuucagagcacacaaguaaa

SEQ ID NO: 862714 - RNA, 22 nt, Human
uucuucaugcuguugcugcuug

SEQ ID NO: 862715 - RNA, 22 nt, Human
aacaugcucuguuucuuggaug

SEQ ID NO: 862716 - RNA, 22 nt, Human
ucaccagucuuucuuaccauug

SEQ ID NO: 862717 - RNA, 22 nt, Human
cgcagggauuucaaggggccuu

SEQ ID NO: 862718 - RNA, 22 nt, Human
agccagucggggccaugcuggg

SEQ ID NO: 862719 - RNA, 22 nt, Human
auguuuuugagauacaaacaga

SEQ ID NO: 862720 - RNA, 22 nt, Human
caaguccucugguuucaaauag

SEQ ID NO: 862721 - RNA, 22 nt, Human
caguuucuauggcugggcucug

SEQ ID NO: 862722 - RNA, 23 nt, Human
acuuuauccuauaucuuuguucu

SEQ ID NO: 862723 - RNA, 22 nt, Human
auacagaaaaguggauagccag

SEQ ID NO: 862724 - RNA, 22 nt, Human
uuuuuaguagagguggguuuca

SEQ ID NO: 862725 - RNA, 22 nt, Human
gccaggaguucagaugcauguu

SEQ ID NO: 862726 - RNA, 22 nt, Human
guacagaaauggggccccaggu

SEQ ID NO: 862727 - RNA, 22 nt, Human
uaugaaaagguggccaauguag

SEQ ID NO: 862728 - RNA, 22 nt, Human
ccaggagaugggagcaucuaaa

SEQ ID NO: 862729 - RNA, 22 nt, Human
uuucacagcuggguggcagagu

SEQ ID NO: 862730 - RNA, 22 nt, Human
uugugguuaaccgcacauuuuu

SEQ ID NO: 862731 - RNA, 22 nt, Human
auugucuuuccacugagaaguu

SEQ ID NO: 862732 - RNA, 22 nt, Human
uccaugaguuugaggaaaagag

SEQ ID NO: 862733 - RNA, 22 nt, Human
cagcuuccauaagagauggaga

SEQ ID NO: 862734 - RNA, 22 nt, Human
gauagaaagaauauagauucca

SEQ ID NO: 862735 - RNA, 22 nt, Human
auagucacugccuuccauuugu

SEQ ID NO: 862736 - RNA, 22 nt, Human
aaagccauugaacuguacuuua

SEQ ID NO: 862737 - RNA, 22 nt, Human
aguaaaaauugaggugcaaaau

SEQ ID NO: 862738 - RNA, 22 nt, Human
ugcuuuaaaauggacuguuuug

SEQ ID NO: 862739 - RNA, 22 nt, Human
gagaggggcccaagccacauag

SEQ ID NO: 862740 - RNA, 22 nt, Human
uguccuuauauuguggaagggg

SEQ ID NO: 862741 - RNA, 22 nt, Human
uuggaucagaugauaucuuugu

SEQ ID NO: 862742 - RNA, 22 nt, Human
ucauuucccuccuacaaagagg

SEQ ID NO: 862743 - RNA, 22 nt, Human
uuccucagaaaauacuguccaa

SEQ ID NO: 862744 - RNA, 21 nt, Human
uaaggccaagucuauuucugu

SEQ ID NO: 862745 - RNA, 22 nt, Human
augguuuacugaucuuuuuggu

SEQ ID NO: 862746 - RNA, 22 nt, Human
cuagcaucagaugagaagcugu

SEQ ID NO: 862747 - RNA, 22 nt, Human
ucaggagagaaagaauacaauu

SEQ ID NO: 862748 - RNA, 22 nt, Human
uuuccagguauuaauacuguau

SEQ ID NO: 862749 - RNA, 22 nt, Human
aggauuuaucaggaacucucuu

SEQ ID NO: 862750 - RNA, 22 nt, Human
cagugucuccagaugcuccaau

SEQ ID NO: 862751 - RNA, 22 nt, Human
auucacaaaaugauauagauac

SEQ ID NO: 862752 - RNA, 22 nt, Human
aagacuuucaaaccuauguuug

SEQ ID NO: 862753 - RNA, 22 nt, Human
ccuccuuuccuguuuuccugag

SEQ ID NO: 862754 - RNA, 20 nt, Human
aucaggauucuugcuuuguu

SEQ ID NO: 862755 - RNA, 22 nt, Human
aucaggauuauuaaaucuggau

SEQ ID NO: 862756 - RNA, 22 nt, Human
guggcaggagacuggaagaugg

SEQ ID NO: 862757 - RNA, 22 nt, Human
agucuugcucuugcaucugcuu

SEQ ID NO: 862758 - RNA, 22 nt, Human
gcagagcuucuguccuucagga

SEQ ID NO: 862759 - RNA, 22 nt, Human
aaagauuugaguucugcuuaua

SEQ ID NO: 862760 - RNA, 22 nt, Human
uccaggagggggagccgugccg

SEQ ID NO: 862761 - RNA, 22 nt, Human
caaaucuauauguugauauucu

SEQ ID NO: 862762 - RNA, 22 nt, Human
cauuucaaaagaauugccagaa

SEQ ID NO: 862763 - RNA, 22 nt, Human
aaggcagcaugaaucccuguac

SEQ ID NO: 862764 - RNA, 22 nt, Human
uggagagguugaauaacuuguc

SEQ ID NO: 862765 - RNA, 22 nt, Human
uucucugaucuugcuagacuga

SEQ ID NO: 862766 - RNA, 22 nt, Human
cucaggauagauuguccucuca

SEQ ID NO: 862767 - RNA, 22 nt, Human
aaaauugagagucuugugcaag

SEQ ID NO: 862768 - RNA, 22 nt, Human
gaggagagagggacugucugca

SEQ ID NO: 862769 - RNA, 22 nt, Human
cuggaggcacccuuagagaggc

SEQ ID NO: 862770 - RNA, 22 nt, Human
ggcagcuguaagaugagugaau

SEQ ID NO: 862771 - RNA, 21 nt, Human
gccaggaguagauuacauuua

SEQ ID NO: 862772 - RNA, 22 nt, Human
agaggccggccgagcccauggg

SEQ ID NO: 862773 - RNA, 22 nt, Human
uccaggagugcugguuagagua

SEQ ID NO: 862774 - RNA, 22 nt, Human
acaugcuuugauguauuuugca

SEQ ID NO: 862775 - RNA, 22 nt, Human
aggagcagaauuuaaugugcag

SEQ ID NO: 862776 - RNA, 21 nt, Human
cuacagaagcucuccuaucca

SEQ ID NO: 862777 - RNA, 22 nt, Human
gaauuacaugacccugaguaga

SEQ ID NO: 862778 - RNA, 22 nt, Human
gauuuacagcuauacccaaugg

SEQ ID NO: 862779 - RNA, 22 nt, Human
uauuugcaacauaaaacucuga

SEQ ID NO: 862780 - RNA, 22 nt, Human
uugaacauuggcaauuucauau

SEQ ID NO: 862781 - RNA, 22 nt, Human
ugaggcagggaguuuaauuguc

SEQ ID NO: 862782 - RNA, 22 nt, Human
uggcagcugguacagugggucu

SEQ ID NO: 862783 - RNA, 22 nt, Human
gcuucccagcagaggaaagacu

SEQ ID NO: 862784 - RNA, 22 nt, Human
ucugggaacagccuggcugugu

SEQ ID NO: 862785 - RNA, 22 nt, Human
aggaaaggccuuugcauuuggu

SEQ ID NO: 862786 - RNA, 22 nt, Human
acuugcauuauauuuaucacaa

SEQ ID NO: 862787 - RNA, 22 nt, Human
gcugugcuugggaagaaucucu

SEQ ID NO: 862788 - RNA, 20 nt, Human
agcaagaguaaggacagcga

SEQ ID NO: 862789 - RNA, 23 nt, Human
cccagggacacgaugacaccucc

SEQ ID NO: 862790 - RNA, 22 nt, Human
ccuggaucuuucugacugacaa

SEQ ID NO: 862791 - RNA, 22 nt, Human
uucuacaugguugcucagaggg

SEQ ID NO: 862792 - RNA, 22 nt, Human
uucucuuugacauuauucaggu

SEQ ID NO: 862793 - RNA, 22 nt, Human
caaauagugucacauugugagg

SEQ ID NO: 862794 - RNA, 22 nt, Human
gauaucauaucagacaaccucu

SEQ ID NO: 862795 - RNA, 22 nt, Human
aggcagacaaggucccuggucu

SEQ ID NO: 862796 - RNA, 22 nt, Human
uuucauggcuaggacuagagug

SEQ ID NO: 862797 - RNA, 22 nt, Human
aauuuuaagcauaugacugguu

SEQ ID NO: 862798 - RNA, 22 nt, Human
agaggcaguauacaauccgagc

SEQ ID NO: 862799 - RNA, 22 nt, Human
auguuuccauuuucuuguauca

SEQ ID NO: 862800 - RNA, 22 nt, Human
uaauuucaaguuuagggcucua

SEQ ID NO: 862801 - RNA, 23 nt, Human
uucauuugucuacuucacuuguu

SEQ ID NO: 862802 - RNA, 22 nt, Human
ucaggagacauucuuaaaguag

SEQ ID NO: 862803 - RNA, 22 nt, Human
gcugcugugccuggcguccugu

SEQ ID NO: 862804 - RNA, 22 nt, Human
cagucuuuguucccauuacuga

SEQ ID NO: 862805 - RNA, 22 nt, Human
caggcagcugggucaccguccc

SEQ ID NO: 862806 - RNA, 22 nt, Human
aagugggaauagaaaugaaggu

SEQ ID NO: 862807 - RNA, 22 nt, Human
aaaggccaugguuggaguguuu

SEQ ID NO: 862808 - RNA, 22 nt, Human
uccaaaaaacguuugaauaguu

SEQ ID NO: 862809 - RNA, 22 nt, Human
cagaucuagagcuuuuccaucu

SEQ ID NO: 862810 - RNA, 22 nt, Human
cauuucaaguaacagauugcuu

SEQ ID NO: 862811 - RNA, 22 nt, Human
uaaggccaaacuauuauaguuc

SEQ ID NO: 862812 - RNA, 22 nt, Human
cuagggaguggcagagcuggga

SEQ ID NO: 862813 - RNA, 22 nt, Human
agagggaucacccuguuucugg

SEQ ID NO: 862814 - RNA, 22 nt, Human
ucaaguuucucucagauuaugg

SEQ ID NO: 862815 - RNA, 22 nt, Human
gaggcagcugaagcuucaaaga

SEQ ID NO: 862816 - RNA, 22 nt, Human
caugcuuaugauuugcuaagcc

SEQ ID NO: 862817 - RNA, 23 nt, Human
cagaaaacccagagcucaguccc

SEQ ID NO: 862818 - RNA, 22 nt, Human
ucucacuuuguugcccagacuu

SEQ ID NO: 862819 - RNA, 22 nt, Human
uuauagaacagccuccucuaga

SEQ ID NO: 862820 - RNA, 22 nt, Human
acaaugaacacacaaggaauuc

SEQ ID NO: 862821 - RNA, 22 nt, Human
caucagaaggccagaggguagc

SEQ ID NO: 862822 - RNA, 19 nt, Human
caaggccaccauuucuccg

SEQ ID NO: 862823 - RNA, 22 nt, Human
uucauacuguguuuccaaguuu

SEQ ID NO: 862824 - RNA, 22 nt, Human
aauuuccagaucagaugacuca

SEQ ID NO: 862825 - RNA, 22 nt, Human
aaaauuauggaguaucccaaag

SEQ ID NO: 862826 - RNA, 22 nt, Human
caaauacuggguaaguuaauuu

SEQ ID NO: 862827 - RNA, 22 nt, Human
uggcagcagacaaaaggccauu

SEQ ID NO: 862828 - RNA, 22 nt, Human
gauuucaaggaguuuucacagu

SEQ ID NO: 862829 - RNA, 22 nt, Human
uccuggauaucaaacaaacauu

SEQ ID NO: 862830 - RNA, 22 nt, Human
uccaggagaaaacugacggugg

SEQ ID NO: 862831 - RNA, 22 nt, Human
ugccaggagucaggccaggcag

SEQ ID NO: 862832 - RNA, 22 nt, Human
gaaugaaagauuugcauucuau

SEQ ID NO: 862833 - RNA, 22 nt, Human
gcccaggaguuugcauuuuaac

SEQ ID NO: 862834 - RNA, 22 nt, Human
gcccaggauaaugcugucccug

SEQ ID NO: 862835 - RNA, 22 nt, Human
gaccauuugcuaguaaauugca

SEQ ID NO: 862836 - RNA, 22 nt, Human
ucuccucuauuucuguauguau

SEQ ID NO: 862837 - RNA, 22 nt, Human
auuaggcauucugaaugagguc

SEQ ID NO: 862838 - RNA, 22 nt, Human
ucagugugaggucuuccacccg

SEQ ID NO: 862839 - RNA, 22 nt, Human
aucagcaucuuuaacaauuacc

SEQ ID NO: 862840 - RNA, 22 nt, Human
aaguccuuuaauaucacauagu

SEQ ID NO: 862841 - RNA, 22 nt, Human
gagagcaggaggcagcgggacg

SEQ ID NO: 862842 - RNA, 22 nt, Human
ucucauugguauauacaugugu

SEQ ID NO: 862843 - RNA, 22 nt, Human
aauuaaaugacaggggaagaug

SEQ ID NO: 862844 - RNA, 22 nt, Human
ucuucauuccguagauauuuau

SEQ ID NO: 862845 - RNA, 22 nt, Human
uucagaaaggauaauuggaagg

SEQ ID NO: 862846 - RNA, 22 nt, Human
ucauuucucccggccaaaaacu

SEQ ID NO: 862847 - RNA, 22 nt, Human
ccucugcucugguccaugugcu

SEQ ID NO: 862848 - RNA, 22 nt, Human
acaggagacccugcugguucug

SEQ ID NO: 862849 - RNA, 22 nt, Human
uaaagccaauauaccuagcaua

SEQ ID NO: 862850 - RNA, 22 nt, Human
cccuuagcucaauuucuugccc

SEQ ID NO: 862851 - RNA, 22 nt, Human
gcagcugcaauaggcaucaagc

SEQ ID NO: 862852 - RNA, 22 nt, Human
auucaaguggcugcuauguuaa

SEQ ID NO: 862853 - RNA, 22 nt, Human
ugagauguaagguaugcuuacu

SEQ ID NO: 862854 - RNA, 23 nt, Human
ucaggauauugugugccaaggug

SEQ ID NO: 862855 - RNA, 22 nt, Human
uuuaaagaaauuccucaucuuu

SEQ ID NO: 862856 - RNA, 22 nt, Human
guuccaaaguuagaguguauug

SEQ ID NO: 862857 - RNA, 22 nt, Human
uccaugagagguaacuuuacaa

SEQ ID NO: 862858 - RNA, 19 nt, Human
ucucuacacuacauuucua

SEQ ID NO: 862859 - RNA, 22 nt, Human
uucaugugaauauauuugucuu

SEQ ID NO: 862860 - RNA, 22 nt, Human
ucccaggacaugggcucugcuc

SEQ ID NO: 862861 - RNA, 22 nt, Human
aucaggaugacaacugcugggu

SEQ ID NO: 862862 - RNA, 22 nt, Human
acccaggaggcaagguugcagu

SEQ ID NO: 862863 - RNA, 22 nt, Human
gaggggaagacuucuggacagu

SEQ ID NO: 862864 - RNA, 22 nt, Human
cuuaacagagagaaguguugcu

SEQ ID NO: 862865 - RNA, 22 nt, Human
ucuacuguagugaugcugcagu

SEQ ID NO: 862866 - RNA, 22 nt, Human
ggcauuuaguuuucauauucug

SEQ ID NO: 862867 - RNA, 22 nt, Human
auuccaaagacagaagcagcug

SEQ ID NO: 862868 - RNA, 20 nt, Human
agaagucagcucagaaguga

SEQ ID NO: 862869 - RNA, 22 nt, Human
aguucacagccauguucaugug

SEQ ID NO: 862870 - RNA, 22 nt, Human
ucucuucuaauuaggguccaug

SEQ ID NO: 862871 - RNA, 22 nt, Human
ucaggaugguccuuuaugagaa

SEQ ID NO: 862872 - RNA, 17 nt, Human
gcccaggaaggacggcc

SEQ ID NO: 862873 - RNA, 23 nt, Human
uccaggagaauuccagggcccgg

SEQ ID NO: 862874 - RNA, 22 nt, Human
ccaggagacaaagaugacugcu

SEQ ID NO: 862875 - RNA, 22 nt, Human
cugcuguguggugaaacucagu

SEQ ID NO: 862876 - RNA, 22 nt, Human
gaggcagcugaaggagugacag

SEQ ID NO: 862877 - RNA, 22 nt, Human
acaauucugaugguuucccagu

SEQ ID NO: 862878 - RNA, 22 nt, Human
auaaagauuucuuuuucucuac

SEQ ID NO: 862879 - RNA, 22 nt, Human
auuccaaacagugcugcagacu

SEQ ID NO: 862880 - RNA, 18 nt, Human
aagaggaggagcagguug

SEQ ID NO: 862881 - RNA, 22 nt, Human rhinovirus 89
cauuuguuccugauugccaugu

SEQ ID NO: 862882 - RNA, 23 nt, Human
cagggaggagauacuguguaucu

SEQ ID NO: 862883 - RNA, 22 nt, Human
ugaggcagggagaguggauaug

SEQ ID NO: 862884 - RNA, 22 nt, Human
auacagaaguuuuccacuuauu

SEQ ID NO: 862885 - RNA, 22 nt, Human
ucuucucucauguaggagggaa

SEQ ID NO: 862886 - RNA, 22 nt, Human
uggaguuccuuugaaaggcucu

SEQ ID NO: 862887 - RNA, 22 nt, Human
cagggagggacaauugucaccu

SEQ ID NO: 862888 - RNA, 22 nt, Human
gcagcugagcgugaggaagagu

SEQ ID NO: 862889 - RNA, 22 nt, Human
aauacauauggaauuccauguu

SEQ ID NO: 862890 - RNA, 21 nt, Human
cucuugugucagagccagagg

SEQ ID NO: 862891 - RNA, 22 nt, Human
cuagcaucagaugagaagcugu

SEQ ID NO: 862892 - RNA, 22 nt, Human
gcucaggacccaggugugaccu

SEQ ID NO: 862893 - RNA, 22 nt, Human
uucucagaggagucgggagcug

SEQ ID NO: 862894 - RNA, 22 nt, Human
aaagccauugaacuguacuuua

SEQ ID NO: 862895 - RNA, 22 nt, Human
ccacagcugaccgcaggugagc

SEQ ID NO: 862896 - RNA, 22 nt, Human
agaaaugaauauguagugguua

SEQ ID NO: 862897 - RNA, 20 nt, Human
gggcaguucaaugccacucu

SEQ ID NO: 862898 - RNA, 22 nt, Human
aagagggcagcacagguggguc

SEQ ID NO: 862899 - RNA, 22 nt, Human
ugcccagggauaagccuagaga

SEQ ID NO: 862900 - RNA, 22 nt, Human
acagaauuaaugaaaauuacaa

SEQ ID NO: 862901 - RNA, 22 nt, Human
gcagagaagaugcccaggcuuc

SEQ ID NO: 862902 - RNA, 22 nt, Human
gcuucacaggcaaguuaagccu

SEQ ID NO: 862903 - RNA, 22 nt, Human
aaaggccaauaaagacaagcug

SEQ ID NO: 862904 - RNA, 19 nt, Human
agucuuucccacucgucuu

SEQ ID NO: 862905 - RNA, 23 nt, Human
uugcauagacauccucauagauu

SEQ ID NO: 862906 - RNA, 22 nt, Human
gucaggaucucccaguacauau

SEQ ID NO: 862907 - RNA, 22 nt, Human
gaggcugccccuuccucagcug

SEQ ID NO: 862908 - RNA, 22 nt, Human
uucagggagagcgggacgggug

SEQ ID NO: 862909 - RNA, 22 nt, Human
aggcagacaaggacacaguggg

SEQ ID NO: 862910 - RNA, 22 nt, Human
uucuucucggcugucagauagu

SEQ ID NO: 862911 - RNA, 22 nt, Human
uauggcuuuucauuccuaugug

SEQ ID NO: 862912 - RNA, 22 nt, Human
ggcagcaucucuggcagcagcu

SEQ ID NO: 862913 - RNA, 22 nt, Human
aucuauacuacaaauggcuggu

SEQ ID NO: 862914 - RNA, 22 nt, Human
agauaaaaugguucaaaggcua

SEQ ID NO: 862915 - RNA, 22 nt, Human
gaggggaaagugugaggcugcg

SEQ ID NO: 862916 - RNA, 22 nt, Human
aguucucaagacaauuaccugu

SEQ ID NO: 862917 - RNA, 22 nt, Human
cagagagagucaaaucuuugcu

SEQ ID NO: 862918 - RNA, 22 nt, Human
aagaggaggacgguucccagaa

SEQ ID NO: 862919 - RNA, 22 nt, Human
aaauagcagccuuuaguuaaca

SEQ ID NO: 862920 - RNA, 22 nt, Human
aaaugcauggcuguuuuaaagc

SEQ ID NO: 862921 - RNA, 20 nt, Human
acuugcugggcuuuguuacc

SEQ ID NO: 862922 - RNA, 22 nt, Human
cagcaggaggugaguagcaggu

SEQ ID NO: 862923 - RNA, 22 nt, Human
gagagaaaugugcaguuugggc

SEQ ID NO: 862924 - RNA, 22 nt, Human
aauuuccagaccccauccacag

SEQ ID NO: 862925 - RNA, 23 nt, Human
aggcccaacucugugagggcugc

SEQ ID NO: 862926 - RNA, 22 nt, Human
auuguucaaagugcuuugcaug

SEQ ID NO: 862927 - RNA, 22 nt, Human
aagccagauuucacucuuaauu

SEQ ID NO: 862928 - RNA, 17 nt, Human
ugcuuaauuuugacugg

SEQ ID NO: 862929 - RNA, 22 nt, Human
gauuuacagcuauacccaaugg

SEQ ID NO: 862930 - RNA, 22 nt, Human
ucacagacacagggagaagcau

SEQ ID NO: 862931 - RNA, 22 nt, Human
auuaggcagggcaugguggcuc

SEQ ID NO: 862932 - RNA, 22 nt, Human
auuacaguaacagcuacaaugc

SEQ ID NO: 862933 - RNA, 22 nt, Human
augcugugccuggaaagcggcu

SEQ ID NO: 862934 - RNA, 20 nt, Human
gaaguccuguuauauccuuu

SEQ ID NO: 862935 - RNA, 22 nt, Human
ccacagagacaggguccuugcu

SEQ ID NO: 862936 - RNA, 22 nt, Human
aggacagggauucaaacuccca

SEQ ID NO: 862937 - RNA, 22 nt, Human
ucuucacaggagccugccugcc

SEQ ID NO: 862938 - RNA, 22 nt, Human
augcuuuuccaggagaaauaua

SEQ ID NO: 862939 - RNA, 16 nt, Human
cuuccucuucacuggc

SEQ ID NO: 862940 - RNA, 22 nt, Human
ggccagcagucacagggucaga

SEQ ID NO: 862941 - RNA, 22 nt, Human
cccaggcagugugugcaugcgu

SEQ ID NO: 862942 - RNA, 22 nt, Human
cugagagugcucuuugauguca

SEQ ID NO: 862943 - RNA, 22 nt, Human
cugauacauaguagcaugucau

SEQ ID NO: 862944 - RNA, 22 nt, Human
gaauuucauuuguuuccuacca

SEQ ID NO: 862945 - RNA, 22 nt, Human
ggcagcuucuuaauauggagac

SEQ ID NO: 862946 - RNA, 22 nt, Human
gcugcccaggguggagccggcu

SEQ ID NO: 862947 - RNA, 22 nt, Human
aaaaucugcuuccuuuuacaga

SEQ ID NO: 862948 - RNA, 22 nt, Human
cccaggaauuggaggcugcagu

SEQ ID NO: 862949 - RNA, 22 nt, Human
caugcuuaugauuugcuaagcc

SEQ ID NO: 862950 - RNA, 22 nt, Human
ggcagggaagcuggcaucacgg

SEQ ID NO: 862951 - RNA, 22 nt, Human
uaacaagucauuuuaaauuaug

SEQ ID NO: 862952 - RNA, 22 nt, Human
auauccaagaaacaauuaauuc

SEQ ID NO: 862953 - RNA, 22 nt, Human
aggcagcuggcaaauucuagag

SEQ ID NO: 862954 - RNA, 22 nt, Human
auagaauuauggaaagcaucuu

SEQ ID NO: 862955 - RNA, 22 nt, Human
caguccuuauuccuauauuccu

SEQ ID NO: 862956 - RNA, 22 nt, Human
ucacagaaauaagauaguuauu

SEQ ID NO: 862957 - RNA, 23 nt, Human
uauggcuuacagugcuuuaggua

SEQ ID NO: 862958 - RNA, 20 nt, Human
agaaucugacccagagagac

SEQ ID NO: 862959 - RNA, 22 nt, Human
aucacaaaggucucagagcaca

SEQ ID NO: 862960 - RNA, 22 nt, Human
ugauugaacugagcuucaagau

SEQ ID NO: 862961 - RNA, 22 nt, Human
augcugugccuucucugugcca

SEQ ID NO: 862962 - RNA, 21 nt, Human
augucaaaugcuuuauuuuau

SEQ ID NO: 862963 - RNA, 22 nt, Human
auuuagccucauuuuugacaua

SEQ ID NO: 862964 - RNA, 21 nt, Human
uucuucaaagaagaaggcaca

SEQ ID NO: 862965 - RNA, 22 nt, Human
acuggcagagacccugauggcc

SEQ ID NO: 862966 - RNA, 22 nt, Human
ggcagcuuucucacccaugacc

SEQ ID NO: 862967 - RNA, 22 nt, Human
auuucccaugugaaucaauugg

SEQ ID NO: 862968 - RNA, 22 nt, Human
caguaaauuaucucaucucugu

SEQ ID NO: 862969 - RNA, 22 nt, Human
ugaggcaguauucuccauucca

SEQ ID NO: 862970 - RNA, 22 nt, Human
ugaauaaucuuggguauuaaua

SEQ ID NO: 862971 - RNA, 22 nt, Human
aaguaaauaucuguuuauagca

SEQ ID NO: 862972 - RNA, 22 nt, Human
aaguuugcauagauuaagcauu

SEQ ID NO: 862973 - RNA, 22 nt, Human
auuauauaggacuugcccuucc

SEQ ID NO: 862974 - RNA, 22 nt, Human
gaucagaaucuucauuuucagu

SEQ ID NO: 862975 - RNA, 22 nt, Human
acuuaaaaagaaucuuuucacg

SEQ ID NO: 862976 - RNA, 22 nt, Human
acagaaauugggcaaauggaag

SEQ ID NO: 862977 - RNA, 22 nt, Human
uuugcagucuggccugcuuugg

SEQ ID NO: 862978 - RNA, 22 nt, Human
uaggcagcgcuuggcugugcuu

SEQ ID NO: 862979 - RNA, 22 nt, Human
aagaaaucauaucauuucuugg

SEQ ID NO: 862980 - RNA, 22 nt, Human
guuguuuugcaggauccuuaca

SEQ ID NO: 862981 - RNA, 22 nt, Human
uagggaggcuacuucuuguagg

SEQ ID NO: 862982 - RNA, 22 nt, Human
uuuccagguauuaauacuguau

SEQ ID NO: 862983 - RNA, 22 nt, Human
uaauuucaaauuucuuagcgug

SEQ ID NO: 862984 - RNA, 22 nt, Human
uucaugugaucacagauuguaa

SEQ ID NO: 862985 - RNA, 22 nt, Human
aucauucuagcuguuguguuga

SEQ ID NO: 862986 - RNA, 22 nt, Human
cuucccagaccuuagagugcag

SEQ ID NO: 862987 - RNA, 22 nt, Human
ugaaggccagggauuugcagcc

SEQ ID NO: 862988 - RNA, 22 nt, Human
cugcuguguugccagugucacc

SEQ ID NO: 862989 - RNA, 22 nt, Human
uaagcugugggagauuggcaua

SEQ ID NO: 862990 - RNA, 22 nt, Human
ucuaaacacuaagucuugaugc

SEQ ID NO: 862991 - RNA, 21 nt, Human
ggagggcagcccagacuggcu

SEQ ID NO: 862992 - RNA, 23 nt, Human
cugcccugaucuugaucuauugu

SEQ ID NO: 862993 - RNA, 22 nt, Human
ggccagagaauaugccuuacgu

SEQ ID NO: 862994 - RNA, 22 nt, Human
gggugggacugaagucugaggg

SEQ ID NO: 862995 - RNA, 22 nt, Human
uggaaauguauuugggcaugcc

SEQ ID NO: 862996 - RNA, 22 nt, Human
aguucuuuugugaacauaugcu

SEQ ID NO: 862997 - RNA, 22 nt, Human
gaucuucucuuuaguagaaaca

SEQ ID NO: 862998 - RNA, 22 nt, Human
aaggccagacaggaccacaucu

SEQ ID NO: 862999 - RNA, 22 nt, Human
uuaagcaacacacauuaauuau

SEQ ID NO: 863000 - RNA, 22 nt, Human
auuuccauagagcgucucacag

SEQ ID NO: 863001 - RNA, 22 nt, Human
cauuuauucauuugcuagggcu

SEQ ID NO: 863002 - RNA, 20 nt, Human
gagauggacagaugaagggg

SEQ ID NO: 863003 - RNA, 22 nt, Human
uaaugucagcauaguuuauuuu

SEQ ID NO: 863004 - RNA, 23 nt, Human
acaacuuuacagauacauuuugu

SEQ ID NO: 863005 - RNA, 22 nt, Human
uggcagcugauuagauggugcc

SEQ ID NO: 863006 - RNA, 22 nt, Human
aguauaauuagauaucaaaagu

SEQ ID NO: 863007 - RNA, 22 nt, Human
agcuaccuggcuuaucacuguc

SEQ ID NO: 863008 - RNA, 22 nt, Human
augaacaaguauuugcaugagc

SEQ ID NO: 863009 - RNA, 22 nt, Human
cauuuucaugaguuucuguuca

SEQ ID NO: 863010 - RNA, 22 nt, Human
ucagagagccucaggcacugcc

SEQ ID NO: 863011 - RNA, 20 nt, Human
cagaggcaaggagacuugga

SEQ ID NO: 863012 - RNA, 22 nt, Human
uaguacaguuuaaauauuaaua

SEQ ID NO: 863013 - RNA, 22 nt, Human
aggggagguggcagaaaugugc

SEQ ID NO: 863014 - RNA, 22 nt, Human
auuaggcauucugaaugagguc

SEQ ID NO: 863015 - RNA, 22 nt, Human
ggaaaugacuuggugcuucguu

SEQ ID NO: 863016 - RNA, 19 nt, Human
uauuucaaagugccgucua

SEQ ID NO: 863017 - RNA, 22 nt, Human
agauuuacuggagucuuuggug

SEQ ID NO: 863018 - RNA, 22 nt, Human
aucuccaggcauuucaagagac

SEQ ID NO: 863019 - RNA, 22 nt, Human
cagaaauguacugacaugcagu

SEQ ID NO: 863020 - RNA, 22 nt, Human
uauuuguugaguuguuaugucu

SEQ ID NO: 863021 - RNA, 22 nt, Human
ggauuugaauuguugaaaugau

SEQ ID NO: 863022 - RNA, 22 nt, Human
cccaggagagggaaccaaaugu

SEQ ID NO: 863023 - RNA, 22 nt, Human
uuacacaacaucuguauuauua

SEQ ID NO: 863024 - RNA, 22 nt, Human
uugaauaguguuuucaguauac

SEQ ID NO: 863025 - RNA, 22 nt, Human
uucauagaucucaauuuugagg

SEQ ID NO: 863026 - RNA, 22 nt, Human
ucagggugaaccaggcaggaau

SEQ ID NO: 863027 - RNA, 22 nt, Human
gcaggagagccagcaggcuucc

SEQ ID NO: 863028 - RNA, 22 nt, Human
agaggccaggcugcagagggau

SEQ ID NO: 863029 - RNA, 22 nt, Human
uugaauaauaugcuucguucuc

SEQ ID NO: 863030 - RNA, 22 nt, Human
cccaggaaccuaccagcucgag

SEQ ID NO: 863031 - RNA, 22 nt, Human
uuauuucauguaaaauuuaugu

SEQ ID NO: 863032 - RNA, 22 nt, Human
ucaggagauguaaccuuagcug

SEQ ID NO: 863033 - RNA, 22 nt, Human
aagcaccugcaguugacaaaaa

SEQ ID NO: 863034 - RNA, 22 nt, Human
caacauuucaaggucuuuagga

SEQ ID NO: 863035 - RNA, 22 nt, Human
ucaguaaaugagcaaaaauuuc

SEQ ID NO: 863036 - RNA, 22 nt, Human
caggaaaggugugucaugaugg

SEQ ID NO: 863037 - RNA, 22 nt, Human
uucauugucucuguuugccuuc

SEQ ID NO: 863038 - RNA, 18 nt, Human
uggcagcuagguaaagaa

SEQ ID NO: 863039 - RNA, 22 nt, Human
uaaguccuggcugguuugaagc

SEQ ID NO: 863040 - RNA, 19 nt, Human
auacagauguauccaugau

SEQ ID NO: 863041 - RNA, 22 nt, Human
gaggccagaguuccccgaguca

SEQ ID NO: 863042 - RNA, 22 nt, Human
gucauucuuaacaacucaguag

SEQ ID NO: 863043 - RNA, 22 nt, Human
ugaggcaguauuuuagugacuu

SEQ ID NO: 863044 - RNA, 21 nt, Human
ugaaaugagaaugcugagcac

SEQ ID NO: 863045 - RNA, 22 nt, Human
gaggcugauucggggaacagca

SEQ ID NO: 863046 - RNA, 22 nt, Human
gauuucaaggauguuagaggug

SEQ ID NO: 863047 - RNA, 22 nt, Human
caugcuguguguuuuagcucca

SEQ ID NO: 863048 - RNA, 20 nt, Human
cuucuucagccuaugcuuca

SEQ ID NO: 863049 - RNA, 22 nt, Human
ucuccucuauuucuguauguau

SEQ ID NO: 863050 - RNA, 22 nt, Human
uugcugugaaaccaugggaagu

SEQ ID NO: 863051 - RNA, 22 nt, Human
gcugcugugaauuuuuuaaaug

SEQ ID NO: 863052 - RNA, 22 nt, Human
ucauuuaauagcuuuugucuuu

SEQ ID NO: 863053 - RNA, 22 nt, Human
ggaggagguggguuaaguugua

SEQ ID NO: 863054 - RNA, 22 nt, Human
acccaggagacggaggugcagu

SEQ ID NO: 863055 - RNA, 22 nt, Human
aggcagcugaccacaguaugau

SEQ ID NO: 863056 - RNA, 22 nt, Human
uucuucagucccacuagccaca

SEQ ID NO: 863057 - RNA, 22 nt, Human
ucagugugaguaccaugcucag

SEQ ID NO: 863058 - RNA, 22 nt, Human
agguacaaaagaguauaugaga

SEQ ID NO: 863059 - RNA, 22 nt, Human
ggcagaagauaggacagggaau

SEQ ID NO: 863060 - RNA, 22 nt, Human
gagagggauacugaguuuuggu

SEQ ID NO: 863061 - RNA, 22 nt, Human
cacaaauggccguguucaaaga

SEQ ID NO: 863062 - RNA, 21 nt, Human
aggaggggucuuucccacuga

SEQ ID NO: 863063 - RNA, 22 nt, Human
cugcugugauugggagaaaccg

SEQ ID NO: 863064 - RNA, 22 nt, Human
aaagacuuggcuuaugauuugc

SEQ ID NO: 863065 - RNA, 22 nt, Human
guuaggcaaauaacuguggagc

SEQ ID NO: 863066 - RNA, 22 nt, Human
aucaguuaguuacugcuaagau

SEQ ID NO: 863067 - RNA, 19 nt, Human
aguggcagaucuggaagua

SEQ ID NO: 863068 - RNA, 22 nt, Human
cagaggauucccuagugaccug

SEQ ID NO: 863069 - RNA, 22 nt, Human
caguugcuggaugugcagcucu

SEQ ID NO: 863070 - RNA, 22 nt, Human
uucuccucuguuggccuucccu

SEQ ID NO: 863071 - RNA, 22 nt, Human
aaugcauauguaggcaagcagu

SEQ ID NO: 863072 - RNA, 22 nt, Human
gcagagcuccccaagacaccaa

SEQ ID NO: 863073 - RNA, 22 nt, Human
cugccuccugccgugcagcuuc

SEQ ID NO: 863074 - RNA, 22 nt, Human
cugccaucugagccaaaagugc

SEQ ID NO: 863075 - RNA, 22 nt, Human
agaaggggagaagcuaccagga

SEQ ID NO: 863076 - RNA, 22 nt, Human
aggccagcucuacccuuggacu

SEQ ID NO: 863077 - RNA, 22 nt, Human
auuaaauuuucacuaggcuccc

SEQ ID NO: 863078 - RNA, 22 nt, Human
auguuuuugagauacaaacaga

SEQ ID NO: 863079 - RNA, 22 nt, Human
uucucugaaggccaugcucacu

SEQ ID NO: 863080 - RNA, 22 nt, Human
aaguugagaugucauaggagac

SEQ ID NO: 863081 - RNA, 22 nt, Human
auuguuaugaaaauaagauguu

SEQ ID NO: 863082 - RNA, 22 nt, Human
cuauuucaaggcccagauauga

SEQ ID NO: 863083 - RNA, 22 nt, Human
cccaggaggcagagcuugcagu

SEQ ID NO: 863084 - RNA, 22 nt, Human
gacccaggagagaggguugcau

SEQ ID NO: 863085 - RNA, 22 nt, Human
caugguuuugagccuauuaugc

SEQ ID NO: 863086 - RNA, 22 nt, Human
gauuucaaaaguagauccauca

SEQ ID NO: 863087 - RNA, 22 nt, Human
auucuucauaccuacugagguu

SEQ ID NO: 863088 - RNA, 22 nt, Human
uggcuuuacugucauucuuaug

SEQ ID NO: 863089 - RNA, 22 nt, Human
gucuccugagccuugacugcaa

SEQ ID NO: 863090 - RNA, 22 nt, Human
gauuuccauuuucaacuccugc

SEQ ID NO: 863091 - RNA, 22 nt, Human
cccaggaggguggccucugccc

SEQ ID NO: 863092 - RNA, 22 nt, Human
uugagaagaauguguugaguuu

SEQ ID NO: 863093 - RNA, 19 nt, Human
uccuucagucagaucuggg

SEQ ID NO: 863094 - RNA, 22 nt, Human
agauggagaaugacaauuaagg

SEQ ID NO: 863095 - RNA, 22 nt, Human
ugcaggaaauuccaggguggcc

SEQ ID NO: 863096 - RNA, 22 nt, Human
uucuuacagaguuuacagagcc

SEQ ID NO: 863097 - RNA, 22 nt, Human
aacugcuguggccuaguacuua

SEQ ID NO: 863098 - RNA, 22 nt, Human
gaaagccagagagaaagggcuc

SEQ ID NO: 863099 - RNA, 22 nt, Human
cccagaaggucgaggcugcagu

SEQ ID NO: 863100 - RNA, 22 nt, Human
cccaggaggucgaagcugcagu

SEQ ID NO: 863101 - RNA, 22 nt, Human
gaauauauuggugaaaauaguu

SEQ ID NO: 863102 - RNA, 22 nt, Human
ucagccagaggcuucuugguuu

SEQ ID NO: 863103 - RNA, 22 nt, Human
uucugggagagaaagggccuug

SEQ ID NO: 863104 - RNA, 22 nt, Human
guuaggcauuugccuuaauuuu

SEQ ID NO: 863105 - RNA, 17 nt, Human
uuucuccuuccaucuca

SEQ ID NO: 863106 - RNA, 22 nt, Human
aaaguucaugguguuauagaaa

SEQ ID NO: 863107 - RNA, 22 nt, Human
agaggccggccgagcccauggg

SEQ ID NO: 863108 - RNA, 23 nt, Human
cuccccaguguccucaugcaucu

SEQ ID NO: 863109 - RNA, 22 nt, Human
ucucauugguauauacaugugu

SEQ ID NO: 863110 - RNA, 22 nt, Human
ucagccaguuuguuuauuccgg

SEQ ID NO: 863111 - RNA, 22 nt, Human
ucauuuaauaauuuuugaguag

SEQ ID NO: 863112 - RNA, 22 nt, Human
uucuaacaaguggcuuguuagu

SEQ ID NO: 863113 - RNA, 22 nt, Human
uaaggccagcaugaaugcagca

SEQ ID NO: 863114 - RNA, 22 nt, Human
uugcaaaggggaauaaagcaau

SEQ ID NO: 863115 - RNA, 22 nt, Human
gauggcaggcaggugaguagag

SEQ ID NO: 863116 - RNA, 22 nt, Human
gucaacuuuaagaugaucuuuu

SEQ ID NO: 863117 - RNA, 19 nt, Human
uaucuguuuccugcuuguc

SEQ ID NO: 863118 - RNA, 22 nt, Human
uggcauuuucuccuuugaguuu

SEQ ID NO: 863119 - RNA, 22 nt, Human
ucacuguugaccuggaaguggg

SEQ ID NO: 863120 - RNA, 22 nt, Human
ccuugcauauauuauaucuuug

SEQ ID NO: 863121 - RNA, 22 nt, Human
cacaauacuauuuuuaggucuu

SEQ ID NO: 863122 - RNA, 22 nt, Human
auggagacgcaagggaccuagg

SEQ ID NO: 863123 - RNA, 22 nt, Human
aacauacauauuucagugucca

SEQ ID NO: 863124 - RNA, 22 nt, Human
uagcagaagaacaacaugaucu

SEQ ID NO: 863125 - RNA, 22 nt, Human
auacagaaaaugaugcagaguu

SEQ ID NO: 863126 - RNA, 22 nt, Human
caggcagcagccacucugguau

SEQ ID NO: 863127 - RNA, 21 nt, Human
gacaaagugaagcaggcagga

SEQ ID NO: 863128 - RNA, 22 nt, Human
uuuggacuuagccugcagaauu

SEQ ID NO: 863129 - RNA, 22 nt, Human
ggaggacaggggcugcagcaca

SEQ ID NO: 863130 - RNA, 22 nt, Human
ccuggagaccagaggauacuuc

SEQ ID NO: 863131 - RNA, 22 nt, Human
ugguaauuuacgcauuucugua

SEQ ID NO: 863132 - RNA, 22 nt, Human
ucauuucuccgaccugcugucc

SEQ ID NO: 863133 - RNA, 22 nt, Human
cucuucuuauggccguggcuga

SEQ ID NO: 863134 - RNA, 22 nt, Human
gcucaggaaauaguuuaguguu

SEQ ID NO: 863135 - RNA, 22 nt, Human
agcccagggaaccaggaagugg

SEQ ID NO: 863136 - RNA, 22 nt, Human
uucuucaaauagcagggaguca

SEQ ID NO: 863137 - RNA, 22 nt, Human
uacucagagucauugcccuucu

SEQ ID NO: 863138 - RNA, 22 nt, Human
guagaaauguaaccaggagaua

SEQ ID NO: 863139 - RNA, 22 nt, Human
ccaauacacuuuauagaagaaa

SEQ ID NO: 863140 - RNA, 22 nt, Human
uggaaggaagccaaggaagguu

SEQ ID NO: 863141 - RNA, 22 nt, Human
uuggcagugucugcaaaaugga

SEQ ID NO: 863142 - RNA, 22 nt, Human
uauugaugcuuggauugggcca

SEQ ID NO: 863143 - RNA, 17 nt, Human
acagagcacaucaagau

SEQ ID NO: 863144 - RNA, 22 nt, Human
auuucauacuaaggcucaaaaa

SEQ ID NO: 863145 - RNA, 22 nt, Human
acaauguguuuuuauacauuug

SEQ ID NO: 863146 - RNA, 22 nt, Human
agaggggacagccaccugcccg

SEQ ID NO: 863147 - RNA, 22 nt, Human
uaugauuuguagacauuugauu

SEQ ID NO: 863148 - RNA, 22 nt, Human
aacaaaugaccugauuucuucc

SEQ ID NO: 863149 - RNA, 22 nt, Human
cauggcugcgagaagagugggu

SEQ ID NO: 863150 - RNA, 22 nt, Human
caguccuuggcaaguucucagu

SEQ ID NO: 863151 - RNA, 22 nt, Human
caaguccaucagauaagcaaga

SEQ ID NO: 863152 - RNA, 21 nt, Human
aggauuuacuauuaacugugu

SEQ ID NO: 863153 - RNA, 22 nt, Human
guguguuucagaagccaggugu

SEQ ID NO: 863154 - RNA, 22 nt, Human
augcuguguuuuaaauggaaau

SEQ ID NO: 863155 - RNA, 22 nt, Human
agaauaauacugaaaugcugaa

SEQ ID NO: 863156 - RNA, 22 nt, Human
caggauggagggagggcuguua

SEQ ID NO: 863157 - RNA, 22 nt, Human
gguacaauucugggguaugcuc

SEQ ID NO: 863158 - RNA, 22 nt, Human
uccauuuucuugcucuagguaa

SEQ ID NO: 863159 - RNA, 22 nt, Human
aguguguccagaaaucuguauu

SEQ ID NO: 863160 - RNA, 22 nt, Human
cagcuggcaaguggagcagggu

SEQ ID NO: 863161 - RNA, 22 nt, Human
ugaggggaaggcaugauaaaua

SEQ ID NO: 863162 - RNA, 22 nt, Human
cccuggagguggagguugcagg

SEQ ID NO: 863163 - RNA, 22 nt, Human
uugcaauagccuuauuuccaaa

SEQ ID NO: 863164 - RNA, 22 nt, Human
uucucagagcacugcugacaaa

SEQ ID NO: 863165 - RNA, 22 nt, Human
ucagucucuggggcuucuguuu

SEQ ID NO: 863166 - RNA, 22 nt, Human
ugaguucuaguggcugcagauu

SEQ ID NO: 863167 - RNA, 22 nt, Human
uugcugaauugaauccuuuggu

SEQ ID NO: 863168 - RNA, 22 nt, Human
cuugauguauaaguugauaugu

SEQ ID NO: 863169 - RNA, 22 nt, Human
ggcagcuguaagaugagugaau

SEQ ID NO: 863170 - RNA, 22 nt, Human
cgcagggauuucaaggggccuu

SEQ ID NO: 863171 - RNA, 22 nt, Human
gucuucuuuaaccuacuaaagc

SEQ ID NO: 863172 - RNA, 22 nt, Human
ggagcuguuggcagcuaucuug

SEQ ID NO: 863173 - RNA, 22 nt, Human
cagugucuccagaugcuccaau

SEQ ID NO: 863174 - RNA, 22 nt, Human
ucagagagugcaaaauauagcu

SEQ ID NO: 863175 - RNA, 22 nt, Human
auacacauguguaugugcaugc

SEQ ID NO: 863176 - RNA, 22 nt, Human
ggacagaggguugacagaguau

SEQ ID NO: 863177 - RNA, 22 nt, Human
cauuuacacuucuaaccacaag

SEQ ID NO: 863178 - RNA, 22 nt, Human
gucuaacaagcauuaggaaccc

SEQ ID NO: 863179 - RNA, 22 nt, Human
ggcagcucugcuccacaugagu

SEQ ID NO: 863180 - RNA, 20 nt, Human
cuguaucagguuacaaagua

SEQ ID NO: 863181 - RNA, 22 nt, Human
cauagaaaagaguagguaaugu

SEQ ID NO: 863182 - RNA, 22 nt, Human
ugaggcaggaaguuauauaaug

SEQ ID NO: 863183 - RNA, 22 nt, Human
uuucacuagaacguucuuguuu

SEQ ID NO: 863184 - RNA, 22 nt, Human
uucccaauauucugcuuuuaug

SEQ ID NO: 863185 - RNA, 22 nt, Human
uccuggauaucaaacaaacauu

SEQ ID NO: 863186 - RNA, 22 nt, Human
acaggagaauuaucuggaacaa

SEQ ID NO: 863187 - RNA, 22 nt, Human
augugcuuuauuaaguaaaaau

SEQ ID NO: 863188 - RNA, 22 nt, Human
uuccucagaaaauacuguccaa

SEQ ID NO: 863189 - RNA, 22 nt, Human
uggauuuaccacagggccacag

SEQ ID NO: 863190 - RNA, 20 nt, Human
ggaggguggaagaaagcaag

SEQ ID NO: 863191 - RNA, 22 nt, Human
ucuuugcagaauuuaacuuugc

SEQ ID NO: 863192 - RNA, 22 nt, Human
aaggcagcagugcacgacugau

SEQ ID NO: 863193 - RNA, 22 nt, Human
ucagccaguuugauucuauuug

SEQ ID NO: 863194 - RNA, 22 nt, Human
uuucuucauagaccuugucuug

SEQ ID NO: 863195 - RNA, 22 nt, Human
aaggaaccuggaguagagggag

SEQ ID NO: 863196 - RNA, 22 nt, Human
cuugcacacauguacaugugua

SEQ ID NO: 863197 - RNA, 22 nt, Human
gaguccuuccagcaggcauuua

SEQ ID NO: 863198 - RNA, 22 nt, Human
uuuaauauucugcauucuccuu

SEQ ID NO: 863199 - RNA, 22 nt, Human
auaauaaaccaggaugggucug

SEQ ID NO: 863200 - RNA, 21 nt, Human
aacugguucaauucaacuaga

SEQ ID NO: 863201 - RNA, 22 nt, Human
agaggccaugcuagaggccugg

SEQ ID NO: 863202 - RNA, 22 nt, Human
cauucuuacacaauauuuuaau

SEQ ID NO: 863203 - RNA, 22 nt, Human
uaaagcacauaucuuacaauaa

SEQ ID NO: 863204 - RNA, 22 nt, Human
augaaacaugcuuuguggauga

SEQ ID NO: 863205 - RNA, 22 nt, Human
caggaaagggaugggcugccac

SEQ ID NO: 863206 - RNA, 22 nt, Human
gcagagcuucuguccuucagga

SEQ ID NO: 863207 - RNA, 22 nt, Human
cagucaccauagaauaaaacau

SEQ ID NO: 863208 - RNA, 22 nt, Human
uaaacauggauucugaucacag

SEQ ID NO: 863209 - RNA, 22 nt, Human
agucucugggcaugguugugac

SEQ ID NO: 863210 - RNA, 22 nt, Human
ucagccucucugaguccagacc

SEQ ID NO: 863211 - RNA, 19 nt, Human
cccaggagucuggcugguu

SEQ ID NO: 863212 - RNA, 22 nt, Human
uucaggauucuuucagacuggg

SEQ ID NO: 863213 - RNA, 22 nt, Human
aaguccuuucucauggaggaau

SEQ ID NO: 863214 - RNA, 22 nt, Human
ccucaggggucacugugaggag

SEQ ID NO: 863215 - RNA, 22 nt, Human
gaauuucaagcagugcaauguu

SEQ ID NO: 863216 - RNA, 22 nt, Human
agcugcccugguaagauugaug

SEQ ID NO: 863217 - RNA, 22 nt, Human
aucaggaucacagaaacuuuua

SEQ ID NO: 863218 - RNA, 22 nt, Human
ugaaaagacugcaagagagcau

SEQ ID NO: 863219 - RNA, 22 nt, Human
cagcugacccgugggaggcggg

SEQ ID NO: 863220 - RNA, 22 nt, Human
cucaacagcucugccauacucc

SEQ ID NO: 863221 - RNA, 19 nt, Human
aaucagaaauaucgaggcc

SEQ ID NO: 863222 - RNA, 22 nt, Human
uuuugugagcccauaaaugcca

SEQ ID NO: 863223 - RNA, 22 nt, Human
auaucaguaucuauguauuugu

SEQ ID NO: 863224 - RNA, 22 nt, Human
uuccuuagaguuuccagaaagc

SEQ ID NO: 863225 - RNA, 22 nt, Human
gggaagcaggugcagcucgccu

SEQ ID NO: 863226 - RNA, 22 nt, Human
caauuucauuaauagauauaga

SEQ ID NO: 863227 - RNA, 22 nt, Human
gaucagaaugggacauauccug

SEQ ID NO: 863228 - RNA, 22 nt, Human
ucauuuguucucauucucuacu

SEQ ID NO: 863229 - RNA, 22 nt, Human
uucaggauaugugauaucugaa

SEQ ID NO: 863230 - RNA, 21 nt, Human
uccaggaguggcugggcaggg

SEQ ID NO: 863231 - RNA, 22 nt, Human
agggagugguuaagaaggugca

SEQ ID NO: 863232 - RNA, 22 nt, Human
gagucaccacacggugcugacu

SEQ ID NO: 863233 - RNA, 22 nt, Human
uuggaugaagucuagcuuuagu

SEQ ID NO: 863234 - RNA, 22 nt, Human
acagaauuaucaggaaauguua

SEQ ID NO: 863235 - RNA, 22 nt, Human
uguccauggauagagcugcucg

SEQ ID NO: 863236 - RNA, 22 nt, Human
gccaugcuugguaugcugugag

SEQ ID NO: 863237 - RNA, 22 nt, Human
uucagaaacagagugagugagu

SEQ ID NO: 863238 - RNA, 22 nt, Human
cgaggcagaggcugaaacggcu

SEQ ID NO: 863239 - RNA, 22 nt, Human
uucauucuuauuugugaucugg

SEQ ID NO: 863240 - RNA, 22 nt, Human
ugaggcaguugagcuuccugag

SEQ ID NO: 863241 - RNA, 22 nt, Human
uuucaacguguaaucuuauuua

SEQ ID NO: 863242 - RNA, 22 nt, Human
aguaaacauuuucauauuuucu

SEQ ID NO: 863243 - RNA, 22 nt, Human
uuuggaauuggcauucuauucu

SEQ ID NO: 863244 - RNA, 22 nt, Human
cagcuggcuggucagugcacaa

SEQ ID NO: 863245 - RNA, 22 nt, Human
aauauaugagggagcuauuuga

SEQ ID NO: 863246 - RNA, 22 nt, Human
aucagcuuuucucaucagaaau

SEQ ID NO: 863247 - RNA, 22 nt, Human
cccaggagauggagguugcagu

SEQ ID NO: 863248 - RNA, 22 nt, Human
uuuaggcagcacgggcagcccu

SEQ ID NO: 863249 - RNA, 22 nt, Human
gaggagagaacauuccuccaua

SEQ ID NO: 863250 - RNA, 22 nt, Human
aaguccuugaagaaacaguucu

SEQ ID NO: 863251 - RNA, 22 nt, Human
caaagucauggggaugcagguc

SEQ ID NO: 863252 - RNA, 22 nt, Human
uugaacuguaagcaugucugcc

SEQ ID NO: 863253 - RNA, 22 nt, Human
aucauucuauuguugagcugcc

SEQ ID NO: 863254 - RNA, 22 nt, Human
guuaggcagugugguauagcag

SEQ ID NO: 863255 - RNA, 22 nt, Human
cuacagaaucuaccucaagcca

SEQ ID NO: 863256 - RNA, 22 nt, Human
cuagaaauucugauucaguagg

SEQ ID NO: 863257 - RNA, 22 nt, Human
cucuucucugcagccuuugaag

SEQ ID NO: 863258 - RNA, 22 nt, Human
agucugucuacuuaaagucugu

SEQ ID NO: 863259 - RNA, 22 nt, Human
gagagcuggguucaaguagcug

SEQ ID NO: 863260 - RNA, 22 nt, Human
ccacuguuuuucaguuaacuuu

SEQ ID NO: 863261 - RNA, 22 nt, Human
gacagcugugcaggagaagggg

SEQ ID NO: 863262 - RNA, 22 nt, Human
aacauucuauuuugcuaaaaca

SEQ ID NO: 863263 - RNA, 22 nt, Human
gugaauaagaccuaaggaugaa

SEQ ID NO: 863264 - RNA, 22 nt, Human
uaaucauggccucaaauuuuau

SEQ ID NO: 863265 - RNA, 20 nt, Human
auaaaauaacugccacaaga

SEQ ID NO: 863266 - RNA, 22 nt, Human
agucucagaaaagaagcaugga

SEQ ID NO: 863267 - RNA, 22 nt, Human
cagcugacgccagaguggaauu

SEQ ID NO: 863268 - RNA, 22 nt, Human
agggaguuagaaauccaggaua

SEQ ID NO: 863269 - RNA, 22 nt, Human
augaggcaaucaugguccaguu

SEQ ID NO: 863270 - RNA, 22 nt, Human
ucaggagagaguuggguaggcu

SEQ ID NO: 863271 - RNA, 22 nt, Human
uuggcagugaugcagcuuguuc

SEQ ID NO: 863272 - RNA, 22 nt, Human
ugaaagcagcaccaauaccauu

SEQ ID NO: 863273 - RNA, 22 nt, Human
uuccaugacaccgagggaaguc

SEQ ID NO: 863274 - RNA, 22 nt, Human
cagcugacccagugaggaggca

SEQ ID NO: 863275 - RNA, 22 nt, Human
gcuucccagcagaggaaagacu

SEQ ID NO: 863276 - RNA, 22 nt, Human
ucuccucucuuaccugguacaa

SEQ ID NO: 863277 - RNA, 23 nt, Human
agaggggagcaucugcuggcuga

SEQ ID NO: 863278 - RNA, 22 nt, Human
gaggcagcgggucaggaccgug

SEQ ID NO: 863279 - RNA, 22 nt, Human
gguuugaacagcuuuggagaag

SEQ ID NO: 863280 - RNA, 22 nt, Human
gaggcacuggaggaaaggagaa

SEQ ID NO: 863281 - RNA, 22 nt, Human
cccaggagaugcacuccauugg

SEQ ID NO: 863282 - RNA, 22 nt, Human
uuugaaugcaggacauacagaa

SEQ ID NO: 863283 - RNA, 22 nt, Human
cuguuaauugugaauuuuacau

SEQ ID NO: 863284 - RNA, 22 nt, Human
gagggagggccaggucccaacc

SEQ ID NO: 863285 - RNA, 22 nt, Human
caguaaauuugagggaucuaau

SEQ ID NO: 863286 - RNA, 22 nt, Human
cauuuaguuauacuaaaacauu

SEQ ID NO: 863287 - RNA, 23 nt, Human
uuugaaguugacugccuuccaga

SEQ ID NO: 863288 - RNA, 22 nt, Human
caaauagugucacauugugagg

SEQ ID NO: 863289 - RNA, 16 nt, Human
ccuggauccccugugg

SEQ ID NO: 863290 - RNA, 22 nt, Human
gaggagagggcugcgggcccac

SEQ ID NO: 863291 - RNA, 22 nt, Human
uucaauucugcucugaucuuag

SEQ ID NO: 863292 - RNA, 22 nt, Human
uccauuuuguagguaugcuaca

SEQ ID NO: 863293 - RNA, 21 nt, Human
auacacauacacauaaaugug

SEQ ID NO: 863294 - RNA, 22 nt, Human
aaauauaauuucugccucaaua

SEQ ID NO: 863295 - RNA, 22 nt, Human
agagauucauguuuacuguagg

SEQ ID NO: 863296 - RNA, 22 nt, Human
uuauuacacugaaagaauugcg

SEQ ID NO: 863297 - RNA, 22 nt, Human
cuaaucaucuuucucuuaaagc

SEQ ID NO: 863298 - RNA, 22 nt, Human
uacuuccuguuuccaugucugu

SEQ ID NO: 863299 - RNA, 22 nt, Human
aggcaggcugcuauggaguaga

SEQ ID NO: 863300 - RNA, 22 nt, Human
ucaggagaacuuccuucuaccc

SEQ ID NO: 863301 - RNA, 22 nt, Human
accagcugcugauugcuaaaug

SEQ ID NO: 863302 - RNA, 22 nt, Human
gauggcuucacuuacauggcug

SEQ ID NO: 863303 - RNA, 22 nt, Human
uuacagaaaauguguuuuaacu

SEQ ID NO: 863304 - RNA, 18 nt, Human
gaaagccaugcagcagug

SEQ ID NO: 863305 - RNA, 22 nt, Human
aucacugucgucaucugagauu

SEQ ID NO: 863306 - RNA, 22 nt, Human
uggagagguugaauaacuuguc

SEQ ID NO: 863307 - RNA, 22 nt, Human
uucacagauguauuggaacucc

SEQ ID NO: 863308 - RNA, 22 nt, Human
cccaggagauggugcguggucu

SEQ ID NO: 863309 - RNA, 20 nt, Human
uuugucuguuaaguguuucu

SEQ ID NO: 863310 - RNA, 22 nt, Human
gcagcugaaagggaucucuaca

SEQ ID NO: 863311 - RNA, 22 nt, Human
ugaggcaggacauggacaacug

SEQ ID NO: 863312 - RNA, 22 nt, Human
acaggauuagcaaguaaucagg

SEQ ID NO: 863313 - RNA, 22 nt, Human
uugcagcugcaguaaauguuca

SEQ ID NO: 863314 - RNA, 22 nt, Human
uuacaagauaaccugaugcugu

SEQ ID NO: 863315 - RNA, 21 nt, Human
ucuuccuccacagcgugccac

SEQ ID NO: 863316 - RNA, 22 nt, Human
aguaaagcagaguugcaguaca

SEQ ID NO: 863317 - RNA, 22 nt, Human
ucugcugucacucauuugcuuc

SEQ ID NO: 863318 - RNA, 22 nt, Human
auguuucaaugcacuuuagccu

SEQ ID NO: 863319 - RNA, 21 nt, Human
agccagcuaucacacagcauu

SEQ ID NO: 863320 - RNA, 22 nt, Human
gaguccuuuucucuguccacug

SEQ ID NO: 863321 - RNA, 22 nt, Human
guugaaagagcauggacuugaa

SEQ ID NO: 863322 - RNA, 22 nt, Human
ggagaaugauauauagcucagu

SEQ ID NO: 863323 - RNA, 22 nt, Human
caggaggaagaacucugcaaca

SEQ ID NO: 863324 - RNA, 17 nt, Human
aggccagaugaggcaag

SEQ ID NO: 863325 - RNA, 22 nt, Human
uugcauuuaaguagauguuaca

SEQ ID NO: 863326 - RNA, 22 nt, Human
aagacauugucauuuuauaauu

SEQ ID NO: 863327 - RNA, 22 nt, Human
gagcgauguggguauguagaag

SEQ ID NO: 863328 - RNA, 22 nt, Human
cugcuguguuccuccugcaucu

SEQ ID NO: 863329 - RNA, 22 nt, Human
uucucagaauugacugggagca

SEQ ID NO: 863330 - RNA, 17 nt, Human
gccaggagguuugagcu

SEQ ID NO: 863331 - RNA, 22 nt, Human
aggguggcuggaggaaucagaa

SEQ ID NO: 863332 - RNA, 22 nt, Human
aacaguaaagacagaauuuauc

SEQ ID NO: 863333 - RNA, 22 nt, Human
gaaggggacuggcagcugcaga

SEQ ID NO: 863334 - RNA, 22 nt, Human
uuaaaauuauggcccauuugga

SEQ ID NO: 863335 - RNA, 22 nt, Human
uuaugauuugccacagauuggu

SEQ ID NO: 863336 - RNA, 22 nt, Human
agaggggaggcgaaccagaguc

SEQ ID NO: 863337 - RNA, 22 nt, Human
uuugacauggaauaacucauuu

SEQ ID NO: 863338 - RNA, 22 nt, Human
auugauggcggccucuccauau

SEQ ID NO: 863339 - RNA, 21 nt, Human
uucuucuuggacuguuuuggc

SEQ ID NO: 863340 - RNA, 22 nt, Human
ggagcaggagucucuugaauuu

SEQ ID NO: 863341 - RNA, 22 nt, Human
ugguuuaauuuccauuuccuug

SEQ ID NO: 863342 - RNA, 22 nt, Human
cccaggauggggcugcaguuau

SEQ ID NO: 863343 - RNA, 22 nt, Human
cauuuacauaacaguaacgcug

SEQ ID NO: 863344 - RNA, 22 nt, Human
cuugcugucuugcauuuagagc

SEQ ID NO: 863345 - RNA, 22 nt, Human
cagcuuccauaagagauggaga

SEQ ID NO: 863346 - RNA, 20 nt, Human
uucaggauucuagaccacac

SEQ ID NO: 863347 - RNA, 22 nt, Human
gaaaggcaguacagcugagccu

SEQ ID NO: 863348 - RNA, 22 nt, Human
aauacaguaauuuugaugaguu

SEQ ID NO: 863349 - RNA, 22 nt, Human
ccucaugguacuuacuguagcu

SEQ ID NO: 863350 - RNA, 20 nt, Human
uacagacaugacaauaaugg

SEQ ID NO: 863351 - RNA, 22 nt, Human
cacauauuguaguucaccagga

SEQ ID NO: 863352 - RNA, 22 nt, Human
augcuuaacuuccuagucuaua

SEQ ID NO: 863353 - RNA, 22 nt, Human
uuuccagagcaugucugcucag

SEQ ID NO: 863354 - RNA, 22 nt, Human
guacagaaggauuucuaguagu

SEQ ID NO: 863355 - RNA, 22 nt, Human
aaggagaaaugguagaugugca

SEQ ID NO: 863356 - RNA, 19 nt, Human
uucaggauugacccuacug

SEQ ID NO: 863357 - RNA, 22 nt, Human
ugcugaugaguccuucuaucgc

SEQ ID NO: 863358 - RNA, 22 nt, Human
caaucaguuucuguuguauaau

SEQ ID NO: 863359 - RNA, 22 nt, Human
aggagagcuggugucuggaauc

SEQ ID NO: 863360 - RNA, 23 nt, Human
aaggccagaauuucaauggugcc

SEQ ID NO: 863361 - RNA, 22 nt, Human
cuguucucuggcgguggcuguu

SEQ ID NO: 863362 - RNA, 22 nt, Human
cccaggaugucgaggcugcagu

SEQ ID NO: 863363 - RNA, 18 nt, Human
aggcaggugcuggaaguc

SEQ ID NO: 863364 - RNA, 22 nt, Human
gggcagcucagccaccaugcag

SEQ ID NO: 863365 - RNA, 22 nt, Human
aaguccauucuuccagccagcu

SEQ ID NO: 863366 - RNA, 22 nt, Human
acuuugaaacuaaaauucauua

SEQ ID NO: 863367 - RNA, 22 nt, Human
caagaucagggugccagaaugg

SEQ ID NO: 863368 - RNA, 22 nt, Human
augcuguguauuuuacucuuuc

SEQ ID NO: 863369 - RNA, 22 nt, Human
uuuccaaagguggcaggaacaa

SEQ ID NO: 863370 - RNA, 22 nt, Human
ggagcuguucaggacugcuuca

SEQ ID NO: 863371 - RNA, 22 nt, Human
uauuuucuggacagucuugcuu

SEQ ID NO: 863372 - RNA, 23 nt, Human
aagucaccaagaggaaggcggag

SEQ ID NO: 863373 - RNA, 22 nt, Human
guucuaauauuuuaaaagccaa

SEQ ID NO: 863374 - RNA, 22 nt, Human
aggggcucaaagugugcaggga

SEQ ID NO: 863375 - RNA, 17 nt, Human
uccaugagacaugaaga

SEQ ID NO: 863376 - RNA, 17 nt, Human
agaacuguaguagcucc

SEQ ID NO: 863377 - RNA, 22 nt, Human
accuugaugccuuuccaagaug

SEQ ID NO: 863378 - RNA, 22 nt, Human
uuccuuagcugucccuggaaau

SEQ ID NO: 863379 - RNA, 22 nt, Human
gaguccuuuugugccacaggga

SEQ ID NO: 863380 - RNA, 22 nt, Human
caggacagagcccagacugugu

SEQ ID NO: 863381 - RNA, 22 nt, Human
caacugugaauuuuaugauacc

SEQ ID NO: 863382 - RNA, 22 nt, Human
gaaggccaguuuugagauaggu

SEQ ID NO: 863383 - RNA, 22 nt, Human
cuuaggcaguuuaggaaagaga

SEQ ID NO: 863384 - RNA, 22 nt, Human
uugaaaguagcagcugcauaug

SEQ ID NO: 863385 - RNA, 22 nt, Human
uugugguuaaccgcacauuuuu

SEQ ID NO: 863386 - RNA, 22 nt, Human
ucccaggaauugaagccagugu

SEQ ID NO: 863387 - RNA, 22 nt, Human
ugaauaauuccuuuuugucaag

SEQ ID NO: 863388 - RNA, 22 nt, Human
ugaaaugacaaagguuuuucuu

SEQ ID NO: 863389 - RNA, 22 nt, Human
cauuuguuggucagauuguagu

SEQ ID NO: 863390 - RNA, 22 nt, Human
gugguaaucggauucuuaccgg

SEQ ID NO: 863391 - RNA, 22 nt, Human
aaucaugugggauagucugcuc

SEQ ID NO: 863392 - RNA, 20 nt, Human
aggaggcauagucuggaaag

SEQ ID NO: 863393 - RNA, 22 nt, Human
ucaguucuuuauuucacaguga

SEQ ID NO: 863394 - RNA, 22 nt, Human
aggaagcuccaugaaggcagag

SEQ ID NO: 863395 - RNA, 22 nt, Human
gcucaggaccgaggggugggaa

SEQ ID NO: 863396 - RNA, 22 nt, Human
aggcagcuucugauuagcagcg

SEQ ID NO: 863397 - RNA, 22 nt, Human
ugaaauaggaaacagauguuuc

SEQ ID NO: 863398 - RNA, 22 nt, Human
aauacaguagguaauaguucau

SEQ ID NO: 863399 - RNA, 22 nt, Human
gaauuucaggacaacuggaagg

SEQ ID NO: 863400 - RNA, 22 nt, Human
ucacauucucagcaucuauaca

SEQ ID NO: 863401 - RNA, 22 nt, Human
ugccuggauucgguuguuguca

SEQ ID NO: 863402 - RNA, 22 nt, Human
acuauacaagauuagggauuug

SEQ ID NO: 863403 - RNA, 22 nt, Human
acaacuuuagucuggagggaaa

SEQ ID NO: 863404 - RNA, 22 nt, Human
ugucaccaccggaagaaacugc

SEQ ID NO: 863405 - RNA, 22 nt, Human
cauggcuuuguucauauaauuu

SEQ ID NO: 863406 - RNA, 21 nt, Human
uucuucaugaugauuaauggc

SEQ ID NO: 863407 - RNA, 22 nt, Human
uuucaaaccuacuuguauguuu

SEQ ID NO: 863408 - RNA, 21 nt, Human
ggcagcucagcagauggggac

SEQ ID NO: 863409 - RNA, 22 nt, Human
caggauagaaaggccauggagu

SEQ ID NO: 863410 - RNA, 22 nt, Human
caucagaaggccagaggguagc

SEQ ID NO: 863411 - RNA, 22 nt, Human
gcagcugcaauaggcaucaagc

SEQ ID NO: 863412 - RNA, 22 nt, Human
ggcugaaggaugaaagcugcag

SEQ ID NO: 863413 - RNA, 22 nt, Human
ccccaggaagccucagauuugc

SEQ ID NO: 863414 - RNA, 22 nt, Human
aucuaaaaggagcucuuuaucu

SEQ ID NO: 863415 - RNA, 22 nt, Human
uggcagucuggguuggcaguua

SEQ ID NO: 863416 - RNA, 22 nt, Human
acaagcaugggcuuugacauca

SEQ ID NO: 863417 - RNA, 22 nt, Human
ucucacuggguauaaaugagua

SEQ ID NO: 863418 - RNA, 22 nt, Human
ugaggcagccugcauuaaagag

SEQ ID NO: 863419 - RNA, 22 nt, Human
aggccagacagcuagaaacagg

SEQ ID NO: 863420 - RNA, 22 nt, Human
uaaggccauuauggugggcccg

SEQ ID NO: 863421 - RNA, 22 nt, Human
acauuccaaaaacuagcagaua

SEQ ID NO: 863422 - RNA, 22 nt, Human
gagaggauccacaaaccaggaa

SEQ ID NO: 863423 - RNA, 22 nt, Human
ugcuuuaaccaucuuguuugga

SEQ ID NO: 863424 - RNA, 22 nt, Human
cacucaggcugugucaggagga

SEQ ID NO: 863425 - RNA, 22 nt, Human
uggcagagcaaaaagauagaau

SEQ ID NO: 863426 - RNA, 22 nt, Human
aaaauuauucauggcuuuugga

SEQ ID NO: 863427 - RNA, 22 nt, Human
uuuggaauuggaaagugcugug

SEQ ID NO: 863428 - RNA, 22 nt, Human
ccagcagagucuaggaaggagg

SEQ ID NO: 863429 - RNA, 22 nt, Human
aggcaguggagcuggaauaggc

SEQ ID NO: 863430 - RNA, 22 nt, Human
acaaauguggacauggauaaug

SEQ ID NO: 863431 - RNA, 22 nt, Human
cauuuauuggcauguaguaggu

SEQ ID NO: 863432 - RNA, 22 nt, Human
aaagaaucagaagucucaaaca

SEQ ID NO: 863433 - RNA, 22 nt, Human
caucagucuagauucuaguacc

SEQ ID NO: 863434 - RNA, 22 nt, Human
gaugaaaaucuugagaugucga

SEQ ID NO: 863435 - RNA, 22 nt, Human
auacagaagaccccuccgucau

SEQ ID NO: 863436 - RNA, 23 nt, Human
ucuauacauacugcagccucugg

SEQ ID NO: 863437 - RNA, 22 nt, Human
gaggcaugcagagcuggagcag

SEQ ID NO: 863438 - RNA, 21 nt, Human
gcuauacagaauggccagagg

SEQ ID NO: 863439 - RNA, 22 nt, Human
uaaguccuaacagacugggggc

SEQ ID NO: 863440 - RNA, 23 nt, Human
cugcuguuuucuguaccugaagc

SEQ ID NO: 863441 - RNA, 22 nt, Human
cuucucagcauuuugucagucu

SEQ ID NO: 863442 - RNA, 22 nt, Human
auagaauucuuugaaauuuaug

SEQ ID NO: 863443 - RNA, 22 nt, Human
acagguuuuuguggauauaugu

SEQ ID NO: 863444 - RNA, 22 nt, Human
acagaaauaacuuuuuauguuu

SEQ ID NO: 863445 - RNA, 22 nt, Human
uccauucauucauugaugaaca

SEQ ID NO: 863446 - RNA, 22 nt, Human
agucaccaacaugguucccagg

SEQ ID NO: 863447 - RNA, 22 nt, Human
uccaggagacacccuugugugu

SEQ ID NO: 863448 - RNA, 22 nt, Human
ugacccauggucugaucauagg

SEQ ID NO: 863449 - RNA, 22 nt, Human
aguccuuacucgggggcccaga

SEQ ID NO: 863450 - RNA, 17 nt, Human
ccaggagagaugcuugu

SEQ ID NO: 863451 - RNA, 20 nt, Human
ucucagcauaagaacccuuc

SEQ ID NO: 863452 - RNA, 22 nt, Human
uuccucagcuggccugauuggg

SEQ ID NO: 863453 - RNA, 22 nt, Human
aaauauaguaaaugcauaguuc

SEQ ID NO: 863454 - RNA, 22 nt, Human
agaaaugaagcaggaguuauua

SEQ ID NO: 863455 - RNA, 22 nt, Human
cugcugugcauauuuaucuagg

SEQ ID NO: 863456 - RNA, 22 nt, Human
acaacauuauacauagaaagcu

SEQ ID NO: 863457 - RNA, 20 nt, Human
ugcugucguguuuucugcuu

SEQ ID NO: 863458 - RNA, 20 nt, Human
uucuucucuaguuaucuuca

SEQ ID NO: 863459 - RNA, 22 nt, Human
agaggaggaagagcuuuaaaau

SEQ ID NO: 863460 - RNA, 22 nt, Human
uguacauacauagauauacaca

SEQ ID NO: 863461 - RNA, 22 nt, Human
auuccaaagccugaauaaugga

SEQ ID NO: 863462 - RNA, 22 nt, Human
caucagaaagaguccuggacuu

SEQ ID NO: 863463 - RNA, 22 nt, Human
ugcuagugcaggguuuucaguu

SEQ ID NO: 863464 - RNA, 22 nt, Human
uucuucuucuggcugcaccugg

SEQ ID NO: 863465 - RNA, 22 nt, Human
ucagaaaagagaaaaucuuaua

SEQ ID NO: 863466 - RNA, 22 nt, Human
ucuuuuggaaaugaugugcagg

SEQ ID NO: 863467 - RNA, 22 nt, Human
auuucucuuagcaagacauuac

SEQ ID NO: 863468 - RNA, 22 nt, Human
uucuacaugguugcucagaggg

SEQ ID NO: 863469 - RNA, 22 nt, Human
gaggcagcaauaaaaagaauuu

SEQ ID NO: 863470 - RNA, 23 nt, Human
uugaaagguagcuggcagcuaga

SEQ ID NO: 863471 - RNA, 22 nt, Human
uucucuuugacauuauucaggu

SEQ ID NO: 863472 - RNA, 22 nt, Human
ggagugucagaaacaguguccu

SEQ ID NO: 863473 - RNA, 22 nt, Human
accaggaggccuugguucugag

SEQ ID NO: 863474 - RNA, 22 nt, Human
uuuauuaugauggacaccuucg

SEQ ID NO: 863475 - RNA, 22 nt, Human
cugccaggcgauggauuggcug

SEQ ID NO: 863476 - RNA, 22 nt, Human
cgaggcagacaaaaguuggaag

SEQ ID NO: 863477 - RNA, 19 nt, Human
ugcuuaauuccuaguaggu

SEQ ID NO: 863478 - RNA, 22 nt, Human
uggggcucaccuaggcuggaag

SEQ ID NO: 863479 - RNA, 20 nt, Human
ugugcaggagagugaggcug

SEQ ID NO: 863480 - RNA, 22 nt, Human
auccagucaaaauuaguaaggu

SEQ ID NO: 863481 - RNA, 22 nt, Human
caggauggucagaugcauuguc

SEQ ID NO: 863482 - RNA, 22 nt, Human
ucuucaaguuccaaagugcagg

SEQ ID NO: 863483 - RNA, 22 nt, Human
auuaggcauucaugcagcuccu

SEQ ID NO: 863484 - RNA, 23 nt, Human
uagaauucaaucuguuccacauc

SEQ ID NO: 863485 - RNA, 22 nt, Human
aaaguccuuuuugccaugcaag

SEQ ID NO: 863486 - RNA, 22 nt, Human
aaaucaguuagugguaggauug

SEQ ID NO: 863487 - RNA, 22 nt, Human
acagugacguuuauuugagacg

SEQ ID NO: 863488 - RNA, 19 nt, Human
cuauacagccucugaggaa

SEQ ID NO: 863489 - RNA, 22 nt, Human
uaguccuugguaaaauucuaug

SEQ ID NO: 863490 - RNA, 22 nt, Human
cugcugugaguuuggaggucua

SEQ ID NO: 863491 - RNA, 22 nt, Human
gucaggaugggcagccaaacua

SEQ ID NO: 863492 - RNA, 22 nt, Human
cugcuucugggaugauggagua

SEQ ID NO: 863493 - RNA, 22 nt, Human
cucaggauuuaaaggggcacuc

SEQ ID NO: 863494 - RNA, 22 nt, Human
uaauuacagguccaaaacaauc

SEQ ID NO: 863495 - RNA, 22 nt, Human
uccccagggcugcagagggugu

SEQ ID NO: 863496 - RNA, 22 nt, Human
ucaggaggccaccaggaccugu

SEQ ID NO: 863497 - RNA, 22 nt, Human
aauucuaaauguaauuuagaau

SEQ ID NO: 863498 - RNA, 17 nt, Human
ucaggauguagcaguag

SEQ ID NO: 863499 - RNA, 22 nt, Human
aguucacauaucuguuuuauuu

SEQ ID NO: 863500 - RNA, 22 nt, Human
aaagaaggggucuacauccaau

SEQ ID NO: 863501 - RNA, 22 nt, Human
aaacugcuuuccacaguggcua

SEQ ID NO: 863502 - RNA, 22 nt, Human
augaaaauucuaugcaggccag

SEQ ID NO: 863503 - RNA, 22 nt, Human
auuacacuuguucaucaucacc

SEQ ID NO: 863504 - RNA, 22 nt, Human
uuuauccaaggguuuuaacugu

SEQ ID NO: 863505 - RNA, 22 nt, Human
auuucagaugaccaaauggaaa

SEQ ID NO: 863506 - RNA, 22 nt, Human
augauauuugcaaugugcuugc

SEQ ID NO: 863507 - RNA, 17 nt, Human
uugaacugcugagucag

SEQ ID NO: 863508 - RNA, 22 nt, Human
aucaggauggguuuggcuuagg

SEQ ID NO: 863509 - RNA, 22 nt, Human
gugcugugugauccaugcuggc

SEQ ID NO: 863510 - RNA, 22 nt, Human
cagcuggccaaucagggcgccc

SEQ ID NO: 863511 - RNA, 22 nt, Human
aaauuucaagcaaaguagcuau

SEQ ID NO: 863512 - RNA, 22 nt, Human
uuugcaaauaccaugaaacuug

SEQ ID NO: 863513 - RNA, 22 nt, Human
uucacagaguuauuuuuaugcu

SEQ ID NO: 863514 - RNA, 21 nt, Human
agcagaggggacauguuugau

SEQ ID NO: 863515 - RNA, 20 nt, Human
uacuggauuagggcucaccc

SEQ ID NO: 863516 - RNA, 22 nt, Human
uacauaguauucacauuguuuu

SEQ ID NO: 863517 - RNA, 22 nt, Human
uuccaugaaagugaaauggagc

SEQ ID NO: 863518 - RNA, 22 nt, Human
gcucccagcaauugaggcagcc

SEQ ID NO: 863519 - RNA, 22 nt, Human
ggcucagaccucccagcuccag

SEQ ID NO: 863520 - RNA, 22 nt, Human
aucaggaucugggagccugaaa

SEQ ID NO: 863521 - RNA, 22 nt, Human
gaaauauuacaguggaggggau

SEQ ID NO: 863522 - RNA, 22 nt, Human
uugcaucuaccauaucaaagau

SEQ ID NO: 863523 - RNA, 22 nt, Human
cccaggaggugugcccaacucg

SEQ ID NO: 863524 - RNA, 22 nt, Human
uucuucaaaacaacacuggccu

SEQ ID NO: 863525 - RNA, 21 nt, Human
uguccuuaaugcaauguccuu

SEQ ID NO: 863526 - RNA, 22 nt, Human
cagaaggcuggcagauugagau

SEQ ID NO: 863527 - RNA, 22 nt, Human
auaacaugagccagauugaaag

SEQ ID NO: 863528 - RNA, 22 nt, Human
ucagcauaucuugagcuucaug

SEQ ID NO: 863529 - RNA, 22 nt, Human
cugcuguggugucaagcaucuc

SEQ ID NO: 863530 - RNA, 19 nt, Human
uuagccauccacagugaaa

SEQ ID NO: 863531 - RNA, 22 nt, Human
gggcagcugccccucucugggc

SEQ ID NO: 863532 - RNA, 22 nt, Human
gcauguguuauuuuauguauga

SEQ ID NO: 863533 - RNA, 22 nt, Human
agcugccccaugagaggcaggu

SEQ ID NO: 863534 - RNA, 22 nt, Human
auucuucauuuacuguuacuug

SEQ ID NO: 863535 - RNA, 22 nt, Human
uuucuaguaaucaauauaaagu

SEQ ID NO: 863536 - RNA, 22 nt, Human
cagauggaacacagaaaggaga

SEQ ID NO: 863537 - RNA, 22 nt, Human
uuucaaauagaaucuuuccaaa

SEQ ID NO: 863538 - RNA, 20 nt, Human
cagaggcauuuucagacucu

SEQ ID NO: 863539 - RNA, 22 nt, Human
guuugcauuuauuagucuucug

SEQ ID NO: 863540 - RNA, 22 nt, Human
gaggggaaaguucugcacaagg

SEQ ID NO: 863541 - RNA, 22 nt, Human
cucuuucugauucgcugggacc

SEQ ID NO: 863542 - RNA, 22 nt, Human
gugcauuuaggucacaugaugu

SEQ ID NO: 863543 - RNA, 22 nt, Human
uuucuucagagagagcuuuccc

SEQ ID NO: 863544 - RNA, 22 nt, Human
ucaggaugguccuuuaugagaa

SEQ ID NO: 863545 - RNA, 22 nt, Human
agggagcuucuggccucagccu

SEQ ID NO: 863546 - RNA, 22 nt, Human
uccaugucuucaugugucuaac

SEQ ID NO: 863547 - RNA, 22 nt, Human
aagauggaguaguguaaugguu

SEQ ID NO: 863548 - RNA, 22 nt, Human
uugaaaggaauacagaggccua

SEQ ID NO: 863549 - RNA, 22 nt, Human
gaauuucacaaggugaggauaa

SEQ ID NO: 863550 - RNA, 22 nt, Human
gggaggugauuaggaccaugua

SEQ ID NO: 863551 - RNA, 20 nt, Human
gaguuccccauuucuccugg

SEQ ID NO: 863552 - RNA, 22 nt, Human
cuucuucauguauugauagucu

SEQ ID NO: 863553 - RNA, 22 nt, Human
gcucaggaucccaggggugugc

SEQ ID NO: 863554 - RNA, 22 nt, Human
ccucuucuaggacguccuugug

SEQ ID NO: 863555 - RNA, 22 nt, Human
uucuucuugucugcccucacau

SEQ ID NO: 863556 - RNA, 22 nt, Human
uuuccaaaggaguaccacgcau

SEQ ID NO: 863557 - RNA, 22 nt, Human
aaaagccaugcauaccuaagag

SEQ ID NO: 863558 - RNA, 22 nt, Human
ugucaccacuggcugaaacacc

SEQ ID NO: 863559 - RNA, 22 nt, Human
uuugaagauaaauauggagaaa

SEQ ID NO: 863560 - RNA, 22 nt, Human
aggcagaucacuugaggccagg

SEQ ID NO: 863561 - RNA, 22 nt, Human
gggcaguugauggaggucugga

SEQ ID NO: 863562 - RNA, 23 nt, Human
aaauuauugcucuucaauugccu

SEQ ID NO: 863563 - RNA, 22 nt, Human
cugccagucuaugcugcucggc

SEQ ID NO: 863564 - RNA, 22 nt, Human
gaaacuguauguaguuuuuggg

SEQ ID NO: 863565 - RNA, 22 nt, Human
ggcuuugccuggaauuuccuug

SEQ ID NO: 863566 - RNA, 22 nt, Human
uuuauuugaaucaggggagaau

SEQ ID NO: 863567 - RNA, 22 nt, Human
uacaucauaauaauacuuagaa

SEQ ID NO: 863568 - RNA, 21 nt, Human
uccaaaaaggagcguccuucu

SEQ ID NO: 863569 - RNA, 22 nt, Human
gucuucuuguuuugaaggaaau

SEQ ID NO: 863570 - RNA, 22 nt, Human
ucuuuaaugugauuguaauuau

SEQ ID NO: 863571 - RNA, 17 nt, Human
agaggcagauacuugga

SEQ ID NO: 863572 - RNA, 18 nt, Human
caugucugcgccacaagg

SEQ ID NO: 863573 - RNA, 19 nt, Human
aaggcagcaguagcaucca

SEQ ID NO: 863574 - RNA, 22 nt, Human
cucaucugauaaaucacucuua

SEQ ID NO: 863575 - RNA, 22 nt, Human
acuguagcugccacuggaugca

SEQ ID NO: 863576 - RNA, 22 nt, Human
gcuguucucuguaacaugcauu

SEQ ID NO: 863577 - RNA, 19 nt, Human
ugagaggcuuaaggcagcu

SEQ ID NO: 863578 - RNA, 22 nt, Human
auucuucaucagagaugcacua

SEQ ID NO: 863579 - RNA, 22 nt, Human
uucaggauccccuugaugggcu

SEQ ID NO: 863580 - RNA, 22 nt, Human
aggagaggcaucaagaaaaucg

SEQ ID NO: 863581 - RNA, 22 nt, Human
uuuauacauggagaauuuuugc

SEQ ID NO: 863582 - RNA, 22 nt, Human
ugaguucucacccauucuucuu

SEQ ID NO: 863583 - RNA, 22 nt, Human
uuuccaaagcugaguugagcaa

SEQ ID NO: 863584 - RNA, 22 nt, Human
uuugaaaggugucgagaugugu

SEQ ID NO: 863585 - RNA, 22 nt, Human
aaucagaauuuguccccugagu

SEQ ID NO: 863586 - RNA, 21 nt, Human
uuuuauugaugaauggccacu

SEQ ID NO: 863587 - RNA, 22 nt, Human
uuuccucauuuaucugcuggga

SEQ ID NO: 863588 - RNA, 22 nt, Human
cuucagaggggacucaaaguca

SEQ ID NO: 863589 - RNA, 22 nt, Human
auucuucauuguugauucaugu

SEQ ID NO: 863590 - RNA, 15 nt, Human
aaucagaaguguggc

SEQ ID NO: 863591 - RNA, 22 nt, Human
gcagggcaaacccagguguuca

SEQ ID NO: 863592 - RNA, 22 nt, Human
uucaguaaaacacugcaauguc

SEQ ID NO: 863593 - RNA, 22 nt, Human
accaggaggaaguguuaaugau

SEQ ID NO: 863594 - RNA, 22 nt, Human
uuucaaagaguuguaaauuacu

SEQ ID NO: 863595 - RNA, 22 nt, Human
cacucaggguacaauggagggc

SEQ ID NO: 863596 - RNA, 22 nt, Human
uuuaggcauacuuuugggagaa

SEQ ID NO: 863597 - RNA, 19 nt, Human
ggcagcuggacgcuguuca

SEQ ID NO: 863598 - RNA, 22 nt, Human
caggauggucucgaucuccuga

SEQ ID NO: 863599 - RNA, 22 nt, Human
cucaggauagauuguccucuca

SEQ ID NO: 863600 - RNA, 22 nt, Human
ccauggcaauggucagucuauu

SEQ ID NO: 863601 - RNA, 22 nt, Human
ggcgcacaaugugcagguuugu

SEQ ID NO: 863602 - RNA, 22 nt, Human
agacagcuaauaaaugagugug

SEQ ID NO: 863603 - RNA, 22 nt, Human
agugcuguaacaacuuauuugg

SEQ ID NO: 863604 - RNA, 22 nt, Human
uuccaaaguuaguuauuagaaa

SEQ ID NO: 863605 - RNA, 22 nt, Human
uuugacauuggcuuauucuguu

SEQ ID NO: 863606 - RNA, 20 nt, Human
cccaggagcugugccccauc

SEQ ID NO: 863607 - RNA, 22 nt, Human
augcuuaagcucaguuauauau

SEQ ID NO: 863608 - RNA, 22 nt, Human
ucccaggaaaacacucgaggac

SEQ ID NO: 863609 - RNA, 22 nt, Human
ggagggacccacucuagaggug

SEQ ID NO: 863610 - RNA, 22 nt, Human
cccaggagguuggggcuacagu

SEQ ID NO: 863611 - RNA, 22 nt, Human
auauacugaggagacuuuauau

SEQ ID NO: 863612 - RNA, 22 nt, Human
acagucauuagauacaaugucu

SEQ ID NO: 863613 - RNA, 22 nt, Human
ucagaauucugaccuuggguca

SEQ ID NO: 863614 - RNA, 22 nt, Human
uggcagcugaggggaggcuuug

SEQ ID NO: 863615 - RNA, 22 nt, Human
aaaauuauagaucuagugccug

SEQ ID NO: 863616 - RNA, 19 nt, Human
cuucuucuuggcagccaag

SEQ ID NO: 863617 - RNA, 22 nt, Human
gcccaggaguuggaggcugcag

SEQ ID NO: 863618 - RNA, 22 nt, Human
uugaaguuguaguucagugaag

SEQ ID NO: 863619 - RNA, 22 nt, Human
ugaaagggguugaguuacagcu

SEQ ID NO: 863620 - RNA, 22 nt, Human
agcuacccgaggacaggcuaag

SEQ ID NO: 863621 - RNA, 22 nt, Human
cugagccagcuggcaugugcua

SEQ ID NO: 863622 - RNA, 22 nt, Human
uuucaacauauaccauaaugcc

SEQ ID NO: 863623 - RNA, 22 nt, Human
cacaaaugguuguagacauuaa

SEQ ID NO: 863624 - RNA, 22 nt, Human
aagagaggacauggugaaccug

SEQ ID NO: 863625 - RNA, 21 nt, Human
ucaguaaaccuaaagauugua

SEQ ID NO: 863626 - RNA, 22 nt, Human
ucuucucuacaccagcagcccc

SEQ ID NO: 863627 - RNA, 22 nt, Human
ugguaauuaauuugauagguuc

SEQ ID NO: 863628 - RNA, 22 nt, Human
gagggagucugugcaaagaauu

SEQ ID NO: 863629 - RNA, 22 nt, Human
gcccaggaaguugaggcugccg

SEQ ID NO: 863630 - RNA, 22 nt, Human
cccaaggaagacgcuugugaua

SEQ ID NO: 863631 - RNA, 19 nt, Human
acagaaauuaguuauuuuc

SEQ ID NO: 863632 - RNA, 22 nt, Human
augguuuacaauguuuucaguu

SEQ ID NO: 863633 - RNA, 22 nt, Human
cuucucagcaugguuacuguga

SEQ ID NO: 863634 - RNA, 22 nt, Human
gggcacagaagucuaagacauc

SEQ ID NO: 863635 - RNA, 22 nt, Human
guuaggcaugaguguguauuaa

SEQ ID NO: 863636 - RNA, 22 nt, Human
agaauuccuccucugggacacu

SEQ ID NO: 863637 - RNA, 22 nt, Human
acuugcugguggcauuuacagu

SEQ ID NO: 863638 - RNA, 22 nt, Human
uucuauacaaagauuucucaca

SEQ ID NO: 863639 - RNA, 22 nt, Human
caucagaaccagcugggugagg

SEQ ID NO: 863640 - RNA, 22 nt, Human
acauaauagcauuucuaauuug

SEQ ID NO: 863641 - RNA, 22 nt, Human
caaguccuccaugugacuaggu

SEQ ID NO: 863642 - RNA, 22 nt, Human
uuagccauauagaaaaagagcu

SEQ ID NO: 863643 - RNA, 22 nt, Human
uuacagaaagguugugggauag

SEQ ID NO: 863644 - RNA, 22 nt, Human
ucccaggacuuccaguuggagg

SEQ ID NO: 863645 - RNA, 22 nt, Human
ugaaggccagcagagugaaggc

SEQ ID NO: 863646 - RNA, 22 nt, Human
gaagaaucaagcaguaauuugu

SEQ ID NO: 863647 - RNA, 20 nt, Human
uuucuugucggcuguugcug

SEQ ID NO: 863648 - RNA, 22 nt, Human
ccacaucucgguccccucuuug

SEQ ID NO: 863649 - RNA, 23 nt, Human
acuuuauugaccccaggucaguu

SEQ ID NO: 863650 - RNA, 22 nt, Human
ggcaugcucuuuguccacagua

SEQ ID NO: 863651 - RNA, 22 nt, Human
gauuucaaccuaacaguaugac

SEQ ID NO: 863652 - RNA, 22 nt, Human
gucaggauuuacaaacuucagu

SEQ ID NO: 863653 - RNA, 22 nt, Human
uucucagguagugcugaugcug

SEQ ID NO: 863654 - RNA, 22 nt, Human
uuacagaaaagggguuguccuu

SEQ ID NO: 863655 - RNA, 22 nt, Human
aauaaugucuuuggcuugacca

SEQ ID NO: 863656 - RNA, 22 nt, Human
uucuucaacaaggacacuguua

SEQ ID NO: 863657 - RNA, 22 nt, Human
agugcuuucuugcuccaucagu

SEQ ID NO: 863658 - RNA, 22 nt, Human
cuucucagucaccugugagucu

SEQ ID NO: 863659 - RNA, 22 nt, Human
ugaggcaggagaauggcgggaa

SEQ ID NO: 863660 - RNA, 19 nt, Human
aauacaguguuauagaauu

SEQ ID NO: 863661 - RNA, 17 nt, Human
acucaggaucugggagu

SEQ ID NO: 863662 - RNA, 22 nt, Human
ugaaguaacuguccaggaucca

SEQ ID NO: 863663 - RNA, 22 nt, Human
aagcagggcuuuaagcgguuuu

SEQ ID NO: 863664 - RNA, 22 nt, Human
acagaauucuaguauguggcuu

SEQ ID NO: 863665 - RNA, 22 nt, Human
augugcuuguaauguuaaaugu

SEQ ID NO: 863666 - RNA, 22 nt, Human
gaagcagcugccagagaugucu

SEQ ID NO: 863667 - RNA, 22 nt, Human
agggaagcccuggcugagaccc

SEQ ID NO: 863668 - RNA, 22 nt, Human
aucagaaauagucauguuacuu

SEQ ID NO: 863669 - RNA, 22 nt, Human
gggcagcucugcccaucagagg

SEQ ID NO: 863670 - RNA, 22 nt, Human
agucuugcauuuucugaagaug

SEQ ID NO: 863671 - RNA, 22 nt, Human
gauggcagguaguggucucauc

SEQ ID NO: 863672 - RNA, 22 nt, Human
aaucagaauuuauugaaucuuu

SEQ ID NO: 863673 - RNA, 22 nt, Human
uuucaucuuccuuggcauaggu

SEQ ID NO: 863674 - RNA, 22 nt, Human
agcauauaaauggacauauuug

SEQ ID NO: 863675 - RNA, 22 nt, Human
gagcagcugagcuggaaugaga

SEQ ID NO: 863676 - RNA, 22 nt, Human
aucauucuaguccuuauggucu

SEQ ID NO: 863677 - RNA, 22 nt, Human
uuccuuaggcuguuugcagugc

SEQ ID NO: 863678 - RNA, 22 nt, Human
gcaugucaugucauguaggaau

SEQ ID NO: 863679 - RNA, 22 nt, Human
acaccauacucauguugguucc

SEQ ID NO: 863680 - RNA, 22 nt, Human
auugaaagagaauguagcucuu

SEQ ID NO: 863681 - RNA, 22 nt, Human
ugaauagauuuuuaacauauaa

SEQ ID NO: 863682 - RNA, 22 nt, Human
uucuuaacuggaaaaugucaga

SEQ ID NO: 863683 - RNA, 22 nt, Human
aagcagagcaagcguauuuauu

SEQ ID NO: 863684 - RNA, 22 nt, Human
ugaaaugagauaauuuaagugc

SEQ ID NO: 863685 - RNA, 23 nt, Human
uucuucucaauuaguugauucag

SEQ ID NO: 863686 - RNA, 20 nt, Human
uuucaagucagcaauucuca

SEQ ID NO: 863687 - RNA, 22 nt, Human
uguccuuauauuguggaagggg

SEQ ID NO: 863688 - RNA, 22 nt, Human
uucuccagagggcucugcagga

SEQ ID NO: 863689 - RNA, 22 nt, Human
agauuucagaugcucggcaguu

SEQ ID NO: 863690 - RNA, 22 nt, Human
ccagaagaccccguccaccucc

SEQ ID NO: 863691 - RNA, 22 nt, Human
uuuuuaguagagguggguuuca

SEQ ID NO: 863692 - RNA, 17 nt, Human
gcgcagcuccuggcgcg

SEQ ID NO: 863693 - RNA, 22 nt, Human
ucuuuguaaaugccuagcauaa

SEQ ID NO: 863694 - RNA, 22 nt, Human
ggagcugugcagugacuacaga

SEQ ID NO: 863695 - RNA, 20 nt, Human
aucaggauucuugcuuuguu

SEQ ID NO: 863696 - RNA, 22 nt, Human
acaaauaugguacucggagaaa

SEQ ID NO: 863697 - RNA, 21 nt, Human
uucuccccagcgaauccucgg

SEQ ID NO: 863698 - RNA, 22 nt, Human
aggaagcugccugggaugggaa

SEQ ID NO: 863699 - RNA, 22 nt, Human
ccuccuuuccuguuuuccugag

SEQ ID NO: 863700 - RNA, 22 nt, Human
gggcaguuuauucuagaugguu

SEQ ID NO: 863701 - RNA, 22 nt, Human
gcaggaagcauagaagaaugcc

SEQ ID NO: 863702 - RNA, 22 nt, Human
uucugugaaucuuuuuucccac

SEQ ID NO: 863703 - RNA, 22 nt, Human
ucagaauugucuggggaauguu

SEQ ID NO: 863704 - RNA, 22 nt, Human
auguuuccagguucuuccuaug

SEQ ID NO: 863705 - RNA, 22 nt, Human
ugguaaauauguccauucucuu

SEQ ID NO: 863706 - RNA, 22 nt, Human
aaauggaucuguggaauacauu

SEQ ID NO: 863707 - RNA, 22 nt, Human
aaaguauuugugauuuuuacca

SEQ ID NO: 863708 - RNA, 22 nt, Human
gagccagcuauguagcaagagg

SEQ ID NO: 863709 - RNA, 22 nt, Human
ucaauucaauugaacaguuacu

SEQ ID NO: 863710 - RNA, 22 nt, Human
acugccauuggucaaaugagug

SEQ ID NO: 863711 - RNA, 22 nt, Human
aaaauuauggaguaucccaaag

SEQ ID NO: 863712 - RNA, 22 nt, Human
ugcuuaauaggaguugaacauu

SEQ ID NO: 863713 - RNA, 20 nt, Human
ucacuaguaaccaucugcuu

SEQ ID NO: 863714 - RNA, 22 nt, Human
ucuuagaaauuccccaguggcu

SEQ ID NO: 863715 - RNA, 22 nt, Human
aauaugcauuaacuguguacau

SEQ ID NO: 863716 - RNA, 22 nt, Human
guacagaaaguacccauagaag

SEQ ID NO: 863717 - RNA, 22 nt, Human
aggcagcuuaagcccuggccca

SEQ ID NO: 863718 - RNA, 22 nt, Human
auggcauuauagcaaugguuug

SEQ ID NO: 863719 - RNA, 22 nt, Human
ugaaagguagcuggccucauag

SEQ ID NO: 863720 - RNA, 22 nt, Human
ucuuuucaucauuuaauaggua

SEQ ID NO: 863721 - RNA, 22 nt, Human
ucagaauuugauuccugggaua

SEQ ID NO: 863722 - RNA, 22 nt, Human
cccaggagaauauuuuuggguc

SEQ ID NO: 863723 - RNA, 22 nt, Human
uucugaaccauugagcacugcc

SEQ ID NO: 863724 - RNA, 21 nt, Human
aggcaucuaaagagaguagac

SEQ ID NO: 863725 - RNA, 22 nt, Human
aucaggaucacugggagucuug

SEQ ID NO: 863726 - RNA, 22 nt, Human
aauuuguuaaaagugagugaca

SEQ ID NO: 863727 - RNA, 22 nt, Human
uuaauuaaauucaugagcauug

SEQ ID NO: 863728 - RNA, 22 nt, Human
uauuccaacugucauagucaua

SEQ ID NO: 863729 - RNA, 22 nt, Human
gaaauauacaugaagucggcug

SEQ ID NO: 863730 - RNA, 22 nt, Human
acaaagucacaauaauuaaccu

SEQ ID NO: 863731 - RNA, 22 nt, Human
guuaucaugcuucaucaucacu

SEQ ID NO: 863732 - RNA, 22 nt, Human
ucaaaauuucagcacuagcccu

SEQ ID NO: 863733 - RNA, 22 nt, Human
acaaagaucuugcuuuccuacu

SEQ ID NO: 863734 - RNA, 22 nt, Human
ugcugaugcuguucuguuagga

SEQ ID NO: 863735 - RNA, 22 nt, Human
augcugugucaccuuaggauuu

SEQ ID NO: 863736 - RNA, 22 nt, Human
aguacaauuuaaugaagauagc

SEQ ID NO: 863737 - RNA, 22 nt, Human
uucucuuagcuguaaagucaau

SEQ ID NO: 863738 - RNA, 23 nt, Human
ccaaagucgaagucuaguccaga

SEQ ID NO: 863739 - RNA, 20 nt, Human
caucagaaauccugacccac

SEQ ID NO: 863740 - RNA, 22 nt, Human
acaaauauuuacugaauccacu

SEQ ID NO: 863741 - RNA, 22 nt, Human
gaggccagaagugccucgggcu

SEQ ID NO: 863742 - RNA, 22 nt, Human
aggcuggagggcaauggcaaga

SEQ ID NO: 863743 - RNA, 22 nt, Human
uugcauuugaucuuggguucuc

SEQ ID NO: 863744 - RNA, 22 nt, Human
ggaggggauuuaguagaugcua

SEQ ID NO: 863745 - RNA, 22 nt, Human
gaugauaacagcauuucaacug

SEQ ID NO: 863746 - RNA, 22 nt, Human
gauuucaaggaguuuucacagu

SEQ ID NO: 863747 - RNA, 22 nt, Human
aagggcaggagaagacggauau

SEQ ID NO: 863748 - RNA, 22 nt, Human
agagggcagucucagauuggga

SEQ ID NO: 863749 - RNA, 22 nt, Human
ccaggagauaagcugaguuuau

SEQ ID NO: 863750 - RNA, 22 nt, Human
aaauuucaguuaccuuuacguu

SEQ ID NO: 863751 - RNA, 22 nt, Human
gccaggaggcugcuguguaggc

SEQ ID NO: 863752 - RNA, 22 nt, Human
augcuguguuugagaaccuagg

SEQ ID NO: 863753 - RNA, 21 nt, Human
cucaggaucuuauauauuagu

SEQ ID NO: 863754 - RNA, 22 nt, Human
caagauggaguccgggaaugug

SEQ ID NO: 863755 - RNA, 22 nt, Human
gcaggagacaacuguaaggaga

SEQ ID NO: 863756 - RNA, 22 nt, Human
cacauacuuguguguacauaug

SEQ ID NO: 863757 - RNA, 22 nt, Human
gauaaaauaacuauggaauacu

SEQ ID NO: 863758 - RNA, 22 nt, Human
aggguggcaccuggaagggaug

SEQ ID NO: 863759 - RNA, 22 nt, Human
uugaaagugccaaguccuagug

SEQ ID NO: 863760 - RNA, 22 nt, Human
uucuuucucaacaugaauguuu

SEQ ID NO: 863761 - RNA, 21 nt, Human
uuucacaaaaguaugugacaa

SEQ ID NO: 863762 - RNA, 22 nt, Human
aaacggauauaacagcaaacgc

SEQ ID NO: 863763 - RNA, 17 nt, Human
aagagaggcugagcugg

SEQ ID NO: 863764 - RNA, 22 nt, Human
auguucaaacuuuuuacacacc

SEQ ID NO: 863765 - RNA, 22 nt, Human
uaauuguagcuuuguaaucagc

SEQ ID NO: 863766 - RNA, 22 nt, Human
aagacuuucaaaccuauguuug

SEQ ID NO: 863767 - RNA, 22 nt, Human
agcaccauugcaaauauggcag

SEQ ID NO: 863768 - RNA, 22 nt, Human
acuggcaggcugcuggccggcg

SEQ ID NO: 863769 - RNA, 22 nt, Human
cccuggaguccuggcaguugau

SEQ ID NO: 863770 - RNA, 22 nt, Human
uucuuuuccuacacagcgauuu

SEQ ID NO: 863771 - RNA, 22 nt, Human
ugagagggcccagagcacacca

SEQ ID NO: 863772 - RNA, 22 nt, Human
aauuuuaaucaguggugcugag

SEQ ID NO: 863773 - RNA, 22 nt, Human
cccaggaaguggagguugcagu

SEQ ID NO: 863774 - RNA, 23 nt, Human
uuacagaaaguaugcuuuuguuu

SEQ ID NO: 863775 - RNA, 22 nt, Human
cuuaaagaguauuuaauauaau

SEQ ID NO: 863776 - RNA, 22 nt, Human
uagugcuuuaaguuuacagaga

SEQ ID NO: 863777 - RNA, 22 nt, Human
caacauuugaguaaagaaaugg

SEQ ID NO: 863778 - RNA, 22 nt, Human
uggcagcuugaaugcagucuuu

SEQ ID NO: 863779 - RNA, 22 nt, Human
uucaggauggcggauguugggg

SEQ ID NO: 863780 - RNA, 22 nt, Human
aagcagaggguauggccagguu

SEQ ID NO: 863781 - RNA, 22 nt, Human
uugacacaguuuucucauuaag

SEQ ID NO: 863782 - RNA, 22 nt, Human
aauguuuuaaaagagauugaga

SEQ ID NO: 863783 - RNA, 23 nt, Human
uuaaacuucagugcagaacacuc

SEQ ID NO: 863784 - RNA, 20 nt, Human
uauuuacaacuuagagccuc

SEQ ID NO: 863785 - RNA, 22 nt, Human
aaugaaacuguauauagacugu

SEQ ID NO: 863786 - RNA, 22 nt, Human
gaggagcuugaggcuaggagcc

SEQ ID NO: 863787 - RNA, 22 nt, Human
ucagaauuagagcucuucuuga

SEQ ID NO: 863788 - RNA, 22 nt, Human
ucacaguuauagucuguagaau

SEQ ID NO: 863789 - RNA, 22 nt, Human
auacauacauguaugcacauac

SEQ ID NO: 863790 - RNA, 23 nt, Human
aggucagcaggcaaggaaauggc

SEQ ID NO: 863791 - RNA, 22 nt, Human
gaucauuuugaugcccuuuuag

SEQ ID NO: 863792 - RNA, 22 nt, Human
gugagggguggcugagcaguuu

SEQ ID NO: 863793 - RNA, 22 nt, Human
uuaaagaauagugccccuauug

SEQ ID NO: 863794 - RNA, 22 nt, Human
uucuuuuacauuaagauuucag

SEQ ID NO: 863795 - RNA, 22 nt, Human
uacccaggggcugagcagaggu

SEQ ID NO: 863796 - RNA, 22 nt, Human
agagugaaguuuuugaaaguga

SEQ ID NO: 863797 - RNA, 21 nt, Human
agaggcaggcauuaaguacac

SEQ ID NO: 863798 - RNA, 22 nt, Human
cauagaaacugagacaaggauu

SEQ ID NO: 863799 - RNA, 22 nt, Human
acccaggacacagagaugaccc

SEQ ID NO: 863800 - RNA, 22 nt, Human
uaaauuguuuucuagaaguugu

SEQ ID NO: 863801 - RNA, 22 nt, Human
aggcagcaugggcccagagucc

SEQ ID NO: 863802 - RNA, 22 nt, Human
auucuucagcaggggacacuau

SEQ ID NO: 863803 - RNA, 22 nt, Human
uguccucuuccagugcuccuuc

SEQ ID NO: 863804 - RNA, 21 nt, Human
uucucagaucgaguagugaga

SEQ ID NO: 863805 - RNA, 22 nt, Human
ucaggagaaucagggcuguccu

SEQ ID NO: 863806 - RNA, 22 nt, Human
aucagcaucuuuaacaauuacc

SEQ ID NO: 863807 - RNA, 19 nt, Human
uccauaaugaagauagagg

SEQ ID NO: 863808 - RNA, 22 nt, Human
aaggccagcuuguagggcuggu

SEQ ID NO: 863809 - RNA, 22 nt, Human
cugaaaauguuacacaggaaga

SEQ ID NO: 863810 - RNA, 22 nt, Human
caguccuuaaggaaacauuugu

SEQ ID NO: 863811 - RNA, 22 nt, Human
uugauguacagaauuguucaca

SEQ ID NO: 863812 - RNA, 22 nt, Human
gaggcagcaaaauauaucauaa

SEQ ID NO: 863813 - RNA, 22 nt, Human
auacacauauguguguauaugu

SEQ ID NO: 863814 - RNA, 22 nt, Human
uguuuuaagagcgcacuuuaua

SEQ ID NO: 863815 - RNA, 22 nt, Human
gagacagcacaggccacuggga

SEQ ID NO: 863816 - RNA, 22 nt, Human
aucaggauucaccccagagcug

SEQ ID NO: 863817 - RNA, 20 nt, Human
aagggcagagggaacagacu

SEQ ID NO: 863818 - RNA, 22 nt, Human
aaaguccugacugcaggggaug

SEQ ID NO: 863819 - RNA, 22 nt, Human
gaggcaucugggcacagaagug

SEQ ID NO: 863820 - RNA, 22 nt, Human
ucccaggauguuggcggcaggu

SEQ ID NO: 863821 - RNA, 22 nt, Human
ugucauaacuuagugacaaauc

SEQ ID NO: 863822 - RNA, 22 nt, Human
cccaggaggcagauguugcagu

SEQ ID NO: 863823 - RNA, 22 nt, Human
aaguccuuaggaagcagucguu

SEQ ID NO: 863824 - RNA, 22 nt, Human
ucauacaucuguccuggagcuc

SEQ ID NO: 863825 - RNA, 22 nt, Human
uugcugugucauuuguuuaauc

SEQ ID NO: 863826 - RNA, 22 nt, Human
ugaacucgggaggaggcugcag

SEQ ID NO: 863827 - RNA, 22 nt, Human
ggcagcugcaaaucugcucugu

SEQ ID NO: 863828 - RNA, 22 nt, Human
ucaaauaccagcaauuucaugu

SEQ ID NO: 863829 - RNA, 22 nt, Human
uucagaaaggauaauuggaagg

SEQ ID NO: 863830 - RNA, 22 nt, Human
acaguccuuguguggaacauua

SEQ ID NO: 863831 - RNA, 22 nt, Human
uggcauuugggcuggcuuuucu

SEQ ID NO: 863832 - RNA, 22 nt, Human
ugaagaaucccagggaauuugg

SEQ ID NO: 863833 - RNA, 22 nt, Human
gagaggaguagacacuuugguu

SEQ ID NO: 863834 - RNA, 22 nt, Human
acaaugaacacacaaggaauuc

SEQ ID NO: 863835 - RNA, 22 nt, Human
gugaauaaucacccuucuggau

SEQ ID NO: 863836 - RNA, 20 nt, Human
augugucuguaaacaacucu

SEQ ID NO: 863837 - RNA, 22 nt, Human
gucaggauuuuaaaaucccagu

SEQ ID NO: 863838 - RNA, 22 nt, Human
uguacaaucugaugauguaugg

SEQ ID NO: 863839 - RNA, 22 nt, Human
aaaggccacugcaagggaaggu

SEQ ID NO: 863840 - RNA, 22 nt, Human
aaauuuucagagcacuagagaa

SEQ ID NO: 863841 - RNA, 22 nt, Human
uuuuuguagucauuagaagagg

SEQ ID NO: 863842 - RNA, 22 nt, Human
uacuuuuagccuauuugauucu

SEQ ID NO: 863843 - RNA, 22 nt, Human
aaggcagcagaggaaaggugcu

SEQ ID NO: 863844 - RNA, 22 nt, Human
uucuucaugcuguugcugcuug

SEQ ID NO: 863845 - RNA, 22 nt, Human
aucagaaauugcuaccagugga

SEQ ID NO: 863846 - RNA, 22 nt, Human
ccaggagaugggaaaguagcag

SEQ ID NO: 863847 - RNA, 22 nt, Human
gagggaggugauacugaacgua

SEQ ID NO: 863848 - RNA, 22 nt, Human
caguccuugauccaauaguggg

SEQ ID NO: 863849 - RNA, 22 nt, Human
cucugcauuuuaacagaugauu

SEQ ID NO: 863850 - RNA, 22 nt, Human
uuccauaauaggcuuaagugaa

SEQ ID NO: 863851 - RNA, 22 nt, Human
uccaugagcuagcuuuccaaag

SEQ ID NO: 863852 - RNA, 22 nt, Human
ccugcucagagcgucuugugug

SEQ ID NO: 863853 - RNA, 20 nt, Human
cucaggauugucuagccccu

SEQ ID NO: 863854 - RNA, 22 nt, Human
uagaugcuacaauuuuguacuc

SEQ ID NO: 863855 - RNA, 22 nt, Human
ggacaagccugugaguggguuu

SEQ ID NO: 863856 - RNA, 20 nt, Human
uccaggagaacugggagccg

SEQ ID NO: 863857 - RNA, 22 nt, Human
ccuugcugcgugcuagcacaga

SEQ ID NO: 863858 - RNA, 22 nt, Human
uguaaauaauuccuaggcuuuu

SEQ ID NO: 863859 - RNA, 22 nt, Human
caguccuucuccauuaaggcuc

SEQ ID NO: 863860 - RNA, 22 nt, Human
agcuggcaguaugacuggugac

SEQ ID NO: 863861 - RNA, 22 nt, Human
aaagccagguugugugcaggaa

SEQ ID NO: 863862 - RNA, 22 nt, Human
gcaggagaaaugaagauugggu

SEQ ID NO: 863863 - RNA, 22 nt, Human
cugcagagcaaguaacauccuc

SEQ ID NO: 863864 - RNA, 22 nt, Human
aauaacuggcacauaucacaua

SEQ ID NO: 863865 - RNA, 22 nt, Human
ggaagagggaaccacgacugua

SEQ ID NO: 863866 - RNA, 22 nt, Human
cuccaugaauuugagcuuugug

SEQ ID NO: 863867 - RNA, 22 nt, Human
auucauaaguaaaugauuaccu

SEQ ID NO: 863868 - RNA, 22 nt, Human
auuucagguaccugugggaucc

SEQ ID NO: 863869 - RNA, 22 nt, Human
uaauuauuugaagacauuagag

SEQ ID NO: 863870 - RNA, 22 nt, Human
cccaggagagagacuugaaucu

SEQ ID NO: 863871 - RNA, 19 nt, Human
ucccaggaaccuuuuauuu

SEQ ID NO: 863872 - RNA, 22 nt, Human
aguuauaugugaaaacacguau

SEQ ID NO: 863873 - RNA, 22 nt, Human
uuucaaagucaauaucauuacc

SEQ ID NO: 863874 - RNA, 18 nt, Human
aaacuggcuuggccugug

SEQ ID NO: 863875 - RNA, 22 nt, Human
uugacacagaucaauauucaac

SEQ ID NO: 863876 - RNA, 22 nt, Human
caacagucugguuuauauaaua

SEQ ID NO: 863877 - RNA, 20 nt, Human
auacuuguuuucaggcuuuu

SEQ ID NO: 863878 - RNA, 22 nt, Human
uggagaggaaagugcaguuuug

SEQ ID NO: 863879 - RNA, 22 nt, Human
uggcauuucaguauuuucauaa

SEQ ID NO: 863880 - RNA, 22 nt, Human
uuaaagauucugaggcugauua

SEQ ID NO: 863881 - RNA, 19 nt, Human
caguccuuuccgcuuucuc

SEQ ID NO: 863882 - RNA, 22 nt, Human
cuucugugcuucacaguugcca

SEQ ID NO: 863883 - RNA, 18 nt, Human
gcagcugacacuggaguu

SEQ ID NO: 863884 - RNA, 22 nt, Human
gugguuuugccauuacaaguaa

SEQ ID NO: 863885 - RNA, 22 nt, Human
agcugaugccauguggaacagu

SEQ ID NO: 863886 - RNA, 22 nt, Human
agucaccauuuucaccugccuc

SEQ ID NO: 863887 - RNA, 19 nt, Human
gugcuuuuuaagagcucag

SEQ ID NO: 863888 - RNA, 22 nt, Human
ucuuuccaaggacucuguagca

SEQ ID NO: 863889 - RNA, 22 nt, Human
uacaaaguagaaauucaguaaa

SEQ ID NO: 863890 - RNA, 22 nt, Human
accaggagccauagagucaggc

SEQ ID NO: 863891 - RNA, 22 nt, Human
cagugguugguagauacuugag

SEQ ID NO: 863892 - RNA, 22 nt, Human
gcugcccauuccacuggauggu

SEQ ID NO: 863893 - RNA, 22 nt, Human
uaugccugauaacugugucucu

SEQ ID NO: 863894 - RNA, 19 nt, Human
agaaguuagacauugcaau

SEQ ID NO: 863895 - RNA, 22 nt, Human
caucagaaaccuugaggaaacu

SEQ ID NO: 863896 - RNA, 22 nt, Human
uuugcacuagcauuuguccaug

SEQ ID NO: 863897 - RNA, 23 nt, Human
uuuauccaacucuguaaucucuc

SEQ ID NO: 863898 - RNA, 22 nt, Human
uuaaauuccagccucauaauag

SEQ ID NO: 863899 - RNA, 22 nt, Human
cccaggagauaacguucccaag

SEQ ID NO: 863900 - RNA, 22 nt, Human
gaccuggaggauccucuucuug

SEQ ID NO: 863901 - RNA, 20 nt, Human
gcccaggaauuugcauuucu

SEQ ID NO: 863902 - RNA, 22 nt, Human
uuccuuaguguuagauucugug

SEQ ID NO: 863903 - RNA, 22 nt, Human
uucuuauagaagcaaccauugu

SEQ ID NO: 863904 - RNA, 19 nt, Human
cauuuuaagcauccccagu

SEQ ID NO: 863905 - RNA, 22 nt, Human
uugaaagaggcaaaguuugauc

SEQ ID NO: 863906 - RNA, 22 nt, Human
uuuccuaggagauugaucacau

SEQ ID NO: 863907 - RNA, 22 nt, Human
uucucagauauuuacugagcau

SEQ ID NO: 863908 - RNA, 23 nt, Human
uaucagugugaugaggcugcugc

SEQ ID NO: 863909 - RNA, 22 nt, Human
ucuauacaugugcacacacauc

SEQ ID NO: 863910 - RNA, 15 nt, Human
uggcagcuuguuaag

SEQ ID NO: 863911 - RNA, 18 nt, Human
ugaauagggguuugcaga

SEQ ID NO: 863912 - RNA, 22 nt, Human
ggggcagccuccaggaaagcug

SEQ ID NO: 863913 - RNA, 19 nt, Human
caggaugaucccaugacac

SEQ ID NO: 863914 - RNA, 22 nt, Human
agaagucauuuauguuagauga

SEQ ID NO: 863915 - RNA, 22 nt, Human
ucugcaggcuuggaguggcagc

SEQ ID NO: 863916 - RNA, 22 nt, Human
aaaucaguuaagaugaggccau

SEQ ID NO: 863917 - RNA, 22 nt, Human
guaggcagucucucaggugauc

SEQ ID NO: 863918 - RNA, 22 nt, Human
gagugcagaugccagccccagu

SEQ ID NO: 863919 - RNA, 22 nt, Human
uggcauuuggcuuacuuauguu

SEQ ID NO: 863920 - RNA, 22 nt, Human
uaggauuuaggcuuuaacaucu

SEQ ID NO: 863921 - RNA, 22 nt, Human
uuccuuaguugacugucuuagu

SEQ ID NO: 863922 - RNA, 22 nt, Human
augaaaauguacauguguauaa

SEQ ID NO: 863923 - RNA, 22 nt, Human
ggauggcagucugcaugagaaa

SEQ ID NO: 863924 - RNA, 17 nt, Human
gucauucucagaaaaug

SEQ ID NO: 863925 - RNA, 22 nt, Human
aaacaaacaauuaguugugugg

SEQ ID NO: 863926 - RNA, 22 nt, Human
ucaggauguuaauauagcauua

SEQ ID NO: 863927 - RNA, 22 nt, Human
acagucucuccacacugcaggg

SEQ ID NO: 863928 - RNA, 23 nt, Human
guaaaauacgcagugcaguguga

SEQ ID NO: 863929 - RNA, 22 nt, Human
uauuuccagcaguaagaagaca

SEQ ID NO: 863930 - RNA, 22 nt, Human
ccuugcugaccaucaccuuuga

SEQ ID NO: 863931 - RNA, 20 nt, Human
agcauuugaaauaugacuau

SEQ ID NO: 863932 - RNA, 22 nt, Human
aggauuuaccuccagcuaggcu

SEQ ID NO: 863933 - RNA, 18 nt, Human
gagagggaucccucagga

SEQ ID NO: 863934 - RNA, 22 nt, Human
cucagaauuuagggcucugagg

SEQ ID NO: 863935 - RNA, 22 nt, Human
gcuuggcauugaccauuaucau

SEQ ID NO: 863936 - RNA, 22 nt, Human
agaccgagaaguucuccaggcc

SEQ ID NO: 863937 - RNA, 22 nt, Human
uucucagaugauucagauaaac

SEQ ID NO: 863938 - RNA, 22 nt, Human
aggauuuauuauaugcccucau

SEQ ID NO: 863939 - RNA, 22 nt, Human
uuugaagugcaaugaggauucu

SEQ ID NO: 863940 - RNA, 22 nt, Human
cuuaagauuugcgauaccuaau

SEQ ID NO: 863941 - RNA, 22 nt, Human
uuagccaugcccuagaagagga

SEQ ID NO: 863942 - RNA, 22 nt, Human
caguccuuagucuggauggcuu

SEQ ID NO: 863943 - RNA, 22 nt, Human
aggcagguccccuggaaggcac

SEQ ID NO: 863944 - RNA, 20 nt, Human
ucagugauuuugaagaggaa

SEQ ID NO: 863945 - RNA, 22 nt, Human
ggagcggagggagggccacugu

SEQ ID NO: 863946 - RNA, 22 nt, Human
cugaauaaagcccucgcgcgcu

SEQ ID NO: 863947 - RNA, 22 nt, Human
uggugguuaugcgcuuuguggg

SEQ ID NO: 863948 - RNA, 22 nt, Human
cacaauguauauguauaucaaa

SEQ ID NO: 863949 - RNA, 22 nt, Human
uaaaugaagaaauggagauugu

SEQ ID NO: 863950 - RNA, 22 nt, Human
caugauuuugucuuguguuaau

SEQ ID NO: 863951 - RNA, 22 nt, Human
gagugcaguuggggugagggga

SEQ ID NO: 863952 - RNA, 22 nt, Human
gcucagagcuugaaguuccacu

SEQ ID NO: 863953 - RNA, 22 nt, Human
agccagcugugggcucaggcgg

SEQ ID NO: 863954 - RNA, 22 nt, Human
ugcugcugaucauuuauagucu

SEQ ID NO: 863955 - RNA, 22 nt, Human
ggcagcacugcagcuuguuggg

SEQ ID NO: 863956 - RNA, 22 nt, Human
cucaggaugaaagucaugguga

SEQ ID NO: 863957 - RNA, 22 nt, Human
ucuacccagagcuaugaccuga

SEQ ID NO: 863958 - RNA, 20 nt, Human
ucuggcaggugaacgagcug

SEQ ID NO: 863959 - RNA, 22 nt, Human
uucauguguauggaacauuuuu

SEQ ID NO: 863960 - RNA, 22 nt, Human
aagcaaaggcaggagcuuguga

SEQ ID NO: 863961 - RNA, 23 nt, Human
cugcugugaaacaugguuuuggu

SEQ ID NO: 863962 - RNA, 22 nt, Human
acuagaaauuacucagaauaaa

SEQ ID NO: 863963 - RNA, 22 nt, Human
gcuguguuggugaagcuguagc

SEQ ID NO: 863964 - RNA, 22 nt, Human
agaggccagguccagaguuugu

SEQ ID NO: 863965 - RNA, 22 nt, Human
gaaggucaccuccccucucugg

SEQ ID NO: 863966 - RNA, 22 nt, Human
uugguccacugugaaauuggga

SEQ ID NO: 863967 - RNA, 22 nt, Human
ggagguggcagagggacauucu

SEQ ID NO: 863968 - RNA, 22 nt, Human
cccaggaguaagugacauuguu

SEQ ID NO: 863969 - RNA, 22 nt, Human
caaguccuaaauguauuuguug

SEQ ID NO: 863970 - RNA, 22 nt, Human
auauacaguuuuacaggguuuc

SEQ ID NO: 863971 - RNA, 22 nt, Human
aagaggagacuucagcaacuug

SEQ ID NO: 863972 - RNA, 22 nt, Human
augaauaaguaaacuccuuugg

SEQ ID NO: 863973 - RNA, 22 nt, Human
agaaaacuugucacagcucuca

SEQ ID NO: 863974 - RNA, 22 nt, Human
ucaauucugguccucaggaacu

SEQ ID NO: 863975 - RNA, 22 nt, Human
uuacagaagugaaggccuuuaa

SEQ ID NO: 863976 - RNA, 22 nt, Human
ccagugcuuccaggaauacggu

SEQ ID NO: 863977 - RNA, 22 nt, Human
ugcuuuggaucuauuugcugag

SEQ ID NO: 863978 - RNA, 22 nt, Human
cagugaaaucacaacuuuaguu

SEQ ID NO: 863979 - RNA, 22 nt, Human
uaacagaagaaaacauauugga

SEQ ID NO: 863980 - RNA, 22 nt, Human
aauagcucacugauuucucuuu

SEQ ID NO: 863981 - RNA, 22 nt, Human
ucaguaaaugguugcuguuauu

SEQ ID NO: 863982 - RNA, 22 nt, Human
agcuggcagucauccuagugag

SEQ ID NO: 863983 - RNA, 22 nt, Human
caaacuggcuaugggaaucuug

SEQ ID NO: 863984 - RNA, 22 nt, Human
uucagaaagguaaauggauuuc

SEQ ID NO: 863985 - RNA, 19 nt, Human
caggaaugagguaauggcu

SEQ ID NO: 863986 - RNA, 22 nt, Human
uucccucucacuuaaagcuugg

SEQ ID NO: 863987 - RNA, 22 nt, Human
gggagucugggcuagacuccuu

SEQ ID NO: 863988 - RNA, 20 nt, Human
guggcaggcagugaaggagc

SEQ ID NO: 863989 - RNA, 22 nt, Human
aaagcagaggugauaugacuua

SEQ ID NO: 863990 - RNA, 22 nt, Human
uaaggccaaacuauuauaguuc

SEQ ID NO: 863991 - RNA, 22 nt, Human
auaaagucuaccguauuaaaga

SEQ ID NO: 863992 - RNA, 22 nt, Human
ucauuuauaaggaugcaauuaa

SEQ ID NO: 863993 - RNA, 22 nt, Human
aagugggaauagaaaugaaggu

SEQ ID NO: 863994 - RNA, 22 nt, Human
caacuuucuguuaaauguuagu

SEQ ID NO: 863995 - RNA, 22 nt, Human
caggauggagaguuguugguug

SEQ ID NO: 863996 - RNA, 22 nt, Human
acuauacaccaaaauauuaagg

SEQ ID NO: 863997 - RNA, 22 nt, Human
uggcuguguuaccacuucaugu

SEQ ID NO: 863998 - RNA, 22 nt, Human
aaugggauaauuguucauggga

SEQ ID NO: 863999 - RNA, 22 nt, Human
cauugcuguuaauugucucuag

SEQ ID NO: 864000 - RNA, 22 nt, Human
guagccauuggcaaugaagccu

SEQ ID NO: 864001 - RNA, 22 nt, Human
aaguccuuuccaguccugugau

SEQ ID NO: 864002 - RNA, 22 nt, Human
cagucaccugaagacuugacca

SEQ ID NO: 864003 - RNA, 22 nt, Human
ccaugagccaggcugaggaagc

SEQ ID NO: 864004 - RNA, 22 nt, Human
uuagaaaugcacccaagaccua

SEQ ID NO: 864005 - RNA, 22 nt, Human
aggaagcuuagugaaaggacca

SEQ ID NO: 864006 - RNA, 22 nt, Human
cuccaggagggggauggcugua

SEQ ID NO: 864007 - RNA, 22 nt, Human
gucacagaguuauuaauugugu

SEQ ID NO: 864008 - RNA, 22 nt, Human
cccaggaaaguggaggcggcug

SEQ ID NO: 864009 - RNA, 22 nt, Human
agucuucucauuucacaugcuu

SEQ ID NO: 864010 - RNA, 22 nt, Human
ucugggaauuuauuggcacuuu

SEQ ID NO: 864011 - RNA, 22 nt, Human
aaaauaacuucuacuauuugca

SEQ ID NO: 864012 - RNA, 22 nt, Human
auucuuaauugccaugcuguau

SEQ ID NO: 864013 - RNA, 22 nt, Human
ugaaaugauguacaagaaggca

SEQ ID NO: 864014 - RNA, 22 nt, Human
uguugauuaguguuuagacuua

SEQ ID NO: 864015 - RNA, 17 nt, Human
agagagagcaugccacc

SEQ ID NO: 864016 - RNA, 22 nt, Human
acagaauuuaaagcucuagacu

SEQ ID NO: 864017 - RNA, 22 nt, Human
ccaggcugggcuacaaguugag

SEQ ID NO: 864018 - RNA, 22 nt, Human
aaggcagccucugccagccggg

SEQ ID NO: 864019 - RNA, 22 nt, Human
aaugaaaauuggacccuagaac

SEQ ID NO: 864020 - RNA, 22 nt, Human
cccaggaagagugaguggcauu

SEQ ID NO: 864021 - RNA, 22 nt, Human
ugucauaaucaguuuugcaugu

SEQ ID NO: 864022 - RNA, 22 nt, Human
cuuaggcaaccaggucaaugcu

SEQ ID NO: 864023 - RNA, 22 nt, Human
uuuacagaugaggauacugagg

SEQ ID NO: 864024 - RNA, 22 nt, Human
cagaauaaaagucccaaggcau

SEQ ID NO: 864025 - RNA, 22 nt, Human
gaugaaaaaagacgagcauaua

SEQ ID NO: 864026 - RNA, 22 nt, Human
gacagcuguggagaggcaugug

SEQ ID NO: 864027 - RNA, 22 nt, Human
acuuuaucaggaaucacacagc

SEQ ID NO: 864028 - RNA, 21 nt, Human
ggcagcguguggacaggaagg

SEQ ID NO: 864029 - RNA, 22 nt, Human
aggcaagcccccagugaggcuc

SEQ ID NO: 864030 - RNA, 23 nt, Human
ucuaauacaugaaaccuagaugu

SEQ ID NO: 864031 - RNA, 22 nt, Human
gguacaaugguucauuuuaugu

SEQ ID NO: 864032 - RNA, 22 nt, Human
gaggagcugggucagggagaca

SEQ ID NO: 864033 - RNA, 22 nt, Human
aggcuagcuuuggcucaguaaa

SEQ ID NO: 864034 - RNA, 22 nt, Human
ggcagccuugacuagugacuua

SEQ ID NO: 864035 - RNA, 22 nt, Human
agggaagcuuguuacugagaag

SEQ ID NO: 864036 - RNA, 22 nt, Human
caaagauuuuagaauuugcaau

SEQ ID NO: 864037 - RNA, 22 nt, Human
uaaucugaagaaacaggacuug

SEQ ID NO: 864038 - RNA, 22 nt, Human
augaaaacggaccagagcuauu

SEQ ID NO: 864039 - RNA, 22 nt, Human
guuuucugauuagcaaaucuga

SEQ ID NO: 864040 - RNA, 22 nt, Human
ucuuaaagagcgcaauuugagg

SEQ ID NO: 864041 - RNA, 22 nt, Human
gcuagaucucucauaaauucca

SEQ ID NO: 864042 - RNA, 22 nt, Human
uucuucuucauuucugacgaug

SEQ ID NO: 864043 - RNA, 22 nt, Human
uaagagaauguuguggcuaggu

SEQ ID NO: 864044 - RNA, 22 nt, Human
uaauacuuuugccuuguauuca

SEQ ID NO: 864045 - RNA, 22 nt, Human
gaauacauuggaaaucagaaua

SEQ ID NO: 864046 - RNA, 22 nt, Human
guuaggcagcccaagaugucag

SEQ ID NO: 864047 - RNA, 22 nt, Human
uuuagaaugugacuguauuuga

SEQ ID NO: 864048 - RNA, 22 nt, Human
cccaggaaaugaacuucugauu

SEQ ID NO: 864049 - RNA, 22 nt, Human
cucuaacaccacagugugguuu

SEQ ID NO: 864050 - RNA, 20 nt, Human
cucuccucacccgugucagg

SEQ ID NO: 864051 - RNA, 22 nt, Human
agggagcucaguuggaagcggu

SEQ ID NO: 864052 - RNA, 22 nt, Human
gggcagcugccagaggccaugg

SEQ ID NO: 864053 - RNA, 21 nt, Human
acaugucuggucauuuuuagc

SEQ ID NO: 864054 - RNA, 22 nt, Human
aaaaacugcaauuacuuuuguc

SEQ ID NO: 864055 - RNA, 20 nt, Human
cuucuucaguaguuuguucu

SEQ ID NO: 864056 - RNA, 21 nt, Human
uuuaaagaauaggaagggagg

SEQ ID NO: 864057 - RNA, 22 nt, Human
aggccagcuuccagaggggcag

SEQ ID NO: 864058 - RNA, 22 nt, Human
aaucagaaagaucuugaugaga

SEQ ID NO: 864059 - RNA, 22 nt, Human
auucauuugcuauuguguaugg

SEQ ID NO: 864060 - RNA, 22 nt, Human
gacuaugugaagugugaauagg

SEQ ID NO: 864061 - RNA, 22 nt, Human
gucuucaacaauaacuaccacu

SEQ ID NO: 864062 - RNA, 22 nt, Human
uggaguucauccaugacagcuu

SEQ ID NO: 864063 - RNA, 22 nt, Human
gaggccagcuaguccaggaagu

SEQ ID NO: 864064 - RNA, 22 nt, Human
gcagcugaauguccauugcugc

SEQ ID NO: 864065 - RNA, 22 nt, Human
aaggcagcuuuaaaaaagaugc

SEQ ID NO: 864066 - RNA, 22 nt, Human
aggcaggcccucuggaaaggua

SEQ ID NO: 864067 - RNA, 22 nt, Human
acacuaaugagaaaggaauuaa

SEQ ID NO: 864068 - RNA, 22 nt, Human
gauaaaauauguggccuuuagu

SEQ ID NO: 864069 - RNA, 22 nt, Human
acuuuugguucuguaacuguga

SEQ ID NO: 864070 - RNA, 22 nt, Human
agcagaggaggauuuaguuagg

SEQ ID NO: 864071 - RNA, 19 nt, Human
acauuuaaauucagaucuc

SEQ ID NO: 864072 - RNA, 22 nt, Human
uagaaacagcauauauuagccc

SEQ ID NO: 864073 - RNA, 22 nt, Human
ugcuggaauaauuucauguuaa

SEQ ID NO: 864074 - RNA, 22 nt, Human
ggauggagguucucagaugcuc

SEQ ID NO: 864075 - RNA, 22 nt, Human
ccaggaaaauaccaagcuuuaa

SEQ ID NO: 864076 - RNA, 19 nt, Human
uggagggguuugaaugugg

SEQ ID NO: 864077 - RNA, 22 nt, Human
gcaggagacuggcugugguagu

SEQ ID NO: 864078 - RNA, 22 nt, Human
guacagaaggagcuuuggauuc

SEQ ID NO: 864079 - RNA, 22 nt, Human
uaaagaucuuaggaagauuuuc

SEQ ID NO: 864080 - RNA, 22 nt, Human
aagggaggccagagguuuugca

SEQ ID NO: 864081 - RNA, 22 nt, Human
ugaaagguuaaaaguaguauug

SEQ ID NO: 864082 - RNA, 22 nt, Human
ucacaguaucacacaaggauua

SEQ ID NO: 864083 - RNA, 22 nt, Human
ucacagaagagauauugacaga

SEQ ID NO: 864084 - RNA, 22 nt, Human
aauacauguuuucuacuauucu

SEQ ID NO: 864085 - RNA, 22 nt, Human
acccaggacuuggcaaccucau

SEQ ID NO: 864086 - RNA, 22 nt, Human
cuugaaguugcaaaacauuaau

SEQ ID NO: 864087 - RNA, 22 nt, Human
aagccaaugagagaggccucag

SEQ ID NO: 864088 - RNA, 22 nt, Human
uccauguguuuuccuguccaca

SEQ ID NO: 864089 - RNA, 22 nt, Human
aggccagcagcaugacggcauc

SEQ ID NO: 864090 - RNA, 22 nt, Human
agaggcaggagguugacuugag

SEQ ID NO: 864091 - RNA, 22 nt, Human
aagggcagaauagagaagaugg

SEQ ID NO: 864092 - RNA, 22 nt, Human
agggagcuaggauccugaaggu

SEQ ID NO: 864093 - RNA, 22 nt, Human
acaauacaggcuucuggacuua

SEQ ID NO: 864094 - RNA, 22 nt, Human
guaggcagauaggagugcagcc

SEQ ID NO: 864095 - RNA, 22 nt, Human
aaaucaguucucccuuucuuca

SEQ ID NO: 864096 - RNA, 22 nt, Human
augcuguggaugccuugcccca

SEQ ID NO: 864097 - RNA, 19 nt, Human
cuuugucagaacaugcuuc

SEQ ID NO: 864098 - RNA, 22 nt, Human
uaucaucuuguugucaugcagc

SEQ ID NO: 864099 - RNA, 22 nt, Human
uguacaauguggccaguguuaa

SEQ ID NO: 864100 - RNA, 22 nt, Human
ccugucacgaugacugcacucu

SEQ ID NO: 864101 - RNA, 22 nt, Human
uacuaaacaucuggcauuaaau

SEQ ID NO: 864102 - RNA, 22 nt, Human
auaacaugaccugugcuucaca

SEQ ID NO: 864103 - RNA, 22 nt, Human
uggagaauuuugucaccagaca

SEQ ID NO: 864104 - RNA, 22 nt, Human
ucaagugcuugugagguauuug

SEQ ID NO: 864105 - RNA, 22 nt, Human
cuucuucauaggcaguccuguu

SEQ ID NO: 864106 - RNA, 22 nt, Human
uagugcuugagucucuccguac

SEQ ID NO: 864107 - RNA, 22 nt, Human
auuuccagugcacugaauagaa

SEQ ID NO: 864108 - RNA, 23 nt, Human
cagcccuuccugcauguuuuugu

SEQ ID NO: 864109 - RNA, 19 nt, Human
uugaaauuguuugauaugg

SEQ ID NO: 864110 - RNA, 22 nt, Human
aggcagcccacaggacacagga

SEQ ID NO: 864111 - RNA, 22 nt, Human
aaguauuucguucugaaaaagu

SEQ ID NO: 864112 - RNA, 21 nt, Human
aaucauacaaaacaugucagg

SEQ ID NO: 864113 - RNA, 22 nt, Human
uggcauuuuguucaguauaugg

SEQ ID NO: 864114 - RNA, 22 nt, Human
acugguuuuccagguuacuucu

SEQ ID NO: 864115 - RNA, 22 nt, Human
gagggucccugcucagggccag

SEQ ID NO: 864116 - RNA, 17 nt, Human
uaucagaauguguuuac

SEQ ID NO: 864117 - RNA, 22 nt, Human
ucuuuggaucccaacuggcugg

SEQ ID NO: 864118 - RNA, 22 nt, Human
ggugaagggccuuaggagacag

SEQ ID NO: 864119 - RNA, 22 nt, Human
uaucagaaaugccuuaaauugg

SEQ ID NO: 864120 - RNA, 22 nt, Human
gacaauacagaaagggacaugc

SEQ ID NO: 864121 - RNA, 22 nt, Human
uucuccaacacaagcaugaugu

SEQ ID NO: 864122 - RNA, 20 nt, Human
gaugggaaucggagcuggua

SEQ ID NO: 864123 - RNA, 22 nt, Human
ucugggaaaugcuguuccuugu

SEQ ID NO: 864124 - RNA, 22 nt, Human
ccaggagaugauguuggggauu

SEQ ID NO: 864125 - RNA, 22 nt, Human
aggcggcuccgggagugugggc

SEQ ID NO: 864126 - RNA, 22 nt, Human
aguaaacauagaauguucuucc

SEQ ID NO: 864127 - RNA, 22 nt, Human
cagggaggaugggcuguuuugc

SEQ ID NO: 864128 - RNA, 22 nt, Human
gcgucugaguugcgggggcuca

SEQ ID NO: 864129 - RNA, 22 nt, Human
cugcugugugaccauggacagg

SEQ ID NO: 864130 - RNA, 22 nt, Human
auuuugaugcuaucuaaugaau

SEQ ID NO: 864131 - RNA, 21 nt, Human
uggagacucugguucuuugug

SEQ ID NO: 864132 - RNA, 22 nt, Human
gcagaauugauggagaacuuaa

SEQ ID NO: 864133 - RNA, 21 nt, Human
uuucuucacuuugccccaugu

SEQ ID NO: 864134 - RNA, 22 nt, Human
ugugaaggagaugaagggagug

SEQ ID NO: 864135 - RNA, 22 nt, Human
uaucuguuaugggcugaauugc

SEQ ID NO: 864136 - RNA, 22 nt, Human
uacaauacuuaaccuauuuugc

SEQ ID NO: 864137 - RNA, 18 nt, Human
agcuucccucugagaggg

SEQ ID NO: 864138 - RNA, 22 nt, Human
cagaaucagcccuugcuauuaa

SEQ ID NO: 864139 - RNA, 22 nt, Human
aagggaggaggauuuauuguac

SEQ ID NO: 864140 - RNA, 22 nt, Human
cagcugacuucauaggaagaca

SEQ ID NO: 864141 - RNA, 15 nt, Human
caggagaggaagguu

SEQ ID NO: 864142 - RNA, 22 nt, Human
cccaugagauucugaauuuggc

SEQ ID NO: 864143 - RNA, 18 nt, Human
cugcccagagcauuucau

SEQ ID NO: 864144 - RNA, 22 nt, Human
agggagcuuccgaacuacagcu

SEQ ID NO: 864145 - RNA, 22 nt, Human
ugcauuuccagauuucuggagu

SEQ ID NO: 864146 - RNA, 22 nt, Human
gaagaggaugacaggagccggu

SEQ ID NO: 864147 - RNA, 22 nt, Human
cuuagcaugugguguccuugua

SEQ ID NO: 864148 - RNA, 22 nt, Human
uaauauauuucugcuaagcuca

SEQ ID NO: 864149 - RNA, 22 nt, Human
ggcauuuaguuuucauauucug

SEQ ID NO: 864150 - RNA, 22 nt, Human
acucagaaugacugaugcugug

SEQ ID NO: 864151 - RNA, 22 nt, Human
gacuucuauuaauaccucuacu

SEQ ID NO: 864152 - RNA, 17 nt, Human
ugaaaucagcacccagg

SEQ ID NO: 864153 - RNA, 22 nt, Human
gcacaauuauuuaugcaguaug

SEQ ID NO: 864154 - RNA, 22 nt, Human
uuugaaaguucuucugacacua

SEQ ID NO: 864155 - RNA, 22 nt, Human
gauuucuugauaaguaguguga

SEQ ID NO: 864156 - RNA, 22 nt, Human
aucuaaacagguguucuuuaga

SEQ ID NO: 864157 - RNA, 22 nt, Human
uuugaaauaugaggcauuauga

SEQ ID NO: 864158 - RNA, 22 nt, Human
uugauacaggcucuauuucauc

SEQ ID NO: 864159 - RNA, 22 nt, Human
agggagcucuaaguagagggac

SEQ ID NO: 864160 - RNA, 22 nt, Human
aucuucucaagcagcauccugu

SEQ ID NO: 864161 - RNA, 20 nt, Human
aauaaacuacugagagaugu

SEQ ID NO: 864162 - RNA, 22 nt, Human
gcagcugcagagaccggguggg

SEQ ID NO: 864163 - RNA, 23 nt, Human
uuccagaguccacaucugccacc

SEQ ID NO: 864164 - RNA, 22 nt, Human
acuggauuccauugugcaaaga

SEQ ID NO: 864165 - RNA, 22 nt, Human
acauuuaaauaccuauguuucu

SEQ ID NO: 864166 - RNA, 22 nt, Human
gccugcagaacugugaggcaau

SEQ ID NO: 864167 - RNA, 16 nt, Human
gcaacuuugggguuga

SEQ ID NO: 864168 - RNA, 22 nt, Human
gaaauauuguacuggagauguu

SEQ ID NO: 864169 - RNA, 22 nt, Human
uccauuuuucaugacuccucaa

SEQ ID NO: 864170 - RNA, 22 nt, Human
guuccaaagucucugagcugag

SEQ ID NO: 864171 - RNA, 22 nt, Human
gagggaggggagcuccacccuc

SEQ ID NO: 864172 - RNA, 20 nt, Human
ccucaguguccuggacuggg

SEQ ID NO: 864173 - RNA, 22 nt, Human
cagcuagcuaagaaggccagag

SEQ ID NO: 864174 - RNA, 22 nt, Human
aaaaaucuaugacugcuucucc

SEQ ID NO: 864175 - RNA, 22 nt, Human
auggcuuuccugggacaugggc

SEQ ID NO: 864176 - RNA, 22 nt, Human
ggaccuggcaauuugcaucucu

SEQ ID NO: 864177 - RNA, 22 nt, Human
ccagaucuaaguccaaaguacu

SEQ ID NO: 864178 - RNA, 22 nt, Human
gagguagcaugcuggaagggac

SEQ ID NO: 864179 - RNA, 17 nt, Human
ggcagcugugugcaugc

SEQ ID NO: 864180 - RNA, 22 nt, Human
aauugcuaaagauuauguuuuc

SEQ ID NO: 864181 - RNA, 22 nt, Human
gaggcaccucgcgggaggaggc

SEQ ID NO: 864182 - RNA, 22 nt, Human
caaagccauagaguagauaaga

SEQ ID NO: 864183 - RNA, 22 nt, Human
aaagcagucacuccagugugau

SEQ ID NO: 864184 - RNA, 22 nt, Human
aggauuuacuagcaaggauucu

SEQ ID NO: 864185 - RNA, 22 nt, Human
aaauacugucucugagagagcc

SEQ ID NO: 864186 - RNA, 22 nt, Human
gacggcagaaacucaugagguc

SEQ ID NO: 864187 - RNA, 22 nt, Human
gguggagcuggaccaggagagg

SEQ ID NO: 864188 - RNA, 22 nt, Human
auggcauuccaagucuucuuuu

SEQ ID NO: 864189 - RNA, 22 nt, Human
uaaguccuagaugauucacaga

SEQ ID NO: 864190 - RNA, 22 nt, Human
uucauaaucaccaaaaacugga

SEQ ID NO: 864191 - RNA, 22 nt, Human
agacccagaaagcagcugcauu

SEQ ID NO: 864192 - RNA, 19 nt, Human
cuugcugggugguuucugc

SEQ ID NO: 864193 - RNA, 22 nt, Human
uggggcuccuccuggcaggagg

SEQ ID NO: 864194 - RNA, 22 nt, Human
uaaguccuaauggcagaagucu

SEQ ID NO: 864195 - RNA, 22 nt, Human
auacagaaaaguggauagccag

SEQ ID NO: 864196 - RNA, 22 nt, Human
ucucaggaagugauauugagac

SEQ ID NO: 864197 - RNA, 22 nt, Human
caucagaaccaguggggacauu

SEQ ID NO: 864198 - RNA, 19 nt, Human
acaaaugauguugcacuga

SEQ ID NO: 864199 - RNA, 22 nt, Human
auacagaacucucaguuguaua

SEQ ID NO: 864200 - RNA, 20 nt, Human
ucucuucuggggagauaaaa

SEQ ID NO: 864201 - RNA, 22 nt, Human
cuucuucaguugcauguauugg

SEQ ID NO: 864202 - RNA, 22 nt, Human
gcuggauccacaaauaacuuug

SEQ ID NO: 864203 - RNA, 22 nt, Human
uuuacagaauguugaauuuggg

SEQ ID NO: 864204 - RNA, 22 nt, Human
uaaaacuuaacuauccagauua

SEQ ID NO: 864205 - RNA, 22 nt, Human
ucaggagaaaauaucaggaagu

SEQ ID NO: 864206 - RNA, 22 nt, Human
ugaggggagcccgcccuggacg

SEQ ID NO: 864207 - RNA, 22 nt, Human
auaaagucauuaugaagaucua

SEQ ID NO: 864208 - RNA, 22 nt, Human
cuguaugaggaucagacuggac

SEQ ID NO: 864209 - RNA, 22 nt, Human
aucagaaaucuaggauucagaa

SEQ ID NO: 864210 - RNA, 17 nt, Human
aggcaggcagagcggga

SEQ ID NO: 864211 - RNA, 22 nt, Human
ugcugcugauggcaccuaggca

SEQ ID NO: 864212 - RNA, 22 nt, Human
aagaagagaacuggcauccuaa

SEQ ID NO: 864213 - RNA, 22 nt, Human
cacugagcugauagaauuccag

SEQ ID NO: 864214 - RNA, 22 nt, Human
uuuacauuucccucugucaguu

SEQ ID NO: 864215 - RNA, 19 nt, Human
augcuuuauguuauuucuu

SEQ ID NO: 864216 - RNA, 21 nt, Human
gcucagaguauugcacuguuu

SEQ ID NO: 864217 - RNA, 22 nt, Human
gcacaauaacagccaagguuau

SEQ ID NO: 864218 - RNA, 22 nt, Human
gauuucuuuagguguaauagug

SEQ ID NO: 864219 - RNA, 22 nt, Human
ccagaucuucuuuucagugucu

SEQ ID NO: 864220 - RNA, 22 nt, Human
guguugaugacauuuuagaaac

SEQ ID NO: 864221 - RNA, 22 nt, Human
gcugcaggcauuuuccugggca

SEQ ID NO: 864222 - RNA, 22 nt, Human
uggcagcuggaucccaaggcag

SEQ ID NO: 864223 - RNA, 22 nt, Human
gucauauacacugcauguaauc

SEQ ID NO: 864224 - RNA, 23 nt, Human
auuugagaaaguauuuuuaagac

SEQ ID NO: 864225 - RNA, 22 nt, Human
aaauuaguacauugcaaagucc

SEQ ID NO: 864226 - RNA, 21 nt, Human
cuguggaagggaacuagaggg

SEQ ID NO: 864227 - RNA, 22 nt, Human
aaucagaacuucucaggguggg

SEQ ID NO: 864228 - RNA, 22 nt, Human
uugaaagucacaauggcauuaa

SEQ ID NO: 864229 - RNA, 22 nt, Human
auuuccuuugcaaagacugugc

SEQ ID NO: 864230 - RNA, 22 nt, Human
uaaagucaucuuuacaucuuug

SEQ ID NO: 864231 - RNA, 22 nt, Human
auaguuugaaggcuguucuacu

SEQ ID NO: 864232 - RNA, 22 nt, Human
auggagggugucagagagcgaa

SEQ ID NO: 864233 - RNA, 22 nt, Human
gagggaugguaguugacacuga

SEQ ID NO: 864234 - RNA, 22 nt, Human
ggagccuggucagguuggcucc

SEQ ID NO: 864235 - RNA, 22 nt, Human
uauuucagggagaauaaauuug

SEQ ID NO: 864236 - RNA, 22 nt, Human
acacauuucucuuuuuguaagu

SEQ ID NO: 864237 - RNA, 22 nt, Human
acaugcuuccaaauuauguugg

SEQ ID NO: 864238 - RNA, 22 nt, Human
cuggacucugcagagaaaagua

SEQ ID NO: 864239 - RNA, 22 nt, Human
uggcagcucccagagcuuccaa

SEQ ID NO: 864240 - RNA, 22 nt, Human
gcaggcaguuauuuaguagaau

SEQ ID NO: 864241 - RNA, 22 nt, Human
augcuuuaaacuauaaauccac

SEQ ID NO: 864242 - RNA, 22 nt, Human
augcuuaaugaggguauauaug

SEQ ID NO: 864243 - RNA, 22 nt, Human
aggcaguuguagagagggcucu

SEQ ID NO: 864244 - RNA, 22 nt, Human
agacaacaucacuaaagcugag

SEQ ID NO: 864245 - RNA, 22 nt, Human
gcccaggaggcagagguugugg

SEQ ID NO: 864246 - RNA, 22 nt, Human
uaaugucaaggugauagauuug

SEQ ID NO: 864247 - RNA, 22 nt, Human
cuuaaagaaauugaggagagga

SEQ ID NO: 864248 - RNA, 22 nt, Human
uagaauaugauuaauuuucuua

SEQ ID NO: 864249 - RNA, 22 nt, Human
gguacaauggaccauaaaagcu

SEQ ID NO: 864250 - RNA, 22 nt, Human
aaaucucaauuugaauuguagc

SEQ ID NO: 864251 - RNA, 22 nt, Human
agagcagcugugacauggacag

SEQ ID NO: 864252 - RNA, 22 nt, Human
acucuucuugcugcucauuaau

SEQ ID NO: 864253 - RNA, 22 nt, Human
aguguuugagacacauuucacu

SEQ ID NO: 864254 - RNA, 22 nt, Human
guaggcagguggaggagugaag

SEQ ID NO: 864255 - RNA, 21 nt, Human
auacauucuauuaagcauuua

SEQ ID NO: 864256 - RNA, 22 nt, Human
aagguucuaagggaagccaugc

SEQ ID NO: 864257 - RNA, 22 nt, Human
aaauuagucgguuuaggaauuu

SEQ ID NO: 864258 - RNA, 20 nt, Human
gucaggauuaguaaacucug

SEQ ID NO: 864259 - RNA, 22 nt, Human
uauuucuucgggauucaagcua

SEQ ID NO: 864260 - RNA, 22 nt, Human
accaggaggccuggagcacaaa

SEQ ID NO: 864261 - RNA, 22 nt, Human
uggcagcuaucuuuaaugagau

SEQ ID NO: 864262 - RNA, 23 nt, Human
cugcuguguuggucucgauggga

SEQ ID NO: 864263 - RNA, 22 nt, Human
acaacauucuuaaauacacuga

SEQ ID NO: 864264 - RNA, 22 nt, Human
cuuuccaaugcauuuccaaugu

SEQ ID NO: 864265 - RNA, 22 nt, Human
uuuauccaguguuggaauuuuu

SEQ ID NO: 864266 - RNA, 22 nt, Human
cuucuucagcacaauauugaug

SEQ ID NO: 864267 - RNA, 18 nt, Human
caagaaucucuaaagaag

SEQ ID NO: 864268 - RNA, 22 nt, Human
cagcucccgccaucgggaggca

SEQ ID NO: 864269 - RNA, 22 nt, Human
aggaagcucaaagccaugaugu

SEQ ID NO: 864270 - RNA, 22 nt, Human
aacuggauuaacuggcucaaau

SEQ ID NO: 864271 - RNA, 22 nt, Human
auuugcuuucagguauaaaagg

SEQ ID NO: 864272 - RNA, 22 nt, Human
ugucaccacauuugucaauauc

SEQ ID NO: 864273 - RNA, 18 nt, Human
guaggucaguaccaagca

SEQ ID NO: 864274 - RNA, 19 nt, Human
augucuggguaacagcugc

SEQ ID NO: 864275 - RNA, 22 nt, Human
ugaggcagguggauuacaaggu

SEQ ID NO: 864276 - RNA, 22 nt, Human
cggagggguuugaacagaggag

SEQ ID NO: 864277 - RNA, 22 nt, Human
aucaggaugacuauaaggcugc

SEQ ID NO: 864278 - RNA, 22 nt, Human
agucuuuccugcuugacuguuc

SEQ ID NO: 864279 - RNA, 22 nt, Human
cacaauuuggugcuaaagaaag

SEQ ID NO: 864280 - RNA, 22 nt, Human
ugcuggguuaccuaagccuaaa

SEQ ID NO: 864281 - RNA, 23 nt, Human
uuugaaaguaucaacucgccuga

SEQ ID NO: 864282 - RNA, 22 nt, Human
auggaucacagugccgugggug

SEQ ID NO: 864283 - RNA, 20 nt, Human
uaggcagcuugacccuuggu

SEQ ID NO: 864284 - RNA, 17 nt, Human
cuguuaauucauuuccc

SEQ ID NO: 864285 - RNA, 22 nt, Human
uuauuucauugauuucuaagac

SEQ ID NO: 864286 - RNA, 22 nt, Human
gauaucauaucagacaaccucu

SEQ ID NO: 864287 - RNA, 19 nt, Human
guuccaaaggccagaccuu

SEQ ID NO: 864288 - RNA, 22 nt, Human
cagcagaggugguucacauugu

SEQ ID NO: 864289 - RNA, 22 nt, Human
acagagagaaacaaucagcagc

SEQ ID NO: 864290 - RNA, 22 nt, Human
uacagcuaggcaaaaaugacau

SEQ ID NO: 864291 - RNA, 22 nt, Human
aaaucagucccucuuggaauuu

SEQ ID NO: 864292 - RNA, 22 nt, Human
gccaggaguguguggcuauguu

SEQ ID NO: 864293 - RNA, 22 nt, Human
agugcuuugguauagaacuauu

SEQ ID NO: 864294 - RNA, 22 nt, Human
caacuuuaugauugguuuguca

SEQ ID NO: 864295 - RNA, 22 nt, Human
cuguguuugaugagaagccacc

SEQ ID NO: 864296 - RNA, 22 nt, Human
acagugcuggcuacaacccugg

SEQ ID NO: 864297 - RNA, 22 nt, Human
auacagaauuugcccuuuucau

SEQ ID NO: 864298 - RNA, 22 nt, Human
gcugugcuugggaagaaucucu

SEQ ID NO: 864299 - RNA, 18 nt, Human
gagaggagccagaauuuu

SEQ ID NO: 864300 - RNA, 22 nt, Human
gaagcagcuggugagauggagc

SEQ ID NO: 864301 - RNA, 22 nt, Human
agccaacuaggagauuaaggua

SEQ ID NO: 864302 - RNA, 22 nt, Human
ugacuucaagguucagcaccuu

SEQ ID NO: 864303 - RNA, 22 nt, Human
aaauaucauuuauaacuuuuaa

SEQ ID NO: 864304 - RNA, 21 nt, Human
uuccagagauuguuucaccug

SEQ ID NO: 864305 - RNA, 22 nt, Human
uccaugagggacacuggaugcu

SEQ ID NO: 864306 - RNA, 22 nt, Human
agaaguuguagguuugcauauu

SEQ ID NO: 864307 - RNA, 21 nt, Human
auuauuauaaagaccacaggg

SEQ ID NO: 864308 - RNA, 22 nt, Human
aaggagaguacaggaguuggua

SEQ ID NO: 864309 - RNA, 22 nt, Human
ccacugaggcaggcaguaucua

SEQ ID NO: 864310 - RNA, 20 nt, Human
aguacaauguaugauucaga

SEQ ID NO: 864311 - RNA, 22 nt, Human
ucauuucuauugcuacugucug

SEQ ID NO: 864312 - RNA, 22 nt, Human
aggcagcugcccucuccuuccu

SEQ ID NO: 864313 - RNA, 22 nt, Human
ugaggcagcaauuguauuguau

SEQ ID NO: 864314 - RNA, 22 nt, Human
auauucuugugauuauaaagua

SEQ ID NO: 864315 - RNA, 23 nt, Human
uuuggacuugugacucuucuccu

SEQ ID NO: 864316 - RNA, 22 nt, Human
uucacagauuucccugcacaug

SEQ ID NO: 864317 - RNA, 22 nt, Human
auuuguagugaagugaaaauaa

SEQ ID NO: 864318 - RNA, 22 nt, Human
uauguuauuuucauacaacaga

SEQ ID NO: 864319 - RNA, 22 nt, Human
gcagcuucaguaggugaagaca

SEQ ID NO: 864320 - RNA, 22 nt, Human
cuacccagagugaaucucuuaa

SEQ ID NO: 864321 - RNA, 22 nt, Human
uguccuuaaggagcuuaauguc

SEQ ID NO: 864322 - RNA, 22 nt, Human
aggcagccaucugcaggaagga

SEQ ID NO: 864323 - RNA, 22 nt, Human
cugcuucuccaaaguaggacuu

SEQ ID NO: 864324 - RNA, 22 nt, Human
cauuuccagcuccugcaucaug

SEQ ID NO: 864325 - RNA, 22 nt, Human
uuucaggguacauggagcaaau

SEQ ID NO: 864326 - RNA, 22 nt, Human
uuuccaaaggcuaaacucaguu

SEQ ID NO: 864327 - RNA, 19 nt, Human
uuugaaaggauuguuauuu

SEQ ID NO: 864328 - RNA, 22 nt, Human
cuggccagaguuggagggugug

SEQ ID NO: 864329 - RNA, 22 nt, Human
gggagacacgcugcaggcauaa

SEQ ID NO: 864330 - RNA, 22 nt, Human
ucucaggaaauaggauuugagu

SEQ ID NO: 864331 - RNA, 21 nt, Human
agaauucuuaaguauucuaau

SEQ ID NO: 864332 - RNA, 22 nt, Human
uugcccagaguccacagcguac

SEQ ID NO: 864333 - RNA, 18 nt, Human
gcacuucacccagcuagu

SEQ ID NO: 864334 - RNA, 22 nt, Human
auagaauucguguuuguaauuc

SEQ ID NO: 864335 - RNA, 22 nt, Human
gagcagcuccagccgcaugacu

SEQ ID NO: 864336 - RNA, 22 nt, Human
ccuucauugcaucuuuaagaga

SEQ ID NO: 864337 - RNA, 22 nt, Human
ccagaauucagaaagggcauaa

SEQ ID NO: 864338 - RNA, 22 nt, Human
auagaauuugcacuaaaucugc

SEQ ID NO: 864339 - RNA, 22 nt, Human
caucagaaucugagucucugcc

SEQ ID NO: 864340 - RNA, 22 nt, Human
ggaggugggcuaaggacucucu

SEQ ID NO: 864341 - RNA, 22 nt, Human
uugaagaggacuuugcagcugu

SEQ ID NO: 864342 - RNA, 22 nt, Human
uuacagaaaagggcuuuaagag

SEQ ID NO: 864343 - RNA, 18 nt, Human
cauuguacaaugcuuuau

SEQ ID NO: 864344 - RNA, 22 nt, Human
cagcaggauaugguggagagag

SEQ ID NO: 864345 - RNA, 21 nt, Human
aucacauuggcuguuauuauu

SEQ ID NO: 864346 - RNA, 22 nt, Human
agaagugagugugacucagcag

SEQ ID NO: 864347 - RNA, 22 nt, Human
auggaucagaaucccgggaggg

SEQ ID NO: 864348 - RNA, 22 nt, Human
caauuucacuaauaauauuuac

SEQ ID NO: 864349 - RNA, 22 nt, Human
ucugggaaguccucugucaugc

SEQ ID NO: 864350 - RNA, 22 nt, Human
uaauuauucuagucacauagca

SEQ ID NO: 864351 - RNA, 22 nt, Human
uagugcuuuaggccugaguguc

SEQ ID NO: 864352 - RNA, 21 nt, Human
auggcuuuuuuaaagcuugug

SEQ ID NO: 864353 - RNA, 21 nt, Human
ugaaagaaggugcagucugaa

SEQ ID NO: 864354 - RNA, 22 nt, Human
agagggagcccagucauagcug

SEQ ID NO: 864355 - RNA, 22 nt, Human
uucuuuucuuuaggcauugugu

SEQ ID NO: 864356 - RNA, 22 nt, Human
auucuucacauaagugcuguac

SEQ ID NO: 864357 - RNA, 22 nt, Human
aggagaggucucccuuccccag

SEQ ID NO: 864358 - RNA, 22 nt, Human
gagaggcagaggccugaaaccg

SEQ ID NO: 864359 - RNA, 22 nt, Human
accaggagucuagccuagucaa

SEQ ID NO: 864360 - RNA, 22 nt, Human
cuucucagaucucagcuuugag

SEQ ID NO: 864361 - RNA, 22 nt, Human
ggagaagggacagacucagcuu

SEQ ID NO: 864362 - RNA, 20 nt, Human
cugcccagccacugagggau

SEQ ID NO: 864363 - RNA, 22 nt, Human
uagcacauuguugaccagaagg

SEQ ID NO: 864364 - RNA, 22 nt, Human
auuaggcaauucugggcaucuc

SEQ ID NO: 864365 - RNA, 22 nt, Human
uuguuuuaucuuucuacagacu

SEQ ID NO: 864366 - RNA, 22 nt, Human
cagggaggcugucuuaugccug

SEQ ID NO: 864367 - RNA, 22 nt, Human
gcaacuuuagggccagcaagua

SEQ ID NO: 864368 - RNA, 22 nt, Human
ucucuucuauuugagacuauuu

SEQ ID NO: 864369 - RNA, 22 nt, Human
uacaguaagaugaaauagcaau

SEQ ID NO: 864370 - RNA, 22 nt, Human
agcuucuuggcucagcacuugg

SEQ ID NO: 864371 - RNA, 19 nt, Human
uagaggagaagggaagugg

SEQ ID NO: 864372 - RNA, 22 nt, Human
aaauagauugcugaggcauuac

SEQ ID NO: 864373 - RNA, 21 nt, Human
uuugaaagcccuauguuuuca

SEQ ID NO: 864374 - RNA, 22 nt, Human
gcaaacaagcugccugaagauu

SEQ ID NO: 864375 - RNA, 22 nt, Human
aaggcagccauagcaccaucca

SEQ ID NO: 864376 - RNA, 22 nt, Human
ccuggagagagaggccaacugc

SEQ ID NO: 864377 - RNA, 22 nt, Human
aguggcagagccaaguagagcc

SEQ ID NO: 864378 - RNA, 22 nt, Human
aaggcagccagauccuuugggu

SEQ ID NO: 864379 - RNA, 22 nt, Human
agauaaugaaugccaugacauu

SEQ ID NO: 864380 - RNA, 22 nt, Human
gcagaggauagcauaugaaccu

SEQ ID NO: 864381 - RNA, 22 nt, Human
ggaggaggggugacugaaugcu

SEQ ID NO: 864382 - RNA, 22 nt, Human
aaugauuuccccuacacagaag

SEQ ID NO: 864383 - RNA, 22 nt, Human
auucuucaccauggauaauuug

SEQ ID NO: 864384 - RNA, 21 nt, Human
auacagaagguggcaaaguac

SEQ ID NO: 864385 - RNA, 22 nt, Human
aaaaugaugcuguaauuuggca

SEQ ID NO: 864386 - RNA, 23 nt, Human
agcacacuuguacaaugcccuag

SEQ ID NO: 864387 - RNA, 22 nt, Human
aggcagucuaucucuggagccu

SEQ ID NO: 864388 - RNA, 22 nt, Human
aggguagggccguagggccaug

SEQ ID NO: 864389 - RNA, 22 nt, Human
aguaaacacugucuuuauauau

SEQ ID NO: 864390 - RNA, 22 nt, Human
uuagccauugucagcacauggc

SEQ ID NO: 864391 - RNA, 22 nt, Human
guuuaauaauguugaauuacua

SEQ ID NO: 864392 - RNA, 22 nt, Human
uuauucuuuaaacauauauguu

SEQ ID NO: 864393 - RNA, 22 nt, Human
aaaguccuguuugaaggaccug

SEQ ID NO: 864394 - RNA, 20 nt, Human
aggcagcuggccaggcaggu

SEQ ID NO: 864395 - RNA, 22 nt, Human
acuauacaguauguacgugcac

SEQ ID NO: 864396 - RNA, 22 nt, Human
auuauuauuguugauguuaggg

SEQ ID NO: 864397 - RNA, 22 nt, Human
uuacagaauguucuuccaacag

SEQ ID NO: 864398 - RNA, 22 nt, Human
aucuugcauuugcuaaaaugca

SEQ ID NO: 864399 - RNA, 22 nt, Human
aggcagcguagcaaggcuagua

SEQ ID NO: 864400 - RNA, 22 nt, Human
uucuucuccuaaggagaguccu

SEQ ID NO: 864401 - RNA, 22 nt, Human
aguacaacauuagaguaucuua

SEQ ID NO: 864402 - RNA, 22 nt, Human
gaggccagggaugcaaugagag

SEQ ID NO: 864403 - RNA, 19 nt, Human
gaggagcuaucggagacag

SEQ ID NO: 864404 - RNA, 21 nt, Human
agcagaggcugccuggugacu

SEQ ID NO: 864405 - RNA, 22 nt, Human
acacagauuuuacauguuaugc

SEQ ID NO: 864406 - RNA, 22 nt, Human
aaucuuucccuauuaaaugugg

SEQ ID NO: 864407 - RNA, 22 nt, Human
ugaaugaguuuggcugcuguuc

SEQ ID NO: 864408 - RNA, 20 nt, Human
agcugccccugggcacugcc

SEQ ID NO: 864409 - RNA, 19 nt, Human
uuucuuaggccuuuggccu

SEQ ID NO: 864410 - RNA, 22 nt, Human
aauagaaaggaggggcucuugu

SEQ ID NO: 864411 - RNA, 22 nt, Human
ugcuuuaacauaagauaucuuu

SEQ ID NO: 864412 - RNA, 22 nt, Human
uaagaaacccaggaauuucuua

SEQ ID NO: 864413 - RNA, 22 nt, Human
ucaggauggcuucugcaucaaa

SEQ ID NO: 864414 - RNA, 22 nt, Human
aaaggccaagcaugagguggac

SEQ ID NO: 864415 - RNA, 22 nt, Human
gggcagcuggauaguuuuaaau

SEQ ID NO: 864416 - RNA, 22 nt, Human
uugcuucaguagcucuuuaaag

SEQ ID NO: 864417 - RNA, 22 nt, Human
aaauucaauuaacuuucaugcu

SEQ ID NO: 864418 - RNA, 22 nt, Human
caggaugaagggcaaaggcaag

SEQ ID NO: 864419 - RNA, 22 nt, Human
gaagcagccacggggagacaga

SEQ ID NO: 864420 - RNA, 22 nt, Human
uuaacacuccuaacuacagucu

SEQ ID NO: 864421 - RNA, 22 nt, Human
gcauggcugguguccugaggga

SEQ ID NO: 864422 - RNA, 22 nt, Human
acgagagguccuuagaaucugu

SEQ ID NO: 864423 - RNA, 20 nt, Human
agggcagcuugaggagccgg

SEQ ID NO: 864424 - RNA, 22 nt, Human
cuuuuccacugagccucacaaa

SEQ ID NO: 864425 - RNA, 22 nt, Human
gcucaggagcucuugguggcgc

SEQ ID NO: 864426 - RNA, 22 nt, Human
uugacaauguccuuugaauuuc

SEQ ID NO: 864427 - RNA, 22 nt, Human
cugaacucuuuaugacagcuug

SEQ ID NO: 864428 - RNA, 22 nt, Human
auuucaggauagccuaguuuug

SEQ ID NO: 864429 - RNA, 22 nt, Human
gacagaggcuggagcaccuccu

SEQ ID NO: 864430 - RNA, 22 nt, Human
uucugagacaauugagagucua

SEQ ID NO: 864431 - RNA, 22 nt, Human
acaaaugugucuaauugugccu

SEQ ID NO: 864432 - RNA, 22 nt, Human
aaggcaguagguguuucaaacu

SEQ ID NO: 864433 - RNA, 22 nt, Human
ucagaaaagguagcugugacaa

SEQ ID NO: 864434 - RNA, 22 nt, Human
aagcagcuuuugaagagugagg

SEQ ID NO: 864435 - RNA, 22 nt, Human
cagaccagaaggaagccgacaa

SEQ ID NO: 864436 - RNA, 22 nt, Human
uuuucaguaaugucuacauaau

SEQ ID NO: 864437 - RNA, 22 nt, Human
gaauagcuuccuuuuuuccaaa

SEQ ID NO: 864438 - RNA, 22 nt, Human
aaugugaucgcuuuagaagcuu

SEQ ID NO: 864439 - RNA, 22 nt, Human
agaggccacuuugccugugaug

SEQ ID NO: 864440 - RNA, 19 nt, Human
uauggcaggccgaggcacu

SEQ ID NO: 864441 - RNA, 22 nt, Human
gcuccucuucucccacugaaug

SEQ ID NO: 864442 - RNA, 22 nt, Human
acccaggagccgugagagguua

SEQ ID NO: 864443 - RNA, 22 nt, Human
auguauccuuauacacauuuau

SEQ ID NO: 864444 - RNA, 19 nt, Human
uggcaucuguaaaauggug

SEQ ID NO: 864445 - RNA, 23 nt, Human
uguaacaauucccagccuuugcc

SEQ ID NO: 864446 - RNA, 22 nt, Human
uagauuuuacuucugucauuac

SEQ ID NO: 864447 - RNA, 22 nt, Human
uuagaaaugauuucaccucuuu

SEQ ID NO: 864448 - RNA, 19 nt, Human
cccaggaggcggagguugc

SEQ ID NO: 864449 - RNA, 22 nt, Human
agcuucccaagguuggaagguu

SEQ ID NO: 864450 - RNA, 22 nt, Human
aauacugagaucccacaaagca

SEQ ID NO: 864451 - RNA, 22 nt, Human
gaggcagagaccuucaggaccu

SEQ ID NO: 864452 - RNA, 22 nt, Human
ucacaaaugaggaaaucgagca

SEQ ID NO: 864453 - RNA, 22 nt, Human
cccaggagcuucucucugccuc

SEQ ID NO: 864454 - RNA, 22 nt, Human
cauuuuaagaugaccugguuuc

SEQ ID NO: 864455 - RNA, 22 nt, Human
aguaaaaauugaggugcaaaau

SEQ ID NO: 864456 - RNA, 20 nt, Human
uuucaguugguuaauggcau

SEQ ID NO: 864457 - RNA, 22 nt, Human
cacaaaugugcagaaaugugag

SEQ ID NO: 864458 - RNA, 22 nt, Human
gcagaggcuguagggaagguug

SEQ ID NO: 864459 - RNA, 22 nt, Human
guagaaauagugguugacagga

SEQ ID NO: 864460 - RNA, 22 nt, Human
aaggcagucugguuucaaagca

SEQ ID NO: 864461 - RNA, 22 nt, Human
uggcagcuauggucuaagggcc

SEQ ID NO: 864462 - RNA, 22 nt, Human
uugcaggaaacugagugugagc

SEQ ID NO: 864463 - RNA, 22 nt, Human
uucacagacuuuccauagauug

SEQ ID NO: 864464 - RNA, 22 nt, Human
agaggcagcagucauacuacag

SEQ ID NO: 864465 - RNA, 22 nt, Human
uccauuuuagaagaaaauccac

SEQ ID NO: 864466 - RNA, 22 nt, Human
agggcagcccuucugggagggc

SEQ ID NO: 864467 - RNA, 22 nt, Human
cagcugacagugaggugggggc

SEQ ID NO: 864468 - RNA, 22 nt, Human
cugcuuuguaaaauagacauaa

SEQ ID NO: 864469 - RNA, 21 nt, Human
gggugggaggacacagcaggc

SEQ ID NO: 864470 - RNA, 22 nt, Human
guccucugaaguugugcaaugc

SEQ ID NO: 864471 - RNA, 22 nt, Human
cugaggaagacagcagcugugu

SEQ ID NO: 864472 - RNA, 22 nt, Human
auucaaguccagcuucucuaca

SEQ ID NO: 864473 - RNA, 22 nt, Human
cagcagagggagccauugaaau

SEQ ID NO: 864474 - RNA, 21 nt, Human
ucacuagugccuucugucauu

SEQ ID NO: 864475 - RNA, 22 nt, Human
cacaauuuccaagucauguuau

SEQ ID NO: 864476 - RNA, 22 nt, Human
gcccaggaguucaagucuagug

SEQ ID NO: 864477 - RNA, 22 nt, Human
augaaacaguguguauagcaaa

SEQ ID NO: 864478 - RNA, 22 nt, Human
gcugccagcuuuccuuggcuga

SEQ ID NO: 864479 - RNA, 22 nt, Human
uugaaggacauccuauuucuag

SEQ ID NO: 864480 - RNA, 22 nt, Human
uuuauuuggcauccagggagaa

SEQ ID NO: 864481 - RNA, 23 nt, Human
aaacugcuuccaauuccugccau

SEQ ID NO: 864482 - RNA, 22 nt, Human
augaaaauacugugguugauag

SEQ ID NO: 864483 - RNA, 22 nt, Human
uaauuucaaguuuagggcucua

SEQ ID NO: 864484 - RNA, 22 nt, Human
uuucuuaguccuagagugauuu

SEQ ID NO: 864485 - RNA, 23 nt, Human
gugcugugagccccuuggccucc

SEQ ID NO: 864486 - RNA, 22 nt, Human
acccaggagagagcuauaaaau

SEQ ID NO: 864487 - RNA, 22 nt, Human
agaccuggauuccaauccuacc

SEQ ID NO: 864488 - RNA, 22 nt, Human
auuuguugcuagcagcacugau

SEQ ID NO: 864489 - RNA, 19 nt, Human
agccuggcuuugcucugcu

SEQ ID NO: 864490 - RNA, 22 nt, Human
agaaacauccugcuuuccauuu

SEQ ID NO: 864491 - RNA, 22 nt, Human
aaauuguugaucuacaguaagg

SEQ ID NO: 864492 - RNA, 22 nt, Human
gcuugaaaauucauagguauuu

SEQ ID NO: 864493 - RNA, 22 nt, Human
gaggcagcagaacauggaagag

SEQ ID NO: 864494 - RNA, 22 nt, Human
uugauggcugugauuuacucag

SEQ ID NO: 864495 - RNA, 22 nt, Human
ucacauaaauuauacaauuuca

SEQ ID NO: 864496 - RNA, 22 nt, Human
gcccaggaaagauagggccuca

SEQ ID NO: 864497 - RNA, 18 nt, Human
ugagaggcagguagagga

SEQ ID NO: 864498 - RNA, 22 nt, Human
uuuaaagaaauuccucaucuuu

SEQ ID NO: 864499 - RNA, 22 nt, Human
uagaauucaagauucaacaggc

SEQ ID NO: 864500 - RNA, 22 nt, Human
gaauuucagaucagagaccauu

SEQ ID NO: 864501 - RNA, 22 nt, Human
cuuaggcaagcagagcccaucc

SEQ ID NO: 864502 - RNA, 22 nt, Human
ugaggcagcccacuuuccuuag

SEQ ID NO: 864503 - RNA, 22 nt, Human
aucuauacucagaguuaauauc

SEQ ID NO: 864504 - RNA, 22 nt, Human
ugaggggagacagaguggacuc

SEQ ID NO: 864505 - RNA, 22 nt, Human
aaaccgcaauuacuuuugcguc

SEQ ID NO: 864506 - RNA, 22 nt, Human
ugucaccaaguugaugaaugca

SEQ ID NO: 864507 - RNA, 22 nt, Human
acccaggacaaaauaaccaggu

SEQ ID NO: 864508 - RNA, 20 nt, Human
uuccaacucacaucucuaca

SEQ ID NO: 864509 - RNA, 17 nt, Human
uaaguccuaguuauuuu

SEQ ID NO: 864510 - RNA, 22 nt, Human
uagcacaucuggcgcuuauagg

SEQ ID NO: 864511 - RNA, 22 nt, Human
caguccuugcuaugacccugag

SEQ ID NO: 864512 - RNA, 21 nt, Human
uccuuccuugagguccuuucc

SEQ ID NO: 864513 - RNA, 22 nt, Human
cagucucuugcuucauuaguug

SEQ ID NO: 864514 - RNA, 22 nt, Human
aggaaaacacaguauugaugga

SEQ ID NO: 864515 - RNA, 22 nt, Human
ugaggggagcuagcaugccuug

SEQ ID NO: 864516 - RNA, 22 nt, Human
acuauacauugaauguuaaggu

SEQ ID NO: 864517 - RNA, 22 nt, Human
agcccaggucucaaaguacagg

SEQ ID NO: 864518 - RNA, 22 nt, Human
guaaauuauuucaagaucaucu

SEQ ID NO: 864519 - RNA, 23 nt, Human
agggagcuaaaaggcuggagcag

SEQ ID NO: 864520 - RNA, 22 nt, Human
uucacagaugccugaugugugg

SEQ ID NO: 864521 - RNA, 22 nt, Human
agccaacuaauuaaacaacuuu

SEQ ID NO: 864522 - RNA, 22 nt, Human
ugcacauucacuuagguauugu

SEQ ID NO: 864523 - RNA, 22 nt, Human
uuuaacagaugugaaauuuuca

SEQ ID NO: 864524 - RNA, 22 nt, Human
gcccaggauucuuucuuccuua

SEQ ID NO: 864525 - RNA, 22 nt, Human
ugacauaauaauccaaacauac

SEQ ID NO: 864526 - RNA, 22 nt, Human
uggcagcagacaaaaggccauu

SEQ ID NO: 864527 - RNA, 22 nt, Human
uuuuuugucuugaagaaauggu

SEQ ID NO: 864528 - RNA, 22 nt, Human
ccucaggaaccacauugcugcu

SEQ ID NO: 864529 - RNA, 22 nt, Human
ggauuuacaaguuuaacucuca

SEQ ID NO: 864530 - RNA, 22 nt, Human
uuucauaaggguuucuagacuu

SEQ ID NO: 864531 - RNA, 22 nt, Human
uacaaaaaauugauacugacga

SEQ ID NO: 864532 - RNA, 22 nt, Human
uccaggagauucauuaggucau

SEQ ID NO: 864533 - RNA, 17 nt, Human
uccauacaauucucucu

SEQ ID NO: 864534 - RNA, 22 nt, Human
gugaauaauuuuuuaguauaag

SEQ ID NO: 864535 - RNA, 22 nt, Human
auagucacugccuuccauuugu

SEQ ID NO: 864536 - RNA, 22 nt, Human
uuuuaguguagucaccgugggu

SEQ ID NO: 864537 - RNA, 22 nt, Human
agaucauaugaaaaauuucaag

SEQ ID NO: 864538 - RNA, 22 nt, Human
cccauugugguuguugaggaua

SEQ ID NO: 864539 - RNA, 22 nt, Human
aacuuugaggucacugaauucc

SEQ ID NO: 864540 - RNA, 22 nt, Human
aacaugcugccuuucuacgagu

SEQ ID NO: 864541 - RNA, 22 nt, Human
cugcccaggaaccagaggggca

SEQ ID NO: 864542 - RNA, 22 nt, Human
cgucuuccucuuacgaugcgcu

SEQ ID NO: 864543 - RNA, 22 nt, Human
uuugaacaugcugcaugauaau

SEQ ID NO: 864544 - RNA, 22 nt, Human
uuuaggcaaacucauugucaga

SEQ ID NO: 864545 - RNA, 22 nt, Human
gaccauuuguugaaaagauuau

SEQ ID NO: 864546 - RNA, 22 nt, Human
guucuaauuuggggcuccuuag

SEQ ID NO: 864547 - RNA, 22 nt, Human
uucucugaucuugcuagacuga

SEQ ID NO: 864548 - RNA, 22 nt, Human
agggggugucucugauuggguu

SEQ ID NO: 864549 - RNA, 21 nt, Human
uuugaaagugggugauucuuu

SEQ ID NO: 864550 - RNA, 22 nt, Human
uuucacacaacgugaauauacu

SEQ ID NO: 864551 - RNA, 22 nt, Human
ucccaggaaggauucggcauuu

SEQ ID NO: 864552 - RNA, 22 nt, Human
aauaauauuugaagcuucaaag

SEQ ID NO: 864553 - RNA, 22 nt, Human
caaguccucugguuucaaauag

SEQ ID NO: 864554 - RNA, 22 nt, Human
uagcuuuccuuguugccugugc

SEQ ID NO: 864555 - RNA, 22 nt, Human
ggcagcuuucaauaggguuaug

SEQ ID NO: 864556 - RNA, 22 nt, Human
agucucugucguagaucagcgu

SEQ ID NO: 864557 - RNA, 22 nt, Human
cccaggaggcagagauagcagu

SEQ ID NO: 864558 - RNA, 22 nt, Human
ugucugugaccucuuaggcaag

SEQ ID NO: 864559 - RNA, 22 nt, Human
augaaacacacacgcgcauacu

SEQ ID NO: 864560 - RNA, 22 nt, Human
ugcauguguguguauuuauaaa

SEQ ID NO: 864561 - RNA, 22 nt, Human
ucaggauguccaaaauccagcc

SEQ ID NO: 864562 - RNA, 22 nt, Human
acauaauagguaccugaauaau

SEQ ID NO: 864563 - RNA, 21 nt, Human
uucucagagucuauuacaguu

SEQ ID NO: 864564 - RNA, 22 nt, Human
caauuuuuaaacuaugaaguug

SEQ ID NO: 864565 - RNA, 22 nt, Human
aguggcaggcggagauguagga

SEQ ID NO: 864566 - RNA, 22 nt, Human
auucuuauuauaguaaaacagu

SEQ ID NO: 864567 - RNA, 22 nt, Human
guuuauaaggcccaauauuucu

SEQ ID NO: 864568 - RNA, 23 nt, Human
ucagucuucccugucaguaauag

SEQ ID NO: 864569 - RNA, 22 nt, Human
auuccaaaaggauguuagaaug

SEQ ID NO: 864570 - RNA, 22 nt, Human
uagaaauguugguauuaacauu

SEQ ID NO: 864571 - RNA, 17 nt, Human
uucaaagcuuaucaagg

SEQ ID NO: 864572 - RNA, 22 nt, Human
uauuucaacguaugaaaagcug

SEQ ID NO: 864573 - RNA, 18 nt, Human
uacagauuauagauacau

SEQ ID NO: 864574 - RNA, 19 nt, Human
uuugaaagaguuuuauugg

SEQ ID NO: 864575 - RNA, 22 nt, Human
uaaagcaguguugggucggacg

SEQ ID NO: 864576 - RNA, 22 nt, Human
ucacagaagaugcuggauguug

SEQ ID NO: 864577 - RNA, 22 nt, Human
ggcauuuagauugaauuucugu

SEQ ID NO: 864578 - RNA, 22 nt, Human
aaaucaguuguuauauuaaaga

SEQ ID NO: 864579 - RNA, 22 nt, Human
uauuuuaucugccagaguggag

SEQ ID NO: 864580 - RNA, 19 nt, Human
aacuggauaauggccacau

SEQ ID NO: 864581 - RNA, 21 nt, Human
cucaggauggcggccuggugg

SEQ ID NO: 864582 - RNA, 22 nt, Human
agcugccgaugcccagcugcau

SEQ ID NO: 864583 - RNA, 22 nt, Human
ucccaggaagaucccagggacc

SEQ ID NO: 864584 - RNA, 22 nt, Human
agacugaauaacaagcaaauaa

SEQ ID NO: 864585 - RNA, 22 nt, Human
ugcauggacucaucagacaaga

SEQ ID NO: 864586 - RNA, 22 nt, Human
uuacagaaggaacacuacucag

SEQ ID NO: 864587 - RNA, 22 nt, Human
aucaggaucaugcuggguggga

SEQ ID NO: 864588 - RNA, 22 nt, Human
gaaauauugggacucagagcuu

SEQ ID NO: 864589 - RNA, 22 nt, Human
ccuauacagccucagcugagau

SEQ ID NO: 864590 - RNA, 22 nt, Human
cagaggcagccgggggagaacg

SEQ ID NO: 864591 - RNA, 22 nt, Human
ucuggaucuccagcacuuauca

SEQ ID NO: 864592 - RNA, 22 nt, Human
ucagucuuugcuuaugacaaua

SEQ ID NO: 864593 - RNA, 22 nt, Human
uuucucaguuacuagcuguggu

SEQ ID NO: 864594 - RNA, 22 nt, Human
auaucagacagaaagcauugac

SEQ ID NO: 864595 - RNA, 22 nt, Human
ugucucugggugauucaguccu

SEQ ID NO: 864596 - RNA, 22 nt, Human
auaaaauuugcuacuguuaaau

SEQ ID NO: 864597 - RNA, 23 nt, Human
cuugcagggcuggaggcuuagaa

SEQ ID NO: 864598 - RNA, 22 nt, Human
uagggaggaggguuuucaaauc

SEQ ID NO: 864599 - RNA, 19 nt, Human
agacagagcucaguggguu

SEQ ID NO: 864600 - RNA, 22 nt, Human
gcuucacacuaaaaauguuaaa

SEQ ID NO: 864601 - RNA, 22 nt, Human
augugaggcagcacggagauua

SEQ ID NO: 864602 - RNA, 22 nt, Human
guggcagcggugugcaaggagg

SEQ ID NO: 864603 - RNA, 22 nt, Human
gaggcagagugcaccccaggag

SEQ ID NO: 864604 - RNA, 22 nt, Human
uacagacaguuuuucagauauu

SEQ ID NO: 864605 - RNA, 22 nt, Human
ugcccacauggugccauggcca

SEQ ID NO: 864606 - RNA, 22 nt, Human
uuuguaugugauaagacuauuc

SEQ ID NO: 864607 - RNA, 22 nt, Human
uguccuuagaagaagugaaaga

SEQ ID NO: 864608 - RNA, 22 nt, Human
augcuuaacucuguacauaguu

SEQ ID NO: 864609 - RNA, 22 nt, Human
uagaagcaguaauagaaauagg

SEQ ID NO: 864610 - RNA, 22 nt, Human
uucuucuuaauguccugggaac

SEQ ID NO: 864611 - RNA, 22 nt, Human
uucauugugaacacauucugcc

SEQ ID NO: 864612 - RNA, 22 nt, Human
uuucaaaauuuugcagugguaa

SEQ ID NO: 864613 - RNA, 22 nt, Human
uggcagcugagugcacccccuc

SEQ ID NO: 864614 - RNA, 22 nt, Human
aaauaguucagcuuguaaaccc

SEQ ID NO: 864615 - RNA, 22 nt, Human
uacaggaaguaaguaaugaaau

SEQ ID NO: 864616 - RNA, 23 nt, Human
acuauaaaguuguucugauuuac

SEQ ID NO: 864617 - RNA, 22 nt, Human
ucagugaucuaaggguauggcc

SEQ ID NO: 864618 - RNA, 22 nt, Human
cuaaaauuaucaagauaauucc

SEQ ID NO: 864619 - RNA, 22 nt, Human
aaccauuugcaguuacugagac

SEQ ID NO: 864620 - RNA, 17 nt, Human
gagacagcaggagcccc

SEQ ID NO: 864621 - RNA, 22 nt, Human
gcuggaucccugugggaguggu

SEQ ID NO: 864622 - RNA, 22 nt, Human
uugcacuaggaaaaggcagcca

SEQ ID NO: 864623 - RNA, 22 nt, Human
uauggcuuuuaacugucguaug

SEQ ID NO: 864624 - RNA, 22 nt, Human
acaugcuucauauuauaaccaa

SEQ ID NO: 864625 - RNA, 22 nt, Human
gccaggagccagcuucuuagca

SEQ ID NO: 864626 - RNA, 22 nt, Human
uacagaaaaacuggcauugaag

SEQ ID NO: 864627 - RNA, 22 nt, Human
caauuuuuuccaugcucuuaca

SEQ ID NO: 864628 - RNA, 20 nt, Human
agaggccaguuaggagucua

SEQ ID NO: 864629 - RNA, 22 nt, Human
uucagaaaucgaguuucauguc

SEQ ID NO: 864630 - RNA, 22 nt, Human
uuucagggagccuagaagagcu

SEQ ID NO: 864631 - RNA, 22 nt, Human
cccaagagguggagguugcagu

SEQ ID NO: 864632 - RNA, 22 nt, Human
cugcugugucagaguccagggg

SEQ ID NO: 864633 - RNA, 22 nt, Human
cugggaaauggcuucgagcuca

SEQ ID NO: 864634 - RNA, 22 nt, Human
cucucagacugaagggccugug

SEQ ID NO: 864635 - RNA, 22 nt, Human
caaauguauaaauguacuuucu

SEQ ID NO: 864636 - RNA, 22 nt, Human
ucagaaaugaucguuauucauu

SEQ ID NO: 864637 - RNA, 22 nt, Human
uggagacugugcuaagggaguu

SEQ ID NO: 864638 - RNA, 22 nt, Human
aggcagcuggaaaacuccaggc

SEQ ID NO: 864639 - RNA, 22 nt, Human
uuggaucacucugaagccuuac

SEQ ID NO: 864640 - RNA, 21 nt, Human
uuucuuaggcucuaaaaugac

SEQ ID NO: 864641 - RNA, 22 nt, Human
acucaggaauggggcugggacu

SEQ ID NO: 864642 - RNA, 22 nt, Human
ucuucacauggaacaugaagcu

SEQ ID NO: 864643 - RNA, 22 nt, Human
aaggccagccugagagcuaaca

SEQ ID NO: 864644 - RNA, 22 nt, Human
gcuggcuugauaguuucugcuu

SEQ ID NO: 864645 - RNA, 22 nt, Human
uucauugugauucuuggcuagc

SEQ ID NO: 864646 - RNA, 22 nt, Human
uaggaggguuagagggaaauau

SEQ ID NO: 864647 - RNA, 22 nt, Human
guucuaauaggagaaaagacag

SEQ ID NO: 864648 - RNA, 22 nt, Human
uaauuucaccguugcuagaaau

SEQ ID NO: 864649 - RNA, 22 nt, Human
aaagccauuacaaaauuucaua

SEQ ID NO: 864650 - RNA, 22 nt, Human
aaaucaguaaauguucauuaac

SEQ ID NO: 864651 - RNA, 22 nt, Human
ucaucugucccaggcuuuuuuc

SEQ ID NO: 864652 - RNA, 22 nt, Human
agucucuuauucccuauugcug

SEQ ID NO: 864653 - RNA, 22 nt, Human
gaggcgagaagcuggagauggu

SEQ ID NO: 864654 - RNA, 22 nt, Human
cugcugugagugguucuugccu

SEQ ID NO: 864655 - RNA, 22 nt, Human
uuuuuuaguuaggucagaaugu

SEQ ID NO: 864656 - RNA, 22 nt, Human
cccaggaguuagagguuguggu

SEQ ID NO: 864657 - RNA, 22 nt, Human
uaucauaaguuaauuaaacagu

SEQ ID NO: 864658 - RNA, 22 nt, Human
ucugucuucaucagcaugugau

SEQ ID NO: 864659 - RNA, 22 nt, Human
acagucuacuugagcuuguaua

SEQ ID NO: 864660 - RNA, 22 nt, Human
auggcagccugagcagaggaau

SEQ ID NO: 864661 - RNA, 22 nt, Human
gagggugggccagauaugaggg

SEQ ID NO: 864662 - RNA, 22 nt, Human
ugugaacuggcagguggacggg

SEQ ID NO: 864663 - RNA, 17 nt, Human
agagggaaaaugcgguu

SEQ ID NO: 864664 - RNA, 22 nt, Human
uccaugaguuugaggaaaagag

SEQ ID NO: 864665 - RNA, 22 nt, Human
aacaaacaaacauuuugucauc

SEQ ID NO: 864666 - RNA, 22 nt, Human
uccaggaggguuuucugccuuc

SEQ ID NO: 864667 - RNA, 22 nt, Human
uauccaaaggaacaaucacagc

SEQ ID NO: 864668 - RNA, 22 nt, Human
ugaaucauggauaaauagcuua

SEQ ID NO: 864669 - RNA, 21 nt, Human
auacagaacauugauccaaga

SEQ ID NO: 864670 - RNA, 22 nt, Human
caaugaaaauuuaaguugcagc

SEQ ID NO: 864671 - RNA, 22 nt, Human
aucaggauagucuguaaauugu

SEQ ID NO: 864672 - RNA, 22 nt, Human
uagcacaucuucuuggccugca

SEQ ID NO: 864673 - RNA, 22 nt, Human
aaguccuucuuuauaugagagu

SEQ ID NO: 864674 - RNA, 22 nt, Human
cugucauugagccugucagggc

SEQ ID NO: 864675 - RNA, 22 nt, Human
gcucaggaucagccaccucuuu

SEQ ID NO: 864676 - RNA, 22 nt, Human
ucuucagacccuuagcugugau

SEQ ID NO: 864677 - RNA, 22 nt, Human
uuucuagugguuaagauuuaca

SEQ ID NO: 864678 - RNA, 22 nt, Human
uugaaaguuaucuagauucuga

SEQ ID NO: 864679 - RNA, 22 nt, Human
cagcuucugcuaucgaacaucu

SEQ ID NO: 864680 - RNA, 22 nt, Human
acaugcuuguuuuucacaaccu

SEQ ID NO: 864681 - RNA, 16 nt, Human
ucccaggaggcggaac

SEQ ID NO: 864682 - RNA, 22 nt, Human
uugcugugucugauggcugaga

SEQ ID NO: 864683 - RNA, 22 nt, Human
ucuacagacagagcagguggga

SEQ ID NO: 864684 - RNA, 22 nt, Human
uucuucuuuccuauaauuaauu

SEQ ID NO: 864685 - RNA, 22 nt, Human
aauaauaagauacuaagggagu

SEQ ID NO: 864686 - RNA, 22 nt, Human
cucuggcuucuaccuugcaguu

SEQ ID NO: 864687 - RNA, 22 nt, Human
uaguccuugcugggcacagagu

SEQ ID NO: 864688 - RNA, 22 nt, Human
uuagagucaagcugcauguucu

SEQ ID NO: 864689 - RNA, 22 nt, Human
aggcacagcacaccuggccccc

SEQ ID NO: 864690 - RNA, 22 nt, Human
ucacagaacaauguuuaguucu

SEQ ID NO: 864691 - RNA, 21 nt, Human
uacagaaugcgcuucagucug

SEQ ID NO: 864692 - RNA, 23 nt, Human
aauaucaaggugauguucccaga

SEQ ID NO: 864693 - RNA, 22 nt, Human
aggcagaugggagcuggaaguu

SEQ ID NO: 864694 - RNA, 22 nt, Human
acaacaaaaucacuagucuucc

SEQ ID NO: 864695 - RNA, 22 nt, Human
acacaaauuguaggauaauugc

SEQ ID NO: 864696 - RNA, 22 nt, Human
gaaggccacuuuguguugagaa

SEQ ID NO: 864697 - RNA, 22 nt, Human
aggacagcagugcuggcacuug

SEQ ID NO: 864698 - RNA, 22 nt, Human
augaggcaguacacacaaagcc

SEQ ID NO: 864699 - RNA, 22 nt, Human
uaagaaguacaaaaauuuucug

SEQ ID NO: 864700 - RNA, 22 nt, Human
gcaaaauuaaacuuagcaucau

SEQ ID NO: 864701 - RNA, 22 nt, Human
uuucaguuuuugcucgauguau

SEQ ID NO: 864702 - RNA, 22 nt, Human
gauuuccaggucauuaauaaag

SEQ ID NO: 864703 - RNA, 22 nt, Human
guacaauagucccuguuuggau

SEQ ID NO: 864704 - RNA, 21 nt, Human
gagauuuagaaggaucaauuu

SEQ ID NO: 864705 - RNA, 22 nt, Human
uuccuuagauccuucaaucacg

SEQ ID NO: 864706 - RNA, 22 nt, Human
cauuguuaauugguaucuuaca

SEQ ID NO: 864707 - RNA, 22 nt, Human
ccaaaugugccuguuucaacaa

SEQ ID NO: 864708 - RNA, 22 nt, Human
ugaaaugaaacagaacauauca

SEQ ID NO: 864709 - RNA, 22 nt, Human
uagcagaaacuguuacagaagg

SEQ ID NO: 864710 - RNA, 23 nt, Human
ucagagagcuguugagagcugcc

SEQ ID NO: 864711 - RNA, 22 nt, Human
ggagagugggagcaacuguugc

SEQ ID NO: 864712 - RNA, 22 nt, Human
gagaggucaucucccaucagca

SEQ ID NO: 864713 - RNA, 22 nt, Human
uagaacauaagucauucauuug

SEQ ID NO: 864714 - RNA, 22 nt, Human
cagaggcagugggguugcuccu

SEQ ID NO: 864715 - RNA, 22 nt, Human
cuuuguagcugcuucugauuua

SEQ ID NO: 864716 - RNA, 23 nt, Human
aguacaauaaguauaauucuuuc

SEQ ID NO: 864717 - RNA, 22 nt, Human
uucagaaaaaacuucaauaagu

SEQ ID NO: 864718 - RNA, 22 nt, Human
ggccagcuuugagcugcaggaa

SEQ ID NO: 864719 - RNA, 22 nt, Human
ugcugcuguauccuuaguguca

SEQ ID NO: 864720 - RNA, 22 nt, Human
aauaagauccugaagauauguu

SEQ ID NO: 864721 - RNA, 22 nt, Human
uuacagauggaucuagcaaaau

SEQ ID NO: 864722 - RNA, 22 nt, Human
auagacauuuugcauucaagca

SEQ ID NO: 864723 - RNA, 22 nt, Human
cuggcuuucauuucaagcacgu

SEQ ID NO: 864724 - RNA, 22 nt, Human
uuugaagacagaucaauauaag

SEQ ID NO: 864725 - RNA, 22 nt, Human
aggguagguguaagauagcccu

SEQ ID NO: 864726 - RNA, 19 nt, Human
acuguaaggcauuuuuuuc

SEQ ID NO: 864727 - RNA, 22 nt, Human
ucuuugaacuuggcugaucucu

SEQ ID NO: 864728 - RNA, 22 nt, Human
ccaggagagcagaagcccaggc

SEQ ID NO: 864729 - RNA, 22 nt, Human
cuuccaaacccaggguaugggc

SEQ ID NO: 864730 - RNA, 22 nt, Human
uauuuucuguggaggaccagau

SEQ ID NO: 864731 - RNA, 22 nt, Human
gaaauauuucucuugagccccu

SEQ ID NO: 864732 - RNA, 22 nt, Human
acucaggaaaugagaggcucuc

SEQ ID NO: 864733 - RNA, 22 nt, Human
ucagucucaucaacucuauucc

SEQ ID NO: 864734 - RNA, 22 nt, Human
aaaggaagauugagcuuuucca

SEQ ID NO: 864735 - RNA, 22 nt, Human
agugcuguuagguuaauauagu

SEQ ID NO: 864736 - RNA, 22 nt, Human
uuuccaaaaugaaucuaaugca

SEQ ID NO: 864737 - RNA, 22 nt, Human
uuaguacugauagggucaauca

SEQ ID NO: 864738 - RNA, 22 nt, Human
cagcugccugucuggaggcaau

SEQ ID NO: 864739 - RNA, 22 nt, Human
cuugaaagaagggucuuuuaau

SEQ ID NO: 864740 - RNA, 22 nt, Human
aauuccaggcagaaaugugagu

SEQ ID NO: 864741 - RNA, 22 nt, Human
uucuuaaaacuuauggacaggu

SEQ ID NO: 864742 - RNA, 22 nt, Human
aaauacagaguugcuuaaaagc

SEQ ID NO: 864743 - RNA, 23 nt, Human
aucauucuccaaucuggagcagg

SEQ ID NO: 864744 - RNA, 22 nt, Human
uacccaggagaaacagcagggc

SEQ ID NO: 864745 - RNA, 22 nt, Human
ucaaaauuaaaccaacguccag

SEQ ID NO: 864746 - RNA, 22 nt, Human
agaugaaaagauaagcagcaau

SEQ ID NO: 864747 - RNA, 22 nt, Human
ucuguggauuuuaguguucaug

SEQ ID NO: 864748 - RNA, 22 nt, Human
uacaugaaguugucuaaacugg

SEQ ID NO: 864749 - RNA, 22 nt, Human
auugcuguacacuucuagaucu

SEQ ID NO: 864750 - RNA, 22 nt, Human
uagugcuuggcccuaccagaua

SEQ ID NO: 864751 - RNA, 22 nt, Human
uuacaguuuaguccaagccaga

SEQ ID NO: 864752 - RNA, 22 nt, Human
uaaguccuauuccaggucucuc

SEQ ID NO: 864753 - RNA, 22 nt, Human
cacaggagagcugggaggugcc

SEQ ID NO: 864754 - RNA, 22 nt, Human
ggcauuuauuugucucauucuu

SEQ ID NO: 864755 - RNA, 22 nt, Human
uugaauaaaugagcagugaauu

SEQ ID NO: 864756 - RNA, 22 nt, Human
caggcagccugagggaucuggg

SEQ ID NO: 864757 - RNA, 22 nt, Human
aaaacuaaauacgcuuugccuc

SEQ ID NO: 864758 - RNA, 22 nt, Human
uccauuuuagagaugaagaaac

SEQ ID NO: 864759 - RNA, 23 nt, Human
gggcaguuauguuguccuuggcu

SEQ ID NO: 864760 - RNA, 22 nt, Human
uuugcaguuucauugcugaaau

SEQ ID NO: 864761 - RNA, 22 nt, Human
uggcaauuuuaggugguuuagu

SEQ ID NO: 864762 - RNA, 22 nt, Human
uauuuaucgagugucuacuaug

SEQ ID NO: 864763 - RNA, 22 nt, Human
uugaacugguaguuggaaaucu

SEQ ID NO: 864764 - RNA, 22 nt, Human
ccuggaucccgauggcugugag

SEQ ID NO: 864765 - RNA, 22 nt, Human
ugucaccaugccagcuucugcc

SEQ ID NO: 864766 - RNA, 22 nt, Human
aucauuucccuuuagaucacaa

SEQ ID NO: 864767 - RNA, 22 nt, Human
uggagaggagcaccauggccau

SEQ ID NO: 864768 - RNA, 22 nt, Human
uauaaaauucucaguuuggggu

SEQ ID NO: 864769 - RNA, 20 nt, Human
ggggcugcaugcagagaaga

SEQ ID NO: 864770 - RNA, 22 nt, Human
uuucaaaguugggaauuguaau

SEQ ID NO: 864771 - RNA, 23 nt, Human
uccuuccuuugagaggcuccauc

SEQ ID NO: 864772 - RNA, 22 nt, Human
aagauaaacucuugauuucuga

SEQ ID NO: 864773 - RNA, 22 nt, Human
auaaaugauucagcaggaaaua

SEQ ID NO: 864774 - RNA, 22 nt, Human
ucugucuccucugaggugccag

SEQ ID NO: 864775 - RNA, 22 nt, Human
ugaggcaggagguugagaacug

SEQ ID NO: 864776 - RNA, 22 nt, Human
gugucccaggccucuggaauua

SEQ ID NO: 864777 - RNA, 22 nt, Human
aggagcagaauuuaaugugcag

SEQ ID NO: 864778 - RNA, 22 nt, Human
uuauccuggauuauauauguga

SEQ ID NO: 864779 - RNA, 22 nt, Human
agagggagugaaauggaauaga

SEQ ID NO: 864780 - RNA, 22 nt, Human
uucuucuugaaacuuuagguug

SEQ ID NO: 864781 - RNA, 22 nt, Human
uuuccaagagcuuauuucugaa

SEQ ID NO: 864782 - RNA, 22 nt, Human
uggcagcugguacagugggucu

SEQ ID NO: 864783 - RNA, 22 nt, Human
uccaggagaaaacugacggugg

SEQ ID NO: 864784 - RNA, 22 nt, Human
cuugcugugugguguucucaga

SEQ ID NO: 864785 - RNA, 22 nt, Human
aggcaguuuaggcagcgauuua

SEQ ID NO: 864786 - RNA, 22 nt, Human
guuuacauguacucauuauacu

SEQ ID NO: 864787 - RNA, 22 nt, Human
caggcagccugcggucugcaca

SEQ ID NO: 864788 - RNA, 22 nt, Human
gagggcaguagccucguacccu

SEQ ID NO: 864789 - RNA, 22 nt, Human
uuuucauuguuccucgagcauu

SEQ ID NO: 864790 - RNA, 22 nt, Human
ggcaggcucagcagccaaggag

SEQ ID NO: 864791 - RNA, 22 nt, Human
auacagaacaagccucaccucc

SEQ ID NO: 864792 - RNA, 22 nt, Human
cagucuucuaaccuagcagccu

SEQ ID NO: 864793 - RNA, 18 nt, Human
uuugcaaaggaaguaugg

SEQ ID NO: 864794 - RNA, 22 nt, Human
gcaguucuacuuauccauagac

SEQ ID NO: 864795 - RNA, 19 nt, Human
aggcagcaggccagggaug

SEQ ID NO: 864796 - RNA, 22 nt, Human
gaaugaauucagcacauggaau

SEQ ID NO: 864797 - RNA, 22 nt, Human
uaucaagugacuaucacagaac

SEQ ID NO: 864798 - RNA, 22 nt, Human
gcuuuggaugugugccugaggu

SEQ ID NO: 864799 - RNA, 22 nt, Human
ugcagucuccaccuccugggug

SEQ ID NO: 864800 - RNA, 22 nt, Human
uucaacuuuaugcauauguauu

SEQ ID NO: 864801 - RNA, 22 nt, Human
aaucagaacuccuaccacagag

SEQ ID NO: 864802 - RNA, 22 nt, Human
agcaccugccugcauuggcuau

SEQ ID NO: 864803 - RNA, 22 nt, Human
ugucaccaugcgaggcuaauuu

SEQ ID NO: 864804 - RNA, 22 nt, Human
caauuucaucuugugcuucaau

SEQ ID NO: 864805 - RNA, 22 nt, Human
aggcuagcaaugggagaugagu

SEQ ID NO: 864806 - RNA, 22 nt, Human
gagguggucgaggagggguacc

SEQ ID NO: 864807 - RNA, 22 nt, Human
uuuaaauucugucugccgcuua

SEQ ID NO: 864808 - RNA, 22 nt, Human
aucacaaaggcugcuucaugau

SEQ ID NO: 864809 - RNA, 20 nt, Human
gggagucuggaugaaagaug

SEQ ID NO: 864810 - RNA, 23 nt, Human
accaggagaaaagcuuugcggga

SEQ ID NO: 864811 - RNA, 22 nt, Human
ugaggcagucacccccuccugc

SEQ ID NO: 864812 - RNA, 22 nt, Human
augaggcaucugcagucacuag

SEQ ID NO: 864813 - RNA, 22 nt, Human
caucagaagaaagacaaaugau

SEQ ID NO: 864814 - RNA, 22 nt, Human
aauuucaaugcacucaugguug

SEQ ID NO: 864815 - RNA, 22 nt, Human
uauuugaaaguguacaaaaacu

SEQ ID NO: 864816 - RNA, 22 nt, Human
gcccaggauaaugcugucccug

SEQ ID NO: 864817 - RNA, 22 nt, Human
aaaucaguucacguucugaggu

SEQ ID NO: 864818 - RNA, 22 nt, Human
cugcugugcacccaggaaggcu

SEQ ID NO: 864819 - RNA, 22 nt, Human
uuaaauuagucaagcuucucug

SEQ ID NO: 864820 - RNA, 22 nt, Human
guagggagcccagagcccagug

SEQ ID NO: 864821 - RNA, 22 nt, Human
uucacagucacccuucuccaug

SEQ ID NO: 864822 - RNA, 22 nt, Human
uagcacauacauaauagauaga

SEQ ID NO: 864823 - RNA, 22 nt, Human
gagucaccuugggucagcgaua

SEQ ID NO: 864824 - RNA, 22 nt, Human
cccaggagguggagguugcggu

SEQ ID NO: 864825 - RNA, 22 nt, Human
auggauuugcuuauacacaugu

SEQ ID NO: 864826 - RNA, 20 nt, Human
aggcaguuagaaggagauga

SEQ ID NO: 864827 - RNA, 22 nt, Human
aauguuaauguguuugcuuaug

SEQ ID NO: 864828 - RNA, 22 nt, Human
cugcuguggaugcaggaccuca

SEQ ID NO: 864829 - RNA, 22 nt, Human
gaggagaggccaucguuguuau

SEQ ID NO: 864830 - RNA, 22 nt, Human
ggcaugcugcguacagaugaac

SEQ ID NO: 864831 - RNA, 22 nt, Human
gaggcagaaguugcagugagca

SEQ ID NO: 864832 - RNA, 22 nt, Human
cugcccagaagccagaugggca

SEQ ID NO: 864833 - RNA, 22 nt, Human
uuauuuaaugugaucugaagag

SEQ ID NO: 864834 - RNA, 22 nt, Human
auuacaagaugcauccauauuu

SEQ ID NO: 864835 - RNA, 22 nt, Human
cuagaaaucucuguuuacauca

SEQ ID NO: 864836 - RNA, 23 nt, Human
acugucugauauguuuuccauca

SEQ ID NO: 864837 - RNA, 22 nt, Human
auggguuucccucugaaauuau

SEQ ID NO: 864838 - RNA, 22 nt, Human
gcugcuguugauuuaguccaau

SEQ ID NO: 864839 - RNA, 22 nt, Human
ucacacagguuugcaaugauuu

SEQ ID NO: 864840 - RNA, 20 nt, Human
caggagggacauuucagcau

SEQ ID NO: 864841 - RNA, 21 nt, Human
uaaauaauaaguugcugagau

SEQ ID NO: 864842 - RNA, 22 nt, Human
uuuaaauuauaguuaaugucug

SEQ ID NO: 864843 - RNA, 22 nt, Human
uguucucacuggaugcuucaca

SEQ ID NO: 864844 - RNA, 22 nt, Human
ucccuucacagaugcgauguuu

SEQ ID NO: 864845 - RNA, 22 nt, Human
ucauuucccuccuacaaagagg

SEQ ID NO: 864846 - RNA, 22 nt, Human
aggccagcccugggcugagaga

SEQ ID NO: 864847 - RNA, 22 nt, Human
uuugacauuauccuguuacugg

SEQ ID NO: 864848 - RNA, 23 nt, Human
uuucuucagaagccuugcgaggc

SEQ ID NO: 864849 - RNA, 22 nt, Human
aggcagugccuggaccccagcu

SEQ ID NO: 864850 - RNA, 22 nt, Human
agucucugccagcuuguccucu

SEQ ID NO: 864851 - RNA, 22 nt, Human
gguacaauccacuguggguuag

SEQ ID NO: 864852 - RNA, 21 nt, Human
cuacagaagcucuccuaucca

SEQ ID NO: 864853 - RNA, 22 nt, Human
cugcuuugauuagaagaguaca

SEQ ID NO: 864854 - RNA, 22 nt, Human
ucucugguuauuaacuaacucc

SEQ ID NO: 864855 - RNA, 22 nt, Human
aaauugcagaugcuaaaugacu

SEQ ID NO: 864856 - RNA, 22 nt, Human
ccagaauuuggaucaugauuuu

SEQ ID NO: 864857 - RNA, 20 nt, Human
cucaggauacugcaaaguug

SEQ ID NO: 864858 - RNA, 22 nt, Human
uguacauagaucuugaaaauua

SEQ ID NO: 864859 - RNA, 22 nt, Human
cuuaaauuggaugaguuaaguu

SEQ ID NO: 864860 - RNA, 22 nt, Human
aaagcaguauauugguaguugu

SEQ ID NO: 864861 - RNA, 22 nt, Human
cuggaaauuggagaugauguuu

SEQ ID NO: 864862 - RNA, 22 nt, Human
ggucagagggugggcugccugu

SEQ ID NO: 864863 - RNA, 17 nt, Human
uagcuguguuucagcua

SEQ ID NO: 864864 - RNA, 22 nt, Human
ugauuuccuaggucuggagaag

SEQ ID NO: 864865 - RNA, 22 nt, Human
auuauccucagaaaacauguga

SEQ ID NO: 864866 - RNA, 22 nt, Human
gucaggauuugaacucaggucu

SEQ ID NO: 864867 - RNA, 22 nt, Human
uuagaaagcuuuccauagucaa

SEQ ID NO: 864868 - RNA, 22 nt, Human
aggagggagcuuaagccaggca

SEQ ID NO: 864869 - RNA, 22 nt, Human
acucaggaaauugagauaaugg

SEQ ID NO: 864870 - RNA, 22 nt, Human
cauuuacagcagacugaugaaa

SEQ ID NO: 864871 - RNA, 22 nt, Human
aagcaccuggguuauaucuuag

SEQ ID NO: 864872 - RNA, 22 nt, Human
uuugaagucagacacugcuuug

SEQ ID NO: 864873 - RNA, 22 nt, Human
ucagccaggccaccuucagcuu

SEQ ID NO: 864874 - RNA, 21 nt, Human
gcugcaucaaucuacccaggg

SEQ ID NO: 864875 - RNA, 22 nt, Human
ucugaaaugcaaauuugacuga

SEQ ID NO: 864876 - RNA, 22 nt, Human
gaggaggcuuccgggaggcacg

SEQ ID NO: 864877 - RNA, 22 nt, Human
uuuguaaauagcaguacucaug

SEQ ID NO: 864878 - RNA, 22 nt, Human
ucauuuguugaacuuuagugcg

SEQ ID NO: 864879 - RNA, 23 nt, Human
uuagagaugauuaaaaaaucuug

SEQ ID NO: 864880 - RNA, 22 nt, Human
ggacagcugcuuucaggccaca

SEQ ID NO: 864881 - RNA, 22 nt, Human
aaggcagccuuuguuugauuga

SEQ ID NO: 864882 - RNA, 22 nt, Human
ucauuuguucaucugcucuucu

SEQ ID NO: 864883 - RNA, 22 nt, Human
auguucuuccaaaucuguaaca

SEQ ID NO: 864884 - RNA, 22 nt, Human
cucacugugccuuuucccaaac

SEQ ID NO: 864885 - RNA, 17 nt, Human
caggcagacauguaagc

SEQ ID NO: 864886 - RNA, 20 nt, Human
acaggagaucugaggaaagg

SEQ ID NO: 864887 - RNA, 22 nt, Human
aagccgaggccacacagcagga

SEQ ID NO: 864888 - RNA, 22 nt, Human
gcagaauuggauaguugugaua

SEQ ID NO: 864889 - RNA, 22 nt, Human
cuucagaagccugcagccuuug

SEQ ID NO: 864890 - RNA, 22 nt, Human
aauuuacacuucauuuggaggg

SEQ ID NO: 864891 - RNA, 22 nt, Human
agugauggugagugagaagcuc

SEQ ID NO: 864892 - RNA, 22 nt, Human
cugcuguggccagccaggucaa

SEQ ID NO: 864893 - RNA, 22 nt, Human
uugcucaggcuggugugcagug

SEQ ID NO: 864894 - RNA, 22 nt, Human
augaguucaauuguuucaguca

SEQ ID NO: 864895 - RNA, 22 nt, Human
uucauuaauucauucagugacu

SEQ ID NO: 864896 - RNA, 22 nt, Human
aguuauaaucugcuacugauau

SEQ ID NO: 864897 - RNA, 22 nt, Human
uuugacaugcaaagcacuuuag

SEQ ID NO: 864898 - RNA, 22 nt, Human
gucaggauuauuuuauuaaaag

SEQ ID NO: 864899 - RNA, 21 nt, Human
cccaggaggagcuccggcucc

SEQ ID NO: 864900 - RNA, 22 nt, Human
cagaaaucauugugaugacagg

SEQ ID NO: 864901 - RNA, 22 nt, Human
cccaggaguuggaggcuacggu

SEQ ID NO: 864902 - RNA, 22 nt, Human
ucugcaucauuuuucagagccg

SEQ ID NO: 864903 - RNA, 22 nt, Human
uuacagaaucuacucgugguga

SEQ ID NO: 864904 - RNA, 22 nt, Human
ugaagaaucagauuggccugcg

SEQ ID NO: 864905 - RNA, 19 nt, Human
uccaggaggcugccauuga

SEQ ID NO: 864906 - RNA, 22 nt, Human
agugugucugaucacuugugag

SEQ ID NO: 864907 - RNA, 22 nt, Human
caggguggggaaauagcgcccu

SEQ ID NO: 864908 - RNA, 22 nt, Human
aucugccuccaaguccaugugu

SEQ ID NO: 864909 - RNA, 22 nt, Human
uaaguccuucaccuaauccuca

SEQ ID NO: 864910 - RNA, 22 nt, Human
uuuguuaauucuuauguuagag

SEQ ID NO: 864911 - RNA, 22 nt, Human
uuuaacuuaaucugcuugauga

SEQ ID NO: 864912 - RNA, 21 nt, Human
ggcagccucuguggaagggga

SEQ ID NO: 864913 - RNA, 20 nt, Human
acuggaucuggcuggagcug

SEQ ID NO: 864914 - RNA, 19 nt, Human
ugcugcuguccuugcaggg

SEQ ID NO: 864915 - RNA, 22 nt, Human
ucuacugugguccuuguaacca

SEQ ID NO: 864916 - RNA, 22 nt, Human
uaaacauuuguuauucuuguuu

SEQ ID NO: 864917 - RNA, 22 nt, Human
aagucaccccacacucuuggga

SEQ ID NO: 864918 - RNA, 22 nt, Human
guucuugccagcauccucaggu

SEQ ID NO: 864919 - RNA, 23 nt, Human
uuucaaauuacucugcagaugac

SEQ ID NO: 864920 - RNA, 22 nt, Human
uuuccaaaaguuuguucugugc

SEQ ID NO: 864921 - RNA, 22 nt, Human
agcagccuuugaucaucuggga

SEQ ID NO: 864922 - RNA, 18 nt, Human
gcaggcuuuuccuggguc

SEQ ID NO: 864923 - RNA, 22 nt, Human
gaaaggccauuucugaggguuu

SEQ ID NO: 864924 - RNA, 22 nt, Human
aaagccaugaauguuauagagg

SEQ ID NO: 864925 - RNA, 22 nt, Human
uagaaaugaauguuuaaaaguc

SEQ ID NO: 864926 - RNA, 22 nt, Human
ugcuucugggcaaaugugugug

SEQ ID NO: 864927 - RNA, 22 nt, Human
cuucugugauuugguuaggaua

SEQ ID NO: 864928 - RNA, 22 nt, Human
uccaggaguggggcagaggucu

SEQ ID NO: 864929 - RNA, 22 nt, Human
augguuuuagaaucaggaaaaa

SEQ ID NO: 864930 - RNA, 22 nt, Human
aaaacuuucagggauacagaaa

SEQ ID NO: 864931 - RNA, 22 nt, Human
ugcuuauugcuuucaagacugu

SEQ ID NO: 864932 - RNA, 16 nt, Human
aggaggggaauuagga

SEQ ID NO: 864933 - RNA, 21 nt, Human
gauuugcagaaacuagacagg

SEQ ID NO: 864934 - RNA, 22 nt, Human
aagucacaagcauauaugcauu

SEQ ID NO: 864935 - RNA, 22 nt, Human
gucagagagggcacgugcacac

SEQ ID NO: 864936 - RNA, 22 nt, Human
cuuaaacugaaagcuacaagau

SEQ ID NO: 864937 - RNA, 23 nt, Human
uacaugcuauaauuucacccuca

SEQ ID NO: 864938 - RNA, 22 nt, Human
ugucaccaguuccaggaaauaa

SEQ ID NO: 864939 - RNA, 22 nt, Human
uccaggaguccugggagugauu

SEQ ID NO: 864940 - RNA, 22 nt, Human
uagggcaggggaggaaucugaa

SEQ ID NO: 864941 - RNA, 22 nt, Human
uacccaggaggaaacugaggcu

SEQ ID NO: 864942 - RNA, 22 nt, Human
uucagaaagguuaaucuggauu

SEQ ID NO: 864943 - RNA, 22 nt, Human
uguggaaaagaauaagggagau

SEQ ID NO: 864944 - RNA, 22 nt, Human
ccauggcuuucuuucauuguaa

SEQ ID NO: 864945 - RNA, 22 nt, Human
aaacugcugguugcuggccagc

SEQ ID NO: 864946 - RNA, 22 nt, Human
auacagaagaacuauagccacu

SEQ ID NO: 864947 - RNA, 22 nt, Human
aguugcagacgcagagauguug

SEQ ID NO: 864948 - RNA, 22 nt, Human
augguuuauugcuuuaaugaaa

SEQ ID NO: 864949 - RNA, 22 nt, Human
ugaaaauggccugaagaagcaa

SEQ ID NO: 864950 - RNA, 22 nt, Human
ucucuucuaauuuucccgagua

SEQ ID NO: 864951 - RNA, 22 nt, Human
aguagaauagauggauacuauu

SEQ ID NO: 864952 - RNA, 22 nt, Human
uuuggacaaguuacugguuucc

SEQ ID NO: 864953 - RNA, 22 nt, Human
uauguuaagugggauaaucaaa

SEQ ID NO: 864954 - RNA, 22 nt, Human
ucucaggaucuaauacauggua

SEQ ID NO: 864955 - RNA, 22 nt, Human
auguuauuaaaguacagauucu

SEQ ID NO: 864956 - RNA, 22 nt, Human
uccaauauggauaaaaggggcc

SEQ ID NO: 864957 - RNA, 22 nt, Human
aucauuacuccuguaaaauugu

SEQ ID NO: 864958 - RNA, 22 nt, Human
ucuucuuccucauuuauacaua

SEQ ID NO: 864959 - RNA, 22 nt, Human
uggcagcuuccugcucauagga

SEQ ID NO: 864960 - RNA, 22 nt, Human
uuugaacuucuaccugucauau

SEQ ID NO: 864961 - RNA, 22 nt, Human
ccaggaaauagugcugugaucu

SEQ ID NO: 864962 - RNA, 22 nt, Human
uuccuuagccugccuuccaggg

SEQ ID NO: 864963 - RNA, 22 nt, Human
aucacauucuuucaaagcaguc

SEQ ID NO: 864964 - RNA, 22 nt, Human
acaugaaacuguugcauuagaa

SEQ ID NO: 864965 - RNA, 22 nt, Human
ugaggggauacgguacacauug

SEQ ID NO: 864966 - RNA, 22 nt, Human
uuucaguuuaugucuugaauua

SEQ ID NO: 864967 - RNA, 22 nt, Human
agaggacagacggaaagugcca

SEQ ID NO: 864968 - RNA, 20 nt, Human
aguuauaguaucuagccaug

SEQ ID NO: 864969 - RNA, 22 nt, Human
caucagaagauggcucuggaaa

SEQ ID NO: 864970 - RNA, 22 nt, Human
augcagcugucagggagaacau

SEQ ID NO: 864971 - RNA, 22 nt, Human
cugcugugagcacuccagccug

SEQ ID NO: 864972 - RNA, 22 nt, Human
uucagaaguagcuaagcaguca

SEQ ID NO: 864973 - RNA, 22 nt, Human
ugaacaaacugcauucuucacu

SEQ ID NO: 864974 - RNA, 22 nt, Human
aaaguccuagcgauccacagaa

SEQ ID NO: 864975 - RNA, 22 nt, Human
auuuagcaaaaaaugaugaagc

SEQ ID NO: 864976 - RNA, 22 nt, Human
ggcaagcucaggccucaggugu

SEQ ID NO: 864977 - RNA, 22 nt, Human
ggguggagaggcuaaguccagu

SEQ ID NO: 864978 - RNA, 22 nt, Human
ucuuuaauucagcaugaugcgg

SEQ ID NO: 864979 - RNA, 22 nt, Human
uuugaaguguuauuucuaucac

SEQ ID NO: 864980 - RNA, 22 nt, Human
ucaggagagagaaauuggggcu

SEQ ID NO: 864981 - RNA, 22 nt, Human
acaagccaauuacugugccagg

SEQ ID NO: 864982 - RNA, 22 nt, Human
uagggauguaaacauaguaauu

SEQ ID NO: 864983 - RNA, 22 nt, Human
aucccaugagaccacguuggcu

SEQ ID NO: 864984 - RNA, 22 nt, Human
ggcaauuucaugugguuuaaac

SEQ ID NO: 864985 - RNA, 22 nt, Human
uccaggagguuuggaggaagca

SEQ ID NO: 864986 - RNA, 22 nt, Human
acaaaugucuccucuuuuguua

SEQ ID NO: 864987 - RNA, 22 nt, Human
uuucugugguggguaguucaga

SEQ ID NO: 864988 - RNA, 22 nt, Human
aaacauguuuucugaauauuuu

SEQ ID NO: 864989 - RNA, 22 nt, Human
gauggacagccuggaaggaaag

SEQ ID NO: 864990 - RNA, 22 nt, Human
acccaggagguggaggcugcag

SEQ ID NO: 864991 - RNA, 22 nt, Human
uguuguuuucucauggagaaua

SEQ ID NO: 864992 - RNA, 22 nt, Human
auggaaagggaagcaaggaaca

SEQ ID NO: 864993 - RNA, 22 nt, Human
aggcugcugaggccaccacgcu

SEQ ID NO: 864994 - RNA, 22 nt, Human
cauuuguaguuaaaaaugucuc

SEQ ID NO: 864995 - RNA, 22 nt, Human
cagaauuuagcacaauguaugg

SEQ ID NO: 864996 - RNA, 22 nt, Human
uaacauuagguagacauaagcc

SEQ ID NO: 864997 - RNA, 22 nt, Human
uggcaucucaaacaggcagauu

SEQ ID NO: 864998 - RNA, 22 nt, Human
uagaacuacaagcauuaaaagu

SEQ ID NO: 864999 - RNA, 22 nt, Human
ucagaauuuugguuugguuggu

SEQ ID NO: 865000 - RNA, 22 nt, Human
uugauuucuauucagauguaga

SEQ ID NO: 865001 - RNA, 22 nt, Human
uugggcucaggaguuugagacc

SEQ ID NO: 865002 - RNA, 22 nt, Human
aggucagcaugaguagaaggua

SEQ ID NO: 865003 - RNA, 22 nt, Human
augccaaagcccaaguucauca

SEQ ID NO: 865004 - RNA, 22 nt, Human
uuuaggcaagggcaagauuauc

SEQ ID NO: 865005 - RNA, 22 nt, Human
ugaggcagugugagauaauaaa

SEQ ID NO: 865006 - RNA, 22 nt, Human
ggauggcaggacaaggacccag

SEQ ID NO: 865007 - RNA, 22 nt, Human
agagguagagguugcagugagc

SEQ ID NO: 865008 - RNA, 22 nt, Human
gaaggccauuuuuagguagaau

SEQ ID NO: 865009 - RNA, 19 nt, Human
uuugcagugguuccuuugu

SEQ ID NO: 865010 - RNA, 19 nt, Human
uggcauuuggaggcaaccu

SEQ ID NO: 865011 - RNA, 22 nt, Human
acagcauugagagcuaaauuua

SEQ ID NO: 865012 - RNA, 21 nt, Human
gugcuuuuccuuaauguucuu

SEQ ID NO: 865013 - RNA, 19 nt, Human
caaggccaccauuucuccg

SEQ ID NO: 865014 - RNA, 22 nt, Human
caggaaugaggucguaaguguc

SEQ ID NO: 865015 - RNA, 22 nt, Human
acuuugaaucucagauaaccaa

SEQ ID NO: 865016 - RNA, 22 nt, Human
ccagugcuucuuugcuagcugg

SEQ ID NO: 865017 - RNA, 22 nt, Human
ucuuagaaugucaacugauguu

SEQ ID NO: 865018 - RNA, 22 nt, Human
cuucuucaagagaaugggagac

SEQ ID NO: 865019 - RNA, 22 nt, Human
uugcauuucccauugaguaaug

SEQ ID NO: 865020 - RNA, 22 nt, Human
cagcaggagcagucagacuccu

SEQ ID NO: 865021 - RNA, 17 nt, Human
aaucuguuuacagucag

SEQ ID NO: 865022 - RNA, 22 nt, Human
ugaauaaucauguccauagugu

SEQ ID NO: 865023 - RNA, 22 nt, Human
uggcuuuaaaucuguauucaua

SEQ ID NO: 865024 - RNA, 22 nt, Human
acaaaauuguguuaaacuuuau

SEQ ID NO: 865025 - RNA, 22 nt, Human
ccagagagauugcuucuaaaga

SEQ ID NO: 865026 - RNA, 22 nt, Human
uagggcagaguccaggaugggc

SEQ ID NO: 865027 - RNA, 22 nt, Human
aaguguagauuauggagugucu

SEQ ID NO: 865028 - RNA, 17 nt, Human
gccucugcuugugucau

SEQ ID NO: 865029 - RNA, 22 nt, Human
agcacauucugccuugcuuugc

SEQ ID NO: 865030 - RNA, 22 nt, Human
cuguaaauaugaagaauauaug

SEQ ID NO: 865031 - RNA, 19 nt, Human
cuucuggcccugagccacc

SEQ ID NO: 865032 - RNA, 22 nt, Human
gaucagaauucuuguguguuuc

SEQ ID NO: 865033 - RNA, 22 nt, Human
uugaaauggaagugaaaauucu

SEQ ID NO: 865034 - RNA, 22 nt, Human
uaucagaagacuuacaguaucg

SEQ ID NO: 865035 - RNA, 22 nt, Human
caguucuuaauaccaugugguu

SEQ ID NO: 865036 - RNA, 22 nt, Human
uuuauccagcagcuauucaaaa

SEQ ID NO: 865037 - RNA, 22 nt, Human
aggacuuagaacauuauguacu

SEQ ID NO: 865038 - RNA, 20 nt, Human
ucuuauacagaaaacauuuu

SEQ ID NO: 865039 - RNA, 22 nt, Human
ucuggcaggucaaucauucuuu

SEQ ID NO: 865040 - RNA, 22 nt, Human
auuuagaacuuuguuugccaau

SEQ ID NO: 865041 - RNA, 22 nt, Human
aaaacugaaauacgauccaaug

SEQ ID NO: 865042 - RNA, 22 nt, Human
aggccagccucaggcagggacc

SEQ ID NO: 865043 - RNA, 22 nt, Human
uucccucuccuacucaggaaag

SEQ ID NO: 865044 - RNA, 22 nt, Human
uacauauacugagugauuugcu

SEQ ID NO: 865045 - RNA, 22 nt, Human
uucagugucaauuuuuaaauau

SEQ ID NO: 865046 - RNA, 22 nt, Human
acaaaguccugguguauggcca

SEQ ID NO: 865047 - RNA, 22 nt, Human
aauggccagcaacaggagugaa

SEQ ID NO: 865048 - RNA, 22 nt, Human
auucaacggguagaagggucuu

SEQ ID NO: 865049 - RNA, 22 nt, Human
cauggcuucuaagugauaacgu

SEQ ID NO: 865050 - RNA, 22 nt, Human
uaaggccagccagcaaaucugu

SEQ ID NO: 865051 - RNA, 22 nt, Human
agagcagcacguuguccccaca

SEQ ID NO: 865052 - RNA, 22 nt, Human
ccuggauucaagucuuucuuuc

SEQ ID NO: 865053 - RNA, 23 nt, Human
aaucuauacuuaggcugguaaua

SEQ ID NO: 865054 - RNA, 22 nt, Human
ucacaaauauuuuaacaguagg

SEQ ID NO: 865055 - RNA, 22 nt, Human
acagauuuuugguaaauaauuu

SEQ ID NO: 865056 - RNA, 22 nt, Human
auugaggcagcauaguucaggg

SEQ ID NO: 865057 - RNA, 22 nt, Human
agggauggaagacuugaagacc

SEQ ID NO: 865058 - RNA, 22 nt, Human
agucucuuuguggacucugccu

SEQ ID NO: 865059 - RNA, 22 nt, Human
uagugcuuaauaaauuucagaa

SEQ ID NO: 865060 - RNA, 22 nt, Human
ggccagcucuuguccacggagg

SEQ ID NO: 865061 - RNA, 22 nt, Human
ucaacuuuaguguagcuauuua

SEQ ID NO: 865062 - RNA, 20 nt, Human
cccaggagugagcagcuuua

SEQ ID NO: 865063 - RNA, 22 nt, Human
cagaaaauaaaguuucuacgca

SEQ ID NO: 865064 - RNA, 22 nt, Human
uuuaggcaugcaguucuauuua

SEQ ID NO: 865065 - RNA, 22 nt, Human
ugaaaugagagcacagaauaaa

SEQ ID NO: 865066 - RNA, 22 nt, Human
gcaccugauugauuucacugcu

SEQ ID NO: 865067 - RNA, 22 nt, Human
gggcagcuggcuuauagguuug

SEQ ID NO: 865068 - RNA, 22 nt, Human
cggagccugcuuguugcagcug

SEQ ID NO: 865069 - RNA, 22 nt, Human
agcacauaccagaaccacaggu

SEQ ID NO: 865070 - RNA, 22 nt, Human
caaucaguaaccggaucauggu

SEQ ID NO: 865071 - RNA, 22 nt, Human
uuucuucagccacuccaaacug

SEQ ID NO: 865072 - RNA, 22 nt, Human
aggcagcuggcagcacccaggg

SEQ ID NO: 865073 - RNA, 22 nt, Human
ggcagccuugagggaggccugg

SEQ ID NO: 865074 - RNA, 22 nt, Human
uaauuccaaguugagacaugca

SEQ ID NO: 865075 - RNA, 22 nt, Human
ccaugagcuuccuauauagggu

SEQ ID NO: 865076 - RNA, 22 nt, Human
uggcuuaauauuucauauuuaa

SEQ ID NO: 865077 - RNA, 21 nt, Human
acaggagaccgccuggcaguc

SEQ ID NO: 865078 - RNA, 22 nt, Human
cauacuuugggauaagagugga

SEQ ID NO: 865079 - RNA, 22 nt, Human
uucagaauauuuguuuuacaug

SEQ ID NO: 865080 - RNA, 22 nt, Human
ggcucagacucccaggcccucu

SEQ ID NO: 865081 - RNA, 22 nt, Human
uuucuuauacuauauugucauc

SEQ ID NO: 865082 - RNA, 22 nt, Human
acucaggaaaugaagacugguu

SEQ ID NO: 865083 - RNA, 22 nt, Human
uauccaaaguuucucagaaacu

SEQ ID NO: 865084 - RNA, 22 nt, Human
caggcagcugaggacuuugcua

SEQ ID NO: 865085 - RNA, 22 nt, Human
aaaaauugcugagaacggaauu

SEQ ID NO: 865086 - RNA, 22 nt, Human
ucagccagugccuugaucuugc

SEQ ID NO: 865087 - RNA, 22 nt, Human
gaagaaucugaggacagucauu

SEQ ID NO: 865088 - RNA, 22 nt, Human
aagcuggaacaucuugaggaag

SEQ ID NO: 865089 - RNA, 22 nt, Human
ugucucugauaaguaguucagu

SEQ ID NO: 865090 - RNA, 22 nt, Human
acuuuagaccaucuuccacagu

SEQ ID NO: 865091 - RNA, 22 nt, Human
auuaucuauguagaaugauuuu

SEQ ID NO: 865092 - RNA, 22 nt, Human
ucucuucucuagugagcaacug

SEQ ID NO: 865093 - RNA, 22 nt, Human
gcaacuuucaagcaccaugggg

SEQ ID NO: 865094 - RNA, 20 nt, Human
cccagugaagcauggaagag

SEQ ID NO: 865095 - RNA, 22 nt, Human
cuuucaacuacauacaggcgau

SEQ ID NO: 865096 - RNA, 22 nt, Human
aauaauuagugggacagagaac

SEQ ID NO: 865097 - RNA, 22 nt, Human
ugugaaagcaagucuaguucuc

SEQ ID NO: 865098 - RNA, 22 nt, Human
uuucaguucaguuuauuauauc

SEQ ID NO: 865099 - RNA, 22 nt, Human
gaauuucaaagagguuaagagg

SEQ ID NO: 865100 - RNA, 22 nt, Human
gggcagcugccacuccgcuugc

SEQ ID NO: 865101 - RNA, 22 nt, Human
guaaaauagaauaacguggcua

SEQ ID NO: 865102 - RNA, 22 nt, Human
uggauuuauggagaccgaaagu

SEQ ID NO: 865103 - RNA, 22 nt, Human
gauuuacagaucuaagggucac

SEQ ID NO: 865104 - RNA, 22 nt, Human
uccaggagcucauccacgucaa

SEQ ID NO: 865105 - RNA, 22 nt, Human
uaucuaaauggaauauuccaga

SEQ ID NO: 865106 - RNA, 22 nt, Human
cccaucacagacacuggguuau

SEQ ID NO: 865107 - RNA, 22 nt, Human
ugacaguuaagguauacauuca

SEQ ID NO: 865108 - RNA, 19 nt, Human
agauuuaccucauauaguu

SEQ ID NO: 865109 - RNA, 22 nt, Human
uuguuaaaaauagauuuccagg

SEQ ID NO: 865110 - RNA, 22 nt, Human
auuuucagagacaucuggacuu

SEQ ID NO: 865111 - RNA, 22 nt, Human
ucaacuuugaaaccauagugaa

SEQ ID NO: 865112 - RNA, 22 nt, Human
auguguaugcaugcacuaagau

SEQ ID NO: 865113 - RNA, 19 nt, Human
ugccuggacaaaugugggg

SEQ ID NO: 865114 - RNA, 22 nt, Human
ucugggaagcugguccuguucu

SEQ ID NO: 865115 - RNA, 22 nt, Human
gugauuuucuccuccuagaagu

SEQ ID NO: 865116 - RNA, 22 nt, Human
agaccauagggaccucagguug

SEQ ID NO: 865117 - RNA, 22 nt, Human
ccugcugugaagccaggccugu

SEQ ID NO: 865118 - RNA, 22 nt, Human
ucuuuaauguacuuucuuucac

SEQ ID NO: 865119 - RNA, 22 nt, Human
auucuucagaauaucuggcacu

SEQ ID NO: 865120 - RNA, 22 nt, Human
ugaauaguccuuggaauaacug

SEQ ID NO: 865121 - RNA, 22 nt, Human
uuuuccaaaguaccaugucccu

SEQ ID NO: 865122 - RNA, 20 nt, Human
acaggggcagcacaauaaug

SEQ ID NO: 865123 - RNA, 22 nt, Human
auucuucaaagagugucaaagu

SEQ ID NO: 865124 - RNA, 22 nt, Human
agaguucugcucuucucaguga

SEQ ID NO: 865125 - RNA, 21 nt, Human
ugaaacaaucagacagagucu

SEQ ID NO: 865126 - RNA, 22 nt, Human
aagaauucacugguagagucaa

SEQ ID NO: 865127 - RNA, 22 nt, Human
acaugcauacacguacauaccu

SEQ ID NO: 865128 - RNA, 22 nt, Human
uggcuuuauaaauccacugguu

SEQ ID NO: 865129 - RNA, 22 nt, Human
aguaaaauuucugcugaggaga

SEQ ID NO: 865130 - RNA, 22 nt, Human
cugacagucucauugauuugcu

SEQ ID NO: 865131 - RNA, 22 nt, Human
aacuggauuuaggaacagagaa

SEQ ID NO: 865132 - RNA, 22 nt, Human
gauggcuuugugcaccaugauu

SEQ ID NO: 865133 - RNA, 22 nt, Human
cugcugugacagcugccguguu

SEQ ID NO: 865134 - RNA, 22 nt, Human
ccaggagaaugggauuacccua

SEQ ID NO: 865135 - RNA, 19 nt, Human
ucaucucacagggccuggc

SEQ ID NO: 865136 - RNA, 22 nt, Human
aagauuauggcagauaacaauu

SEQ ID NO: 865137 - RNA, 22 nt, Human
cauggagauaaacugaaauauu

SEQ ID NO: 865138 - RNA, 22 nt, Human
ucuuuaauauaaaggaaugaau

SEQ ID NO: 865139 - RNA, 22 nt, Human
cagaauggcuuuuauggcucag

SEQ ID NO: 865140 - RNA, 22 nt, Human
ucagugcacagagauuuuuguu

SEQ ID NO: 865141 - RNA, 22 nt, Human
gcuguggucugugagcuccaaa

SEQ ID NO: 865142 - RNA, 22 nt, Human
caaauacuggguaaguuaauuu

SEQ ID NO: 865143 - RNA, 22 nt, Human
aucagaaaggugggcaagcaga

SEQ ID NO: 865144 - RNA, 22 nt, Human
ugaggcagguaagcaaguuuug

SEQ ID NO: 865145 - RNA, 19 nt, Human
ggcagcuugggaagguagc

SEQ ID NO: 865146 - RNA, 19 nt, Human
uuccuuagaggaggcggug

SEQ ID NO: 865147 - RNA, 22 nt, Human
aggcagugcucaagacagcagc

SEQ ID NO: 865148 - RNA, 22 nt, Human
ccagagagaaauggauuugagu

SEQ ID NO: 865149 - RNA, 22 nt, Human
gaaguucaaaagacagauuuga

SEQ ID NO: 865150 - RNA, 22 nt, Human
augaauaaaacauuuuaaucag

SEQ ID NO: 865151 - RNA, 22 nt, Human
caucaucaaaagugacagagaa

SEQ ID NO: 865152 - RNA, 22 nt, Human
cagucuuuguucccauuacuga

SEQ ID NO: 865153 - RNA, 22 nt, Human
uuugaauguuuuagguacuuaa

SEQ ID NO: 865154 - RNA, 22 nt, Human
ggagugggaacaaugacauggu

SEQ ID NO: 865155 - RNA, 22 nt, Human
uacuuguagcagguggcauuua

SEQ ID NO: 865156 - RNA, 21 nt, Human
agucuguuaggaugacucuga

SEQ ID NO: 865157 - RNA, 22 nt, Human
ugaaacaaugugaaguugcuga

SEQ ID NO: 865158 - RNA, 22 nt, Human
acauuuuuuagagucccacauu

SEQ ID NO: 865159 - RNA, 22 nt, Human
ugaaauagacacagugcuauac

SEQ ID NO: 865160 - RNA, 22 nt, Human
aaggaguuuggguagucauaca

SEQ ID NO: 865161 - RNA, 20 nt, Human
ugugaaagcaguagaaugac

SEQ ID NO: 865162 - RNA, 22 nt, Human
gagggaauggugugcaagaggu

SEQ ID NO: 865163 - RNA, 22 nt, Human
guggaaugaauagauuugcauu

SEQ ID NO: 865164 - RNA, 22 nt, Human
cuuaacauccugcauuuuucuu

SEQ ID NO: 865165 - RNA, 22 nt, Human
uaucagaaggcacauggagucu

SEQ ID NO: 865166 - RNA, 22 nt, Human
uuuaggcagucauugaacaagu

SEQ ID NO: 865167 - RNA, 22 nt, Human
aggcagagcuggguuuugaaau

SEQ ID NO: 865168 - RNA, 22 nt, Human
gccucugcaauuacauugugcc

SEQ ID NO: 865169 - RNA, 22 nt, Human
agaaaugacacacaugagacau

SEQ ID NO: 865170 - RNA, 22 nt, Human
ucagaauucuacaauagaucag

SEQ ID NO: 865171 - RNA, 22 nt, Human
ucauuguuucugcuuuucauga

SEQ ID NO: 865172 - RNA, 22 nt, Human
ggccagaggugguacauagcuu

SEQ ID NO: 865173 - RNA, 22 nt, Human
uacacaugaucauuuaguagca

SEQ ID NO: 865174 - RNA, 22 nt, Human
aaacuuugguauguagcaaaac

SEQ ID NO: 865175 - RNA, 22 nt, Human
ugaaggccuaacuuccagugcu

SEQ ID NO: 865176 - RNA, 22 nt, Human
caggcagcugacugucagauau

SEQ ID NO: 865177 - RNA, 22 nt, Human
aaaggccacacugcucuuucuc

SEQ ID NO: 865178 - RNA, 21 nt, Human
cuacagaaucgagcauucugg

SEQ ID NO: 865179 - RNA, 17 nt, Human
aaggccauuuccaccca

SEQ ID NO: 865180 - RNA, 22 nt, Human
uuccucuagcuucucacuaaca

SEQ ID NO: 865181 - RNA, 22 nt, Human
agggaggucuuugaggggcuua

SEQ ID NO: 865182 - RNA, 22 nt, Human
aucuuucaguuucauaccaauu

SEQ ID NO: 865183 - RNA, 22 nt, Human
uugcauuuuuagaugcuucugu

SEQ ID NO: 865184 - RNA, 22 nt, Human
uauuccaaaauaguuaagcacu

SEQ ID NO: 865185 - RNA, 22 nt, Human
cuguguuggcuuuucucuugua

SEQ ID NO: 865186 - RNA, 23 nt, Human
ggauuuaguggaugagcugagug

SEQ ID NO: 865187 - RNA, 22 nt, Human
uuuauuguuuagaagggggcug

SEQ ID NO: 865188 - RNA, 22 nt, Human
augcuuaauacacuguuaaagg

SEQ ID NO: 865189 - RNA, 22 nt, Human
cauuguuauagcauuacacacc

SEQ ID NO: 865190 - RNA, 22 nt, Human
guuuuauaggugaaauauuacu

SEQ ID NO: 865191 - RNA, 22 nt, Human
guucuucagaggggaaagaacc

SEQ ID NO: 865192 - RNA, 22 nt, Human
uuaauucuaguuuaacacuuag

SEQ ID NO: 865193 - RNA, 22 nt, Human
aucuucucauguguaaugaggu

SEQ ID NO: 865194 - RNA, 22 nt, Human
ggguacuuaauauuuacggggu

SEQ ID NO: 865195 - RNA, 22 nt, Human
ggcagcuuguccuucaggagag

SEQ ID NO: 865196 - RNA, 22 nt, Human
acuucuucuucagcugggggau

SEQ ID NO: 865197 - RNA, 22 nt, Human
gaguucuaaaggcagaacauaa

SEQ ID NO: 865198 - RNA, 22 nt, Human
ugccgcagugcggggagggccc

SEQ ID NO: 865199 - RNA, 22 nt, Human
ucuucagauggccaguuguccc

SEQ ID NO: 865200 - RNA, 20 nt, Human
gaguccuuaugggcugaggu

SEQ ID NO: 865201 - RNA, 22 nt, Human
gucaggauuggggucaugaguc

SEQ ID NO: 865202 - RNA, 20 nt, Human
uuuaggcauuacucuuuugu

SEQ ID NO: 865203 - RNA, 22 nt, Human
uugaaagacuucuccugugaaa

SEQ ID NO: 865204 - RNA, 22 nt, Human
auuaaauuaaguggcuaauuua

SEQ ID NO: 865205 - RNA, 22 nt, Human
gaaccucagugaaacuggaggu

SEQ ID NO: 865206 - RNA, 22 nt, Human
acauugcugcauucuccuuccc

SEQ ID NO: 865207 - RNA, 21 nt, Human
cccaggagaagaaaagaugca

SEQ ID NO: 865208 - RNA, 22 nt, Human
cucagagaggcaguggaaguca

SEQ ID NO: 865209 - RNA, 22 nt, Human
gaggcagcagggcugguuccuu

SEQ ID NO: 865210 - RNA, 21 nt, Human
acagcaagccuucacaugagu

SEQ ID NO: 865211 - RNA, 22 nt, Human
auuauucuuaugucaucauggc

SEQ ID NO: 865212 - RNA, 20 nt, Human
uggccuuuaaauaguauucc

SEQ ID NO: 865213 - RNA, 22 nt, Human
gcacaauaauucuuguuuugcu

SEQ ID NO: 865214 - RNA, 22 nt, Human
gcagcuaccacccaggaaggac

SEQ ID NO: 865215 - RNA, 22 nt, Human
uuaacaauagaguuucuucagg

SEQ ID NO: 865216 - RNA, 22 nt, Human
gaggggaagacuucuggacagu

SEQ ID NO: 865217 - RNA, 22 nt, Human
ugcaggaaucagaggggaagcg

SEQ ID NO: 865218 - RNA, 22 nt, Human
uaacagaaaggggacagaaaua

SEQ ID NO: 865219 - RNA, 22 nt, Human
ucuuagcacagcuauauaaguu

SEQ ID NO: 865220 - RNA, 22 nt, Human
gcucucuugguggcuguccugg

SEQ ID NO: 865221 - RNA, 22 nt, Human
gucccaggugggcuccaccucu

SEQ ID NO: 865222 - RNA, 22 nt, Human
cugcuuugacuguuaagaacca

SEQ ID NO: 865223 - RNA, 22 nt, Human
uccuuguugcugcagucaccug

SEQ ID NO: 865224 - RNA, 18 nt, Human
ucaggagacacagacgca

SEQ ID NO: 865225 - RNA, 22 nt, Human
uuacaaaguguuaugauaaaca

SEQ ID NO: 865226 - RNA, 22 nt, Human
ugcuucagaggaaaggcaaaag

SEQ ID NO: 865227 - RNA, 22 nt, Human
caaagucagcugccagucccaa

SEQ ID NO: 865228 - RNA, 22 nt, Human
uuuuagcacuaagugauaugcu

SEQ ID NO: 865229 - RNA, 22 nt, Human
gucaacuugcaagaugcugggc

SEQ ID NO: 865230 - RNA, 22 nt, Human
uuccugggacuggagcagccca

SEQ ID NO: 865231 - RNA, 22 nt, Human
uccaugaggcagggaggcuggc

SEQ ID NO: 865232 - RNA, 19 nt, Human
aaaauugcguauuuugagg

SEQ ID NO: 865233 - RNA, 22 nt, Human
ucucaguguguuuucucucaga

SEQ ID NO: 865234 - RNA, 22 nt, Human
cauuuguacagaacagcuuuau

SEQ ID NO: 865235 - RNA, 22 nt, Human
auucuucaguauguguggauug

SEQ ID NO: 865236 - RNA, 22 nt, Human
agcugcccuuaauaggcauuca

SEQ ID NO: 865237 - RNA, 22 nt, Human
cagauuucagcucauauauuau

SEQ ID NO: 865238 - RNA, 22 nt, Human
uucugaaagccaauucauugaa

SEQ ID NO: 865239 - RNA, 22 nt, Human
auuccaaacuuaccccagagga

SEQ ID NO: 865240 - RNA, 22 nt, Human
auucauuuagguauucacuuac

SEQ ID NO: 865241 - RNA, 22 nt, Human
cagaauuuuucgaauguacugu

SEQ ID NO: 865242 - RNA, 22 nt, Human
cuccaggaaagccugaggcccg

SEQ ID NO: 865243 - RNA, 22 nt, Human
ccagaggaggggggucuuucug

SEQ ID NO: 865244 - RNA, 22 nt, Human
uuucaacuuguuugcuuccaua

SEQ ID NO: 865245 - RNA, 22 nt, Human
ucaguaaaguucuuucuugcug

SEQ ID NO: 865246 - RNA, 19 nt, Human
acuggcaguuucugcaugg

SEQ ID NO: 865247 - RNA, 22 nt, Human
ucacugucugaaagaaauggcc

SEQ ID NO: 865248 - RNA, 22 nt, Human
gcuggcaggagccuuucccuuu

SEQ ID NO: 865249 - RNA, 22 nt, Human
auuauuauauagggaaaguccc

SEQ ID NO: 865250 - RNA, 22 nt, Human
uaguaucuauuaguaacaagag

SEQ ID NO: 865251 - RNA, 22 nt, Human
aguggaccagaagacugaagcu

SEQ ID NO: 865252 - RNA, 17 nt, Human
cauuuguugaucaguug

SEQ ID NO: 865253 - RNA, 22 nt, Human
guacagaaugcuugguaaggca

SEQ ID NO: 865254 - RNA, 22 nt, Human
uuucaguuguccuguuaauagc

SEQ ID NO: 865255 - RNA, 22 nt, Human
aagugaagaaauacaugagaau

SEQ ID NO: 865256 - RNA, 22 nt, Human
augguuuuccucugcugcuuaa

SEQ ID NO: 865257 - RNA, 22 nt, Human
cccuugcaucccauguguggcc

SEQ ID NO: 865258 - RNA, 22 nt, Human
uucaugugaauauauuugucuu

SEQ ID NO: 865259 - RNA, 22 nt, Human
aacaugauggggaagaacaaga

SEQ ID NO: 865260 - RNA, 22 nt, Human
uguuccaagcugcuggauaagc

SEQ ID NO: 865261 - RNA, 22 nt, Human
uuuaggcacagaguugagggac

SEQ ID NO: 865262 - RNA, 22 nt, Human
gcagaauuuggggguaaccuuu

SEQ ID NO: 865263 - RNA, 16 nt, Human
aaggagggaagagaau

SEQ ID NO: 865264 - RNA, 22 nt, Human
ggaggggaacuaaucccgugac

SEQ ID NO: 865265 - RNA, 22 nt, Human
auaaagauuuuuaggcauuucu

SEQ ID NO: 865266 - RNA, 22 nt, Human
cugcuguguuggcauuggauag

SEQ ID NO: 865267 - RNA, 22 nt, Human
uuuuugcugauaagcagaauuc

SEQ ID NO: 865268 - RNA, 23 nt, Human
acagaaaucauuuguaagguacc

SEQ ID NO: 865269 - RNA, 22 nt, Human
aacaugcuuugauaaauaaaag

SEQ ID NO: 865270 - RNA, 22 nt, Human
aggcggcugguguccugcaggu

SEQ ID NO: 865271 - RNA, 22 nt, Human
aaggaaccauuugugugcaugg

SEQ ID NO: 865272 - RNA, 22 nt, Human
aggcagcuggaggcagagacua

SEQ ID NO: 865273 - RNA, 22 nt, Human
auuaggcacuagaaugucaauu

SEQ ID NO: 865274 - RNA, 22 nt, Human
acaaagucaaauugcagccgcc

SEQ ID NO: 865275 - RNA, 22 nt, Human
caucagaaugaauguucuggag

SEQ ID NO: 865276 - RNA, 22 nt, Human
ggaggacacuggcucugccuuc

SEQ ID NO: 865277 - RNA, 22 nt, Human
ggccagcucugcacagcagcug

SEQ ID NO: 865278 - RNA, 22 nt, Human
uguacaauagcuauuaucucca

SEQ ID NO: 865279 - RNA, 22 nt, Human
ggaggaggggcgcuuugucuau

SEQ ID NO: 865280 - RNA, 22 nt, Human
ggugagggaguggaacgaggug

SEQ ID NO: 865281 - RNA, 22 nt, Human
ucauuuguggaagugauugugg

SEQ ID NO: 865282 - RNA, 20 nt, Human
ugcguguguauuuauuuucu

SEQ ID NO: 865283 - RNA, 22 nt, Human
ggagaggguguggaaaguuauc

SEQ ID NO: 865284 - RNA, 22 nt, Human
ucucacuuuguugcccagacuu

SEQ ID NO: 865285 - RNA, 20 nt, Human
aaucagaaagugugagcucu

SEQ ID NO: 865286 - RNA, 22 nt, Human
uaucagaacacauguuuugcag

SEQ ID NO: 865287 - RNA, 22 nt, Human
uuaagauagaacccaguagucu

SEQ ID NO: 865288 - RNA, 22 nt, Human
aggauuuauuccagaaaugcaa

SEQ ID NO: 865289 - RNA, 22 nt, Human
uuucuucucgacaccuuauccc

SEQ ID NO: 865290 - RNA, 22 nt, Human
gcaucuaaauaaacgugggagu

SEQ ID NO: 865291 - RNA, 21 nt, Human
agcaccuuacagcuauaaugg

SEQ ID NO: 865292 - RNA, 22 nt, Human
cguccuuacagagggucacagc

SEQ ID NO: 865293 - RNA, 22 nt, Human
auacagaauucacuacaguuuc

SEQ ID NO: 865294 - RNA, 22 nt, Human
augcuguguccuagugaaagaa

SEQ ID NO: 865295 - RNA, 23 nt, Human
acagacaacacugaugagagaaa

SEQ ID NO: 865296 - RNA, 21 nt, Human
ugcugaugucagagaagcaag

SEQ ID NO: 865297 - RNA, 22 nt, Human
ucucugaguauccugaacugcc

SEQ ID NO: 865298 - RNA, 22 nt, Human
gccaggagugucccacucauuu

SEQ ID NO: 865299 - RNA, 22 nt, Human
ggggcagcuaccggaaguaggg

SEQ ID NO: 865300 - RNA, 22 nt, Human
aaauuucaguuggaaugagcuc

SEQ ID NO: 865301 - RNA, 22 nt, Human
agugcuuugugcucucacugca

SEQ ID NO: 865302 - RNA, 19 nt, Human
uacauacuuauucuaaaag

SEQ ID NO: 865303 - RNA, 22 nt, Human
aggguggcugaguagauggaag

SEQ ID NO: 865304 - RNA, 19 nt, Human
aacuguaauuaauacccua

SEQ ID NO: 865305 - RNA, 22 nt, Human
caaagcaccacaaaccagguga

SEQ ID NO: 865306 - RNA, 22 nt, Human
uuuacagauguggaaagugagc

SEQ ID NO: 865307 - RNA, 22 nt, Human
acaugcuuugauguauuuugca

SEQ ID NO: 865308 - RNA, 22 nt, Human
gauuuacagguuagguccugua

SEQ ID NO: 865309 - RNA, 23 nt, Human
ugaaggccuggaggacgcguugu

SEQ ID NO: 865310 - RNA, 22 nt, Human
caucagaauuacuuggggagcu

SEQ ID NO: 865311 - RNA, 22 nt, Human
gauuuagagcaggaaugcaugg

SEQ ID NO: 865312 - RNA, 20 nt, Human
aucuucuuggccagcuugcu

SEQ ID NO: 865313 - RNA, 22 nt, Human
uggaaagucucuuuugacugua

SEQ ID NO: 865314 - RNA, 22 nt, Human
gaggagagagggacugucugca

SEQ ID NO: 865315 - RNA, 18 nt, Human
acugugugaauuagcucc

SEQ ID NO: 865316 - RNA, 22 nt, Human
agagugcagauaagagaauguu

SEQ ID NO: 865317 - RNA, 22 nt, Human
auugaaagaguuuucugcugca

SEQ ID NO: 865318 - RNA, 22 nt, Human
ggcaggcagaggcugagacagg

SEQ ID NO: 865319 - RNA, 22 nt, Human
cagcugccuucugcgggaaguc

SEQ ID NO: 865320 - RNA, 22 nt, Human
cagucaccaccagguggcagua

SEQ ID NO: 865321 - RNA, 22 nt, Human
agacucaagcagauaggaauua

SEQ ID NO: 865322 - RNA, 22 nt, Human
uuucuucagccuucacaaccug

SEQ ID NO: 865323 - RNA, 22 nt, Human
uuuccuaguucuaagaaaugua

SEQ ID NO: 865324 - RNA, 22 nt, Human
caggaugagaagggcucuuacg

SEQ ID NO: 865325 - RNA, 22 nt, Human
aucuauacccaucaugauuuaa

SEQ ID NO: 865326 - RNA, 17 nt, Human
gcuguaguuugauaaga

SEQ ID NO: 865327 - RNA, 22 nt, Human
cuacagaaacacuggacaugug

SEQ ID NO: 865328 - RNA, 22 nt, Human
ccaggcugagcaugauuggagc

SEQ ID NO: 865329 - RNA, 21 nt, Human
ucaggagagcccaucuacaaa

SEQ ID NO: 865330 - RNA, 22 nt, Human
gguggaaggccuggaaggaggc

SEQ ID NO: 865331 - RNA, 22 nt, Human
agaauuucaaauggaaguuuua

SEQ ID NO: 865332 - RNA, 22 nt, Human
gcggagggcgagcccgcggagc

SEQ ID NO: 865333 - RNA, 21 nt, Human
ccugcugugaucuuagugagu

SEQ ID NO: 865334 - RNA, 22 nt, Human
uaguuuuacuugcgaugauaau

SEQ ID NO: 865335 - RNA, 22 nt, Human
guucuucacauuucauugagga

SEQ ID NO: 865336 - RNA, 21 nt, Human
aaugaaguggcuauuuugagg

SEQ ID NO: 865337 - RNA, 22 nt, Human
uaacaucuuuagcagcucgaac

SEQ ID NO: 865338 - RNA, 23 nt, Human
uggaaagcggaccuggggcagag

SEQ ID NO: 865339 - RNA, 22 nt, Human
gcuggcagggacagcugcgugu

SEQ ID NO: 865340 - RNA, 22 nt, Human
agauucuacucuagauccaugg

SEQ ID NO: 865341 - RNA, 22 nt, Human
gaaggccauugcguccugggau

SEQ ID NO: 865342 - RNA, 22 nt, Human
ucccaggacccaggcauucaca

SEQ ID NO: 865343 - RNA, 19 nt, Human
ugaaauggcaguugcuaaa

SEQ ID NO: 865344 - RNA, 22 nt, Human
agaaaucaauaucuauauguug

SEQ ID NO: 865345 - RNA, 22 nt, Human
gaggcaguguugaaaaggagag

SEQ ID NO: 865346 - RNA, 22 nt, Human
cugcuguguuucacaccucugg

SEQ ID NO: 865347 - RNA, 22 nt, Human
cagaccucaguccucaguagga

SEQ ID NO: 865348 - RNA, 22 nt, Human
aaugaacauauaaagagaucuu

SEQ ID NO: 865349 - RNA, 22 nt, Human
aaaggccaccaacaugaagcau

SEQ ID NO: 865350 - RNA, 18 nt, Human
augggaggggccaagaga

SEQ ID NO: 865351 - RNA, 22 nt, Human
uccaggaguccuggguggcccc

SEQ ID NO: 865352 - RNA, 22 nt, Human
cugcuguguuucugcuagaaaa

SEQ ID NO: 865353 - RNA, 22 nt, Human
ugcagggcccucauuccugucc

SEQ ID NO: 865354 - RNA, 22 nt, Human
ucucucagaggaagaggcagug

SEQ ID NO: 865355 - RNA, 20 nt, Human
gcccaagguccagaaggggg

SEQ ID NO: 865356 - RNA, 22 nt, Human
aagaacuuccuaauauauuuuc

SEQ ID NO: 865357 - RNA, 22 nt, Human
auuugcuucugugaaaucaagu

SEQ ID NO: 865358 - RNA, 22 nt, Human
caaguaaacaauaugugauuca

SEQ ID NO: 865359 - RNA, 22 nt, Human
uaaagccauacugaaagccacu

SEQ ID NO: 865360 - RNA, 22 nt, Human
gcccaggaguugaagggcugac

SEQ ID NO: 865361 - RNA, 22 nt, Human
auggauuuggaugagauuacuu

SEQ ID NO: 865362 - RNA, 22 nt, Human
gggcagcugccaagugcaucgc

SEQ ID NO: 865363 - RNA, 22 nt, Human
uguucuuuggcuucacagcucu

SEQ ID NO: 865364 - RNA, 22 nt, Human
aauacugucuuucacagauauu

SEQ ID NO: 865365 - RNA, 22 nt, Human
uagugcuuaacacaaagugauu

SEQ ID NO: 865366 - RNA, 22 nt, Human
uggcagcugucuguggggucuc

SEQ ID NO: 865367 - RNA, 22 nt, Human
cuuccaaaauuuauauguugaa

SEQ ID NO: 865368 - RNA, 22 nt, Human
ugcuguguucuccugacucacc

SEQ ID NO: 865369 - RNA, 17 nt, Human
aagacagaagccaugag

SEQ ID NO: 865370 - RNA, 21 nt, Human
gaacauuuggguuguuucuac

SEQ ID NO: 865371 - RNA, 22 nt, Human
aauauaugugguauugaccagc

SEQ ID NO: 865372 - RNA, 22 nt, Human
cauuucaauacuaucugagaau

SEQ ID NO: 865373 - RNA, 22 nt, Human
uucauucugcaguucucagcuc

SEQ ID NO: 865374 - RNA, 22 nt, Human
ccauuucacucuuccugaagga

SEQ ID NO: 865375 - RNA, 22 nt, Human
acuucaugcagaagagagcugu

SEQ ID NO: 865376 - RNA, 22 nt, Human
cauuuacacacagaggugugcu

SEQ ID NO: 865377 - RNA, 22 nt, Human
uuauauuaguuagacuugcugu

SEQ ID NO: 865378 - RNA, 22 nt, Human
cucuuaguaaugccaugaagca

SEQ ID NO: 865379 - RNA, 22 nt, Human
cauagaaacuugcagcaagcac

SEQ ID NO: 865380 - RNA, 22 nt, Human
caggcgagugaacagacucuca

SEQ ID NO: 865381 - RNA, 22 nt, Human
cagcaggaccauugaggcauca

SEQ ID NO: 865382 - RNA, 22 nt, Human
caagaaucagaccugucagggu

SEQ ID NO: 865383 - RNA, 22 nt, Human
augaaauauuucagagcagagu

SEQ ID NO: 865384 - RNA, 22 nt, Human
ugcacaaacuugugucccaggg

SEQ ID NO: 865385 - RNA, 22 nt, Human
gccccagcguggcuguguuagg

SEQ ID NO: 865386 - RNA, 22 nt, Human
cuaauacacccuauugcuuguu

SEQ ID NO: 865387 - RNA, 22 nt, Human
gccaggagaaaaggcgaaugau

SEQ ID NO: 865388 - RNA, 22 nt, Human
agaaaucaugucuuauuucuau

SEQ ID NO: 865389 - RNA, 22 nt, Human
caggcagccaggggaccugucc

SEQ ID NO: 865390 - RNA, 22 nt, Human
cauuaauauuguucuucuuuag

SEQ ID NO: 865391 - RNA, 22 nt, Human
ucuggaucccaccgccacacac

SEQ ID NO: 865392 - RNA, 22 nt, Human
ccuggaucuccucuauucauau

SEQ ID NO: 865393 - RNA, 22 nt, Human
ggaggcgauccugggaaacacc

SEQ ID NO: 865394 - RNA, 22 nt, Human
gaaggaggugucaguuggacug

SEQ ID NO: 865395 - RNA, 22 nt, Human
gaggccaggaagcccaagauca

SEQ ID NO: 865396 - RNA, 22 nt, Human
uaauuuacuugcaaauaacaau

SEQ ID NO: 865397 - RNA, 22 nt, Human
aagggcagccugacucacgguc

SEQ ID NO: 865398 - RNA, 22 nt, Human
gugaauaauauuguuuauaaaa

SEQ ID NO: 865399 - RNA, 22 nt, Human
cuugggaaugcuaacagaugac

SEQ ID NO: 865400 - RNA, 22 nt, Human
uucucugaguacguuucagugu

SEQ ID NO: 865401 - RNA, 22 nt, Human
acaauauuguacccagaaguuu

SEQ ID NO: 865402 - RNA, 21 nt, Human
cccaggaggcugagaagagca

SEQ ID NO: 865403 - RNA, 22 nt, Human
caaaucuauauguugauauucu

SEQ ID NO: 865404 - RNA, 23 nt, Human
cuuugccacccagagccugacag

SEQ ID NO: 865405 - RNA, 22 nt, Human
gaagcagcaaguauaggacagg

SEQ ID NO: 865406 - RNA, 22 nt, Human
caaagaagagauuuacagagcu

SEQ ID NO: 865407 - RNA, 22 nt, Human
ucuucucuccugcuuggcagaa

SEQ ID NO: 865408 - RNA, 22 nt, Human
uuuuucaagacaaccugcaugu

SEQ ID NO: 865409 - RNA, 22 nt, Human
cauuucaaacaguuacagcugc

SEQ ID NO: 865410 - RNA, 20 nt, Human
caccagucaugagucaauac

SEQ ID NO: 865411 - RNA, 22 nt, Human
uuucagaaccgcuaaaauaaau

SEQ ID NO: 865412 - RNA, 22 nt, Human
uacugaaaguggucaacagugg

SEQ ID NO: 865413 - RNA, 22 nt, Human
uagucaccugugagcugcguag

SEQ ID NO: 865414 - RNA, 22 nt, Human
cauggucuacaauuucauuuua

SEQ ID NO: 865415 - RNA, 22 nt, Human
augcuguggaaguuccugaagc

SEQ ID NO: 865416 - RNA, 22 nt, Human
uuccauaauaaccugagagaaa

SEQ ID NO: 865417 - RNA, 18 nt, Human
cugcccagagcacuugug

SEQ ID NO: 865418 - RNA, 22 nt, Human
uuuguagaggguaauugacaga

SEQ ID NO: 865419 - RNA, 22 nt, Human
cccucuacagggaagcgcuuuc

SEQ ID NO: 865420 - RNA, 22 nt, Human
uaguccuuacuuacuagaauaa

SEQ ID NO: 865421 - RNA, 22 nt, Human
agucacuguucugucaugucaa

SEQ ID NO: 865422 - RNA, 22 nt, Human
ucuuugcaaaauacaacaaugg

SEQ ID NO: 865423 - RNA, 22 nt, Human
auuccaaagcacaucagaacua

SEQ ID NO: 865424 - RNA, 22 nt, Human
gaaguacaguuuuaucuagcca

SEQ ID NO: 865425 - RNA, 22 nt, Human
uucacacacagcuuccuauugu

SEQ ID NO: 865426 - RNA, 22 nt, Human
aacuuucuuggaugucucaaca

SEQ ID NO: 865427 - RNA, 22 nt, Human
gagagguccauuccccugucag

SEQ ID NO: 865428 - RNA, 22 nt, Human
caauuucacuaaugaugugggg

SEQ ID NO: 865429 - RNA, 22 nt, Human
agcauccaacaggagggaaggg

SEQ ID NO: 865430 - RNA, 22 nt, Human
uaauauguguuacugacuuuuu

SEQ ID NO: 865431 - RNA, 22 nt, Human
aucauucugauggucaaugcua

SEQ ID NO: 865432 - RNA, 22 nt, Human
guaaacaucagccacucuauuu

SEQ ID NO: 865433 - RNA, 18 nt, Human
ucuuuggacaacuacugg

SEQ ID NO: 865434 - RNA, 22 nt, Human
auugaaaguccuaucuaaggga

SEQ ID NO: 865435 - RNA, 22 nt, Human
uauaucaccaaaaacaguucug

SEQ ID NO: 865436 - RNA, 22 nt, Human
aguccaaggagagacagcauuu

SEQ ID NO: 865437 - RNA, 22 nt, Human
ccuggauccaugaaaaggcuac

SEQ ID NO: 865438 - RNA, 22 nt, Human
aauaauuacccaucuuuuugua

SEQ ID NO: 865439 - RNA, 16 nt, Human
auuuccagauuaugca

SEQ ID NO: 865440 - RNA, 22 nt, Human
ucaaguuucucucagauuaugg

SEQ ID NO: 865441 - RNA, 22 nt, Human
ugcuggaggauuaaacaaguca

SEQ ID NO: 865442 - RNA, 22 nt, Human
gcccaggaucugcucagaucau

SEQ ID NO: 865443 - RNA, 22 nt, Human
aaggcagcacagcaacugcuca

SEQ ID NO: 865444 - RNA, 22 nt, Human
acucaggagggaucagcuauca

SEQ ID NO: 865445 - RNA, 22 nt, Human
cucccaggguagggagagacua

SEQ ID NO: 865446 - RNA, 23 nt, Human
agaggcaggaguggcuugcccgg

SEQ ID NO: 865447 - RNA, 22 nt, Human
gagguagccacagauagagacu

SEQ ID NO: 865448 - RNA, 22 nt, Human
gcuccucugucaaaugagagug

SEQ ID NO: 865449 - RNA, 22 nt, Human
aaggccaacuaggaugagcuag

SEQ ID NO: 865450 - RNA, 22 nt, Human
uuucaucuucccagagaccuug

SEQ ID NO: 865451 - RNA, 22 nt, Human
gcagaauuuucuguuuucuaga

SEQ ID NO: 865452 - RNA, 22 nt, Human
uguuugaauuuugcuaacgugu

SEQ ID NO: 865453 - RNA, 22 nt, Human
ccaggaugacccccacuuuccu

SEQ ID NO: 865454 - RNA, 22 nt, Human
aggcagacugugcgggaagagu

SEQ ID NO: 865455 - RNA, 22 nt, Human
gucuucuuguguugccugucuu

SEQ ID NO: 865456 - RNA, 22 nt, Human
gggagcugaauggcaauggaga

SEQ ID NO: 865457 - RNA, 22 nt, Human
uuuuaacuuaaaauacauagau

SEQ ID NO: 865458 - RNA, 22 nt, Human
uaauuccaccuuuuuccaacuu

SEQ ID NO: 865459 - RNA, 22 nt, Human
cagugauguuucugcaucagag

SEQ ID NO: 865460 - RNA, 21 nt, Human
cgcagagcgaacuugcggcgc

SEQ ID NO: 865461 - RNA, 22 nt, Human
cuuugcaauagaggcacacaug

SEQ ID NO: 865462 - RNA, 22 nt, Human
ucauuugugugagugauuugac

SEQ ID NO: 865463 - RNA, 21 nt, Human
uuacagaauccaugggaaguc

SEQ ID NO: 865464 - RNA, 22 nt, Human
ccacuucaucagugcuccauuu

SEQ ID NO: 865465 - RNA, 22 nt, Human
uaauuuuaugacaguguauuuu

SEQ ID NO: 865466 - RNA, 22 nt, Human
aauuuacaguugcugaugguac

SEQ ID NO: 865467 - RNA, 22 nt, Human
uguucuucuagauugccuuuua

SEQ ID NO: 865468 - RNA, 22 nt, Human
cugcuguguggauucaauggcu

SEQ ID NO: 865469 - RNA, 22 nt, Human
ccaggagacccagggaaggagc

SEQ ID NO: 865470 - RNA, 22 nt, Human
uuucaguuacugcuauaucauu

SEQ ID NO: 865471 - RNA, 22 nt, Human
ucaauaaaucccucugacccug

SEQ ID NO: 865472 - RNA, 22 nt, Human
caaauaguaugagcaaugauuc

SEQ ID NO: 865473 - RNA, 16 nt, Human
gcccaggacgggaggc

SEQ ID NO: 865474 - RNA, 22 nt, Human
aaguccuuauguggaggggcua

SEQ ID NO: 865475 - RNA, 22 nt, Human
ccaggaaauggcuugcuucuuu

SEQ ID NO: 865476 - RNA, 22 nt, Human
uuaaggauguugugauuuauua

SEQ ID NO: 865477 - RNA, 22 nt, Human
uuugcagugucagcuucugugu

SEQ ID NO: 865478 - RNA, 22 nt, Human
uuuaggcagcagugaggaugaa

SEQ ID NO: 865479 - RNA, 22 nt, Human
ucccaggaugugcgugccgccg

SEQ ID NO: 865480 - RNA, 22 nt, Human
gcucccaggcauggagguaauu

SEQ ID NO: 865481 - RNA, 22 nt, Human
aggccagcaagaaagagagucu

SEQ ID NO: 865482 - RNA, 22 nt, Human
ucagugugaggucuuccacccg

SEQ ID NO: 865483 - RNA, 23 nt, Human
ugguucuaggccuauaauuauau

SEQ ID NO: 865484 - RNA, 22 nt, Human
aggaggcacucacucucagggu

SEQ ID NO: 865485 - RNA, 22 nt, Human
cuggcuguauuaguuugauccu

SEQ ID NO: 865486 - RNA, 22 nt, Human
cccaggaggcagagguugcagu

SEQ ID NO: 865487 - RNA, 22 nt, Human
ucucaggacuuugggaagcuca

SEQ ID NO: 865488 - RNA, 22 nt, Human
aguccuuagaacagugccuggg

SEQ ID NO: 865489 - RNA, 22 nt, Human
auggcuuugcucaaguuuagcc

SEQ ID NO: 865490 - RNA, 22 nt, Human
uuuuuggguccaggcuguaucu

SEQ ID NO: 865491 - RNA, 22 nt, Human
acaggagacccugcugguucug

SEQ ID NO: 865492 - RNA, 22 nt, Human
cagaguggcgacccccucagcu

SEQ ID NO: 865493 - RNA, 19 nt, Human
ugaguucugugguucucaa

SEQ ID NO: 865494 - RNA, 22 nt, Human
gugacaguggucacuuguaguu

SEQ ID NO: 865495 - RNA, 22 nt, Human
gcuguguuuuauguuagguuaa

SEQ ID NO: 865496 - RNA, 22 nt, Human
acauaauaaaaauaacagcuca

SEQ ID NO: 865497 - RNA, 22 nt, Human
acaggagaaaucuggucaaaag

SEQ ID NO: 865498 - RNA, 22 nt, Human
auaguuugugaaacacagcagu

SEQ ID NO: 865499 - RNA, 22 nt, Human
gaaauauacauugcaggaagag

SEQ ID NO: 865500 - RNA, 22 nt, Human
uccaggagguugagacugcagu

SEQ ID NO: 865501 - RNA, 22 nt, Human
ucuucagagugaaagucuguga

SEQ ID NO: 865502 - RNA, 22 nt, Human
aggcagcauccagaggagaaug

SEQ ID NO: 865503 - RNA, 22 nt, Human
ugucucaguacacuccgauguu

SEQ ID NO: 865504 - RNA, 22 nt, Human
cugcuguguuagcagguuuagu

SEQ ID NO: 865505 - RNA, 22 nt, Human
cucaggauggaagccuacagga

SEQ ID NO: 865506 - RNA, 22 nt, Human
uccaggaggcaccuuuggacca

SEQ ID NO: 865507 - RNA, 22 nt, Human
ggccaggaagggaagaucagca

SEQ ID NO: 865508 - RNA, 22 nt, Human
auuacagaaugcaguuccuuau

SEQ ID NO: 865509 - RNA, 22 nt, Human
agaucuauuagcaaacugccau

SEQ ID NO: 865510 - RNA, 22 nt, Human
acaacuuuguagcaauuccacg

SEQ ID NO: 865511 - RNA, 22 nt, Human
uugaaaguuuauggagucugca

SEQ ID NO: 865512 - RNA, 22 nt, Human
agaauucauaggaaguuuccua

SEQ ID NO: 865513 - RNA, 22 nt, Human
cacccugggcugggccuguuaa

SEQ ID NO: 865514 - RNA, 22 nt, Human
ucagaauugcagggagggcagg

SEQ ID NO: 865515 - RNA, 22 nt, Human
gggcagcugcagggauggugac

SEQ ID NO: 865516 - RNA, 22 nt, Human
ugaggcagaaauuccuguuuuc

SEQ ID NO: 865517 - RNA, 22 nt, Human
cauuuccugucuggaggucaaa

SEQ ID NO: 865518 - RNA, 23 nt, Human
uccaggagcaugcuggcuggcga

SEQ ID NO: 865519 - RNA, 22 nt, Human
cucccaggggaacuaucaagua

SEQ ID NO: 865520 - RNA, 22 nt, Human
aggauuuagauuuggaggaacu

SEQ ID NO: 865521 - RNA, 22 nt, Human
caugcuuauucauucugcuaac

SEQ ID NO: 865522 - RNA, 22 nt, Human
aucauaaagugcuaucugauug

SEQ ID NO: 865523 - RNA, 22 nt, Human
augcuuuagugucaaguuuggg

SEQ ID NO: 865524 - RNA, 22 nt, Human
agugcuuuauguuguugugcaa

SEQ ID NO: 865525 - RNA, 19 nt, Human
aucugccuuagugcugcug

SEQ ID NO: 865526 - RNA, 22 nt, Human
auacaugugggucuaaacauau

SEQ ID NO: 865527 - RNA, 22 nt, Human
uacuuugaagacaauaucugga

SEQ ID NO: 865528 - RNA, 22 nt, Human
gagggagugccagagggccagc

SEQ ID NO: 865529 - RNA, 22 nt, Human
gaucuguuucauucacagucug

SEQ ID NO: 865530 - RNA, 22 nt, Human
guucuucaucauuaacacucug

SEQ ID NO: 865531 - RNA, 22 nt, Human
ugaaggccacuuccugugagcu

SEQ ID NO: 865532 - RNA, 22 nt, Human
cccaggagguggaguucacagu

SEQ ID NO: 865533 - RNA, 22 nt, Human
auugaaagauuuugggcucaug

SEQ ID NO: 865534 - RNA, 22 nt, Human
uggucuuuaagguagcugucau

SEQ ID NO: 865535 - RNA, 22 nt, Human
gcugguuuccuuaucuauaaag

SEQ ID NO: 865536 - RNA, 22 nt, Human
ggggggugcugaucaguggagc

SEQ ID NO: 865537 - RNA, 22 nt, Human
ccccaggagauuugggagcaca

SEQ ID NO: 865538 - RNA, 22 nt, Human
uggcuuaagauuuaugcuuuua

SEQ ID NO: 865539 - RNA, 22 nt, Human
acccaggagcaggcugggcagu

SEQ ID NO: 865540 - RNA, 22 nt, Human
uuauuuaaaagugguaagauuc

SEQ ID NO: 865541 - RNA, 22 nt, Human
cucuaacacuguaaugcuuucu

SEQ ID NO: 865542 - RNA, 22 nt, Human
cucuccucagaacaggcccucu

SEQ ID NO: 865543 - RNA, 22 nt, Human
auauaauuguucugaaguguuu

SEQ ID NO: 865544 - RNA, 22 nt, Human
ccagcugucagugugaaaauaa

SEQ ID NO: 865545 - RNA, 22 nt, Human
ccagcuauugcuguguaacagu

SEQ ID NO: 865546 - RNA, 22 nt, Human
ugccaggauggccagggggcca

SEQ ID NO: 865547 - RNA, 22 nt, Human
uauuucuaagagauaucuguac

SEQ ID NO: 865548 - RNA, 22 nt, Human
auucuucacauggauaggaucu

SEQ ID NO: 865549 - RNA, 22 nt, Human
uccaggagauacacugcaccag

SEQ ID NO: 865550 - RNA, 22 nt, Human
auuccaguuggguucuaauaca

SEQ ID NO: 865551 - RNA, 22 nt, Human
ugauaauauuuugaaucauaag

SEQ ID NO: 865552 - RNA, 22 nt, Human
acacauuuacauguuuacguau

SEQ ID NO: 865553 - RNA, 22 nt, Human
uaagaaucugcauuuuaacaag

SEQ ID NO: 865554 - RNA, 22 nt, Human
ucagaaauacaaaacacuuacu

SEQ ID NO: 865555 - RNA, 22 nt, Human
agcauuuagucuuuauugcagc

SEQ ID NO: 865556 - RNA, 22 nt, Human
uaucuguuaggaucagagcugg

SEQ ID NO: 865557 - RNA, 22 nt, Human
uggauuuauuagguuggugaaa

SEQ ID NO: 865558 - RNA, 22 nt, Human
cagcuacuccucccaugacuuc

SEQ ID NO: 865559 - RNA, 22 nt, Human
aggauuuagcaugaaaugugaa

SEQ ID NO: 865560 - RNA, 22 nt, Human
ugaaucaguauaaauucucaaa

SEQ ID NO: 865561 - RNA, 22 nt, Human
cagaaaaggaagagcuauguaa

SEQ ID NO: 865562 - RNA, 22 nt, Human
acaugucuuuuaaagucuaaua

SEQ ID NO: 865563 - RNA, 17 nt, Human
gaggacagggaaguagg

SEQ ID NO: 865564 - RNA, 22 nt, Human
uaaguggaagguuauaugcuaa

SEQ ID NO: 865565 - RNA, 22 nt, Human
ccuggacucaggcugugggcac

SEQ ID NO: 865566 - RNA, 22 nt, Human
acauucacuauguccaaacucu

SEQ ID NO: 865567 - RNA, 22 nt, Human
acuuugcagggcuugauaucca

SEQ ID NO: 865568 - RNA, 22 nt, Human
cuggauuuaggacuaguccaag

SEQ ID NO: 865569 - RNA, 22 nt, Human
aggaagcuaaccagggagugag

SEQ ID NO: 865570 - RNA, 22 nt, Human
aaauguuuugcucccauguggu

SEQ ID NO: 865571 - RNA, 22 nt, Human
caagauggguguugugaugguu

SEQ ID NO: 865572 - RNA, 22 nt, Human
gcagcuccuccugggcuggaga

SEQ ID NO: 865573 - RNA, 22 nt, Human
cucuccucugaaguggugaccc

SEQ ID NO: 865574 - RNA, 20 nt, Human
ggcagcuugggcagcaguua

SEQ ID NO: 865575 - RNA, 22 nt, Human
accaggagccacaggaggagcc

SEQ ID NO: 865576 - RNA, 22 nt, Human
aguuacagugaccauuuauuua

SEQ ID NO: 865577 - RNA, 22 nt, Human
gaggcagcuggguccggucggg

SEQ ID NO: 865578 - RNA, 22 nt, Human
gcuuugaagucugugucuuuug

SEQ ID NO: 865579 - RNA, 22 nt, Human
aaagccaugggucuuuggcaua

SEQ ID NO: 865580 - RNA, 22 nt, Human
agucaauucuuuucaacucaag

SEQ ID NO: 865581 - RNA, 19 nt, Human
ugaggggaggagaggccug

SEQ ID NO: 865582 - RNA, 22 nt, Human
uaguccuuuccggcugcuauaa

SEQ ID NO: 865583 - RNA, 22 nt, Human
aaagccagagcaagcugucaca

SEQ ID NO: 865584 - RNA, 22 nt, Human
caugcuuuucaaucuaucuuaa

SEQ ID NO: 865585 - RNA, 22 nt, Human
cucugcaugccuugcucagaca

SEQ ID NO: 865586 - RNA, 22 nt, Human
cagucccuaguggagcucacag

SEQ ID NO: 865587 - RNA, 22 nt, Human
aggauuuaggagcuggcuaacg

SEQ ID NO: 865588 - RNA, 22 nt, Human
uggcagcugugcuucauucuuu

SEQ ID NO: 865589 - RNA, 22 nt, Human
aauuccaaguagcaucccauca

SEQ ID NO: 865590 - RNA, 22 nt, Human
cuuaggcauccaggguucuucc

SEQ ID NO: 865591 - RNA, 22 nt, Human
ggcacagagcccagcuuccuag

SEQ ID NO: 865592 - RNA, 22 nt, Human
ucccaggaggugcuuccuagga

SEQ ID NO: 865593 - RNA, 22 nt, Human
acauaccauacauggugagaug

SEQ ID NO: 865594 - RNA, 22 nt, Human
uaaaaugaucucucauguucuu

SEQ ID NO: 865595 - RNA, 22 nt, Human
gucaggaugcuauuguuauuaa

SEQ ID NO: 865596 - RNA, 22 nt, Human
uugguuuaggaacuggcuugga

SEQ ID NO: 865597 - RNA, 23 nt, Human
ucucaagaggaagcagggcucau

SEQ ID NO: 865598 - RNA, 22 nt, Human
uccaggagucuagccucaggcc

SEQ ID NO: 865599 - RNA, 22 nt, Human
acaacuuuaauggguuucagcu

SEQ ID NO: 865600 - RNA, 22 nt, Human
gucacuguuuccuauuauauuu

SEQ ID NO: 865601 - RNA, 19 nt, Human
cccaggagcaguauugaug

SEQ ID NO: 865602 - RNA, 23 nt, Human
acauacauggagauaaagugaug

SEQ ID NO: 865603 - RNA, 22 nt, Human
aagggagguaaagcuauuuaaa

SEQ ID NO: 865604 - RNA, 22 nt, Human
aguucuucauaaccuuacugug

SEQ ID NO: 865605 - RNA, 22 nt, Human
uauaucauggagauuaacauuc

SEQ ID NO: 865606 - RNA, 20 nt, Human
uguuccaagcuaaugaauga

SEQ ID NO: 865607 - RNA, 22 nt, Human
uuugaaagccuggcuuuucucu

SEQ ID NO: 865608 - RNA, 22 nt, Human
cuacccagcaccuaggcugccu

SEQ ID NO: 865609 - RNA, 22 nt, Human
gcuuuaaugaagucacgcaaag

SEQ ID NO: 865610 - RNA, 22 nt, Human
cuauaauuaugcucaaaaugua

SEQ ID NO: 865611 - RNA, 22 nt, Human
auuauccagcaccaaugucaga

SEQ ID NO: 865612 - RNA, 22 nt, Human
aggcagacucaauggcuagaua

SEQ ID NO: 865613 - RNA, 22 nt, Human
ggccaggagaggagggcacuga

SEQ ID NO: 865614 - RNA, 22 nt, Human
agcaccuugcucuuggccuucc

SEQ ID NO: 865615 - RNA, 22 nt, Human
uggaagggagugacagucagag

SEQ ID NO: 865616 - RNA, 22 nt, Human
acucaggaagaaagcagcuggu

SEQ ID NO: 865617 - RNA, 22 nt, Human
guugacagcuggugagcugcua

SEQ ID NO: 865618 - RNA, 22 nt, Human
cucaggauccaucuccugcccu

SEQ ID NO: 865619 - RNA, 22 nt, Human
ggcauuuacauaaucuuauuua

SEQ ID NO: 865620 - RNA, 22 nt, Human
aucuuucaaucaggaaaaaucu

SEQ ID NO: 865621 - RNA, 21 nt, Human
ccaggaaggacugagcucccu

SEQ ID NO: 865622 - RNA, 22 nt, Human
ucaguucaguauacacuauucu

SEQ ID NO: 865623 - RNA, 22 nt, Human
uuuacagagaauguacauaaag

SEQ ID NO: 865624 - RNA, 22 nt, Human
cacauauuugaugaagcuuugu

SEQ ID NO: 865625 - RNA, 22 nt, Human
caaugugguggcagaugucagu

SEQ ID NO: 865626 - RNA, 22 nt, Human
ugaaucugauuucccuggaggc

SEQ ID NO: 865627 - RNA, 22 nt, Human
uugagaagaaauaguuugcaau

SEQ ID NO: 865628 - RNA, 22 nt, Human
aucacaaaggguuuucucugag

SEQ ID NO: 865629 - RNA, 22 nt, Human
gaggggagacagggaaaucagu

SEQ ID NO: 865630 - RNA, 22 nt, Human
gcaaaauuuacacuccuucuuc

SEQ ID NO: 865631 - RNA, 20 nt, Human
caauuucaucauuuccugug

SEQ ID NO: 865632 - RNA, 22 nt, Human
agcugcuacugcucugccagag

SEQ ID NO: 865633 - RNA, 22 nt, Human
agggugguucuuuuaguggaag

SEQ ID NO: 865634 - RNA, 22 nt, Human
ggagaggggcaaguuuaucuag

SEQ ID NO: 865635 - RNA, 22 nt, Human
uaaauuaugucacaugacucug

SEQ ID NO: 865636 - RNA, 22 nt, Human
gcugauguuuaguugauguuac

SEQ ID NO: 865637 - RNA, 22 nt, Human
cugcugugggcaggguagcugg

SEQ ID NO: 865638 - RNA, 22 nt, Human
cuuccaaagcacuuuauggacc

SEQ ID NO: 865639 - RNA, 19 nt, Human
uacuaaacaugcauauugg

SEQ ID NO: 865640 - RNA, 22 nt, Human
aggcagcagucaugaggaaaga

SEQ ID NO: 865641 - RNA, 22 nt, Human
cauggcuuuguucuguuagaug

SEQ ID NO: 865642 - RNA, 22 nt, Human
ucaauaaauagcuuggcucagc

SEQ ID NO: 865643 - RNA, 22 nt, Human
ucaggaugguguggaggaaaua

SEQ ID NO: 865644 - RNA, 22 nt, Human
aguccagugaacuguaaauagg

SEQ ID NO: 865645 - RNA, 22 nt, Human
cagcagagaccaagugauuuga

SEQ ID NO: 865646 - RNA, 21 nt, Human
cccacggaaugaugaggcacu

SEQ ID NO: 865647 - RNA, 22 nt, Human
gagucuuugguaaagucugcug

SEQ ID NO: 865648 - RNA, 22 nt, Human
aacacuuucuauuauuaugguu

SEQ ID NO: 865649 - RNA, 22 nt, Human
guaaacaacacaaaucauuuga

SEQ ID NO: 865650 - RNA, 22 nt, Human
aauggcuucugaagcacacuuu

SEQ ID NO: 865651 - RNA, 21 nt, Human
uccaggagcacgggacuagga

SEQ ID NO: 865652 - RNA, 22 nt, Human
gauggcuucagucuccuugggu

SEQ ID NO: 865653 - RNA, 20 nt, Human
uugauucaagggcugaugga

SEQ ID NO: 865654 - RNA, 22 nt, Human
uuuccucacuucaugagaguuu

SEQ ID NO: 865655 - RNA, 22 nt, Human
cuacagaauggagggucagaga

SEQ ID NO: 865656 - RNA, 22 nt, Human
auacagauguugaauguuauau

SEQ ID NO: 865657 - RNA, 22 nt, Human
ucagaaauagucuuuaaaauga

SEQ ID NO: 865658 - RNA, 22 nt, Human
uucaacuauuaugaauaaaauu

SEQ ID NO: 865659 - RNA, 22 nt, Human
ucuuugaauucaaacuguucaa

SEQ ID NO: 865660 - RNA, 22 nt, Human
ucauuuguugcuguuaccugag

SEQ ID NO: 865661 - RNA, 22 nt, Human
ucccaggagcaccuuuugagcc

SEQ ID NO: 865662 - RNA, 22 nt, Human
uucaacuaauguuuauuuuaug

SEQ ID NO: 865663 - RNA, 22 nt, Human
aaaugaaaugagugccuggagg

SEQ ID NO: 865664 - RNA, 22 nt, Human
uucauucuugucuuuguauagu

SEQ ID NO: 865665 - RNA, 22 nt, Human
cuguuucaagugaagucagaca

SEQ ID NO: 865666 - RNA, 22 nt, Human
caggcagcugggucaccguccc

SEQ ID NO: 865667 - RNA, 20 nt, Human
ucacaucuggcagcugauga

SEQ ID NO: 865668 - RNA, 22 nt, Human
uuauuauugugguugcauuauc

SEQ ID NO: 865669 - RNA, 22 nt, Human
cauagaaaucaggugagaaucu

SEQ ID NO: 865670 - RNA, 22 nt, Human
uccagccuaggggaacagcugc

SEQ ID NO: 865671 - RNA, 23 nt, Human
augaaugaauaaggcaggaaagc

SEQ ID NO: 865672 - RNA, 22 nt, Human
uucagaaaaagaccauugcaau

SEQ ID NO: 865673 - RNA, 22 nt, Human
uggcagcuagcuguuuucaugc

SEQ ID NO: 865674 - RNA, 22 nt, Human
uaaaauugcggugaauauuucc

SEQ ID NO: 865675 - RNA, 22 nt, Human
agaggaggcagcuuaacucagu

SEQ ID NO: 865676 - RNA, 22 nt, Human
uuuuagauaguuuaacugcacu

SEQ ID NO: 865677 - RNA, 22 nt, Human
aguggcagagguugacugcagu

SEQ ID NO: 865678 - RNA, 22 nt, Human
aggauuuauuacaagccauggu

SEQ ID NO: 865679 - RNA, 22 nt, Human
cauuucaauuauuugcucuucu

SEQ ID NO: 865680 - RNA, 22 nt, Human
gaggcagcugaagcuucaaaga

SEQ ID NO: 865681 - RNA, 22 nt, Human
caagauggagaagcagcaaggg

SEQ ID NO: 865682 - RNA, 22 nt, Human
ucugggaacucugucauuuccc

SEQ ID NO: 865683 - RNA, 22 nt, Human
caggagaaauguggcugcuacc

SEQ ID NO: 865684 - RNA, 21 nt, Human
gagugcagcaagguagagucu

SEQ ID NO: 865685 - RNA, 22 nt, Human
gacagcuggcaguggaaaggug

SEQ ID NO: 865686 - RNA, 22 nt, Human
uuagaaaucugcugccaugcaa

SEQ ID NO: 865687 - RNA, 22 nt, Human
uagucaccuguugugugaugcc

SEQ ID NO: 865688 - RNA, 22 nt, Human
caggauggucuucauuuggcuc

SEQ ID NO: 865689 - RNA, 22 nt, Human
ugaggcaggagaaucaccggaa

SEQ ID NO: 865690 - RNA, 22 nt, Human
gucuucuuuucagucugcuugu

SEQ ID NO: 865691 - RNA, 22 nt, Human
uaaagccaacacuuuacugcuc

SEQ ID NO: 865692 - RNA, 22 nt, Human
auaugaaaagaagucaccauug

SEQ ID NO: 865693 - RNA, 22 nt, Human
uucaggaugaaagugugcaaca

SEQ ID NO: 865694 - RNA, 22 nt, Human
auuugcuuuaagguauaaaagg

SEQ ID NO: 865695 - RNA, 22 nt, Human
cagaguucaaagccugcuggga

SEQ ID NO: 865696 - RNA, 22 nt, Human
cccuguacagucucuguggcac

SEQ ID NO: 865697 - RNA, 22 nt, Human
uggcaaggccacaggugcaguu

SEQ ID NO: 865698 - RNA, 22 nt, Human
gaguccuugucauaauucagug

SEQ ID NO: 865699 - RNA, 22 nt, Human
uaggagggcccugaaaauggca

SEQ ID NO: 865700 - RNA, 22 nt, Human
uaucagaacacagccacagcca

SEQ ID NO: 865701 - RNA, 22 nt, Human
uuuguuuagaaagagauuggug

SEQ ID NO: 865702 - RNA, 20 nt, Human
agaagucagcucagaaguga

SEQ ID NO: 865703 - RNA, 22 nt, Human
uccaggagugugugcuaauggg

SEQ ID NO: 865704 - RNA, 22 nt, Human
uagcuguguaagcuugguaaga

SEQ ID NO: 865705 - RNA, 19 nt, Human
ucuuucauuucuagcucug

SEQ ID NO: 865706 - RNA, 22 nt, Human
uguacaaugcugagguuugggg

SEQ ID NO: 865707 - RNA, 22 nt, Human
uggcuucuugggaugggucauu

SEQ ID NO: 865708 - RNA, 22 nt, Human
cuuuuauuuugaauuaagggcu

SEQ ID NO: 865709 - RNA, 22 nt, Human
caguuuuugccauuaagaguaa

SEQ ID NO: 865710 - RNA, 22 nt, Human
gugcugugcgcuuuuucuguau

SEQ ID NO: 865711 - RNA, 22 nt, Human
ggcaccagccaccuauuucuag

SEQ ID NO: 865712 - RNA, 20 nt, Human
ccagaagagaugaucaucca

SEQ ID NO: 865713 - RNA, 22 nt, Human
cuucaggauuuaggaagaugaa

SEQ ID NO: 865714 - RNA, 22 nt, Human
guacagaauuaugccaugaggg

SEQ ID NO: 865715 - RNA, 22 nt, Human
auucuacaacccaauaauaauu

SEQ ID NO: 865716 - RNA, 22 nt, Human
uuaaaauagccagugccccucu

SEQ ID NO: 865717 - RNA, 22 nt, Human
uccuucuuugacaaguggcaga

SEQ ID NO: 865718 - RNA, 22 nt, Human
uaucuguuugcucacagguguu

SEQ ID NO: 865719 - RNA, 22 nt, Human
uuucaugagauuccuccacauc

SEQ ID NO: 865720 - RNA, 22 nt, Human
caggaugggauguagugggccc

SEQ ID NO: 865721 - RNA, 22 nt, Human
gugcauuugugcaugcacaugu

SEQ ID NO: 865722 - RNA, 23 nt, Human
gcagaggagcaagcuggacacca

SEQ ID NO: 865723 - RNA, 22 nt, Human
ugaugaaaauaugauucugagg

SEQ ID NO: 865724 - RNA, 22 nt, Human
aaucuguuuaguucugcguaug

SEQ ID NO: 865725 - RNA, 22 nt, Human
agcagagccugggcuaggggug

SEQ ID NO: 865726 - RNA, 22 nt, Human
uaagaacuucggacauguuauc

SEQ ID NO: 865727 - RNA, 22 nt, Human
agagagggcauagaaaaaggga

SEQ ID NO: 865728 - RNA, 21 nt, Human
cauuuacaugacagauugguu

SEQ ID NO: 865729 - RNA, 22 nt, Human
caagaaucuugcagcuuagacu

SEQ ID NO: 865730 - RNA, 18 nt, Human
uaaauauauuucccccuu

SEQ ID NO: 865731 - RNA, 22 nt, Human
gugaaggacuagcauggagggc

SEQ ID NO: 865732 - RNA, 23 nt, Human
ucuugaaaagccuacagcaguuc

SEQ ID NO: 865733 - RNA, 22 nt, Human
gcuggaucaaguccuucaccca

SEQ ID NO: 865734 - RNA, 22 nt, Human
uuauucuucuucucuugccagg

SEQ ID NO: 865735 - RNA, 22 nt, Human
guagaaaugguguguuucuucu

SEQ ID NO: 865736 - RNA, 22 nt, Human
auuaaauuggaucugcauaguu

SEQ ID NO: 865737 - RNA, 22 nt, Human
ggaggggagauguuugggcuca

SEQ ID NO: 865738 - RNA, 22 nt, Human
ugaaugaauccuaacaaagaca

SEQ ID NO: 865739 - RNA, 22 nt, Human
guuugcauauuugcacaggaau

SEQ ID NO: 865740 - RNA, 22 nt, Human
aaugcuuuuugcgaaaugugca

SEQ ID NO: 865741 - RNA, 22 nt, Human
gugaacuauuggguaucauaaa

SEQ ID NO: 865742 - RNA, 22 nt, Human
ucuggauccuaugcacuggacu

SEQ ID NO: 865743 - RNA, 22 nt, Human
uuucucugcugccugugucgau

SEQ ID NO: 865744 - RNA, 21 nt, Human
uuagaaagcucacuacaguua

SEQ ID NO: 865745 - RNA, 22 nt, Human
accaggagagauuuuauugaga

SEQ ID NO: 865746 - RNA, 22 nt, Human
ccaggagaauaauggcagauua

SEQ ID NO: 865747 - RNA, 22 nt, Human
ggagaggauguuuuaguaacuu

SEQ ID NO: 865748 - RNA, 22 nt, Human
aggcagcuaagauggauaauga

SEQ ID NO: 865749 - RNA, 22 nt, Human
auugaaaauaaggccagaaaca

SEQ ID NO: 865750 - RNA, 22 nt, Human
gucuuuaugguaugaaaacuga

SEQ ID NO: 865751 - RNA, 22 nt, Human
cccaggcagccugcagggaagg

SEQ ID NO: 865752 - RNA, 22 nt, Human
uggcagcuacagacagagguga

SEQ ID NO: 865753 - RNA, 22 nt, Human
aaaucaguuggaacacaagcag

SEQ ID NO: 865754 - RNA, 22 nt, Human
uacuuuuuagcacagugugugc

SEQ ID NO: 865755 - RNA, 19 nt, Human
uugaaagauuagcuuucua

SEQ ID NO: 865756 - RNA, 19 nt, Human
ggcagucucaagcagcaca

SEQ ID NO: 865757 - RNA, 22 nt, Human
aaugguuuucuagaacaugaaa

SEQ ID NO: 865758 - RNA, 22 nt, Human
aggcacaggccucagcacccag

SEQ ID NO: 865759 - RNA, 21 nt, Human
ggauggauagggaagagauuu

SEQ ID NO: 865760 - RNA, 22 nt, Human
cuggcuuuggucaugugaucau

SEQ ID NO: 865761 - RNA, 22 nt, Human
aggauuuacaaugauucuaggu

SEQ ID NO: 865762 - RNA, 22 nt, Human
ugaguuuugucuugcuagaagu

SEQ ID NO: 865763 - RNA, 22 nt, Human
aagacuguacauuuuccagucu

SEQ ID NO: 865764 - RNA, 22 nt, Human
gcccaggaguugaaugcagcag

SEQ ID NO: 865765 - RNA, 22 nt, Human
acuggaucuaauugguuauagu

SEQ ID NO: 865766 - RNA, 22 nt, Human
caggaugguggcaugaucagaa

SEQ ID NO: 865767 - RNA, 22 nt, Human
uuucagcugguaaaggaguagc

SEQ ID NO: 865768 - RNA, 22 nt, Human
cauuuguaucugggcugcugug

SEQ ID NO: 865769 - RNA, 22 nt, Human
ucaggagacuuaugucacagug

SEQ ID NO: 865770 - RNA, 22 nt, Human
ggggcagcucccgagggcagga

SEQ ID NO: 865771 - RNA, 22 nt, Human
gccauuuucugucuuguuuauu

SEQ ID NO: 865772 - RNA, 23 nt, Human
cuuuuaacuugaucugagaccag

SEQ ID NO: 865773 - RNA, 22 nt, Human
uuuaacagguaaaguaaaugug

SEQ ID NO: 865774 - RNA, 20 nt, Human
uugagcuuuuaguacagaca

SEQ ID NO: 865775 - RNA, 22 nt, Human
ucaggagaaagccaauuagagu

SEQ ID NO: 865776 - RNA, 22 nt, Human
cugcugugcaggugccuaugau

SEQ ID NO: 865777 - RNA, 22 nt, Human
uugcagcuucgagucuaucugu

SEQ ID NO: 865778 - RNA, 22 nt, Human
ccagcagagcauggggaggaag

SEQ ID NO: 865779 - RNA, 22 nt, Human
ccagggaguuuccaaucugaga

SEQ ID NO: 865780 - RNA, 22 nt, Human
aaugguauuugucaagcauagu

SEQ ID NO: 865781 - RNA, 22 nt, Human
aauuucaauuacuuuugcacca

SEQ ID NO: 865782 - RNA, 22 nt, Human
ugcccaggaucuggcgaugcuc

SEQ ID NO: 865783 - RNA, 22 nt, Human
aacaucuacuaagugccaggca

SEQ ID NO: 865784 - RNA, 22 nt, Human
cuggaucaugcauugcuugucc

SEQ ID NO: 865785 - RNA, 22 nt, Human
gcucuaauugaaaaauacugca

SEQ ID NO: 865786 - RNA, 22 nt, Human
auucuuauuuaaauagagucug

SEQ ID NO: 865787 - RNA, 21 nt, Human
gcaaauguucaggaaaaaaga

SEQ ID NO: 865788 - RNA, 22 nt, Human
uaggcagaauuguugaaugaag

SEQ ID NO: 865789 - RNA, 22 nt, Human
gaaggccacggaauggagcugg

SEQ ID NO: 865790 - RNA, 18 nt, Human
aagucaccccugcucccu

SEQ ID NO: 865791 - RNA, 22 nt, Human
uccaggaggcagggcugugccc

SEQ ID NO: 865792 - RNA, 22 nt, Human
ccagucacucugugagagcuac

SEQ ID NO: 865793 - RNA, 22 nt, Human
acugcccucccaucuauugcaa

SEQ ID NO: 865794 - RNA, 22 nt, Human
ucugaagauuaccagcuaaaug

SEQ ID NO: 865795 - RNA, 22 nt, Human
gcccaggaguucaaggcugcag

SEQ ID NO: 865796 - RNA, 21 nt, Human
uacugagaccucacagugugc

SEQ ID NO: 865797 - RNA, 22 nt, Human
uuuccaaaggaggaaccaguuu

SEQ ID NO: 865798 - RNA, 22 nt, Human
augaaacagugaauuagucaag

SEQ ID NO: 865799 - RNA, 22 nt, Human
gcccaggaggucaaguagcuau

SEQ ID NO: 865800 - RNA, 22 nt, Human
cauaauuacugauaugcugauu

SEQ ID NO: 865801 - RNA, 22 nt, Human
uaauaaacugcuacgcuuaguu

SEQ ID NO: 865802 - RNA, 22 nt, Human
cucccaggcacagggaggagcc

SEQ ID NO: 865803 - RNA, 22 nt, Human
cccuggaggcuggaggcaguag

SEQ ID NO: 865804 - RNA, 22 nt, Human
gagugucugaauuagagcacaa

SEQ ID NO: 865805 - RNA, 22 nt, Human
uauccaaacauauagucucucu

SEQ ID NO: 865806 - RNA, 20 nt, Human
uucuauacauaucacugaaa

SEQ ID NO: 865807 - RNA, 22 nt, Human
auugcuaggaacagguugcacc

SEQ ID NO: 865808 - RNA, 18 nt, Human
agaugaaagcaaaugaca

SEQ ID NO: 865809 - RNA, 22 nt, Human
uacagaauuagauuauuagaga

SEQ ID NO: 865810 - RNA, 22 nt, Human
cauggauugaauauaaauuaga

SEQ ID NO: 865811 - RNA, 23 nt, Human
uguaacaauuucauauacaugca

SEQ ID NO: 865812 - RNA, 22 nt, Human
gcuccuucaggugguagcuguu

SEQ ID NO: 865813 - RNA, 22 nt, Human
aaaacauguccauacagaaacu

SEQ ID NO: 865814 - RNA, 22 nt, Human
gcaggcagagguggaggagaca

SEQ ID NO: 865815 - RNA, 22 nt, Human
guagaaauuccauuuacuuuga

SEQ ID NO: 865816 - RNA, 22 nt, Human
cucaagacugaucgcaguggaa

SEQ ID NO: 865817 - RNA, 22 nt, Human
cauucuuauauuuacucauuca

SEQ ID NO: 865818 - RNA, 22 nt, Human
aggcagcauuugaauccagguc

SEQ ID NO: 865819 - RNA, 22 nt, Human
uacuaaauaguuuaauuccuca

SEQ ID NO: 865820 - RNA, 22 nt, Human
uccaugagagguaacuuuacaa

SEQ ID NO: 865821 - RNA, 22 nt, Human
gauagaaagaauauagauucca

SEQ ID NO: 865822 - RNA, 22 nt, Human
aggauuuaaauccuuaaccacu

SEQ ID NO: 865823 - RNA, 22 nt, Human
aaagcagguugcaauuacagug

SEQ ID NO: 865824 - RNA, 22 nt, Human
uccaggagggggagccgugccg

SEQ ID NO: 865825 - RNA, 22 nt, Human
caugcugugugguuagaacugu

SEQ ID NO: 865826 - RNA, 22 nt, Human
uugcugaaaucuaugacauccu

SEQ ID NO: 865827 - RNA, 22 nt, Human
auagaaauguauuuuggacuag

SEQ ID NO: 865828 - RNA, 22 nt, Human
uuucacaucagagguagauuag

SEQ ID NO: 865829 - RNA, 22 nt, Human
agggcagccucucagccuaggu

SEQ ID NO: 865830 - RNA, 22 nt, Human
uuucauggcuaggacuagagug

SEQ ID NO: 865831 - RNA, 22 nt, Human
acuugcauuauauuuaucacaa

SEQ ID NO: 865832 - RNA, 22 nt, Human
caugcuuuuuucuaguauaaau

SEQ ID NO: 865833 - RNA, 22 nt, Human
gcuuugaagacuuuuccagggu

SEQ ID NO: 865834 - RNA, 22 nt, Human
aauugcaauuuucuuaaggucu

SEQ ID NO: 865835 - RNA, 22 nt, Human
auuucacaaaccauccugauuu

SEQ ID NO: 865836 - RNA, 22 nt, Human
cauuucaaggaccacccuggga

SEQ ID NO: 865837 - RNA, 22 nt, Human
acugcuuuaucugagaaguccu

SEQ ID NO: 865838 - RNA, 22 nt, Human
uucacagaauggcaaguuaugg

SEQ ID NO: 865839 - RNA, 22 nt, Human
uucaggaugcagagguuguagu

SEQ ID NO: 865840 - RNA, 22 nt, Human
ucagucuucccuccagugcaac

SEQ ID NO: 865841 - RNA, 18 nt, Human
uuccaugauuccuuucac

SEQ ID NO: 865842 - RNA, 22 nt, Human
ugauugaagaggugaggaaguu

SEQ ID NO: 865843 - RNA, 22 nt, Human
agcccaggagguggagguugca

SEQ ID NO: 865844 - RNA, 22 nt, Human
cuccccagguucaggagguggg

SEQ ID NO: 865845 - RNA, 22 nt, Human
augaacaagagagggaagauuc

SEQ ID NO: 865846 - RNA, 22 nt, Human
ggagaggagauuguggcauuuu

SEQ ID NO: 865847 - RNA, 22 nt, Human
auacaaagacaaaucucaaucu

SEQ ID NO: 865848 - RNA, 22 nt, Human
ccaaagcaagucacaugaucaa

SEQ ID NO: 865849 - RNA, 22 nt, Human
uuacauaacgguaugaaaaaug

SEQ ID NO: 865850 - RNA, 22 nt, Human
aaauuauuacaagcuaguuggc

SEQ ID NO: 865851 - RNA, 22 nt, Human
caggcagcauuuacucugauga

SEQ ID NO: 865852 - RNA, 22 nt, Human
uucuccagaccuugugacuaug

SEQ ID NO: 865853 - RNA, 22 nt, Human
uuuaucuuuaggacuuugcaga

SEQ ID NO: 865854 - RNA, 22 nt, Human
ccaggagauuuuuccauagcac

SEQ ID NO: 865855 - RNA, 22 nt, Human
ccagcagaggggcggagugcag

SEQ ID NO: 865856 - RNA, 22 nt, Human
agaggucagauuucuccuggug

SEQ ID NO: 865857 - RNA, 22 nt, Human
aggcaguggaaggagaaagcaa

SEQ ID NO: 865858 - RNA, 22 nt, Human
ggagauggaauagauucugacu

SEQ ID NO: 865859 - RNA, 22 nt, Human
uucuucaguuugguaaauguaa

SEQ ID NO: 865860 - RNA, 22 nt, Human
ucaccagucuuucuuaccauug

SEQ ID NO: 865861 - RNA, 22 nt, Human
caucagaauagcucuguggaua

SEQ ID NO: 865862 - RNA, 22 nt, Human
uuacagaaugugccauuugguc

SEQ ID NO: 865863 - RNA, 22 nt, Human
gagguggaaggcaggaacaaau

SEQ ID NO: 865864 - RNA, 20 nt, Human
agaaaucagaccacacacua

SEQ ID NO: 865865 - RNA, 22 nt, Human
ucucucuucaacccuuaacuag

SEQ ID NO: 865866 - RNA, 22 nt, Human
auccauuugaaagaacagucca

SEQ ID NO: 865867 - RNA, 21 nt, Human
uaaggccaagucuauuucugu

SEQ ID NO: 865868 - RNA, 22 nt, Human
auuaaagacagcagauggaugg

SEQ ID NO: 865869 - RNA, 22 nt, Human
agaucugaccuaaccccaccac

SEQ ID NO: 865870 - RNA, 22 nt, Human
aaggccagaguacuagaggcug

SEQ ID NO: 865871 - RNA, 22 nt, Human
uucucuuuugugaugugagaug

SEQ ID NO: 865872 - RNA, 18 nt, Human
ucuuccaacacugacacc

SEQ ID NO: 865873 - RNA, 22 nt, Human
uuugaaaucuaaucaaggaaca

SEQ ID NO: 865874 - RNA, 20 nt, Human
gcccaggaucucugaggcau

SEQ ID NO: 865875 - RNA, 22 nt, Human
aggcaggccccugagaauagac

SEQ ID NO: 865876 - RNA, 22 nt, Human
gccaggagaaugcuagcagagg

SEQ ID NO: 865877 - RNA, 22 nt, Human
cauuucaaguaacagauugcuu

SEQ ID NO: 865878 - RNA, 22 nt, Human
aauuaaaugacaggggaagaug

SEQ ID NO: 865879 - RNA, 22 nt, Human
aagagagggguugcauggaaau

SEQ ID NO: 865880 - RNA, 22 nt, Human
gcagaggacagggauuuagauu

SEQ ID NO: 865881 - RNA, 22 nt, Human
gcagcugccuucagcuggaugg

SEQ ID NO: 865882 - RNA, 22 nt, Human
cuggccaggcuugggacagaca

SEQ ID NO: 865883 - RNA, 22 nt, Human
gcaggcuccaaggccugggaga

SEQ ID NO: 865884 - RNA, 22 nt, Human
auacaacagaaaaugauuauuc

SEQ ID NO: 865885 - RNA, 22 nt, Human
ggccaggagcugcacagggcuc

SEQ ID NO: 865886 - RNA, 23 nt, Human
acacauuuuucccguucugaggu

SEQ ID NO: 865887 - RNA, 22 nt, Human
caggaugagaggcccagggaag

SEQ ID NO: 865888 - RNA, 22 nt, Human
cugccaggcagggagauggcug

SEQ ID NO: 865889 - RNA, 22 nt, Human
gaggcauggccugaggcuagga

SEQ ID NO: 865890 - RNA, 22 nt, Human
acacauauucauauguacuuac

SEQ ID NO: 865891 - RNA, 22 nt, Human
uucucagagugaccaagucuuu

SEQ ID NO: 865892 - RNA, 22 nt, Human
uuaaaugaggcugauguagauu

SEQ ID NO: 865893 - RNA, 22 nt, Human
gagauuuaauuggauuaacuua

SEQ ID NO: 865894 - RNA, 22 nt, Human
uaucuguucaauggaagaugac

SEQ ID NO: 865895 - RNA, 22 nt, Human
cauauaauguuugaagaugugg

SEQ ID NO: 865896 - RNA, 22 nt, Human
uaccauuucauucuuuccucau

SEQ ID NO: 865897 - RNA, 22 nt, Human
uuuauccaccuuacccuguucc

SEQ ID NO: 865898 - RNA, 22 nt, Human
uaaggccaaguucauauacaac

SEQ ID NO: 865899 - RNA, 22 nt, Human
guucuucagucacaucacagaa

SEQ ID NO: 865900 - RNA, 22 nt, Human
uucugggacaucuggacaguuu

SEQ ID NO: 865901 - RNA, 22 nt, Human
auggcuuuguuccaauaaaacu

SEQ ID NO: 865902 - RNA, 22 nt, Human
cucuucuuuaguccagaccauc

SEQ ID NO: 865903 - RNA, 22 nt, Human
caggagggcccgagacucuucc

SEQ ID NO: 865904 - RNA, 22 nt, Human
uggcuuuagguugcauguuucu

SEQ ID NO: 865905 - RNA, 22 nt, Human
aaaguccuguuaacuguuaaca

SEQ ID NO: 865906 - RNA, 22 nt, Human
uucauucuugggaucagagagu

SEQ ID NO: 865907 - RNA, 23 nt, Human
cuuuuaacuagaguaucagcugc

SEQ ID NO: 865908 - RNA, 23 nt, Human
uugcacauuggagcuggucuucu

SEQ ID NO: 865909 - RNA, 22 nt, Human
uguugagacugagggagucagc

SEQ ID NO: 865910 - RNA, 22 nt, Human
accaggagacaugaccaaugag

SEQ ID NO: 865911 - RNA, 22 nt, Human
uggaggggcaauggagcgcgga

SEQ ID NO: 865912 - RNA, 23 nt, Human
ggagaggggugugggcaucuuua

SEQ ID NO: 865913 - RNA, 22 nt, Human
ucaggagacaaagggugcggag

SEQ ID NO: 865914 - RNA, 22 nt, Human
cccuggaggcaaagguugcagu

SEQ ID NO: 865915 - RNA, 22 nt, Human
caauuucaugccauguauugcu

SEQ ID NO: 865916 - RNA, 22 nt, Human
uauuauuaaauggcagaauuuu

SEQ ID NO: 865917 - RNA, 22 nt, Human
gcaaagcauucuguggagucua

SEQ ID NO: 865918 - RNA, 22 nt, Human
cauuuacaauguacagguugug

SEQ ID NO: 865919 - RNA, 22 nt, Human
ugcccaggcuggaaugcagugg

SEQ ID NO: 865920 - RNA, 22 nt, Human
caaguccuuagaugguucuuug

SEQ ID NO: 865921 - RNA, 22 nt, Human
aaauguauugcauaggauauuu

SEQ ID NO: 865922 - RNA, 22 nt, Human
uuauagaacagccuccucuaga

SEQ ID NO: 865923 - RNA, 22 nt, Human
uaucagaaggaagugccuuuaa

SEQ ID NO: 865924 - RNA, 22 nt, Human
uucaacuuuggagauuuaauaa

SEQ ID NO: 865925 - RNA, 22 nt, Human
caauuucaauacaaaauacauu

SEQ ID NO: 865926 - RNA, 18 nt, Human
aaguccuuccuuugcuuu

SEQ ID NO: 865927 - RNA, 22 nt, Human
uuuaaauuuagaagaaacacug

SEQ ID NO: 865928 - RNA, 23 nt, Human
cuucucagaagucugugccagga

SEQ ID NO: 865929 - RNA, 22 nt, Human
aguuuucacacucaccaaaagg

SEQ ID NO: 865930 - RNA, 22 nt, Human
caucagaauguuauggggggcu

SEQ ID NO: 865931 - RNA, 22 nt, Human
uccaugagacagauacuguaag

SEQ ID NO: 865932 - RNA, 22 nt, Human
ucuucagacuccaaauguuuua

SEQ ID NO: 865933 - RNA, 22 nt, Human
cucaggaugucggugacuauug

SEQ ID NO: 865934 - RNA, 22 nt, Human
acagaauuugcuugggcaaugg

SEQ ID NO: 865935 - RNA, 22 nt, Human
aaaguccagagggcacacugaa

SEQ ID NO: 865936 - RNA, 22 nt, Human
agguaggggguuugggaacugc

SEQ ID NO: 865937 - RNA, 22 nt, Human
accaggaguaacagugaguggu

SEQ ID NO: 865938 - RNA, 22 nt, Human
caggauggccccggggcugugc

SEQ ID NO: 865939 - RNA, 22 nt, Human
gcuguguuugacaguagcagac

SEQ ID NO: 865940 - RNA, 22 nt, Human
aggccagaaaugucagggagug

SEQ ID NO: 865941 - RNA, 20 nt, Human
uuucacagucccuguuuccu

SEQ ID NO: 865942 - RNA, 22 nt, Human
ccugcuguucuguuuagugaac

SEQ ID NO: 865943 - RNA, 22 nt, Human
caggagagauaugaguccccac

SEQ ID NO: 865944 - RNA, 23 nt, Human
ccacuagcaccuguucaacuucu

SEQ ID NO: 865945 - RNA, 22 nt, Human
gaggcugcuuugaugacaggag

SEQ ID NO: 865946 - RNA, 22 nt, Human
gaggcagcugaaggagugacag

SEQ ID NO: 865947 - RNA, 17 nt, Human
cucacggaggaugaauc

SEQ ID NO: 865948 - RNA, 22 nt, Human
uauuaaagggaaguuaugcaug

SEQ ID NO: 865949 - RNA, 22 nt, Human
aaaauauuuuagggccaggaga

SEQ ID NO: 865950 - RNA, 22 nt, Human
ggcagaggaaggaugaauucac

SEQ ID NO: 865951 - RNA, 22 nt, Human
aguaaaauuaauggaucagaag

SEQ ID NO: 865952 - RNA, 22 nt, Human
uucaggauccccaccgcguuua

SEQ ID NO: 865953 - RNA, 22 nt, Human
ucagaauuuuuguuacccuuga

SEQ ID NO: 865954 - RNA, 22 nt, Human
auuaaaauuccaagguaugcca

SEQ ID NO: 865955 - RNA, 22 nt, Human
uugcaucuagggcaacccagag

SEQ ID NO: 865956 - RNA, 22 nt, Human
aaggcagcaagaauuccagguu

SEQ ID NO: 865957 - RNA, 22 nt, Human
auuucagauucagaaauguagg

SEQ ID NO: 865958 - RNA, 22 nt, Human
aguggcagagugcacucaggca

SEQ ID NO: 865959 - RNA, 18 nt, Human
gucacuguguuucugagc

SEQ ID NO: 865960 - RNA, 22 nt, Human
ucacuucacacccacuaucaug

SEQ ID NO: 865961 - RNA, 22 nt, Human
aaaauugaagugaucaggaacu

SEQ ID NO: 865962 - RNA, 22 nt, Human
ggcagcuucucccaggcuguuu

SEQ ID NO: 865963 - RNA, 22 nt, Human
cccgggaggaggaaguugcagu

SEQ ID NO: 865964 - RNA, 22 nt, Human
uaacaauaguguuugcuaguca

SEQ ID NO: 865965 - RNA, 22 nt, Human
agugagaguauuaaugugaacu

SEQ ID NO: 865966 - RNA, 21 nt, Human
ggacagcugcgcgcagggcuc

SEQ ID NO: 865967 - RNA, 22 nt, Human
uaaguaaauuuauaaugugauu

SEQ ID NO: 865968 - RNA, 22 nt, Human
cuugaaagcuuugcgucuucua

SEQ ID NO: 865969 - RNA, 22 nt, Human
cagcuuucaucagugacacuca

SEQ ID NO: 865970 - RNA, 22 nt, Human
guuuuucuuugugugaagacaa

SEQ ID NO: 865971 - RNA, 15 nt, Human
cuccaugauuuugca

SEQ ID NO: 865972 - RNA, 22 nt, Human
gacauaauccuccucaccuacu

SEQ ID NO: 865973 - RNA, 22 nt, Human
agaggauguucuaggcacucau

SEQ ID NO: 865974 - RNA, 22 nt, Human
cccaggaagaggggucaggugu

SEQ ID NO: 865975 - RNA, 22 nt, Human
caaggccauauugccuguaugu

SEQ ID NO: 865976 - RNA, 22 nt, Human
gaggccaaucaauagggcaaua

SEQ ID NO: 865977 - RNA, 23 nt, Human
acuuuauccuauaucuuuguucu

SEQ ID NO: 865978 - RNA, 22 nt, Human
uaacaguguggacuugagaucu

SEQ ID NO: 865979 - RNA, 22 nt, Human
ccagaccacccuggccaugcac

SEQ ID NO: 865980 - RNA, 22 nt, Human
cucaggaugcaauuccaucaag

SEQ ID NO: 865981 - RNA, 22 nt, Human
uuuuccagagcugucucuugca

SEQ ID NO: 865982 - RNA, 22 nt, Human
gcugcccaggagagguggggcu

SEQ ID NO: 865983 - RNA, 22 nt, Human
aagacaauuugauacuaguugc

SEQ ID NO: 865984 - RNA, 22 nt, Human
uaucuuguaauagguccacuug

SEQ ID NO: 865985 - RNA, 22 nt, Human
uuuuaucugcuucauuaguuga

SEQ ID NO: 865986 - RNA, 22 nt, Human
gaggcagccagagguucucauu

SEQ ID NO: 865987 - RNA, 19 nt, Human
ucucuacacuacauuucua

SEQ ID NO: 865988 - RNA, 22 nt, Human
uccaggagaaggccauccagcg

SEQ ID NO: 865989 - RNA, 22 nt, Human
aacauguugcuuuaauaauauu

SEQ ID NO: 865990 - RNA, 22 nt, Human
uacacauguauuuauguguaca

SEQ ID NO: 865991 - RNA, 20 nt, Human
cugcugugugugccucagcc

SEQ ID NO: 865992 - RNA, 22 nt, Human
ggaggcagaauagagugugggu

SEQ ID NO: 865993 - RNA, 22 nt, Human
ugaaggaaugaguauacuguuu

SEQ ID NO: 865994 - RNA, 22 nt, Human
auagacauagccguaauuuauu

SEQ ID NO: 865995 - RNA, 22 nt, Human
guuucacagaugguguucauau

SEQ ID NO: 865996 - RNA, 22 nt, Human
aggagagggguaggauuaauuu

SEQ ID NO: 865997 - RNA, 22 nt, Human
cagcugcuuuaguuuuccaucc

SEQ ID NO: 865998 - RNA, 22 nt, Human
agaggcaggaagagcugauuuu

SEQ ID NO: 865999 - RNA, 19 nt, Human
cagaaauagcgaaguguaa

SEQ ID NO: 866000 - RNA, 22 nt, Human
uaaaauagcaugugcagugaaa

SEQ ID NO: 866001 - RNA, 22 nt, Human
cuuuccaagaaugcagauaccu

SEQ ID NO: 866002 - RNA, 22 nt, Human
aggcagcagugauaagauagga

SEQ ID NO: 866003 - RNA, 22 nt, Human
aaguuucauuguucauguaaca

SEQ ID NO: 866004 - RNA, 22 nt, Human
uuauuccauucaguucaacaag

SEQ ID NO: 866005 - RNA, 22 nt, Human
auuuuacuuugugaauauugac

SEQ ID NO: 866006 - RNA, 22 nt, Human
aauaaaaugaacugguagaguu

SEQ ID NO: 866007 - RNA, 22 nt, Human
caggcagcgcucguggccuggc

SEQ ID NO: 866008 - RNA, 22 nt, Human
gucuuucuaugaugaacuguug

SEQ ID NO: 866009 - RNA, 22 nt, Human
auucaaguucuucugucuuugc

SEQ ID NO: 866010 - RNA, 22 nt, Human
gaaguccugguccucucauuca

SEQ ID NO: 866011 - RNA, 22 nt, Human
gagaggcaggcgcugcaauggu

SEQ ID NO: 866012 - RNA, 22 nt, Human
ucagagaguuggaaagaauuaa

SEQ ID NO: 866013 - RNA, 22 nt, Human
cccagcaguaaccaguggaaau

SEQ ID NO: 866014 - RNA, 22 nt, Human
augcaucuauucccaagggcag

SEQ ID NO: 866015 - RNA, 22 nt, Human
uuaaaaugaauauugauuagca

SEQ ID NO: 866016 - RNA, 22 nt, Human
cuuaagaugaggucaugcuaua

SEQ ID NO: 866017 - RNA, 20 nt, Human
cuucuucauuaacccuacug

SEQ ID NO: 866018 - RNA, 22 nt, Human
gccaucacauccaggcuaccuc

SEQ ID NO: 866019 - RNA, 22 nt, Human
auguacaaaauguuuugaaaug

SEQ ID NO: 866020 - RNA, 20 nt, Human
guugaaaguaauaugaugcu

SEQ ID NO: 866021 - RNA, 22 nt, Human
acaacaaagacacuugaaauga

SEQ ID NO: 866022 - RNA, 19 nt, Human
aggcaggugcagagguccc

SEQ ID NO: 866023 - RNA, 22 nt, Human
gugcauuugacgaauacucacu

SEQ ID NO: 866024 - RNA, 22 nt, Human
uuacagaacugcccuaguuggc

SEQ ID NO: 866025 - RNA, 19 nt, Human
caggaaggggcgaaucugg

SEQ ID NO: 866026 - RNA, 22 nt, Human
cccaggaaacccgaaggcgacc

SEQ ID NO: 866027 - RNA, 22 nt, Human
acauacauauguuuaaaugcau

SEQ ID NO: 866028 - RNA, 22 nt, Human
caguucuuuguggggaguucuc

SEQ ID NO: 866029 - RNA, 22 nt, Human
gcccaggacucagggugucgcg

SEQ ID NO: 866030 - RNA, 22 nt, Human
cuuuaacaaaugacucuugucu

SEQ ID NO: 866031 - RNA, 22 nt, Human
uccucagacuucccuuugugua

SEQ ID NO: 866032 - RNA, 23 nt, Human
uggacgccgacuuuggaggcgcu

SEQ ID NO: 866033 - RNA, 22 nt, Human
ggcucagagaccugcgaucuga

SEQ ID NO: 866034 - RNA, 22 nt, Human
gaggucagucagaccaggguuu

SEQ ID NO: 866035 - RNA, 22 nt, Human
uuuuuauaugaaggauagugcg

SEQ ID NO: 866036 - RNA, 22 nt, Human
uacugaaauacuaagaaguuaa

SEQ ID NO: 866037 - RNA, 22 nt, Human
uuacuacugcuuuacuacuggg

SEQ ID NO: 866038 - RNA, 20 nt, Human
accaauguuagcuuaguacu

SEQ ID NO: 866039 - RNA, 20 nt, Human
uggcaucucucaauuguagg

SEQ ID NO: 866040 - RNA, 22 nt, Human
gaauauuuuuaaagggacuaau

SEQ ID NO: 866041 - RNA, 19 nt, Human
aucugagauuauaaacaga

SEQ ID NO: 866042 - RNA, 22 nt, Human
aaggcagcccuggcucagccug

SEQ ID NO: 866043 - RNA, 22 nt, Human
uucuucaauuuuccauauacug

SEQ ID NO: 866044 - RNA, 22 nt, Human
uucuucucucauagauuaaggu

SEQ ID NO: 866045 - RNA, 22 nt, Human
guucuucaguaaaauuaaaugu

SEQ ID NO: 866046 - RNA, 22 nt, Human
agcugcccagauaggaggaggc

SEQ ID NO: 866047 - RNA, 22 nt, Human
ugaggcaggacugagcgggaug

SEQ ID NO: 866048 - RNA, 22 nt, Human
caacuuugugugaccuagauag

SEQ ID NO: 866049 - RNA, 22 nt, Human
agaccaagaaaggaugaggauc

SEQ ID NO: 866050 - RNA, 22 nt, Human
aucaggauuacacggggaugcu

SEQ ID NO: 866051 - RNA, 22 nt, Human
uuaacauacaucaugaacaaug

SEQ ID NO: 866052 - RNA, 22 nt, Human
agccauuuuccugaaauauaac

SEQ ID NO: 866053 - RNA, 22 nt, Human
cagaaauaaacuucucacaucg

SEQ ID NO: 866054 - RNA, 22 nt, Human
ggcaucuccaaaacaugaacuc

SEQ ID NO: 866055 - RNA, 22 nt, Human
uuuaggaaugugguuuuugagc

SEQ ID NO: 866056 - RNA, 22 nt, Human
uaggcagcagugcuaugauucu

SEQ ID NO: 866057 - RNA, 22 nt, Human
uaaaugagggcugacaugauug

SEQ ID NO: 866058 - RNA, 22 nt, Human
acuggcaguagagggagcgcau

SEQ ID NO: 866059 - RNA, 22 nt, Human
uagaauucauguuacuguuagc

SEQ ID NO: 866060 - RNA, 22 nt, Human
aaggcaguacuuuauguccaua

SEQ ID NO: 866061 - RNA, 22 nt, Human
aggcagcuuuguaguaaagcua

SEQ ID NO: 866062 - RNA, 22 nt, Human
uuugaaagcaccauuugaguag

SEQ ID NO: 866063 - RNA, 22 nt, Human
agauaucaccaguuuuacauac

SEQ ID NO: 866064 - RNA, 22 nt, Human
aaaggccauuacuugcuuuuag

SEQ ID NO: 866065 - RNA, 22 nt, Human
caggcagggagcuggaaaggau

SEQ ID NO: 866066 - RNA, 22 nt, Human
cucccaggacucagaggagaag

SEQ ID NO: 866067 - RNA, 22 nt, Human
ggugagaggcagaggacagcuu

SEQ ID NO: 866068 - RNA, 19 nt, Human
agggaguuuauauuugcac

SEQ ID NO: 866069 - RNA, 19 nt, Human
ucauuguugguuugucggg

SEQ ID NO: 866070 - RNA, 23 nt, Human
auguuauuauuagcagucuugcc

SEQ ID NO: 866071 - RNA, 22 nt, Human
uugguacaaugugcuagguagg

SEQ ID NO: 866072 - RNA, 22 nt, Human
ccaugagacagcaacugaaagu

SEQ ID NO: 866073 - RNA, 20 nt, Human
cugcugugguccuuuauuuu

SEQ ID NO: 866074 - RNA, 22 nt, Human
aaggcagccgugugacugcaug

SEQ ID NO: 866075 - RNA, 22 nt, Human
gaagaauccuguccucuuuagg

SEQ ID NO: 866076 - RNA, 22 nt, Human
cuuaauuacccaaugugguagg

SEQ ID NO: 866077 - RNA, 22 nt, Human
uguaggccuauguccagcaauu

SEQ ID NO: 866078 - RNA, 22 nt, Human
ccaugcacaccagcaggcagac

SEQ ID NO: 866079 - RNA, 21 nt, Human
ccaagacucccaucuaguggu

SEQ ID NO: 866080 - RNA, 22 nt, Human
uucaucaauguguuuaauaaug

SEQ ID NO: 866081 - RNA, 22 nt, Human
cccaggaacagggcucagaccc

SEQ ID NO: 866082 - RNA, 22 nt, Human
auuaaacugagcaaauuaacau

SEQ ID NO: 866083 - RNA, 22 nt, Human
agcaccuguugcacuucauaau

SEQ ID NO: 866084 - RNA, 22 nt, Human
ugcaggaacugggagggauagu

SEQ ID NO: 866085 - RNA, 19 nt, Human
ggcaggcuggauagagagg

SEQ ID NO: 866086 - RNA, 22 nt, Human
uuucaaagaccauuaacuauca

SEQ ID NO: 866087 - RNA, 22 nt, Human
accaggaguagaauaucuguga

SEQ ID NO: 866088 - RNA, 20 nt, Human
agcaagaguaaggacagcga

SEQ ID NO: 866089 - RNA, 22 nt, Human
ucaacugcaaguuugcuuaguu

SEQ ID NO: 866090 - RNA, 22 nt, Human
caaguaaagaaucacauuucuu

SEQ ID NO: 866091 - RNA, 22 nt, Human
uuagacaagggcuccuuaaaag

SEQ ID NO: 866092 - RNA, 22 nt, Human
guucuucaucuuaaccaucugu

SEQ ID NO: 866093 - RNA, 22 nt, Human
acaucugaccauuacaagacau

SEQ ID NO: 866094 - RNA, 22 nt, Human
auucacaaaaugauauagauac

SEQ ID NO: 866095 - RNA, 22 nt, Human
uuugaaguucccccauaucaga

SEQ ID NO: 866096 - RNA, 22 nt, Human
ucaauucaacacaugcacauug

SEQ ID NO: 866097 - RNA, 22 nt, Human
guaggcagggcuguggggagaa

SEQ ID NO: 866098 - RNA, 22 nt, Human
auccuuagguggugcaucaggg

SEQ ID NO: 866099 - RNA, 22 nt, Human
ucuggaucggguuccucagguc

SEQ ID NO: 866100 - RNA, 20 nt, Human
aggcucagcugagcucuugg

SEQ ID NO: 866101 - RNA, 22 nt, Human
ugcuauacauguacauauuagu

SEQ ID NO: 866102 - RNA, 22 nt, Human
gugguuuucuccaacccagaac

SEQ ID NO: 866103 - RNA, 22 nt, Human
uuauagugggcccaacauggcg

SEQ ID NO: 866104 - RNA, 22 nt, Human
ggauuuccucuugacucuaaag

SEQ ID NO: 866105 - RNA, 22 nt, Human
agaauaaucacugaaguucaaa

SEQ ID NO: 866106 - RNA, 22 nt, Human
acauaauaccuaggacaguuug

SEQ ID NO: 866107 - RNA, 22 nt, Human
uaaagccacgcuggaaaucagg

SEQ ID NO: 866108 - RNA, 22 nt, Human
gugaauaaagggaguuuucaaa

SEQ ID NO: 866109 - RNA, 22 nt, Human
gcugcccagacauugaaucagg

SEQ ID NO: 866110 - RNA, 22 nt, Human
cugucccuucauuauucacuac

SEQ ID NO: 866111 - RNA, 21 nt, Human
auagaacaccaggcauauaua

SEQ ID NO: 866112 - RNA, 22 nt, Human
aguccuuaugagaugcugccuu

SEQ ID NO: 866113 - RNA, 22 nt, Human
uuccuuaggggacagggggaua

SEQ ID NO: 866114 - RNA, 22 nt, Human
auagcuuuacagaagaguuuag

SEQ ID NO: 866115 - RNA, 17 nt, Human
cuuuuaauuuacuuccc

SEQ ID NO: 866116 - RNA, 22 nt, Human
uuucagaaagcugaacauauga

SEQ ID NO: 866117 - RNA, 22 nt, Human
aggaagcuccuggagagccagu

SEQ ID NO: 866118 - RNA, 22 nt, Human
uuucugcugugcuuucuugcgu

SEQ ID NO: 866119 - RNA, 22 nt, Human
uguccuuauaagaaaaggaaau

SEQ ID NO: 866120 - RNA, 22 nt, Human
cccaugagaccugguuuaaggc

SEQ ID NO: 866121 - RNA, 22 nt, Human
gcccaggaagugacucagaugu

SEQ ID NO: 866122 - RNA, 22 nt, Human
aaaggcaggcuuucacaucuca

SEQ ID NO: 866123 - RNA, 22 nt, Human
gcucaggacuggaggagcgggg

SEQ ID NO: 866124 - RNA, 22 nt, Human
ugaugaaauguugaggcaguga

SEQ ID NO: 866125 - RNA, 22 nt, Human
aaucuagucuccuuaagucuuu

SEQ ID NO: 866126 - RNA, 18 nt, Human
gagucuuuguuacugcug

SEQ ID NO: 866127 - RNA, 22 nt, Human
uacaguauguucuugaauuugg

SEQ ID NO: 866128 - RNA, 22 nt, Human
ccaguacugucuccaauauucc

SEQ ID NO: 866129 - RNA, 22 nt, Human
gauuuuauuagcccaaacuuug

SEQ ID NO: 866130 - RNA, 22 nt, Human
ucacugcucagucuguacuaca

SEQ ID NO: 866131 - RNA, 22 nt, Human
aaauuauucucauguguuucuu

SEQ ID NO: 866132 - RNA, 22 nt, Human
uggaaauggaucugaugagucu

SEQ ID NO: 866133 - RNA, 23 nt, Human
uggcaaggaaugggauggagacu

SEQ ID NO: 866134 - RNA, 22 nt, Human
caaauauuccagguacaucccu

SEQ ID NO: 866135 - RNA, 22 nt, Human
uuugaaagggacaaagucacug

SEQ ID NO: 866136 - RNA, 22 nt, Human
ugcauaguucuccuuccuccuc

SEQ ID NO: 866137 - RNA, 22 nt, Human
uuucauaauacuguacaugaaa

SEQ ID NO: 866138 - RNA, 22 nt, Human
cuuugcaaacgauuaccacaug

SEQ ID NO: 866139 - RNA, 22 nt, Human
cuuaagauuugagauaccuaau

SEQ ID NO: 866140 - RNA, 22 nt, Human
ucucaagaucucaagauggccc

SEQ ID NO: 866141 - RNA, 22 nt, Human
ugaaagcacaaguucuaacagg

SEQ ID NO: 866142 - RNA, 22 nt, Human
ucaaaauuuuauuucucaagga

SEQ ID NO: 866143 - RNA, 22 nt, Human
ugaguuuuuucaacauaugaag

SEQ ID NO: 866144 - RNA, 22 nt, Human
aucaggauucaguaucuccagc

SEQ ID NO: 866145 - RNA, 22 nt, Human
ugaggggaacugaugcccauug

SEQ ID NO: 866146 - RNA, 22 nt, Human
uucaggaugcucagaguagucu

SEQ ID NO: 866147 - RNA, 22 nt, Human
cuuuggcacagucucauuugau

SEQ ID NO: 866148 - RNA, 22 nt, Human
gaagcacauggcuauagcuauu

SEQ ID NO: 866149 - RNA, 22 nt, Human
gagaggaguuacuauuuccgag

SEQ ID NO: 866150 - RNA, 22 nt, Human
caagaauccuguucuugaagau

SEQ ID NO: 866151 - RNA, 22 nt, Human
ggugaaggucagagcaggaaaa

SEQ ID NO: 866152 - RNA, 22 nt, Human
agucaccaggguuugcuggguu

SEQ ID NO: 866153 - RNA, 22 nt, Human
acuuugaaagccuuggccccgg

SEQ ID NO: 866154 - RNA, 22 nt, Human
aaucuguucuacucuauucaga

SEQ ID NO: 866155 - RNA, 22 nt, Human
uguaaauaguuagcuugccucu

SEQ ID NO: 866156 - RNA, 22 nt, Human
acuagaaacuaauggauuauua

SEQ ID NO: 866157 - RNA, 22 nt, Human
gauugaaacauaggcagucgag

SEQ ID NO: 866158 - RNA, 17 nt, Human
aggcagcucagaacauc

SEQ ID NO: 866159 - RNA, 22 nt, Human
gaggccuggagccgccuaggcg

SEQ ID NO: 866160 - RNA, 22 nt, Human
ucuuugcaggccaaauuguuaa

SEQ ID NO: 866161 - RNA, 22 nt, Human
gaggagcuugugagaagauguc

SEQ ID NO: 866162 - RNA, 22 nt, Human
uauacagauggaaagauacaca

SEQ ID NO: 866163 - RNA, 22 nt, Human
cuuucauucuuagauauuagug

SEQ ID NO: 866164 - RNA, 18 nt, Human
aauuuccauaugaauugc

SEQ ID NO: 866165 - RNA, 22 nt, Human
ugaaugaacuaaaucauaguuc

SEQ ID NO: 866166 - RNA, 22 nt, Human
cauuucaagcauugacuucuau

SEQ ID NO: 866167 - RNA, 22 nt, Human
uauaauuaguaaauggcagauu

SEQ ID NO: 866168 - RNA, 22 nt, Human
cuuugaagauggcaaauuuaga

SEQ ID NO: 866169 - RNA, 22 nt, Human
guucuucaggcugugcucuaga

SEQ ID NO: 866170 - RNA, 22 nt, Human
uaaaaguauacuuucaaaggag

SEQ ID NO: 866171 - RNA, 22 nt, Human
ggcagcuauuccaagcagcacu

SEQ ID NO: 866172 - RNA, 22 nt, Human
uaaggccaauuacauauguuca

SEQ ID NO: 866173 - RNA, 22 nt, Human
cuggcugugcagucuuccagaa

SEQ ID NO: 866174 - RNA, 22 nt, Human
auguuauaguuauaaaaugagg

SEQ ID NO: 866175 - RNA, 22 nt, Human
uccugagagcagcugcuuugga

SEQ ID NO: 866176 - RNA, 22 nt, Human
uuaauuacaaaacacauagguu

SEQ ID NO: 866177 - RNA, 22 nt, Human
uaaacauggcuguuucaguuau

SEQ ID NO: 866178 - RNA, 17 nt, Human
uucucugagcuguauug

SEQ ID NO: 866179 - RNA, 22 nt, Human
gacagugcauuuccuggcaugg

SEQ ID NO: 866180 - RNA, 22 nt, Human
cuauuacauuucuggacauuca

SEQ ID NO: 866181 - RNA, 22 nt, Human
auuuucaucauggguuuaacau

SEQ ID NO: 866182 - RNA, 22 nt, Human
gaugccuccaaaugagggcaga

SEQ ID NO: 866183 - RNA, 22 nt, Human
gaggagcugggcugagaggguc

SEQ ID NO: 866184 - RNA, 22 nt, Human
gaagaauccaugcuaauuuacc

SEQ ID NO: 866185 - RNA, 18 nt, Human
ugaggcagucagugaugg

SEQ ID NO: 866186 - RNA, 22 nt, Human
uggcagcuggagggcaauggcc

SEQ ID NO: 866187 - RNA, 22 nt, Human
agacgagggccuggcacacagu

SEQ ID NO: 866188 - RNA, 22 nt, Human
uuaacauuguccuuagcagauu

SEQ ID NO: 866189 - RNA, 21 nt, Human
aggcagcuggaaggccuggcu

SEQ ID NO: 866190 - RNA, 22 nt, Human
acaugaaaaauguuugcaguuu

SEQ ID NO: 866191 - RNA, 22 nt, Human
uaauuucagugcaagcucacgg

SEQ ID NO: 866192 - RNA, 19 nt, Human
accaggagacagugagcuu

SEQ ID NO: 866193 - RNA, 22 nt, Human
augcugugucaggaauuugaua

SEQ ID NO: 866194 - RNA, 22 nt, Human
uuucauuuugguuaugccauaa

SEQ ID NO: 866195 - RNA, 22 nt, Human
augcuguguggccaccuccaug

SEQ ID NO: 866196 - RNA, 22 nt, Human
uuaaugauaccuauguuaauuu

SEQ ID NO: 866197 - RNA, 22 nt, Human
gaaagccaucuggcugcuggga

SEQ ID NO: 866198 - RNA, 22 nt, Human
cagugguuauacuuacuguuuc

SEQ ID NO: 866199 - RNA, 22 nt, Human
augcuguguggucaaguuaauu

SEQ ID NO: 866200 - RNA, 22 nt, Human
ucauuuguaccauuuuuuaaga

SEQ ID NO: 866201 - RNA, 22 nt, Human
acccaggacucucuuccaguag

SEQ ID NO: 866202 - RNA, 22 nt, Human
cugaaugaggaaaagagugagg

SEQ ID NO: 866203 - RNA, 22 nt, Human
auggcuuucucuaaugugguau

SEQ ID NO: 866204 - RNA, 22 nt, Human
cuuauacacccucuucccaggc

SEQ ID NO: 866205 - RNA, 22 nt, Human
uuugacaucuaagaauucuuac

SEQ ID NO: 866206 - RNA, 22 nt, Human
ucauaauacaaagaguucugca

SEQ ID NO: 866207 - RNA, 22 nt, Human
ucauuguuauguuuugcugucu

SEQ ID NO: 866208 - RNA, 22 nt, Human
auuuacugagguaaauaaacug

SEQ ID NO: 866209 - RNA, 22 nt, Human
uggauuagugcugaaaugaugg

SEQ ID NO: 866210 - RNA, 22 nt, Human
gaggaggccaguggaaggaagc

SEQ ID NO: 866211 - RNA, 21 nt, Human
caaucaguuggcauuugagca

SEQ ID NO: 866212 - RNA, 19 nt, Human
uuacuuggcaaagucaguc

SEQ ID NO: 866213 - RNA, 22 nt, Human
cuacagaaaaucagccacaggc

SEQ ID NO: 866214 - RNA, 22 nt, Human
ugaugaaacugagguuccaaga

SEQ ID NO: 866215 - RNA, 22 nt, Human
guuuucaauuauaagauggcuu

SEQ ID NO: 866216 - RNA, 19 nt, Human
guugaaaguaggugagggu

SEQ ID NO: 866217 - RNA, 22 nt, Human
aucuaacagcaacaccagaaua

SEQ ID NO: 866218 - RNA, 22 nt, Human
gucauaaagcuuguugcauuua

SEQ ID NO: 866219 - RNA, 22 nt, Human
agacaaaugguaauuaugucua

SEQ ID NO: 866220 - RNA, 22 nt, Human
aucacuguguauguauaugcag

SEQ ID NO: 866221 - RNA, 22 nt, Human
aggcagaggagaaugaucuucc

SEQ ID NO: 866222 - RNA, 22 nt, Human
uaucuguuccaggcacucagcu

SEQ ID NO: 866223 - RNA, 22 nt, Human
cuggaguuagaguagacacuga

SEQ ID NO: 866224 - RNA, 22 nt, Human
cucuucuugucucugguuagaa

SEQ ID NO: 866225 - RNA, 22 nt, Human
aguaaacaguaucuuuaguguc

SEQ ID NO: 866226 - RNA, 22 nt, Human
aaaggagacuucagaucuccuu

SEQ ID NO: 866227 - RNA, 22 nt, Human
cuucagaauccagaaucagaau

SEQ ID NO: 866228 - RNA, 22 nt, Human
auguaaaucaagcagugcuggu

SEQ ID NO: 866229 - RNA, 22 nt, Human
caggagauguaagacuucuguu

SEQ ID NO: 866230 - RNA, 22 nt, Human
aagcuggcaugucaccugagaa

SEQ ID NO: 866231 - RNA, 22 nt, Human
ccuggaucagucacuguugcug

SEQ ID NO: 866232 - RNA, 22 nt, Human
cuaauuauguuguuauaaucaa

SEQ ID NO: 866233 - RNA, 22 nt, Human
uaaguucauaagcuuauucuua

SEQ ID NO: 866234 - RNA, 22 nt, Human
uccauuuucuaaguaucacuua

SEQ ID NO: 866235 - RNA, 23 nt, Human
aggcagcuggguagcaucuuucu

SEQ ID NO: 866236 - RNA, 22 nt, Human
cugguacaaaaugcugauauca

SEQ ID NO: 866237 - RNA, 22 nt, Human
uuuucagugggcaaugauguga

SEQ ID NO: 866238 - RNA, 22 nt, Human
cugccaggcagcagagggagaa

SEQ ID NO: 866239 - RNA, 22 nt, Human
uaucagaaacucuggggcaggg

SEQ ID NO: 866240 - RNA, 22 nt, Human
ccauggcucuuaccuuguuaua

SEQ ID NO: 866241 - RNA, 22 nt, Human
gauuucaauccagcuuucuucu

SEQ ID NO: 866242 - RNA, 22 nt, Human
aggaguggugcaggaccugcca

SEQ ID NO: 866243 - RNA, 22 nt, Human
gcccaggagccuggagaugugu

SEQ ID NO: 866244 - RNA, 22 nt, Human
uguuuucagucauauagcaggu

SEQ ID NO: 866245 - RNA, 22 nt, Human
ugaggcaggaguucaggcugcg

SEQ ID NO: 866246 - RNA, 22 nt, Human
ggauucuaacugaacagaauau

SEQ ID NO: 866247 - RNA, 22 nt, Human
aagauauagauaaaacuaugca

SEQ ID NO: 866248 - RNA, 22 nt, Human
ugagacaguuuuucuauuucca

SEQ ID NO: 866249 - RNA, 20 nt, Human
ccacaggaguccagucgacc

SEQ ID NO: 866250 - RNA, 22 nt, Human
ugagggagagggcgaaaaugaa

SEQ ID NO: 866251 - RNA, 22 nt, Human
aggccagcgcugcuagcucccg

SEQ ID NO: 866252 - RNA, 22 nt, Human
aggcagcuggacauaacuaacc

SEQ ID NO: 866253 - RNA, 22 nt, Human
ccaggaagcugucugauaugaa

SEQ ID NO: 866254 - RNA, 22 nt, Human
gaaauauucuugucuuguuuuc

SEQ ID NO: 866255 - RNA, 22 nt, Human
agcugcccagcuaggaagaagg

SEQ ID NO: 866256 - RNA, 22 nt, Human
gagggagggacuagcauucucu

SEQ ID NO: 866257 - RNA, 22 nt, Human
guuuuauaggcuguugcuauau

SEQ ID NO: 866258 - RNA, 22 nt, Human
auauauuugagaauauucauga

SEQ ID NO: 866259 - RNA, 22 nt, Human
uuuuauagcugaauaguauucc

SEQ ID NO: 866260 - RNA, 22 nt, Human
gaucugaagagcaaugaaauau

SEQ ID NO: 866261 - RNA, 22 nt, Human
uuuccaaauaaggucacacuca

SEQ ID NO: 866262 - RNA, 22 nt, Human
agucuugcucuugcaucugcuu

SEQ ID NO: 866263 - RNA, 22 nt, Human
uuuucuuaggugcuccaaguag

SEQ ID NO: 866264 - RNA, 21 nt, Human
ugaaugaggaggauggcauuu

SEQ ID NO: 866265 - RNA, 22 nt, Human
gguacaaugucuuacagaccca

SEQ ID NO: 866266 - RNA, 22 nt, Human
uaaucuaccacuauugcaauau

SEQ ID NO: 866267 - RNA, 22 nt, Human
gcccaggaagccaccgggaagu

SEQ ID NO: 866268 - RNA, 22 nt, Human
caggcagcucugcuuuuccuaa

SEQ ID NO: 866269 - RNA, 22 nt, Human
cuaacuuuagcuuagauuauca

SEQ ID NO: 866270 - RNA, 22 nt, Human
uaguuaaaauaauggagauguu

SEQ ID NO: 866271 - RNA, 22 nt, Human
ucaggagggugacaggcccugg

SEQ ID NO: 866272 - RNA, 22 nt, Human
uguccuuacaaggucccuuucg

SEQ ID NO: 866273 - RNA, 22 nt, Human
uguguuauugccacugaagacc

SEQ ID NO: 866274 - RNA, 22 nt, Human
cuugaaagucacaugcagcccu

SEQ ID NO: 866275 - RNA, 20 nt, Human
cugcuguguuauuguagaac

SEQ ID NO: 866276 - RNA, 22 nt, Human
cccaggagaccuagaucuguuu

SEQ ID NO: 866277 - RNA, 22 nt, Human
gcguuaauaacauuaauaaugc

SEQ ID NO: 866278 - RNA, 22 nt, Human
gaauacaugauacaugaacugc

SEQ ID NO: 866279 - RNA, 22 nt, Human
aaaaggcauggagguugauagu

SEQ ID NO: 866280 - RNA, 22 nt, Human
uagcucuucauuucaucugauu

SEQ ID NO: 866281 - RNA, 22 nt, Human
uggaggaaaaaaccaggcagag

SEQ ID NO: 866282 - RNA, 22 nt, Human
auagaauagcauagaaaauuga

SEQ ID NO: 866283 - RNA, 22 nt, Human
augguuuuucaaguauucagaa

SEQ ID NO: 866284 - RNA, 22 nt, Human
gaugagcauuguuucauguguu

SEQ ID NO: 866285 - RNA, 22 nt, Human
uguauacauuuaacuagauaga

SEQ ID NO: 866286 - RNA, 22 nt, Human
ggaagaggcugagccagguccc

SEQ ID NO: 866287 - RNA, 22 nt, Human
aggcugcucaguagauggagcu

SEQ ID NO: 866288 - RNA, 22 nt, Human
cacaaugugguuugucaucuuu

SEQ ID NO: 866289 - RNA, 23 nt, Human
ucuguacacaucagcaucuccca

SEQ ID NO: 866290 - RNA, 22 nt, Human
uuauuuacaacucuucucuucc

SEQ ID NO: 866291 - RNA, 22 nt, Human
gucaggauuaaugggaguaugc

SEQ ID NO: 866292 - RNA, 22 nt, Human
ucugggaacagccuggcugugu

SEQ ID NO: 866293 - RNA, 22 nt, Human
cccaggaaaugggcucuugccu

SEQ ID NO: 866294 - RNA, 22 nt, Human
cagggagggaggaaaauuugcu

SEQ ID NO: 866295 - RNA, 22 nt, Human
auuaggcauuauggggauaagg

SEQ ID NO: 866296 - RNA, 20 nt, Human
cagagccaagagcagcaucu

SEQ ID NO: 866297 - RNA, 22 nt, Human
uagaaauaaaucugcagcuggg

SEQ ID NO: 866298 - RNA, 22 nt, Human
agggacuuguguccuauguaug

SEQ ID NO: 866299 - RNA, 22 nt, Human
uguuuuaaucucccauugcucu

SEQ ID NO: 866300 - RNA, 22 nt, Human
ugucccucugaggcuucccugg

SEQ ID NO: 866301 - RNA, 22 nt, Human
ucauuuguacuugugugcuugu

SEQ ID NO: 866302 - RNA, 22 nt, Human
agcccaggaaguugaggcuugc

SEQ ID NO: 866303 - RNA, 22 nt, Human
gcccaggaaaugccccguggug

SEQ ID NO: 866304 - RNA, 22 nt, Human
ucaaaauucuagggagaauggu

SEQ ID NO: 866305 - RNA, 22 nt, Human
cuuaggcagacugcugaugcag

SEQ ID NO: 866306 - RNA, 22 nt, Human
ucucaggaauagaguggcagca

SEQ ID NO: 866307 - RNA, 22 nt, Human
ggcagcuuguccuggaggaugg

SEQ ID NO: 866308 - RNA, 22 nt, Human
acagguuugucugauguaauga

SEQ ID NO: 866309 - RNA, 22 nt, Human
acacauuucuaaauuuuuaccg

SEQ ID NO: 866310 - RNA, 22 nt, Human
aaagcagagguugcagugagcu

SEQ ID NO: 866311 - RNA, 23 nt, Human
auucuucauuaucuucuagaaaa

SEQ ID NO: 866312 - RNA, 22 nt, Human
cugaauaauacagacuagcuuc

SEQ ID NO: 866313 - RNA, 22 nt, Human
cccaggaaaagcagugccagca

SEQ ID NO: 866314 - RNA, 22 nt, Human
gaggacaggagacucacuguuu

SEQ ID NO: 866315 - RNA, 22 nt, Human
gcugcugucagugguggcaguu

SEQ ID NO: 866316 - RNA, 22 nt, Human
aaagcagauucugaugcaguag

SEQ ID NO: 866317 - RNA, 21 nt, Human
gauaaaaugggccuugguccu

SEQ ID NO: 866318 - RNA, 20 nt, Human
uguaacaaucuggauguugc

SEQ ID NO: 866319 - RNA, 22 nt, Human
auagaaauggcagcuggugcua

SEQ ID NO: 866320 - RNA, 22 nt, Human
ugauuuccccagucuugcugcu

SEQ ID NO: 866321 - RNA, 22 nt, Human
gaggcagcugggauacaaggga

SEQ ID NO: 866322 - RNA, 22 nt, Human
aaguccuuuauccuaaaagguc

SEQ ID NO: 866323 - RNA, 22 nt, Human
ucucucuugucaccccaucugc

SEQ ID NO: 866324 - RNA, 22 nt, Human
auguuuccgugagcauccuuga

SEQ ID NO: 866325 - RNA, 22 nt, Human
ucucuguacaguacaugccgug

SEQ ID NO: 866326 - RNA, 22 nt, Human
acagaauuuacacaucucuaaa

SEQ ID NO: 866327 - RNA, 22 nt, Human
ucgagcucuggagccaaggaug

SEQ ID NO: 866328 - RNA, 17 nt, Human
ucauuuguugugacuag

SEQ ID NO: 866329 - RNA, 22 nt, Human
acuuggcaaguaucuauaaagu

SEQ ID NO: 866330 - RNA, 22 nt, Human
acacaaacugcuagaaaauugg

SEQ ID NO: 866331 - RNA, 18 nt, Human
cugcugugucgucugggc

SEQ ID NO: 866332 - RNA, 22 nt, Human
ugcccaggauugugaggucagg

SEQ ID NO: 866333 - RNA, 22 nt, Human
aaugccaacuuggauauacauu

SEQ ID NO: 866334 - RNA, 22 nt, Human
aggaugagaagauuggaaucuu

SEQ ID NO: 866335 - RNA, 22 nt, Human
agugcagccgagaucaggugcu

SEQ ID NO: 866336 - RNA, 23 nt, Human
gagugcagaauagacaugcagug

SEQ ID NO: 866337 - RNA, 22 nt, Human
caaugaaagcaacugccuauaa

SEQ ID NO: 866338 - RNA, 22 nt, Human
aucugccugcaguggagguggg

SEQ ID NO: 866339 - RNA, 22 nt, Human
ugaggcagggaguuuaauuguc

SEQ ID NO: 866340 - RNA, 22 nt, Human
uccaugagcuagggauucauca

SEQ ID NO: 866341 - RNA, 22 nt, Human
aucugcaggaaugugugcagag

SEQ ID NO: 866342 - RNA, 23 nt, Human
gaaucaguggcuaacaaggaaac

SEQ ID NO: 866343 - RNA, 22 nt, Human
uuuggaauauuaaaaugucuca

SEQ ID NO: 866344 - RNA, 22 nt, Human
aggacaggauugagcugaacug

SEQ ID NO: 866345 - RNA, 22 nt, Human
cuuaaauuuucaucuacaagaa

SEQ ID NO: 866346 - RNA, 22 nt, Human
uuugaauagaggccccucagaa

SEQ ID NO: 866347 - RNA, 21 nt, Human
uagggcaggcauuggaagaga

SEQ ID NO: 866348 - RNA, 22 nt, Human
cuucucaguugcaagugucaga

SEQ ID NO: 866349 - RNA, 19 nt, Human
uuucccagcccuugcugug

SEQ ID NO: 866350 - RNA, 22 nt, Human
ucacacauucuagguauguuga

SEQ ID NO: 866351 - RNA, 22 nt, Human
uaauuucaauagcuugcauaau

SEQ ID NO: 866352 - RNA, 23 nt, Human
ccacagagcugccaauuccugug

SEQ ID NO: 866353 - RNA, 23 nt, Human
agaugagccaacaccuccaugcc

SEQ ID NO: 866354 - RNA, 22 nt, Human
uaugcuguggaaaauacaaaga

SEQ ID NO: 866355 - RNA, 22 nt, Human
gcuuuuauugucuuuacgacga

SEQ ID NO: 866356 - RNA, 22 nt, Human
agagagcauugaggaaaucuuc

SEQ ID NO: 866357 - RNA, 22 nt, Human
uuaauaaacaggugcagcugaa

SEQ ID NO: 866358 - RNA, 22 nt, Human
ucugaacuccagcccugcucuc

SEQ ID NO: 866359 - RNA, 22 nt, Human
caaggccagagccagcgauaag

SEQ ID NO: 866360 - RNA, 22 nt, Human
ucuggaucaccacuucugccuc

SEQ ID NO: 866361 - RNA, 22 nt, Human
aucugccugagucuagguuuuc

SEQ ID NO: 866362 - RNA, 22 nt, Human
uuugcaaagugacuauuauaug

SEQ ID NO: 866363 - RNA, 22 nt, Human
uagggaugacgaaaggacagag

SEQ ID NO: 866364 - RNA, 22 nt, Human
aaggagagagcuuugcuggaac

SEQ ID NO: 866365 - RNA, 22 nt, Human
ggaagaggcugaggccaugcug

SEQ ID NO: 866366 - RNA, 22 nt, Human
aguauuuagcauagugguuagu

SEQ ID NO: 866367 - RNA, 22 nt, Human
aauaauuuccagccaacuggaa

SEQ ID NO: 866368 - RNA, 22 nt, Human
ccagaucuaguguuguaaagcu

SEQ ID NO: 866369 - RNA, 22 nt, Human
uauaagaaacaaggcaaauuuu

SEQ ID NO: 866370 - RNA, 22 nt, Human
aauauccacacugugucccugc

SEQ ID NO: 866371 - RNA, 22 nt, Human
guggcaggagacuggaagaugg

SEQ ID NO: 866372 - RNA, 22 nt, Human
ggcagucuuaucagcauuggac

SEQ ID NO: 866373 - RNA, 22 nt, Human
cugagacuuucaugugcuuuua

SEQ ID NO: 866374 - RNA, 22 nt, Human
caaugucaugauuuuccauuag

SEQ ID NO: 866375 - RNA, 22 nt, Human
ucuuuguaacugucuauugaga

SEQ ID NO: 866376 - RNA, 22 nt, Human
cagcuggcugcaugaugccaaa

SEQ ID NO: 866377 - RNA, 22 nt, Human
ggagggaaugucuagcauucuu

SEQ ID NO: 866378 - RNA, 22 nt, Human
aaacaugaauagauauuaaaca

SEQ ID NO: 866379 - RNA, 22 nt, Human
uuccuuaguuauuugguccccu

SEQ ID NO: 866380 - RNA, 22 nt, Human
uuuagaaguucacacauuuaaa

SEQ ID NO: 866381 - RNA, 22 nt, Human
ucuaaacagccucuuaccaacu

SEQ ID NO: 866382 - RNA, 22 nt, Human
ucuucagaggaagucagucuuu

SEQ ID NO: 866383 - RNA, 22 nt, Human
cccaggagagaggggauaaagc

SEQ ID NO: 866384 - RNA, 20 nt, Human
aaacauucauguacaaguga

SEQ ID NO: 866385 - RNA, 22 nt, Human
ugcugugagguugagaaggaag

SEQ ID NO: 866386 - RNA, 22 nt, Human
caguuucuacgaaggucaaccc

SEQ ID NO: 866387 - RNA, 22 nt, Human
uuugaaauuaagauauugucca

SEQ ID NO: 866388 - RNA, 22 nt, Human
uggcagcuccuggggccagcac

SEQ ID NO: 866389 - RNA, 22 nt, Human
ccaggcagcaaauuuucugaau

SEQ ID NO: 866390 - RNA, 22 nt, Human
cuagaaauauuuuacagucaag

SEQ ID NO: 866391 - RNA, 22 nt, Human
uuauccaacaugacuuaugucc

SEQ ID NO: 866392 - RNA, 22 nt, Human
uuccaagagcuuuaauuguuga

SEQ ID NO: 866393 - RNA, 22 nt, Human
ugaggcagcuuuuucugugugu

SEQ ID NO: 866394 - RNA, 22 nt, Human
uccaggagaccagauguaggcc

SEQ ID NO: 866395 - RNA, 22 nt, Human
gaggcagcaucuauggugggaa

SEQ ID NO: 866396 - RNA, 16 nt, Human
uuuccaaagggcagcu

SEQ ID NO: 866397 - RNA, 22 nt, Human
uggauuuaguucuucacaggcc

SEQ ID NO: 866398 - RNA, 22 nt, Human
ccaaaauuauuacauuuguagg

SEQ ID NO: 866399 - RNA, 22 nt, Human
ugaaaggugacauuucuuggau

SEQ ID NO: 866400 - RNA, 22 nt, Human
uccaggagguagugcuuaauuu

SEQ ID NO: 866401 - RNA, 22 nt, Human
uagcuaucuguguccagaucca

SEQ ID NO: 866402 - RNA, 22 nt, Human
augguuuaaagaguaugacuuu

SEQ ID NO: 866403 - RNA, 18 nt, Human
ucauagaagugaaucaga

SEQ ID NO: 866404 - RNA, 22 nt, Human
cccaggagaccugugaaaggac

SEQ ID NO: 866405 - RNA, 22 nt, Human
aucagaauaauuagauuucaga

SEQ ID NO: 866406 - RNA, 22 nt, Human
aggcaagcugcagagaguccuu

SEQ ID NO: 866407 - RNA, 22 nt, Human
uuucaguguaucuuccaaaagc

SEQ ID NO: 866408 - RNA, 22 nt, Human
ucauuauuuuggacuggagugu

SEQ ID NO: 866409 - RNA, 22 nt, Human
agaggcggagguugcagugagc

SEQ ID NO: 866410 - RNA, 22 nt, Human
ucaggaugaccacgagccucua

SEQ ID NO: 866411 - RNA, 22 nt, Human
aauuucaaacuaauaggaacca

SEQ ID NO: 866412 - RNA, 22 nt, Human
auguagagcaguguuguccaau

SEQ ID NO: 866413 - RNA, 22 nt, Human
uguacaauggcuauaauacccu

SEQ ID NO: 866414 - RNA, 22 nt, Human
aagacuuucaaguaugcaugca

SEQ ID NO: 866415 - RNA, 20 nt, Human
auucuacaagaauaagcaug

SEQ ID NO: 866416 - RNA, 22 nt, Human
uuaacaugucuugacuucaucu

SEQ ID NO: 866417 - RNA, 22 nt, Human
uuuaaauuuguguuuagagggu

SEQ ID NO: 866418 - RNA, 22 nt, Human
agcccaggcagagggaugcuug

SEQ ID NO: 866419 - RNA, 22 nt, Human
ucuuccucuagaucugaggccc

SEQ ID NO: 866420 - RNA, 22 nt, Human
gccaggagacuccauucauuug

SEQ ID NO: 866421 - RNA, 22 nt, Human
aucuuucuauuucuaaaaacua

SEQ ID NO: 866422 - RNA, 22 nt, Human
caaggccauaagagauacaaaa

SEQ ID NO: 866423 - RNA, 22 nt, Human
aaagaaucuauauaucaccacc

SEQ ID NO: 866424 - RNA, 22 nt, Human
cagaggcaggauaagaacugcg

SEQ ID NO: 866425 - RNA, 22 nt, Human
cugaacuuauugagugcuugcu

SEQ ID NO: 866426 - RNA, 22 nt, Human
ugcuggguagaaguauuagucu

SEQ ID NO: 866427 - RNA, 22 nt, Human
agcucccagagcucgagaguaa

SEQ ID NO: 866428 - RNA, 22 nt, Human
gggagggguugcauguuugagu

SEQ ID NO: 866429 - RNA, 22 nt, Human
aagcaauagcaacaacuuuaca

SEQ ID NO: 866430 - RNA, 22 nt, Human
uagauauaucugucauacuggu

SEQ ID NO: 866431 - RNA, 21 nt, Human
caauuucaugggaagauggga

SEQ ID NO: 866432 - RNA, 22 nt, Human
ugaggcagugauguuuaagcac

SEQ ID NO: 866433 - RNA, 22 nt, Human
cuucugcaauaaguuuuggucc

SEQ ID NO: 866434 - RNA, 22 nt, Human
uaggcagcuuagguuagaagug

SEQ ID NO: 866435 - RNA, 22 nt, Human
gaggcagugucgguggcaggau

SEQ ID NO: 866436 - RNA, 22 nt, Human
ccauggcucuagagauugaaaa

SEQ ID NO: 866437 - RNA, 22 nt, Human
uccaggaggacugagggggcug

SEQ ID NO: 866438 - RNA, 22 nt, Human
uugcugaagugaagguauguuu

SEQ ID NO: 866439 - RNA, 22 nt, Human
uacuuucuguccuucuguuaaa

SEQ ID NO: 866440 - RNA, 20 nt, Human
auccaugagagucuggauuc

SEQ ID NO: 866441 - RNA, 19 nt, Human
uguguguuuauauauguau

SEQ ID NO: 866442 - RNA, 22 nt, Human
gauagaaagagugguucuuuuu

SEQ ID NO: 866443 - RNA, 22 nt, Human
aucagaaauugcccagcuguuu

SEQ ID NO: 866444 - RNA, 21 nt, Human
aggcagcucaggcccagagag

SEQ ID NO: 866445 - RNA, 22 nt, Human
uauuugcaacauaaaacucuga

SEQ ID NO: 866446 - RNA, 22 nt, Human
ggcagcuggggcagugcccugu

SEQ ID NO: 866447 - RNA, 22 nt, Human
gagggagggaaaguuuaacacu

SEQ ID NO: 866448 - RNA, 22 nt, Human
guuuaaucagaggaauuauaga

SEQ ID NO: 866449 - RNA, 22 nt, Human
aucugccuggcuccaggugagc

SEQ ID NO: 866450 - RNA, 22 nt, Human
ucaccgccuugcccggccgggc

SEQ ID NO: 866451 - RNA, 22 nt, Human
auuaggcagacaacguagccgg

SEQ ID NO: 866452 - RNA, 22 nt, Human
aucaggauagugguuaccuggg

SEQ ID NO: 866453 - RNA, 22 nt, Human
gcagggaagacccggagcagcg

SEQ ID NO: 866454 - RNA, 22 nt, Human
ggcauuuaucuaauauaguuua

SEQ ID NO: 866455 - RNA, 22 nt, Human
uugguacaaaaguaacuguggu

SEQ ID NO: 866456 - RNA, 22 nt, Human
cgaggcagggaagcugcaaaag

SEQ ID NO: 866457 - RNA, 23 nt, Human
aggcgagcucuucuccagcacgu

SEQ ID NO: 866458 - RNA, 22 nt, Human
auuuucaaaacaucugcugugu

SEQ ID NO: 866459 - RNA, 22 nt, Human
ugaaaugauaucugauaacaaa

SEQ ID NO: 866460 - RNA, 22 nt, Human
gcccaggagguggaggugcagu

SEQ ID NO: 866461 - RNA, 22 nt, Human
guccaaauuuuucacauguaga

SEQ ID NO: 866462 - RNA, 22 nt, Human
gaggggcagagguagagaacaa

SEQ ID NO: 866463 - RNA, 22 nt, Human
uauggcuuuuuauucaucuuac

SEQ ID NO: 866464 - RNA, 22 nt, Human
aguccuuacaccuggaaccuau

SEQ ID NO: 866465 - RNA, 22 nt, Human
acaugcauaggagaagucuuua

SEQ ID NO: 866466 - RNA, 22 nt, Human
cagaugaggcaaccucauugcu

SEQ ID NO: 866467 - RNA, 22 nt, Human
acagcauucaauaaauaauaac

SEQ ID NO: 866468 - RNA, 22 nt, Human
cuugaacucaaugugaggaaga

SEQ ID NO: 866469 - RNA, 22 nt, Human
aguaaaauuguauuggaaaaca

SEQ ID NO: 866470 - RNA, 22 nt, Human
uuccaagaguaaauucaaauug

SEQ ID NO: 866471 - RNA, 22 nt, Human
uuuaaagagaaugugaaggagu

SEQ ID NO: 866472 - RNA, 22 nt, Human
ccugcugugaccggggagcagg

SEQ ID NO: 866473 - RNA, 22 nt, Human
gagugcagaugaacagaagauu

SEQ ID NO: 866474 - RNA, 22 nt, Human
uucuucaaugugcccuguuuuc

SEQ ID NO: 866475 - RNA, 23 nt, Human
uccaggagaauuccagggcccgg

SEQ ID NO: 866476 - RNA, 22 nt, Human
uugaauaauuaauuacacucag

SEQ ID NO: 866477 - RNA, 22 nt, Human
ugaacucucucaagugacagaa

SEQ ID NO: 866478 - RNA, 22 nt, Human
acucagaaccauuuacucugag

SEQ ID NO: 866479 - RNA, 22 nt, Human
caauuucacugacacccuggaa

SEQ ID NO: 866480 - RNA, 22 nt, Human
gugguaauuuaauccuacacug

SEQ ID NO: 866481 - RNA, 22 nt, Human
uucuucaaacaaaaguggcaug

SEQ ID NO: 866482 - RNA, 22 nt, Human
gugaauaaccuacuccaggccu

SEQ ID NO: 866483 - RNA, 22 nt, Human
uaucaauacauguuaucagugu

SEQ ID NO: 866484 - RNA, 22 nt, Human
cugagcugggaguagagacucu

SEQ ID NO: 866485 - RNA, 22 nt, Human
uuuacagaugaggaaacugaga

SEQ ID NO: 866486 - RNA, 22 nt, Human
agcgagggaggucugaggacag

SEQ ID NO: 866487 - RNA, 22 nt, Human
guuccaaauuuggaucuuuagg

SEQ ID NO: 866488 - RNA, 22 nt, Human
gcuucccacagcuggacugggg

SEQ ID NO: 866489 - RNA, 22 nt, Human
ugagacaaccuaauuaaacacc

SEQ ID NO: 866490 - RNA, 22 nt, Human
acagaauugauggaaaucucag

SEQ ID NO: 866491 - RNA, 22 nt, Human
auccaaaccuggacaugagugg

SEQ ID NO: 866492 - RNA, 22 nt, Human
uggcauuucuguuagacucuca

SEQ ID NO: 866493 - RNA, 22 nt, Human
auuaaauuggacgcugggggaa

SEQ ID NO: 866494 - RNA, 22 nt, Human
ucucacugcaaauauuauguau

SEQ ID NO: 866495 - RNA, 22 nt, Human
auuuggcaacauuaauugaauc

SEQ ID NO: 866496 - RNA, 22 nt, Human
auaaaaguucaagagaguacag

SEQ ID NO: 866497 - RNA, 21 nt, Human
auccuuagcacuuagaagagu

SEQ ID NO: 866498 - RNA, 22 nt, Human
caggacagcucaacaccuccuc

SEQ ID NO: 866499 - RNA, 22 nt, Human
ccuccucugggaagauucagag

SEQ ID NO: 866500 - RNA, 22 nt, Human
auauacaggugguauguguaaa

SEQ ID NO: 866501 - RNA, 22 nt, Human
uuaaaaucuaaagcaguugucu

SEQ ID NO: 866502 - RNA, 22 nt, Human
aacaugucuggguauucacaag

SEQ ID NO: 866503 - RNA, 22 nt, Human
acagauguacacucauauauaa

SEQ ID NO: 866504 - RNA, 22 nt, Human
cccaggaaugagcaggcagggg

SEQ ID NO: 866505 - RNA, 22 nt, Human
ucuuugaauuucugacugucuu

SEQ ID NO: 866506 - RNA, 22 nt, Human
ggcagacuguaauaggagaauu

SEQ ID NO: 866507 - RNA, 22 nt, Human
aguggacucuucccagugcuug

SEQ ID NO: 866508 - RNA, 22 nt, Human
augaaggcaguuaaacgucauc

SEQ ID NO: 866509 - RNA, 22 nt, Human
gaggccaggagugcuguaaguu

SEQ ID NO: 866510 - RNA, 22 nt, Human
uaaauaugcauguauccuuauc

SEQ ID NO: 866511 - RNA, 22 nt, Human
uuugaaaguccuaggagagucc

SEQ ID NO: 866512 - RNA, 22 nt, Human
ucuuugaaagcuguucuagagu

SEQ ID NO: 866513 - RNA, 20 nt, Human
caucaucacaugagccaauu

SEQ ID NO: 866514 - RNA, 22 nt, Human
uguccucagauaugucuacucu

SEQ ID NO: 866515 - RNA, 21 nt, Human
acuuuaauauacaugaggagg

SEQ ID NO: 866516 - RNA, 22 nt, Human
agagggauaauauguauuguaa

SEQ ID NO: 866517 - RNA, 22 nt, Human
aggaagcuggugugaggaugaa

SEQ ID NO: 866518 - RNA, 22 nt, Human
cuuaaagaugucaaggcuguuu

SEQ ID NO: 866519 - RNA, 22 nt, Human
uucaccacagucucaucuacgc

SEQ ID NO: 866520 - RNA, 22 nt, Human
ccuggaucagagccagagaagc

SEQ ID NO: 866521 - RNA, 22 nt, Human
caagauuugccaguggccaacu

SEQ ID NO: 866522 - RNA, 22 nt, Human
acuguugucaggcugcuuugga

SEQ ID NO: 866523 - RNA, 22 nt, Human
caguccuuucugaaauccuaua

SEQ ID NO: 866524 - RNA, 22 nt, Human
cauaauauacuacauugaugaa

SEQ ID NO: 866525 - RNA, 22 nt, Human
uguggaaaauuggaacguuccu

SEQ ID NO: 866526 - RNA, 22 nt, Human
uugcagcuucuaccacuguuuc

SEQ ID NO: 866527 - RNA, 22 nt, Human
aaggcagccaugugcuuugggu

SEQ ID NO: 866528 - RNA, 22 nt, Human
uucagaaugugaccuuauuugg

SEQ ID NO: 866529 - RNA, 22 nt, Human
uauacagauuaacagauuuaaa

SEQ ID NO: 866530 - RNA, 22 nt, Human
ugccuggaaggcccaugggaag

SEQ ID NO: 866531 - RNA, 19 nt, Human
gcagcugcuugaaaagaaa

SEQ ID NO: 866532 - RNA, 22 nt, Human
aaauugaaugauuaagugguga

SEQ ID NO: 866533 - RNA, 22 nt, Human
uugguacagaugagguauucuc

SEQ ID NO: 866534 - RNA, 22 nt, Human
auuuccagacuuuuuccaggaa

SEQ ID NO: 866535 - RNA, 22 nt, Human
auacuuucugaccaauuaauug

SEQ ID NO: 866536 - RNA, 22 nt, Human
cccaguuucaacuuuccagugg

SEQ ID NO: 866537 - RNA, 22 nt, Human
uucuucucagggucccacaugg

SEQ ID NO: 866538 - RNA, 22 nt, Human
aauuaauggaaaguaaggaagg

SEQ ID NO: 866539 - RNA, 17 nt, Human
uaaagccagucaaguca

SEQ ID NO: 866540 - RNA, 22 nt, Human
uccaggagguugagugaguucc

SEQ ID NO: 866541 - RNA, 22 nt, Human
gccagucugcucccacaaguuc

SEQ ID NO: 866542 - RNA, 22 nt, Human
uauuucagcacaugggauaggu

SEQ ID NO: 866543 - RNA, 22 nt, Human
uacugcaugguggaguggagcu

SEQ ID NO: 866544 - RNA, 22 nt, Human
agugcuuuagagaaauggugcu

SEQ ID NO: 866545 - RNA, 22 nt, Human
caaguccaggucaauuuaaagc

SEQ ID NO: 866546 - RNA, 22 nt, Human
cagagggcucuuggcugccugc

SEQ ID NO: 866547 - RNA, 22 nt, Human
caguccuugcucaaagucuaca

SEQ ID NO: 866548 - RNA, 22 nt, Human
ucaaauaaugccauucaucauc

SEQ ID NO: 866549 - RNA, 22 nt, Human
cuagggaguggcagagcuggga

SEQ ID NO: 866550 - RNA, 22 nt, Human
ccaggagagcaggcgugcagcu

SEQ ID NO: 866551 - RNA, 22 nt, Human
ucuuccaagguugcacacuauc

SEQ ID NO: 866552 - RNA, 22 nt, Human
gagauuuagcugcuuaacuccu

SEQ ID NO: 866553 - RNA, 22 nt, Human
gaaugaaaaccuuggcucaaau

SEQ ID NO: 866554 - RNA, 22 nt, Human
ugcuuaauguacgugaguguac

SEQ ID NO: 866555 - RNA, 22 nt, Human
aggagggagaugcccauccugg

SEQ ID NO: 866556 - RNA, 22 nt, Human
agcauaaaggcacuagaaagag

SEQ ID NO: 866557 - RNA, 22 nt, Human
gaaucucaaggcuugugaggau

SEQ ID NO: 866558 - RNA, 22 nt, Human
ucuaaagaagaggguucugcgg

SEQ ID NO: 866559 - RNA, 22 nt, Human
auguggaggaaaugaguguaca

SEQ ID NO: 866560 - RNA, 20 nt, Human
aggaagcugagauguagagg

SEQ ID NO: 866561 - RNA, 22 nt, Human
caguuucuuggaugccaauuuc

SEQ ID NO: 866562 - RNA, 22 nt, Human
uucuugcaggucacucacugag

SEQ ID NO: 866563 - RNA, 17 nt, Human
ugauaguucauuuuaag

SEQ ID NO: 866564 - RNA, 22 nt, Human
uaggcaacaugucgaauacugu

SEQ ID NO: 866565 - RNA, 22 nt, Human
gcauguguggaggagaugugcu

SEQ ID NO: 866566 - RNA, 22 nt, Human
aaaggugacacucugccagcug

SEQ ID NO: 866567 - RNA, 22 nt, Human
gugcagcugugguggagccagg

SEQ ID NO: 866568 - RNA, 22 nt, Human
agaccaugggcucugaagagca

SEQ ID NO: 866569 - RNA, 21 nt, Human
aaagaaucauggguaauuuca

SEQ ID NO: 866570 - RNA, 22 nt, Human
gucccauaaguagugcaacuug

SEQ ID NO: 866571 - RNA, 22 nt, Human
ucuggcuuucauuuguuuaaag

SEQ ID NO: 866572 - RNA, 22 nt, Human
gaggaaccacucugagaagcca

SEQ ID NO: 866573 - RNA, 22 nt, Human
aggcagacaaggucccuggucu

SEQ ID NO: 866574 - RNA, 22 nt, Human
gagcaccucaauuugcuauuug

SEQ ID NO: 866575 - RNA, 18 nt, Human
uaggagagaauuuauuua

SEQ ID NO: 866576 - RNA, 21 nt, Human
gaguccuuccaauguccucag

SEQ ID NO: 866577 - RNA, 22 nt, Human
gauggcaggugauagccgaguc

SEQ ID NO: 866578 - RNA, 22 nt, Human
ucacugcucuccaauguggagu

SEQ ID NO: 866579 - RNA, 22 nt, Human
auuaugcugguuuacacauuuu

SEQ ID NO: 866580 - RNA, 22 nt, Human
uucuucuuucccccugugguac

SEQ ID NO: 866581 - RNA, 22 nt, Human
aggagaaggaagugcaucacua

SEQ ID NO: 866582 - RNA, 22 nt, Human
uuugaauaucacaaacuuucaa

SEQ ID NO: 866583 - RNA, 22 nt, Human
aaucaguguguaaaguggcugc

SEQ ID NO: 866584 - RNA, 22 nt, Human
ucuucagauaaagggagaguau

SEQ ID NO: 866585 - RNA, 22 nt, Human
gaaagccauagcccagcuuuac

SEQ ID NO: 866586 - RNA, 22 nt, Human
gcccaggagguugggcugugca

SEQ ID NO: 866587 - RNA, 22 nt, Human
acccaggagacagguugcagug

SEQ ID NO: 866588 - RNA, 22 nt, Human
uuugcauaagucauguccagug

SEQ ID NO: 866589 - RNA, 22 nt, Human
agacgagggcccccaggacagc

SEQ ID NO: 866590 - RNA, 22 nt, Human
agggcagccauugagggauucu

SEQ ID NO: 866591 - RNA, 22 nt, Human
cugcaucacagcaggaggcaca

SEQ ID NO: 866592 - RNA, 22 nt, Human
ucauucuugaucacuaguuagu

SEQ ID NO: 866593 - RNA, 22 nt, Human
ccaaaauuaagccucuuauguu

SEQ ID NO: 866594 - RNA, 22 nt, Human
ucugggaaccagugcggcuggg

SEQ ID NO: 866595 - RNA, 22 nt, Human
uucagaaacccauugggucucu

SEQ ID NO: 866596 - RNA, 22 nt, Human
uuucuaggcacagugucuuccc

SEQ ID NO: 866597 - RNA, 22 nt, Human
ccaggaguggcuggugaccuuc

SEQ ID NO: 866598 - RNA, 18 nt, Human
ggcaucugcacagcagcc

SEQ ID NO: 866599 - RNA, 22 nt, Human
caaagccaggcuuucuaaugua

SEQ ID NO: 866600 - RNA, 22 nt, Human
uucaauucuaaacuaauauucu

SEQ ID NO: 866601 - RNA, 22 nt, Human
aaaugucagaggaacauauuga

SEQ ID NO: 866602 - RNA, 22 nt, Human
uguuuuaaagccauugccuuuc

SEQ ID NO: 866603 - RNA, 22 nt, Human
ucaauaaaauuguuuuccuauc

SEQ ID NO: 866604 - RNA, 22 nt, Human
agagggaucacccuguuucugg

SEQ ID NO: 866605 - RNA, 22 nt, Human
cccaggagccaucugucuuggc

SEQ ID NO: 866606 - RNA, 22 nt, Human
auaaaacuuggguaugaucccu

SEQ ID NO: 866607 - RNA, 22 nt, Human
gaggcaacacauuuggaaagca

SEQ ID NO: 866608 - RNA, 22 nt, Human
aauuauauuguggugugaaugu

SEQ ID NO: 866609 - RNA, 22 nt, Human
cauuuguaauacugacuugcag

SEQ ID NO: 866610 - RNA, 22 nt, Human
uuugaauagcauaggauuacau

SEQ ID NO: 866611 - RNA, 22 nt, Human
acagucuugcuguauggucagg

SEQ ID NO: 866612 - RNA, 22 nt, Human
gcuggaucauauggugguucua

SEQ ID NO: 866613 - RNA, 22 nt, Human
cuugaaagauuuggccucugug

SEQ ID NO: 866614 - RNA, 22 nt, Human
acaugucuguaauuauuuuagg

SEQ ID NO: 866615 - RNA, 22 nt, Human
cucaggaucgcuugcccuaggg

SEQ ID NO: 866616 - RNA, 21 nt, Human
uccaggaguucuaauaggugu

SEQ ID NO: 866617 - RNA, 22 nt, Human
gcccaguaguucaagguugcag

SEQ ID NO: 866618 - RNA, 22 nt, Human
uuucauugcagagucugugugc

SEQ ID NO: 866619 - RNA, 22 nt, Human
guaaacauuacugugcuguaua

SEQ ID NO: 866620 - RNA, 23 nt, Human
uauuacaauuggucuuauuaaga

SEQ ID NO: 866621 - RNA, 22 nt, Human
auuccaaagguuaaugcccauu

SEQ ID NO: 866622 - RNA, 22 nt, Human
uccaggagaggccugaccaggu

SEQ ID NO: 866623 - RNA, 22 nt, Human
ccaggagagcauugcacagagg

SEQ ID NO: 866624 - RNA, 22 nt, Human
cuacagaaaccuuuuucauaca

SEQ ID NO: 866625 - RNA, 22 nt, Human
cuaugacacaggccauuauaua

SEQ ID NO: 866626 - RNA, 19 nt, Human
aucugccuguuaucacaua

SEQ ID NO: 866627 - RNA, 22 nt, Human
gaagcagcuuucuggugaggag

SEQ ID NO: 866628 - RNA, 22 nt, Human
cucaggaaaggccaugcaaggg

SEQ ID NO: 866629 - RNA, 22 nt, Human
cuauagaaaauuguaucacacg

SEQ ID NO: 866630 - RNA, 22 nt, Human
aagaaacaaccacugcucuccu

SEQ ID NO: 866631 - RNA, 19 nt, Human
uucauucucuuauuguugu

SEQ ID NO: 866632 - RNA, 22 nt, Human
uuauuauagauuaugcaagauu

SEQ ID NO: 866633 - RNA, 22 nt, Human
ucagagaguuagugucuuagcu

SEQ ID NO: 866634 - RNA, 21 nt, Human
auugaaagucaacaaucaguu

SEQ ID NO: 866635 - RNA, 22 nt, Human
uccaaauacauuuacuguauuu

SEQ ID NO: 866636 - RNA, 22 nt, Human
gauggcagcagcagccagggau

SEQ ID NO: 866637 - RNA, 22 nt, Human
cuuaaaaucuggcaguuagcua

SEQ ID NO: 866638 - RNA, 22 nt, Human
gggauggggagcuggaaagggg

SEQ ID NO: 866639 - RNA, 22 nt, Human
guacauaaaggaggcucuuugc

SEQ ID NO: 866640 - RNA, 19 nt, Human
uaaggccaaaaguaagugu

SEQ ID NO: 866641 - RNA, 22 nt, Human
aaagaaucacauccuucagcaa

SEQ ID NO: 866642 - RNA, 22 nt, Human
cccaggaaugggaaggaggaau

SEQ ID NO: 866643 - RNA, 22 nt, Human
acaguacauaauccugagucug

SEQ ID NO: 866644 - RNA, 22 nt, Human
uuucaacuagccccuaaguccu

SEQ ID NO: 866645 - RNA, 22 nt, Human
aggcuucuucuuccuauuuagu

SEQ ID NO: 866646 - RNA, 22 nt, Human
ucuuuaaucauaaccaagaugg

SEQ ID NO: 866647 - RNA, 22 nt, Human
gauagaaagguguugaaaucca

SEQ ID NO: 866648 - RNA, 20 nt, Human
cuguggaauuuuaccaugcg

SEQ ID NO: 866649 - RNA, 22 nt, Human
uuuccaagacuccaguucuccc

SEQ ID NO: 866650 - RNA, 20 nt, Human
augauuuugcacuaacuuca

SEQ ID NO: 866651 - RNA, 22 nt, Human
guaguucugcagugucaccuga

SEQ ID NO: 866652 - RNA, 22 nt, Human
gcagcugcuggagggaggcagg

SEQ ID NO: 866653 - RNA, 22 nt, Human
uuccaaacugccaauucagaag

SEQ ID NO: 866654 - RNA, 22 nt, Human
uucucagagcucacuguaguaa

SEQ ID NO: 866655 - RNA, 22 nt, Human
guggcagcaaaugccuggacua

SEQ ID NO: 866656 - RNA, 22 nt, Human
gcuaugcaggagccuaaugaca

SEQ ID NO: 866657 - RNA, 22 nt, Human
uucuacaauaugaauaaugaag

SEQ ID NO: 866658 - RNA, 22 nt, Human
aaauaauguuaggccuuugcuc

SEQ ID NO: 866659 - RNA, 22 nt, Human
guacauuucucuuguucuuauu

SEQ ID NO: 866660 - RNA, 22 nt, Human
uuccaugaagggcagccucuca

SEQ ID NO: 866661 - RNA, 22 nt, Human
uucaaauacauucuuugccacu

SEQ ID NO: 866662 - RNA, 21 nt, Human
aucauucuggaaaauucaagc

SEQ ID NO: 866663 - RNA, 22 nt, Human
cuggaucaugggaaagggauca

SEQ ID NO: 866664 - RNA, 22 nt, Human
cagauccacccuuguagugaca

SEQ ID NO: 866665 - RNA, 22 nt, Human
aucuuucagggccauuuguauu

SEQ ID NO: 866666 - RNA, 22 nt, Human
gaaaggccagcucacagaugag

SEQ ID NO: 866667 - RNA, 22 nt, Human
caaauucaaauuucaucagugu

SEQ ID NO: 866668 - RNA, 22 nt, Human
agcagcauuaugauauaucuua

SEQ ID NO: 866669 - RNA, 22 nt, Human
uugaacauuggcaauuucauau

SEQ ID NO: 866670 - RNA, 22 nt, Human
gagcagcucgagaaggaagcag

SEQ ID NO: 866671 - RNA, 22 nt, Human
gggauuuaguaggauaguauac

SEQ ID NO: 866672 - RNA, 22 nt, Human
gagcagcucugugccuggagac

SEQ ID NO: 866673 - RNA, 18 nt, Human
agggagagaccgcggguc

SEQ ID NO: 866674 - RNA, 22 nt, Human
ggagaggaaaugccagcacuuc

SEQ ID NO: 866675 - RNA, 22 nt, Human
uaagacuucauuaguaauaugg

SEQ ID NO: 866676 - RNA, 22 nt, Human
auucuucaucacuaccuuguga

SEQ ID NO: 866677 - RNA, 22 nt, Human
gcagaggccaggccaccagcaa

SEQ ID NO: 866678 - RNA, 22 nt, Human
auuccaaacgccucgcggacuu

SEQ ID NO: 866679 - RNA, 22 nt, Human
agagggcaaguguaguccagua

SEQ ID NO: 866680 - RNA, 22 nt, Human
gcagaggggaagcugaggaauu

SEQ ID NO: 866681 - RNA, 22 nt, Human
uuuccauguuggugaaaugagg

SEQ ID NO: 866682 - RNA, 22 nt, Human
gaaggccacaaaaaaugucaua

SEQ ID NO: 866683 - RNA, 22 nt, Human
ggguggaguagaaagaugaauu

SEQ ID NO: 866684 - RNA, 22 nt, Human
cugcgcagggguggcgccagaa

SEQ ID NO: 866685 - RNA, 22 nt, Human
aaaucucaguguucuaagcauu

SEQ ID NO: 866686 - RNA, 22 nt, Human
gauuuucauuugcacucuagaa

SEQ ID NO: 866687 - RNA, 22 nt, Human
aaagcagagcagggcacuuaug

SEQ ID NO: 866688 - RNA, 22 nt, Human
uuaauaaaguaugaauuggaaa

SEQ ID NO: 866689 - RNA, 22 nt, Human
caggcagcucuaauggaaagug

SEQ ID NO: 866690 - RNA, 22 nt, Human
uguaagaaucagucuuuaaugu

SEQ ID NO: 866691 - RNA, 22 nt, Human
gcugaaugaauguauuuuaaaa

SEQ ID NO: 866692 - RNA, 22 nt, Human
acauucacgcucucaaagcuga

SEQ ID NO: 866693 - RNA, 22 nt, Human
guucuucaucauuuuagauagg

SEQ ID NO: 866694 - RNA, 22 nt, Human
ucaaguuuaauugagauguuua

SEQ ID NO: 866695 - RNA, 22 nt, Human
gccaggagcccugggcaaguuc

SEQ ID NO: 866696 - RNA, 22 nt, Human
uagucaccucuuuaaauguccu

SEQ ID NO: 866697 - RNA, 22 nt, Human
aggagcagaacugauucugacu

SEQ ID NO: 866698 - RNA, 22 nt, Human
uauacagucuuuugcuauauuc

SEQ ID NO: 866699 - RNA, 22 nt, Human
uucuucuuuaucucaguauccu

SEQ ID NO: 866700 - RNA, 19 nt, Human
ucugccucuggucaggcuc

SEQ ID NO: 866701 - RNA, 22 nt, Human
ucauaaaaauagacucuaaagu

SEQ ID NO: 866702 - RNA, 22 nt, Human
cucccagagagcaggugggccg

SEQ ID NO: 866703 - RNA, 22 nt, Human
caugauaauuguuaacaaagua

SEQ ID NO: 866704 - RNA, 22 nt, Human
gaggccaaguuggagaccaggu

SEQ ID NO: 866705 - RNA, 22 nt, Human
uccuuagagacaagaccaguuu

SEQ ID NO: 866706 - RNA, 22 nt, Human
cagaucuagagcuuuuccaucu

SEQ ID NO: 866707 - RNA, 22 nt, Human
augggaggaugcucgggugcuc

SEQ ID NO: 866708 - RNA, 22 nt, Human
cuggcagucugccucuucacug

SEQ ID NO: 866709 - RNA, 22 nt, Human
cccaugagguggagguugcagu

SEQ ID NO: 866710 - RNA, 22 nt, Human
aggcaggcaaccaccugggaag

SEQ ID NO: 866711 - RNA, 22 nt, Human
caauuucagaccuuuccuugga

SEQ ID NO: 866712 - RNA, 22 nt, Human
ugaaggcccuaucuccauauac

SEQ ID NO: 866713 - RNA, 22 nt, Human
augugucuuugagacucugcua

SEQ ID NO: 866714 - RNA, 20 nt, Human
uuucaguuaucuugaccuuc

SEQ ID NO: 866715 - RNA, 22 nt, Human
ugauuuuuagcuauucugaaga

SEQ ID NO: 866716 - RNA, 22 nt, Human
auuucccagcuuugaucaguuu

SEQ ID NO: 866717 - RNA, 22 nt, Human
auguuuccauuuucuuguauca

SEQ ID NO: 866718 - RNA, 22 nt, Human
ugaaaugacagucuuaagcucu

SEQ ID NO: 866719 - RNA, 22 nt, Human
ccauccuaucugaccuacuugu

SEQ ID NO: 866720 - RNA, 22 nt, Human
acucagaagauauaaugacuca

SEQ ID NO: 866721 - RNA, 22 nt, Human
aaucagaaauugagggucuggu

SEQ ID NO: 866722 - RNA, 17 nt, Human
ccuguguuugcuccuuc

SEQ ID NO: 866723 - RNA, 22 nt, Human
uauauacuuucuuccuggguag

SEQ ID NO: 866724 - RNA, 22 nt, Human
uuagccauuuuauacaagugua

SEQ ID NO: 866725 - RNA, 22 nt, Human
uaaggccaaggggccauagucu

SEQ ID NO: 866726 - RNA, 22 nt, Human
auggcuuuuuagacuuugguac

SEQ ID NO: 866727 - RNA, 22 nt, Human
ugcauaauacguuuccuauaac

SEQ ID NO: 866728 - RNA, 22 nt, Human
ucuauacacacaaagaaugcuu

SEQ ID NO: 866729 - RNA, 23 nt, Human
uggaauaauaagguacauuaaca

SEQ ID NO: 866730 - RNA, 22 nt, Human
aaucagaaagaggucauguugc

SEQ ID NO: 866731 - RNA, 22 nt, Human
uucuucuucaagugcugcauuc

SEQ ID NO: 866732 - RNA, 22 nt, Human
agaggggaaguaaugaaugaua

SEQ ID NO: 866733 - RNA, 22 nt, Human
uuguaaauaguaguaagaugcc

SEQ ID NO: 866734 - RNA, 22 nt, Human
cagcuggccccacaguagaggc

SEQ ID NO: 866735 - RNA, 19 nt, Human
agcuuccauauucucuagu

SEQ ID NO: 866736 - RNA, 22 nt, Human
ggugaagggugucauggcauuu

SEQ ID NO: 866737 - RNA, 23 nt, Human
aguaaagcaauuguuggcgagag

SEQ ID NO: 866738 - RNA, 20 nt, Human
accaggagauggaggcaggg

SEQ ID NO: 866739 - RNA, 22 nt, Human
cagaggaugaucuggccucucu

SEQ ID NO: 866740 - RNA, 22 nt, Human
agaaaugaaaccaaagccuaga

SEQ ID NO: 866741 - RNA, 22 nt, Human
uuucacagcuggguggcagagu

SEQ ID NO: 866742 - RNA, 22 nt, Human
uugaagagugccuuccagacau

SEQ ID NO: 866743 - RNA, 22 nt, Human
cuugaaagucagcagaguggau

SEQ ID NO: 866744 - RNA, 22 nt, Human
cacaugaguccugccagguaug

SEQ ID NO: 866745 - RNA, 22 nt, Human
ugcuuauuuauagucaauagag

SEQ ID NO: 866746 - RNA, 22 nt, Human
uaaggccaggcuguggucggca

SEQ ID NO: 866747 - RNA, 22 nt, Human
auggaguucuuuaaauucacag

SEQ ID NO: 866748 - RNA, 22 nt, Human
caaauguaaauucuuuugaagc

SEQ ID NO: 866749 - RNA, 22 nt, Human
ucuucccuaaucaccaucuuca

SEQ ID NO: 866750 - RNA, 22 nt, Human
uguagggaggaaggguuggaaa

SEQ ID NO: 866751 - RNA, 22 nt, Human
aaguccuuuaauaucacauagu

SEQ ID NO: 866752 - RNA, 22 nt, Human
ucagccaguugccccaguuagu

SEQ ID NO: 866753 - RNA, 22 nt, Human
aucaggaugaagcuguagcgaa

SEQ ID NO: 866754 - RNA, 22 nt, Human
auuuaaaugcuuaagaggguuu

SEQ ID NO: 866755 - RNA, 22 nt, Human
ugaauaauccacagucauucau

SEQ ID NO: 866756 - RNA, 22 nt, Human
aucugccucuucuucauugcga

SEQ ID NO: 866757 - RNA, 22 nt, Human
cagauaaaggcuuacuaguagu

SEQ ID NO: 866758 - RNA, 22 nt, Human
gucaggaucaaauugaaguuau

SEQ ID NO: 866759 - RNA, 22 nt, Human
uaaauuauggcuggcagagcag

SEQ ID NO: 866760 - RNA, 22 nt, Human
agaaucugguagaaccaaggau

SEQ ID NO: 866761 - RNA, 22 nt, Human
caaacauucaaguacaagucuu

SEQ ID NO: 866762 - RNA, 22 nt, Human
uuucaugaggggcaaaaucuca

SEQ ID NO: 866763 - RNA, 22 nt, Human
ugcauaaagugccauaguauua

SEQ ID NO: 866764 - RNA, 22 nt, Human
uuugaagacauauuguuacaua

SEQ ID NO: 866765 - RNA, 22 nt, Human
gaaggccaagaggcuccaagau

SEQ ID NO: 866766 - RNA, 22 nt, Human
caaguccuaggucugauugaac

SEQ ID NO: 866767 - RNA, 23 nt, Human
uaugaacugcauugcuggugugu

SEQ ID NO: 866768 - RNA, 22 nt, Human
gaggcagcucuucugaaugggg

SEQ ID NO: 866769 - RNA, 22 nt, Human
cagagcucuauguucauggagg

SEQ ID NO: 866770 - RNA, 22 nt, Human
ugcacauuaguguuugagaugc

SEQ ID NO: 866771 - RNA, 22 nt, Human
ucuggaucgccggcgccugggc

SEQ ID NO: 866772 - RNA, 22 nt, Human
ugugccagccucuggcuguguc

SEQ ID NO: 866773 - RNA, 22 nt, Human
aaaugauugucaaaguucuguu

SEQ ID NO: 866774 - RNA, 22 nt, Human
aaggcaguuugggccaccaucu

SEQ ID NO: 866775 - RNA, 22 nt, Human
augguuuuguccucuuugguuc

SEQ ID NO: 866776 - RNA, 22 nt, Human
uucugugauugacauguggcuu

SEQ ID NO: 866777 - RNA, 22 nt, Human
cucacugacgaggaagcugaga

SEQ ID NO: 866778 - RNA, 22 nt, Human
uacacacagaggccaugggauu

SEQ ID NO: 866779 - RNA, 22 nt, Human
gacccaggaagcuacuucuggu

SEQ ID NO: 866780 - RNA, 22 nt, Human
uugaagaaauuauuuuauauag

SEQ ID NO: 866781 - RNA, 22 nt, Human
caggguggcacaucacagcauu

SEQ ID NO: 866782 - RNA, 22 nt, Human
accaggagcauuuuuuauuagu

SEQ ID NO: 866783 - RNA, 22 nt, Human
ccccaggagcuuguuuuagaga

SEQ ID NO: 866784 - RNA, 22 nt, Human
uuccaugaaggagacugagaag

SEQ ID NO: 866785 - RNA, 22 nt, Human
uauuucagcccuacuacuuggc

SEQ ID NO: 866786 - RNA, 22 nt, Human
agaaaauauucauugagaggcu

SEQ ID NO: 866787 - RNA, 22 nt, Human
uacagaaguaaauaccaaaagc

SEQ ID NO: 866788 - RNA, 22 nt, Human
gccucugcccuccugggacugc

SEQ ID NO: 866789 - RNA, 18 nt, Human
gaugggagcaagagaaga

SEQ ID NO: 866790 - RNA, 22 nt, Human
gcgcaggagccgcggagggccg

SEQ ID NO: 866791 - RNA, 22 nt, Human
uagaaacagaaaacuguaauag

SEQ ID NO: 866792 - RNA, 22 nt, Human
agacucaagacugcagaagacg

SEQ ID NO: 866793 - RNA, 22 nt, Human
cucuucuugccugaugaggcag

SEQ ID NO: 866794 - RNA, 22 nt, Human
aggagagaauguuccaggcuug

SEQ ID NO: 866795 - RNA, 22 nt, Human
aggcagcugaggucuggcgccc

SEQ ID NO: 866796 - RNA, 22 nt, Human
uuguugguggaauugaugcuag

SEQ ID NO: 866797 - RNA, 22 nt, Human
uuuuaucuaccuaugcucauuu

SEQ ID NO: 866798 - RNA, 22 nt, Human
ucuuagaaguucauguuccagc

SEQ ID NO: 866799 - RNA, 22 nt, Human
uaaagccaauauaccuagcaua

SEQ ID NO: 866800 - RNA, 22 nt, Human
acacacucaauugcauaagcac

SEQ ID NO: 866801 - RNA, 22 nt, Human
ucaggauaaaauguaauggcaa

SEQ ID NO: 866802 - RNA, 22 nt, Human
ucuaaccuuugaaacugcuuuc

SEQ ID NO: 866803 - RNA, 22 nt, Human
ucuuuaauaucugccccagagc

SEQ ID NO: 866804 - RNA, 22 nt, Human
caagagagaugcagcucacuca

SEQ ID NO: 866805 - RNA, 22 nt, Human
ccucagaugucuuaaggcacug

SEQ ID NO: 866806 - RNA, 22 nt, Human
uucaccgugaaccgauuccuca

SEQ ID NO: 866807 - RNA, 23 nt, Human
cagaaaacccagagcucaguccc

SEQ ID NO: 866808 - RNA, 22 nt, Human
auggcuuaugaauaacaguagg

SEQ ID NO: 866809 - RNA, 22 nt, Human
ggcagcugucucugaguuagca

SEQ ID NO: 866810 - RNA, 22 nt, Human
aggucagcaggccaggggcgaa

SEQ ID NO: 866811 - RNA, 22 nt, Human
aucagaaaauacccaguguuua

SEQ ID NO: 866812 - RNA, 22 nt, Human
agauuuccuaugguaauuauag

SEQ ID NO: 866813 - RNA, 22 nt, Human
acauucuuaacaguuaaaaacu

SEQ ID NO: 866814 - RNA, 22 nt, Human
gucaggaugagggaugaggagu

SEQ ID NO: 866815 - RNA, 22 nt, Human
augcaaaauaaggcagaaacau

SEQ ID NO: 866816 - RNA, 22 nt, Human
gaggcagcaugguaccuuggag

SEQ ID NO: 866817 - RNA, 22 nt, Human
gacccaggcucgugggacggcu

SEQ ID NO: 866818 - RNA, 22 nt, Human
gauuuuaauuauaggagguccu

SEQ ID NO: 866819 - RNA, 22 nt, Human
guuaaagaagaauaguuccuuu

SEQ ID NO: 866820 - RNA, 22 nt, Human
ucucagaguuuagagcugagcc

SEQ ID NO: 866821 - RNA, 22 nt, Human
ugcuuuggccacuagaauucag

SEQ ID NO: 866822 - RNA, 22 nt, Human
ucuauacugaugggauacuauu

SEQ ID NO: 866823 - RNA, 22 nt, Human
auuaggcagugccauuguacgg

SEQ ID NO: 866824 - RNA, 22 nt, Human
cacagacccagaagggaugaag

SEQ ID NO: 866825 - RNA, 22 nt, Human
ucugaagaacugaguaaacaug

SEQ ID NO: 866826 - RNA, 22 nt, Human
uucagcaaauggacuguucagg

SEQ ID NO: 866827 - RNA, 22 nt, Human
gagggaggcaucaugaauccag

SEQ ID NO: 866828 - RNA, 23 nt, Human
cccaggaguuucacugcaaaggu

SEQ ID NO: 866829 - RNA, 22 nt, Human
uucuuaacucaaauauauaucc

SEQ ID NO: 866830 - RNA, 22 nt, Human
gaggcagcauucgcauagacag

SEQ ID NO: 866831 - RNA, 22 nt, Human
agaaaugaagagagucaagguu

SEQ ID NO: 866832 - RNA, 22 nt, Human
gaggagagccugcacuuugacc

SEQ ID NO: 866833 - RNA, 22 nt, Human
ccuauacaggcuucuuuacaug

SEQ ID NO: 866834 - RNA, 22 nt, Human
gaggagaggcuggacgcgguga

SEQ ID NO: 866835 - RNA, 22 nt, Human
acagaaguuggaauuagauacu

SEQ ID NO: 866836 - RNA, 22 nt, Human
aggcagcuuucagugucucuca

SEQ ID NO: 866837 - RNA, 22 nt, Human
caggcagcuagauuuauaacaa

SEQ ID NO: 866838 - RNA, 22 nt, Human
augaaggcuguguggagccccc

SEQ ID NO: 866839 - RNA, 22 nt, Human
uuccaaagugcuggaauuacau

SEQ ID NO: 866840 - RNA, 22 nt, Human
uuucuagggcucuugucuucug

SEQ ID NO: 866841 - RNA, 22 nt, Human
uacagauauagagauuuauaga

SEQ ID NO: 866842 - RNA, 22 nt, Human
uauuuccaagcugaauccaaug

SEQ ID NO: 866843 - RNA, 22 nt, Human
aaauacuguagauaauagaguu

SEQ ID NO: 866844 - RNA, 22 nt, Human
uucaggauuguguuuuuccuga

SEQ ID NO: 866845 - RNA, 22 nt, Human
caucagaacgugagcuccuugu

SEQ ID NO: 866846 - RNA, 22 nt, Human
ucucuucuagcuucuugugguu

SEQ ID NO: 866847 - RNA, 22 nt, Human
aauauaauuuuauuccuagagu

SEQ ID NO: 866848 - RNA, 22 nt, Human
agggcagcagcggcccaggccu

SEQ ID NO: 866849 - RNA, 22 nt, Human
ggccagaaguuggaaaagagcc

SEQ ID NO: 866850 - RNA, 22 nt, Human
uucauuaguucugaagaugucu

SEQ ID NO: 866851 - RNA, 22 nt, Human
ucuucauuuuauagcaucugug

SEQ ID NO: 866852 - RNA, 22 nt, Human
augauguugauaaauuacuuua

SEQ ID NO: 866853 - RNA, 22 nt, Human
ugcauauuguccuugauauuau

SEQ ID NO: 866854 - RNA, 22 nt, Human
gauuucaagcccccagagauuc

SEQ ID NO: 866855 - RNA, 22 nt, Human
cugacuguaauucuguucuuaa

SEQ ID NO: 866856 - RNA, 19 nt, Human
gaggcgaggcgugcaggag

SEQ ID NO: 866857 - RNA, 22 nt, Human
caauuucagugcuguggagagg

SEQ ID NO: 866858 - RNA, 22 nt, Human
caaaugauacuguuuuuagucu

SEQ ID NO: 866859 - RNA, 23 nt, Human
gggcagcuuaagcuuguuuuucu

SEQ ID NO: 866860 - RNA, 22 nt, Human
cugcauuagucaugcuuugcag

SEQ ID NO: 866861 - RNA, 22 nt, Human
ggaggagggguuuacauuggaa

SEQ ID NO: 866862 - RNA, 22 nt, Human
uaugcugugcuagauacaauau

SEQ ID NO: 866863 - RNA, 22 nt, Human
uuggaaagcaagcuggacauac

SEQ ID NO: 866864 - RNA, 22 nt, Human
ccucaggauccgcaggugcagu

SEQ ID NO: 866865 - RNA, 19 nt, Human
caggagagcaugcacuuug

SEQ ID NO: 866866 - RNA, 18 nt, Human
ugugaacacauuuuucug

SEQ ID NO: 866867 - RNA, 22 nt, Human
auacagaagccuguauuucugg

SEQ ID NO: 866868 - RNA, 22 nt, Human
acagaaugggauuugaauauuu

SEQ ID NO: 866869 - RNA, 22 nt, Human
cugugcagcuggcuuccuggaa

SEQ ID NO: 866870 - RNA, 22 nt, Human
uuugaaaguguuuacuugggaa

SEQ ID NO: 866871 - RNA, 20 nt, Human
uuucugugagaaacacuguu

SEQ ID NO: 866872 - RNA, 19 nt, Human
gacagugcaguuguaguac

SEQ ID NO: 866873 - RNA, 22 nt, Human
auuugcuuaucuccacaguugu

SEQ ID NO: 866874 - RNA, 22 nt, Human
ugugcaggugcaggaagggggc

SEQ ID NO: 866875 - RNA, 22 nt, Human
ugaaauagaaaaacaggcuucu

SEQ ID NO: 866876 - RNA, 22 nt, Human
ccacagagcauuagauuucaga

SEQ ID NO: 866877 - RNA, 22 nt, Human
cuguggaaaauuuguauguaau

SEQ ID NO: 866878 - RNA, 22 nt, Human
cucacugugaccucagcagaca

SEQ ID NO: 866879 - RNA, 22 nt, Human
aauuuacaggugcacucgccau

SEQ ID NO: 866880 - RNA, 22 nt, Human
aagcuggagaguuaggugaaua

SEQ ID NO: 866881 - RNA, 22 nt, Human
uaggcagcauggauucugaaua

SEQ ID NO: 866882 - RNA, 22 nt, Human
aaucagaaaggcuaaggaagca

SEQ ID NO: 866883 - RNA, 22 nt, Human
ggauguugauugaauggccauu

SEQ ID NO: 866884 - RNA, 22 nt, Human
auagcuuucuuaaauauauaaa

SEQ ID NO: 866885 - RNA, 22 nt, Human
ugccuugcgggcguuucuguug

SEQ ID NO: 866886 - RNA, 22 nt, Human
uggcuuuacaucaaauugagua

SEQ ID NO: 866887 - RNA, 23 nt, Human
cagaaauaaacugguuuguagau

SEQ ID NO: 866888 - RNA, 22 nt, Human
aucugacuucacgcccaugcca

SEQ ID NO: 866889 - RNA, 22 nt, Human
caugucuguguacacaugcaca

SEQ ID NO: 866890 - RNA, 22 nt, Human
uuaauuuuaaccuguuuguguc

SEQ ID NO: 866891 - RNA, 22 nt, Human
agaauuucuggaagauugcaag

SEQ ID NO: 866892 - RNA, 22 nt, Human
uuugaaagggaaauaaacuccu

SEQ ID NO: 866893 - RNA, 22 nt, Human
ggcuuggaaauugcaggacaca

SEQ ID NO: 866894 - RNA, 22 nt, Human
gggcagcucuuugguauccuuc

SEQ ID NO: 866895 - RNA, 22 nt, Human
uaauuuuuccacguacacuggg

SEQ ID NO: 866896 - RNA, 22 nt, Human
uucaggauucucucccauuuac

SEQ ID NO: 866897 - RNA, 22 nt, Human
cucaggauucucgacacucaca

SEQ ID NO: 866898 - RNA, 22 nt, Human
ccaggagaugggagcaucuaaa

SEQ ID NO: 866899 - RNA, 22 nt, Human
uucaaguuuugccuccccaucc

SEQ ID NO: 866900 - RNA, 22 nt, Human
gaucuucuagcagaaguaauuu

SEQ ID NO: 866901 - RNA, 22 nt, Human
gcaucuaaacuugcaucauugu

SEQ ID NO: 866902 - RNA, 22 nt, Human
cauuuguuaauuacuauuaucu

SEQ ID NO: 866903 - RNA, 22 nt, Human
guggcaggagagacacagccau

SEQ ID NO: 866904 - RNA, 21 nt, Human
acagcauguuuguguguuugc

SEQ ID NO: 866905 - RNA, 22 nt, Human
agucuccuuggccucaaugccu

SEQ ID NO: 866906 - RNA, 22 nt, Human
cagagggcacaugguuuccuca

SEQ ID NO: 866907 - RNA, 22 nt, Human
guccaugacugugacucacaug

SEQ ID NO: 866908 - RNA, 22 nt, Human
ccaggacaaguguggccauggc

SEQ ID NO: 866909 - RNA, 23 nt, Human
gugagucuugccuuugcugugga

SEQ ID NO: 866910 - RNA, 22 nt, Human
ggagcacuauaauagagauuuu

SEQ ID NO: 866911 - RNA, 17 nt, Human
ugaaggccaugaccacg

SEQ ID NO: 866912 - RNA, 22 nt, Human
cauuuguauagugcuuagacca

SEQ ID NO: 866913 - RNA, 22 nt, Human
uccaggaggccucauuuccugu

SEQ ID NO: 866914 - RNA, 22 nt, Human
aggcaccuugagagcaggagcu

SEQ ID NO: 866915 - RNA, 22 nt, Human
ggcauuuaauccaucugauuga

SEQ ID NO: 866916 - RNA, 22 nt, Human
ggaggggucucuagcgaggaga

SEQ ID NO: 866917 - RNA, 22 nt, Human
uuugaauaaucacugggcauua

SEQ ID NO: 866918 - RNA, 22 nt, Human
ucccaggaaugucugaaaguga

SEQ ID NO: 866919 - RNA, 22 nt, Human
ugaugaauaaacuugagaguca

SEQ ID NO: 866920 - RNA, 22 nt, Human
aguuugaaauguuggcaauauu

SEQ ID NO: 866921 - RNA, 22 nt, Human
uggcagcuguuaauguuuuguu

SEQ ID NO: 866922 - RNA, 22 nt, Human
agaaaagaggcuuucuaagcau

SEQ ID NO: 866923 - RNA, 22 nt, Human
cagagggaaaaggggaguaaua

SEQ ID NO: 866924 - RNA, 22 nt, Human
acagcagcuugcgugucugguc

SEQ ID NO: 866925 - RNA, 22 nt, Human
uucaacccaaguucuccauuuu

SEQ ID NO: 866926 - RNA, 22 nt, Human
cccaggaacuccagagcuccuc

SEQ ID NO: 866927 - RNA, 22 nt, Human
uuugguccugagcaaaacuaug

SEQ ID NO: 866928 - RNA, 22 nt, Human
uuugaaaggaaguuaauacuuu

SEQ ID NO: 866929 - RNA, 22 nt, Human
ccaggagcagauauggacauaa

SEQ ID NO: 866930 - RNA, 22 nt, Human
cucuacucuuaacacagcuagg

SEQ ID NO: 866931 - RNA, 22 nt, Human
uuauuuauggcccucaccugau

SEQ ID NO: 866932 - RNA, 22 nt, Human
uuaauuaugcaaaaggccccau

SEQ ID NO: 866933 - RNA, 22 nt, Human
cagaucuguaguaaaagaucuc

SEQ ID NO: 866934 - RNA, 22 nt, Human
cagaccagcucuaugaacccaa

SEQ ID NO: 866935 - RNA, 22 nt, Human
uuucacaacugcuuauuugaga

SEQ ID NO: 866936 - RNA, 22 nt, Human
cucagugugaaugcucaguaaa

SEQ ID NO: 866937 - RNA, 22 nt, Human
ucaggagaaggcaauguggaaa

SEQ ID NO: 866938 - RNA, 22 nt, Human
gcuuuaaugcuucguggggcca

SEQ ID NO: 866939 - RNA, 20 nt, Human
cauuuguuagcuuucuacug

SEQ ID NO: 866940 - RNA, 22 nt, Human
aggcucagaggugagcaucugc

SEQ ID NO: 866941 - RNA, 22 nt, Human
aauaaaauggucaguuuucuca

SEQ ID NO: 866942 - RNA, 22 nt, Human
ugcugagaucugccaguagaug

SEQ ID NO: 866943 - RNA, 22 nt, Human
aggcagauauuggggugaugug

SEQ ID NO: 866944 - RNA, 22 nt, Human
uauucaaaguaccuucauugcc

SEQ ID NO: 866945 - RNA, 22 nt, Human
uaugaaaauuuagcugaagcau

SEQ ID NO: 866946 - RNA, 22 nt, Human
guguguuuagcauuagcagggg

SEQ ID NO: 866947 - RNA, 22 nt, Human
cuguauuucccacauucucuau

SEQ ID NO: 866948 - RNA, 22 nt, Human
ucugcuguauuagguugaacug

SEQ ID NO: 866949 - RNA, 19 nt, Human
uggagaggaaaugcugcuc

SEQ ID NO: 866950 - RNA, 22 nt, Human
auccaugauuaguaggauaaag

SEQ ID NO: 866951 - RNA, 21 nt, Human
gauugaaaccauggcagugag

SEQ ID NO: 866952 - RNA, 22 nt, Human
cccaggagaucuggaucucguc

SEQ ID NO: 866953 - RNA, 22 nt, Human
ucuuuaauuguggaagagcagc

SEQ ID NO: 866954 - RNA, 22 nt, Human
uuagccauuaaauuacaaggug

SEQ ID NO: 866955 - RNA, 22 nt, Human
gaggagagaugguagauugggu

SEQ ID NO: 866956 - RNA, 22 nt, Human
ugaaugaaugaauuaauagagu

SEQ ID NO: 866957 - RNA, 22 nt, Human
cacauuuaauccuuuauaagua

SEQ ID NO: 866958 - RNA, 22 nt, Human
guaaugaaugaaagaaacuggg

SEQ ID NO: 866959 - RNA, 22 nt, Human
agucaauuaucucuaggucauc

SEQ ID NO: 866960 - RNA, 22 nt, Human
aguacaauuauauuuagauggu

SEQ ID NO: 866961 - RNA, 22 nt, Human
ucaaucacguguuccauguucu

SEQ ID NO: 866962 - RNA, 23 nt, Human
ucucuuucaagagcuuaaugugc

SEQ ID NO: 866963 - RNA, 22 nt, Human
caugguuuauuagagcuuauuu

SEQ ID NO: 866964 - RNA, 22 nt, Human
uccagaauauuugggaaagaug

SEQ ID NO: 866965 - RNA, 22 nt, Human
auugaaagcauggauuuggauu

SEQ ID NO: 866966 - RNA, 22 nt, Human
uuuaggcauugaauuagaauag

SEQ ID NO: 866967 - RNA, 22 nt, Human
ccccaggagaaaucuuaaacua

SEQ ID NO: 866968 - RNA, 22 nt, Human
guuuuauaauugcuucauaaga

SEQ ID NO: 866969 - RNA, 21 nt, Human
auggagggaccagggaagcag

SEQ ID NO: 866970 - RNA, 22 nt, Human
cuuccuucugaagcauagaagc

SEQ ID NO: 866971 - RNA, 22 nt, Human
gcuacugauugaccuuggagag

SEQ ID NO: 866972 - RNA, 22 nt, Human
ucuacugcacuggugucucauc

SEQ ID NO: 866973 - RNA, 22 nt, Human
gaugaaaaauugcugugucaua

SEQ ID NO: 866974 - RNA, 22 nt, Human
auggcuuuucacagaggguucu

SEQ ID NO: 866975 - RNA, 22 nt, Human
ucccaggauuuuaggcucucag

SEQ ID NO: 866976 - RNA, 22 nt, Human
ugcuuggcuuucugagcuucug

SEQ ID NO: 866977 - RNA, 22 nt, Human
uugaaagaagaagcugcgaugu

SEQ ID NO: 866978 - RNA, 22 nt, Human
auuucauugaaguuaauucuuc

SEQ ID NO: 866979 - RNA, 22 nt, Human
ucaguguauggagugcuggauu

SEQ ID NO: 866980 - RNA, 22 nt, Human
uacaagaaauuucugcauauau

SEQ ID NO: 866981 - RNA, 22 nt, Human
cagaagaggacuggguagcuca

SEQ ID NO: 866982 - RNA, 22 nt, Human
aauguaaacagcaagagaaggg

SEQ ID NO: 866983 - RNA, 22 nt, Human
uuugcaaagaaauuauugcugu

SEQ ID NO: 866984 - RNA, 22 nt, Human
uuuauauuucccaggauuggcc

SEQ ID NO: 866985 - RNA, 22 nt, Human
uaugaaacauucauacaaauaa

SEQ ID NO: 866986 - RNA, 22 nt, Human
uagggaugagccaguggguagu

SEQ ID NO: 866987 - RNA, 22 nt, Human
aucacauugccagugauuaccc

SEQ ID NO: 866988 - RNA, 22 nt, Human
ggcagcuggguuggccagaaac

SEQ ID NO: 866989 - RNA, 22 nt, Human
uuugaagugggcauuagaaccu

SEQ ID NO: 866990 - RNA, 22 nt, Human
ggcuuaaugguucuuuuucuca

SEQ ID NO: 866991 - RNA, 22 nt, Human
ccuuaaauucuccauuugaaag

SEQ ID NO: 866992 - RNA, 22 nt, Human
uuggaucaaauuucaugcuguc

SEQ ID NO: 866993 - RNA, 22 nt, Human
uuuccauauuuaaucaaaauaa

SEQ ID NO: 866994 - RNA, 22 nt, Human
ccagugcuaagguagccucugc

SEQ ID NO: 866995 - RNA, 19 nt, Human
agcauuuggaauucuacac

SEQ ID NO: 866996 - RNA, 22 nt, Human
auacuaaaguauagaacuuagu

SEQ ID NO: 866997 - RNA, 20 nt, Human
uauuuguauuugggaaaguu

SEQ ID NO: 866998 - RNA, 22 nt, Human
uuagaaaucaccucugaagauc

SEQ ID NO: 866999 - RNA, 22 nt, Human
uagaugcuguagaaauacuuau

SEQ ID NO: 867000 - RNA, 23 nt, Human
gagauuuagcagacaaagcucuu

SEQ ID NO: 867001 - RNA, 22 nt, Human
uacaugaaccuuuaugugugau

SEQ ID NO: 867002 - RNA, 22 nt, Human
uugcuuugccaccagaagucua

SEQ ID NO: 867003 - RNA, 22 nt, Human
agaccauggccauccuaggaaa

SEQ ID NO: 867004 - RNA, 22 nt, Human
cagaagaguagcugaacaaguu

SEQ ID NO: 867005 - RNA, 21 nt, Human
gggcagcucuguuuuauuuuc

SEQ ID NO: 867006 - RNA, 22 nt, Human
guccaugauucuguguaguaga

SEQ ID NO: 867007 - RNA, 22 nt, Human
uuacaagcagcuacauaucaca

SEQ ID NO: 867008 - RNA, 22 nt, Human
accauccugaaaccuucaugcu

SEQ ID NO: 867009 - RNA, 22 nt, Human
ccaugagcuucaacugacacag

SEQ ID NO: 867010 - RNA, 22 nt, Human
cccagcaggaggagguugcagu

SEQ ID NO: 867011 - RNA, 22 nt, Human
aggcuucugcugauauuucauu

SEQ ID NO: 867012 - RNA, 22 nt, Human
gauaauaagcacagcaggaugu

SEQ ID NO: 867013 - RNA, 22 nt, Human
ucauuucaaugauacuacuaag

SEQ ID NO: 867014 - RNA, 22 nt, Human
uggcagcugcguuguguuucug

SEQ ID NO: 867015 - RNA, 22 nt, Human
gacccaggguggucaccugaaa

SEQ ID NO: 867016 - RNA, 22 nt, Human
guuguuuuuguucucuauagcu

SEQ ID NO: 867017 - RNA, 20 nt, Human
gcucccagccugcagucccc

SEQ ID NO: 867018 - RNA, 22 nt, Human
uaagauaaguggguugagaugg

SEQ ID NO: 867019 - RNA, 20 nt, Human
uccaggagguuaguguggcu

SEQ ID NO: 867020 - RNA, 22 nt, Human
gucuauauauugcuugaauaau

SEQ ID NO: 867021 - RNA, 22 nt, Human
cugcugugugcuuacuuggguu

SEQ ID NO: 867022 - RNA, 22 nt, Human
cuggcugugcugcaggcuuugg

SEQ ID NO: 867023 - RNA, 22 nt, Human
uagggcagagcuuguacacgau

SEQ ID NO: 867024 - RNA, 22 nt, Human
acaauucugaugguuucccagu

SEQ ID NO: 867025 - RNA, 22 nt, Human
uacaaaguaauguauaauaucg

SEQ ID NO: 867026 - RNA, 22 nt, Human
auucugauaucuuauucuagcu

SEQ ID NO: 867027 - RNA, 22 nt, Human
cuagaaauguagauucuuagug

SEQ ID NO: 867028 - RNA, 22 nt, Human
cuggcaguguccagcucgugau

SEQ ID NO: 867029 - RNA, 22 nt, Human
uuuuaugugcuggacuggcagu

SEQ ID NO: 867030 - RNA, 22 nt, Human
auugaaaggcaaaguaggaagc

SEQ ID NO: 867031 - RNA, 22 nt, Human
uacuauaccauguaagauauga

SEQ ID NO: 867032 - RNA, 22 nt, Human
cccaggagguggagguugcagu

SEQ ID NO: 867033 - RNA, 22 nt, Human
cuugcugucccuugguaugaac

SEQ ID NO: 867034 - RNA, 22 nt, Human
cauacuuucuuuuucacgcaua

SEQ ID NO: 867035 - RNA, 22 nt, Human
aguccuuugggaaaaaugacua

SEQ ID NO: 867036 - RNA, 22 nt, Human
uuguccaaaguaacacaucuag

SEQ ID NO: 867037 - RNA, 22 nt, Human
acuggaucagaaucugauuuuu

SEQ ID NO: 867038 - RNA, 22 nt, Human
uaauuucacaguucaacgcaca

SEQ ID NO: 867039 - RNA, 18 nt, Human
aagaggaggaaacccagg

SEQ ID NO: 867040 - RNA, 22 nt, Human
gcugccagccaacuugcugugc

SEQ ID NO: 867041 - RNA, 23 nt, Human
auugaugacuugauuacacuuuu

SEQ ID NO: 867042 - RNA, 22 nt, Human
uuugaaagaaaccagugaguga

SEQ ID NO: 867043 - RNA, 22 nt, Human
caaaugauaccuauuacuaggc

SEQ ID NO: 867044 - RNA, 22 nt, Human
caaguccucaaagggcucugcu

SEQ ID NO: 867045 - RNA, 22 nt, Human
uauuucagucacuucuucucug

SEQ ID NO: 867046 - RNA, 22 nt, Human
ucuaaacaguuucacucuuaau

SEQ ID NO: 867047 - RNA, 22 nt, Human
gaggguggguuucuugcacguc

SEQ ID NO: 867048 - RNA, 22 nt, Human
gaaggccacaagagaaguuaag

SEQ ID NO: 867049 - RNA, 22 nt, Human
cuggguaaguuccuaaggcuca

SEQ ID NO: 867050 - RNA, 22 nt, Human
aaaggccaugguuggaguguuu

SEQ ID NO: 867051 - RNA, 22 nt, Human
gaggagaggggcucccaagagc

SEQ ID NO: 867052 - RNA, 22 nt, Human
acaguuaucuuugaaauagaga

SEQ ID NO: 867053 - RNA, 22 nt, Human
augcugugcuggcuaaccaugg

SEQ ID NO: 867054 - RNA, 22 nt, Human
gcucacugccauucucuagaug

SEQ ID NO: 867055 - RNA, 22 nt, Human
uuuauccagaaucaggauuuuu

SEQ ID NO: 867056 - RNA, 22 nt, Human
aggauuuaucaggaacucucuu

SEQ ID NO: 867057 - RNA, 22 nt, Human
ugaggcagauauuuauuggguu

SEQ ID NO: 867058 - RNA, 22 nt, Human
aggcaggcuggucugaagagug

SEQ ID NO: 867059 - RNA, 22 nt, Human
cucucuguuaugcuuucaugaa

SEQ ID NO: 867060 - RNA, 22 nt, Human
ucucaggagccacagcgggagu

SEQ ID NO: 867061 - RNA, 22 nt, Human
uugcauuugacaaauuauuuaa

SEQ ID NO: 867062 - RNA, 22 nt, Human
aaagauaauguuuccuuauucu

SEQ ID NO: 867063 - RNA, 22 nt, Human
uucaggaucauuuguuuuaucu

SEQ ID NO: 867064 - RNA, 22 nt, Human
uccuucuuucccccuagucauu

SEQ ID NO: 867065 - RNA, 22 nt, Human
cggcagcucgagggccacccgu

SEQ ID NO: 867066 - RNA, 22 nt, Human
cauucauuuaugaaauaucuau

SEQ ID NO: 867067 - RNA, 22 nt, Human
aggcagugcugugcccugaacc

SEQ ID NO: 867068 - RNA, 22 nt, Human
caaauucaaugaacauguuuaa

SEQ ID NO: 867069 - RNA, 22 nt, Human
agauggagaccuuggaugaacu

SEQ ID NO: 867070 - RNA, 22 nt, Human
acuuugaaggggaacauuuuaa

SEQ ID NO: 867071 - RNA, 22 nt, Human
cccaggagagaggccaguuggc

SEQ ID NO: 867072 - RNA, 22 nt, Human
ugccuguguugauuacuuuguc

SEQ ID NO: 867073 - RNA, 22 nt, Human
aaaguccuugcaguuuccucuu

SEQ ID NO: 867074 - RNA, 20 nt, Human
augugagggguugaaguggg

SEQ ID NO: 867075 - RNA, 17 nt, Human
uggcagcugaaagcucu

SEQ ID NO: 867076 - RNA, 22 nt, Human
gaggccaggacaugaaagcuga

SEQ ID NO: 867077 - RNA, 22 nt, Human
ucucccaggcugcccuguggac

SEQ ID NO: 867078 - RNA, 22 nt, Human
cccaggagguguagcugcgugg

SEQ ID NO: 867079 - RNA, 22 nt, Human
cagaagucacccucagaauaac

SEQ ID NO: 867080 - RNA, 22 nt, Human
cccaggaggacauuccauaccc

SEQ ID NO: 867081 - RNA, 22 nt, Human
ugugaauaaugccgcaauaaac

SEQ ID NO: 867082 - RNA, 22 nt, Human
uaucuaaaggauuuaauuuagu

SEQ ID NO: 867083 - RNA, 22 nt, Human
caacugcugacaccaucacucc

SEQ ID NO: 867084 - RNA, 22 nt, Human
ggcagcuaggggcagggaauuc

SEQ ID NO: 867085 - RNA, 23 nt, Human
ucccaggaaucugcauuuuuaac

SEQ ID NO: 867086 - RNA, 18 nt, Human
auauguuaauuagguagg

SEQ ID NO: 867087 - RNA, 22 nt, Human
gaggagcuggcugucgggaggc

SEQ ID NO: 867088 - RNA, 22 nt, Human
auuccaaaggcuggccuggagg

SEQ ID NO: 867089 - RNA, 22 nt, Human
aggcagauuuaggagaaaagaa

SEQ ID NO: 867090 - RNA, 22 nt, Human
caggggaguuuuaugcaacaga

SEQ ID NO: 867091 - RNA, 22 nt, Human
uagggauguggugagaacugag

SEQ ID NO: 867092 - RNA, 22 nt, Human
ucaggagagaaagaauacaauu

SEQ ID NO: 867093 - RNA, 22 nt, Human
cucagaagccuucagucuuggc

SEQ ID NO: 867094 - RNA, 22 nt, Human
agucucuuuaaucacagugucu

SEQ ID NO: 867095 - RNA, 22 nt, Human
ucauagaaugaguuaaugaacu

SEQ ID NO: 867096 - RNA, 22 nt, Human
auugugcaaauauuaucuguag

SEQ ID NO: 867097 - RNA, 22 nt, Human
uagauuuaagacccugaauuug

SEQ ID NO: 867098 - RNA, 22 nt, Human
gugauuuagauguugaaaguga

SEQ ID NO: 867099 - RNA, 22 nt, Human
aggcaggcucaggcccaugcuu

SEQ ID NO: 867100 - RNA, 20 nt, Human
aaguuacauuguauuguacc

SEQ ID NO: 867101 - RNA, 22 nt, Human
caguuucuauggcugggcucug

SEQ ID NO: 867102 - RNA, 22 nt, Human
gaauuuuucuggaagcaauuau

SEQ ID NO: 867103 - RNA, 22 nt, Human
auuaguaaaacauuguauaugu

SEQ ID NO: 867104 - RNA, 22 nt, Human
ucugggaaugaauaagaccugu

SEQ ID NO: 867105 - RNA, 22 nt, Human
uuccaaaccucaaauaauuaau

SEQ ID NO: 867106 - RNA, 21 nt, Human
cccagggaagccgcagucacc

SEQ ID NO: 867107 - RNA, 22 nt, Human
aagggcaggaaaagauggaugu

SEQ ID NO: 867108 - RNA, 18 nt, Human
ccucagggagagagacgc

SEQ ID NO: 867109 - RNA, 21 nt, Human
ucauucacaggguauuguaua

SEQ ID NO: 867110 - RNA, 22 nt, Human
agaauaucguagcauauuaucu

SEQ ID NO: 867111 - RNA, 22 nt, Human
ugccauuuugagauguuaauga

SEQ ID NO: 867112 - RNA, 22 nt, Human
gacccaggcccaaggcugccag

SEQ ID NO: 867113 - RNA, 22 nt, Human
ucccaggacaggccacauggaa

SEQ ID NO: 867114 - RNA, 22 nt, Human
aaauuccagaaacucaguauau

SEQ ID NO: 867115 - RNA, 22 nt, Human
aagaaaucagaaaagcauucgu

SEQ ID NO: 867116 - RNA, 22 nt, Human
augcugugagugugccgcagag

SEQ ID NO: 867117 - RNA, 22 nt, Human
auugcuguggaaauauaagaug

SEQ ID NO: 867118 - RNA, 22 nt, Human
uggcagcagccauggaaggccc

SEQ ID NO: 867119 - RNA, 22 nt, Human
uuugaaagacagaauauuuuug

SEQ ID NO: 867120 - RNA, 22 nt, Human
cagcagagaaauuaaacuucug

SEQ ID NO: 867121 - RNA, 22 nt, Human
aauguuaauuuacugucuucau

SEQ ID NO: 867122 - RNA, 21 nt, Human
uaucagaagagaaagaaugau

SEQ ID NO: 867123 - RNA, 23 nt, Human
gaggcagcuccugcagugcccug

SEQ ID NO: 867124 - RNA, 22 nt, Human
ggccagcugggccaccaggugc

SEQ ID NO: 867125 - RNA, 22 nt, Human
uucaaacaguguagaauauaug

SEQ ID NO: 867126 - RNA, 22 nt, Human
cagucucucugaaguauuaaga

SEQ ID NO: 867127 - RNA, 22 nt, Human
cccuggaggucagaggccuggg

SEQ ID NO: 867128 - RNA, 22 nt, Human
aaguccaugaucaagauguggc

SEQ ID NO: 867129 - RNA, 22 nt, Human
uuucuucaauugcuaacaagga

SEQ ID NO: 867130 - RNA, 22 nt, Human
uggaaggagacugggaagugug

SEQ ID NO: 867131 - RNA, 22 nt, Human
acacaauacagggcucaaaaua

SEQ ID NO: 867132 - RNA, 22 nt, Human
agagacaaugccaaugcacacg

SEQ ID NO: 867133 - RNA, 23 nt, Human
uagggcagcugggagggacaugc

SEQ ID NO: 867134 - RNA, 22 nt, Human
aguacaaugucugacacaguag

SEQ ID NO: 867135 - RNA, 17 nt, Human
uuucaucugggaccacc

SEQ ID NO: 867136 - RNA, 22 nt, Human
caaauuccucagaaucagaaaa

SEQ ID NO: 867137 - RNA, 22 nt, Human
auauaugcauguguacuuaugu

SEQ ID NO: 867138 - RNA, 22 nt, Human
ucuucaauuagauuuaccaauu

SEQ ID NO: 867139 - RNA, 22 nt, Human
cucaggauauugggcuggagca

SEQ ID NO: 867140 - RNA, 22 nt, Human
uccaggagcauccaggugaagc

SEQ ID NO: 867141 - RNA, 22 nt, Human
uucauacucacuccaauaacug

SEQ ID NO: 867142 - RNA, 22 nt, Human
aaucauaauucaaauaagcuua

SEQ ID NO: 867143 - RNA, 22 nt, Human
ggcaggcugggugucauggagu

SEQ ID NO: 867144 - RNA, 22 nt, Human
aacauaauguggccaaagucac

SEQ ID NO: 867145 - RNA, 22 nt, Human
uccaggaguuugagacugcagu

SEQ ID NO: 867146 - RNA, 22 nt, Human
cggagaggugggggcagcaucu

SEQ ID NO: 867147 - RNA, 22 nt, Human
guccucuguuagaaaugugcuu

SEQ ID NO: 867148 - RNA, 17 nt, Human
gcccaggaaggacggcc

SEQ ID NO: 867149 - RNA, 22 nt, Human
uaaaguuuguagcaauugauau

SEQ ID NO: 867150 - RNA, 20 nt, Human
auuuggcaugaaguauugau

SEQ ID NO: 867151 - RNA, 22 nt, Human
uaugcccagcuuaaaguacaca

SEQ ID NO: 867152 - RNA, 22 nt, Human
guagaaauauuuaucucugaga

SEQ ID NO: 867153 - RNA, 22 nt, Human
ggcuuggaccagucacaguggu

SEQ ID NO: 867154 - RNA, 22 nt, Human
agaggaugauuuuaaggacacu

SEQ ID NO: 867155 - RNA, 22 nt, Human
caggcagcagaggaguguggga

SEQ ID NO: 867156 - RNA, 22 nt, Human
cugaauaauuuuauaguugcug

SEQ ID NO: 867157 - RNA, 22 nt, Human
caaggccaugagcagcgagugu

SEQ ID NO: 867158 - RNA, 22 nt, Human
aauauuuguuaguguuuuaaug

SEQ ID NO: 867159 - RNA, 22 nt, Human
cuuaacagagagaaguguugcu

SEQ ID NO: 867160 - RNA, 22 nt, Human
uccugaggcucacuuugaaugu

SEQ ID NO: 867161 - RNA, 22 nt, Human
agcccaggugagggguucgaaa

SEQ ID NO: 867162 - RNA, 22 nt, Human
cccaggaggccaagguugcagu

SEQ ID NO: 867163 - RNA, 22 nt, Human
cccaggaagaaauucugauuug

SEQ ID NO: 867164 - RNA, 22 nt, Human
gacccaggagugcagagagugg

SEQ ID NO: 867165 - RNA, 22 nt, Human
ggaagaggaggagccaggcuuu

SEQ ID NO: 867166 - RNA, 22 nt, Human
agggcaguucaacuucauagug

SEQ ID NO: 867167 - RNA, 17 nt, Human
agcugaccagauggacu

SEQ ID NO: 867168 - RNA, 22 nt, Human
agugcuuugaacgaaaggcuga

SEQ ID NO: 867169 - RNA, 22 nt, Human
cuguggaaauaaacaaugcuaa

SEQ ID NO: 867170 - RNA, 18 nt, Human
ucauuuguuuugcaugaa

SEQ ID NO: 867171 - RNA, 22 nt, Human
cgaggcaggcaggcggaggaua

SEQ ID NO: 867172 - RNA, 22 nt, Human
ggagcagggcagugaauucugg

SEQ ID NO: 867173 - RNA, 22 nt, Human
uaauaucuacuucauagaguuu

SEQ ID NO: 867174 - RNA, 22 nt, Human
uuacuuuggguccugcuuauaa

SEQ ID NO: 867175 - RNA, 22 nt, Human
ucugaaagaagggcagucuuuu

SEQ ID NO: 867176 - RNA, 22 nt, Human
uuuaauauuucuuuccugaagc

SEQ ID NO: 867177 - RNA, 22 nt, Human
agaggcggagcuugcagugagc

SEQ ID NO: 867178 - RNA, 22 nt, Human
gcaggggcuaaggacacagaga

SEQ ID NO: 867179 - RNA, 22 nt, Human
ggaugggagcagaggacgacca

SEQ ID NO: 867180 - RNA, 23 nt, Human
ucguugaauagcaauagcacaac

SEQ ID NO: 867181 - RNA, 22 nt, Human
uucucacuauguauguagauug

SEQ ID NO: 867182 - RNA, 23 nt, Human
uuccacaaugaaaauaaagcagg

SEQ ID NO: 867183 - RNA, 22 nt, Human
cagcagaggcacgucugugaau

SEQ ID NO: 867184 - RNA, 18 nt, Human
gcaggagauggguggggu

SEQ ID NO: 867185 - RNA, 18 nt, Human
uggcagcaggaagccauu

SEQ ID NO: 867186 - RNA, 22 nt, Human
uucacauaaugauacaaagcuu

SEQ ID NO: 867187 - RNA, 22 nt, Human
cagagccaggucuaggagucuc

SEQ ID NO: 867188 - RNA, 22 nt, Human
cuuuacauccuguuucccguuu

SEQ ID NO: 867189 - RNA, 22 nt, Human
aagauuauuuaagacaggaacc

SEQ ID NO: 867190 - RNA, 22 nt, Human
gcccaggaaauaaaagugggcu

SEQ ID NO: 867191 - RNA, 22 nt, Human
uggcagcucauuuggaaaugga

SEQ ID NO: 867192 - RNA, 22 nt, Human
gcaggagagucugugccagguu

SEQ ID NO: 867193 - RNA, 22 nt, Human
ccuucuucuguguggcccaaga

SEQ ID NO: 867194 - RNA, 22 nt, Human
ccaggacagugaacauguaaga

SEQ ID NO: 867195 - RNA, 22 nt, Human
auuugcaaagucguaucuguga

SEQ ID NO: 867196 - RNA, 22 nt, Human
cccaggaggaggaaaaagcucg

SEQ ID NO: 867197 - RNA, 22 nt, Human
caauuucaagauucuguucuuu

SEQ ID NO: 867198 - RNA, 22 nt, Human
gaaggccauuagagccugugcc

SEQ ID NO: 867199 - RNA, 22 nt, Human
uucacagacauugcagacugaa

SEQ ID NO: 867200 - RNA, 23 nt, Human
auuucuaggggauuuucuggugc

SEQ ID NO: 867201 - RNA, 22 nt, Human
gauguagagggaagauuuuaaa

SEQ ID NO: 867202 - RNA, 22 nt, Human
uggcuuuacacauccacugccu

SEQ ID NO: 867203 - RNA, 22 nt, Human
cagaauguagaucaucaucaag

SEQ ID NO: 867204 - RNA, 22 nt, Human
caggcagcaucagucugcugua

SEQ ID NO: 867205 - RNA, 22 nt, Human
acagaacugggggcacagauag

SEQ ID NO: 867206 - RNA, 22 nt, Human
ucucuguaguugggcagcugcu

SEQ ID NO: 867207 - RNA, 22 nt, Human
cuagaaaugcucaagagaaagu

SEQ ID NO: 867208 - RNA, 22 nt, Human
caucaucaaaacaaauggaguc

SEQ ID NO: 867209 - RNA, 18 nt, Human
cuggcuuucuuauccauc

SEQ ID NO: 867210 - RNA, 22 nt, Human
acauuguuugagaauacagaug

SEQ ID NO: 867211 - RNA, 19 nt, Human
ccaggagagcuuggagaag

SEQ ID NO: 867212 - RNA, 22 nt, Human
uuauacuuuauacuacaucauu

SEQ ID NO: 867213 - RNA, 22 nt, Human
acagugcuaaacacuucuugaa

SEQ ID NO: 867214 - RNA, 22 nt, Human
caggcagccuucucgucucaca

SEQ ID NO: 867215 - RNA, 22 nt, Human
ccaggagacaaagaugacugcu

SEQ ID NO: 867216 - RNA, 22 nt, Human
gaagcagcagcuggggacaguu

SEQ ID NO: 867217 - RNA, 22 nt, Human
uccaggagguaugaguggcccc

SEQ ID NO: 867218 - RNA, 22 nt, Human
gaggcugcuguuagcccugggc

SEQ ID NO: 867219 - RNA, 22 nt, Human
ggcagaggaggggugaauuugc

SEQ ID NO: 867220 - RNA, 22 nt, Human
gccagagguucaacaacugucu

SEQ ID NO: 867221 - RNA, 22 nt, Human
gaucagaauuuacuuauaauug

SEQ ID NO: 867222 - RNA, 22 nt, Human
uugguuuacuaggauucaaauu

SEQ ID NO: 867223 - RNA, 22 nt, Human
cuugaaagcacuccuuugacug

SEQ ID NO: 867224 - RNA, 17 nt, Human
uccaggagaggcaaugg

SEQ ID NO: 867225 - RNA, 22 nt, Human
uggcagcuggcucugcgcaggc

SEQ ID NO: 867226 - RNA, 22 nt, Human
uccauacauugaaauaccauuc

SEQ ID NO: 867227 - RNA, 22 nt, Human
ggcagcauauauucagugggca

SEQ ID NO: 867228 - RNA, 21 nt, Human
ucacagacuggucagugaggc

SEQ ID NO: 867229 - RNA, 23 nt, Human
agggugagcaagcuauggagacc

SEQ ID NO: 867230 - RNA, 22 nt, Human
aggcugcugccuuggagagugu

SEQ ID NO: 867231 - RNA, 21 nt, Human
caaagccaggcaacucucucc

SEQ ID NO: 867232 - RNA, 22 nt, Human
agggcagcacaaggcauggacu

SEQ ID NO: 867233 - RNA, 22 nt, Human
ugaacaguuucaagaaaacuuu

SEQ ID NO: 867234 - RNA, 22 nt, Human
ugugaauaccuugaauucauca

SEQ ID NO: 867235 - RNA, 22 nt, Human
aaguuucaaauauaaaauuaca

SEQ ID NO: 867236 - RNA, 22 nt, Human
augcugugguagacagcauucc

SEQ ID NO: 867237 - RNA, 22 nt, Human
cggcagcugauugcagagcacc

SEQ ID NO: 867238 - RNA, 22 nt, Human
auacauauaugguacuuccugg

SEQ ID NO: 867239 - RNA, 22 nt, Human
uggcauuuagaaaacaacaugu

SEQ ID NO: 867240 - RNA, 22 nt, Human
cauuucaaugccuucaacauag

SEQ ID NO: 867241 - RNA, 22 nt, Human
aaccauuugccauuaucuuaag

SEQ ID NO: 867242 - RNA, 22 nt, Human
gcuauacacauuucuugguagu

SEQ ID NO: 867243 - RNA, 22 nt, Human
uuagaaauacaagugagguuga

SEQ ID NO: 867244 - RNA, 17 nt, Human
aaucagauuucugagga

SEQ ID NO: 867245 - RNA, 22 nt, Human
ugucuucagcaaaugccuuucu

SEQ ID NO: 867246 - RNA, 22 nt, Human
auucaaguggcugcuauguuaa

SEQ ID NO: 867247 - RNA, 22 nt, Human
ccaggauggggagcagauagaa

SEQ ID NO: 867248 - RNA, 22 nt, Human
cauuuguaucauauguaucuua

SEQ ID NO: 867249 - RNA, 22 nt, Human
uuauuaaugaguacaaguuauu

SEQ ID NO: 867250 - RNA, 22 nt, Human
gccaggaggucagccccucaac

SEQ ID NO: 867251 - RNA, 22 nt, Human
uggcagcuccggguaggggcug

SEQ ID NO: 867252 - RNA, 22 nt, Human
uuacagaaguuucagcguuuua

SEQ ID NO: 867253 - RNA, 22 nt, Human
gagccaaggguugccauggaga

SEQ ID NO: 867254 - RNA, 22 nt, Human
auuucaggagcaguuucagugg

SEQ ID NO: 867255 - RNA, 20 nt, Human
ucaggaugugcugagugaag

SEQ ID NO: 867256 - RNA, 22 nt, Human
uggcuauugagugaucucuaga

SEQ ID NO: 867257 - RNA, 22 nt, Human
agauauaauaauuuacaagugu

SEQ ID NO: 867258 - RNA, 22 nt, Human
auuccaaagacagaagcagcug

SEQ ID NO: 867259 - RNA, 22 nt, Human
gauaaaauucuuauuuuacccg

SEQ ID NO: 867260 - RNA, 22 nt, Human
ugaaaugaagggcuuguucugg

SEQ ID NO: 867261 - RNA, 22 nt, Human
agcaccugucacaagcagaagg

SEQ ID NO: 867262 - RNA, 22 nt, Human
ccagguaggagagagggauccu

SEQ ID NO: 867263 - RNA, 22 nt, Human
gucaggauuauaauccccaugg

SEQ ID NO: 867264 - RNA, 22 nt, Human
acuaagugauucuaagcaucuu

SEQ ID NO: 867265 - RNA, 22 nt, Human
ugaucugagagcagaucaccau

SEQ ID NO: 867266 - RNA, 22 nt, Human
guuauacauauguguuaacaaa

SEQ ID NO: 867267 - RNA, 22 nt, Human
uuugaagucaaagauugauucc

SEQ ID NO: 867268 - RNA, 23 nt, Human
aggauuuaaaggcaaugcauuuu

SEQ ID NO: 867269 - RNA, 22 nt, Human
gcuuuaaugcaauuucaccuca

SEQ ID NO: 867270 - RNA, 22 nt, Human
agucucugcugguugugccuau

SEQ ID NO: 867271 - RNA, 22 nt, Human
ucuucauuccguagauauuuau

SEQ ID NO: 867272 - RNA, 22 nt, Human
ccagauaaggcuuuuuaaaagc

SEQ ID NO: 867273 - RNA, 19 nt, Human
ugcaagcuuuuucuuguua

SEQ ID NO: 867274 - RNA, 22 nt, Human
auccuuagaagggagugaggac

SEQ ID NO: 867275 - RNA, 22 nt, Human
ccccaggacguggcccucauag

SEQ ID NO: 867276 - RNA, 20 nt, Human
ucagaugggagugagccauc

SEQ ID NO: 867277 - RNA, 18 nt, Human
aggcaggcuggagugacu

SEQ ID NO: 867278 - RNA, 22 nt, Human
gcagaauucuacagaugauaaa

SEQ ID NO: 867279 - RNA, 22 nt, Human
ggcaggcugcuugggucauguc

SEQ ID NO: 867280 - RNA, 22 nt, Human
uuucuucauucaccuucacccc

SEQ ID NO: 867281 - RNA, 22 nt, Human
uugagaagaggcuuuguaggaa

SEQ ID NO: 867282 - RNA, 22 nt, Human
aagauggagcacgagcagaagc

SEQ ID NO: 867283 - RNA, 22 nt, Human
uggagucugugaugcucugggu

SEQ ID NO: 867284 - RNA, 22 nt, Human
uuuaggcaagaacucacugaga

SEQ ID NO: 867285 - RNA, 22 nt, Human
aggcacaguuucauccccgggc

SEQ ID NO: 867286 - RNA, 22 nt, Human
ucccaggacaugggcucugcuc

SEQ ID NO: 867287 - RNA, 22 nt, Human
caauuucagguggauagguuuu

SEQ ID NO: 867288 - RNA, 22 nt, Human
auuaaauuagcaaacugugaaa

SEQ ID NO: 867289 - RNA, 17 nt, Human
ucccaggaacagggaau

SEQ ID NO: 867290 - RNA, 22 nt, Human
auggcauuugaaucugucuuuu

SEQ ID NO: 867291 - RNA, 22 nt, Human
uuuugcuugagugcacaaaaug

SEQ ID NO: 867292 - RNA, 22 nt, Human
ugaacuccaaauacugcugauu

SEQ ID NO: 867293 - RNA, 22 nt, Human
ucacaaauagcuauauuaagga

SEQ ID NO: 867294 - RNA, 22 nt, Human
aggcagaccaugaaucaugacc

SEQ ID NO: 867295 - RNA, 22 nt, Human
gaguccuuuguuccuugccaca

SEQ ID NO: 867296 - RNA, 22 nt, Human
agagacagaggcaauauagcuu

SEQ ID NO: 867297 - RNA, 22 nt, Human
agaggcaguauacaauccgagc

SEQ ID NO: 867298 - RNA, 22 nt, Human
uuccuuagacagagguggucau

SEQ ID NO: 867299 - RNA, 22 nt, Human
uuauggcauauuccucauugua

SEQ ID NO: 867300 - RNA, 22 nt, Human
ucugggaacacacgucacuuca

SEQ ID NO: 867301 - RNA, 20 nt, Human
cugcugugauucccuccucc

SEQ ID NO: 867302 - RNA, 22 nt, Human
uugcuguguaacuccuggccug

SEQ ID NO: 867303 - RNA, 22 nt, Human
aauuucaaguggcaucuuugau

SEQ ID NO: 867304 - RNA, 22 nt, Human
gaaugaaagauuugcauucuau

SEQ ID NO: 867305 - RNA, 22 nt, Human
aggauuuaccgucauuuagucu

SEQ ID NO: 867306 - RNA, 22 nt, Human
augcagcugugggcaagaaaug

SEQ ID NO: 867307 - RNA, 22 nt, Human
uauuuguauguguguacauaua

SEQ ID NO: 867308 - RNA, 22 nt, Human
agggggugcccagaugaaggau

SEQ ID NO: 867309 - RNA, 22 nt, Human
caagaaucaacauuauuuagug

SEQ ID NO: 867310 - RNA, 22 nt, Human
gggcagcucucacagcagccaa

SEQ ID NO: 867311 - RNA, 22 nt, Human
auucuaacacaugcucuaagaa

SEQ ID NO: 867312 - RNA, 22 nt, Human
uuauacuaaaacgcauugaauu

SEQ ID NO: 867313 - RNA, 23 nt, Human
uuaagacuggcugaacuuaguag

SEQ ID NO: 867314 - RNA, 20 nt, Human
uugauaggcagcuugucagg

SEQ ID NO: 867315 - RNA, 23 nt, Human
cauaaaauauuaguaugguagca

SEQ ID NO: 867316 - RNA, 22 nt, Human
gaaacaacuacuauugauuucu

SEQ ID NO: 867317 - RNA, 22 nt, Human
caggagaggaggcuacuucuua

SEQ ID NO: 867318 - RNA, 22 nt, Human
uugcugaaaacaguggguauug

SEQ ID NO: 867319 - RNA, 22 nt, Human
uggcagcugaauggcuggaugg

SEQ ID NO: 867320 - RNA, 22 nt, Human
cuucuucaauagcaagcgcaua

SEQ ID NO: 867321 - RNA, 22 nt, Human
uccaggagugauaaggccacug

SEQ ID NO: 867322 - RNA, 20 nt, Human
agcuucuucugucuaauuuu

SEQ ID NO: 867323 - RNA, 22 nt, Human
aauucucagguaaaaguuaagu

SEQ ID NO: 867324 - RNA, 22 nt, Human
auaucaaacgaaguuauuuuaa

SEQ ID NO: 867325 - RNA, 22 nt, Human
gaauuacaugacccugaguaga

SEQ ID NO: 867326 - RNA, 22 nt, Human
cauuguuaccaucuuuuaccua

SEQ ID NO: 867327 - RNA, 22 nt, Human
uuaauucugccuuucauguaac

SEQ ID NO: 867328 - RNA, 22 nt, Human
uuagcaucugcuguaagcuuau

SEQ ID NO: 867329 - RNA, 19 nt, Human
guuaggcaggguggggagu

SEQ ID NO: 867330 - RNA, 22 nt, Human
uauggcuugucuuuauaccagg

SEQ ID NO: 867331 - RNA, 22 nt, Human
caguaaagcauguaugucuuca

SEQ ID NO: 867332 - RNA, 22 nt, Human
gcccaggaguuugcauuuuaac

SEQ ID NO: 867333 - RNA, 22 nt, Human
uuggaauucaaguuguagcuua

SEQ ID NO: 867334 - RNA, 22 nt, Human
uggagagguuuaaacaaaaguu

SEQ ID NO: 867335 - RNA, 22 nt, Human
auucauaacggcaaaugucacc

SEQ ID NO: 867336 - RNA, 22 nt, Human
cuguuaaucugcuugcaugaug

SEQ ID NO: 867337 - RNA, 22 nt, Human
uaaggccaccguuauagaacca

SEQ ID NO: 867338 - RNA, 22 nt, Human
aggaugaauaacugaaauggug

SEQ ID NO: 867339 - RNA, 22 nt, Human
augcuguggccagaguucaacu

SEQ ID NO: 867340 - RNA, 22 nt, Human
aguccuuagaacacuguaucug

SEQ ID NO: 867341 - RNA, 22 nt, Human
uaugucaaaguuaagaaauagg

SEQ ID NO: 867342 - RNA, 22 nt, Human
auucuucauacagacaaguccu

SEQ ID NO: 867343 - RNA, 22 nt, Human
caguccuugcucugggaugaug

SEQ ID NO: 867344 - RNA, 22 nt, Human
uuuuguuguaauauaccuaucc

SEQ ID NO: 867345 - RNA, 22 nt, Human
aaauuauaggugccaccuugga

SEQ ID NO: 867346 - RNA, 22 nt, Human
uuuucagaggccuaagagguuu

SEQ ID NO: 867347 - RNA, 22 nt, Human
gcucaggaaaacagucuaguaa

SEQ ID NO: 867348 - RNA, 22 nt, Human
ugcuuaauauugugauguaaua

SEQ ID NO: 867349 - RNA, 22 nt, Human
cccaggagacauauagaaggac

SEQ ID NO: 867350 - RNA, 22 nt, Human
auuggcaggaaccgaggagggg

SEQ ID NO: 867351 - RNA, 22 nt, Human
cagcacagggacaauagcagau

SEQ ID NO: 867352 - RNA, 22 nt, Human
ugcauggaggaagaugaaugca

SEQ ID NO: 867353 - RNA, 23 nt, Human
cccaggagccugaguccucucug

SEQ ID NO: 867354 - RNA, 22 nt, Human
uaggagaggugaauggcacacu

SEQ ID NO: 867355 - RNA, 22 nt, Human
uguuugaacugaauaacauagu

SEQ ID NO: 867356 - RNA, 20 nt, Human
aggauuuacuacuaccugcu

SEQ ID NO: 867357 - RNA, 22 nt, Human
uuucaguuuccagcuuugucau

SEQ ID NO: 867358 - RNA, 22 nt, Human
uucacauuggugauauguuucu

SEQ ID NO: 867359 - RNA, 22 nt, Human
gcagaggagaugaagauacuuu

SEQ ID NO: 867360 - RNA, 22 nt, Human
aggagcagcuucugaaccaugu

SEQ ID NO: 867361 - RNA, 22 nt, Human
aagucacccuagggccuggacu

SEQ ID NO: 867362 - RNA, 22 nt, Human
uuauccaaacuggugaaucauu

SEQ ID NO: 867363 - RNA, 22 nt, Human
aggcaagcauuuaaccacucau

SEQ ID NO: 867364 - RNA, 22 nt, Human
gaauuucauugcucugcugugu

SEQ ID NO: 867365 - RNA, 22 nt, Human
auacuguuuugugacuuaucuu

SEQ ID NO: 867366 - RNA, 18 nt, Human
caauuucaauggucugaa

SEQ ID NO: 867367 - RNA, 22 nt, Human
ugaggcaggaggauugcaggau

SEQ ID NO: 867368 - RNA, 22 nt, Human
aaggcagcuucaccacagcauu

SEQ ID NO: 867369 - RNA, 22 nt, Human
caucagaauguuagagaaggga

SEQ ID NO: 867370 - RNA, 22 nt, Human
uggguuuaaacucaacucuaaa

SEQ ID NO: 867371 - RNA, 22 nt, Human
uggaguucucaggugagggcuu

SEQ ID NO: 867372 - RNA, 22 nt, Human
agaggacaaaaugagaagugcu

SEQ ID NO: 867373 - RNA, 22 nt, Human
ggcagcuuccugagccagcagc

SEQ ID NO: 867374 - RNA, 22 nt, Human
uaucugagaaagaagcaccaga

SEQ ID NO: 867375 - RNA, 22 nt, Human
aucaggauuauuaaaucuggau

SEQ ID NO: 867376 - RNA, 22 nt, Human
gaauuucagggucugguaggaa

SEQ ID NO: 867377 - RNA, 22 nt, Human
aggauuuauuggugggaaguua

SEQ ID NO: 867378 - RNA, 22 nt, Human
uuuguuuacucauucauugaug

SEQ ID NO: 867379 - RNA, 22 nt, Human
uccaggaggcucugguugacgu

SEQ ID NO: 867380 - RNA, 22 nt, Human
aaucauaauuguauacauucau

SEQ ID NO: 867381 - RNA, 22 nt, Human
aagaaugauuacaaagcaacga

SEQ ID NO: 867382 - RNA, 22 nt, Human
cuuuggcaaugucauuuucaau

SEQ ID NO: 867383 - RNA, 22 nt, Human
auaaaugccucagaaucauccc

SEQ ID NO: 867384 - RNA, 22 nt, Human
auuucaacguuagauguaauag

SEQ ID NO: 867385 - RNA, 22 nt, Human
agccauucauugugcucucaga

SEQ ID NO: 867386 - RNA, 22 nt, Human
aauauuucugcagaaugguuuu

SEQ ID NO: 867387 - RNA, 22 nt, Human
guuaggcaguuuucuucauucu

SEQ ID NO: 867388 - RNA, 18 nt, Human
agggaguuuuagggaagg

SEQ ID NO: 867389 - RNA, 22 nt, Human
aagauauacuauuaaguaccau

SEQ ID NO: 867390 - RNA, 22 nt, Human
ggagguggcagggaacauaauu

SEQ ID NO: 867391 - RNA, 22 nt, Human
aguaaacauuucagauuuauuu

SEQ ID NO: 867392 - RNA, 22 nt, Human
aaaaacuguaauuacuuuugca

SEQ ID NO: 867393 - RNA, 22 nt, Human
uagauauaagguccuuagaaca

SEQ ID NO: 867394 - RNA, 22 nt, Human
augcuuaaccuugguguacaau

SEQ ID NO: 867395 - RNA, 22 nt, Human
agcugcccuguggggaggguug

SEQ ID NO: 867396 - RNA, 22 nt, Human
uuugagauggagucuugcucug

SEQ ID NO: 867397 - RNA, 22 nt, Human
agcuagccuaggcagagugcau

SEQ ID NO: 867398 - RNA, 22 nt, Human
auggcauuugaccgcuuugugg

SEQ ID NO: 867399 - RNA, 22 nt, Human
uuuucaguuccaucucugcucu

SEQ ID NO: 867400 - RNA, 22 nt, Human
uuucaucuaacacuacauaggg

SEQ ID NO: 867401 - RNA, 22 nt, Human
acuggcagcagcagcccuuggg

SEQ ID NO: 867402 - RNA, 22 nt, Human
aaauugcauuuuaaagguagau

SEQ ID NO: 867403 - RNA, 22 nt, Human
uccaggagagguagaggguucc

SEQ ID NO: 867404 - RNA, 22 nt, Human
aaagauuauggcauugaaauac

SEQ ID NO: 867405 - RNA, 22 nt, Human
ugugaauacagcaugugcuucu

SEQ ID NO: 867406 - RNA, 22 nt, Human
ugcuuuaagacacuaaguuuga

SEQ ID NO: 867407 - RNA, 22 nt, Human
agaggcagaaguguucaaaccc

SEQ ID NO: 867408 - RNA, 20 nt, Human
uuuacauuuugaaacaguga

SEQ ID NO: 867409 - RNA, 22 nt, Human
uuagaaauauggugcugccgcc

SEQ ID NO: 867410 - RNA, 21 nt, Human
aggucagcccagcucuggaag

SEQ ID NO: 867411 - RNA, 22 nt, Human
guugaaagaugucuugguuccc

SEQ ID NO: 867412 - RNA, 22 nt, Human
aaauguuucuacuugugagcau

SEQ ID NO: 867413 - RNA, 22 nt, Human
aaggcagcaacuaauggaucuc

SEQ ID NO: 867414 - RNA, 22 nt, Human
ucccaggauguuuauggcuggu

SEQ ID NO: 867415 - RNA, 22 nt, Human
gaucuucuauguaaugaagugu

SEQ ID NO: 867416 - RNA, 22 nt, Human
uaacagaaauuuuaguuagggg

SEQ ID NO: 867417 - RNA, 22 nt, Human
gauuucuugaccccugucucag

SEQ ID NO: 867418 - RNA, 22 nt, Human
cagucaccuagacagaacuuac

SEQ ID NO: 867419 - RNA, 22 nt, Human
aucugcagaggacaggcgagga

SEQ ID NO: 867420 - RNA, 20 nt, Human
caggaugauuggacacgaug

SEQ ID NO: 867421 - RNA, 22 nt, Human
aacauuucagcaaauaagaaca

SEQ ID NO: 867422 - RNA, 22 nt, Human
acagaugauuuuuaugaaaaca

SEQ ID NO: 867423 - RNA, 22 nt, Human
augacaaaagaagacaugaggu

SEQ ID NO: 867424 - RNA, 22 nt, Human
auauaauacaaccugcuaagug

SEQ ID NO: 867425 - RNA, 22 nt, Human
ucuccuccuuuuuucaacauag

SEQ ID NO: 867426 - RNA, 22 nt, Human
auuuccaguccuaaugaucugg

SEQ ID NO: 867427 - RNA, 22 nt, Human
cucccagagaccaagcugagaa

SEQ ID NO: 867428 - RNA, 22 nt, Human
auggcuuucagauggugaaaga

SEQ ID NO: 867429 - RNA, 15 nt, Human
uucaggauaugacuc

SEQ ID NO: 867430 - RNA, 22 nt, Human
aaucagucucauuuagcaggga

SEQ ID NO: 867431 - RNA, 22 nt, Human
uacagagauacucuagaucaaa

SEQ ID NO: 867432 - RNA, 22 nt, Human
ugaggcagaguaagauacauga

SEQ ID NO: 867433 - RNA, 18 nt, Human
ggucuuuaggucaguguc

SEQ ID NO: 867434 - RNA, 22 nt, Human
ugagccuguccugugcauguga

SEQ ID NO: 867435 - RNA, 22 nt, Human
uucaggaucacuaaacccucca

SEQ ID NO: 867436 - RNA, 22 nt, Human
uaauuucagugggcucugggcu

SEQ ID NO: 867437 - RNA, 22 nt, Human
uauuuccaccuauuauuuucug

SEQ ID NO: 867438 - RNA, 22 nt, Human
uucauucugggcucuaaggaac

SEQ ID NO: 867439 - RNA, 22 nt, Human
cuugcuggugguguuuucuaug

SEQ ID NO: 867440 - RNA, 22 nt, Human
ucucagucuuugcaaggaugcu

SEQ ID NO: 867441 - RNA, 22 nt, Human
uguaaauaaugcauguaaauca

SEQ ID NO: 867442 - RNA, 22 nt, Human
ggcagcuaguuuaagaaagagg

SEQ ID NO: 867443 - RNA, 22 nt, Human
gaaauagacacuuucuaugaau

SEQ ID NO: 867444 - RNA, 22 nt, Human
aaagcagaacugagagagcugg

SEQ ID NO: 867445 - RNA, 22 nt, Human
uuucuagucucgaucucuuaau

SEQ ID NO: 867446 - RNA, 22 nt, Human
gaggcagccucaguggaccucg

SEQ ID NO: 867447 - RNA, 21 nt, Human
uguaaguuucaucugaauugg

SEQ ID NO: 867448 - RNA, 22 nt, Human
cauaauaucuccgauuacuugc

SEQ ID NO: 867449 - RNA, 22 nt, Human
cuacccaggcuuagagggcugg

SEQ ID NO: 867450 - RNA, 22 nt, Human
aaagaaggaugggagaaauccu

SEQ ID NO: 867451 - RNA, 22 nt, Human
caaggccagggaauuuuucugg

SEQ ID NO: 867452 - RNA, 22 nt, Human
uuauagaaggagcauucacuua

SEQ ID NO: 867453 - RNA, 22 nt, Human
cagcuuccgaccgggggcugca

SEQ ID NO: 867454 - RNA, 20 nt, Human
agauuauuccuaagauuucu

SEQ ID NO: 867455 - RNA, 22 nt, Human
aguaccaugcuuccugacuggu

SEQ ID NO: 867456 - RNA, 22 nt, Human
ucuuagaaguuuauggcacgga

SEQ ID NO: 867457 - RNA, 17 nt, Human
guccuacccauggucua

SEQ ID NO: 867458 - RNA, 22 nt, Human
guucuucaaagugacaacuaaa

SEQ ID NO: 867459 - RNA, 22 nt, Human
cagauuucuauuucaaauacau

SEQ ID NO: 867460 - RNA, 22 nt, Human
uccaggaggaggaaggcugcca

SEQ ID NO: 867461 - RNA, 22 nt, Human
uuccuuagggaaagggauaagg

SEQ ID NO: 867462 - RNA, 22 nt, Human
uuucacauuagauaugucauuu

SEQ ID NO: 867463 - RNA, 22 nt, Human
uuuggaaugguaccuucaguug

SEQ ID NO: 867464 - RNA, 22 nt, Human
uuugcagucaaauuugcuaaau

SEQ ID NO: 867465 - RNA, 22 nt, Human
uucuacagacuauaacugugau

SEQ ID NO: 867466 - RNA, 22 nt, Human
ugcuuuaaauaugaauuagcau

SEQ ID NO: 867467 - RNA, 22 nt, Human
ggaggcugagaaguccaagauc

SEQ ID NO: 867468 - RNA, 22 nt, Human
acagucuugagcaucagccaga

SEQ ID NO: 867469 - RNA, 22 nt, Human
caggcagcucaaccuugggagc

SEQ ID NO: 867470 - RNA, 22 nt, Human
gcagggcagaccuccagccuau

SEQ ID NO: 867471 - RNA, 22 nt, Human
gccaggagggaaaggacaauuu

SEQ ID NO: 867472 - RNA, 23 nt, Human
uggagcugacagucagagggagg

SEQ ID NO: 867473 - RNA, 22 nt, Human
gucuucaauagagccucaauuu

SEQ ID NO: 867474 - RNA, 22 nt, Human
uuucuucacaggguauugggug

SEQ ID NO: 867475 - RNA, 22 nt, Human
augugcuucauucuacaugaca

SEQ ID NO: 867476 - RNA, 22 nt, Human
aggcagugcaugcaaaggucgg

SEQ ID NO: 867477 - RNA, 22 nt, Human
aagggaggggauguaagccugg

SEQ ID NO: 867478 - RNA, 22 nt, Human
uucauucuuugaaucugaggua

SEQ ID NO: 867479 - RNA, 22 nt, Human
uugcuuuguggugguucuucca

SEQ ID NO: 867480 - RNA, 22 nt, Human
acuguguggaccacucugaggc

SEQ ID NO: 867481 - RNA, 22 nt, Human
gaggcugaggguuagagaguca

SEQ ID NO: 867482 - RNA, 22 nt, Human
cuccaggaaaauagggaaugag

SEQ ID NO: 867483 - RNA, 19 nt, Human
gaggucagcaagaaguauu

SEQ ID NO: 867484 - RNA, 22 nt, Human
cuggcuuuaacccuacaaaccu

SEQ ID NO: 867485 - RNA, 22 nt, Human
ucugcagggaugugagggguga

SEQ ID NO: 867486 - RNA, 22 nt, Human
ucauggauggccgggaggugau

SEQ ID NO: 867487 - RNA, 22 nt, Human
caauauauaaugaguacuuucc

SEQ ID NO: 867488 - RNA, 22 nt, Human
uagcaucuggagaaacaagucc

SEQ ID NO: 867489 - RNA, 22 nt, Human
ccucuucugcuucaggagcacu

SEQ ID NO: 867490 - RNA, 22 nt, Human
uggcauuucuggccauuugugu

SEQ ID NO: 867491 - RNA, 22 nt, Human
uaaaauguuugcaagagaccag

SEQ ID NO: 867492 - RNA, 22 nt, Human
aaauuauuaugccccucuauaa

SEQ ID NO: 867493 - RNA, 22 nt, Human
uuaaauauuuucagcaggguca

SEQ ID NO: 867494 - RNA, 22 nt, Human
ucugcagguguuggaaggguca

SEQ ID NO: 867495 - RNA, 22 nt, Human
uuugaagauuaugccagaguga

SEQ ID NO: 867496 - RNA, 22 nt, Human
cccaggagguagagguugcagu

SEQ ID NO: 867497 - RNA, 22 nt, Human
acaugcuuuaacuuauuuugau

SEQ ID NO: 867498 - RNA, 22 nt, Human
uuucagacagauucuucucagu

SEQ ID NO: 867499 - RNA, 22 nt, Human
gugauuuugagaccuauauagu

SEQ ID NO: 867500 - RNA, 21 nt, Human
agagagggagaugaaacaucc

SEQ ID NO: 867501 - RNA, 17 nt, Human
cccaugagcccacuccc

SEQ ID NO: 867502 - RNA, 22 nt, Human
gcaggagaacaaagcaagcugc

SEQ ID NO: 867503 - RNA, 22 nt, Human
auauucuuccaaaacaucauuu

SEQ ID NO: 867504 - RNA, 22 nt, Human
aagauauucaaagauuuauuag

SEQ ID NO: 867505 - RNA, 22 nt, Human
ucaauaauggcaggauaaauuu

SEQ ID NO: 867506 - RNA, 22 nt, Human
ucauucuuuaccaaguugucac

SEQ ID NO: 867507 - RNA, 22 nt, Human
acccaggacaugggcacccgug

SEQ ID NO: 867508 - RNA, 22 nt, Human
gagaggagguggcuaugacagc

SEQ ID NO: 867509 - RNA, 22 nt, Human
uguccuuagggauauaaaauau

SEQ ID NO: 867510 - RNA, 22 nt, Human
ucagaaaauaacuguuaguuug

SEQ ID NO: 867511 - RNA, 22 nt, Human
cugcuuugcauagcugccagag

SEQ ID NO: 867512 - RNA, 22 nt, Human
agaggagguccuuuucugaugu

SEQ ID NO: 867513 - RNA, 22 nt, Human
gccuuaauuuaugucuaacaua

SEQ ID NO: 867514 - RNA, 21 nt, Human
gauuuuaaagagacugccaca

SEQ ID NO: 867515 - RNA, 22 nt, Human
uauuuccaaaagccuauuauga

SEQ ID NO: 867516 - RNA, 23 nt, Human
caguggagacucaugcuuccuua

SEQ ID NO: 867517 - RNA, 22 nt, Human
ucuuuuggguucuuaugauuua

SEQ ID NO: 867518 - RNA, 22 nt, Human
uuugcaguagacaucuuauuuu

SEQ ID NO: 867519 - RNA, 22 nt, Human
auugaaagauaggcuacugugg

SEQ ID NO: 867520 - RNA, 22 nt, Human
guuaggcaauaccucuuacacc

SEQ ID NO: 867521 - RNA, 22 nt, Human
uccaggagggguaggcaguaug

SEQ ID NO: 867522 - RNA, 22 nt, Human
uuuuuauaacucuuuugugaca

SEQ ID NO: 867523 - RNA, 22 nt, Human
gaaguccuccuaucuugcucuu

SEQ ID NO: 867524 - RNA, 22 nt, Human
gaggacagagccgccuggcaag

SEQ ID NO: 867525 - RNA, 22 nt, Human
uuugcaauuugugcugcaaaug

SEQ ID NO: 867526 - RNA, 22 nt, Human
uuggaucauggaaugucugcuu

SEQ ID NO: 867527 - RNA, 22 nt, Human
cagcugcuguuacugcuuauua

SEQ ID NO: 867528 - RNA, 22 nt, Human
gaguccuucuggcuggcaggau

SEQ ID NO: 867529 - RNA, 22 nt, Human
caccagacagguguaugcauau

SEQ ID NO: 867530 - RNA, 18 nt, Human
gaggcagcuagcaauuuu

SEQ ID NO: 867531 - RNA, 22 nt, Human
uaaagccacuucauucuagucu

SEQ ID NO: 867532 - RNA, 22 nt, Human
gaggagagaagcuaacggugcu

SEQ ID NO: 867533 - RNA, 22 nt, Human
uugcuuuguuacugcaguuucc

SEQ ID NO: 867534 - RNA, 19 nt, Human
ggucagcugggcuagaggc

SEQ ID NO: 867535 - RNA, 22 nt, Human
cucuaauccuuugucccugggu

SEQ ID NO: 867536 - RNA, 22 nt, Human
uuagccaugugggaaaaacagc

SEQ ID NO: 867537 - RNA, 22 nt, Human
uggaaugacagagagucugaau

SEQ ID NO: 867538 - RNA, 22 nt, Human
cuuuacagaauaagaauacugg

SEQ ID NO: 867539 - RNA, 20 nt, Human
aggagggaccuggauuggcg

SEQ ID NO: 867540 - RNA, 22 nt, Human
aggcaguguguagcuggaagag

SEQ ID NO: 867541 - RNA, 22 nt, Human
auucuucacaaauauauagaag

SEQ ID NO: 867542 - RNA, 22 nt, Human
cagauauuaggagcucaauaau

SEQ ID NO: 867543 - RNA, 22 nt, Human
uuuaggcagaacauggacuuug

SEQ ID NO: 867544 - RNA, 22 nt, Human
uucuucaaccaucuacauaaac

SEQ ID NO: 867545 - RNA, 21 nt, Human
ggcagccugacccccagagag

SEQ ID NO: 867546 - RNA, 22 nt, Human
gaggccaggggccuggagauga

SEQ ID NO: 867547 - RNA, 22 nt, Human
ugaggcagcaauugauuauuca

SEQ ID NO: 867548 - RNA, 22 nt, Human
agauggaguuaguaccagaguc

SEQ ID NO: 867549 - RNA, 22 nt, Human
cuacagaaguuucccuugcuua

SEQ ID NO: 867550 - RNA, 22 nt, Human
aguggcaguagaugagcugguu

SEQ ID NO: 867551 - RNA, 22 nt, Human
uccaggagugcugguuagagua

SEQ ID NO: 867552 - RNA, 22 nt, Human
auucuucacaccuguuccuguu

SEQ ID NO: 867553 - RNA, 22 nt, Human
ccugccugcaccuucucugggg

SEQ ID NO: 867554 - RNA, 22 nt, Human
acccaggaggugacacagggcu

SEQ ID NO: 867555 - RNA, 22 nt, Human
uggcaguccccugugccuggaa

SEQ ID NO: 867556 - RNA, 22 nt, Human
agugcugucaguuuuauagaua

SEQ ID NO: 867557 - RNA, 22 nt, Human
accauuuuggguauuuucagag

SEQ ID NO: 867558 - RNA, 22 nt, Human
uuaggaguccagaugucuuggg

SEQ ID NO: 867559 - RNA, 23 nt, Human
gccaggaguggguagacuaaugc

SEQ ID NO: 867560 - RNA, 22 nt, Human
aaaucucacuguagucaaagug

SEQ ID NO: 867561 - RNA, 19 nt, Human
agcaaauacaucaaaauug

SEQ ID NO: 867562 - RNA, 22 nt, Human
aacauuuaugauugagguaaau

SEQ ID NO: 867563 - RNA, 22 nt, Human
uaucuguuguaguacagaugau

SEQ ID NO: 867564 - RNA, 22 nt, Human
gcugcccacaaugauuacaugg

SEQ ID NO: 867565 - RNA, 22 nt, Human
ggaggaugagcuacgaggagcu

SEQ ID NO: 867566 - RNA, 22 nt, Human
ccuggaucuaaggaagcuggga

SEQ ID NO: 867567 - RNA, 22 nt, Human
gccuuaauuuuuuauaaucucu

SEQ ID NO: 867568 - RNA, 22 nt, Human
uugcugaaguuaaugcuugcaa

SEQ ID NO: 867569 - RNA, 22 nt, Human
cuuuacauaaggauaaaccugg

SEQ ID NO: 867570 - RNA, 22 nt, Human
acuuuaauuaaugaacuguggc

SEQ ID NO: 867571 - RNA, 22 nt, Human
aggccagaugucgggcuagaag

SEQ ID NO: 867572 - RNA, 19 nt, Human
aaaaacuuaguccagaaag

SEQ ID NO: 867573 - RNA, 22 nt, Human
cuuugaagagauuacugugcuc

SEQ ID NO: 867574 - RNA, 22 nt, Human
aucaggaucagggcuagcagag

SEQ ID NO: 867575 - RNA, 22 nt, Human
uuucaacuugaagaauugauac

SEQ ID NO: 867576 - RNA, 22 nt, Human
aaucagaacgcucgaucuucgg

SEQ ID NO: 867577 - RNA, 22 nt, Human
ggaggggaugguuugacccugg

SEQ ID NO: 867578 - RNA, 23 nt, Human
cccuggaguaaauucuuggaagg

SEQ ID NO: 867579 - RNA, 20 nt, Human
caguccaaucagaggccacc

SEQ ID NO: 867580 - RNA, 22 nt, Human
aaaguauucuugacuguuuuuc

SEQ ID NO: 867581 - RNA, 21 nt, Human
cagcagaguaaugcauucgua

SEQ ID NO: 867582 - RNA, 21 nt, Human
cugcuguggcccccgacaugc

SEQ ID NO: 867583 - RNA, 22 nt, Human
cacucuccagcacaccccauuu

SEQ ID NO: 867584 - RNA, 22 nt, Human
uauuacaauuuacauugcacuu

SEQ ID NO: 867585 - RNA, 22 nt, Human
uaaugcuuaacagcuggcuuuu

SEQ ID NO: 867586 - RNA, 22 nt, Human
uccagaaacuuuuccagucuca

SEQ ID NO: 867587 - RNA, 22 nt, Human
cagcgucucguugugggccucg

SEQ ID NO: 867588 - RNA, 17 nt, Human
agauggcaggaggcaga

SEQ ID NO: 867589 - RNA, 22 nt, Human
cuuugaauugccguuucaucug

SEQ ID NO: 867590 - RNA, 22 nt, Human
guuccaaaguuagaguguauug

SEQ ID NO: 867591 - RNA, 22 nt, Human
guaggcagugguuggaagagaa

SEQ ID NO: 867592 - RNA, 20 nt, Human
uuucugugcccaggucuguu

SEQ ID NO: 867593 - RNA, 22 nt, Human
agcaccaugaccuugccauuga

SEQ ID NO: 867594 - RNA, 22 nt, Human
agagggauggccccguaacuca

SEQ ID NO: 867595 - RNA, 22 nt, Human
agucauaugacccuucacaaac

SEQ ID NO: 867596 - RNA, 22 nt, Human
ccucagggaaugggaggcuggg

SEQ ID NO: 867597 - RNA, 22 nt, Human
aacauucugguucuaaaaaccu

SEQ ID NO: 867598 - RNA, 22 nt, Human
aaugguuugauggacaaaauga

SEQ ID NO: 867599 - RNA, 22 nt, Human
ucaugcuuaaaagacacuugag

SEQ ID NO: 867600 - RNA, 21 nt, Human
cauuucaaagagcuggaaauc

SEQ ID NO: 867601 - RNA, 21 nt, Human
ccauaccuaccucaccugguu

SEQ ID NO: 867602 - RNA, 22 nt, Human
caguaucugucaguaaucaggu

SEQ ID NO: 867603 - RNA, 22 nt, Human
aaacuuuguagagaaugcuggc

SEQ ID NO: 867604 - RNA, 22 nt, Human
uucaggaugacaccauguccag

SEQ ID NO: 867605 - RNA, 22 nt, Human
aauucacaaaaguuagauccau

SEQ ID NO: 867606 - RNA, 22 nt, Human
aauaucaguauauuguaucagu

SEQ ID NO: 867607 - RNA, 22 nt, Human
gauuuuauauggcauacugugg

SEQ ID NO: 867608 - RNA, 22 nt, Human
uuacagaaaguuucccaugccg

SEQ ID NO: 867609 - RNA, 21 nt, Human
aaaggccauaaucacggagca

SEQ ID NO: 867610 - RNA, 22 nt, Human
uuugaaguggaaaaggauuuaa

SEQ ID NO: 867611 - RNA, 22 nt, Human
aaaucauguuggcacaauaaaa

SEQ ID NO: 867612 - RNA, 22 nt, Human
acuaaacugaagcaugaaaagg

SEQ ID NO: 867613 - RNA, 22 nt, Human
ugcauguguuugccacagugag

SEQ ID NO: 867614 - RNA, 22 nt, Human
uguugaagauaaaguucucauu

SEQ ID NO: 867615 - RNA, 22 nt, Human
gggagagguuacccgagcaacu

SEQ ID NO: 867616 - RNA, 22 nt, Human
auguucuuguucaaaugucagu

SEQ ID NO: 867617 - RNA, 22 nt, Human
aggcaacuuuuggggaugaugg

SEQ ID NO: 867618 - RNA, 22 nt, Human
uucuuuugggaauuacguaugc

SEQ ID NO: 867619 - RNA, 22 nt, Human
aggcugcuucaauggauaagau

SEQ ID NO: 867620 - RNA, 22 nt, Human
caugugguucaaguacuccaca

SEQ ID NO: 867621 - RNA, 22 nt, Human
caaguccuuuucuuggcucagg

SEQ ID NO: 867622 - RNA, 22 nt, Human
augaacaauaaaauagaucaca

SEQ ID NO: 867623 - RNA, 22 nt, Human
uaagaaucaguagauauagauu

SEQ ID NO: 867624 - RNA, 22 nt, Human
ucuagacacuacuaguaaccgg

SEQ ID NO: 867625 - RNA, 22 nt, Human
gaaaauagcagauagaccaaug

SEQ ID NO: 867626 - RNA, 22 nt, Human
cuucagagugcagaagauuggg

SEQ ID NO: 867627 - RNA, 23 nt, Human
cuugcaggaagcagauggcacac

SEQ ID NO: 867628 - RNA, 22 nt, Human
aggcagcaugggccccagcucc

SEQ ID NO: 867629 - RNA, 22 nt, Human
gaggcagcggcucacagagaaa

SEQ ID NO: 867630 - RNA, 22 nt, Human
ugaggcaggaguuaaugugcuc

SEQ ID NO: 867631 - RNA, 22 nt, Human
acuuauuagcugugugaccuug

SEQ ID NO: 867632 - RNA, 22 nt, Human
gaauaaucaugaaauucaguga

SEQ ID NO: 867633 - RNA, 22 nt, Human
aucuagaacuuaaagucaguca

SEQ ID NO: 867634 - RNA, 22 nt, Human
gcaagcugcucuuauguggagg

SEQ ID NO: 867635 - RNA, 22 nt, Human
gagcagcucugggugacccagu

SEQ ID NO: 867636 - RNA, 22 nt, Human
cugacccauauaagaguggagg

SEQ ID NO: 867637 - RNA, 22 nt, Human
aaucagaaauucuacaucacaa

SEQ ID NO: 867638 - RNA, 22 nt, Human
caggguggcacucagcgcaucu

SEQ ID NO: 867639 - RNA, 22 nt, Human
cagaggcaggaagaugggcagu

SEQ ID NO: 867640 - RNA, 22 nt, Human
gcugggaagugcaagaucaagg

SEQ ID NO: 867641 - RNA, 22 nt, Human
acuucacacagcaaauuuaucu

SEQ ID NO: 867642 - RNA, 22 nt, Human
ucugcuguaaagaauuucugcc

SEQ ID NO: 867643 - RNA, 22 nt, Human
cuguaguugaugauuucugaua

SEQ ID NO: 867644 - RNA, 22 nt, Human
uuuguuuagaugguaaaucagu

SEQ ID NO: 867645 - RNA, 22 nt, Human
ggaucugagagcaagcaggacc

SEQ ID NO: 867646 - RNA, 22 nt, Human
aggcacaggaaugucauccagu

SEQ ID NO: 867647 - RNA, 22 nt, Human
gugacagucaaagacaugacuu

SEQ ID NO: 867648 - RNA, 22 nt, Human
gagagaggccuccauguacuga

SEQ ID NO: 867649 - RNA, 22 nt, Human
uuuaaaauuuagaccucuccac

SEQ ID NO: 867650 - RNA, 22 nt, Human
augguuuaagggagaauauuga

SEQ ID NO: 867651 - RNA, 22 nt, Human
auccaaacauguaccacacuaa

SEQ ID NO: 867652 - RNA, 22 nt, Human
uuuauuauguacaggcacuaua

SEQ ID NO: 867653 - RNA, 22 nt, Human
aaguccuucccaagcauguacc

SEQ ID NO: 867654 - RNA, 22 nt, Human
gccaggaguucagaugcauguu

SEQ ID NO: 867655 - RNA, 22 nt, Human
accgaaggaaacuggaaccguu

SEQ ID NO: 867656 - RNA, 20 nt, Human
uacaauacacaugcauauga

SEQ ID NO: 867657 - RNA, 22 nt, Human
ucuuugcacugugcaagcagaa

SEQ ID NO: 867658 - RNA, 22 nt, Human
agaauuccucuaggaucugccc

SEQ ID NO: 867659 - RNA, 22 nt, Human
guuaauauuuaccugucaagaa

SEQ ID NO: 867660 - RNA, 22 nt, Human
auacaacuuuaucuguaaugag

SEQ ID NO: 867661 - RNA, 22 nt, Human
aggcaggcacacuuccuccagg

SEQ ID NO: 867662 - RNA, 22 nt, Human
aagagggcugcaaucuuauugc

SEQ ID NO: 867663 - RNA, 22 nt, Human
gaggcagcuuaggguacugacu

SEQ ID NO: 867664 - RNA, 22 nt, Human
uaagagaacuggauagauagga

SEQ ID NO: 867665 - RNA, 22 nt, Human
ucuggaucucccucauccuggg

SEQ ID NO: 867666 - RNA, 22 nt, Human
auccuuaguuaagaacaggagu

SEQ ID NO: 867667 - RNA, 22 nt, Human
auauuguugacuauaagaguaa

SEQ ID NO: 867668 - RNA, 21 nt, Human
acucaggagacuaacuauguc

SEQ ID NO: 867669 - RNA, 22 nt, Human
uaagaaucuauuaggaauaugu

SEQ ID NO: 867670 - RNA, 22 nt, Human
agauuuacugagaacugauuac

SEQ ID NO: 867671 - RNA, 22 nt, Human
uuugacaucaauacccuagaau

SEQ ID NO: 867672 - RNA, 22 nt, Human
ugaguaauaaacugucuugcuc

SEQ ID NO: 867673 - RNA, 21 nt, Human
auaagcaugcugauuacauuu

SEQ ID NO: 867674 - RNA, 22 nt, Human
caagaugugccuaaucagaccu

SEQ ID NO: 867675 - RNA, 22 nt, Human
ucacaucucccuggaggacaca

SEQ ID NO: 867676 - RNA, 22 nt, Human
agacaguguguguauauauggu

SEQ ID NO: 867677 - RNA, 22 nt, Human
uuugaaaggagcuuuauccaga

SEQ ID NO: 867678 - RNA, 22 nt, Human
aggcagguuggugagaagacug

SEQ ID NO: 867679 - RNA, 18 nt, Human
ggcagggaaaagauaggg

SEQ ID NO: 867680 - RNA, 22 nt, Human
ucauuuuucacacagggucacc

SEQ ID NO: 867681 - RNA, 22 nt, Human
ucugaaggugcuagagaaagcu

SEQ ID NO: 867682 - RNA, 22 nt, Human
augcugaauugaugcgagggag

SEQ ID NO: 867683 - RNA, 22 nt, Human
aggcagccaaucagaggcugac

SEQ ID NO: 867684 - RNA, 20 nt, Human
agaggaggauuauuuuauuc

SEQ ID NO: 867685 - RNA, 22 nt, Human
uuagagucaaaauggcauguua

SEQ ID NO: 867686 - RNA, 22 nt, Human
cucacuguuuaauagcuggauc

SEQ ID NO: 867687 - RNA, 20 nt, Human
aggcagcugggaaaugaggg

SEQ ID NO: 867688 - RNA, 22 nt, Human
gaggcaguuccugagugacaag

SEQ ID NO: 867689 - RNA, 22 nt, Human
gcaaacaaggacauacauccug

SEQ ID NO: 867690 - RNA, 22 nt, Human
cacacuuugugcuaaucuauuu

SEQ ID NO: 867691 - RNA, 22 nt, Human
cccaggagaauauaauguucuu

SEQ ID NO: 867692 - RNA, 22 nt, Human
gaggaaccaaaucagcuugcac

SEQ ID NO: 867693 - RNA, 22 nt, Human
uuccuuagcuccucauggccug

SEQ ID NO: 867694 - RNA, 18 nt, Human
acucaggaaaugaugaca

SEQ ID NO: 867695 - RNA, 22 nt, Human
cauuuacauuuaagguuaauau

SEQ ID NO: 867696 - RNA, 22 nt, Human
acccaggaggcagagguugcag

SEQ ID NO: 867697 - RNA, 22 nt, Human
gucuucuguaagaugagguccc

SEQ ID NO: 867698 - RNA, 22 nt, Human
gggcagcucggaagugggaaag

SEQ ID NO: 867699 - RNA, 22 nt, Human
gcccaggaguugguggcugcag

SEQ ID NO: 867700 - RNA, 22 nt, Human
uagcccagcaugagcagagcug

SEQ ID NO: 867701 - RNA, 22 nt, Human
auauuucaugggguuccauacu

SEQ ID NO: 867702 - RNA, 22 nt, Human
aagaagagaaaugugcugcugg

SEQ ID NO: 867703 - RNA, 22 nt, Human
gcuccucuauuccccacauuuu

SEQ ID NO: 867704 - RNA, 22 nt, Human
aaguggacuaauacaaggacua

SEQ ID NO: 867705 - RNA, 22 nt, Human
aggccagaaauuuggaguaugu

SEQ ID NO: 867706 - RNA, 22 nt, Human
ugugaauagugccgcaauaaac

SEQ ID NO: 867707 - RNA, 20 nt, Human
guaaaauauggucuuugggu

SEQ ID NO: 867708 - RNA, 22 nt, Human
cuuccaaauguaaauaaguuuc

SEQ ID NO: 867709 - RNA, 22 nt, Human
cuacagaauucaacaaaugguu

SEQ ID NO: 867710 - RNA, 22 nt, Human
caguccuuggcuucauccgagu

SEQ ID NO: 867711 - RNA, 22 nt, Human
uuuuauguuccucuuuaugcga

SEQ ID NO: 867712 - RNA, 22 nt, Human
cauuuccacuucugaaaacugg

SEQ ID NO: 867713 - RNA, 22 nt, Human
auguucaaacaaguuaaugcca

SEQ ID NO: 867714 - RNA, 22 nt, Human
aaagucaucagaaccuuccaga

SEQ ID NO: 867715 - RNA, 22 nt, Human
gcugcugucacggugcuaaggg

SEQ ID NO: 867716 - RNA, 22 nt, Human
cagaggcacaagaaagcaaggc

SEQ ID NO: 867717 - RNA, 22 nt, Human
cugcugugccucuuuucacgug

SEQ ID NO: 867718 - RNA, 22 nt, Human
ccaggagaagcaucugagugua

SEQ ID NO: 867719 - RNA, 22 nt, Human
ucugguaaccuuuaucccuccu

SEQ ID NO: 867720 - RNA, 22 nt, Human
cugcgcagcaaucagagaggag

SEQ ID NO: 867721 - RNA, 22 nt, Human
auggcuuucagauuucuauguu

SEQ ID NO: 867722 - RNA, 22 nt, Human
aucuuucuccauauacaucuuu

SEQ ID NO: 867723 - RNA, 22 nt, Human
caguucuuauuuggccaguguc

SEQ ID NO: 867724 - RNA, 22 nt, Human
acaaaauuaugaagaggccuug

SEQ ID NO: 867725 - RNA, 22 nt, Human
uggagcugggguuugaaucugg

SEQ ID NO: 867726 - RNA, 21 nt, Human
aggcagcaggauccagggaca

SEQ ID NO: 867727 - RNA, 22 nt, Human
gauuucuugauaauucaaaucc

SEQ ID NO: 867728 - RNA, 22 nt, Human
agugcuuucccugaaaccuucc

SEQ ID NO: 867729 - RNA, 22 nt, Human
uaaguccuagcuuugguaggaa

SEQ ID NO: 867730 - RNA, 22 nt, Human
gugauuuaguguuaaguauguu

SEQ ID NO: 867731 - RNA, 22 nt, Human
uuguuugaggucacugauauuu

SEQ ID NO: 867732 - RNA, 22 nt, Human
uugauccaguugaaagugauga

SEQ ID NO: 867733 - RNA, 22 nt, Human
acaaaaagggagaugagguaga

SEQ ID NO: 867734 - RNA, 15 nt, Human
cccaggaguucgaga

SEQ ID NO: 867735 - RNA, 22 nt, Human
uagcugcugcagcacagggagg

SEQ ID NO: 867736 - RNA, 22 nt, Human
uccacauccauugcuugacuuu

SEQ ID NO: 867737 - RNA, 22 nt, Human
aaggcagccuuuugaguugauu

SEQ ID NO: 867738 - RNA, 22 nt, Human
uggcagcugcaggccuccugag

SEQ ID NO: 867739 - RNA, 22 nt, Human
uuuuccagauuggacuuagucc

SEQ ID NO: 867740 - RNA, 22 nt, Human
acacauauauacauauuugugc

SEQ ID NO: 867741 - RNA, 22 nt, Human
ugaucugaaggacaugggaccc

SEQ ID NO: 867742 - RNA, 22 nt, Human
aggguggccaugagggagagau

SEQ ID NO: 867743 - RNA, 22 nt, Human
gagauuuagagagacuuaaaca

SEQ ID NO: 867744 - RNA, 22 nt, Human
uuugaaagagcugauacaugaa

SEQ ID NO: 867745 - RNA, 22 nt, Human
ucuggcaggcaaucggcucugg

SEQ ID NO: 867746 - RNA, 22 nt, Human
ggauggcauguugggcucuguu

SEQ ID NO: 867747 - RNA, 22 nt, Human
ugaggcagcauucuucaagaca

SEQ ID NO: 867748 - RNA, 22 nt, Human
guauagaaacccagaaagauag

SEQ ID NO: 867749 - RNA, 22 nt, Human
agucaccagguuuuagagaccu

SEQ ID NO: 867750 - RNA, 22 nt, Human
uuucaacaccagagaccaugcg

SEQ ID NO: 867751 - RNA, 22 nt, Human
agaaaugacaagacugaucagg

SEQ ID NO: 867752 - RNA, 22 nt, Human
gaauuucaacaguccucaaaug

SEQ ID NO: 867753 - RNA, 22 nt, Human
cuggccagcugacagcagggcu

SEQ ID NO: 867754 - RNA, 22 nt, Human
cccaggaaagagacugcugggu

SEQ ID NO: 867755 - RNA, 22 nt, Human
uuugaaagucaaccuuccaguu

SEQ ID NO: 867756 - RNA, 22 nt, Human
ggaggugguggcagugacaauu

SEQ ID NO: 867757 - RNA, 22 nt, Human
gacccaggguauccagagcugc

SEQ ID NO: 867758 - RNA, 22 nt, Human
guggaauguccuugaucauaag

SEQ ID NO: 867759 - RNA, 22 nt, Human
uauuuccaggccccacucuaga

SEQ ID NO: 867760 - RNA, 20 nt, Human
uuccuuaggcauuggaagaa

SEQ ID NO: 867761 - RNA, 22 nt, Human
uccagaauacucugaaaucauu

SEQ ID NO: 867762 - RNA, 22 nt, Human
aaauauagugacacuuauaguc

SEQ ID NO: 867763 - RNA, 22 nt, Human
ggccuuuaagcaauugaaaaga

SEQ ID NO: 867764 - RNA, 22 nt, Human
guuuuaguggguggccacugau

SEQ ID NO: 867765 - RNA, 19 nt, Human
cauguuaugcuguaguauc

SEQ ID NO: 867766 - RNA, 22 nt, Human
cuacagacccaccuuggaagaa

SEQ ID NO: 867767 - RNA, 22 nt, Human
ccucuucuagguuucagccugc

SEQ ID NO: 867768 - RNA, 22 nt, Human
gaggaaccaaucugugauauuc

SEQ ID NO: 867769 - RNA, 22 nt, Human
gagagucuagugcaccuaguuu

SEQ ID NO: 867770 - RNA, 23 nt, Human
augguuuaugucacacuuuugau

SEQ ID NO: 867771 - RNA, 22 nt, Human
cuggauuuuagaaggcuuccua

SEQ ID NO: 867772 - RNA, 22 nt, Human
auuugcuugugcuaugaaaguu

SEQ ID NO: 867773 - RNA, 22 nt, Human
uuaauuacuaagcacaaugcaa

SEQ ID NO: 867774 - RNA, 22 nt, Human
uaugaaaagguggccaauguag

SEQ ID NO: 867775 - RNA, 22 nt, Human
ugaggcaggaauggggaaaagu

SEQ ID NO: 867776 - RNA, 22 nt, Human
acccaggaugauaauguucaca

SEQ ID NO: 867777 - RNA, 22 nt, Human
cagucucuaaaucaaucugaau

SEQ ID NO: 867778 - RNA, 22 nt, Human
ccaggcugccgaggaaagaaag

SEQ ID NO: 867779 - RNA, 22 nt, Human
aacaugcucuguuucuuggaug

SEQ ID NO: 867780 - RNA, 22 nt, Human
uuugaagucaggcuuucuaccc

SEQ ID NO: 867781 - RNA, 22 nt, Human
aaucaaaaccuacagagguaau

SEQ ID NO: 867782 - RNA, 22 nt, Human
aaucauucuuauuucacagcaa

SEQ ID NO: 867783 - RNA, 23 nt, Human
accaggaguugucucaggaaaca

SEQ ID NO: 867784 - RNA, 22 nt, Human
ugagccugguugcagugucugg

SEQ ID NO: 867785 - RNA, 22 nt, Human
auggccuuagugaugauuaaua

SEQ ID NO: 867786 - RNA, 22 nt, Human
ucagccaggccaggcauucaca

SEQ ID NO: 867787 - RNA, 22 nt, Human
ugcaacuuguuuggagagaaag

SEQ ID NO: 867788 - RNA, 22 nt, Human
cucuucuuggcccccaugaggg

SEQ ID NO: 867789 - RNA, 22 nt, Human
uggcaaggcugugggggcagag

SEQ ID NO: 867790 - RNA, 22 nt, Human
uuaacagagugccuggcaugua

SEQ ID NO: 867791 - RNA, 22 nt, Human
uauuuccauguuagaacuaagu

SEQ ID NO: 867792 - RNA, 22 nt, Human
uugauacuauuaagcacugggc

SEQ ID NO: 867793 - RNA, 22 nt, Human
uacuaucucuucuaacuucaga

SEQ ID NO: 867794 - RNA, 22 nt, Human
auucucuuuguauaacaucuug

SEQ ID NO: 867795 - RNA, 22 nt, Human
agaucugaggguccaagggagg

SEQ ID NO: 867796 - RNA, 22 nt, Human
ggguggagcuuggacaccagua

SEQ ID NO: 867797 - RNA, 22 nt, Human
cauggcuuuuuagcauauucaa

SEQ ID NO: 867798 - RNA, 22 nt, Human
augugaggaagaaagagguaag

SEQ ID NO: 867799 - RNA, 22 nt, Human
agaauuuccuaugagagauucc

SEQ ID NO: 867800 - RNA, 22 nt, Human
augcuguggggagugaggguag

SEQ ID NO: 867801 - RNA, 22 nt, Human
aggcagcuuucuguaggggugu

SEQ ID NO: 867802 - RNA, 22 nt, Human
uuauuauuggugaguuaaggaa

SEQ ID NO: 867803 - RNA, 22 nt, Human
gauguguuuccaggauuuguuu

SEQ ID NO: 867804 - RNA, 22 nt, Human
auucacuggcagacagaacuca

SEQ ID NO: 867805 - RNA, 19 nt, Human
aggauuuauuaugugcuca

SEQ ID NO: 867806 - RNA, 22 nt, Human
uugcuagcugguguaugcauug

SEQ ID NO: 867807 - RNA, 20 nt, Human
cccaggaguuugcucuuacu

SEQ ID NO: 867808 - RNA, 22 nt, Human
gggaggugauggcaagcagcgg

SEQ ID NO: 867809 - RNA, 22 nt, Human
cagcuucugucugauuagcaag

SEQ ID NO: 867810 - RNA, 22 nt, Human
uuacagaaguauugagagaucc

SEQ ID NO: 867811 - RNA, 22 nt, Human
accaggagggacccugguggcc

SEQ ID NO: 867812 - RNA, 22 nt, Human
ucagccagcaucagcuaagugc

SEQ ID NO: 867813 - RNA, 22 nt, Human
ccaggcugugguuuagauagag

SEQ ID NO: 867814 - RNA, 22 nt, Human
auaauucaugggccuuucaccu

SEQ ID NO: 867815 - RNA, 20 nt, Human
acaauacagguugugucuga

SEQ ID NO: 867816 - RNA, 22 nt, Human
uuugaacaggaguaucuauagu

SEQ ID NO: 867817 - RNA, 22 nt, Human
auauacaaagggcaaccucgcu

SEQ ID NO: 867818 - RNA, 22 nt, Human
gcugcugugccuggcguccugu

SEQ ID NO: 867819 - RNA, 22 nt, Human
uucucuuuucaccaguugcuaa

SEQ ID NO: 867820 - RNA, 23 nt, Human
uaauacugcuucagaggcuuaga

SEQ ID NO: 867821 - RNA, 22 nt, Human
cagaaagcuuaggcaaguugga

SEQ ID NO: 867822 - RNA, 22 nt, Human
cugugauuguuaguuccuauac

SEQ ID NO: 867823 - RNA, 22 nt, Human
aaucccagcuacucaggaaguu

SEQ ID NO: 867824 - RNA, 23 nt, Human
uacagaaggaguagucacuaaga

SEQ ID NO: 867825 - RNA, 22 nt, Human
uggcuuaagcgcaacucugucu

SEQ ID NO: 867826 - RNA, 22 nt, Human
aggcaccuugcgguccagugaa

SEQ ID NO: 867827 - RNA, 22 nt, Human
uguauacaggcauaagagauac

SEQ ID NO: 867828 - RNA, 19 nt, Human
ugcugaaguugucagucug

SEQ ID NO: 867829 - RNA, 22 nt, Human
augcugugucuagcaggaacac

SEQ ID NO: 867830 - RNA, 22 nt, Human
aaugucugccagaacugaucau

SEQ ID NO: 867831 - RNA, 22 nt, Human
acaacuuugacccuuguucuua

SEQ ID NO: 867832 - RNA, 22 nt, Human
gucaggaugacaagugcuuuca

SEQ ID NO: 867833 - RNA, 22 nt, Human
cagcaggauuugaaaggaagag

SEQ ID NO: 867834 - RNA, 22 nt, Human
uguacaaugccgagacuaacuc

SEQ ID NO: 867835 - RNA, 22 nt, Human
uugaaauaucaaguuauuagug

SEQ ID NO: 867836 - RNA, 18 nt, Human
gugcugugggcaguggcc

SEQ ID NO: 867837 - RNA, 22 nt, Human
ggugguggagccagcugggagu

SEQ ID NO: 867838 - RNA, 22 nt, Human
gaaggaggcguuagcccuagga

SEQ ID NO: 867839 - RNA, 22 nt, Human
uuucccagagguaugaauaagu

SEQ ID NO: 867840 - RNA, 22 nt, Human
uugauuaaucccaugugaguag

SEQ ID NO: 867841 - RNA, 21 nt, Human
ucucugugucuuuaagcugga

SEQ ID NO: 867842 - RNA, 22 nt, Human
uacacacaugcauuugccuuau

SEQ ID NO: 867843 - RNA, 23 nt, Human
uccaugagaugugggcuucuagu

SEQ ID NO: 867844 - RNA, 22 nt, Human
aggguccugggugcaguugcuu

SEQ ID NO: 867845 - RNA, 22 nt, Human
augcugugaaaaagaaggcuga

SEQ ID NO: 867846 - RNA, 22 nt, Human
ucucuucuaacacuagaaauuc

SEQ ID NO: 867847 - RNA, 22 nt, Human
aauccugugugacucuggggag

SEQ ID NO: 867848 - RNA, 22 nt, Human
augguuuaguuagggcuuuuca

SEQ ID NO: 867849 - RNA, 22 nt, Human
cugucauuuaagacauucugga

SEQ ID NO: 867850 - RNA, 22 nt, Human
guucucucugcuuccaagaugg

SEQ ID NO: 867851 - RNA, 22 nt, Human
uagggcaggugaagaaaagcua

SEQ ID NO: 867852 - RNA, 22 nt, Human
uuuguuaaauauuuauugagug

SEQ ID NO: 867853 - RNA, 22 nt, Human
auaaacucaugccaagaaauga

SEQ ID NO: 867854 - RNA, 22 nt, Human
uuugaaagcaggugugggaggg

SEQ ID NO: 867855 - RNA, 22 nt, Human
caggaugagguagaggcagaua

SEQ ID NO: 867856 - RNA, 22 nt, Human
cccaggagacugagcuguaacc

SEQ ID NO: 867857 - RNA, 22 nt, Human
caucagaaggaaggacgauuau

SEQ ID NO: 867858 - RNA, 22 nt, Human
uggagacucugcaucugugaca

SEQ ID NO: 867859 - RNA, 22 nt, Human
auacuguuucucuucuacauga

SEQ ID NO: 867860 - RNA, 21 nt, Human
aaauacagaaacuuguuuuca

SEQ ID NO: 867861 - RNA, 22 nt, Human
guugaaagcuuuucauuuaguu

SEQ ID NO: 867862 - RNA, 22 nt, Human
gauuucuuuaugaaguacagaa

SEQ ID NO: 867863 - RNA, 22 nt, Human
acauaaguuauggauaaaaugu

SEQ ID NO: 867864 - RNA, 22 nt, Human
uuccaugagcucugaguucaca

SEQ ID NO: 867865 - RNA, 22 nt, Human
aaagccuuugucucaggcucug

SEQ ID NO: 867866 - RNA, 22 nt, Human
uuucucuguucucuaacuguaa

SEQ ID NO: 867867 - RNA, 22 nt, Human
gcagaagucagaccaucugaau

SEQ ID NO: 867868 - RNA, 22 nt, Human
uuucacagguacaaacacuccu

SEQ ID NO: 867869 - RNA, 22 nt, Human
ggacuucuaagugccagacacu

SEQ ID NO: 867870 - RNA, 22 nt, Human
ugcuuugggucucucuaguuuc

SEQ ID NO: 867871 - RNA, 22 nt, Human
gagagggagccagccaggaacc

SEQ ID NO: 867872 - RNA, 22 nt, Human
aggcaacuguuugauaauguug

SEQ ID NO: 867873 - RNA, 20 nt, Human
ccucaggaugagggugagca

SEQ ID NO: 867874 - RNA, 22 nt, Human
cauuuguaguaucuguuuauau

SEQ ID NO: 867875 - RNA, 22 nt, Human
cucagaagaacaaaggcucuac

SEQ ID NO: 867876 - RNA, 22 nt, Human
caggcaggucagugaagaagga

SEQ ID NO: 867877 - RNA, 22 nt, Human
aguauugugacucaaguauucu

SEQ ID NO: 867878 - RNA, 22 nt, Human
gcucccagacugaccagaggug

SEQ ID NO: 867879 - RNA, 22 nt, Human
aggagggaccuaggaauauugc

SEQ ID NO: 867880 - RNA, 22 nt, Human
cauauaaauacaacauguguua

SEQ ID NO: 867881 - RNA, 22 nt, Human
uuugacauugccaauuugcuca

SEQ ID NO: 867882 - RNA, 22 nt, Human
cuucuucaaccugaaaguuuca

SEQ ID NO: 867883 - RNA, 22 nt, Human
agaggacagguuuuccaugggc

SEQ ID NO: 867884 - RNA, 22 nt, Human
aaguguauauaugacuuauaaa

SEQ ID NO: 867885 - RNA, 22 nt, Human
uugaaauacugcauuguucagu

SEQ ID NO: 867886 - RNA, 22 nt, Human
caggcagcugcuggguucagcc

SEQ ID NO: 867887 - RNA, 22 nt, Human
auuuaaauuuucugauggagag

SEQ ID NO: 867888 - RNA, 22 nt, Human
gggacgggcaguccaagggguc

SEQ ID NO: 867889 - RNA, 22 nt, Human
auaagcauguuagaauauuuga

SEQ ID NO: 867890 - RNA, 22 nt, Human
agccagcucccuccccugcagg

SEQ ID NO: 867891 - RNA, 22 nt, Human
cagucucucagcuuucagcugu

SEQ ID NO: 867892 - RNA, 22 nt, Human
uauggcuuuaaacaacuuaggu

SEQ ID NO: 867893 - RNA, 22 nt, Human
cauuaaaauaucucaugguguu

SEQ ID NO: 867894 - RNA, 22 nt, Human
gcaaguuauuuccauuuaaagc

SEQ ID NO: 867895 - RNA, 22 nt, Human
acagccaggaggaacucaguga

SEQ ID NO: 867896 - RNA, 22 nt, Human
aauuuccagaucagaugacuca

SEQ ID NO: 867897 - RNA, 20 nt, Human
gaagcagcuucauguagaca

SEQ ID NO: 867898 - RNA, 22 nt, Human
uuccugagggacuuuugagauu

SEQ ID NO: 867899 - RNA, 22 nt, Human
ugccaggauauaagagugcgau

SEQ ID NO: 867900 - RNA, 22 nt, Human
uagucaccuuuggcaccugcaa

SEQ ID NO: 867901 - RNA, 22 nt, Human
cuacccaggcuggagugcagua

SEQ ID NO: 867902 - RNA, 20 nt, Human
ucauuguguugccaauuccc

SEQ ID NO: 867903 - RNA, 22 nt, Human
aauuucaaacucuugcccucag

SEQ ID NO: 867904 - RNA, 21 nt, Human
gccaggaguagauuacauuua

SEQ ID NO: 867905 - RNA, 22 nt, Human
acuucacagaaauuuuaugagg

SEQ ID NO: 867906 - RNA, 22 nt, Human
auacagaauacuaauuccugag

SEQ ID NO: 867907 - RNA, 22 nt, Human
cucacugucuguacuagcugau

SEQ ID NO: 867908 - RNA, 22 nt, Human
gaaacugugaggaucuuaacuu

SEQ ID NO: 867909 - RNA, 22 nt, Human
aggcacagagaaugcccuccau

SEQ ID NO: 867910 - RNA, 22 nt, Human
gcacaauaauuuuuuuaagagg

SEQ ID NO: 867911 - RNA, 19 nt, Human
uggggcuguguuuugaccc

SEQ ID NO: 867912 - RNA, 22 nt, Human
caguccuuucaauggugaccuu

SEQ ID NO: 867913 - RNA, 22 nt, Human
uacccagggcuuuucugaugca

SEQ ID NO: 867914 - RNA, 17 nt, Human
caauuucauagguuuug

SEQ ID NO: 867915 - RNA, 23 nt, Human
agaucugauguuaccaagaauug

SEQ ID NO: 867916 - RNA, 22 nt, Human
uauacagaaagaauucaagucu

SEQ ID NO: 867917 - RNA, 22 nt, Human
ucacaugaguauuauuuuccaa

SEQ ID NO: 867918 - RNA, 22 nt, Human
ccaaacaaauccccauucuuag

SEQ ID NO: 867919 - RNA, 23 nt, Human
ucuccuccuagauacagucaugg

SEQ ID NO: 867920 - RNA, 22 nt, Human
uagaauaaguugaugauauaug

SEQ ID NO: 867921 - RNA, 22 nt, Human
uugguuuagagagugugguuac

SEQ ID NO: 867922 - RNA, 22 nt, Human
ucaucuugcugccauugcuuua

SEQ ID NO: 867923 - RNA, 22 nt, Human
aguucucagcuuaguaugcugu

SEQ ID NO: 867924 - RNA, 22 nt, Human
uuuaaauggcauuuucccagau

SEQ ID NO: 867925 - RNA, 22 nt, Human
cuggaggcacccuuagagaggc

SEQ ID NO: 867926 - RNA, 19 nt, Human
agaggcagucuccaacagg

SEQ ID NO: 867927 - RNA, 22 nt, Human
auguucuuucagccagugcauc

SEQ ID NO: 867928 - RNA, 20 nt, Human
ucuaauuaaaauugucuagu

SEQ ID NO: 867929 - RNA, 18 nt, Human
auagaaaccuuuaaucag

SEQ ID NO: 867930 - RNA, 22 nt, Human
gcccaggaugguguguaguggu

SEQ ID NO: 867931 - RNA, 22 nt, Human
gccaggaggggagaguguguca

SEQ ID NO: 867932 - RNA, 22 nt, Human
agcaucuggcagaaagucagaa

SEQ ID NO: 867933 - RNA, 20 nt, Human
gggugggagagucugagggu

SEQ ID NO: 867934 - RNA, 22 nt, Human
aucaggaugcugucaguuacca

SEQ ID NO: 867935 - RNA, 22 nt, Human
ugccuguguccccuucuuggca

SEQ ID NO: 867936 - RNA, 19 nt, Human
cuggccaggccaggggccc

SEQ ID NO: 867937 - RNA, 22 nt, Human
agccuuguuggucugaguuugg

SEQ ID NO: 867938 - RNA, 18 nt, Human
aguccuuacgaggcuaua

SEQ ID NO: 867939 - RNA, 22 nt, Human
agaggaugguugaggaagaccu

SEQ ID NO: 867940 - RNA, 22 nt, Human
ucuuucaaugagcauucuuucc

SEQ ID NO: 867941 - RNA, 22 nt, Human
accaggaguuuugaccaggggc

SEQ ID NO: 867942 - RNA, 22 nt, Human
ucagaauucagagggagugggg

SEQ ID NO: 867943 - RNA, 22 nt, Human
ucucuuucuauaugugagucuu

SEQ ID NO: 867944 - RNA, 22 nt, Human
accaggagaggcacuugcaaug

SEQ ID NO: 867945 - RNA, 22 nt, Human
cuuuggcagccucugcuauuga

SEQ ID NO: 867946 - RNA, 22 nt, Human
caaggccaguccauuuuggaag

SEQ ID NO: 867947 - RNA, 20 nt, Human
ugaggcaggagaauggcaug

SEQ ID NO: 867948 - RNA, 22 nt, Human
uaauacagaaguguauuaaaau

SEQ ID NO: 867949 - RNA, 22 nt, Human
aguaaaucagaccucauuaugu

SEQ ID NO: 867950 - RNA, 22 nt, Human
gaccauuucuaggaaucagacu

SEQ ID NO: 867951 - RNA, 22 nt, Human
aguuugaaaguauugacagaag

SEQ ID NO: 867952 - RNA, 22 nt, Human
caauuucagucucagagaguuc

SEQ ID NO: 867953 - RNA, 22 nt, Human
aaaagccaagguccucuucaga

SEQ ID NO: 867954 - RNA, 22 nt, Human
caaaugauagagccgauuauca

SEQ ID NO: 867955 - RNA, 22 nt, Human
aggcaguggcugagaccagggg

SEQ ID NO: 867956 - RNA, 22 nt, Human
cagaguggcacucugcuggaug

SEQ ID NO: 867957 - RNA, 22 nt, Human
cagaucuguuugccagaucagc

SEQ ID NO: 867958 - RNA, 22 nt, Human
ucuuuccauggccacacagucu

SEQ ID NO: 867959 - RNA, 22 nt, Human
auuggcagaaacagcagggcca

SEQ ID NO: 867960 - RNA, 22 nt, Human
cauggcuuguaauaaauuuaua

SEQ ID NO: 867961 - RNA, 19 nt, Human
uucauucuuucuacuuacc

SEQ ID NO: 867962 - RNA, 22 nt, Human
uccaaaguguugggauuauagg

SEQ ID NO: 867963 - RNA, 23 nt, Human
uuuaacuuuccaauaauucauug

SEQ ID NO: 867964 - RNA, 23 nt, Human
aggauguaggauguauggcagag

SEQ ID NO: 867965 - RNA, 22 nt, Human
agcagagguguuuauuauggga

SEQ ID NO: 867966 - RNA, 22 nt, Human
aacauuggauauuuauuaaaag

SEQ ID NO: 867967 - RNA, 22 nt, Human
uugauuaaacaggcauauucaa

SEQ ID NO: 867968 - RNA, 22 nt, Human
aucuaucccaguuuaacucauu

SEQ ID NO: 867969 - RNA, 22 nt, Human
cauucauuagaauagauaugua

SEQ ID NO: 867970 - RNA, 22 nt, Human
aagcagcuggaagaguaagaug

SEQ ID NO: 867971 - RNA, 22 nt, Human
gaugggauuuuuuauguguuca

SEQ ID NO: 867972 - RNA, 23 nt, Human
accaggagccaagaucucccugg

SEQ ID NO: 867973 - RNA, 22 nt, Human
caauauauaggaacaacuuagg

SEQ ID NO: 867974 - RNA, 22 nt, Human
gcuauacaaguguagaauagag

SEQ ID NO: 867975 - RNA, 22 nt, Human
uugcucagcacuggagccagcu

SEQ ID NO: 867976 - RNA, 23 nt, Human
ucaggauauugugugccaaggug

SEQ ID NO: 867977 - RNA, 22 nt, Human
cauuuucagcacccaucugaaa

SEQ ID NO: 867978 - RNA, 22 nt, Human
uaguccuuuaauaguuaaugug

SEQ ID NO: 867979 - RNA, 22 nt, Human
uaaacauguugacaucuuaccu

SEQ ID NO: 867980 - RNA, 22 nt, Human
ccauggcuuuugagucucaaga

SEQ ID NO: 867981 - RNA, 22 nt, Human
aauuuccaaauuucugucacac

SEQ ID NO: 867982 - RNA, 22 nt, Human
caggagaucuuaggaauucuua

SEQ ID NO: 867983 - RNA, 22 nt, Human
cccuugcacauuugucuuuaau

SEQ ID NO: 867984 - RNA, 22 nt, Human
aaauugcaaaaguacuuuuagg

SEQ ID NO: 867985 - RNA, 22 nt, Human
cuguggaaggccuguccugaaa

SEQ ID NO: 867986 - RNA, 22 nt, Human
uguacaauguguuuguuggcuu

SEQ ID NO: 867987 - RNA, 22 nt, Human
uuuggaauguaguuuaaucauc

SEQ ID NO: 867988 - RNA, 22 nt, Human
uuuaggcauugggugcucaagu

SEQ ID NO: 867989 - RNA, 22 nt, Human
uccuuagagauacugucuugaa

SEQ ID NO: 867990 - RNA, 22 nt, Human
aggcaagcauugggaacagggc

SEQ ID NO: 867991 - RNA, 22 nt, Human
uggcagcuuuuuguuucaggcu

SEQ ID NO: 867992 - RNA, 22 nt, Human
acaugcuuuucccacaauuaua

SEQ ID NO: 867993 - RNA, 22 nt, Human
uaucagaaugcagccaugugca

SEQ ID NO: 867994 - RNA, 20 nt, Human
uucacagaggacucagguca

SEQ ID NO: 867995 - RNA, 20 nt, Human
cgugcugugaccuugagcau

SEQ ID NO: 867996 - RNA, 22 nt, Human
ccucacugcuauguguuugcuc

SEQ ID NO: 867997 - RNA, 22 nt, Human
uuucaagaacaacauucauuca

SEQ ID NO: 867998 - RNA, 21 nt, Human
ucuauucauuacaguuauuug

SEQ ID NO: 867999 - RNA, 22 nt, Human
cagagccacuuggagaugagaa

SEQ ID NO: 868000 - RNA, 22 nt, Human
uucagaaacaucaguggaugga

SEQ ID NO: 868001 - RNA, 22 nt, Human
ggagaggagcuauugggggcuc

SEQ ID NO: 868002 - RNA, 22 nt, Human
uggaggaaguugcuggaaguca

SEQ ID NO: 868003 - RNA, 22 nt, Human
gaugccucuuuuggcugaauua

SEQ ID NO: 868004 - RNA, 22 nt, Human
gccacaggcacuuaagggcugg

SEQ ID NO: 868005 - RNA, 22 nt, Human
uaauuucacugauaugaaguca

SEQ ID NO: 868006 - RNA, 22 nt, Human
ugaggcaggacuugcauaaagu

SEQ ID NO: 868007 - RNA, 22 nt, Human
ugagaacugaggauuugaauuc

SEQ ID NO: 868008 - RNA, 22 nt, Human
agguccagcuguugcagccucc

SEQ ID NO: 868009 - RNA, 22 nt, Human
caggagagcccggguccgggcu

SEQ ID NO: 868010 - RNA, 22 nt, Human
uuuaggcacagggaguugguuu

SEQ ID NO: 868011 - RNA, 22 nt, Human
uggcagcuguguccagguagaa

SEQ ID NO: 868012 - RNA, 22 nt, Human
gcagcugagagaagaacagggc

SEQ ID NO: 868013 - RNA, 22 nt, Human
gaaauuauugcuagagacugca

SEQ ID NO: 868014 - RNA, 22 nt, Human
cuucagaagaaaagcagugugu

SEQ ID NO: 868015 - RNA, 22 nt, Human
uauuuuaaagacugccagccua

SEQ ID NO: 868016 - RNA, 21 nt, Human
uucugggaaaugagcuggggc

SEQ ID NO: 868017 - RNA, 22 nt, Human
agaucugaaucucauccgagga

SEQ ID NO: 868018 - RNA, 22 nt, Human
cuguggaauugaugcuuagugu

SEQ ID NO: 868019 - RNA, 22 nt, Human
uuauuauuccccaagucauuau

SEQ ID NO: 868020 - RNA, 22 nt, Human
ugaaggccagcucuuuaucagc

SEQ ID NO: 868021 - RNA, 18 nt, Human
aagaggaggagcagguug

SEQ ID NO: 868022 - RNA, 22 nt, Human
gugcugugucuaucaggaauaa

SEQ ID NO: 868023 - RNA, 22 nt, Human
uggcauuugcucccuuguguuc

SEQ ID NO: 868024 - RNA, 21 nt, Human
cacucaggguaugugccaggc

SEQ ID NO: 868025 - RNA, 22 nt, Human
uuuaagauucaguaaggcaaac

SEQ ID NO: 868026 - RNA, 22 nt, Human
gaaaggugccccauaggcagga

SEQ ID NO: 868027 - RNA, 22 nt, Human
agugcuuuaccuagauaauguu

SEQ ID NO: 868028 - RNA, 22 nt, Human
aggguaggaacugaguggaagg

SEQ ID NO: 868029 - RNA, 22 nt, Human
aguuauuacucuuuaacauauu

SEQ ID NO: 868030 - RNA, 22 nt, Human
aggcaguggaugucaggaaugg

SEQ ID NO: 868031 - RNA, 22 nt, Human
cugcugugcagacagacucucu

SEQ ID NO: 868032 - RNA, 22 nt, Human
uaacagaagaugaaacuucuuu

SEQ ID NO: 868033 - RNA, 23 nt, Human
auauggcuguuguguguuaacau

SEQ ID NO: 868034 - RNA, 22 nt, Human
acagaauugaaaguauaaucug

SEQ ID NO: 868035 - RNA, 22 nt, Human
acaaaauuuuuagacaaggcuu

SEQ ID NO: 868036 - RNA, 22 nt, Human
aaguucuaauuuugcauucagg

SEQ ID NO: 868037 - RNA, 22 nt, Human
agccagcuguucuggggcagca

SEQ ID NO: 868038 - RNA, 20 nt, Human
augcuuucuugugugcugcu

SEQ ID NO: 868039 - RNA, 21 nt, Human
agucccauccgguaagcaagc

SEQ ID NO: 868040 - RNA, 22 nt, Human
aggcagucuaguccccaggcaa

SEQ ID NO: 868041 - RNA, 23 nt, Human
cagaaaucugaaaucuagaaaug

SEQ ID NO: 868042 - RNA, 22 nt, Human
aaugaaauguagcuuauccaua

SEQ ID NO: 868043 - RNA, 22 nt, Human
uuugaaaggguuaugagacuga

SEQ ID NO: 868044 - RNA, 22 nt, Human
uuaucacuuaugagcuuuuugc

SEQ ID NO: 868045 - RNA, 18 nt, Human
agaggggagguaagucug

SEQ ID NO: 868046 - RNA, 22 nt, Human
ugcuucuggaaacaguggcugu

SEQ ID NO: 868047 - RNA, 22 nt, Human
cauuuacagugagaguuuuuac

SEQ ID NO: 868048 - RNA, 22 nt, Human
caaugaaauugagauccagaga

SEQ ID NO: 868049 - RNA, 23 nt, Human
uuuuccagaaucgacucuguaga

SEQ ID NO: 868050 - RNA, 22 nt, Human
caugcugugcaucuugaugacc

SEQ ID NO: 868051 - RNA, 22 nt, Human
gcagcucccagcuugaaagguc

SEQ ID NO: 868052 - RNA, 22 nt, Human
cuggcuuucccuggacaacagc

SEQ ID NO: 868053 - RNA, 22 nt, Human
aggcacaguggcucacaccugu

SEQ ID NO: 868054 - RNA, 22 nt, Human
gagaaaugcaugcaugucauca

SEQ ID NO: 868055 - RNA, 22 nt, Human
gcagaggccuagguggaaggcc

SEQ ID NO: 868056 - RNA, 22 nt, Human
uuuacaaccucauauucugaug

SEQ ID NO: 868057 - RNA, 22 nt, Human
gucaggauguuuauucuccagu

SEQ ID NO: 868058 - RNA, 22 nt, Human
cauguuuacuaccaggagaaug

SEQ ID NO: 868059 - RNA, 22 nt, Human
ucucugaguaagugacaguuca

SEQ ID NO: 868060 - RNA, 22 nt, Human
cagaaacauguauaaaguugua

SEQ ID NO: 868061 - RNA, 22 nt, Human
agagugucugguagcugcucug

SEQ ID NO: 868062 - RNA, 22 nt, Human
aggaaagguagcgugccagcag

SEQ ID NO: 868063 - RNA, 22 nt, Human
acacaaugcauauuuuuccaga

SEQ ID NO: 868064 - RNA, 22 nt, Human
ccucugcucugguccaugugcu

SEQ ID NO: 868065 - RNA, 22 nt, Human
accauguguuuuacacauggua

SEQ ID NO: 868066 - RNA, 22 nt, Human
ucccaggaauccguccucuaga

SEQ ID NO: 868067 - RNA, 22 nt, Human
uuuuaucuucauuccuaucuac

SEQ ID NO: 868068 - RNA, 22 nt, Human
aaaggccagguuggcugguauu

SEQ ID NO: 868069 - RNA, 22 nt, Human
acauuuuuauucaucaaagcag

SEQ ID NO: 868070 - RNA, 22 nt, Human
cccaggaguucgaggcuguagu

SEQ ID NO: 868071 - RNA, 22 nt, Human
acacaaguucuaaagauugcgc

SEQ ID NO: 868072 - RNA, 22 nt, Human
ugaggcaggaugcuugcacagg

SEQ ID NO: 868073 - RNA, 22 nt, Human
guugaaagaucauguggcugcc

SEQ ID NO: 868074 - RNA, 21 nt, Human
gagacagcccagugccagggc

SEQ ID NO: 868075 - RNA, 23 nt, Human
uacuuaggguuuagaucugacug

SEQ ID NO: 868076 - RNA, 22 nt, Human
cugaauaauauuccauuaugag

SEQ ID NO: 868077 - RNA, 22 nt, Human
uggcagcuauuacaaggaaguc

SEQ ID NO: 868078 - RNA, 22 nt, Human
cugcuuccauaaauaaugugcu

SEQ ID NO: 868079 - RNA, 22 nt, Human
gaucuguuauaaucucuuuuau

SEQ ID NO: 868080 - RNA, 22 nt, Human
ucuucuucccaucccucaaaug

SEQ ID NO: 868081 - RNA, 22 nt, Human
uuuccaaaguugccauaagcuu

SEQ ID NO: 868082 - RNA, 22 nt, Human
uggaaggaaagguagcagagaa

SEQ ID NO: 868083 - RNA, 22 nt, Human
aggagggacaccaauauauguu

SEQ ID NO: 868084 - RNA, 22 nt, Human
ucucucuuuuuaaucauguaau

SEQ ID NO: 868085 - RNA, 22 nt, Human
ucacaauuuggauacagcuaug

SEQ ID NO: 868086 - RNA, 22 nt, Human
cuucucagaggccagaagcuau

SEQ ID NO: 868087 - RNA, 21 nt, Human
agggagcuuuagguagaaguu

SEQ ID NO: 868088 - RNA, 22 nt, Human
gaggcaguuugccaugccagga

SEQ ID NO: 868089 - RNA, 22 nt, Human
aaucagaaucaguugacacagc

SEQ ID NO: 868090 - RNA, 22 nt, Human
ccccaggacacauggaccaagu

SEQ ID NO: 868091 - RNA, 22 nt, Human
aaucagaaccuugggucauaac

SEQ ID NO: 868092 - RNA, 22 nt, Human
uuacagaacugucuugaaauuu

SEQ ID NO: 868093 - RNA, 22 nt, Human
auagucuuagaucagauaaagu

SEQ ID NO: 868094 - RNA, 22 nt, Human
ggaggcagaacuucccgucagu

SEQ ID NO: 868095 - RNA, 22 nt, Human
ggcaggcaaugaggaugggaag

SEQ ID NO: 868096 - RNA, 22 nt, Human
uggaggaaguggcuggccagaa

SEQ ID NO: 868097 - RNA, 22 nt, Human
guuccaaacaagucauaaagua

SEQ ID NO: 868098 - RNA, 22 nt, Human
uucauacuaaaguguaagaugu

SEQ ID NO: 868099 - RNA, 22 nt, Human
cggaggggauacauuuucugaa

SEQ ID NO: 868100 - RNA, 22 nt, Human
cugcuguguggugaaacucagu

SEQ ID NO: 868101 - RNA, 22 nt, Human
guuauaaaaugcacaguuguuu

SEQ ID NO: 868102 - RNA, 22 nt, Human
cagagaaaaaauccugcucuca

SEQ ID NO: 868103 - RNA, 22 nt, Human
ucugcuguucauucuuuuagcu

SEQ ID NO: 868104 - RNA, 22 nt, Human
uccaaaaaacguuugaauaguu

SEQ ID NO: 868105 - RNA, 22 nt, Human
ugaaauaauaucuggaucaauc

SEQ ID NO: 868106 - RNA, 22 nt, Human
agaaaugcucaggucaacuuaa

SEQ ID NO: 868107 - RNA, 19 nt, Human
ugugaaagcuaguguucuu

SEQ ID NO: 868108 - RNA, 22 nt, Human
cauuuuaaaugauuuaagccaa

SEQ ID NO: 868109 - RNA, 22 nt, Human
ucuucuccagugcuucugcaca

SEQ ID NO: 868110 - RNA, 22 nt, Human
gcuuuggagccuguguucugcc

SEQ ID NO: 868111 - RNA, 22 nt, Human
auuguauaacagcauguauuuu

SEQ ID NO: 868112 - RNA, 22 nt, Human
auugucuuuccacugagaaguu

SEQ ID NO: 868113 - RNA, 22 nt, Human
auucaaauuaaguuaauucagc

SEQ ID NO: 868114 - RNA, 21 nt, Human
agcagaggcagaauguaugca

SEQ ID NO: 868115 - RNA, 22 nt, Human
uggauuaguuaagaaauguuag

SEQ ID NO: 868116 - RNA, 17 nt, Human
cccacggaggugugaaa

SEQ ID NO: 868117 - RNA, 22 nt, Human
gagagcaggaggcagcgggacg

SEQ ID NO: 868118 - RNA, 22 nt, Human
gaaucucaguggaagcaggaag

SEQ ID NO: 868119 - RNA, 22 nt, Human
uuucaaacauaucuucauuacu

SEQ ID NO: 868120 - RNA, 22 nt, Human
ucucuucuaauuaggguccaug

SEQ ID NO: 868121 - RNA, 22 nt, Human
auuccaaacagugcugcagacu

SEQ ID NO: 868122 - RNA, 22 nt, Human
caggcagcaggagcccugcucg

SEQ ID NO: 868123 - RNA, 22 nt, Human
cuugcaggauuuugcugcugua

SEQ ID NO: 868124 - RNA, 22 nt, Human
cccuuagcucaauuucuugccc

SEQ ID NO: 868125 - RNA, 22 nt, Human
agucccuguacuuuccacugcc

SEQ ID NO: 868126 - RNA, 20 nt, Human
cugagagucugugcuuaguc

SEQ ID NO: 868127 - RNA, 22 nt, Human
uuaguuuucccaucuuuauggu

SEQ ID NO: 868128 - RNA, 22 nt, Human
uugaacaguccuaagagacccu

SEQ ID NO: 868129 - RNA, 22 nt, Human
uuggaucagaugauaucuuugu

SEQ ID NO: 868130 - RNA, 22 nt, Human
uuaacacuugaacucuacaugu

SEQ ID NO: 868131 - RNA, 22 nt, Human
cagaggcauacucccagucuug

SEQ ID NO: 868132 - RNA, 22 nt, Human
cuagccaugggcauuaaaggua

SEQ ID NO: 868133 - RNA, 22 nt, Human
gggcagcuccuguggaauccac

SEQ ID NO: 868134 - RNA, 19 nt, Human
uucuccaggcugcagaggg

SEQ ID NO: 868135 - RNA, 19 nt, Human
aggguggcaaaggagggug

SEQ ID NO: 868136 - RNA, 22 nt, Human
uuuccaaauaaggucacauucu

SEQ ID NO: 868137 - RNA, 22 nt, Human
guccaugauucugugacacccu

SEQ ID NO: 868138 - RNA, 22 nt, Human
uggaauaaagugcuuugaucag

SEQ ID NO: 868139 - RNA, 22 nt, Human
uccaggaggugaggggaccaaa

SEQ ID NO: 868140 - RNA, 22 nt, Human
aaaauacuguggaguguugaaa

SEQ ID NO: 868141 - RNA, 22 nt, Human
gguuuaauggagauauuucaga

SEQ ID NO: 868142 - RNA, 21 nt, Human
uucaaaaugguguguuugucu

SEQ ID NO: 868143 - RNA, 22 nt, Human
aaggcagcaggauuuggugacu

SEQ ID NO: 868144 - RNA, 22 nt, Human
uauacuuuccugcaacuuugau

SEQ ID NO: 868145 - RNA, 22 nt, Human
cagcagagcugggcuuugaauu

SEQ ID NO: 868146 - RNA, 22 nt, Human
ucaguucugcuagaaaaacagu

SEQ ID NO: 868147 - RNA, 22 nt, Human
cguauacaugaagacauugcug

SEQ ID NO: 868148 - RNA, 22 nt, Human
uggcuuuaggagcuauauaccu

SEQ ID NO: 868149 - RNA, 22 nt, Human
uuaauauguugaaauuuauuag

SEQ ID NO: 868150 - RNA, 22 nt, Human
uagcccagaagagggaagcaac

SEQ ID NO: 868151 - RNA, 22 nt, Human
aagauauagauggugguauaaa

SEQ ID NO: 868152 - RNA, 22 nt, Human
aaugggauaggucuucaggaau

SEQ ID NO: 868153 - RNA, 21 nt, Human
cccaggaguccuauuuaaaug

SEQ ID NO: 868154 - RNA, 22 nt, Human
cagugauggauauggagaaguc

SEQ ID NO: 868155 - RNA, 22 nt, Human
uuaaauuuuagaaacagacucu

SEQ ID NO: 868156 - RNA, 22 nt, Human
aggcagcucuguggccucccag

SEQ ID NO: 868157 - RNA, 21 nt, Human
uggaggaauaaagcacagaag

SEQ ID NO: 868158 - RNA, 22 nt, Human
uauacagaacugcacgugcacg

SEQ ID NO: 868159 - RNA, 22 nt, Human
cauuugcagagggugacacucu

SEQ ID NO: 868160 - RNA, 22 nt, Human
cucuucuugaaagaggaauuca

SEQ ID NO: 868161 - RNA, 22 nt, Human
gcagagaacccagcagauuggc

SEQ ID NO: 868162 - RNA, 22 nt, Human
uccaggagggauugggcugugg

SEQ ID NO: 868163 - RNA, 22 nt, Human
ccaggagagcucuaaauggcug

SEQ ID NO: 868164 - RNA, 22 nt, Human
gaagcagcgaaguggaagggac

SEQ ID NO: 868165 - RNA, 20 nt, Human
uacagaaugcaauaaaaugg

SEQ ID NO: 868166 - RNA, 22 nt, Human
cuagccugggauuugaacuuau

SEQ ID NO: 868167 - RNA, 22 nt, Human
ccuuuaauuuacaauguuaauu

SEQ ID NO: 868168 - RNA, 22 nt, Human
ugguuuugcuaaaauagaaaga

SEQ ID NO: 868169 - RNA, 22 nt, Human
uucaggauaguggugaguggca

SEQ ID NO: 868170 - RNA, 22 nt, Human
ccauuguaaauucuguggaagu

SEQ ID NO: 868171 - RNA, 22 nt, Human
aggcagcuuuaacugguaguag

SEQ ID NO: 868172 - RNA, 22 nt, Human
caggaggggguggaguuucgcc

SEQ ID NO: 868173 - RNA, 22 nt, Human
aaucaguguggugacuugucug

SEQ ID NO: 868174 - RNA, 22 nt, Human
cuuaauuacuguccaauaugca

SEQ ID NO: 868175 - RNA, 22 nt, Human
auggcuuaugguaaauauuucu

SEQ ID NO: 868176 - RNA, 22 nt, Human
gauauuuugagaaauccuauga

SEQ ID NO: 868177 - RNA, 22 nt, Human
uuuaaaaucagaugggaguugg

SEQ ID NO: 868178 - RNA, 22 nt, Human
uacacauguuuggcaaguaugu

SEQ ID NO: 868179 - RNA, 22 nt, Human
ugaaacuaggccaaucaaauua

SEQ ID NO: 868180 - RNA, 22 nt, Human
gcaaauauucaagacuuuucca

SEQ ID NO: 868181 - RNA, 22 nt, Human
ucaucucaaaacccaaggggca

SEQ ID NO: 868182 - RNA, 22 nt, Human
cuugcugggguaagucugugcu

SEQ ID NO: 868183 - RNA, 22 nt, Human
ucaugcuuauugcauauuugga

SEQ ID NO: 868184 - RNA, 22 nt, Human
ucugucucaaguucuugcacuc

SEQ ID NO: 868185 - RNA, 22 nt, Human
uaauuauaacaguuacaucuua

SEQ ID NO: 868186 - RNA, 22 nt, Human
uuuauucaucaucuguucauau

SEQ ID NO: 868187 - RNA, 22 nt, Human
uugauagguuuuauguauaguu

SEQ ID NO: 868188 - RNA, 22 nt, Human
cuauacagagcauccuuaacuu

SEQ ID NO: 868189 - RNA, 22 nt, Human
gaggaacccagcugggguugcc

SEQ ID NO: 868190 - RNA, 22 nt, Human
aagacugucuuuucugagugac

SEQ ID NO: 868191 - RNA, 23 nt, Human
ggagugcaauggcgccaucucgg

SEQ ID NO: 868192 - RNA, 22 nt, Human
aguccuuaugugguggagagag

SEQ ID NO: 868193 - RNA, 22 nt, Human
acauuuaaccaaacuguuuaau

SEQ ID NO: 868194 - RNA, 22 nt, Human
cuacccagauccaggauggcua

SEQ ID NO: 868195 - RNA, 19 nt, Human
ccauggagagagaugcauu

SEQ ID NO: 868196 - RNA, 22 nt, Human
gcucacugcaaccucugcuucc

SEQ ID NO: 868197 - RNA, 22 nt, Human
guuauauauaguauuucucuga

SEQ ID NO: 868198 - RNA, 22 nt, Human
ucugcugugauuugcuaccugu

SEQ ID NO: 868199 - RNA, 22 nt, Human
aaauacugggcucaaaaggguu

SEQ ID NO: 868200 - RNA, 22 nt, Human
ugcuggcuacauuauugcuguc

SEQ ID NO: 868201 - RNA, 22 nt, Human
aguucacagccauguucaugug

SEQ ID NO: 868202 - RNA, 22 nt, Human
cagcuggcgggcagagccgcca

SEQ ID NO: 868203 - RNA, 22 nt, Human
cuggcuuucuauuuggugcuau

SEQ ID NO: 868204 - RNA, 22 nt, Human
uaucagaaagauauuacugggg

SEQ ID NO: 868205 - RNA, 22 nt, Human
ugaagaauaagauagauggagc

SEQ ID NO: 868206 - RNA, 22 nt, Human
uucucagauccaucagaagucc

SEQ ID NO: 868207 - RNA, 22 nt, Human
ggaggaggcggcagaaguuccu

SEQ ID NO: 868208 - RNA, 22 nt, Human
auguauuucuauguagugaaga

SEQ ID NO: 868209 - RNA, 22 nt, Human
ucucgacagccuggcacagugg

SEQ ID NO: 868210 - RNA, 22 nt, Human
cuggcuuucucugugguguuca

SEQ ID NO: 868211 - RNA, 22 nt, Human
aauaucagcacuuuugugguau

SEQ ID NO: 868212 - RNA, 22 nt, Human
ccauccugcauugcuauucaga

SEQ ID NO: 868213 - RNA, 22 nt, Human
cuggcaaguacugggccagcuc

SEQ ID NO: 868214 - RNA, 21 nt, Human
uaauaauuccacuacagagua

SEQ ID NO: 868215 - RNA, 22 nt, Human
uugaauaguuuuggauagcaua

SEQ ID NO: 868216 - RNA, 22 nt, Human
uuuaggcaauagauggcagugu

SEQ ID NO: 868217 - RNA, 23 nt, Human
ugcaugugaauucauacuuguuu

SEQ ID NO: 868218 - RNA, 22 nt, Human
uaggagagcugaacuauugucu

SEQ ID NO: 868219 - RNA, 21 nt, Human
acagucuccccagaucucucc

SEQ ID NO: 868220 - RNA, 22 nt, Human
ugaauaauuaugggaguccuaa

SEQ ID NO: 868221 - RNA, 22 nt, Human
ugaaacaagauccacagacuug

SEQ ID NO: 868222 - RNA, 22 nt, Human
gugaauaaaacaccugccaaga

SEQ ID NO: 868223 - RNA, 22 nt, Human
uucaacuagauuuauacaauuc

SEQ ID NO: 868224 - RNA, 22 nt, Human
uaguccuuuaucaaacauuuau

SEQ ID NO: 868225 - RNA, 22 nt, Human
ugguuuuagaugccuuuacugc

SEQ ID NO: 868226 - RNA, 22 nt, Human
ugcuuucaaaggcuuucuagau

SEQ ID NO: 868227 - RNA, 22 nt, Human
ugaggcaggagaaucacaugaa

SEQ ID NO: 868228 - RNA, 22 nt, Human
cuuuggcaaggguuuuaauugu

SEQ ID NO: 868229 - RNA, 22 nt, Human
gcuggauccugauucgucuuug

SEQ ID NO: 868230 - RNA, 22 nt, Human
aaaacaguuuaggcaucacagu

SEQ ID NO: 868231 - RNA, 22 nt, Human
cccaggaggcagagguuggagc

SEQ ID NO: 868232 - RNA, 22 nt, Human
auauuaaauggauuuugggagc

SEQ ID NO: 868233 - RNA, 22 nt, Human
cuuugaauuccaguacaauaac

SEQ ID NO: 868234 - RNA, 22 nt, Human
uguuuuuaaauaaugauagaaa

SEQ ID NO: 868235 - RNA, 22 nt, Human
caagauggacauaaggagagaa

SEQ ID NO: 868236 - RNA, 21 nt, Human
uuugaaagcuacaucuauagc

SEQ ID NO: 868237 - RNA, 22 nt, Human
auguuucaccagcaaauuaccu

SEQ ID NO: 868238 - RNA, 22 nt, Human
ucauuucaaguucugacagcua

SEQ ID NO: 868239 - RNA, 22 nt, Human
ugaaguuauauauguugaaaau

SEQ ID NO: 868240 - RNA, 22 nt, Human
agggcagcucucaccucuggcc

SEQ ID NO: 868241 - RNA, 22 nt, Human
gaucauuuacuuguucuggacu

SEQ ID NO: 868242 - RNA, 22 nt, Human
cauucucaauaguagaugagua

SEQ ID NO: 868243 - RNA, 22 nt, Human
uucacagagagaacucaaacca

SEQ ID NO: 868244 - RNA, 22 nt, Human
augaauaaacaggugccucuuc

SEQ ID NO: 868245 - RNA, 22 nt, Human
uuuaaugaauaauucaaaucug

SEQ ID NO: 868246 - RNA, 20 nt, Human
agagcagcaguuggugaggu

SEQ ID NO: 868247 - RNA, 19 nt, Human
uggcaggcccaggauggac

SEQ ID NO: 868248 - RNA, 22 nt, Human
uuugaaaggaauuaggaugaca

SEQ ID NO: 868249 - RNA, 22 nt, Human
uuccuuagugccucuuccgcug

SEQ ID NO: 868250 - RNA, 19 nt, Human
accaggaguaucagagcug

SEQ ID NO: 868251 - RNA, 22 nt, Human
ucauuauccuaguaucuugaau

SEQ ID NO: 868252 - RNA, 22 nt, Human
ugucugugaccucuuuggagcc

SEQ ID NO: 868253 - RNA, 22 nt, Human
aagcagaggaccgacggaggga

SEQ ID NO: 868254 - RNA, 22 nt, Human
uuagaaaugucacagaucugau

SEQ ID NO: 868255 - RNA, 22 nt, Human
caaggccacguucugcaugcgg

SEQ ID NO: 868256 - RNA, 22 nt, Human
caguccuuagauuuuacugcca

SEQ ID NO: 868257 - RNA, 22 nt, Human
caaguccucgcuucuagcugug

SEQ ID NO: 868258 - RNA, 22 nt, Human
uuuaggcagcuacauacuaacu

SEQ ID NO: 868259 - RNA, 23 nt, Human
uucauuugucuacuucacuuguu

SEQ ID NO: 868260 - RNA, 21 nt, Human
ucacaucuauguuaagcaaac

SEQ ID NO: 868261 - RNA, 22 nt, Human
cuugaaagcacuuaguaaauua

SEQ ID NO: 868262 - RNA, 22 nt, Human
ggagaggacauggcucccacag

SEQ ID NO: 868263 - RNA, 18 nt, Human
aguaaagcuuauuacaug

SEQ ID NO: 868264 - RNA, 23 nt, Human
cauuucaacgaauuuuccuucug

SEQ ID NO: 868265 - RNA, 23 nt, Human
gaggcacucaggaaaugugagug

SEQ ID NO: 868266 - RNA, 22 nt, Human
aauuccagcuaggaaaagcuuc

SEQ ID NO: 868267 - RNA, 22 nt, Human
uagaaacaucagcuaaccaaaa

SEQ ID NO: 868268 - RNA, 22 nt, Human
agucucuuccuucaaggcuggu

SEQ ID NO: 868269 - RNA, 22 nt, Human
agauggcagggguaccuggaag

SEQ ID NO: 868270 - RNA, 21 nt, Human
agggagcuggccacacagccu

SEQ ID NO: 868271 - RNA, 22 nt, Human
ugcuuaauacguauuugcugga

SEQ ID NO: 868272 - RNA, 22 nt, Human
ucaggagacauucuuaaaguag

SEQ ID NO: 868273 - RNA, 22 nt, Human
ugccaggagucaggccaggcag

SEQ ID NO: 868274 - RNA, 22 nt, Human
aucagaaaguucaucauguuug

SEQ ID NO: 868275 - RNA, 22 nt, Human
agcagagguuuguuggaaaccu

SEQ ID NO: 868276 - RNA, 22 nt, Human
ucacccuugauaauguucuucu

SEQ ID NO: 868277 - RNA, 21 nt, Human
uugaaaguaaauucagcagcu

SEQ ID NO: 868278 - RNA, 22 nt, Human
ggcagcuuccuaggagagggca

SEQ ID NO: 868279 - RNA, 22 nt, Human
aauuucaagucuugaagaagua

SEQ ID NO: 868280 - RNA, 22 nt, Human
ggaggggagucucccaaagccg

SEQ ID NO: 868281 - RNA, 22 nt, Human
auuaaagaaacccagcauguga

SEQ ID NO: 868282 - RNA, 22 nt, Human
augaaauaucuugaagaaauuc

SEQ ID NO: 868283 - RNA, 22 nt, Human
guugaaaguagaugcuauuugg

SEQ ID NO: 868284 - RNA, 22 nt, Human
ggcagaggagcuggaaacaugg

SEQ ID NO: 868285 - RNA, 22 nt, Human
ugucucugaggugagggucagc

SEQ ID NO: 868286 - RNA, 22 nt, Human
cuacuucuaaguacauggugau

SEQ ID NO: 868287 - RNA, 22 nt, Human
ugcuuagacgucaaguacagcc

SEQ ID NO: 868288 - RNA, 22 nt, Human
aauuucaaagcucacuggcaua

SEQ ID NO: 868289 - RNA, 22 nt, Human
acuauacagaagaggauaggaa

SEQ ID NO: 868290 - RNA, 22 nt, Human
cuggcuugcagcucaucauaaa

SEQ ID NO: 868291 - RNA, 20 nt, Human
ggcaggcuuuauauggaggg

SEQ ID NO: 868292 - RNA, 22 nt, Human
gcauuuccugugcuuggcauau

SEQ ID NO: 868293 - RNA, 22 nt, Human
ugcuuuaagagauuguuaguac

SEQ ID NO: 868294 - RNA, 22 nt, Human
uggcagcuagauaguguguuua

SEQ ID NO: 868295 - RNA, 22 nt, Human
agucaaaugaguaaauauauaa

SEQ ID NO: 868296 - RNA, 22 nt, Human
ugugugucagagucuccauggu

SEQ ID NO: 868297 - RNA, 22 nt, Human
aaugucugcucuacucaggagg

SEQ ID NO: 868298 - RNA, 22 nt, Human
aaucagaaaauucaguggaauu

SEQ ID NO: 868299 - RNA, 22 nt, Human
aaguauaagcuauucuucauga

SEQ ID NO: 868300 - RNA, 22 nt, Human
gccaggagcaugucauuguuga

SEQ ID NO: 868301 - RNA, 22 nt, Human
aggcagauuacuugaggccagg

SEQ ID NO: 868302 - RNA, 22 nt, Human
acaguggagaaggcaugaggcu

SEQ ID NO: 868303 - RNA, 22 nt, Human
gggcagcuguaucugagcuuau

SEQ ID NO: 868304 - RNA, 22 nt, Human
ucuucacaugaccuucaugucu

SEQ ID NO: 868305 - RNA, 22 nt, Human
aaaggccacacagagcagggag

SEQ ID NO: 868306 - RNA, 22 nt, Human
aggcuucugugagcucauacaa

SEQ ID NO: 868307 - RNA, 20 nt, Human
agaaaaaguguggaaauuuc

SEQ ID NO: 868308 - RNA, 23 nt, Human
uugauuucaaaugcagagaacac

SEQ ID NO: 868309 - RNA, 22 nt, Human
cuaaagaagcuagcaaucuaua

SEQ ID NO: 868310 - RNA, 22 nt, Human
gagagucuaggaaccucauaua

SEQ ID NO: 868311 - RNA, 22 nt, Human
gagucaccuuggccgcuguccc

SEQ ID NO: 868312 - RNA, 22 nt, Human
ucuuagcauuucauaacaacug

SEQ ID NO: 868313 - RNA, 22 nt, Human
uuugaaagaauuuauguacuuu

SEQ ID NO: 868314 - RNA, 22 nt, Human
ggugaaggcacaagagggcaag

SEQ ID NO: 868315 - RNA, 22 nt, Human
uuggcaggaauauugcagaggu

SEQ ID NO: 868316 - RNA, 22 nt, Human
aggaagcugcuggaguagugug

SEQ ID NO: 868317 - RNA, 22 nt, Human
uacuagaaccucacaacaaucc

SEQ ID NO: 868318 - RNA, 22 nt, Human
cauagagugauguaagguaugu

SEQ ID NO: 868319 - RNA, 22 nt, Human
augaaggcuguguagauggaug

SEQ ID NO: 868320 - RNA, 22 nt, Human
uuucccaguucccugcucuaua

SEQ ID NO: 868321 - RNA, 22 nt, Human
auuucacaucuaucucagauuu

SEQ ID NO: 868322 - RNA, 22 nt, Human
agacagcugggaaauggagugu

SEQ ID NO: 868323 - RNA, 22 nt, Human
ucuucaucucagauuaacagga

SEQ ID NO: 868324 - RNA, 22 nt, Human
ggugaguugggguucacagguc

SEQ ID NO: 868325 - RNA, 22 nt, Human
ucucaggaagauuagggcuaag

SEQ ID NO: 868326 - RNA, 22 nt, Human
aauauuaucaaaagcuuuuuca

SEQ ID NO: 868327 - RNA, 19 nt, Human
uucacaauuaugaaauuag

SEQ ID NO: 868328 - RNA, 22 nt, Human
uuuacuuuugguaaggucauuu

SEQ ID NO: 868329 - RNA, 22 nt, Human
uuaaagggccgauuuccaggcc

SEQ ID NO: 868330 - RNA, 22 nt, Human
ucaccgucgggggucgcugucu

SEQ ID NO: 868331 - RNA, 22 nt, Human
uguauguugggucaaaguacau

SEQ ID NO: 868332 - RNA, 22 nt, Human
uggauuuaauggaugaggggca

SEQ ID NO: 868333 - RNA, 21 nt, Human
ucucugguuggaguugugcca

SEQ ID NO: 868334 - RNA, 22 nt, Human
gcaacuuuagaaaaaucuauaa

SEQ ID NO: 868335 - RNA, 22 nt, Human
auggcuuugaaguaauguaauu

SEQ ID NO: 868336 - RNA, 22 nt, Human
auuuuacuacuccaauuaauga

SEQ ID NO: 868337 - RNA, 22 nt, Human
augguuuugaagggaggucaaa

SEQ ID NO: 868338 - RNA, 23 nt, Human
uggcagcuguguaagagaaagca

SEQ ID NO: 868339 - RNA, 22 nt, Human
agcccagguucuaaagccaaac

SEQ ID NO: 868340 - RNA, 22 nt, Human
auggaaagugcauggaagucau

SEQ ID NO: 868341 - RNA, 22 nt, Human
auucuucacuguuucagaauga

SEQ ID NO: 868342 - RNA, 22 nt, Human
gggcagcugucuugguucucaa

SEQ ID NO: 868343 - RNA, 18 nt, Human
cgaggcaggcggaucacg

SEQ ID NO: 868344 - RNA, 22 nt, Human
aaggacagggaugguugauugu

SEQ ID NO: 868345 - RNA, 18 nt, Human
agucuucugauccauuuu

SEQ ID NO: 868346 - RNA, 22 nt, Human
aggaggggcauagaaauguaau

SEQ ID NO: 868347 - RNA, 21 nt, Human
agccuguugguuuacugcuca

SEQ ID NO: 868348 - RNA, 22 nt, Human
cagucucagaggugggaguggg

SEQ ID NO: 868349 - RNA, 21 nt, Human
ucauuugugaucugauuucca

SEQ ID NO: 868350 - RNA, 22 nt, Human
cccaaggacacgggcagggaca

SEQ ID NO: 868351 - RNA, 19 nt, Human
uccaggagcaaagccaguu

SEQ ID NO: 868352 - RNA, 22 nt, Human
uugaauaauguguauguuguua

SEQ ID NO: 868353 - RNA, 22 nt, Human
cuggcugggagcgagcugcuca

SEQ ID NO: 868354 - RNA, 22 nt, Human
augacaguucuacacuuaaucu

SEQ ID NO: 868355 - RNA, 22 nt, Human
aauuccagaggaggacaguccu

SEQ ID NO: 868356 - RNA, 22 nt, Human
ucccaggaucugagggcagaga

SEQ ID NO: 868357 - RNA, 22 nt, Human
aggaaacuccccuacaucucaa

SEQ ID NO: 868358 - RNA, 22 nt, Human
gaaguccucaaugcauugucuu

SEQ ID NO: 868359 - RNA, 22 nt, Human
augcuuuuaugucacaugguca

SEQ ID NO: 868360 - RNA, 22 nt, Human
caucagaacaaaucgguuaaga

SEQ ID NO: 868361 - RNA, 22 nt, Human
uagaaacagauguuuuugaaga

SEQ ID NO: 868362 - RNA, 22 nt, Human
aaugagacacgugaagcagaug

SEQ ID NO: 868363 - RNA, 22 nt, Human
cucauacauaugccauuccugc

SEQ ID NO: 868364 - RNA, 22 nt, Human
ucaguaaaugaaugaauauaug

SEQ ID NO: 868365 - RNA, 22 nt, Human
acuauacauaaaacauuugggu

SEQ ID NO: 868366 - RNA, 22 nt, Human
ccguagcacaugcuccuggggc

SEQ ID NO: 868367 - RNA, 22 nt, Human
aucaggauguuuggcugucaua

SEQ ID NO: 868368 - RNA, 20 nt, Human
aagcacauuucuacaauaau

SEQ ID NO: 868369 - RNA, 22 nt, Human
cucaggauugugccuagggaga

SEQ ID NO: 868370 - RNA, 22 nt, Human
ugucuuuggaauauuuagcuga

SEQ ID NO: 868371 - RNA, 22 nt, Human
aaguuucaugauguaauuauug

SEQ ID NO: 868372 - RNA, 22 nt, Human
ucuauacaaguuucacuuugac

SEQ ID NO: 868373 - RNA, 22 nt, Human
agucucugcaugccugcugugc

SEQ ID NO: 868374 - RNA, 22 nt, Human
ggacagcucugccaggagcuca

SEQ ID NO: 868375 - RNA, 22 nt, Human
ccucaggauacaggagccacag

SEQ ID NO: 868376 - RNA, 22 nt, Human
gaggcugcccaacuggagugga

SEQ ID NO: 868377 - RNA, 22 nt, Human
uuacagaagagaaagaauucag

SEQ ID NO: 868378 - RNA, 22 nt, Human
aauauaaugcuguuuuaugcca

SEQ ID NO: 868379 - RNA, 22 nt, Human
acaacuuuucuaucauguggaa

SEQ ID NO: 868380 - RNA, 22 nt, Human
uuucagacaggacuucauaugu

SEQ ID NO: 868381 - RNA, 22 nt, Human
cauuuguuuagaagucuuuaua

SEQ ID NO: 868382 - RNA, 22 nt, Human
uauagccauuuccaguggcauc

SEQ ID NO: 868383 - RNA, 22 nt, Human
caucauaaaauugagauaacug

SEQ ID NO: 868384 - RNA, 22 nt, Human
uggaaagcgaggaguuggcauu

SEQ ID NO: 868385 - RNA, 22 nt, Human
ucucacuuuccagacuuuucaa

SEQ ID NO: 868386 - RNA, 22 nt, Human
ucauaaaaugcuccugauauug

SEQ ID NO: 868387 - RNA, 22 nt, Human
aaacauuugcaacucgguuugg

SEQ ID NO: 868388 - RNA, 22 nt, Human
aaucagugguucccagcccagg

SEQ ID NO: 868389 - RNA, 22 nt, Human
uaucuguuguccaugcagaaag

SEQ ID NO: 868390 - RNA, 22 nt, Human
uguacaaucuuggucccuuuau

SEQ ID NO: 868391 - RNA, 22 nt, Human
gcaagcugaugugauagugaaa

SEQ ID NO: 868392 - RNA, 22 nt, Human
ucugggaagcugcgugccuguu

SEQ ID NO: 868393 - RNA, 22 nt, Human
uuauccaagcagaagcugcaca

SEQ ID NO: 868394 - RNA, 22 nt, Human
uaucuguugucuuuuacaugua

SEQ ID NO: 868395 - RNA, 22 nt, Human
gccugcagauauauaggauggu

SEQ ID NO: 868396 - RNA, 22 nt, Human
guuuucaaggggauuuaacuga

SEQ ID NO: 868397 - RNA, 22 nt, Human
acauuucuaguuguucaucucc

SEQ ID NO: 868398 - RNA, 21 nt, Human
uccagaaaagaggucauuagc

SEQ ID NO: 868399 - RNA, 22 nt, Human
gagggcauaguuaaauaggagg

SEQ ID NO: 868400 - RNA, 22 nt, Human
cauuuguaggaugcuucuuguu

SEQ ID NO: 868401 - RNA, 22 nt, Human
aaugucugagucucuguauccc

SEQ ID NO: 868402 - RNA, 22 nt, Human
cacaauuuguuuuaucaguauu

SEQ ID NO: 868403 - RNA, 22 nt, Human
cccaggaggcggagguuguggu

SEQ ID NO: 868404 - RNA, 22 nt, Human
aagugagugguaaggagcaugg

SEQ ID NO: 868405 - RNA, 22 nt, Human
auuucaaggcuauuaauauaaa

SEQ ID NO: 868406 - RNA, 22 nt, Human
uaaucuacuguuuauaugaaau

SEQ ID NO: 868407 - RNA, 22 nt, Human
aaugcaaagcaagcagagauuu

SEQ ID NO: 868408 - RNA, 22 nt, Human
ugcuguguggaugugaagaauc

SEQ ID NO: 868409 - RNA, 22 nt, Human
aauggccagcugggagaguuga

SEQ ID NO: 868410 - RNA, 22 nt, Human
ccaagaugaucuuuacaguguu

SEQ ID NO: 868411 - RNA, 22 nt, Human
gaggcagcuuggggcugugggu

SEQ ID NO: 868412 - RNA, 22 nt, Human
aaaauugaggcucauguuaaau

SEQ ID NO: 868413 - RNA, 22 nt, Human
uuauuugcccauguuuagcaga

SEQ ID NO: 868414 - RNA, 22 nt, Human
agugugagcccuggaguggugc

SEQ ID NO: 868415 - RNA, 21 nt, Human
caaguccuuugccaaagugcu

SEQ ID NO: 868416 - RNA, 22 nt, Human
uaacauguuaagaaauuagaua

SEQ ID NO: 868417 - RNA, 22 nt, Human
cuucucaaaguugugaaucagg

SEQ ID NO: 868418 - RNA, 22 nt, Human
ucauagaagcaccagaagauau

SEQ ID NO: 868419 - RNA, 22 nt, Human
cucaggaugcaggucacaggac

SEQ ID NO: 868420 - RNA, 22 nt, Human
auauaggcuaacaacuauugag

SEQ ID NO: 868421 - RNA, 19 nt, Human
uucccaggaaaggggugca

SEQ ID NO: 868422 - RNA, 22 nt, Human
uucuucaguguagcaacuguau

SEQ ID NO: 868423 - RNA, 22 nt, Human
cccaggaaaucaggcuuucuag

SEQ ID NO: 868424 - RNA, 22 nt, Human
acauaauaggugccugaauauu

SEQ ID NO: 868425 - RNA, 17 nt, Human
gcugacccuggagaagu

SEQ ID NO: 868426 - RNA, 22 nt, Human
gcugauguaagacuuuugguuu

SEQ ID NO: 868427 - RNA, 22 nt, Human
cugcuuuggacaacuauucuug

SEQ ID NO: 868428 - RNA, 22 nt, Human
ggaggaugccaagcugugcaca

SEQ ID NO: 868429 - RNA, 19 nt, Human
uuccaaaaucaggauuuga

SEQ ID NO: 868430 - RNA, 22 nt, Human
ugguuuaaccugucucuuauua

SEQ ID NO: 868431 - RNA, 22 nt, Human
ugaaaugaaugugauucgauag

SEQ ID NO: 868432 - RNA, 22 nt, Human
uccaggaguuugaccugugggc

SEQ ID NO: 868433 - RNA, 22 nt, Human
uucaggauucugugucugacaa

SEQ ID NO: 868434 - RNA, 22 nt, Human
uuuccaaacccagcgagcuaca

SEQ ID NO: 868435 - RNA, 22 nt, Human
aaacuuuguucgucugaugugg

SEQ ID NO: 868436 - RNA, 22 nt, Human
cauuucaaaagaauugccagaa

SEQ ID NO: 868437 - RNA, 22 nt, Human
aaaaagguugauccagauuagg

SEQ ID NO: 868438 - RNA, 22 nt, Human
ucauuucucccggccaaaaacu

SEQ ID NO: 868439 - RNA, 22 nt, Human
uaucuguuggcuccuaguugua

SEQ ID NO: 868440 - RNA, 21 nt, Human
agaauaaugguaucauuugcu

SEQ ID NO: 868441 - RNA, 22 nt, Human
acaaaauuaccuaguuauuuuc

SEQ ID NO: 868442 - RNA, 22 nt, Human
cugcuguguaucauuuuagaug

SEQ ID NO: 868443 - RNA, 22 nt, Human
uucaggauuauacucucuuccc

SEQ ID NO: 868444 - RNA, 22 nt, Human
aaaggugacugcagcagcuauu

SEQ ID NO: 868445 - RNA, 22 nt, Human
aaauggauggaaagcaauuuuu

SEQ ID NO: 868446 - RNA, 22 nt, Human
gaggcagugcauugucuagggg

SEQ ID NO: 868447 - RNA, 22 nt, Human
uuuuucagccaugaauuacacu

SEQ ID NO: 868448 - RNA, 22 nt, Human
auuucaacagaguuugaaggca

SEQ ID NO: 868449 - RNA, 22 nt, Human
caguggagagacuuuuacucuu

SEQ ID NO: 868450 - RNA, 22 nt, Human
acaacuuucuggguuaucugau

SEQ ID NO: 868451 - RNA, 22 nt, Human
augguauugcaacaacugucau

SEQ ID NO: 868452 - RNA, 22 nt, Human
ugaaaugagauagauaaucagg

SEQ ID NO: 868453 - RNA, 22 nt, Human
gaaaaaggauaaauacaguguu

SEQ ID NO: 868454 - RNA, 22 nt, Human
caguaaaugcagauauagauac

SEQ ID NO: 868455 - RNA, 22 nt, Human
aggacagcccuugagagcacau

SEQ ID NO: 868456 - RNA, 22 nt, Human
aggaaaggccuuugcauuuggu

SEQ ID NO: 868457 - RNA, 22 nt, Human
gcuauacagcaggagaauggaa

SEQ ID NO: 868458 - RNA, 17 nt, Human
caagagagaugacugga

SEQ ID NO: 868459 - RNA, 22 nt, Human
ugcuugaaagggguuucccagu

SEQ ID NO: 868460 - RNA, 22 nt, Human
ugaaggcccagccacagaaugg

SEQ ID NO: 868461 - RNA, 22 nt, Human
gugcuuucugcugcauuccucu

SEQ ID NO: 868462 - RNA, 22 nt, Human
gucuccugagacugcagucacc

SEQ ID NO: 868463 - RNA, 22 nt, Human
aaguuacacauuuucauuguaa

SEQ ID NO: 868464 - RNA, 22 nt, Human
cagcugccccuccagggcuggg

SEQ ID NO: 868465 - RNA, 22 nt, Human
uaucagaaaucaacacacagug

SEQ ID NO: 868466 - RNA, 22 nt, Human
uuucuuguaagauguuuauuaa

SEQ ID NO: 868467 - RNA, 23 nt, Human
agaauuccaguuucuuaugucac

SEQ ID NO: 868468 - RNA, 22 nt, Human
uuaaauauuauguugucugcaa

SEQ ID NO: 868469 - RNA, 22 nt, Human
auuucacucauucauguuacuu

SEQ ID NO: 868470 - RNA, 22 nt, Human
ccaggcugcagucaaggggcau

SEQ ID NO: 868471 - RNA, 22 nt, Human
gaggauggaggugugagcuaug

SEQ ID NO: 868472 - RNA, 22 nt, Human
uacugcauaacuggcauguggg

SEQ ID NO: 868473 - RNA, 22 nt, Human
ggaucugauuaauaagguggac

SEQ ID NO: 868474 - RNA, 19 nt, Human
aaagcagaggagcaucuga

SEQ ID NO: 868475 - RNA, 22 nt, Human
aggcaggcacuccggaaguguc

SEQ ID NO: 868476 - RNA, 22 nt, Human
uucauacuguguuuccaaguuu

SEQ ID NO: 868477 - RNA, 22 nt, Human
caaggccaguucaccaagggca

SEQ ID NO: 868478 - RNA, 22 nt, Human
gaggcacugcaguacagugacu

SEQ ID NO: 868479 - RNA, 22 nt, Human
uucucugagauagacuaagugg

SEQ ID NO: 868480 - RNA, 22 nt, Human
ugcuuuaaaauggacuguuuug

SEQ ID NO: 868481 - RNA, 22 nt, Human
uuacagaaaggaaggacugacu

SEQ ID NO: 868482 - RNA, 22 nt, Human
gcagcugcagacccucagugcu

SEQ ID NO: 868483 - RNA, 22 nt, Human
ugcacagugaccccuggugacu

SEQ ID NO: 868484 - RNA, 22 nt, Human
ccagaggaaaaauaucucccua

SEQ ID NO: 868485 - RNA, 20 nt, Human
gaaguccuuucacucuuccc

SEQ ID NO: 868486 - RNA, 22 nt, Human
uaggcagcugcaaacuucgguc

SEQ ID NO: 868487 - RNA, 22 nt, Human
guuccaaagcaaaggaggugag

SEQ ID NO: 868488 - RNA, 22 nt, Human
aagucacccacaggcagcagaa

SEQ ID NO: 868489 - RNA, 22 nt, Human
auaaauaucacuguugucccuc

SEQ ID NO: 868490 - RNA, 22 nt, Human
gauggcagucaaccaggugagg

SEQ ID NO: 868491 - RNA, 22 nt, Human
caagaugggcaccccagcaccu

SEQ ID NO: 868492 - RNA, 21 nt, Human
auuucagagcacacaaguaaa

SEQ ID NO: 868493 - RNA, 22 nt, Human
aggguagggcccggagacagac

SEQ ID NO: 868494 - RNA, 22 nt, Human
uaagaaucggucgcaacagagg

SEQ ID NO: 868495 - RNA, 22 nt, Human
ugggagcccaagggagcugccg

SEQ ID NO: 868496 - RNA, 22 nt, Human
agcugcccuuuaugaugcugaa

SEQ ID NO: 868497 - RNA, 22 nt, Human
guacagaaauggggccccaggu

SEQ ID NO: 868498 - RNA, 22 nt, Human
aggaugaggcuggcaggucuug

SEQ ID NO: 868499 - RNA, 22 nt, Human
caaggccacugcucagguuucc

SEQ ID NO: 868500 - RNA, 22 nt, Human
cccaggaguuugaguucagcau

SEQ ID NO: 868501 - RNA, 22 nt, Human
ccaggagagcucucguucagug

SEQ ID NO: 868502 - RNA, 22 nt, Human
uguacaaugccagggaacacca

SEQ ID NO: 868503 - RNA, 22 nt, Human
auguucuguuuuguaauucaua

SEQ ID NO: 868504 - RNA, 22 nt, Human
uuccuuagcagaccugguaucc

SEQ ID NO: 868505 - RNA, 22 nt, Human
cagaaccaggaacugauggaga

SEQ ID NO: 868506 - RNA, 19 nt, Human
uggagacugagagugagca

SEQ ID NO: 868507 - RNA, 22 nt, Human
aggggaugauccucccgcagcg

SEQ ID NO: 868508 - RNA, 22 nt, Human
cacagcauaaugaaauauacuu

SEQ ID NO: 868509 - RNA, 22 nt, Human
ccuggagauuucuucaagcuuu

SEQ ID NO: 868510 - RNA, 22 nt, Human
cugaauaauguucucuuguaug

SEQ ID NO: 868511 - RNA, 22 nt, Human
acaauuccacauggcaugcagg

SEQ ID NO: 868512 - RNA, 22 nt, Human
cagguaaaaauaaauuugugag

SEQ ID NO: 868513 - RNA, 22 nt, Human
cuccuuagugccucugcacgag

SEQ ID NO: 868514 - RNA, 17 nt, Human
uuugaaaggaugucagu

SEQ ID NO: 868515 - RNA, 22 nt, Human
uugcaggauuuuagagaugaca

SEQ ID NO: 868516 - RNA, 22 nt, Human
ggaggccagggacccagucagc

SEQ ID NO: 868517 - RNA, 22 nt, Human
aagacugugucuauggcuacuc

SEQ ID NO: 868518 - RNA, 22 nt, Human
uuaacacuaucugucauaauua

SEQ ID NO: 868519 - RNA, 22 nt, Human
ggaguaggaguagaacucauca

SEQ ID NO: 868520 - RNA, 22 nt, Human
aguuugaauugaaaugcagaug

SEQ ID NO: 868521 - RNA, 22 nt, Human
caauuuuuguacuuauaguacu

SEQ ID NO: 868522 - RNA, 22 nt, Human
aggcagcuagagagugaaacug

SEQ ID NO: 868523 - RNA, 22 nt, Human
ugcuguggcaguuuauguauag

SEQ ID NO: 868524 - RNA, 20 nt, Human
aggaggggauagaaucaaag

SEQ ID NO: 868525 - RNA, 19 nt, Human
cucucacucgccacauccu

SEQ ID NO: 868526 - RNA, 22 nt, Human
auaggcuuauauaaaaacaucu

SEQ ID NO: 868527 - RNA, 22 nt, Human
gaccaaggaagaggggagccag

SEQ ID NO: 868528 - RNA, 22 nt, Human
auauucuucuuguucagacuau

SEQ ID NO: 868529 - RNA, 22 nt, Human
cccaggaaugaggggcggaggc

SEQ ID NO: 868530 - RNA, 22 nt, Human
aggugagggugccagugcaugg

SEQ ID NO: 868531 - RNA, 22 nt, Human
uguaacaauuucuuacuauugu

SEQ ID NO: 868532 - RNA, 22 nt, Human
uuuaggcacaacuacucagcua

SEQ ID NO: 868533 - RNA, 22 nt, Human
auaaagauuucuuuuucucuac

SEQ ID NO: 868534 - RNA, 22 nt, Human
auuggcaguuagugacgaggcu

SEQ ID NO: 868535 - RNA, 22 nt, Human
gaguccuuuucauagcaguggg

SEQ ID NO: 868536 - RNA, 22 nt, Human
aggaucugugagugcugcagac

SEQ ID NO: 868537 - RNA, 22 nt, Human
gcccaggauggagaauaguggu

SEQ ID NO: 868538 - RNA, 22 nt, Human
uuccagcaggcagacaggagau

SEQ ID NO: 868539 - RNA, 22 nt, Human
acccaggaggcaagguugcagu

SEQ ID NO: 868540 - RNA, 21 nt, Human
aaauggauagggcaauggaag

SEQ ID NO: 868541 - RNA, 22 nt, Human
ucccaggaugaagacaguguug

SEQ ID NO: 868542 - RNA, 22 nt, Human
gcugucccgcugacuuccagcu

SEQ ID NO: 868543 - RNA, 22 nt, Human
acagaguucccacuccagaagc

SEQ ID NO: 868544 - RNA, 22 nt, Human
agaggggaaggaugugauguga

SEQ ID NO: 868545 - RNA, 22 nt, Human
agagcagcuggggcagagacca

SEQ ID NO: 868546 - RNA, 19 nt, Human
ugcccaggccagguugggc

SEQ ID NO: 868547 - RNA, 22 nt, Human
uuagccauuaauguccugugca

SEQ ID NO: 868548 - RNA, 22 nt, Human
aggcagcuuucuggugcaccau

SEQ ID NO: 868549 - RNA, 22 nt, Human
ucugcugugggucuauauuuua

SEQ ID NO: 868550 - RNA, 22 nt, Human
uggcagcugucagaaugcaaau

SEQ ID NO: 868551 - RNA, 22 nt, Human
aaucaagucaaccaucaugugc

SEQ ID NO: 868552 - RNA, 21 nt, Human
uucuucaguuuaauauaaaau

SEQ ID NO: 868553 - RNA, 22 nt, Human
auauacugauagcugcacuucu

SEQ ID NO: 868554 - RNA, 22 nt, Human
caggauggugugagugugagga

SEQ ID NO: 868555 - RNA, 22 nt, Human
cagagacauucaguaaauuauc

SEQ ID NO: 868556 - RNA, 19 nt, Human
ugaggggcucacagucuca

SEQ ID NO: 868557 - RNA, 22 nt, Human
ugcugcuguuuccuacaucuca

SEQ ID NO: 868558 - RNA, 22 nt, Human
augaggcauuccacucaaacuc

SEQ ID NO: 868559 - RNA, 21 nt, Human
aaugcauuaacauaaagcuga

SEQ ID NO: 868560 - RNA, 22 nt, Human
cugcugugcuuguggccacccg

SEQ ID NO: 868561 - RNA, 22 nt, Human
ugaaauagucuaaaaaaccaga

SEQ ID NO: 868562 - RNA, 22 nt, Human
auuuaguguauucuaauaugug

SEQ ID NO: 868563 - RNA, 22 nt, Human
aagcaauauacugauaugauua

SEQ ID NO: 868564 - RNA, 22 nt, Human
cucuucuugcuagacugagugc

SEQ ID NO: 868565 - RNA, 22 nt, Human
accaggaguugggggugggacc

SEQ ID NO: 868566 - RNA, 22 nt, Human
gugaauaacuuucuauguuaau

SEQ ID NO: 868567 - RNA, 22 nt, Human
ucugucccugagagcucaggag

SEQ ID NO: 868568 - RNA, 22 nt, Human
aucagaaaaacauaauguuauu

SEQ ID NO: 868569 - RNA, 22 nt, Human
uauuucaagaacuucuauccau

SEQ ID NO: 868570 - RNA, 22 nt, Human
auugaaagguuuugagcagaua

SEQ ID NO: 868571 - RNA, 22 nt, Human
auguuacacauaggcauaaaug

SEQ ID NO: 868572 - RNA, 22 nt, Human
uauuucagguauggugugaaau

SEQ ID NO: 868573 - RNA, 22 nt, Human
aagggcagagggaaucccacau

SEQ ID NO: 868574 - RNA, 22 nt, Human
aacuagucagugauucucagaa

SEQ ID NO: 868575 - RNA, 22 nt, Human
caaggccaguuucuccuaguca

SEQ ID NO: 868576 - RNA, 22 nt, Human
aaucuucuuucuuaacaguaca

SEQ ID NO: 868577 - RNA, 22 nt, Human
ucaggagacuggcagugcccac

SEQ ID NO: 868578 - RNA, 19 nt, Human
ugcauaaauuauauacuuu

SEQ ID NO: 868579 - RNA, 20 nt, Human
aggacagcagcugccacuug

SEQ ID NO: 868580 - RNA, 20 nt, Human
ugaaggccagcagcauaggg

SEQ ID NO: 868581 - RNA, 22 nt, Human
aaugaacagauacacauaggca

SEQ ID NO: 868582 - RNA, 18 nt, Human
ugaaacaagaauggugca

SEQ ID NO: 868583 - RNA, 22 nt, Human
caguccagcccccugcuaaaag

SEQ ID NO: 868584 - RNA, 22 nt, Human
ucacagacauggugagguaaca

SEQ ID NO: 868585 - RNA, 22 nt, Human
uggcagcugccauguccacgug

SEQ ID NO: 868586 - RNA, 22 nt, Human
ugcuugugagaguuuuuucaga

SEQ ID NO: 868587 - RNA, 22 nt, Human
caguccuuccuugccccuuggg

SEQ ID NO: 868588 - RNA, 22 nt, Human
caguugccuacuacauggcagg

SEQ ID NO: 868589 - RNA, 22 nt, Human
ucauacacaagagcauguaaca

SEQ ID NO: 868590 - RNA, 22 nt, Human
uucaacucuucaagaucacauc

SEQ ID NO: 868591 - RNA, 21 nt, Human
auggauuuaaacaggccacaa

SEQ ID NO: 868592 - RNA, 22 nt, Human
cccaggaacagcacagaacagc

SEQ ID NO: 868593 - RNA, 22 nt, Human
ucgcugugguuucuguacaugg

SEQ ID NO: 868594 - RNA, 23 nt, Human
uugcuuucaucaugagaugcucc

SEQ ID NO: 868595 - RNA, 22 nt, Human
aagaaaucugauauuuguuuca

SEQ ID NO: 868596 - RNA, 22 nt, Human
auuuccaauuucauccaugucc

SEQ ID NO: 868597 - RNA, 22 nt, Human
ucuuugcaaauguuauuaucuu

SEQ ID NO: 868598 - RNA, 22 nt, Human
uuuaggcagaagcccugcugau

SEQ ID NO: 868599 - RNA, 22 nt, Human
agaccaagugcaggugccacua

SEQ ID NO: 868600 - RNA, 22 nt, Human
cgccucagccguggucaucuuc

SEQ ID NO: 868601 - RNA, 22 nt, Human
uugaauaauauguucaggagga

SEQ ID NO: 868602 - RNA, 20 nt, Human
ugaaggccauuuguuccaga

SEQ ID NO: 868603 - RNA, 22 nt, Human
caaaggcaggcccccugugcag

SEQ ID NO: 868604 - RNA, 22 nt, Human
uuagccauggacugaauugacu

SEQ ID NO: 868605 - RNA, 22 nt, Human
guugaaaguggagaaccugguu

SEQ ID NO: 868606 - RNA, 22 nt, Human
ugaggggagguuggggcacauc

SEQ ID NO: 868607 - RNA, 23 nt, Human
uguugaaguaacuguuacauaga

SEQ ID NO: 868608 - RNA, 20 nt, Human
gccaggagggugugaugagc

SEQ ID NO: 868609 - RNA, 22 nt, Human
cccaggaggcagaaguugcagu

SEQ ID NO: 868610 - RNA, 22 nt, Human
aucaggaugacaacugcugggu

SEQ ID NO: 868611 - RNA, 23 nt, Human
auguauuuaaauuucagugauga

SEQ ID NO: 868612 - RNA, 22 nt, Human
ucugcaggaggcuggcugcagg

SEQ ID NO: 868613 - RNA, 22 nt, Human
ugugauauuugaguauugucaa

SEQ ID NO: 868614 - RNA, 22 nt, Human
cugcugugcaacauugcaccua

SEQ ID NO: 868615 - RNA, 23 nt, Human
aggcagcagguuguccaggguga

SEQ ID NO: 868616 - RNA, 21 nt, Human
agccagucuguuuucuagugc

SEQ ID NO: 868617 - RNA, 22 nt, Human
aggaagcuagagccaccggacu

SEQ ID NO: 868618 - RNA, 22 nt, Human
ccaggagagcaaaggucacucu

SEQ ID NO: 868619 - RNA, 22 nt, Human
cucacuguccaacaggcuuuac

SEQ ID NO: 868620 - RNA, 22 nt, Human
aaucagcuaaauaaacuaguca

SEQ ID NO: 868621 - RNA, 22 nt, Human
uagggauguccugagacuuggc

SEQ ID NO: 868622 - RNA, 22 nt, Human
caguucacacugugcuaucugc

SEQ ID NO: 868623 - RNA, 22 nt, Human
ugaaaugagcauuuauucuuua

SEQ ID NO: 868624 - RNA, 19 nt, Human
uggauuuauauucuuuauc

SEQ ID NO: 868625 - RNA, 22 nt, Human
caacagcugaucuuugaugaag

SEQ ID NO: 868626 - RNA, 22 nt, Human
gaggcagcugggcuggugguuu

SEQ ID NO: 868627 - RNA, 22 nt, Human
aguacauauaguaauuuagcca

SEQ ID NO: 868628 - RNA, 22 nt, Human
gacaguccuugcccaguaucua

SEQ ID NO: 868629 - RNA, 17 nt, Human
ggcagccucaggcguuu

SEQ ID NO: 868630 - RNA, 22 nt, Human
acccaggauaaucuguguaucu

SEQ ID NO: 868631 - RNA, 23 nt, Human
cccagggacacgaugacaccucc

SEQ ID NO: 868632 - RNA, 22 nt, Human
cagugcugggcagaggagagcg

SEQ ID NO: 868633 - RNA, 22 nt, Human
uguguacacagauaguaauggc

SEQ ID NO: 868634 - RNA, 22 nt, Human
uuugcauaggauggacauuuua

SEQ ID NO: 868635 - RNA, 22 nt, Human
uguuuaauaauucuaugauagu

SEQ ID NO: 868636 - RNA, 22 nt, Human
gggacuucauagcuaggcacuu

SEQ ID NO: 868637 - RNA, 22 nt, Human
aagcgccaugguuccugcgcag

SEQ ID NO: 868638 - RNA, 22 nt, Human
augaaaauugacagcggaagua

SEQ ID NO: 868639 - RNA, 22 nt, Human
agagggcagggcgguaaguccu

SEQ ID NO: 868640 - RNA, 22 nt, Human
aggacagcaguuggugagguuc

SEQ ID NO: 868641 - RNA, 22 nt, Human
aucugcuugaaugagcaacagg

SEQ ID NO: 868642 - RNA, 22 nt, Human
ucagauggguuuugaaggaugu

SEQ ID NO: 868643 - RNA, 22 nt, Human
gaggcaguguuuacugcccugu

SEQ ID NO: 868644 - RNA, 22 nt, Human
uagcaucuguucuuucauuaaa

SEQ ID NO: 868645 - RNA, 22 nt, Human
agugagggaugaagaacugcgg

SEQ ID NO: 868646 - RNA, 23 nt, Human
cccauuuucauguuaacuccugg

SEQ ID NO: 868647 - RNA, 22 nt, Human
uugaaaggguuaaagugguaaa

SEQ ID NO: 868648 - RNA, 22 nt, Human
auacaaauuuauagaugcauuu

SEQ ID NO: 868649 - RNA, 22 nt, Human
ugagauguaagguaugcuuacu

SEQ ID NO: 868650 - RNA, 22 nt, Human
uuuacagagagagaacuggacu

SEQ ID NO: 868651 - RNA, 22 nt, Human
caguccuucauuccuccuuuga

SEQ ID NO: 868652 - RNA, 22 nt, Human
uuugcauaaaggagcauuucuc

SEQ ID NO: 868653 - RNA, 22 nt, Human
uguauacaauucacacuuccca

SEQ ID NO: 868654 - RNA, 22 nt, Human
cugaauaauuuucuguuguaug

SEQ ID NO: 868655 - RNA, 22 nt, Human
uuuaucuguuguacauuuaugc

SEQ ID NO: 868656 - RNA, 22 nt, Human
caacuuuucugugaauuuaagu

SEQ ID NO: 868657 - RNA, 22 nt, Human
auggcuuaagaaugcuuuugug

SEQ ID NO: 868658 - RNA, 22 nt, Human
uuauucuuuucuccagaauccc

SEQ ID NO: 868659 - RNA, 22 nt, Human
accaggagguguuugcucaagu

SEQ ID NO: 868660 - RNA, 22 nt, Human
auacauaauuacuuccgauguu

SEQ ID NO: 868661 - RNA, 22 nt, Human
aaggcagcaccgccuccugaaa

SEQ ID NO: 868662 - RNA, 22 nt, Human
aauguauuccucaugcaagagu

SEQ ID NO: 868663 - RNA, 22 nt, Human
ccauaauauuaaaugcuuuugu

SEQ ID NO: 868664 - RNA, 22 nt, Human
uucuucuccgaggagggcuggu

SEQ ID NO: 868665 - RNA, 22 nt, Human
gaccauuuuuacagagcauuca

SEQ ID NO: 868666 - RNA, 22 nt, Human
caggcagcccugcaccaagugu

SEQ ID NO: 868667 - RNA, 20 nt, Human
ucauuucuugggguuccaag

SEQ ID NO: 868668 - RNA, 22 nt, Human
cucaggauuaaggaaucuaaau

SEQ ID NO: 868669 - RNA, 22 nt, Human
gggcagcuagcccucuagccca

SEQ ID NO: 868670 - RNA, 22 nt, Human
agaggggaguccuaaucugauu

SEQ ID NO: 868671 - RNA, 22 nt, Human
cagagauuauuauaacuaauua

SEQ ID NO: 868672 - RNA, 22 nt, Human
aggagaggguggcauuaaguuu

SEQ ID NO: 868673 - RNA, 22 nt, Human
gagggccagcagccucagcaug

SEQ ID NO: 868674 - RNA, 22 nt, Human
gcauguguugguuuaugcaugu

SEQ ID NO: 868675 - RNA, 22 nt, Human
agagagagggaaacugcuaaac

SEQ ID NO: 868676 - RNA, 22 nt, Human
uccaggagagguguggggacug

SEQ ID NO: 868677 - RNA, 22 nt, Human
uuuaacagaugcuaugucuacc

SEQ ID NO: 868678 - RNA, 22 nt, Human
cagauacuguaaaauuucagua

SEQ ID NO: 868679 - RNA, 22 nt, Human
ucuacuguagugaugcugcagu

SEQ ID NO: 868680 - RNA, 22 nt, Human
uuugaaagcuacuuucggguca

SEQ ID NO: 868681 - RNA, 22 nt, Human
agugcuuugagcguuugaaaag

SEQ ID NO: 868682 - RNA, 22 nt, Human
aaggcaguaaaaucuaccuugc

SEQ ID NO: 868683 - RNA, 22 nt, Human
guguuuuaagaaagaagcucag

SEQ ID NO: 868684 - RNA, 22 nt, Human
agagaugaacauaaaacaagga

SEQ ID NO: 868685 - RNA, 22 nt, Human
gagacaggauuuaaccaaagcu

SEQ ID NO: 868686 - RNA, 22 nt, Human
ugaaaugaucaguuugguuacu

SEQ ID NO: 868687 - RNA, 22 nt, Human
uucaugugauaaaugugugacu

SEQ ID NO: 868688 - RNA, 22 nt, Human
auuuccaagaaagcuuuaggau

SEQ ID NO: 868689 - RNA, 22 nt, Human
ucacaguaaaagcauggaagag

SEQ ID NO: 868690 - RNA, 22 nt, Human
auuuaucucuggaaacuaagca

SEQ ID NO: 868691 - RNA, 22 nt, Human
ccuggaucgaugccgagggaaa

SEQ ID NO: 868692 - RNA, 22 nt, Human
ucagcugcucaaauuuauguca

SEQ ID NO: 868693 - RNA, 22 nt, Human
caaggccaagguuuugugaacu

SEQ ID NO: 868694 - RNA, 22 nt, Human
aucuuguuauaagagauaaugg

SEQ ID NO: 868695 - RNA, 22 nt, Human
guucuucaggccauccucccag

SEQ ID NO: 868696 - RNA, 22 nt, Human
ccuggaucuuucugacugacaa

SEQ ID NO: 868697 - RNA, 22 nt, Human
ugaaaugauuauaugguguuug

SEQ ID NO: 868698 - RNA, 22 nt, Human
uucagcaaacacgaugcuuguu

SEQ ID NO: 868699 - RNA, 22 nt, Human
uccucagaaaccccugugaggu

SEQ ID NO: 868700 - RNA, 22 nt, Human
ucaguaaacagguuuaaguccu

SEQ ID NO: 868701 - RNA, 23 nt, Human
agaugaggcuucuccauguuggu

SEQ ID NO: 868702 - RNA, 22 nt, Human
cagcugccccgcuggcugacca

SEQ ID NO: 868703 - RNA, 18 nt, Human
ccagguggugacagagau

SEQ ID NO: 868704 - RNA, 22 nt, Human
gcauguuauguaucugcccagc

SEQ ID NO: 868705 - RNA, 22 nt, Human
ggaggggaggauuaaugacaaa

SEQ ID NO: 868706 - RNA, 22 nt, Human
cuuacagagaagaaaauguagu

SEQ ID NO: 868707 - RNA, 22 nt, Human
ugcccaggguuucuaagagcag

SEQ ID NO: 868708 - RNA, 22 nt, Human
ucugauaacucuggccccaggc

SEQ ID NO: 868709 - RNA, 22 nt, Human
ggaggggagguccagcugaucu

SEQ ID NO: 868710 - RNA, 22 nt, Human
ucuuugaauccuuuacaucuga

SEQ ID NO: 868711 - RNA, 22 nt, Human
aggaggggcaaugauagucugg

SEQ ID NO: 868712 - RNA, 22 nt, Human
acuuucugcaguguuggaaaug

SEQ ID NO: 868713 - RNA, 22 nt, Human
uacugaaaagccacaaggacca

SEQ ID NO: 868714 - RNA, 22 nt, Human
uuggcaguaaaagaaaaugcuu

SEQ ID NO: 868715 - RNA, 22 nt, Human
cucaggauagcugcgcagccug

SEQ ID NO: 868716 - RNA, 22 nt, Human
gcauucuuuuuaggagguuccu

SEQ ID NO: 868717 - RNA, 22 nt, Human
agucugucugucacuucugcag

SEQ ID NO: 868718 - RNA, 22 nt, Human
gauuucaaguaucuugggcgag

SEQ ID NO: 868719 - RNA, 22 nt, Human
cccaggagguggagguugcagc

SEQ ID NO: 868720 - RNA, 22 nt, Human
uguaacaaaauaccuuggauug

SEQ ID NO: 868721 - RNA, 22 nt, Human
gagguggugguggaggcauagc

SEQ ID NO: 868722 - RNA, 22 nt, Human
uacaacauuguguugcuucaua

SEQ ID NO: 868723 - RNA, 22 nt, Human
ucaggaauccagacagggcaca

SEQ ID NO: 868724 - RNA, 22 nt, Human
aggaugagccgcgcaagcugac

SEQ ID NO: 868725 - RNA, 22 nt, Human
cucccagggucuaggcugcugg

SEQ ID NO: 868726 - RNA, 22 nt, Human
cugcaucaguggauaugauggu

SEQ ID NO: 868727 - RNA, 22 nt, Human
ccugcuguaaugugucuuuauu

SEQ ID NO: 868728 - RNA, 22 nt, Human
cugcccaggaaggagaggaugg

SEQ ID NO: 868729 - RNA, 22 nt, Human
aauuccaggaugcaggaggugc

SEQ ID NO: 868730 - RNA, 22 nt, Human
cugccaggcacgugcagcauca

SEQ ID NO: 868731 - RNA, 22 nt, Human
uugaagaaagucauauauaaug

SEQ ID NO: 868732 - RNA, 22 nt, Human
uagcucuucaaucacugucucc

SEQ ID NO: 868733 - RNA, 22 nt, Human
aaaucagugcucauuugaaagg

SEQ ID NO: 868734 - RNA, 22 nt, Human
agacaaauggaguaugagcaac

SEQ ID NO: 868735 - RNA, 23 nt, Human
uucuuucaagaaguucacagugc

SEQ ID NO: 868736 - RNA, 22 nt, Human
uauguguuugacacccugcaag

SEQ ID NO: 868737 - RNA, 22 nt, Human
ucaucugucauccacaaagcug

SEQ ID NO: 868738 - RNA, 22 nt, Human
agaccaagacuauaaugagagg

SEQ ID NO: 868739 - RNA, 22 nt, Human
augcacaagcaagagauaaugg

SEQ ID NO: 868740 - RNA, 22 nt, Human
cuacagaagaaacuaucacuau

SEQ ID NO: 868741 - RNA, 22 nt, Human
guauacagauacuuagacgugc

SEQ ID NO: 868742 - RNA, 20 nt, Human
gcagcuacucugucucgcuc

SEQ ID NO: 868743 - RNA, 22 nt, Human
caaggccacuccagagacuggu

SEQ ID NO: 868744 - RNA, 22 nt, Human
ugucaccagcugcuccucagga

SEQ ID NO: 868745 - RNA, 22 nt, Human
augguuuacugaucuuuuuggu

SEQ ID NO: 868746 - RNA, 22 nt, Human
uuucuaggucuuccauacugcc

SEQ ID NO: 868747 - RNA, 22 nt, Human
uggccaggcagguagaacggcc

SEQ ID NO: 868748 - RNA, 22 nt, Human
aauaucaacaguguccuucuaa

SEQ ID NO: 868749 - RNA, 22 nt, Human
aaaagucugcucucauuucaga

SEQ ID NO: 868750 - RNA, 22 nt, Human
ugaaacaaauuuggaaaaucua

SEQ ID NO: 868751 - RNA, 22 nt, Human
uaggcagccagcaucaguuggg

SEQ ID NO: 868752 - RNA, 23 nt, Human
uggaggaaacacaucagaagacc

SEQ ID NO: 868753 - RNA, 22 nt, Human
caauuucaaugaggccacaggg

SEQ ID NO: 868754 - RNA, 22 nt, Human
uucuaugccauguucagcuacu

SEQ ID NO: 868755 - RNA, 22 nt, Human
gcauaauauacaugcuugaucc

SEQ ID NO: 868756 - RNA, 22 nt, Human
gucacuguauccagguuccagc

SEQ ID NO: 868757 - RNA, 22 nt, Human
aauuauccuuaaugcaguaagc

SEQ ID NO: 868758 - RNA, 18 nt, Human
gcagcuagccaggggggc

SEQ ID NO: 868759 - RNA, 21 nt, Human
uggcaggcagcuggaagcuug

SEQ ID NO: 868760 - RNA, 22 nt, Human
gaacccaggcuuuugaggcugu

SEQ ID NO: 868761 - RNA, 22 nt, Human
ugaggcaguucuuacuuguauu

SEQ ID NO: 868762 - RNA, 22 nt, Human
gaggaggcacuugagcagaugu

SEQ ID NO: 868763 - RNA, 22 nt, Human
aggcaagcgcagaagcggagga

SEQ ID NO: 868764 - RNA, 22 nt, Human
uguguucuggaaagcucacuga

SEQ ID NO: 868765 - RNA, 22 nt, Human
ucaaaauuagugaccaaaggca

SEQ ID NO: 868766 - RNA, 20 nt, Human
gggcagcuccccucauucug

SEQ ID NO: 868767 - RNA, 22 nt, Human
agcacaauagagcaguuaaaaa

SEQ ID NO: 868768 - RNA, 22 nt, Human
gccaggagagcuccuucagguu

SEQ ID NO: 868769 - RNA, 22 nt, Human
aaaggccacuugaaggauuuuu

SEQ ID NO: 868770 - RNA, 22 nt, Human
uuuaggcaaauuucagaugugc

SEQ ID NO: 868771 - RNA, 22 nt, Human
auugcuguaaauuaucuuauua

SEQ ID NO: 868772 - RNA, 20 nt, Human
gauuucaaagcagaguggcc

SEQ ID NO: 868773 - RNA, 22 nt, Human
uucuuugaguuaguacagucca

SEQ ID NO: 868774 - RNA, 22 nt, Human
cuuaaauucuuaaugcccucau

SEQ ID NO: 868775 - RNA, 22 nt, Human
gauggcagcauauugacagcau

SEQ ID NO: 868776 - RNA, 18 nt, Human
uugagggaggggcagagu

SEQ ID NO: 868777 - RNA, 22 nt, Human
gguuauauaauucagugcuuuc

SEQ ID NO: 868778 - RNA, 22 nt, Human
guccucuggaagaugaguucuu

SEQ ID NO: 868779 - RNA, 22 nt, Human
cuugcuucauuagugucuuagu

SEQ ID NO: 868780 - RNA, 22 nt, Human
ugcuauacggagcaucuucagg

SEQ ID NO: 868781 - RNA, 22 nt, Human
cuuagaaaucgaacucagguua

SEQ ID NO: 868782 - RNA, 21 nt, Human
gcugcccaacccugcaucucc

SEQ ID NO: 868783 - RNA, 22 nt, Human
aucuaacacuguaaacugucuu

SEQ ID NO: 868784 - RNA, 22 nt, Human
cagagccauuauggagacuugc

SEQ ID NO: 868785 - RNA, 22 nt, Human
caggagaggcuguacguuucuc

SEQ ID NO: 868786 - RNA, 22 nt, Human
guaaacauuuucaucugugccc

SEQ ID NO: 868787 - RNA, 22 nt, Human
aaauauagcaauuaugccuacu

SEQ ID NO: 868788 - RNA, 22 nt, Human
ccucacugaagaggugacauuu

SEQ ID NO: 868789 - RNA, 22 nt, Human
aacuuuguguguuuaauauggc

SEQ ID NO: 868790 - RNA, 22 nt, Human
caguaaauacauaucagagaag

SEQ ID NO: 868791 - RNA, 22 nt, Human
cuacagaagccguggucaggaa

SEQ ID NO: 868792 - RNA, 22 nt, Human
aggcaguuguugcugagcagcu

SEQ ID NO: 868793 - RNA, 22 nt, Human
ucugcaggcuuauaggaugggu

SEQ ID NO: 868794 - RNA, 22 nt, Human
cacaauuuccuugcuucacuuu

SEQ ID NO: 868795 - RNA, 22 nt, Human
uucccaugccuggccccuaucc

SEQ ID NO: 868796 - RNA, 22 nt, Human
uuagaaagaacuuuagauauca

SEQ ID NO: 868797 - RNA, 22 nt, Human
acauauauuacuaguaaagaca

SEQ ID NO: 868798 - RNA, 22 nt, Human
gcagcugccccgacugugaguc

SEQ ID NO: 868799 - RNA, 22 nt, Human
auccaugaucaauuuauuacua

SEQ ID NO: 868800 - RNA, 22 nt, Human
cuggauuugccuauggugcuuu

SEQ ID NO: 868801 - RNA, 22 nt, Human
aggcaguuuauccccagagccu

SEQ ID NO: 868802 - RNA, 22 nt, Human
ggauucagugucuguuaauagu

SEQ ID NO: 868803 - RNA, 22 nt, Human
gggcagcuggccagguauucug

SEQ ID NO: 868804 - RNA, 22 nt, Human
ccuugcguuuuacagcuucuag

SEQ ID NO: 868805 - RNA, 22 nt, Human
uuauacauguguuuugagauga

SEQ ID NO: 868806 - RNA, 22 nt, Human
gggcagcucuggcugugggaag

SEQ ID NO: 868807 - RNA, 22 nt, Human
cccaggagguggagcuugcagu

SEQ ID NO: 868808 - RNA, 22 nt, Human
aauuaaauugguuuagagagga

SEQ ID NO: 868809 - RNA, 23 nt, Human
ucucaggacacacaugucuauca

SEQ ID NO: 868810 - RNA, 17 nt, Human
caaggccagcaucuuca

SEQ ID NO: 868811 - RNA, 22 nt, Human
acaucucaugaaugauaaauca

SEQ ID NO: 868812 - RNA, 22 nt, Human
gccuaauaacuagcuguguaac

SEQ ID NO: 868813 - RNA, 17 nt, Human
gagagcugcugcuuccg

SEQ ID NO: 868814 - RNA, 22 nt, Human
ucugcaggcucuagaugagguu

SEQ ID NO: 868815 - RNA, 22 nt, Human
auuucaacacuuuuggaauuag

SEQ ID NO: 868816 - RNA, 23 nt, Human
ggccauuucauuugguucaaacu

SEQ ID NO: 868817 - RNA, 22 nt, Human
gaccauuugcuaguaaauugca

SEQ ID NO: 868818 - RNA, 22 nt, Human
cauuuguagcuauuuacuguau

SEQ ID NO: 868819 - RNA, 21 nt, Human
ugaggcaggggugcuuuuguc

SEQ ID NO: 868820 - RNA, 23 nt, Human
uaauucacauauacauugcuuca

SEQ ID NO: 868821 - RNA, 22 nt, Human
uuugacaaaggaaaaaugcaca

SEQ ID NO: 868822 - RNA, 22 nt, Human
gauuuacaaagcucucuagugu

SEQ ID NO: 868823 - RNA, 22 nt, Human
ugaaggccucugguacaugcca

SEQ ID NO: 868824 - RNA, 22 nt, Human
agugcuuuagcauccaacuguc

SEQ ID NO: 868825 - RNA, 22 nt, Human
ugccuugcacauaauauacauu

SEQ ID NO: 868826 - RNA, 22 nt, Human
uuacuuugcuuucucauuacag

SEQ ID NO: 868827 - RNA, 22 nt, Human
gaggucaggcuugcagcagggu

SEQ ID NO: 868828 - RNA, 22 nt, Human
uuauacaguuuauacuuagaau

SEQ ID NO: 868829 - RNA, 23 nt, Human
aaugauuucaugaugauagcagc

SEQ ID NO: 868830 - RNA, 22 nt, Human
agcccagggacagggcggaugu

SEQ ID NO: 868831 - RNA, 22 nt, Human
gauaaugaugacaaugacaacc

SEQ ID NO: 868832 - RNA, 18 nt, Human
cucaccauucugcccaau

SEQ ID NO: 868833 - RNA, 22 nt, Human
acaggccacaguggagucucug

SEQ ID NO: 868834 - RNA, 22 nt, Human
auagcuguuagauuggggucga

SEQ ID NO: 868835 - RNA, 22 nt, Human
uuuuaagaugcuaguauuucag

SEQ ID NO: 868836 - RNA, 21 nt, Human
uuucagaccuaucuuugaagg

SEQ ID NO: 868837 - RNA, 22 nt, Human
agaaaucauugaauuauuugcu

SEQ ID NO: 868838 - RNA, 22 nt, Human
gauuucaaagguucugcaugcc

SEQ ID NO: 868839 - RNA, 22 nt, Human
acccaggauagagugcugcagu

SEQ ID NO: 868840 - RNA, 22 nt, Human
uuuauccauaucauuaaaaucu

SEQ ID NO: 868841 - RNA, 22 nt, Human
auugaaagauauacuguucuca

SEQ ID NO: 868842 - RNA, 22 nt, Human
caaggccaagucucugugaaga

SEQ ID NO: 868843 - RNA, 22 nt, Human
ccuggaucuuuguuguaaauau

SEQ ID NO: 868844 - RNA, 22 nt, Human
acaugcuuugcacuuacaucau

SEQ ID NO: 868845 - RNA, 22 nt, Human
cccaggagacagaaacagaggu

SEQ ID NO: 868846 - RNA, 21 nt, Human
caagccagaccaauagcagcc

SEQ ID NO: 868847 - RNA, 22 nt, Human
acucaggaaaaauguagugaua

SEQ ID NO: 868848 - RNA, 18 nt, Human
cugcuugggagacgucag

SEQ ID NO: 868849 - RNA, 22 nt, Human
aggccagcacgacagccgcagg

SEQ ID NO: 868850 - RNA, 22 nt, Human
uccaugagaacccuuggagaua

SEQ ID NO: 868851 - RNA, 22 nt, Human
acccaggaaaacauggugcaga

SEQ ID NO: 868852 - RNA, 22 nt, Human
cccagggaagccauuucugacu

SEQ ID NO: 868853 - RNA, 21 nt, Human
uucaaagacuugaugcugacc

SEQ ID NO: 868854 - RNA, 22 nt, Human
ugcuuauucuuuccacaauuca

SEQ ID NO: 868855 - RNA, 22 nt, Human
auaugcuugggacugauacagu

SEQ ID NO: 868856 - RNA, 22 nt, Human
uucuagaugauaaaccagcagc

SEQ ID NO: 868857 - RNA, 22 nt, Human
aauaauuuuagcucagaguugu

SEQ ID NO: 868858 - RNA, 20 nt, Human
guaaugaauguaaacaguaa

SEQ ID NO: 868859 - RNA, 22 nt, Human
agcuggcagcucucagggguac

SEQ ID NO: 868860 - RNA, 18 nt, Human
caauuucauccuuaagcc

SEQ ID NO: 868861 - RNA, 22 nt, Human
cugcugugccuuaaaaugcaag

SEQ ID NO: 868862 - RNA, 22 nt, Human
caauuucauggauaaaagaugu

SEQ ID NO: 868863 - RNA, 22 nt, Human
cuugcaggccuuucuagcucua

SEQ ID NO: 868864 - RNA, 22 nt, Human
ugaaagguuauuuaggucugcu

SEQ ID NO: 868865 - RNA, 20 nt, Human
uauggcuuggcaaagcuuca

SEQ ID NO: 868866 - RNA, 22 nt, Human
ccaggagacuguacugauauuu

SEQ ID NO: 868867 - RNA, 22 nt, Human
uuccuuagugacuucuagcuac

SEQ ID NO: 868868 - RNA, 22 nt, Human
auaucagaaauaguaagcagag

SEQ ID NO: 868869 - RNA, 22 nt, Human
uaugaacucuggagucugagug

SEQ ID NO: 868870 - RNA, 23 nt, Human
uccaggagaaccccugucugucc

SEQ ID NO: 868871 - RNA, 22 nt, Human
uuucacaaaugucuuuaacuug

SEQ ID NO: 868872 - RNA, 22 nt, Human
uccaugaggaccaaauucguag

SEQ ID NO: 868873 - RNA, 22 nt, Human
agggcagcagcuccuccuagcu

SEQ ID NO: 868874 - RNA, 22 nt, Human
uccaggagacacaagguacaua

SEQ ID NO: 868875 - RNA, 22 nt, Human
cauuuguauguuccuccuuagg

SEQ ID NO: 868876 - RNA, 22 nt, Human
aucaggaucugcaucauaagaa

SEQ ID NO: 868877 - RNA, 22 nt, Human
ugaagaauaaaugguugagacu

SEQ ID NO: 868878 - RNA, 22 nt, Human
aacagaauaguugauguacagu

SEQ ID NO: 868879 - RNA, 22 nt, Human
caggcagcugcgacaagagagc

SEQ ID NO: 868880 - RNA, 22 nt, Human
gcagggaagaucuuggagcugc

SEQ ID NO: 868881 - RNA, 22 nt, Human
aggcaggcucaaugcccagucu

SEQ ID NO: 868882 - RNA, 22 nt, Human
ugaggcagugcugggaagccug

SEQ ID NO: 868883 - RNA, 22 nt, Human
ggaggugggauuaggaccuaaa

SEQ ID NO: 868884 - RNA, 22 nt, Human
gaaacugugaucguguucuggg

SEQ ID NO: 868885 - RNA, 22 nt, Human
ucugcaggcuguacaggaagca

SEQ ID NO: 868886 - RNA, 19 nt, Human
gaaguccucuaguaaauuu

SEQ ID NO: 868887 - RNA, 18 nt, Human
ugcuuggagcauuuacca

SEQ ID NO: 868888 - RNA, 22 nt, Human
acccaggagcucugggguccuc

SEQ ID NO: 868889 - RNA, 22 nt, Human
guaucacuuuugagagugagaa

SEQ ID NO: 868890 - RNA, 22 nt, Human
auauauaaccuggauaaggcuu

SEQ ID NO: 868891 - RNA, 22 nt, Human
uugcagcuuagugauguuaucu

SEQ ID NO: 868892 - RNA, 20 nt, Human
aagagaggaaguuauacuag

SEQ ID NO: 868893 - RNA, 22 nt, Human
aguccaugguucugacucaucu

SEQ ID NO: 868894 - RNA, 22 nt, Human
cucaggauuuacuaauuucaag

SEQ ID NO: 868895 - RNA, 18 nt, Human
aggcagacacuagagguc

SEQ ID NO: 868896 - RNA, 22 nt, Human
uugaauaggacucagcagugau

SEQ ID NO: 868897 - RNA, 22 nt, Human
aaucuucuacuugacaguucuc

SEQ ID NO: 868898 - RNA, 22 nt, Human
ucagagaguuacacaaauuguu

SEQ ID NO: 868899 - RNA, 22 nt, Human
ucucagucagccuugauguccc

SEQ ID NO: 868900 - RNA, 22 nt, Human
cuuguccccagcagguugguuu

SEQ ID NO: 868901 - RNA, 22 nt, Human
gagugcaggccugagcaccauc

SEQ ID NO: 868902 - RNA, 22 nt, Human
uggauuagguacuaugaauaua

SEQ ID NO: 868903 - RNA, 22 nt, Human
cccaggugcugcgugaagccuc

SEQ ID NO: 868904 - RNA, 22 nt, Human
uugugaguagugccgcaauaaa

SEQ ID NO: 868905 - RNA, 22 nt, Human
gaauuucaaaagccagaacggg

SEQ ID NO: 868906 - RNA, 22 nt, Human
gaaagaggaaggagauguauua

SEQ ID NO: 868907 - RNA, 22 nt, Human
gagucaccacugugauagucga

SEQ ID NO: 868908 - RNA, 22 nt, Human
auaucacaguaguuguuuaguu

SEQ ID NO: 868909 - RNA, 22 nt, Human
cuggcuuucuguuauaaagaca

SEQ ID NO: 868910 - RNA, 22 nt, Human
uauuuuaaagugaagggucuug

SEQ ID NO: 868911 - RNA, 22 nt, Human
uguccuuaucuccaaacaauca

SEQ ID NO: 868912 - RNA, 22 nt, Human
aauuccaaauguuuucaaucca

SEQ ID NO: 868913 - RNA, 22 nt, Human
aauauuguuucaagaucacaga

SEQ ID NO: 868914 - RNA, 22 nt, Human
gaagugaagguuacucuagauu

SEQ ID NO: 868915 - RNA, 16 nt, Human
ccccaggacuuggcac

SEQ ID NO: 868916 - RNA, 22 nt, Human
agggagcugagcugugagcagc

SEQ ID NO: 868917 - RNA, 22 nt, Human
caaauaguuuuucauguauuau

SEQ ID NO: 868918 - RNA, 22 nt, Human
uggcaggcagugugggagcugg

SEQ ID NO: 868919 - RNA, 22 nt, Human
aggagaggcucuaacucugugu

SEQ ID NO: 868920 - RNA, 22 nt, Human
uuguaaaugaccuuuucuaauu

SEQ ID NO: 868921 - RNA, 22 nt, Human
aucuacccacugaacacaauau

SEQ ID NO: 868922 - RNA, 22 nt, Human
guuaaagaguuuggcuuucuuc

SEQ ID NO: 868923 - RNA, 22 nt, Human
agcccaggaaucugcaucuuga

SEQ ID NO: 868924 - RNA, 22 nt, Human
cugcuguggguuaagacacugu

SEQ ID NO: 868925 - RNA, 22 nt, Human
guugaaugaaucauucuaugua

SEQ ID NO: 868926 - RNA, 22 nt, Human
aucaggauccaccuugagccug

SEQ ID NO: 868927 - RNA, 22 nt, Human
uuugcagugauucuugcaguga

SEQ ID NO: 868928 - RNA, 20 nt, Human
uuuuccagaaaguaucauug

SEQ ID NO: 868929 - RNA, 22 nt, Human
cauagaaaguauuauggaauuu

SEQ ID NO: 868930 - RNA, 22 nt, Human
auucuucaccugagucagucua

SEQ ID NO: 868931 - RNA, 22 nt, Human
aaggcagcucagcucauggcag

SEQ ID NO: 868932 - RNA, 22 nt, Human
cagaaggcuuuguggaguagac

SEQ ID NO: 868933 - RNA, 22 nt, Human
gaguccuuaauacacuggugga

SEQ ID NO: 868934 - RNA, 22 nt, Human
aaauacuagaauucagaguuga

SEQ ID NO: 868935 - RNA, 22 nt, Human
guucuucagauuccauuucagu

SEQ ID NO: 868936 - RNA, 22 nt, Human
cagaauaaagguacaauugagu

SEQ ID NO: 868937 - RNA, 22 nt, Human
uaaggccaauuaacaaccaggg

SEQ ID NO: 868938 - RNA, 22 nt, Human
ucugggaacugagcuccccuag

SEQ ID NO: 868939 - RNA, 20 nt, Human
aggcaccugucacaggugag

SEQ ID NO: 868940 - RNA, 22 nt, Human
uuguuauaaagacuaaauaugu

SEQ ID NO: 868941 - RNA, 22 nt, Human
uuacagaagaguaacuuggcaa

SEQ ID NO: 868942 - RNA, 22 nt, Human
agccagucggggccaugcuggg

SEQ ID NO: 868943 - RNA, 22 nt, Human
cccauucauccucgcuuccuuc

SEQ ID NO: 868944 - RNA, 22 nt, Human
caggcagcguccugcuuccugu

SEQ ID NO: 868945 - RNA, 22 nt, Human
cccaggaccgcgcggcugagcg

SEQ ID NO: 868946 - RNA, 22 nt, Human
cccaagagcuucuaggacgcug

SEQ ID NO: 868947 - RNA, 19 nt, Human
gcuuuggagggagguucua

SEQ ID NO: 868948 - RNA, 19 nt, Human
uggcagggagaguuugaag

SEQ ID NO: 868949 - RNA, 22 nt, Human
ggugaagguggaacgcagagca

SEQ ID NO: 868950 - RNA, 22 nt, Human
cuucuucacacuggucugaagc

SEQ ID NO: 868951 - RNA, 22 nt, Human
cccaggaggcgcagguugcggu

SEQ ID NO: 868952 - RNA, 22 nt, Human
ccccggaggcggagguugcagu

SEQ ID NO: 868953 - RNA, 22 nt, Human
caggcagaguuagagcaacugg

SEQ ID NO: 868954 - RNA, 22 nt, Human
uaugaacuuuugaugugacaug

SEQ ID NO: 868955 - RNA, 22 nt, Human
guuaaauucgaugauggauaaa

SEQ ID NO: 868956 - RNA, 22 nt, Human
cuacagaaggagaaauggguaa

SEQ ID NO: 868957 - RNA, 22 nt, Human
aaguaaaauguuuccuuuauua

SEQ ID NO: 868958 - RNA, 22 nt, Human
augcugugauuguagaaauauu

SEQ ID NO: 868959 - RNA, 22 nt, Human
cggcagcuccgcgccguaggac

SEQ ID NO: 868960 - RNA, 22 nt, Human
uuucacauaugguuguugauug

SEQ ID NO: 868961 - RNA, 22 nt, Human
gcaucuaauccaguccagcauc

SEQ ID NO: 868962 - RNA, 22 nt, Human
gauuucuuugcaagcuguguuc

SEQ ID NO: 868963 - RNA, 22 nt, Human
cucaugauguagcgaaugagaa

SEQ ID NO: 868964 - RNA, 21 nt, Human
cuugaaagguagagucuacag

SEQ ID NO: 868965 - RNA, 19 nt, Human
ucccaggaagcaaauguca

SEQ ID NO: 868966 - RNA, 22 nt, Human
uguauuuuuagaccuuuagacc

SEQ ID NO: 868967 - RNA, 22 nt, Human
uugcauuugagaaaguucuccu

SEQ ID NO: 868968 - RNA, 22 nt, Human
aaggagagguuguccguguugu

SEQ ID NO: 868969 - RNA, 22 nt, Human
gaucugaaucaauagaauaacu

SEQ ID NO: 868970 - RNA, 22 nt, Human
gauuucuucauuuguggugaau

SEQ ID NO: 868971 - RNA, 22 nt, Human
gaggcagcaggcugaggaggau

SEQ ID NO: 868972 - RNA, 22 nt, Human
cagaggcaaaagagguggaggu

SEQ ID NO: 868973 - RNA, 18 nt, Human
uugcuuuguaagcuugca

SEQ ID NO: 868974 - RNA, 22 nt, Human
cuucuucaucuguaaaacuugg

SEQ ID NO: 868975 - RNA, 22 nt, Human
caaauguauucucacuucaggg

SEQ ID NO: 868976 - RNA, 22 nt, Human
cauuuguuaaccaguguggauu

SEQ ID NO: 868977 - RNA, 19 nt, Human
ucucugcuucucuuggcau

SEQ ID NO: 868978 - RNA, 22 nt, Human
aaacaaacauagguuugaaagu

SEQ ID NO: 868979 - RNA, 20 nt, Human
uuacagaaaugauguuauuu

SEQ ID NO: 868980 - RNA, 22 nt, Human
cauuucaauacaguuuguaaau

SEQ ID NO: 868981 - RNA, 22 nt, Human
gugggagcuuuggcaucaggcu

SEQ ID NO: 868982 - RNA, 22 nt, Human
aguuauccgaaggcacugagau

SEQ ID NO: 868983 - RNA, 22 nt, Human
gcucucuuuuuccagugguggu

SEQ ID NO: 868984 - RNA, 22 nt, Human
uuuucauuuuuguagaugcaag

SEQ ID NO: 868985 - RNA, 22 nt, Human
auuaggcauauaugcuuuuaau

SEQ ID NO: 868986 - RNA, 22 nt, Human
gugcagcugcaggagucagguc

SEQ ID NO: 868987 - RNA, 22 nt, Human
gagguagcgaguggacagugca

SEQ ID NO: 868988 - RNA, 22 nt, Human
uugcauuuccuguacuguuuga

SEQ ID NO: 868989 - RNA, 22 nt, Human
uauaaaauggcaucagcuccaa

SEQ ID NO: 868990 - RNA, 22 nt, Human
auuucaacauucucaguuguag

SEQ ID NO: 868991 - RNA, 22 nt, Human
uugaaaguccuucuugaguuac

SEQ ID NO: 868992 - RNA, 22 nt, Human
uugaaaggugaacaugaugcac

SEQ ID NO: 868993 - RNA, 22 nt, Human
aucacauuguuagcauagacug

SEQ ID NO: 868994 - RNA, 22 nt, Human
cauagcuuagggguuaaacuca

SEQ ID NO: 868995 - RNA, 22 nt, Human
aaggcaguuaauuuggcuagaa

SEQ ID NO: 868996 - RNA, 22 nt, Human
ggcauuaagaauaucauuaaaa

SEQ ID NO: 868997 - RNA, 22 nt, Human
ugagacaaaauugacagacaaa

SEQ ID NO: 868998 - RNA, 20 nt, Human
uguuaaaggacacuugcuuu

SEQ ID NO: 868999 - RNA, 22 nt, Human
ugaggggagaagcagcagccug

SEQ ID NO: 869000 - RNA, 22 nt, Human
ccagauuugagcgucuuaaacc

SEQ ID NO: 869001 - RNA, 22 nt, Human
acugugugacuguuauuacugu

SEQ ID NO: 869002 - RNA, 21 nt, Human
auacagaaggcagacucucuc

SEQ ID NO: 869003 - RNA, 22 nt, Human
ugucaaauuuuuauugcaguau

SEQ ID NO: 869004 - RNA, 22 nt, Human
uaaauuauguuccauguccuuu

SEQ ID NO: 869005 - RNA, 22 nt, Human
gaucauuugcaggaaacauuaa

SEQ ID NO: 869006 - RNA, 22 nt, Human
aacauauaaacucuuaaguuca

SEQ ID NO: 869007 - RNA, 22 nt, Human
uuucaaguguccugauuaaugg

SEQ ID NO: 869008 - RNA, 22 nt, Human
ugaaacauuugaugaucuuugg

SEQ ID NO: 869009 - RNA, 22 nt, Human
gcccaggagaggccagggcuga

SEQ ID NO: 869010 - RNA, 22 nt, Human
caauacuuccuuguuagaggca

SEQ ID NO: 869011 - RNA, 19 nt, Human
uuucagacucaucuccagc

SEQ ID NO: 869012 - RNA, 22 nt, Human
ugccugugguuccaguuuuuuc

SEQ ID NO: 869013 - RNA, 22 nt, Human
gugguaauagagcuccaaacua

SEQ ID NO: 869014 - RNA, 22 nt, Human
uuuugaauaauucagaaacagc

SEQ ID NO: 869015 - RNA, 22 nt, Human
uuugaagaccuuaucucuaaau

SEQ ID NO: 869016 - RNA, 22 nt, Human
aauuuuaagcauaugacugguu

SEQ ID NO: 869017 - RNA, 22 nt, Human
aaggcaguaggaucuuccacag

SEQ ID NO: 869018 - RNA, 22 nt, Human
aaguccuuggagaauagaaagg

SEQ ID NO: 869019 - RNA, 22 nt, Human
uagaaaucagcaggcauaugua

SEQ ID NO: 869020 - RNA, 22 nt, Human
aaagcagacugauuugcaucac

SEQ ID NO: 869021 - RNA, 22 nt, Human
ccucaggaaaugaauaaauggc

SEQ ID NO: 869022 - RNA, 22 nt, Human
uucagcaagaccaccauguacc

SEQ ID NO: 869023 - RNA, 22 nt, Human
uaagaaucgauguuuauuuaga

SEQ ID NO: 869024 - RNA, 22 nt, Human
agcugcccugggcuggagaugg

SEQ ID NO: 869025 - RNA, 22 nt, Human
uaauuauagccgcuauuuugcu

SEQ ID NO: 869026 - RNA, 22 nt, Human
cuguauuuguccucuauuuauu

SEQ ID NO: 869027 - RNA, 22 nt, Human
aagcaccucuaugauugcuuuu

SEQ ID NO: 869028 - RNA, 22 nt, Human
ucagguggcuuggagggggacg

SEQ ID NO: 869029 - RNA, 22 nt, Human
aaagaaucguguguaguuugaa

SEQ ID NO: 869030 - RNA, 22 nt, Human
agaggcagccguauuucaaagg

SEQ ID NO: 869031 - RNA, 22 nt, Human
gaagugaagagauuagaaauca

SEQ ID NO: 869032 - RNA, 22 nt, Human
ggcuuggaaaugguaaugagcu

SEQ ID NO: 869033 - RNA, 22 nt, Human
guucuucagcauuagaagucau

SEQ ID NO: 869034 - RNA, 20 nt, Human
uauuccaaggguagagaaaa

SEQ ID NO: 869035 - RNA, 22 nt, Human
ucaggagaguguucaguggagg

SEQ ID NO: 869036 - RNA, 22 nt, Human
acagcauugcuccaucucaaga

SEQ ID NO: 869037 - RNA, 22 nt, Human
caaggccaaagggccacuguca

SEQ ID NO: 869038 - RNA, 22 nt, Human
ugcuuggccuacuuguccuuug

SEQ ID NO: 869039 - RNA, 22 nt, Human
uuccuuagggucagccagaucu

SEQ ID NO: 869040 - RNA, 22 nt, Human
cauuucacaaauggccacauca

SEQ ID NO: 869041 - RNA, 22 nt, Human
cagaauuuaaguggauuauucu

SEQ ID NO: 869042 - RNA, 22 nt, Human
accaggaggcuacacuguccca

SEQ ID NO: 869043 - RNA, 22 nt, Human
cugcccaggcugaaggaacauc

SEQ ID NO: 869044 - RNA, 22 nt, Human
cucaggauguacuacagaaggc

SEQ ID NO: 869045 - RNA, 22 nt, Human
cauaaaauggcuuguucuuuaa

SEQ ID NO: 869046 - RNA, 22 nt, Human
ggcaagaaggcuucagguagcu

SEQ ID NO: 869047 - RNA, 17 nt, Human
gaggagcuccaguaggu

SEQ ID NO: 869048 - RNA, 22 nt, Human
gagaggggcccaagccacauag

SEQ ID NO: 869049 - RNA, 20 nt, Human
uccaugaguuagagacuaua

SEQ ID NO: 869050 - RNA, 22 nt, Human
agaggagugggaagcagugcaa

SEQ ID NO: 869051 - RNA, 22 nt, Human
gcagaggagcaaguugcuacag

SEQ ID NO: 869052 - RNA, 22 nt, Human
uccauuuucaucucauguauaa

SEQ ID NO: 869053 - RNA, 21 nt, Human
cucaaagaccaaaaguguaga

SEQ ID NO: 869054 - RNA, 22 nt, Human
cugcuuugggcagcuuuguggc

SEQ ID NO: 869055 - RNA, 22 nt, Human
uacugccuggagcauuggugcu

SEQ ID NO: 869056 - RNA, 22 nt, Human
cuuugcaaacugucacacuuuc

SEQ ID NO: 869057 - RNA, 22 nt, Human
agccuauuccaggaugagcuca

SEQ ID NO: 869058 - RNA, 22 nt, Human
aaagauuugaguucugcuuaua

SEQ ID NO: 869059 - RNA, 22 nt, Human
gaauuucagagguaacaucauc

SEQ ID NO: 869060 - RNA, 22 nt, Human
augcagcuucaggauuaugaug

SEQ ID NO: 869061 - RNA, 22 nt, Human
gaggucaggggagaggcugaug

SEQ ID NO: 869062 - RNA, 22 nt, Human
aaguccuuguauacagaaucaa

SEQ ID NO: 869063 - RNA, 22 nt, Human
gccaggaggcuuaacuggacag

SEQ ID NO: 869064 - RNA, 22 nt, Human
aggcagcccugugcuggaugcu

SEQ ID NO: 869065 - RNA, 22 nt, Human
auguuaaaugguuuauuauuaa

SEQ ID NO: 869066 - RNA, 22 nt, Human
uuuguaaaggccugaauuucag

SEQ ID NO: 869067 - RNA, 19 nt, Human
caagugaagccugggaugg

SEQ ID NO: 869068 - RNA, 22 nt, Human
agaucaguuagauagcuugaug

SEQ ID NO: 869069 - RNA, 22 nt, Human
agucaccaucuguggcagccug

SEQ ID NO: 869070 - RNA, 22 nt, Human
auguuucaccaguuuuauaaga

SEQ ID NO: 869071 - RNA, 22 nt, Human
uucaggauggaguaccuuuuau

SEQ ID NO: 869072 - RNA, 22 nt, Human
ucaggagauggucuuuauaggc

SEQ ID NO: 869073 - RNA, 22 nt, Human
uguucauuuggcccuuuuguau

SEQ ID NO: 869074 - RNA, 22 nt, Human
gagaggugaaggcugcccuggg

SEQ ID NO: 869075 - RNA, 22 nt, Human
cuucagaaugggacuguguuug

SEQ ID NO: 869076 - RNA, 22 nt, Human
aggcagcugugaggacuggauu

SEQ ID NO: 869077 - RNA, 22 nt, Human
guuuuucuaggaccaugugauu

SEQ ID NO: 869078 - RNA, 22 nt, Human
gaacuguaguuaauacuacaca

SEQ ID NO: 869079 - RNA, 22 nt, Human
cccuuagcuccaagggguuugg

SEQ ID NO: 869080 - RNA, 22 nt, Human
auuuccaggagaaaggauuuua

SEQ ID NO: 869081 - RNA, 22 nt, Human
uucaauucaauucuaaauauau

SEQ ID NO: 869082 - RNA, 22 nt, Human
agagugcaaccgaaacaagcag

SEQ ID NO: 869083 - RNA, 18 nt, Human
ugcuggguaacuguaugg

SEQ ID NO: 869084 - RNA, 22 nt, Human
caucacccggaacugugucugc

SEQ ID NO: 869085 - RNA, 22 nt, Human
uagucaccagcuacaggacagc

SEQ ID NO: 869086 - RNA, 22 nt, Human
uaauuauuaugacaacaauugc

SEQ ID NO: 869087 - RNA, 22 nt, Human
uccaggagucagacagauggug

SEQ ID NO: 869088 - RNA, 22 nt, Human
cuagaaauacaggcacgugcca

SEQ ID NO: 869089 - RNA, 22 nt, Human
guccuuaguuacuuuucauguc

SEQ ID NO: 869090 - RNA, 22 nt, Human
ucacacagauugguagagcuga

SEQ ID NO: 869091 - RNA, 22 nt, Human
uacuaaacccucgauggaucuu

SEQ ID NO: 869092 - RNA, 22 nt, Human
auacaacuuuacaugcaauucc

SEQ ID NO: 869093 - RNA, 23 nt, Human
uuucaacuccugccauuauuucu

SEQ ID NO: 869094 - RNA, 22 nt, Human
aaaggaagaugccaggacucug

SEQ ID NO: 869095 - RNA, 22 nt, Human
cggagaggaccugcaacucgcu

SEQ ID NO: 869096 - RNA, 23 nt, Human
caauuucauaugauucuaccuaa

SEQ ID NO: 869097 - RNA, 22 nt, Human
auauuauucuaguaacagugau

SEQ ID NO: 869098 - RNA, 23 nt, Human
ugaguucucaucuuggcuucuau

SEQ ID NO: 869099 - RNA, 22 nt, Human
aagcagaguccccuucccaugg

SEQ ID NO: 869100 - RNA, 22 nt, Human
caggcagcucgaugccuuguug

SEQ ID NO: 869101 - RNA, 22 nt, Human
ggaggcaggaaagacagguuca

SEQ ID NO: 869102 - RNA, 22 nt, Human
agaggggagagcuaagcaauuc

SEQ ID NO: 869103 - RNA, 22 nt, Human
acauguaaaaggaacaugcaug

SEQ ID NO: 869104 - RNA, 22 nt, Human
uuuauuguuaucaugggugagu

SEQ ID NO: 869105 - RNA, 22 nt, Human
ugaggcagaaaauagcaguuca

SEQ ID NO: 869106 - RNA, 22 nt, Human
agugcagcaugcuggggaggcu

SEQ ID NO: 869107 - RNA, 22 nt, Human
uauuucagcaagaagaaugugg

SEQ ID NO: 869108 - RNA, 22 nt, Human
aggagaggaaucauuauuacaa

SEQ ID NO: 869109 - RNA, 22 nt, Human
ucacugcugcugccaugaugga

SEQ ID NO: 869110 - RNA, 22 nt, Human
caucucaugggcaugccaagcu

SEQ ID NO: 869111 - RNA, 22 nt, Human
uucaggaucaaguugccaguag

SEQ ID NO: 869112 - RNA, 19 nt, Human
gccaggagggcucuggcug

SEQ ID NO: 869113 - RNA, 22 nt, Human
aaacuuuggauugugauugugc

SEQ ID NO: 869114 - RNA, 22 nt, Human
auggagggugguaagacagaga

SEQ ID NO: 869115 - RNA, 22 nt, Human
aaaauugagagucuugugcaag

SEQ ID NO: 869116 - RNA, 22 nt, Human
cuauacaguaaccacagugauu

SEQ ID NO: 869117 - RNA, 22 nt, Human
ucagagaggcaauacuguuuaa

SEQ ID NO: 869118 - RNA, 22 nt, Human
ucaguagcagaaagcaaugagu

SEQ ID NO: 869119 - RNA, 22 nt, Human
uucagaaaugaauauugguauu

SEQ ID NO: 869120 - RNA, 22 nt, Human
guacagaaaugugaugacgcaa

SEQ ID NO: 869121 - RNA, 22 nt, Human
uggcagcucuguucaacaugag

SEQ ID NO: 869122 - RNA, 22 nt, Human
ccaggagagcgcccucccggcc

SEQ ID NO: 869123 - RNA, 19 nt, Human
agauggcaaaaugcaaaga

SEQ ID NO: 869124 - RNA, 22 nt, Human
auuccaaacucuuucccugucg

SEQ ID NO: 869125 - RNA, 22 nt, Human
acaugauuuuaguaucauaaua

SEQ ID NO: 869126 - RNA, 22 nt, Human
uuuacagaaugucaauuucuau

SEQ ID NO: 869127 - RNA, 22 nt, Human
cuuguaauuauaauguacuguu

SEQ ID NO: 869128 - RNA, 22 nt, Human
cauugcuuccuaugucccuucu

SEQ ID NO: 869129 - RNA, 22 nt, Human
aagaaugagcucaaagaucuua

SEQ ID NO: 869130 - RNA, 22 nt, Human
ggcauuuagagggcuuuucuga

SEQ ID NO: 869131 - RNA, 22 nt, Human
gaguccuugacacauaguaggu

SEQ ID NO: 869132 - RNA, 22 nt, Human
ucagauggcacacagagccugc

SEQ ID NO: 869133 - RNA, 22 nt, Human
ugagauuuguuuuauaaaauag

SEQ ID NO: 869134 - RNA, 22 nt, Human
uuuaaugauagcuguuucacau

SEQ ID NO: 869135 - RNA, 22 nt, Human
uuucacauuuaggcgugaauug

SEQ ID NO: 869136 - RNA, 22 nt, Human
aacacuuugggcauggccuucc

SEQ ID NO: 869137 - RNA, 22 nt, Human
ucccugggcuucuccagacuug

SEQ ID NO: 869138 - RNA, 22 nt, Human
auugaaagcacaaagaacaagu

SEQ ID NO: 869139 - RNA, 22 nt, Human
gaaauaagaguccaugccaggu

SEQ ID NO: 869140 - RNA, 22 nt, Human
ucagaauaugcuaaugacauuu

SEQ ID NO: 869141 - RNA, 22 nt, Human
ugcuuaauagugcacugguuuc

SEQ ID NO: 869142 - RNA, 22 nt, Human
gugcuuuuaaaggcaauuagua

SEQ ID NO: 869143 - RNA, 22 nt, Human
gaguccuuggcaucaucaguac

SEQ ID NO: 869144 - RNA, 23 nt, Human
ggcagcucucaucugaugacuga

SEQ ID NO: 869145 - RNA, 22 nt, Human
uuccaugaaauguguuaugcuu

SEQ ID NO: 869146 - RNA, 22 nt, Human
aggcaguuucugggacagcaua

SEQ ID NO: 869147 - RNA, 22 nt, Human
agugcuuuccuucuugugacau

SEQ ID NO: 869148 - RNA, 22 nt, Human
cuuaggcagggcuggaagaucu

SEQ ID NO: 869149 - RNA, 19 nt, Human
uucuccagccugaccugag

SEQ ID NO: 869150 - RNA, 22 nt, Human
aguuggagugaacaugagauug

SEQ ID NO: 869151 - RNA, 18 nt, Human
ggcagcuugacuagcaac

SEQ ID NO: 869152 - RNA, 22 nt, Human
gcccaggauggcuggaggugcu

SEQ ID NO: 869153 - RNA, 22 nt, Human
agaaagcaucuccauuguaggu

SEQ ID NO: 869154 - RNA, 22 nt, Human
uugauacauuuuuaggauaaac

SEQ ID NO: 869155 - RNA, 22 nt, Human
agggagcucacaguccaguaga

SEQ ID NO: 869156 - RNA, 22 nt, Human
uggcagagugcagaagaggcau

SEQ ID NO: 869157 - RNA, 20 nt, Human
cccagguaggugccaugagu

SEQ ID NO: 869158 - RNA, 22 nt, Human
aaggcagcaugaaucccuguac

SEQ ID NO: 869159 - RNA, 22 nt, Human
cagucaccuugaggacucagac

SEQ ID NO: 869160 - RNA, 22 nt, Human
uuccacaauguaugaauaagau

SEQ ID NO: 869161 - RNA, 19 nt, Human
gagcgcagagggcagggga

SEQ ID NO: 869162 - RNA, 22 nt, Human
ggcagcucacgggcauggggug

SEQ ID NO: 869163 - RNA, 22 nt, Human
ucaggaugagcucauaacuaug

SEQ ID NO: 869164 - RNA, 21 nt, Human
auuuccaaauaaggucacauu

SEQ ID NO: 869165 - RNA, 22 nt, Human
augcuuuaaaugucuuuugcuu

SEQ ID NO: 869166 - RNA, 21 nt, Human
ucuugaaaauuguagcaguuu

SEQ ID NO: 869167 - RNA, 22 nt, Human
auguuucagauacagaucaaau

SEQ ID NO: 869168 - RNA, 22 nt, Human
auccaugaagguacuucucagg

SEQ ID NO: 869169 - RNA, 22 nt, Human rhinovirus B
uggccauucagcauaacacaca

SEQ ID NO: 869170 - RNA, 22 nt, Human
agggccaaguccaggaccucgg

SEQ ID NO: 869171 - RNA, 20 nt, Human
ucccaggcuccacccuagac

SEQ ID NO: 869172 - RNA, 22 nt, Human
auggcuuugaaguaauguaauu

SEQ ID NO: 869173 - RNA, 22 nt, Human
uacuuuuccuggaaccacugcu

SEQ ID NO: 869174 - RNA, 22 nt, Human
gguucacagguccugggagcag

SEQ ID NO: 869175 - RNA, 22 nt, Human
uuccaggaugcugcugcuuuuu

SEQ ID NO: 869176 - RNA, 22 nt, Human
gcugccaccguggagaugagug

SEQ ID NO: 869177 - RNA, 21 nt, Human
aguguguguggaaugagaaua

SEQ ID NO: 869178 - RNA, 19 nt, Human
ugggcagguucaguaaugg

SEQ ID NO: 869179 - RNA, 22 nt, Human
cccaguguuccuugaggggcug

SEQ ID NO: 869180 - RNA, 22 nt, Human
cuuuguaucuaaauaucuugaa

SEQ ID NO: 869181 - RNA, 22 nt, Human
cagcagcuccaaagaauagcca

SEQ ID NO: 869182 - RNA, 22 nt, Human
uuguuuaaagaacuucugacuu

SEQ ID NO: 869183 - RNA, 22 nt, Human
gaguuuauugucuuccaggcuu

SEQ ID NO: 869184 - RNA, 17 nt, Human
uagcuguguuucagcua

SEQ ID NO: 869185 - RNA, 22 nt, Human
aggacuucuaagcuaagaaguu

SEQ ID NO: 869186 - RNA, 22 nt, Human
auuugccuuuuaaacucacaau

SEQ ID NO: 869187 - RNA, 22 nt, Human
uguuuaugcaucguuaauacca

SEQ ID NO: 869188 - RNA, 22 nt, Human
ugaccuuucucugggugcuugg

SEQ ID NO: 869189 - RNA, 23 nt, Human
ugauuacaagggccaaagaaagg

SEQ ID NO: 869190 - RNA, 22 nt, Human
auaguguguuagugacauaggc

SEQ ID NO: 869191 - RNA, 22 nt, Human
ccugcugucucugggcaggcag

SEQ ID NO: 869192 - RNA, 22 nt, Human
ugucucagaguguuguauuaga

SEQ ID NO: 869193 - RNA, 22 nt, Human
auaaauagugcugccaugagua

SEQ ID NO: 869194 - RNA, 22 nt, Human
gccuggcugaggccucugcuaa

SEQ ID NO: 869195 - RNA, 21 nt, Human
ugucuuuaggaccuguuaaau

SEQ ID NO: 869196 - RNA, 22 nt, Human
cagggcugaacugagcuuguga

SEQ ID NO: 869197 - RNA, 22 nt, Human
ugcaucuaaguggcuaacaacc

SEQ ID NO: 869198 - RNA, 22 nt, Human
ugaaaguuauuacugaugaugu

SEQ ID NO: 869199 - RNA, 19 nt, Human
aaauaucagagagaugaua

SEQ ID NO: 869200 - RNA, 22 nt, Human
caguuucagcucaagcacucag

SEQ ID NO: 869201 - RNA, 22 nt, Human
gcagcaucagguucacugcgug

SEQ ID NO: 869202 - RNA, 23 nt, Human
cuuucauugugguuucacagagc

SEQ ID NO: 869203 - RNA, 22 nt, Human
cuggaaugccucccugucagag

SEQ ID NO: 869204 - RNA, 22 nt, Human
auguuuccauuuucuuguauca

SEQ ID NO: 869205 - RNA, 22 nt, Human
cugcugugcacccaggaaggcu

SEQ ID NO: 869206 - RNA, 22 nt, Human
auuagugcccaggcugccucuu

SEQ ID NO: 869207 - RNA, 22 nt, Human
cuuaggcaaccaggucaaugcu

SEQ ID NO: 869208 - RNA, 22 nt, Human
cauguauugaagugugcaucug

SEQ ID NO: 869209 - RNA, 22 nt, Human
cuuuauguuggggugucuuagu

SEQ ID NO: 869210 - RNA, 22 nt, Human
uagcaucaugaucagaacuguu

SEQ ID NO: 869211 - RNA, 22 nt, Human
auuuacauaauagacuuuaggu

SEQ ID NO: 869212 - RNA, 22 nt, Human
ucagugcuugacagcucuggga

SEQ ID NO: 869213 - RNA, 22 nt, Human
gcagccagguuugaggaccacu

SEQ ID NO: 869214 - RNA, 22 nt, Human
ugaaaacacuuuaguuuagguc

SEQ ID NO: 869215 - RNA, 22 nt, Human
uggcucugugucucccagcagc

SEQ ID NO: 869216 - RNA, 22 nt, Human
agaaaugacaagacugaucagg

SEQ ID NO: 869217 - RNA, 22 nt, Human
uauuugcugaaucugauucaga

SEQ ID NO: 869218 - RNA, 22 nt, Human
uaacagcauuugaaugaguaac

SEQ ID NO: 869219 - RNA, 22 nt, Human
agccagcaugaagacagaggcc

SEQ ID NO: 869220 - RNA, 22 nt, Human
uuucaguugauugcuuggguua

SEQ ID NO: 869221 - RNA, 22 nt, Human
cugaggcuaaccucgagagaca

SEQ ID NO: 869222 - RNA, 22 nt, Human
gggaguggauuauguggaccca

SEQ ID NO: 869223 - RNA, 22 nt, Human
ucucauuugccucaucuauaaa

SEQ ID NO: 869224 - RNA, 22 nt, Human
agagagguuugcuggaagauuc

SEQ ID NO: 869225 - RNA, 18 nt, Human
auuaaucauaaaaugcug

SEQ ID NO: 869226 - RNA, 22 nt, Human
uguucauuccggggagggcuaa

SEQ ID NO: 869227 - RNA, 19 nt, Human
auuugcuugucugcucugc

SEQ ID NO: 869228 - RNA, 20 nt, Human
ugcuggcaugcaagagggaa

SEQ ID NO: 869229 - RNA, 22 nt, Human
ucaugucaguuucuucuauaaa

SEQ ID NO: 869230 - RNA, 22 nt, Human
acauaaguuauggauaaaaugu

SEQ ID NO: 869231 - RNA, 22 nt, Human
ucccuguggauaucugcagcug

SEQ ID NO: 869232 - RNA, 22 nt, Human
cacugcagcaccaugcagggcu

SEQ ID NO: 869233 - RNA, 22 nt, Human
uacaucauuuuggagaugagca

SEQ ID NO: 869234 - RNA, 22 nt, Human
gggaagugaaguguagcugucu

SEQ ID NO: 869235 - RNA, 22 nt, Human
uauguuucaucaggcauggagu

SEQ ID NO: 869236 - RNA, 22 nt, Human
agcaaaagauagauuaacaaga

SEQ ID NO: 869237 - RNA, 22 nt, Human
guagaacuaggacuucagguau

SEQ ID NO: 869238 - RNA, 22 nt, Human
ucacacaugaguaaauacaggg

SEQ ID NO: 869239 - RNA, 22 nt, Human
auguaacacccacuuuuauagc

SEQ ID NO: 869240 - RNA, 22 nt, Human
gggucuggacggcugcaggaag

SEQ ID NO: 869241 - RNA, 22 nt, Human
aguucagaguaaauguugaagg

SEQ ID NO: 869242 - RNA, 22 nt, Human
acagccaaggaauuaggaaggg

SEQ ID NO: 869243 - RNA, 22 nt, Human
caggcagaguuagagcaacugg

SEQ ID NO: 869244 - RNA, 22 nt, Human
auuuuccucaagccucuggaag

SEQ ID NO: 869245 - RNA, 22 nt, Human
aagagagggacuuauuaaaguc

SEQ ID NO: 869246 - RNA, 22 nt, Human
cagccagcuggcacugugagua

SEQ ID NO: 869247 - RNA, 22 nt, Human
auuagauuguaaauguuuucac

SEQ ID NO: 869248 - RNA, 22 nt, Human
cuauguucucggcacuauggau

SEQ ID NO: 869249 - RNA, 22 nt, Human
uauguuuaguauccauuuucag

SEQ ID NO: 869250 - RNA, 22 nt, Human
ccacacugaaccucagugucuu

SEQ ID NO: 869251 - RNA, 22 nt, Human
ccugucuggggacucccugggu

SEQ ID NO: 869252 - RNA, 22 nt, Human
guccagccccugacucccaggc

SEQ ID NO: 869253 - RNA, 18 nt, Human
guacacaaagucaaagua

SEQ ID NO: 869254 - RNA, 22 nt, Human
aaacuaaaccuggcuuaguaag

SEQ ID NO: 869255 - RNA, 22 nt, Human
guuguacagcauccagugcaga

SEQ ID NO: 869256 - RNA, 22 nt, Human
aguggcugcugacuuuaauaca

SEQ ID NO: 869257 - RNA, 22 nt, Human
guaggaauuuugugagcuuucc

SEQ ID NO: 869258 - RNA, 22 nt, Human
cugagugaucagcuuggguccg

SEQ ID NO: 869259 - RNA, 22 nt, Human
uuuucacacaaggugauaaguu

SEQ ID NO: 869260 - RNA, 22 nt, Human
uccucaggaucuaggagugcuu

SEQ ID NO: 869261 - RNA, 22 nt, Human
ugacagagcaagaucuagauaa

SEQ ID NO: 869262 - RNA, 22 nt, Human
uucuagacuguguacagauuca

SEQ ID NO: 869263 - RNA, 22 nt, Human
aaacuagaugauuaugaagcau

SEQ ID NO: 869264 - RNA, 22 nt, Human
cauuuagaagucuuagaacuau

SEQ ID NO: 869265 - RNA, 22 nt, Human
acacaaaaucaaaguccuaggc

SEQ ID NO: 869266 - RNA, 22 nt, Human
auugcucagcacaagcagcaga

SEQ ID NO: 869267 - RNA, 22 nt, Human
guggaagguaaugcagcuuacu

SEQ ID NO: 869268 - RNA, 22 nt, Human
ugaagcaacuggacaaguuggc

SEQ ID NO: 869269 - RNA, 22 nt, Human
cagcuggccugagcgguggcgg

SEQ ID NO: 869270 - RNA, 20 nt, Human
agcuguuuacauggauuucu

SEQ ID NO: 869271 - RNA, 22 nt, Human
agcacagaugugaguggaggcu

SEQ ID NO: 869272 - RNA, 22 nt, Human
uaugucuuaacucuagaaaggu

SEQ ID NO: 869273 - RNA, 22 nt, Human
ugauauuuaagcaaaaauaugg

SEQ ID NO: 869274 - RNA, 22 nt, Human
gaaagguuuggcuuuucaguag

SEQ ID NO: 869275 - RNA, 22 nt, Human
aaugcuuuuacgacauguaccu

SEQ ID NO: 869276 - RNA, 22 nt, Human
aaaauaugacugugcuccuuaa

SEQ ID NO: 869277 - RNA, 22 nt, Human
gagcagugacuggagcaugaga

SEQ ID NO: 869278 - RNA, 22 nt, Human
acagcagggucacauucccucu

SEQ ID NO: 869279 - RNA, 22 nt, Human
uccacagguccggcaugaacag

SEQ ID NO: 869280 - RNA, 22 nt, Human
uuucuaaaugguggcugcauug

SEQ ID NO: 869281 - RNA, 22 nt, Human
gcugcagcagcugcaggguugu

SEQ ID NO: 869282 - RNA, 22 nt, Human
gcucagaguuaauuggaugggu

SEQ ID NO: 869283 - RNA, 22 nt, Human
ccugugccaaaaggcugcuuau

SEQ ID NO: 869284 - RNA, 22 nt, Human
uuucucagcucagcaucugggu

SEQ ID NO: 869285 - RNA, 22 nt, Human
aggccagcuguuacuagagcca

SEQ ID NO: 869286 - RNA, 22 nt, Human
guucuaggagccaagaauauag

SEQ ID NO: 869287 - RNA, 22 nt, Human
ucauaaagcuugccugcagugu

SEQ ID NO: 869288 - RNA, 22 nt, Human
ucuuuccuacuuuauugugaac

SEQ ID NO: 869289 - RNA, 22 nt, Human
gaguugccucuaagucccuggu

SEQ ID NO: 869290 - RNA, 22 nt, Human
uccaggaggcagggcugugccc

SEQ ID NO: 869291 - RNA, 22 nt, Human
ggggugugucugacaaugguau

SEQ ID NO: 869292 - RNA, 22 nt, Human
aaauccuaagcagaggaauuua

SEQ ID NO: 869293 - RNA, 22 nt, Human
uguccauacaauguaacaucuu

SEQ ID NO: 869294 - RNA, 22 nt, Human
uucuucaaaauccagcaugauu

SEQ ID NO: 869295 - RNA, 22 nt, Human
uauauuugugugugauuuauga

SEQ ID NO: 869296 - RNA, 22 nt, Human
cccagguguuuguggcagaggu

SEQ ID NO: 869297 - RNA, 22 nt, Human
auauuuguaaaauucugugucu

SEQ ID NO: 869298 - RNA, 22 nt, Human
augccucugcucuugguccuca

SEQ ID NO: 869299 - RNA, 22 nt, Human
uuuguuuucaaugugucauuca

SEQ ID NO: 869300 - RNA, 22 nt, Human
ccaggcuguaagagugauguug

SEQ ID NO: 869301 - RNA, 21 nt, Human
uccagggucagaaguucagug

SEQ ID NO: 869302 - RNA, 22 nt, Human
aggagcuucagagagaaccugg

SEQ ID NO: 869303 - RNA, 23 nt, Human
ugggucacuguuucaccauugcu

SEQ ID NO: 869304 - RNA, 22 nt, Human
caaaguaauuuggagauauaua

SEQ ID NO: 869305 - RNA, 22 nt, Human
auaacuuagaguaggcaaaagu

SEQ ID NO: 869306 - RNA, 22 nt, Human
aaagaugccuaacucagaagau

SEQ ID NO: 869307 - RNA, 22 nt, Human
agggcagcagcugucccugaga

SEQ ID NO: 869308 - RNA, 22 nt, Human
gauuucaaagguucugcaugcc

SEQ ID NO: 869309 - RNA, 20 nt, Human
uccuaacuauaaaguggcuc

SEQ ID NO: 869310 - RNA, 22 nt, Human
uuuacagagaauguacauaaag

SEQ ID NO: 869311 - RNA, 22 nt, Human
ucugugaaaggaaagaacugac

SEQ ID NO: 869312 - RNA, 22 nt, Human
ccuugggagaaauugcagaguc

SEQ ID NO: 869313 - RNA, 22 nt, Human
gggcuccaaccccagugaacuc

SEQ ID NO: 869314 - RNA, 22 nt, Human
uuucuaaucugauucuccuacc

SEQ ID NO: 869315 - RNA, 17 nt, Human
ccaggucuccuugcuuu

SEQ ID NO: 869316 - RNA, 22 nt, Human
gcccagcaggacagagugguuu

SEQ ID NO: 869317 - RNA, 22 nt, Human
uuagaagcaggcugugucccca

SEQ ID NO: 869318 - RNA, 22 nt, Human
aaaguuuuauaugcugcagcga

SEQ ID NO: 869319 - RNA, 22 nt, Human
gugcucuaaggcaccacugagc

SEQ ID NO: 869320 - RNA, 22 nt, Human
gggucccuggaauuacuugaca

SEQ ID NO: 869321 - RNA, 22 nt, Human
uguucuuaacuuuuguguauau

SEQ ID NO: 869322 - RNA, 22 nt, Human
gugaaauuguauuuggcauuga

SEQ ID NO: 869323 - RNA, 22 nt, Human
uucagcaagugucucuacuguc

SEQ ID NO: 869324 - RNA, 22 nt, Human
uucagugcagacgccgaagccc

SEQ ID NO: 869325 - RNA, 22 nt, Human
ccuggccaggcauggagucaca

SEQ ID NO: 869326 - RNA, 22 nt, Human
cuucuacacaucccucuugcuu

SEQ ID NO: 869327 - RNA, 22 nt, Human
aaagaacagauguguggugcau

SEQ ID NO: 869328 - RNA, 22 nt, Human
uuggccagagguuucucucaug

SEQ ID NO: 869329 - RNA, 22 nt, Human
aaaggcuucggaucagaaggua

SEQ ID NO: 869330 - RNA, 22 nt, Human
ugacacuucaaagaccaggguc

SEQ ID NO: 869331 - RNA, 22 nt, Human
agaugcagaaaaacuaagugau

SEQ ID NO: 869332 - RNA, 22 nt, Human
ugcuccugaacacagcccuaug

SEQ ID NO: 869333 - RNA, 22 nt, Human
uaggcuucccgcucacaugccc

SEQ ID NO: 869334 - RNA, 23 nt, Human
acugccugugccgaucucucuca

SEQ ID NO: 869335 - RNA, 22 nt, Human
accuggagcuuccaacucaacu

SEQ ID NO: 869336 - RNA, 20 nt, Human
aagcuucacuucauuugauc

SEQ ID NO: 869337 - RNA, 22 nt, Human
uagugccaaagccuggugucau

SEQ ID NO: 869338 - RNA, 22 nt, Human
aauuacaaauguagacucucau

SEQ ID NO: 869339 - RNA, 22 nt, Human
uaagccugcaugaaccaugaga

SEQ ID NO: 869340 - RNA, 22 nt, Human
uccaggcuccugacuuuuuggg

SEQ ID NO: 869341 - RNA, 22 nt, Human
ugucauggacagauuagaugag

SEQ ID NO: 869342 - RNA, 22 nt, Human
auacagaugagaucaggcauaa

SEQ ID NO: 869343 - RNA, 23 nt, Human
uuacaacuauuugccauguuguu

SEQ ID NO: 869344 - RNA, 22 nt, Human
ugcuuucacuucucugcagcca

SEQ ID NO: 869345 - RNA, 23 nt, Human
aguuucacauuuuacauguggcu

SEQ ID NO: 869346 - RNA, 19 nt, Human
cugcucagagcagcuccag

SEQ ID NO: 869347 - RNA, 22 nt, Human
cucacugcccugaaguuggguu

SEQ ID NO: 869348 - RNA, 22 nt, Human
cagccugacaccagcuuugggc

SEQ ID NO: 869349 - RNA, 22 nt, Human
uacauucagaauugggaggcaa

SEQ ID NO: 869350 - RNA, 22 nt, Human
uaaagguccaaagagggcuacg

SEQ ID NO: 869351 - RNA, 22 nt, Human
aggaaaugcaggcaaauacucu

SEQ ID NO: 869352 - RNA, 22 nt, Human
uuuauuucacucuccggauacu

SEQ ID NO: 869353 - RNA, 22 nt, Human
agcccaggaaguugaggcuugc

SEQ ID NO: 869354 - RNA, 22 nt, Human
cugauuccaaagccaaagcuau

SEQ ID NO: 869355 - RNA, 22 nt, Human
gcuucaaacugagcuucaagug

SEQ ID NO: 869356 - RNA, 22 nt, Human
uuacauuuugggguaaggauaa

SEQ ID NO: 869357 - RNA, 22 nt, Human
aaagaggcagguguuacuggaa

SEQ ID NO: 869358 - RNA, 22 nt, Human
ucacauucuucccugacuucuu

SEQ ID NO: 869359 - RNA, 22 nt, Human
cuggagggcuggacuaaggaaa

SEQ ID NO: 869360 - RNA, 22 nt, Human
guucaguguuuuuauugacagg

SEQ ID NO: 869361 - RNA, 22 nt, Human
agucagagacccuagaucuaau

SEQ ID NO: 869362 - RNA, 22 nt, Human
ccagggugugggcgucggcacg

SEQ ID NO: 869363 - RNA, 22 nt, Human
caaauguaauugcgguuuuugc

SEQ ID NO: 869364 - RNA, 22 nt, Human
uggcccugggcaucuuucguga

SEQ ID NO: 869365 - RNA, 22 nt, Human
cucuccucagaacaggcccucu

SEQ ID NO: 869366 - RNA, 22 nt, Human
gugaaggcuaauuaaacaaguu

SEQ ID NO: 869367 - RNA, 22 nt, Human
gcugggaguuugauuugacugg

SEQ ID NO: 869368 - RNA, 21 nt, Human
uccaggagcacgggacuagga

SEQ ID NO: 869369 - RNA, 22 nt, Human
guggccagggcccacaggauga

SEQ ID NO: 869370 - RNA, 22 nt, Human
gggcuguggagccgcgagggcu

SEQ ID NO: 869371 - RNA, 22 nt, Human
uuugagaaaugggcucugugcu

SEQ ID NO: 869372 - RNA, 22 nt, Human
uuaggcaaagauauuacguagu

SEQ ID NO: 869373 - RNA, 22 nt, Human
ucucugggccucccuuuccaag

SEQ ID NO: 869374 - RNA, 22 nt, Human
aggaauugccuggggccuggga

SEQ ID NO: 869375 - RNA, 22 nt, Human
uuccugggccuuaaaucuuuug

SEQ ID NO: 869376 - RNA, 22 nt, Human
uaaguccaaggguaugaguugg

SEQ ID NO: 869377 - RNA, 22 nt, Human
gccugccuuuguaugacccuga

SEQ ID NO: 869378 - RNA, 22 nt, Human
cauuauugccagccauacugaa

SEQ ID NO: 869379 - RNA, 22 nt, Human
cagugcuccugauguacccuug

SEQ ID NO: 869380 - RNA, 21 nt, Human
aagaacuauugagguacacag

SEQ ID NO: 869381 - RNA, 22 nt, Human
ugcuauuaccugcuggacaguc

SEQ ID NO: 869382 - RNA, 22 nt, Human
aauucccauuugcagaaaauca

SEQ ID NO: 869383 - RNA, 22 nt, Human
gugucuauaaugaaaugcacuu

SEQ ID NO: 869384 - RNA, 22 nt, Human
aucuuuaggaaccuaaccuauu

SEQ ID NO: 869385 - RNA, 22 nt, Human
ucaaauaugugauagaagcuaa

SEQ ID NO: 869386 - RNA, 22 nt, Human
guauaguuugcgauuugugguu

SEQ ID NO: 869387 - RNA, 22 nt, Human
aaaacauguccauacagaaacu

SEQ ID NO: 869388 - RNA, 22 nt, Human
ggcaguguuuauggguaacaca

SEQ ID NO: 869389 - RNA, 19 nt, Human
agagauccagcuucuagcu

SEQ ID NO: 869390 - RNA, 20 nt, Human
cuggaagccuuuccagagca

SEQ ID NO: 869391 - RNA, 22 nt, Human
aguccauaggcaguucauaaca

SEQ ID NO: 869392 - RNA, 22 nt, Human
gcagugaagauggcagguuggg

SEQ ID NO: 869393 - RNA, 22 nt, Human
cagaaccuuggugguagggaca

SEQ ID NO: 869394 - RNA, 22 nt, Human
agagagcuguccugggacaccc

SEQ ID NO: 869395 - RNA, 22 nt, Human
cccuggaguagcacugggucgc

SEQ ID NO: 869396 - RNA, 22 nt, Human
ucagcuccuauacuuuguccug

SEQ ID NO: 869397 - RNA, 22 nt, Human
ucauguuuuugccauaugacuc

SEQ ID NO: 869398 - RNA, 22 nt, Human
uguuuacaugcauaagcuuaag

SEQ ID NO: 869399 - RNA, 22 nt, Human
acaggacaacucagcagccagc

SEQ ID NO: 869400 - RNA, 22 nt, Human
uccuagaagauggaucagagaa

SEQ ID NO: 869401 - RNA, 23 nt, Human
ggcuagaguggaggggaacugca

SEQ ID NO: 869402 - RNA, 22 nt, Human
aaacaucuaucagcauuuuuua

SEQ ID NO: 869403 - RNA, 22 nt, Human
acagggccucagccagggcaga

SEQ ID NO: 869404 - RNA, 22 nt, Human
gggaagaagacauggugaaggc

SEQ ID NO: 869405 - RNA, 22 nt, Human
aaagcauuucaugucuagaaag

SEQ ID NO: 869406 - RNA, 22 nt, Human
cuguggcucaggccuguaagcc

SEQ ID NO: 869407 - RNA, 21 nt, Human
acagcagcaaucugucuuucc

SEQ ID NO: 869408 - RNA, 22 nt, Human
uagccaaagaagguauauuugu

SEQ ID NO: 869409 - RNA, 22 nt, Human
agccacugucugaacuucugug

SEQ ID NO: 869410 - RNA, 22 nt, Human
auggaaugccaaguucacugcu

SEQ ID NO: 869411 - RNA, 22 nt, Human
aggucuaacugauagaauucau

SEQ ID NO: 869412 - RNA, 22 nt, Human
ugggugacagacaccucucugu

SEQ ID NO: 869413 - RNA, 20 nt, Human
acaaucuguuuguugucugu

SEQ ID NO: 869414 - RNA, 22 nt, Human
aaauacagaguugcuuaaaagc

SEQ ID NO: 869415 - RNA, 22 nt, Human
agcuggggguagugagaaauaa

SEQ ID NO: 869416 - RNA, 22 nt, Human
uaaguucucugaaaugaaaaag

SEQ ID NO: 869417 - RNA, 23 nt, Human
cugugcucagagggagggagagc

SEQ ID NO: 869418 - RNA, 22 nt, Human
agugucugaguaaauuucucau

SEQ ID NO: 869419 - RNA, 22 nt, Human
gagggcucuaccaaguaacucu

SEQ ID NO: 869420 - RNA, 22 nt, Human
gaagguuuugauuccacugaau

SEQ ID NO: 869421 - RNA, 22 nt, Human
gacagccaggucugaugaccca

SEQ ID NO: 869422 - RNA, 22 nt, Human
uguaaaguuuuauuguuccuuc

SEQ ID NO: 869423 - RNA, 22 nt, Human
ucuuugauacagauguaagcug

SEQ ID NO: 869424 - RNA, 22 nt, Human
cugcuccagacaccugcagggg

SEQ ID NO: 869425 - RNA, 22 nt, Human
ucugggaguggguccaaggaau

SEQ ID NO: 869426 - RNA, 22 nt, Human
caggacacuacagaugggaggg

SEQ ID NO: 869427 - RNA, 22 nt, Human
cugcuuucugcaccccaggucg

SEQ ID NO: 869428 - RNA, 22 nt, Human
aguuucauauuaccaugucacc

SEQ ID NO: 869429 - RNA, 22 nt, Human
gagcugcacaucugaggcuaau

SEQ ID NO: 869430 - RNA, 21 nt, Human
uucuagaaccgugggcgguuc

SEQ ID NO: 869431 - RNA, 22 nt, Human
gccuggcucugagggagcuccu

SEQ ID NO: 869432 - RNA, 22 nt, Human
cugcuguggccagccaggucaa

SEQ ID NO: 869433 - RNA, 22 nt, Human
ugaagcccugucuuauggaaga

SEQ ID NO: 869434 - RNA, 22 nt, Human
uccagacucugucacuuccuag

SEQ ID NO: 869435 - RNA, 22 nt, Human
ucucugagguuguuuccagcac

SEQ ID NO: 869436 - RNA, 22 nt, Human
uggcuacaucacagagaauucc

SEQ ID NO: 869437 - RNA, 22 nt, Human
caggcugccgugaagcaggccu

SEQ ID NO: 869438 - RNA, 22 nt, Human
caggagcucacugucuaauggg

SEQ ID NO: 869439 - RNA, 22 nt, Human
ugaaagguagcuggccucauag

SEQ ID NO: 869440 - RNA, 22 nt, Human
caguguuuagcacagugcuugg

SEQ ID NO: 869441 - RNA, 22 nt, Human
gcagagcugucuaagucacuuc

SEQ ID NO: 869442 - RNA, 22 nt, Human
guucugggucuggacacacaga

SEQ ID NO: 869443 - RNA, 22 nt, Human
uugagauagaucucaucuuccc

SEQ ID NO: 869444 - RNA, 22 nt, Human
ugucaguguauacauacaguau

SEQ ID NO: 869445 - RNA, 22 nt, Human
aggcucugugaugugccaggca

SEQ ID NO: 869446 - RNA, 22 nt, Human
cagcuugugcaaagguccuggg

SEQ ID NO: 869447 - RNA, 22 nt, Human
gcuguacaguuuacuagguggg

SEQ ID NO: 869448 - RNA, 22 nt, Human
aguuuuauguagacaauucauu

SEQ ID NO: 869449 - RNA, 22 nt, Human
uacagauauuucucuucaacaa

SEQ ID NO: 869450 - RNA, 22 nt, Human
acagagcaugcucaguguguga

SEQ ID NO: 869451 - RNA, 22 nt, Human
ugaauuaaaggaauucgaauuc

SEQ ID NO: 869452 - RNA, 22 nt, Human
ugagccaggcccagugggguca

SEQ ID NO: 869453 - RNA, 17 nt, Human
ccuuucucuuucaucuc

SEQ ID NO: 869454 - RNA, 22 nt, Human
guacaauuaagugcacaaauag

SEQ ID NO: 869455 - RNA, 22 nt, Human
augcaaauaaacagucuaguug

SEQ ID NO: 869456 - RNA, 22 nt, Human
cugcaaaaguaauugcagguuu

SEQ ID NO: 869457 - RNA, 22 nt, Human
uagugugucccuggggaguguu

SEQ ID NO: 869458 - RNA, 20 nt, Human
aaaaauugauaucgcuuccu

SEQ ID NO: 869459 - RNA, 22 nt, Human
agcugcuccaauuuuuaccauu

SEQ ID NO: 869460 - RNA, 22 nt, Human
ucugggccuuggaguggggaga

SEQ ID NO: 869461 - RNA, 22 nt, Human
gcauucuuugaaugcuucuaau

SEQ ID NO: 869462 - RNA, 22 nt, Human
gcugaagcccacguggcuugua

SEQ ID NO: 869463 - RNA, 21 nt, Human
guucaauagcucuuugaaugc

SEQ ID NO: 869464 - RNA, 22 nt, Human
agcaggugaugugagucuggaa

SEQ ID NO: 869465 - RNA, 22 nt, Human
cugccagacacguuaugcucau

SEQ ID NO: 869466 - RNA, 22 nt, Human
uguacagauugaucauggagag

SEQ ID NO: 869467 - RNA, 19 nt, Human
cucuuuccauuguauuugc

SEQ ID NO: 869468 - RNA, 22 nt, Human
acaugcaugcuuuggugggugu

SEQ ID NO: 869469 - RNA, 22 nt, Human
gaaauguuccugaucccugauu

SEQ ID NO: 869470 - RNA, 22 nt, Human
uuucuuauauucugucauuguu

SEQ ID NO: 869471 - RNA, 22 nt, Human
ugucucugagaugacucccacc

SEQ ID NO: 869472 - RNA, 22 nt, Human
ugucucugaaauauguggcucc

SEQ ID NO: 869473 - RNA, 22 nt, Human
ucacauuuguguuuuauuagag

SEQ ID NO: 869474 - RNA, 22 nt, Human
uaaagcagugguucucaaacuu

SEQ ID NO: 869475 - RNA, 22 nt, Human
gaugucuuucuaauacuggcuu

SEQ ID NO: 869476 - RNA, 22 nt, Human
agcucccauuaucuucugaaac

SEQ ID NO: 869477 - RNA, 22 nt, Human
aucuuuaggcaaguuacuuaac

SEQ ID NO: 869478 - RNA, 22 nt, Human
ggcugccuucagacuccagcuu

SEQ ID NO: 869479 - RNA, 22 nt, Human
auuagcaacauggugaauaugu

SEQ ID NO: 869480 - RNA, 22 nt, Human
cccaggucgucagcaguguggu

SEQ ID NO: 869481 - RNA, 16 nt, Human
ugugcauguucugugu

SEQ ID NO: 869482 - RNA, 22 nt, Human
ccagcccucacugaggccucuc

SEQ ID NO: 869483 - RNA, 22 nt, Human
auucacaugauguauguagggc

SEQ ID NO: 869484 - RNA, 22 nt, Human
agagucuuuugucaguaauguu

SEQ ID NO: 869485 - RNA, 20 nt, Human
ucuuggaaaaaguucagaau

SEQ ID NO: 869486 - RNA, 22 nt, Human
cugacagguugguagcuuugga

SEQ ID NO: 869487 - RNA, 22 nt, Human
auuuccaugucgguauuuuaua

SEQ ID NO: 869488 - RNA, 22 nt, Human
cugccucuguugggcauggucu

SEQ ID NO: 869489 - RNA, 22 nt, Human
uccaggcucagucaagcacuuc

SEQ ID NO: 869490 - RNA, 19 nt, Human
uguacguguggguguuuaa

SEQ ID NO: 869491 - RNA, 22 nt, Human
gagagcuggccagcuucaguau

SEQ ID NO: 869492 - RNA, 22 nt, Human
cauucaaauuaagauuuuguua

SEQ ID NO: 869493 - RNA, 22 nt, Human
ggcccuguuagagcucccacaa

SEQ ID NO: 869494 - RNA, 22 nt, Human
ugagacagccucugcacucaug

SEQ ID NO: 869495 - RNA, 22 nt, Human
ucaggccugcaaaugaauggua

SEQ ID NO: 869496 - RNA, 22 nt, Human
uagcaacugcucuauucuagga

SEQ ID NO: 869497 - RNA, 22 nt, Human
uuggaagaguagaguugaauaa

SEQ ID NO: 869498 - RNA, 22 nt, Human
gugagcuucugccucucagucc

SEQ ID NO: 869499 - RNA, 21 nt, Human
ucugggagugggaaaaugguc

SEQ ID NO: 869500 - RNA, 22 nt, Human
aguucagccauuuguuaacuau

SEQ ID NO: 869501 - RNA, 21 nt, Human
auucucaggcccauccucagg

SEQ ID NO: 869502 - RNA, 22 nt, Human
aucuuuaguagaggaauauauu

SEQ ID NO: 869503 - RNA, 22 nt, Human
ucuucuuaaaguauguucucuu

SEQ ID NO: 869504 - RNA, 22 nt, Human
uccugugugcuuucuuuagguu

SEQ ID NO: 869505 - RNA, 22 nt, Human
caguaguggucuaucacuggag

SEQ ID NO: 869506 - RNA, 22 nt, Human
agguugaacccccaagaccuau

SEQ ID NO: 869507 - RNA, 22 nt, Human
ccuucugucucccucauauuga

SEQ ID NO: 869508 - RNA, 22 nt, Human
gggcucagucugcggcgcgcgg

SEQ ID NO: 869509 - RNA, 23 nt, Human
agaguuuucuguuuucuguaggg

SEQ ID NO: 869510 - RNA, 22 nt, Human
uuccuuucugucagccugagug

SEQ ID NO: 869511 - RNA, 22 nt, Human
aggucaaaaugcuuuucagguc

SEQ ID NO: 869512 - RNA, 22 nt, Human
uuggccagguccauuucuccau

SEQ ID NO: 869513 - RNA, 22 nt, Human
aaguaacacggaacuugaagca

SEQ ID NO: 869514 - RNA, 20 nt, Human
uuucuggguacucucccucu

SEQ ID NO: 869515 - RNA, 22 nt, Human
ucugcugugauuugcuaccugu

SEQ ID NO: 869516 - RNA, 22 nt, Human
cacagggcagugcugcccacuc

SEQ ID NO: 869517 - RNA, 22 nt, Human
gcccaggaaaugccccguggug

SEQ ID NO: 869518 - RNA, 22 nt, Human
acuaaauaguuuugacagaaca

SEQ ID NO: 869519 - RNA, 21 nt, Human
uggguccccgacacgcuaccu

SEQ ID NO: 869520 - RNA, 22 nt, Human
aagcacaggagacgcacagcca

SEQ ID NO: 869521 - RNA, 17 nt, Human
gggagaugaagggauau

SEQ ID NO: 869522 - RNA, 22 nt, Human
aauucacaugcaugucugugca

SEQ ID NO: 869523 - RNA, 22 nt, Human
ucacaacucuuuccauuuaaua

SEQ ID NO: 869524 - RNA, 22 nt, Human
ccugugccauccugagcauccc

SEQ ID NO: 869525 - RNA, 22 nt, Human
ugucauggucuguaaggagccc

SEQ ID NO: 869526 - RNA, 22 nt, Human
cucagcagguaccacaugaucu

SEQ ID NO: 869527 - RNA, 22 nt, Human
augaaauaucuugaagaaauuc

SEQ ID NO: 869528 - RNA, 22 nt, Human
cuuguucaucugcauaccaagu

SEQ ID NO: 869529 - RNA, 22 nt, Human
gcaaugcaaucagaugauuauu

SEQ ID NO: 869530 - RNA, 22 nt, Human
agagacugucacauaacagagg

SEQ ID NO: 869531 - RNA, 23 nt, Human
uguuuuucauucacaugggcugu

SEQ ID NO: 869532 - RNA, 22 nt, Human
ggagaagguggcucagcaaagg

SEQ ID NO: 869533 - RNA, 22 nt, Human
auaaucagaauucaugaaagau

SEQ ID NO: 869534 - RNA, 19 nt, Human
uguacauauagagcucagu

SEQ ID NO: 869535 - RNA, 22 nt, Human
aucaacagugaagagaucaaga

SEQ ID NO: 869536 - RNA, 22 nt, Human
aauaauauuugaagcuucaaag

SEQ ID NO: 869537 - RNA, 22 nt, Human
acaugcaugggguaaugguauu

SEQ ID NO: 869538 - RNA, 22 nt, Human
uggaaauuacuaacacuuagag

SEQ ID NO: 869539 - RNA, 22 nt, Human
uggcuggaauggagcugagccu

SEQ ID NO: 869540 - RNA, 22 nt, Human
ccagauuugagcgucuuaaacc

SEQ ID NO: 869541 - RNA, 22 nt, Human
uuaaugcuugucuagaucuucu

SEQ ID NO: 869542 - RNA, 22 nt, Human
gugcaguggcagauccuagcuc

SEQ ID NO: 869543 - RNA, 22 nt, Human
gcuguucuuucagcccagggcu

SEQ ID NO: 869544 - RNA, 22 nt, Human
uucuucuugucugcccucacau

SEQ ID NO: 869545 - RNA, 22 nt, Human
guuuaugaaugugucagacaua

SEQ ID NO: 869546 - RNA, 22 nt, Human
caggacacuuguucuucucugc

SEQ ID NO: 869547 - RNA, 22 nt, Human
ggucaugagggagcagugcagg

SEQ ID NO: 869548 - RNA, 22 nt, Human
uaguucuacucaaagugugauc

SEQ ID NO: 869549 - RNA, 22 nt, Human
guuucauauauaguaacugaaa

SEQ ID NO: 869550 - RNA, 22 nt, Human
acaagguauccacauuaaaugu

SEQ ID NO: 869551 - RNA, 22 nt, Human
acagacugucaugacacuauau

SEQ ID NO: 869552 - RNA, 22 nt, Human
cccagggguucuagaccagcuu

SEQ ID NO: 869553 - RNA, 22 nt, Human
ggagaggaaaugccagcacuuc

SEQ ID NO: 869554 - RNA, 22 nt, Human
aaaaugugaucuacaaaugcaa

SEQ ID NO: 869555 - RNA, 22 nt, Human
gugcaauuuugcaucuguaugc

SEQ ID NO: 869556 - RNA, 22 nt, Human
ugggggagauuagagcuucuua

SEQ ID NO: 869557 - RNA, 22 nt, Human
ccagggauguggcagcaccaua

SEQ ID NO: 869558 - RNA, 22 nt, Human
ugcuccagaaccugaccaugcu

SEQ ID NO: 869559 - RNA, 22 nt, Human
auguacauaaaauguauaauga

SEQ ID NO: 869560 - RNA, 22 nt, Human
agcagcaucuucuaaguaaggc

SEQ ID NO: 869561 - RNA, 22 nt, Human
caggcagccugcggucugcaca

SEQ ID NO: 869562 - RNA, 22 nt, Human
aauuguacaggaaguugcugga

SEQ ID NO: 869563 - RNA, 22 nt, Human
gaguaacaucuggaaccgacac

SEQ ID NO: 869564 - RNA, 22 nt, Human
gcuucugccuugcacuuuguca

SEQ ID NO: 869565 - RNA, 22 nt, Human
ugagggcuaaauuguggcaggu

SEQ ID NO: 869566 - RNA, 22 nt, Human
ggugcugaugaagauguagccu

SEQ ID NO: 869567 - RNA, 22 nt, Human
agcuggagccagugugaggcuu

SEQ ID NO: 869568 - RNA, 22 nt, Human
acugcaacaccuccuggguuca

SEQ ID NO: 869569 - RNA, 22 nt, Human
cuggaagaggaagccagcugga

SEQ ID NO: 869570 - RNA, 17 nt, Human
gacaggcucagugacga

SEQ ID NO: 869571 - RNA, 22 nt, Human
gaagccaguguuugaagaauuu

SEQ ID NO: 869572 - RNA, 22 nt, Human
ggcaucuguccaucucuccagc

SEQ ID NO: 869573 - RNA, 22 nt, Human
acagguaccggucagauuacgg

SEQ ID NO: 869574 - RNA, 22 nt, Human
ucagugaaccuucuguggcagg

SEQ ID NO: 869575 - RNA, 22 nt, Human
guggccagccccauggacaguu

SEQ ID NO: 869576 - RNA, 23 nt, Human
uaggcucuguagguagagauggg

SEQ ID NO: 869577 - RNA, 22 nt, Human
uuuguguggcguuggccggcgg

SEQ ID NO: 869578 - RNA, 22 nt, Human
aaaaguuaccucuguaauauaa

SEQ ID NO: 869579 - RNA, 22 nt, Human
ugucuauuugaauuauccuaau

SEQ ID NO: 869580 - RNA, 22 nt, Human
cccugaggaccaggaaggaggg

SEQ ID NO: 869581 - RNA, 22 nt, Human
gugacagcuccuugguuagaug

SEQ ID NO: 869582 - RNA, 22 nt, Human
ccaggcccugccugugguuccu

SEQ ID NO: 869583 - RNA, 22 nt, Human
uuucugauauucauuuagaaga

SEQ ID NO: 869584 - RNA, 22 nt, Human
cagcaacuuaggcagaacaucu

SEQ ID NO: 869585 - RNA, 22 nt, Human
uauagagucauguuuacucuaa

SEQ ID NO: 869586 - RNA, 22 nt, Human
gaaauuuacaacuuucucaugg

SEQ ID NO: 869587 - RNA, 22 nt, Human
cuucagcuguggucuccaaggc

SEQ ID NO: 869588 - RNA, 22 nt, Human
uggggcagggaugggaaacuau

SEQ ID NO: 869589 - RNA, 22 nt, Human
agcugcagguucagcauuccac

SEQ ID NO: 869590 - RNA, 23 nt, Human
cuguggccaccccuagcuggagg

SEQ ID NO: 869591 - RNA, 22 nt, Human
gagcccagggugaaauagcagc

SEQ ID NO: 869592 - RNA, 22 nt, Human
uuuauuaagaugcgaaugcuga

SEQ ID NO: 869593 - RNA, 22 nt, Human
ugagccaggcuccaugccaccu

SEQ ID NO: 869594 - RNA, 22 nt, Human
aaagcaugauuagauagaugau

SEQ ID NO: 869595 - RNA, 22 nt, Human
uccccacuccugggcagaugcg

SEQ ID NO: 869596 - RNA, 22 nt, Human
cuauuaaauacucuucaaauug

SEQ ID NO: 869597 - RNA, 22 nt, Human
aggggugaaggcccgauaggag

SEQ ID NO: 869598 - RNA, 22 nt, Human
uguuauuauguuuccagagccu

SEQ ID NO: 869599 - RNA, 22 nt, Human
auucauguucggggccacguug

SEQ ID NO: 869600 - RNA, 22 nt, Human
uccuguguucuagguauggucu

SEQ ID NO: 869601 - RNA, 22 nt, Human
cugcaggguuuuucaaggacaa

SEQ ID NO: 869602 - RNA, 21 nt, Human
gucauccaccucucgggcucu

SEQ ID NO: 869603 - RNA, 22 nt, Human
auuaaauuaaguggcuaauuua

SEQ ID NO: 869604 - RNA, 22 nt, Human
aggacagcauuuucagcaucuc

SEQ ID NO: 869605 - RNA, 22 nt, Human
uccugggcccaggcugccaggg

SEQ ID NO: 869606 - RNA, 22 nt, Human
ugagcagaugugccaaacugua

SEQ ID NO: 869607 - RNA, 22 nt, Human
uccugaggacccugucaggggc

SEQ ID NO: 869608 - RNA, 22 nt, Human
aagugauuucugccugcauguu

SEQ ID NO: 869609 - RNA, 22 nt, Human
ggcaccaggacaugacucccag

SEQ ID NO: 869610 - RNA, 22 nt, Human
cagaaucuguugggguugcaga

SEQ ID NO: 869611 - RNA, 22 nt, Human
uuuccuugccuccuguccuucu

SEQ ID NO: 869612 - RNA, 20 nt, Human
ucccuggaggugguggcauc

SEQ ID NO: 869613 - RNA, 22 nt, Human
ugacacagauuagagacauacc

SEQ ID NO: 869614 - RNA, 22 nt, Human
aggcccaaaagaaaccacuggg

SEQ ID NO: 869615 - RNA, 22 nt, Human
ggagacagugguagggccuaag

SEQ ID NO: 869616 - RNA, 22 nt, Human
agagcuuuugggaauucaggua

SEQ ID NO: 869617 - RNA, 19 nt, Human
acaggcagaauugggugug

SEQ ID NO: 869618 - RNA, 22 nt, Human
ggcugagggccagggcuagucu

SEQ ID NO: 869619 - RNA, 21 nt, Human
uaggacuuuacaauuuaggaa

SEQ ID NO: 869620 - RNA, 22 nt, Human
aacagucuuggaagucuuguua

SEQ ID NO: 869621 - RNA, 22 nt, Human
aggcagcccacaggacacagga

SEQ ID NO: 869622 - RNA, 22 nt, Human
uguaacaaauacccuugaaguu

SEQ ID NO: 869623 - RNA, 22 nt, Human
cuuuguuuauauuucuccucga

SEQ ID NO: 869624 - RNA, 22 nt, Human
aggcuggcgucaggggcuguac

SEQ ID NO: 869625 - RNA, 22 nt, Human
cuagccagauuuaaagagagac

SEQ ID NO: 869626 - RNA, 22 nt, Human
agaaaauuacuccagagacaag

SEQ ID NO: 869627 - RNA, 22 nt, Human
gaggcaguuugccaugccagga

SEQ ID NO: 869628 - RNA, 22 nt, Human
uaguuacagaucuaggacuguu

SEQ ID NO: 869629 - RNA, 22 nt, Human
cgaggccaauguguuuuaugaa

SEQ ID NO: 869630 - RNA, 22 nt, Human
agagugccacugacaggucccu

SEQ ID NO: 869631 - RNA, 22 nt, Human
uucugaaaccuucaguaugaag

SEQ ID NO: 869632 - RNA, 22 nt, Human
uaccauuuugaaacauuucauc

SEQ ID NO: 869633 - RNA, 22 nt, Human
cagaggaaaugggaaggagaua

SEQ ID NO: 869634 - RNA, 22 nt, Human
aacaggcuccuugugaauggau

SEQ ID NO: 869635 - RNA, 22 nt, Human
guuuccaugaaaauguuucugc

SEQ ID NO: 869636 - RNA, 22 nt, Human
uucaaugucuauguacauuuua

SEQ ID NO: 869637 - RNA, 22 nt, Human
ucaggcugugggcacuggccau

SEQ ID NO: 869638 - RNA, 19 nt, Human
cugugucacauuuaugaaa

SEQ ID NO: 869639 - RNA, 22 nt, Human
aucagaaaaacauaauguuauu

SEQ ID NO: 869640 - RNA, 20 nt, Human
cugagcgucuaagaggugag

SEQ ID NO: 869641 - RNA, 22 nt, Human
ucuguuauacaacaaguaacag

SEQ ID NO: 869642 - RNA, 22 nt, Human
aaaugcugcagcuaguguguuu

SEQ ID NO: 869643 - RNA, 22 nt, Human
uuccagaguauugguagcuaua

SEQ ID NO: 869644 - RNA, 22 nt, Human
gcagcucuggggcaggccugag

SEQ ID NO: 869645 - RNA, 22 nt, Human
agaagccacaggaaagcagcuu

SEQ ID NO: 869646 - RNA, 22 nt, Human
gugaaggaguuaucagugguua

SEQ ID NO: 869647 - RNA, 22 nt, Human
ucucuucuaauuuucccgagua

SEQ ID NO: 869648 - RNA, 22 nt, Human
guguaaacaaugaaaacagagc

SEQ ID NO: 869649 - RNA, 22 nt, Human
caggcucccacccuccugcagc

SEQ ID NO: 869650 - RNA, 22 nt, Human
cacaagacuuauuuguguagaa

SEQ ID NO: 869651 - RNA, 22 nt, Human
gagcuuuuacugcuguauugaa

SEQ ID NO: 869652 - RNA, 22 nt, Human
aauaccaugauaauuaauucau

SEQ ID NO: 869653 - RNA, 18 nt, Human
uucugugcaucuuucuau

SEQ ID NO: 869654 - RNA, 22 nt, Human
uacuacauuaauaaaacauuca

SEQ ID NO: 869655 - RNA, 20 nt, Human
acaguguuaguuaucaucuc

SEQ ID NO: 869656 - RNA, 22 nt, Human
ucuaaggacaguuauuacuggg

SEQ ID NO: 869657 - RNA, 22 nt, Human
ucaugucagcuguugaugugca

SEQ ID NO: 869658 - RNA, 22 nt, Human
cugaaguucuacaagccucagg

SEQ ID NO: 869659 - RNA, 22 nt, Human
uaguauaucuuuaguacauagu

SEQ ID NO: 869660 - RNA, 22 nt, Human
ugccucaggcaccuggcagguu

SEQ ID NO: 869661 - RNA, 22 nt, Human
ggaaggaaagcagcuuggcccu

SEQ ID NO: 869662 - RNA, 19 nt, Human
auacaugcauuuacaugcu

SEQ ID NO: 869663 - RNA, 22 nt, Human
uggcuucuagagcccauccuuc

SEQ ID NO: 869664 - RNA, 22 nt, Human
agacauaaacuuacugaaauac

SEQ ID NO: 869665 - RNA, 22 nt, Human
gcaggcugggguagccccacuu

SEQ ID NO: 869666 - RNA, 22 nt, Human
agcagguuuguuuucuucugag

SEQ ID NO: 869667 - RNA, 22 nt, Human
ucacaauauuuaucuuccaauu

SEQ ID NO: 869668 - RNA, 22 nt, Human
ucaguacagcuuagucuucuca

SEQ ID NO: 869669 - RNA, 22 nt, Human
ugcucaguccuccugcagugcc

SEQ ID NO: 869670 - RNA, 22 nt, Human
ccaggcuuccuaaugugugcag

SEQ ID NO: 869671 - RNA, 22 nt, Human
cacaggcuuuuuuggcugaugu

SEQ ID NO: 869672 - RNA, 22 nt, Human
ucaucuuuguaucccuaacaca

SEQ ID NO: 869673 - RNA, 22 nt, Human
cacauacaugcacaccuaaaua

SEQ ID NO: 869674 - RNA, 22 nt, Human
aauaauguacauacauauuucg

SEQ ID NO: 869675 - RNA, 23 nt, Human
uuacagaaaguaugcuuuuguuu

SEQ ID NO: 869676 - RNA, 22 nt, Human
accagcucagaagccagaaaga

SEQ ID NO: 869677 - RNA, 22 nt, Human
uugugucauguuccauugaaaa

SEQ ID NO: 869678 - RNA, 16 nt, Human
ggcagcagcuccgugc

SEQ ID NO: 869679 - RNA, 22 nt, Human
gcacaaacugcaauuacuuuug

SEQ ID NO: 869680 - RNA, 22 nt, Human
ugucaucugaauuucucaucac

SEQ ID NO: 869681 - RNA, 22 nt, Human
agcuuuauucaugauuucaggg

SEQ ID NO: 869682 - RNA, 18 nt, Human
gggcaagcggcugucacc

SEQ ID NO: 869683 - RNA, 22 nt, Human
acagucugccucucagagcagc

SEQ ID NO: 869684 - RNA, 21 nt, Human
uucagcaagcacucuggacac

SEQ ID NO: 869685 - RNA, 22 nt, Human
guccucagucaguuuggugggg

SEQ ID NO: 869686 - RNA, 16 nt, Human
guuacccacccaaggc

SEQ ID NO: 869687 - RNA, 22 nt, Human
ccaggcaggcagcguucucagg

SEQ ID NO: 869688 - RNA, 22 nt, Human
guucuaagggcuugaaauguau

SEQ ID NO: 869689 - RNA, 22 nt, Human
guacauuucaguuuccuuaaga

SEQ ID NO: 869690 - RNA, 21 nt, Human
ucuccucccggggagaggccg

SEQ ID NO: 869691 - RNA, 22 nt, Human
aaagaagacagacauuucuuuc

SEQ ID NO: 869692 - RNA, 22 nt, Human
aaaagucuugucaagguuccca

SEQ ID NO: 869693 - RNA, 22 nt, Human
uggccugggcaugaagcaucgu

SEQ ID NO: 869694 - RNA, 22 nt, Human
ucugugccuucucccagacuua

SEQ ID NO: 869695 - RNA, 22 nt, Human
ugucuucuaccuugacagcauu

SEQ ID NO: 869696 - RNA, 22 nt, Human
aaaggaguuacucauaaagcuu

SEQ ID NO: 869697 - RNA, 22 nt, Human
ggacugggccagggguuggacu

SEQ ID NO: 869698 - RNA, 22 nt, Human
gcagcagagaccccaggaagga

SEQ ID NO: 869699 - RNA, 22 nt, Human
cucuggccgcagcucagcucug

SEQ ID NO: 869700 - RNA, 22 nt, Human
ucaugaaucguggaaugauuua

SEQ ID NO: 869701 - RNA, 22 nt, Human
uagaaguugaacuaaaaauauu

SEQ ID NO: 869702 - RNA, 22 nt, Human
cauuuuaaaugauuuaagccaa

SEQ ID NO: 869703 - RNA, 22 nt, Human
cagcaucucugccugccugcaa

SEQ ID NO: 869704 - RNA, 22 nt, Human
acaaagauucauuugcauuauu

SEQ ID NO: 869705 - RNA, 22 nt, Human
ccacaguguuuugucacauuag

SEQ ID NO: 869706 - RNA, 22 nt, Human
cagcuguucuugggacagacag

SEQ ID NO: 869707 - RNA, 22 nt, Human
cugccuuugcccuugacacugu

SEQ ID NO: 869708 - RNA, 22 nt, Human
ucacaguaucagguggagugga

SEQ ID NO: 869709 - RNA, 22 nt, Human
agaaagggaacuggcaaagcca

SEQ ID NO: 869710 - RNA, 22 nt, Human
agaguggcuucuuugacaugcu

SEQ ID NO: 869711 - RNA, 22 nt, Human
uuccucucgcucuccggggccc

SEQ ID NO: 869712 - RNA, 17 nt, Human
uaaauacacaaggguau

SEQ ID NO: 869713 - RNA, 22 nt, Human
aguuccagcugugaccagaaaa

SEQ ID NO: 869714 - RNA, 22 nt, Human
aaaguucuggagaaaauaauga

SEQ ID NO: 869715 - RNA, 22 nt, Human
gucugagggagaaggaucuggg

SEQ ID NO: 869716 - RNA, 21 nt, Human
acaguauauuagauauuugaa

SEQ ID NO: 869717 - RNA, 22 nt, Human
ucagagucaggaaugcuugauu

SEQ ID NO: 869718 - RNA, 22 nt, Human
uuauaggaaaaguucuagaaaa

SEQ ID NO: 869719 - RNA, 19 nt, Human
uugaggggccaggggagau

SEQ ID NO: 869720 - RNA, 22 nt, Human
gcaaagcaaucaggaguagcau

SEQ ID NO: 869721 - RNA, 17 nt, Human
auguuaauuucacauuu

SEQ ID NO: 869722 - RNA, 22 nt, Human
cuuguauagggaaagauaaauc

SEQ ID NO: 869723 - RNA, 22 nt, Human
cagcugggcuaagaguagaggc

SEQ ID NO: 869724 - RNA, 22 nt, Human
uugcagaagccuguuguuccug

SEQ ID NO: 869725 - RNA, 22 nt, Human
accaggcuccccuuggauccug

SEQ ID NO: 869726 - RNA, 22 nt, Human
uccaggaguuugagacugcagu

SEQ ID NO: 869727 - RNA, 22 nt, Human
uuugcucugcuguugccaggug

SEQ ID NO: 869728 - RNA, 22 nt, Human
agaggcccucucugcucagucu

SEQ ID NO: 869729 - RNA, 22 nt, Human
acugccuugauugccaguuucc

SEQ ID NO: 869730 - RNA, 22 nt, Human
uauccaauucaccauugauggg

SEQ ID NO: 869731 - RNA, 22 nt, Human
aucugcuuccugggcuccauga

SEQ ID NO: 869732 - RNA, 22 nt, Human
uaauaacaauuguaggacauga

SEQ ID NO: 869733 - RNA, 22 nt, Human
aguggggccgcgguccugcccu

SEQ ID NO: 869734 - RNA, 22 nt, Human
aacagcuuagaaauguugcuaa

SEQ ID NO: 869735 - RNA, 22 nt, Human
uaaugcuuaauuuucacaagcc

SEQ ID NO: 869736 - RNA, 22 nt, Human
uauugaaaugaaugacagugau

SEQ ID NO: 869737 - RNA, 22 nt, Human
aaaaagacuagucgagugcagu

SEQ ID NO: 869738 - RNA, 22 nt, Human
uaacucugaauccucacagcag

SEQ ID NO: 869739 - RNA, 22 nt, Human
uccuccucuaucagacagugcc

SEQ ID NO: 869740 - RNA, 22 nt, Human
uugcaaaguucccuacacaugu

SEQ ID NO: 869741 - RNA, 23 nt, Human
uagcaaaguuguuugggaaauuu

SEQ ID NO: 869742 - RNA, 22 nt, Human
gagcucccuggagguucagaua

SEQ ID NO: 869743 - RNA, 22 nt, Human
uggcucugcugaaccuagugca

SEQ ID NO: 869744 - RNA, 22 nt, Human
aaugcaggcacgugcaagcaag

SEQ ID NO: 869745 - RNA, 22 nt, Human
ugcauuaagugucugcauaugg

SEQ ID NO: 869746 - RNA, 22 nt, Human
auacaaauuuauagaugcauuu

SEQ ID NO: 869747 - RNA, 22 nt, Human
ucugggaguuagaauacauggg

SEQ ID NO: 869748 - RNA, 22 nt, Human
guguuuccaguucagaaagcaa

SEQ ID NO: 869749 - RNA, 20 nt, Human
auguaaaauuauaaggcuga

SEQ ID NO: 869750 - RNA, 22 nt, Human
auacagaagaacuauagccacu

SEQ ID NO: 869751 - RNA, 22 nt, Human
aacacaggaggcuauguuuucu

SEQ ID NO: 869752 - RNA, 22 nt, Human
ugguggaguuucucuuucaaac

SEQ ID NO: 869753 - RNA, 22 nt, Human
gcuauuuagugagucacauccu

SEQ ID NO: 869754 - RNA, 22 nt, Human
auucuucuaauaugaucguguu

SEQ ID NO: 869755 - RNA, 22 nt, Human
ucauuuauuugacuuuggagug

SEQ ID NO: 869756 - RNA, 22 nt, Human
gucaggacucugacccgucccg

SEQ ID NO: 869757 - RNA, 22 nt, Human
uggacccccucaaggcagagcu

SEQ ID NO: 869758 - RNA, 22 nt, Human
uggcacugccuggcagggcccc

SEQ ID NO: 869759 - RNA, 22 nt, Human
cuguggcucugcagucccaaca

SEQ ID NO: 869760 - RNA, 22 nt, Human
uuugacagauccuuaacucagc

SEQ ID NO: 869761 - RNA, 22 nt, Human
ucccagccuuccuuguggugaa

SEQ ID NO: 869762 - RNA, 22 nt, Human
cugagcagaccauggcagaggu

SEQ ID NO: 869763 - RNA, 22 nt, Human
uggcucagaaggcugccuucac

SEQ ID NO: 869764 - RNA, 22 nt, Human
cagcaccuuccuuaacuccagg

SEQ ID NO: 869765 - RNA, 22 nt, Human
aacaggggcugguugaaagagc

SEQ ID NO: 869766 - RNA, 22 nt, Human
agcccuccuggggccacgcugg

SEQ ID NO: 869767 - RNA, 22 nt, Human
cuucccuuccccucacggagac

SEQ ID NO: 869768 - RNA, 22 nt, Human
gagaaucuccagaugaaguccu

SEQ ID NO: 869769 - RNA, 22 nt, Human
agguuuaugauucugcacgugg

SEQ ID NO: 869770 - RNA, 22 nt, Human
gcucugcugucuucuugcaggc

SEQ ID NO: 869771 - RNA, 22 nt, Human
ugcaggagauaauggugcuuag

SEQ ID NO: 869772 - RNA, 22 nt, Human
agaggcagcagucauacuacag

SEQ ID NO: 869773 - RNA, 23 nt, Human
ucaggauauugugugccaaggug

SEQ ID NO: 869774 - RNA, 22 nt, Human
uggagggaacccaggcugcucu

SEQ ID NO: 869775 - RNA, 22 nt, Human
agucauuuggagcaccuuauua

SEQ ID NO: 869776 - RNA, 22 nt, Human
aaguagaaaaccgcacuggacu

SEQ ID NO: 869777 - RNA, 22 nt, Human
cagaagcuuugcucauaaccau

SEQ ID NO: 869778 - RNA, 22 nt, Human
uuggaucaaauuucaugcuguc

SEQ ID NO: 869779 - RNA, 22 nt, Human
auauccuuuacugugucacaga

SEQ ID NO: 869780 - RNA, 21 nt, Human
ucgaccugcugggcucgggcu

SEQ ID NO: 869781 - RNA, 23 nt, Human
uuucacauuaauguuuagcagga

SEQ ID NO: 869782 - RNA, 22 nt, Human
gagccaaucuuugggcucuugg

SEQ ID NO: 869783 - RNA, 22 nt, Human
guuagguagaaguuuacuuuga

SEQ ID NO: 869784 - RNA, 22 nt, Human
aucuacaggauaguuuaauauu

SEQ ID NO: 869785 - RNA, 22 nt, Human
aaagaaugucugaacagcuggc

SEQ ID NO: 869786 - RNA, 22 nt, Human
gacaguaagucagagacuuggu

SEQ ID NO: 869787 - RNA, 22 nt, Human
ucaaaguagccggauggaauuu

SEQ ID NO: 869788 - RNA, 22 nt, Human
cgggcagcggcguggccauggu

SEQ ID NO: 869789 - RNA, 21 nt, Human
aaucaagaguacugguguggc

SEQ ID NO: 869790 - RNA, 22 nt, Human
cuuuucucugcgggucuuucau

SEQ ID NO: 869791 - RNA, 22 nt, Human
uggcaguggugucugcacaggc

SEQ ID NO: 869792 - RNA, 22 nt, Human
ggguggagugugaaaucuggcu

SEQ ID NO: 869793 - RNA, 22 nt, Human
ggcuguggggccggguacagug

SEQ ID NO: 869794 - RNA, 19 nt, Human
cauuuuaagcauccccagu

SEQ ID NO: 869795 - RNA, 22 nt, Human
cuggcccagucucagaguguca

SEQ ID NO: 869796 - RNA, 22 nt, Human
gcagcuggagccagccagacac

SEQ ID NO: 869797 - RNA, 22 nt, Human
ccagggagcccacaggacaaug

SEQ ID NO: 869798 - RNA, 22 nt, Human
acucaggcacucagcccucgcc

SEQ ID NO: 869799 - RNA, 22 nt, Human
uacaaugucucucaccugacuu

SEQ ID NO: 869800 - RNA, 22 nt, Human
ccaggguggcguagaugcuggg

SEQ ID NO: 869801 - RNA, 22 nt, Human
gcuuccuuauuguugccauagu

SEQ ID NO: 869802 - RNA, 22 nt, Human
auuauguagcuaaaaauugugu

SEQ ID NO: 869803 - RNA, 22 nt, Human
ucuccuuucuggagccugcuca

SEQ ID NO: 869804 - RNA, 22 nt, Human
cuugacuuugccuuuuaaaugu

SEQ ID NO: 869805 - RNA, 22 nt, Human
aagcauuucuguuuaucuaucg

SEQ ID NO: 869806 - RNA, 22 nt, Human
ucagugcuuuugagaagcuccu

SEQ ID NO: 869807 - RNA, 20 nt, Human
uggaguuguggcaguuugga

SEQ ID NO: 869808 - RNA, 18 nt, Human
gagucgucggagagucug

SEQ ID NO: 869809 - RNA, 21 nt, Human
ggacaccagucacacuggauu

SEQ ID NO: 869810 - RNA, 22 nt, Human
augucucugccccagagagcuu

SEQ ID NO: 869811 - RNA, 22 nt, Human
cacacccaaauuucucucucag

SEQ ID NO: 869812 - RNA, 22 nt, Human
cagauucuuaauuuaugggauu

SEQ ID NO: 869813 - RNA, 22 nt, Human
cagcucacccaucacgucugcu

SEQ ID NO: 869814 - RNA, 22 nt, Human
ucagcuguagguauggaugucc

SEQ ID NO: 869815 - RNA, 20 nt, Human
ugaaggcagguaagaaagau

SEQ ID NO: 869816 - RNA, 22 nt, Human
ccugggucacucaggcaggcgg

SEQ ID NO: 869817 - RNA, 22 nt, Human
uggcucuggccaccgggagggc

SEQ ID NO: 869818 - RNA, 23 nt, Human
uuacuuuugcaccaaccuaauau

SEQ ID NO: 869819 - RNA, 22 nt, Human
aguuaacaaguuggcaaucaac

SEQ ID NO: 869820 - RNA, 22 nt, Human
gggcuggcucugucuagaaagg

SEQ ID NO: 869821 - RNA, 22 nt, Human
ucagagaucuucaggaugggac

SEQ ID NO: 869822 - RNA, 21 nt, Human
caaguguggauguggaaggua

SEQ ID NO: 869823 - RNA, 22 nt, Human
augucuguuaaucgacccuaau

SEQ ID NO: 869824 - RNA, 22 nt, Human
cagcucugccaucaucugccuu

SEQ ID NO: 869825 - RNA, 22 nt, Human
ucacuaaugauuuugaaagaag

SEQ ID NO: 869826 - RNA, 22 nt, Human
aggggagaguuaaugugaaugu

SEQ ID NO: 869827 - RNA, 22 nt, Human
ucugcuucuccuacuucauggg

SEQ ID NO: 869828 - RNA, 22 nt, Human
acagaugaguuagaauaggcag

SEQ ID NO: 869829 - RNA, 22 nt, Human
caaagcaggaagcuccugacag

SEQ ID NO: 869830 - RNA, 20 nt, Human
uuauuuguuuacuuuggucc

SEQ ID NO: 869831 - RNA, 22 nt, Human
cuguccagcugaccagagcagc

SEQ ID NO: 869832 - RNA, 22 nt, Human
agacagcaugauacaugaugcu

SEQ ID NO: 869833 - RNA, 22 nt, Human
auauaauacaaccugcuaagug

SEQ ID NO: 869834 - RNA, 22 nt, Human
cccaaacaguuccugugguacu

SEQ ID NO: 869835 - RNA, 22 nt, Human
uuuuguuuucuuagaaaccugg

SEQ ID NO: 869836 - RNA, 22 nt, Human
guuuguucacuaugacuguggu

SEQ ID NO: 869837 - RNA, 22 nt, Human
gaggccacccuaugggucccag

SEQ ID NO: 869838 - RNA, 22 nt, Human
aaggaaagacaggacggaauuc

SEQ ID NO: 869839 - RNA, 22 nt, Human
acagagacuaagcuuuucauca

SEQ ID NO: 869840 - RNA, 22 nt, Human
uacagacaaagugcuauagggu

SEQ ID NO: 869841 - RNA, 22 nt, Human
cagccaggcccagaucaugcug

SEQ ID NO: 869842 - RNA, 22 nt, Human
uucaggccuaauuucuagcccc

SEQ ID NO: 869843 - RNA, 22 nt, Human
cuaggcaguccugacgguacua

SEQ ID NO: 869844 - RNA, 22 nt, Human
acucuuuagagguacaucucuu

SEQ ID NO: 869845 - RNA, 22 nt, Human
gaaauagaggacagcuggauca

SEQ ID NO: 869846 - RNA, 19 nt, Human
aggagaaguagcagaaauu

SEQ ID NO: 869847 - RNA, 22 nt, Human
uuuucaugucauguccuugagg

SEQ ID NO: 869848 - RNA, 22 nt, Human
uuucccaagaaaaauaauugga

SEQ ID NO: 869849 - RNA, 22 nt, Human
agccagcucugaguugaaguac

SEQ ID NO: 869850 - RNA, 22 nt, Human
aagaucaaguguacuuuaugua

SEQ ID NO: 869851 - RNA, 22 nt, Human
ggcugagaagacaguggggugg

SEQ ID NO: 869852 - RNA, 22 nt, Human
cuacaaagaauuucucuagcuc

SEQ ID NO: 869853 - RNA, 22 nt, Human
ucaaaagucugcauucuucaca

SEQ ID NO: 869854 - RNA, 22 nt, Human
cccaggcuagaaaggccaacaa

SEQ ID NO: 869855 - RNA, 22 nt, Human
uguuugcucugacuaucuugcg

SEQ ID NO: 869856 - RNA, 22 nt, Human
cugggaagggagucaagauacu

SEQ ID NO: 869857 - RNA, 20 nt, Human
ggggcugcaugcagagaaga

SEQ ID NO: 869858 - RNA, 20 nt, Human
agaaugcuuuuugcauugca

SEQ ID NO: 869859 - RNA, 22 nt, Human
ugacaaaacugcaauuacuuuu

SEQ ID NO: 869860 - RNA, 22 nt, Human
caaagcugauacucagcaagua

SEQ ID NO: 869861 - RNA, 22 nt, Human
cuuguauucuuccacuuaagau

SEQ ID NO: 869862 - RNA, 22 nt, Human
aggcccugcaggaagcaggaug

SEQ ID NO: 869863 - RNA, 22 nt, Human
gccuuggccuuccuaggccuga

SEQ ID NO: 869864 - RNA, 22 nt, Human
ugggagagucuaaaaccgaggu

SEQ ID NO: 869865 - RNA, 22 nt, Human
uguccagaucaaugcccacaug

SEQ ID NO: 869866 - RNA, 22 nt, Human
auaugucucuguacaacagucu

SEQ ID NO: 869867 - RNA, 22 nt, Human
aagaggcuuauagucuuccugu

SEQ ID NO: 869868 - RNA, 22 nt, Human
ucccuggagauaacuucuggga

SEQ ID NO: 869869 - RNA, 22 nt, Human
ucugcccacaguccaauaguug

SEQ ID NO: 869870 - RNA, 22 nt, Human
uacagaaacagcgugguuagaa

SEQ ID NO: 869871 - RNA, 22 nt, Human
ugcaaugauauugucaaagcau

SEQ ID NO: 869872 - RNA, 22 nt, Human
aggucaagauucuacauuugua

SEQ ID NO: 869873 - RNA, 22 nt, Human
acaaugcaccuauuuuaaaacu

SEQ ID NO: 869874 - RNA, 22 nt, Human
aggagcuggaguccaggcaagu

SEQ ID NO: 869875 - RNA, 22 nt, Human
uggcucuccagagccuauggua

SEQ ID NO: 869876 - RNA, 22 nt, Human
uggcaaugagcaggugcucugg

SEQ ID NO: 869877 - RNA, 22 nt, Human
agcacagauuugucaacauaga

SEQ ID NO: 869878 - RNA, 22 nt, Human
gcugcccacaaccccgugucua

SEQ ID NO: 869879 - RNA, 18 nt, Human
cagauccaggcagcuauu

SEQ ID NO: 869880 - RNA, 22 nt, Human
gugaagcagaguguggaagcaa

SEQ ID NO: 869881 - RNA, 22 nt, Human
uggaaauugcuauuaccgauga

SEQ ID NO: 869882 - RNA, 22 nt, Human
ccagggcugccgcaucccuggu

SEQ ID NO: 869883 - RNA, 22 nt, Human
ucugccugcuaacuccugcacc

SEQ ID NO: 869884 - RNA, 22 nt, Human
gcugcuccagcugugcugcaga

SEQ ID NO: 869885 - RNA, 22 nt, Human
uccugggcagccucucuggaag

SEQ ID NO: 869886 - RNA, 22 nt, Human
agccugcuugagaguccuggcu

SEQ ID NO: 869887 - RNA, 22 nt, Human
aaggccagggaugccagcucgg

SEQ ID NO: 869888 - RNA, 22 nt, Human
gccccacagccugcggucucag

SEQ ID NO: 869889 - RNA, 22 nt, Human
ugcauguuuauaacagaugagg

SEQ ID NO: 869890 - RNA, 22 nt, Human
ucugccuguggauacaugcucu

SEQ ID NO: 869891 - RNA, 22 nt, Human
auucaguggauaucuucacuuu

SEQ ID NO: 869892 - RNA, 22 nt, Human
aagaaguuagguguaacaauau

SEQ ID NO: 869893 - RNA, 22 nt, Human
cccagcagauggcuaugugcua

SEQ ID NO: 869894 - RNA, 22 nt, Human
auagugggaauuacgauauacu

SEQ ID NO: 869895 - RNA, 22 nt, Human
agaaggcuggcccuggguggcc

SEQ ID NO: 869896 - RNA, 22 nt, Human
uucaaacacuguuggcacuggg

SEQ ID NO: 869897 - RNA, 22 nt, Human
gggugugcaggucauggcgucu

SEQ ID NO: 869898 - RNA, 20 nt, Human
aggcucagcugagcucuugg

SEQ ID NO: 869899 - RNA, 22 nt, Human
uucaaagaguugggugucuggg

SEQ ID NO: 869900 - RNA, 22 nt, Human
cagaggcacagcuucuuuuaau

SEQ ID NO: 869901 - RNA, 22 nt, Human
caaggcagcuguagggauuugg

SEQ ID NO: 869902 - RNA, 22 nt, Human
uuuagucauuuggauuugaucu

SEQ ID NO: 869903 - RNA, 22 nt, Human
uagaaacaaaaucugaugacuc

SEQ ID NO: 869904 - RNA, 22 nt, Human
uauacagauaaugaagaccaag

SEQ ID NO: 869905 - RNA, 22 nt, Human
acuuuuaugauaaucaauguuc

SEQ ID NO: 869906 - RNA, 22 nt, Human
agcugcuggggagggcagacac

SEQ ID NO: 869907 - RNA, 22 nt, Human
caguuaaauucuccaguuacca

SEQ ID NO: 869908 - RNA, 22 nt, Human
aauauaguguuagcucauuuga

SEQ ID NO: 869909 - RNA, 22 nt, Human
cagcugcaggaacaaaaaugug

SEQ ID NO: 869910 - RNA, 22 nt, Human
aaggcuuugauuccauugcccu

SEQ ID NO: 869911 - RNA, 17 nt, Human
cucugggugccugugug

SEQ ID NO: 869912 - RNA, 22 nt, Human
ccagggccugagggcgacgccc

SEQ ID NO: 869913 - RNA, 22 nt, Human
uucacauuagugguucuauaua

SEQ ID NO: 869914 - RNA, 22 nt, Human
cagguaggaaaagggugucagg

SEQ ID NO: 869915 - RNA, 22 nt, Human
aaagagcuaacauugccgagau

SEQ ID NO: 869916 - RNA, 19 nt, Human
acagggaauuuccacagaa

SEQ ID NO: 869917 - RNA, 22 nt, Human
ugcauucaaaucuccaggcuca

SEQ ID NO: 869918 - RNA, 22 nt, Human
guucccuuucguauggacuggg

SEQ ID NO: 869919 - RNA, 22 nt, Human
ucagcuguguaucccagggccu

SEQ ID NO: 869920 - RNA, 22 nt, Human
cacuccaggucccaguuccugg

SEQ ID NO: 869921 - RNA, 22 nt, Human
aaucacauuaagcccuguucag

SEQ ID NO: 869922 - RNA, 22 nt, Human
acaugcagaauucuuagagagc

SEQ ID NO: 869923 - RNA, 22 nt, Human
acuugcauguuauuuuuauagg

SEQ ID NO: 869924 - RNA, 22 nt, Human
ucucccagaggaucccagugga

SEQ ID NO: 869925 - RNA, 22 nt, Human
cagaguggcagucccaggccca

SEQ ID NO: 869926 - RNA, 22 nt, Human
uggcuccagaagggagggcgcc

SEQ ID NO: 869927 - RNA, 22 nt, Human
ugcacaguaaacaugacuggag

SEQ ID NO: 869928 - RNA, 22 nt, Human
auuuuagagaaacaaacguagg

SEQ ID NO: 869929 - RNA, 22 nt, Human
gcauccuggcucuaggugucau

SEQ ID NO: 869930 - RNA, 22 nt, Human
ugggccucuggguuagucccua

SEQ ID NO: 869931 - RNA, 22 nt, Human
aggaauggugcucagcagaaau

SEQ ID NO: 869932 - RNA, 22 nt, Human
ugccauggauuaaguggguggc

SEQ ID NO: 869933 - RNA, 22 nt, Human
acaguuuuuucaacauuggaau

SEQ ID NO: 869934 - RNA, 22 nt, Human
uccagggcugacuugggagagg

SEQ ID NO: 869935 - RNA, 22 nt, Human
uuaaaguaaucugugugaauuu

SEQ ID NO: 869936 - RNA, 22 nt, Human
ggagcccagguuguuugugcag

SEQ ID NO: 869937 - RNA, 22 nt, Human
aggaaugucgucauaaacauga

SEQ ID NO: 869938 - RNA, 22 nt, Human
gagcugaaauaugaagccaauu

SEQ ID NO: 869939 - RNA, 22 nt, Human
caguccugcccaggcugacaga

SEQ ID NO: 869940 - RNA, 22 nt, Human
guuuguaugaauguuuuaugcu

SEQ ID NO: 869941 - RNA, 22 nt, Human
uagaaaggauauugagaugaau

SEQ ID NO: 869942 - RNA, 22 nt, Human
ucagguccaagauggccaucca

SEQ ID NO: 869943 - RNA, 20 nt, Human
acuagucuaaaagggcugac

SEQ ID NO: 869944 - RNA, 22 nt, Human
uauuuguugaguuguuaugucu

SEQ ID NO: 869945 - RNA, 22 nt, Human
acacagaguaucuuuugccuag

SEQ ID NO: 869946 - RNA, 22 nt, Human
gcaugagacuagcucaugagca

SEQ ID NO: 869947 - RNA, 22 nt, Human
uguauuugguguauuuaaugag

SEQ ID NO: 869948 - RNA, 22 nt, Human
augacacuuggugauacuuugu

SEQ ID NO: 869949 - RNA, 20 nt, Human
aguguuugcucacagucucc

SEQ ID NO: 869950 - RNA, 22 nt, Human
gcagcugcaauaggcaucaagc

SEQ ID NO: 869951 - RNA, 22 nt, Human
cagcccaaagccccaggcuaga

SEQ ID NO: 869952 - RNA, 22 nt, Human
agcacauuaagugaguucaugu

SEQ ID NO: 869953 - RNA, 22 nt, Human
caagaggagcaggcaggugugc

SEQ ID NO: 869954 - RNA, 22 nt, Human
aaugcaaagcucuuuaauccuu

SEQ ID NO: 869955 - RNA, 22 nt, Human
ccuuuccuuuuuagugugggag

SEQ ID NO: 869956 - RNA, 22 nt, Human
gauacacaaguggaaggagacg

SEQ ID NO: 869957 - RNA, 22 nt, Human
ugagaagauuugcucuucugag

SEQ ID NO: 869958 - RNA, 21 nt, Human
aaaaagcuggggcaugcaugc

SEQ ID NO: 869959 - RNA, 22 nt, Human
caggccaggcugcauuugcccc

SEQ ID NO: 869960 - RNA, 22 nt, Human
aaaauucugucauuaaauugug

SEQ ID NO: 869961 - RNA, 22 nt, Human
caggugggccaugaaaaaugac

SEQ ID NO: 869962 - RNA, 23 nt, Human
uucauagagagauggugagaauu

SEQ ID NO: 869963 - RNA, 22 nt, Human
cuuccugggacaccuaacucua

SEQ ID NO: 869964 - RNA, 22 nt, Human
gcuacaggugacagccucugca

SEQ ID NO: 869965 - RNA, 22 nt, Human
acagauaaggcaguuaagaguu

SEQ ID NO: 869966 - RNA, 22 nt, Human
cugggcaguuuuacaucauugc

SEQ ID NO: 869967 - RNA, 22 nt, Human
gcagcugccccgacugugaguc

SEQ ID NO: 869968 - RNA, 22 nt, Human
ggcaggggugaggccacucuga

SEQ ID NO: 869969 - RNA, 20 nt, Human
caguagcaauaauuagaagc

SEQ ID NO: 869970 - RNA, 22 nt, Human
aaagguuugaggugggaagagg

SEQ ID NO: 869971 - RNA, 18 nt, Human
ccucacagacuuccaugu

SEQ ID NO: 869972 - RNA, 22 nt, Human
cucagagagacaaugugggaca

SEQ ID NO: 869973 - RNA, 22 nt, Human
auccugaagcaugaaugucaaa

SEQ ID NO: 869974 - RNA, 19 nt, Human
uggaggcaagacauggagg

SEQ ID NO: 869975 - RNA, 22 nt, Human
ugugccucacccugcucuuggc

SEQ ID NO: 869976 - RNA, 22 nt, Human
cgcagggccgcgagcgggacca

SEQ ID NO: 869977 - RNA, 22 nt, Human
ugagggccgaggagcugugggu

SEQ ID NO: 869978 - RNA, 22 nt, Human
ggggccuguagagcuucaggga

SEQ ID NO: 869979 - RNA, 22 nt, Human
cuucacaaauggccuagaguuc

SEQ ID NO: 869980 - RNA, 20 nt, Human
ccacccuccaggaacacaua

SEQ ID NO: 869981 - RNA, 22 nt, Human
cucuccagccuuuagcccacgc

SEQ ID NO: 869982 - RNA, 18 nt, Human
acccucuggcuucugagc

SEQ ID NO: 869983 - RNA, 22 nt, Human
acaagcgggccacagugcuggu

SEQ ID NO: 869984 - RNA, 22 nt, Human
agaaaguuuauuucuugaugga

SEQ ID NO: 869985 - RNA, 22 nt, Human
ggaggccaaggaggagcuugcc

SEQ ID NO: 869986 - RNA, 22 nt, Human
ucauuucuuaacuagagugaac

SEQ ID NO: 869987 - RNA, 22 nt, Human
agacacuguguacagaaaaaga

SEQ ID NO: 869988 - RNA, 22 nt, Human
ugucagaggcucagggucucag

SEQ ID NO: 869989 - RNA, 22 nt, Human
gaggcugcuguuagcccugggc

SEQ ID NO: 869990 - RNA, 22 nt, Human
uaggcuuguuacaaaacaguca

SEQ ID NO: 869991 - RNA, 23 nt, Human
ucugggcaccuuguugacaugau

SEQ ID NO: 869992 - RNA, 22 nt, Human
ugguccaguuuagcauugagug

SEQ ID NO: 869993 - RNA, 22 nt, Human
uauuuuacagacuacuuuagau

SEQ ID NO: 869994 - RNA, 22 nt, Human
caggaagcaguagaacuuuucc

SEQ ID NO: 869995 - RNA, 22 nt, Human
auuggggagagcuaauauuuua

SEQ ID NO: 869996 - RNA, 22 nt, Human
gagucugagucuaauggcccca

SEQ ID NO: 869997 - RNA, 22 nt, Human
uggccugguccuugucaaggca

SEQ ID NO: 869998 - RNA, 22 nt, Human
cuuuguaagucuuucuccaaga

SEQ ID NO: 869999 - RNA, 22 nt, Human
uacaugaccuagacuugcuaaa

SEQ ID NO: 870000 - RNA, 19 nt, Human
ugccacagauaaaaacuga

SEQ ID NO: 870001 - RNA, 22 nt, Human
guuuguuuuaagauaggaugga

SEQ ID NO: 870002 - RNA, 22 nt, Human
aguaauaauuuauauuagggag

SEQ ID NO: 870003 - RNA, 22 nt, Human
ugcuccaggugugccucucaug

SEQ ID NO: 870004 - RNA, 22 nt, Human
uuucaguucaccugggaacccg

SEQ ID NO: 870005 - RNA, 22 nt, Human
uucauaaacaaauuaaggccug

SEQ ID NO: 870006 - RNA, 22 nt, Human
uuauggcuaaauuucaauauua

SEQ ID NO: 870007 - RNA, 22 nt, Human
gagcuucccucugcagucccug

SEQ ID NO: 870008 - RNA, 22 nt, Human
ucuggaguugugcaguggaccu

SEQ ID NO: 870009 - RNA, 22 nt, Human
cagaggggauaacagguguaga

SEQ ID NO: 870010 - RNA, 22 nt, Human
uuggaucauggaaugucugcuu

SEQ ID NO: 870011 - RNA, 23 nt, Human
ugcugggguaguuuguggcacag

SEQ ID NO: 870012 - RNA, 22 nt, Human
aacauuuauucuaauucuggga

SEQ ID NO: 870013 - RNA, 22 nt, Human
augugcaugugcacacaugcgu

SEQ ID NO: 870014 - RNA, 22 nt, Human
cagcaaggccauuggaugcagu

SEQ ID NO: 870015 - RNA, 22 nt, Human
gagcagcacugaguuagcagcu

SEQ ID NO: 870016 - RNA, 22 nt, Human
auccuguagucucacagcccca

SEQ ID NO: 870017 - RNA, 19 nt, Human
aggaaagguggccuuagca

SEQ ID NO: 870018 - RNA, 22 nt, Human
ggccaaggcucuugagggcuga

SEQ ID NO: 870019 - RNA, 22 nt, Human
ugcugggggugucucaccaggc

SEQ ID NO: 870020 - RNA, 22 nt, Human
cccagccagccucuucccauau

SEQ ID NO: 870021 - RNA, 22 nt, Human
uuuuuccuuggaugugucucuc

SEQ ID NO: 870022 - RNA, 22 nt, Human
acuggcagccacaacuggcagg

SEQ ID NO: 870023 - RNA, 21 nt, Human
cuccugggcuaagauauagug

SEQ ID NO: 870024 - RNA, 22 nt, Human
ccucagaguuauuugaagugaa

SEQ ID NO: 870025 - RNA, 22 nt, Human
ccacauggauagauagggacau

SEQ ID NO: 870026 - RNA, 22 nt, Human
uuuggucuggaaucuucagggu

SEQ ID NO: 870027 - RNA, 22 nt, Human
aagagggaggugcgggugcaga

SEQ ID NO: 870028 - RNA, 22 nt, Human
agucaucauguacagagagcaa

SEQ ID NO: 870029 - RNA, 22 nt, Human
cagcuguugucucucacauauu

SEQ ID NO: 870030 - RNA, 22 nt, Human
agucaagagacuuaaaauauuu

SEQ ID NO: 870031 - RNA, 22 nt, Human
ggagagagaugccgccuugcuc

SEQ ID NO: 870032 - RNA, 22 nt, Human
auacagaugaaauacuaagcua

SEQ ID NO: 870033 - RNA, 22 nt, Human
caaguugugaaugacagacuuc

SEQ ID NO: 870034 - RNA, 22 nt, Human
agaagcuaauucaugucuuaug

SEQ ID NO: 870035 - RNA, 22 nt, Human
uucuuuuuaaaguguguaugca

SEQ ID NO: 870036 - RNA, 22 nt, Human
ugccagugcuugugucugagca

SEQ ID NO: 870037 - RNA, 22 nt, Human
agggcugagcccaggcauguag

SEQ ID NO: 870038 - RNA, 22 nt, Human
augcuguguggccaccuccaug

SEQ ID NO: 870039 - RNA, 17 nt, Human
ggucugugucuagggaa

SEQ ID NO: 870040 - RNA, 22 nt, Human
uuagaaaauuugcuucuuugga

SEQ ID NO: 870041 - RNA, 22 nt, Human
uuaaagagggaaagacuucaga

SEQ ID NO: 870042 - RNA, 21 nt, Human
ucugucugguuuuagaguggc

SEQ ID NO: 870043 - RNA, 22 nt, Human
ugaguagagaauucagcuaagg

SEQ ID NO: 870044 - RNA, 22 nt, Human
agagaggcugcuggacuauaug

SEQ ID NO: 870045 - RNA, 22 nt, Human
uccaaggagcagucuucaaccu

SEQ ID NO: 870046 - RNA, 22 nt, Human
gcguguaugcaggucugugcag

SEQ ID NO: 870047 - RNA, 22 nt, Human
guaaaugugacuccaccugagu

SEQ ID NO: 870048 - RNA, 22 nt, Human
ucuucacaugaccuucaugucu

SEQ ID NO: 870049 - RNA, 22 nt, Human
gcagucaaagauuggaccaauu

SEQ ID NO: 870050 - RNA, 20 nt, Human
acagcagccuugcuagaaac

SEQ ID NO: 870051 - RNA, 22 nt, Human
uaaauucacuccugguagaccu

SEQ ID NO: 870052 - RNA, 22 nt, Human
auauaaagagcuuaguauagug

SEQ ID NO: 870053 - RNA, 22 nt, Human
auuauccagcaccaaugucaga

SEQ ID NO: 870054 - RNA, 22 nt, Human
acagagggucugggcacaggac

SEQ ID NO: 870055 - RNA, 17 nt, Human
auucuuugaugucucug

SEQ ID NO: 870056 - RNA, 22 nt, Human
uuugguuaauuuaggcuugcau

SEQ ID NO: 870057 - RNA, 22 nt, Human
gccaggcauguccucugcagaa

SEQ ID NO: 870058 - RNA, 22 nt, Human
uauguaaaguagauggcaggua

SEQ ID NO: 870059 - RNA, 22 nt, Human
ucugggagugaagcaacagaug

SEQ ID NO: 870060 - RNA, 22 nt, Human
ccuggcaggacuguuguaagaa

SEQ ID NO: 870061 - RNA, 22 nt, Human
gacacaguuacuuauuuugccu

SEQ ID NO: 870062 - RNA, 22 nt, Human
acaaugcaauaggagcuagaaa

SEQ ID NO: 870063 - RNA, 22 nt, Human
ccuuggcaagacaguggagggu

SEQ ID NO: 870064 - RNA, 18 nt, Human
uugagaaauaagcacuaa

SEQ ID NO: 870065 - RNA, 22 nt, Human
ugaucuagguuggcuucaacug

SEQ ID NO: 870066 - RNA, 22 nt, Human
guauguauacauuguggaaugg

SEQ ID NO: 870067 - RNA, 22 nt, Human
uuuacagcaacagugcagaggu

SEQ ID NO: 870068 - RNA, 22 nt, Human
cuccauauguucaguuaugcag

SEQ ID NO: 870069 - RNA, 22 nt, Human
gacagccaacuggggagggcau

SEQ ID NO: 870070 - RNA, 22 nt, Human
cuuucuugguccugaagauggc

SEQ ID NO: 870071 - RNA, 22 nt, Human
gccaggaguucagaugcauguu

SEQ ID NO: 870072 - RNA, 20 nt, Human
ucauuccaaauaguucagca

SEQ ID NO: 870073 - RNA, 22 nt, Human
uaggccagcccuuaguccuguc

SEQ ID NO: 870074 - RNA, 22 nt, Human
uccagagauccaaagaauauga

SEQ ID NO: 870075 - RNA, 22 nt, Human
gaggcugccccuuccucagcug

SEQ ID NO: 870076 - RNA, 22 nt, Human
aacaucaggaucuuguuacagu

SEQ ID NO: 870077 - RNA, 22 nt, Human
gaggccaggaagcccaagauca

SEQ ID NO: 870078 - RNA, 22 nt, Human
ucagcuggugaguggauagaca

SEQ ID NO: 870079 - RNA, 22 nt, Human
aacuacuaccacagucaagaca

SEQ ID NO: 870080 - RNA, 22 nt, Human
ugguccugguagcggugugcuu

SEQ ID NO: 870081 - RNA, 22 nt, Human
cagaggcucaccagccuuucac

SEQ ID NO: 870082 - RNA, 22 nt, Human
gggacaugaggccauagugauu

SEQ ID NO: 870083 - RNA, 22 nt, Human
auuugccuugugauuuguaagu

SEQ ID NO: 870084 - RNA, 22 nt, Human
cagcuccugccugggcagcugu

SEQ ID NO: 870085 - RNA, 23 nt, Human
acccaucucuccugucaugcaga

SEQ ID NO: 870086 - RNA, 22 nt, Human
gccuguguggaugcgccggugc

SEQ ID NO: 870087 - RNA, 22 nt, Human
cugcaggggaccaaagucugac

SEQ ID NO: 870088 - RNA, 19 nt, Human
augaucugcccuuguaaua

SEQ ID NO: 870089 - RNA, 22 nt, Human
aguuuaauauccuucaacuuuc

SEQ ID NO: 870090 - RNA, 22 nt, Human
agcucccagcuccuuugagaga

SEQ ID NO: 870091 - RNA, 22 nt, Human
ccucaggccagggggcggccag

SEQ ID NO: 870092 - RNA, 20 nt, Human
aggcugggguguuuugccca

SEQ ID NO: 870093 - RNA, 22 nt, Human
cuggcauucuuguuucuggaaa

SEQ ID NO: 870094 - RNA, 22 nt, Human
guuuccuaccagugguuccaga

SEQ ID NO: 870095 - RNA, 22 nt, Human
guaucacuuuugagagugagaa

SEQ ID NO: 870096 - RNA, 22 nt, Human
cucaggaucgcuugcccuaggg

SEQ ID NO: 870097 - RNA, 22 nt, Human
aauaaacaaaucuuuccugugg

SEQ ID NO: 870098 - RNA, 22 nt, Human
gggaaagacccugagucuuauu

SEQ ID NO: 870099 - RNA, 22 nt, Human
uguguucaucaugauaucaggu

SEQ ID NO: 870100 - RNA, 22 nt, Human
uuccauuuuucuaacucucaga

SEQ ID NO: 870101 - RNA, 22 nt, Human
gcccaggaggcagagguugugg

SEQ ID NO: 870102 - RNA, 22 nt, Human
agggcugcugaggaagccuugc

SEQ ID NO: 870103 - RNA, 22 nt, Human
uggcagcugaggggaggcuuug

SEQ ID NO: 870104 - RNA, 22 nt, Human
ucugaaauagaagugucuuucu

SEQ ID NO: 870105 - RNA, 22 nt, Human
ccugcuguuagauuucagucac

SEQ ID NO: 870106 - RNA, 22 nt, Human
uagcagcaauuucagaaguuug

SEQ ID NO: 870107 - RNA, 22 nt, Human
cuucauuggcuuccauagaugc

SEQ ID NO: 870108 - RNA, 22 nt, Human
ggaggaagagguuguucucuca

SEQ ID NO: 870109 - RNA, 22 nt, Human
guccugguagggcucugugucu

SEQ ID NO: 870110 - RNA, 19 nt, Human
ucuuuucacgcauuuugaa

SEQ ID NO: 870111 - RNA, 22 nt, Human
ucaggcccuuugcugcugcccc

SEQ ID NO: 870112 - RNA, 22 nt, Human
ugucacaaguaacuggcaaugc

SEQ ID NO: 870113 - RNA, 17 nt, Human
uacaggagagcaggaac

SEQ ID NO: 870114 - RNA, 22 nt, Human
cucuguccugguuuauacuggc

SEQ ID NO: 870115 - RNA, 22 nt, Human
ccugcccuaauccagagacuag

SEQ ID NO: 870116 - RNA, 22 nt, Human
uccagcccuguggcuuccaccc

SEQ ID NO: 870117 - RNA, 22 nt, Human
auggcaccuuccccagagcuca

SEQ ID NO: 870118 - RNA, 22 nt, Human
cagguacauucguagacccauu

SEQ ID NO: 870119 - RNA, 22 nt, Human
acucccuguacuugccucucuu

SEQ ID NO: 870120 - RNA, 22 nt, Human
cugugcuugacagugggaagca

SEQ ID NO: 870121 - RNA, 22 nt, Human
ucuugcagcuucaucugcaauu

SEQ ID NO: 870122 - RNA, 22 nt, Human
caggaaauuuauguucuacuua

SEQ ID NO: 870123 - RNA, 22 nt, Human
uauuugauagagauaaaugaua

SEQ ID NO: 870124 - RNA, 22 nt, Human
uagcaggaccaugacaagaaaa

SEQ ID NO: 870125 - RNA, 19 nt, Human
cuucaguguucaccuggcc

SEQ ID NO: 870126 - RNA, 22 nt, Human
uaugucuuuuccaaugcugucu

SEQ ID NO: 870127 - RNA, 22 nt, Human
guccuuggccuucuuguaggca

SEQ ID NO: 870128 - RNA, 22 nt, Human
cggggcuguagcacagcugagc

SEQ ID NO: 870129 - RNA, 16 nt, Human
agcagggcgggaagga

SEQ ID NO: 870130 - RNA, 22 nt, Human
ucagcaagcagggggauguuca

SEQ ID NO: 870131 - RNA, 22 nt, Human
ugggggugaaagucuggacagu

SEQ ID NO: 870132 - RNA, 22 nt, Human
uggcccugcagaacuagccugg

SEQ ID NO: 870133 - RNA, 22 nt, Human
ccugggcuuucggcggcuuccu

SEQ ID NO: 870134 - RNA, 22 nt, Human
gggcagugaauauuggugggaa

SEQ ID NO: 870135 - RNA, 22 nt, Human
caggccaggugcucuagaauca

SEQ ID NO: 870136 - RNA, 22 nt, Human
agaagagcccuuuaagggggaa

SEQ ID NO: 870137 - RNA, 22 nt, Human
uuuccucuccggggccuccagg

SEQ ID NO: 870138 - RNA, 22 nt, Human
guuuccaugguguuucuugggu

SEQ ID NO: 870139 - RNA, 22 nt, Human
acuguguccucauguggcagaa

SEQ ID NO: 870140 - RNA, 22 nt, Human
uagaacagcauuuggcuauuaa

SEQ ID NO: 870141 - RNA, 22 nt, Human
ugcaggagagcuggucuggccc

SEQ ID NO: 870142 - RNA, 22 nt, Human
gagaagaaauagaaucacauuu

SEQ ID NO: 870143 - RNA, 22 nt, Human
gagggcuguggggcaugaccag

SEQ ID NO: 870144 - RNA, 19 nt, Human
ggucacaaggaguugugaa

SEQ ID NO: 870145 - RNA, 22 nt, Human
ccaugaccccuggcauccaggg

SEQ ID NO: 870146 - RNA, 23 nt, Human
gcccugcugggaccuccugcuac

SEQ ID NO: 870147 - RNA, 22 nt, Human
cuggaagcuuguuugccagucu

SEQ ID NO: 870148 - RNA, 22 nt, Human
augaguucauacuuucaguacc

SEQ ID NO: 870149 - RNA, 22 nt, Human
uaggcccaguuccgccucccgg

SEQ ID NO: 870150 - RNA, 22 nt, Human
acagauaaaaguuguuuaaaau

SEQ ID NO: 870151 - RNA, 22 nt, Human
ggacaccccggguaccaggucu

SEQ ID NO: 870152 - RNA, 22 nt, Human
uagggcaguuauaacauuagug

SEQ ID NO: 870153 - RNA, 22 nt, Human
uuugaaauuaagauauugucca

SEQ ID NO: 870154 - RNA, 22 nt, Human
ucuggagaggggccuagaauuu

SEQ ID NO: 870155 - RNA, 22 nt, Human
aagauuauggcagauaacaauu

SEQ ID NO: 870156 - RNA, 22 nt, Human
auggggcugaaacauggaagag

SEQ ID NO: 870157 - RNA, 22 nt, Human
ggcagcuuguccuucaggagag

SEQ ID NO: 870158 - RNA, 22 nt, Human
ugucuuuaagcaaacaguguuu

SEQ ID NO: 870159 - RNA, 22 nt, Human
ggggaaagugaauuguguagug

SEQ ID NO: 870160 - RNA, 22 nt, Human
cauguauagguccauagugaau

SEQ ID NO: 870161 - RNA, 22 nt, Human
gaggggcacagcagcuguugca

SEQ ID NO: 870162 - RNA, 22 nt, Human
uacagaauguguaucauuacca

SEQ ID NO: 870163 - RNA, 22 nt, Human
aagggcuggagacugggucuuc

SEQ ID NO: 870164 - RNA, 19 nt, Human
ucaaugcaugaaaucagcc

SEQ ID NO: 870165 - RNA, 22 nt, Human
cccugucuguaccgugaugagc

SEQ ID NO: 870166 - RNA, 22 nt, Human
uucucaguuucacugauaacag

SEQ ID NO: 870167 - RNA, 22 nt, Human
aaacagaaauuuccucaugcuc

SEQ ID NO: 870168 - RNA, 22 nt, Human
gacagagugcagggcuagaaga

SEQ ID NO: 870169 - RNA, 22 nt, Human
gaaauucaaauaagauauguag

SEQ ID NO: 870170 - RNA, 22 nt, Human
ggguuuuaugguucacuugcaa

SEQ ID NO: 870171 - RNA, 22 nt, Human
auguggggacaaaaugauggcc

SEQ ID NO: 870172 - RNA, 22 nt, Human
aaucuaagccaccaguaguuuc

SEQ ID NO: 870173 - RNA, 22 nt, Human
uugucugagaaagugaguugcu

SEQ ID NO: 870174 - RNA, 22 nt, Human
uuuucaucucugcuuuguaccu

SEQ ID NO: 870175 - RNA, 22 nt, Human
uaggccaacguggaagggucca

SEQ ID NO: 870176 - RNA, 22 nt, Human
gagaaguuucugguuugcauag

SEQ ID NO: 870177 - RNA, 22 nt, Human
ugcacugaauaguagacuguac

SEQ ID NO: 870178 - RNA, 22 nt, Human
ugaugcagaauccuagaguguc

SEQ ID NO: 870179 - RNA, 22 nt, Human
aacauacuuauacuaaauaaug

SEQ ID NO: 870180 - RNA, 22 nt, Human
ucugggagggagccucagaauc

SEQ ID NO: 870181 - RNA, 22 nt, Human
uagaaaugauuuugaugcuuca

SEQ ID NO: 870182 - RNA, 22 nt, Human
ggaggcuccaugagcuccugca

SEQ ID NO: 870183 - RNA, 22 nt, Human
gaggcugauucggggaacagca

SEQ ID NO: 870184 - RNA, 22 nt, Human
uuggucuucauccgucacagca

SEQ ID NO: 870185 - RNA, 22 nt, Human
agcuggccagaugucccaaaga

SEQ ID NO: 870186 - RNA, 22 nt, Human
uguguaaauggacugugaauua

SEQ ID NO: 870187 - RNA, 22 nt, Human
ucuucagacuguuguucuuuug

SEQ ID NO: 870188 - RNA, 19 nt, Human
uguuggaggugcugaauua

SEQ ID NO: 870189 - RNA, 22 nt, Human
acuguggccugcuguaugggcu

SEQ ID NO: 870190 - RNA, 22 nt, Human
guacuaagucaggagaagaauu

SEQ ID NO: 870191 - RNA, 22 nt, Human
ugcagggcccucauuccugucc

SEQ ID NO: 870192 - RNA, 22 nt, Human
uuuaggaagaguugaguaaauu

SEQ ID NO: 870193 - RNA, 22 nt, Human
cuggagcuggcuuccuuccacu

SEQ ID NO: 870194 - RNA, 22 nt, Human
caaggaaacaugaaaugcauug

SEQ ID NO: 870195 - RNA, 22 nt, Human
cuauuuguacagcauuaguaau

SEQ ID NO: 870196 - RNA, 21 nt, Human
uccagcuccugccacuccuua

SEQ ID NO: 870197 - RNA, 22 nt, Human
aauggcaccuucaagaagaaaa

SEQ ID NO: 870198 - RNA, 22 nt, Human
agggugccuggaagccacucac

SEQ ID NO: 870199 - RNA, 22 nt, Human
auucagugaguguuuaccggaa

SEQ ID NO: 870200 - RNA, 22 nt, Human
cucucuggauauuuguaugcug

SEQ ID NO: 870201 - RNA, 22 nt, Human
acccaggcuggagugcaguagc

SEQ ID NO: 870202 - RNA, 22 nt, Human
ugauucuauggaaggcauaagg

SEQ ID NO: 870203 - RNA, 22 nt, Human
caggcuucuuuucuuuccagac

SEQ ID NO: 870204 - RNA, 22 nt, Human
acagcugugagggucacuugua

SEQ ID NO: 870205 - RNA, 22 nt, Human
acagagucucagggaugaaagc

SEQ ID NO: 870206 - RNA, 22 nt, Human
aguugucaccucuauucaaauc

SEQ ID NO: 870207 - RNA, 22 nt, Human
acugaugaagaguaccacuguu

SEQ ID NO: 870208 - RNA, 22 nt, Human
uugcuucucagggccugaugca

SEQ ID NO: 870209 - RNA, 22 nt, Human
cccggaaaggcgauuaucccuc

SEQ ID NO: 870210 - RNA, 22 nt, Human
cagcauuuggugaucaucuuaa

SEQ ID NO: 870211 - RNA, 22 nt, Human
accugagcaugccaggagagug

SEQ ID NO: 870212 - RNA, 22 nt, Human
caauaauauccugugcuguuug

SEQ ID NO: 870213 - RNA, 22 nt, Human
gacauucugucaauguugacuc

SEQ ID NO: 870214 - RNA, 22 nt, Human
uugggaaguaauaugguggucu

SEQ ID NO: 870215 - RNA, 22 nt, Human
uccugggaaguugcaucaccgu

SEQ ID NO: 870216 - RNA, 22 nt, Human
cauuuauauaaaauguccagaa

SEQ ID NO: 870217 - RNA, 22 nt, Human
cucagcccggugcucgugccac

SEQ ID NO: 870218 - RNA, 22 nt, Human
guagaguuuaaugaaaaaucug

SEQ ID NO: 870219 - RNA, 22 nt, Human
augcuuccuuaccagaagauga

SEQ ID NO: 870220 - RNA, 22 nt, Human
cugguuuugaauaugucugcuu

SEQ ID NO: 870221 - RNA, 21 nt, Human
uguggcagauguugggaggca

SEQ ID NO: 870222 - RNA, 22 nt, Human
augaggcaaggcuggccguguu

SEQ ID NO: 870223 - RNA, 22 nt, Human
gcagagggcagggguguuuguu

SEQ ID NO: 870224 - RNA, 22 nt, Human
aggccuggugugccggaugcag

SEQ ID NO: 870225 - RNA, 22 nt, Human
ugauuucccucaucauaacaga

SEQ ID NO: 870226 - RNA, 22 nt, Human
acaaugaguuugauguaguuug

SEQ ID NO: 870227 - RNA, 22 nt, Human
aagaaaagaaaccugaggcuuu

SEQ ID NO: 870228 - RNA, 22 nt, Human
uucugacauuugucaaaaugau

SEQ ID NO: 870229 - RNA, 22 nt, Human
gcagcagggagcagggguguca

SEQ ID NO: 870230 - RNA, 23 nt, Human
aguuuccacccaggguagaaggg

SEQ ID NO: 870231 - RNA, 22 nt, Human
ccugggggccaggaagguguga

SEQ ID NO: 870232 - RNA, 22 nt, Human
uuguuuucacagcuuugcccgg

SEQ ID NO: 870233 - RNA, 22 nt, Human
ucagugugaauucauuuuagau

SEQ ID NO: 870234 - RNA, 22 nt, Human
agccccaguaagggagggccug

SEQ ID NO: 870235 - RNA, 22 nt, Human
ccucugagugacagccuccucu

SEQ ID NO: 870236 - RNA, 22 nt, Human
acagauuuggcccagccaaugc

SEQ ID NO: 870237 - RNA, 19 nt, Human
gcugaaggaggugccugca

SEQ ID NO: 870238 - RNA, 15 nt, Human
gaggccaggcaugug

SEQ ID NO: 870239 - RNA, 22 nt, Human
uucuaguucauauucucaaaga

SEQ ID NO: 870240 - RNA, 22 nt, Human
gaggaggucccccgacaugccu

SEQ ID NO: 870241 - RNA, 22 nt, Human
ucaggagaacuuccuucuaccc

SEQ ID NO: 870242 - RNA, 22 nt, Human
aacacugucuuauacuucaaug

SEQ ID NO: 870243 - RNA, 22 nt, Human
ccuucaaaacacuaguuuuuga

SEQ ID NO: 870244 - RNA, 22 nt, Human
cugagcugaaacuugagaggcu

SEQ ID NO: 870245 - RNA, 22 nt, Human
ccucuuugugccugcaggcugc

SEQ ID NO: 870246 - RNA, 22 nt, Human
uaaaggagugugaugaaaggga

SEQ ID NO: 870247 - RNA, 22 nt, Human
caggaggugaaggagaaccagu

SEQ ID NO: 870248 - RNA, 22 nt, Human
aaaagcagaccacgcuuugugg

SEQ ID NO: 870249 - RNA, 22 nt, Human
gcuggguuuccagcaggcagga

SEQ ID NO: 870250 - RNA, 22 nt, Human
agcccagcagaaaguccagccu

SEQ ID NO: 870251 - RNA, 22 nt, Human
acauuccucagugccaguugag

SEQ ID NO: 870252 - RNA, 22 nt, Human
agcugccaccucugccuuuggg

SEQ ID NO: 870253 - RNA, 22 nt, Human
gaugcagaaaguagacaccauc

SEQ ID NO: 870254 - RNA, 22 nt, Human
guuacaaaugccaaagcugaga

SEQ ID NO: 870255 - RNA, 19 nt, Human
acugaagcagggacugaaa

SEQ ID NO: 870256 - RNA, 22 nt, Human
gcccagcaccucucucaggguu

SEQ ID NO: 870257 - RNA, 22 nt, Human
agauauuuugugugauguuuca

SEQ ID NO: 870258 - RNA, 22 nt, Human
acuuugaaggggaacauuuuaa

SEQ ID NO: 870259 - RNA, 22 nt, Human
agucaguguagaaagcccaggc

SEQ ID NO: 870260 - RNA, 22 nt, Human
auagcaccugugaugggaugag

SEQ ID NO: 870261 - RNA, 22 nt, Human
caggcccagcccagcccuucga

SEQ ID NO: 870262 - RNA, 22 nt, Human
gauguaaaauucuugguuguca

SEQ ID NO: 870263 - RNA, 22 nt, Human
auguuggcuggauuuuagauuu

SEQ ID NO: 870264 - RNA, 22 nt, Human
ucucugcccaugagcaaucugc

SEQ ID NO: 870265 - RNA, 22 nt, Human
ugggaagguuagcaguuuguca

SEQ ID NO: 870266 - RNA, 22 nt, Human
ugacagaggagcuggaaugauu

SEQ ID NO: 870267 - RNA, 22 nt, Human
uggaggcaacugaagauguagu

SEQ ID NO: 870268 - RNA, 22 nt, Human
auuugccucugcuuucaaggau

SEQ ID NO: 870269 - RNA, 22 nt, Human
agauuaugcuggcugcuacaag

SEQ ID NO: 870270 - RNA, 22 nt, Human
gagggccaggcagcaagaaggc

SEQ ID NO: 870271 - RNA, 22 nt, Human
ugggagaugguucugagacuuu

SEQ ID NO: 870272 - RNA, 22 nt, Human
auaguuaugcucuagacaagaa

SEQ ID NO: 870273 - RNA, 22 nt, Human
aggcaggauugcugacaacaau

SEQ ID NO: 870274 - RNA, 22 nt, Human
uuucaaacuguacuuuccccua

SEQ ID NO: 870275 - RNA, 22 nt, Human
cagcaucucauucauucauguu

SEQ ID NO: 870276 - RNA, 22 nt, Human
cugugaccuccaggaaggggug

SEQ ID NO: 870277 - RNA, 22 nt, Human
acagcagcagaccagcauaugu

SEQ ID NO: 870278 - RNA, 22 nt, Human
ucuuuccacagcauguccaugc

SEQ ID NO: 870279 - RNA, 21 nt, Human
ucuuuuccuuucugugugcaa

SEQ ID NO: 870280 - RNA, 22 nt, Human
gugggcaguuggugauucucgu

SEQ ID NO: 870281 - RNA, 22 nt, Human
ucugucuguccagggcccccgc

SEQ ID NO: 870282 - RNA, 22 nt, Human
ggcagcuggccuccucgcccac

SEQ ID NO: 870283 - RNA, 22 nt, Human
uugaaacugaguguguuugggg

SEQ ID NO: 870284 - RNA, 22 nt, Human
auggagauuuuuagaauuacag

SEQ ID NO: 870285 - RNA, 22 nt, Human
acaguguucacuuaacaaugga

SEQ ID NO: 870286 - RNA, 22 nt, Human
aaacuucagugaaugacuuaug

SEQ ID NO: 870287 - RNA, 21 nt, Human
ccugagggugguugugaagau

SEQ ID NO: 870288 - RNA, 22 nt, Human
acagcuggugaauguucucugu

SEQ ID NO: 870289 - RNA, 22 nt, Human
uucagcuugaaucuggcuuuga

SEQ ID NO: 870290 - RNA, 22 nt, Human
aaacaggaguugaccaaguaca

SEQ ID NO: 870291 - RNA, 22 nt, Human
agcugucugucuccugaggaga

SEQ ID NO: 870292 - RNA, 22 nt, Human
acacaugugucugcaugcagug

SEQ ID NO: 870293 - RNA, 22 nt, Human
gcccacuccagcuucucccaca

SEQ ID NO: 870294 - RNA, 22 nt, Human
uuuacauguaauguuauacaaa

SEQ ID NO: 870295 - RNA, 18 nt, Human
gccaggcaggguggggaa

SEQ ID NO: 870296 - RNA, 22 nt, Human
aggcccuggucaggucuggcug

SEQ ID NO: 870297 - RNA, 22 nt, Human
ucuugcagaaaauaguauagau

SEQ ID NO: 870298 - RNA, 22 nt, Human
uccauuugaaaugaaagugaua

SEQ ID NO: 870299 - RNA, 22 nt, Human
ccugagcauuagacauccauca

SEQ ID NO: 870300 - RNA, 21 nt, Human
gauaaggcaggaggauaagua

SEQ ID NO: 870301 - RNA, 22 nt, Human
ugccaggcucagccccuaucuu

SEQ ID NO: 870302 - RNA, 22 nt, Human
cauucacaauaguugaaaggug

SEQ ID NO: 870303 - RNA, 22 nt, Human
aggaccuguguuuuccuugaau

SEQ ID NO: 870304 - RNA, 22 nt, Human
ccaggagccugggccaggcugg

SEQ ID NO: 870305 - RNA, 22 nt, Human
agcagccaggaaucugcagagc

SEQ ID NO: 870306 - RNA, 22 nt, Human
cagaaaaggguguuuguucagg

SEQ ID NO: 870307 - RNA, 20 nt, Human
uugagcuuuuaguacagaca

SEQ ID NO: 870308 - RNA, 22 nt, Human
cuguccagugacuuugggccau

SEQ ID NO: 870309 - RNA, 21 nt, Human
aaagaaucauggguaauuuca

SEQ ID NO: 870310 - RNA, 22 nt, Human
ggcccugcaagguacccaggcc

SEQ ID NO: 870311 - RNA, 22 nt, Human
cagccagggagggcaaaugaga

SEQ ID NO: 870312 - RNA, 23 nt, Human
auggucagaauuuuccagcugag

SEQ ID NO: 870313 - RNA, 22 nt, Human
cuuuccaagaaugcagauaccu

SEQ ID NO: 870314 - RNA, 22 nt, Human
ccuuuguggggcgguggguaau

SEQ ID NO: 870315 - RNA, 22 nt, Human
uugagaaacaucuaaucuuugu

SEQ ID NO: 870316 - RNA, 22 nt, Human
ugggcugaaaugcuguggacua

SEQ ID NO: 870317 - RNA, 20 nt, Human
aguuccacauggcuggggag

SEQ ID NO: 870318 - RNA, 22 nt, Human
acaguacagugcagaggaagau

SEQ ID NO: 870319 - RNA, 22 nt, Human
cugggaggugaacagaaaaacu

SEQ ID NO: 870320 - RNA, 19 nt, Human
gccugagccagccaugcaa

SEQ ID NO: 870321 - RNA, 22 nt, Human
aaaauaucagcaaagggugaca

SEQ ID NO: 870322 - RNA, 22 nt, Human
ggcaggcagaggcugagacagg

SEQ ID NO: 870323 - RNA, 22 nt, Human
gccaggcgggucucaaacuccu

SEQ ID NO: 870324 - RNA, 22 nt, Human
ucaguaguuuuaagucuguuaa

SEQ ID NO: 870325 - RNA, 22 nt, Human
gaaucucauucuaacuaguagg

SEQ ID NO: 870326 - RNA, 22 nt, Human
ugacauuuuuaaaaccacuagu

SEQ ID NO: 870327 - RNA, 22 nt, Human
gauaaauggcugaagaaauagu

SEQ ID NO: 870328 - RNA, 22 nt, Human
uaacaguauagccuaacauuuc

SEQ ID NO: 870329 - RNA, 22 nt, Human
uuaggaaagaagcagcuaggag

SEQ ID NO: 870330 - RNA, 22 nt, Human
cugccugcuuaccaugcaucag

SEQ ID NO: 870331 - RNA, 22 nt, Human
uaucuaaaggauuuaauuuagu

SEQ ID NO: 870332 - RNA, 22 nt, Human
aagcugugguaaaggguagagg

SEQ ID NO: 870333 - RNA, 23 nt, Human
aagucagagccaagucaaugaga

SEQ ID NO: 870334 - RNA, 22 nt, Human
aaguaucaaaugguagcauaug

SEQ ID NO: 870335 - RNA, 22 nt, Human
guguguccucaguaguggcaug

SEQ ID NO: 870336 - RNA, 22 nt, Human
accaggcacucuuguggcagug

SEQ ID NO: 870337 - RNA, 20 nt, Human
aggcccugccagggacggag

SEQ ID NO: 870338 - RNA, 22 nt, Human
uuaggaaguuauaguggaaaug

SEQ ID NO: 870339 - RNA, 22 nt, Human
uaucaguggucacaagauacau

SEQ ID NO: 870340 - RNA, 22 nt, Human
ccuggcucccuggaccucauua

SEQ ID NO: 870341 - RNA, 22 nt, Human
uuguauggauuugugggugagu

SEQ ID NO: 870342 - RNA, 22 nt, Human
aagguggcccugagcaugacaa

SEQ ID NO: 870343 - RNA, 22 nt, Human
gaggagcuggcagcgucuccgc

SEQ ID NO: 870344 - RNA, 22 nt, Human
ugaaagguuauuuaggucugcu

SEQ ID NO: 870345 - RNA, 22 nt, Human
uggcgcaguuucucugcugccu

SEQ ID NO: 870346 - RNA, 22 nt, Human
auacaaagcuaaauaugguuuc

SEQ ID NO: 870347 - RNA, 22 nt, Human
ucuaguccuaggagaggaguca

SEQ ID NO: 870348 - RNA, 22 nt, Human
agcugccugcuuaugagcucca

SEQ ID NO: 870349 - RNA, 22 nt, Human
ccauuuuauuagugacauuuag

SEQ ID NO: 870350 - RNA, 22 nt, Human
gaaggcccagcuugaaugcugc

SEQ ID NO: 870351 - RNA, 22 nt, Human
uaccuauagguacaauuacaag

SEQ ID NO: 870352 - RNA, 22 nt, Human
uacaguuuuuauucaugacaag

SEQ ID NO: 870353 - RNA, 22 nt, Human
gcucuguggcauucaugggcag

SEQ ID NO: 870354 - RNA, 22 nt, Human
uaaagacaugguguaggugaac

SEQ ID NO: 870355 - RNA, 22 nt, Human
uguuaagaagaggcaguacuua

SEQ ID NO: 870356 - RNA, 22 nt, Human
guccaccauagggagggcgugg

SEQ ID NO: 870357 - RNA, 22 nt, Human
caguagcaugcaccaggagggu

SEQ ID NO: 870358 - RNA, 22 nt, Human
gauaauaucugguuuauucacc

SEQ ID NO: 870359 - RNA, 16 nt, Human
ggcuccagaauagcga

SEQ ID NO: 870360 - RNA, 22 nt, Human
cugaaggcaccaggggugccag

SEQ ID NO: 870361 - RNA, 22 nt, Human
agggagaacaguugcagcagac

SEQ ID NO: 870362 - RNA, 18 nt, Human
cucucugggugaggacaa

SEQ ID NO: 870363 - RNA, 22 nt, Human
cucagggaguagcacaugugga

SEQ ID NO: 870364 - RNA, 22 nt, Human
uggagggaacaaaggaguccca

SEQ ID NO: 870365 - RNA, 22 nt, Human
ccaggcucacagcaucccagga

SEQ ID NO: 870366 - RNA, 20 nt, Human
agugggagagggcagacugc

SEQ ID NO: 870367 - RNA, 22 nt, Human
agauauacacccauaucacaua

SEQ ID NO: 870368 - RNA, 22 nt, Human
augccagaagccaaaaaauauu

SEQ ID NO: 870369 - RNA, 22 nt, Human
auggcagccuguggacagucaa

SEQ ID NO: 870370 - RNA, 22 nt, Human
cuccaggugcagaaggacucag

SEQ ID NO: 870371 - RNA, 22 nt, Human
ccagccacugggccacugccag

SEQ ID NO: 870372 - RNA, 19 nt, Human
aggagcacugccagcacca

SEQ ID NO: 870373 - RNA, 22 nt, Human
ugguggcaauucaaagacagca

SEQ ID NO: 870374 - RNA, 22 nt, Human
uggagaugcacgagcaggugga

SEQ ID NO: 870375 - RNA, 19 nt, Human
ugccaggaauacuccagaa

SEQ ID NO: 870376 - RNA, 22 nt, Human
ucauaaauuagcugucuuugaa

SEQ ID NO: 870377 - RNA, 22 nt, Human
gcaggaagaugagcucagguaa

SEQ ID NO: 870378 - RNA, 22 nt, Human
aguggcuggagccccaggcugg

SEQ ID NO: 870379 - RNA, 22 nt, Human
aaaugacacuaggcuuuuugca

SEQ ID NO: 870380 - RNA, 22 nt, Human
aguguuuaaacugaagugauga

SEQ ID NO: 870381 - RNA, 22 nt, Human
auggcugggucaccaucagggu

SEQ ID NO: 870382 - RNA, 22 nt, Human
aacauuucagcaccugauuccu

SEQ ID NO: 870383 - RNA, 22 nt, Human
agggagcuuuuucaugugucua

SEQ ID NO: 870384 - RNA, 22 nt, Human
aguacaaaggcccuugauuacu

SEQ ID NO: 870385 - RNA, 22 nt, Human
acaaggcuguggggagaacuga

SEQ ID NO: 870386 - RNA, 22 nt, Human
uugcucugaacccagggcacca

SEQ ID NO: 870387 - RNA, 22 nt, Human
augggcugaggugggauagaag

SEQ ID NO: 870388 - RNA, 22 nt, Human
gaaggcugcugggaaguguggu

SEQ ID NO: 870389 - RNA, 22 nt, Human
gugcucuagaaauugucagugg

SEQ ID NO: 870390 - RNA, 22 nt, Human
uauauuugcuaaaugugugcaa

SEQ ID NO: 870391 - RNA, 23 nt, Human
acauuucaauacugagggucuga

SEQ ID NO: 870392 - RNA, 22 nt, Human
gcccuguguguuugcacugauu

SEQ ID NO: 870393 - RNA, 22 nt, Human
agcuggagaguuuccaggaagg

SEQ ID NO: 870394 - RNA, 22 nt, Human
gcagagcacccugcagugguau

SEQ ID NO: 870395 - RNA, 22 nt, Human
agucuucagagaaauuaacucu

SEQ ID NO: 870396 - RNA, 22 nt, Human
ugugaaugcuuguuauggagug

SEQ ID NO: 870397 - RNA, 22 nt, Human
ucuggggacggggcccagcaau

SEQ ID NO: 870398 - RNA, 22 nt, Human
uuguucauaaagacaguucaga

SEQ ID NO: 870399 - RNA, 22 nt, Human
agcucuggaacucccggcugcu

SEQ ID NO: 870400 - RNA, 22 nt, Human
ucuaggaguugauaaaagggcu

SEQ ID NO: 870401 - RNA, 22 nt, Human
ucuucuguggcucucaccaccc

SEQ ID NO: 870402 - RNA, 22 nt, Human
gcugaagaugcaucccuucucu

SEQ ID NO: 870403 - RNA, 22 nt, Human
agaccuuuauuucaugauagga

SEQ ID NO: 870404 - RNA, 19 nt, Human
guggccugcgcugggugcg

SEQ ID NO: 870405 - RNA, 22 nt, Human
gacccuggcagguagccucaca

SEQ ID NO: 870406 - RNA, 22 nt, Human
uuguggaagcccuaugagagac

SEQ ID NO: 870407 - RNA, 22 nt, Human
agcagguguauauaaggcugag

SEQ ID NO: 870408 - RNA, 22 nt, Human
cugggcccaggcggcucucgga

SEQ ID NO: 870409 - RNA, 18 nt, Human
ucccucagaauuauagaa

SEQ ID NO: 870410 - RNA, 20 nt, Human
aauuagauguuuaaucaaua

SEQ ID NO: 870411 - RNA, 22 nt, Human
ggaagccuaaagcccaggucuc

SEQ ID NO: 870412 - RNA, 22 nt, Human
uuuauucuaacuugcugcucua

SEQ ID NO: 870413 - RNA, 22 nt, Human
guuuggugagcuaagauuauuu

SEQ ID NO: 870414 - RNA, 22 nt, Human
ucuguucagacacuuuacaugu

SEQ ID NO: 870415 - RNA, 22 nt, Human
cccugaggccucagguucauug

SEQ ID NO: 870416 - RNA, 22 nt, Human
gggcucugaaucccaggucugc

SEQ ID NO: 870417 - RNA, 22 nt, Human
uaauuaacauacaaaacagcug

SEQ ID NO: 870418 - RNA, 22 nt, Human
uagucaggaguaggaguuuugg

SEQ ID NO: 870419 - RNA, 17 nt, Human
ucuccaggacgagcuca

SEQ ID NO: 870420 - RNA, 22 nt, Human
uguauuuucuucuggaagcuua

SEQ ID NO: 870421 - RNA, 22 nt, Human
ccacaaggccuguggggcugcu

SEQ ID NO: 870422 - RNA, 22 nt, Human
uucuaguuuccauuuuaagaca

SEQ ID NO: 870423 - RNA, 20 nt, Human
uccugcaguuccuaggaggg

SEQ ID NO: 870424 - RNA, 22 nt, Human
gugcucuguggauugaguugaa

SEQ ID NO: 870425 - RNA, 22 nt, Human
uggccccaucaagggaugaguu

SEQ ID NO: 870426 - RNA, 22 nt, Human
uagcugcccaucuuuccuuuag

SEQ ID NO: 870427 - RNA, 20 nt, Human
uacaauauucccacuuugcu

SEQ ID NO: 870428 - RNA, 22 nt, Human
uaucaacaaaggccuuguguuu

SEQ ID NO: 870429 - RNA, 22 nt, Human
cugcccugggauggucugugcg

SEQ ID NO: 870430 - RNA, 22 nt, Human
aaggaggcagaacucacaugga

SEQ ID NO: 870431 - RNA, 22 nt, Human
uuuacaggauuacccuggcugc

SEQ ID NO: 870432 - RNA, 22 nt, Human
ucucauggcuuaacaagcccac

SEQ ID NO: 870433 - RNA, 22 nt, Human
acauuuugagaaaugacaagcu

SEQ ID NO: 870434 - RNA, 22 nt, Human
ucagagguaguagcagaguuga

SEQ ID NO: 870435 - RNA, 19 nt, Human
acccaggguugauguccag

SEQ ID NO: 870436 - RNA, 22 nt, Human
aagcaaguacaauagcaaguac

SEQ ID NO: 870437 - RNA, 22 nt, Human
agcaugaagacuucagagcuag

SEQ ID NO: 870438 - RNA, 22 nt, Human
uucuagagaacucgagugccuu

SEQ ID NO: 870439 - RNA, 22 nt, Human
aguucuaaggugaguagagagg

SEQ ID NO: 870440 - RNA, 22 nt, Human
auuccaggacuaaaggaacagc

SEQ ID NO: 870441 - RNA, 22 nt, Human
uuuuccuacugauaaacaguua

SEQ ID NO: 870442 - RNA, 22 nt, Human
auuucccaauacgcuaagugga

SEQ ID NO: 870443 - RNA, 22 nt, Human
aaagagucuggcguuuuaaugg

SEQ ID NO: 870444 - RNA, 22 nt, Human
ugccagcuccugcagcuccugu

SEQ ID NO: 870445 - RNA, 22 nt, Human
ccaggcagaugggccggcuuca

SEQ ID NO: 870446 - RNA, 22 nt, Human
uguucauucugugaccugguuc

SEQ ID NO: 870447 - RNA, 23 nt, Human
agauacagaucuacgugucaaug

SEQ ID NO: 870448 - RNA, 22 nt, Human
ucagcccagggacagaggcccc

SEQ ID NO: 870449 - RNA, 22 nt, Human
ucucugaagaaucgaugauucu

SEQ ID NO: 870450 - RNA, 22 nt, Human
uuucaaggauguuauauaaaug

SEQ ID NO: 870451 - RNA, 22 nt, Human
acuuuagaaaagcauccauaga

SEQ ID NO: 870452 - RNA, 22 nt, Human
uuuuggaagccgcggcugggca

SEQ ID NO: 870453 - RNA, 18 nt, Human
caugcagagggaucugug

SEQ ID NO: 870454 - RNA, 22 nt, Human
ucagaggaucaugucccuacuc

SEQ ID NO: 870455 - RNA, 22 nt, Human
aauaagacucugcuagaaauuc

SEQ ID NO: 870456 - RNA, 22 nt, Human
cugugugugaacacagcccagc

SEQ ID NO: 870457 - RNA, 19 nt, Human
ugugugcaaauggaagcca

SEQ ID NO: 870458 - RNA, 22 nt, Human
cccaggcacacugaagugacau

SEQ ID NO: 870459 - RNA, 20 nt, Human
cucuuaaauguaaaguaggc

SEQ ID NO: 870460 - RNA, 22 nt, Human
uucuggggccccaguguccucg

SEQ ID NO: 870461 - RNA, 22 nt, Human
ugaagaagccaauugguaggcu

SEQ ID NO: 870462 - RNA, 22 nt, Human
aaucuaguuuaauauguuuaaa

SEQ ID NO: 870463 - RNA, 21 nt, Human
uauuuauuaauuuguaaggcu

SEQ ID NO: 870464 - RNA, 22 nt, Human
agaaaguucugugaguuguuca

SEQ ID NO: 870465 - RNA, 22 nt, Human
uccaggagguuuggaggaagca

SEQ ID NO: 870466 - RNA, 22 nt, Human
agaguggggacagggccugucc

SEQ ID NO: 870467 - RNA, 22 nt, Human
auucuauagacagaaggucaau

SEQ ID NO: 870468 - RNA, 22 nt, Human
uucuauguggcaucaagcucag

SEQ ID NO: 870469 - RNA, 22 nt, Human
agaagccaacagggcaggagag

SEQ ID NO: 870470 - RNA, 22 nt, Human
aggcagggcucauuucuuaggc

SEQ ID NO: 870471 - RNA, 16 nt, Human
gcuccugggcccucga

SEQ ID NO: 870472 - RNA, 22 nt, Human
ggugagcagcugucuguaugga

SEQ ID NO: 870473 - RNA, 22 nt, Human
cugugcuggcagaccuggaguu

SEQ ID NO: 870474 - RNA, 22 nt, Human
agauacauuguucuaagcauug

SEQ ID NO: 870475 - RNA, 22 nt, Human
ugcuuccuugaucauucccaaa

SEQ ID NO: 870476 - RNA, 22 nt, Human
ggaaugaaacacuucugauucu

SEQ ID NO: 870477 - RNA, 22 nt, Human
ugucugagugcauaugugcugg

SEQ ID NO: 870478 - RNA, 22 nt, Human
ucucaaacuaacaaugauuaua

SEQ ID NO: 870479 - RNA, 22 nt, Human
cucucagggcagguggccuuuc

SEQ ID NO: 870480 - RNA, 22 nt, Human
aggagagagcugagcuuugcug

SEQ ID NO: 870481 - RNA, 20 nt, Human
uauaaauucagagcuuuggu

SEQ ID NO: 870482 - RNA, 22 nt, Human
uaaagugugcauggucaaauau

SEQ ID NO: 870483 - RNA, 22 nt, Human
uggccugcagaggcuguggggc

SEQ ID NO: 870484 - RNA, 22 nt, Human
gugaggggaguaaagccauguu

SEQ ID NO: 870485 - RNA, 22 nt, Human
aacuuuaaaaaauaugucuguu

SEQ ID NO: 870486 - RNA, 22 nt, Human
gccugggagaaugaccuccaac

SEQ ID NO: 870487 - RNA, 22 nt, Human
uuuccacacaggcucuacuacu

SEQ ID NO: 870488 - RNA, 22 nt, Human
auucuacauuuggagugauguc

SEQ ID NO: 870489 - RNA, 22 nt, Human
caggggaguuuuaugcaacaga

SEQ ID NO: 870490 - RNA, 22 nt, Human
cugggcucuagaaaggaaagaa

SEQ ID NO: 870491 - RNA, 22 nt, Human
uuuuggugcaccuagcuuuuuc

SEQ ID NO: 870492 - RNA, 22 nt, Human
gcuucuagggaaggcagucaca

SEQ ID NO: 870493 - RNA, 22 nt, Human
agauguggauccuaggguagaa

SEQ ID NO: 870494 - RNA, 22 nt, Human
cugaggagcaaccccgugcccu

SEQ ID NO: 870495 - RNA, 22 nt, Human
ugaaagaaggguggaaaaugua

SEQ ID NO: 870496 - RNA, 22 nt, Human
gcccaggauucuuucuuccuua

SEQ ID NO: 870497 - RNA, 22 nt, Human
ggcaaaaacagcaaugacuuuu

SEQ ID NO: 870498 - RNA, 23 nt, Human
ucuggaauccucccccuugguuc

SEQ ID NO: 870499 - RNA, 22 nt, Human
acccaggggcagccuugcugug

SEQ ID NO: 870500 - RNA, 19 nt, Human
cucugccucccuccugggu

SEQ ID NO: 870501 - RNA, 21 nt, Human
ugaacaaaguucuuaucguga

SEQ ID NO: 870502 - RNA, 22 nt, Human
uuacacagugaauuuacucaag

SEQ ID NO: 870503 - RNA, 22 nt, Human
uuucauugccauaaggugggau

SEQ ID NO: 870504 - RNA, 22 nt, Human
ggggcugacgggcauguggcuu

SEQ ID NO: 870505 - RNA, 22 nt, Human
ccucuucuaccauuuacauuuu

SEQ ID NO: 870506 - RNA, 22 nt, Human
aacauagaauuguuauauuuuc

SEQ ID NO: 870507 - RNA, 22 nt, Human
aguguuuccugaguguuaucau

SEQ ID NO: 870508 - RNA, 22 nt, Human
aggaugggucagcuagagucca

SEQ ID NO: 870509 - RNA, 22 nt, Human
augcauaugcaaugcacaauuu

SEQ ID NO: 870510 - RNA, 22 nt, Human
caguaguuauuaguugccacug

SEQ ID NO: 870511 - RNA, 21 nt, Human
aggagggcacaaggccaggaa

SEQ ID NO: 870512 - RNA, 22 nt, Human
uuugaagauaaauauggagaaa

SEQ ID NO: 870513 - RNA, 22 nt, Human
uagguacaaggagggauucuug

SEQ ID NO: 870514 - RNA, 22 nt, Human
gacuguccagaauuccuaggug

SEQ ID NO: 870515 - RNA, 20 nt, Human
ugucugugccacggcacucc

SEQ ID NO: 870516 - RNA, 22 nt, Human
uggaagaauaggauagaagaac

SEQ ID NO: 870517 - RNA, 22 nt, Human
cuuggacuuccaggaaguauuu

SEQ ID NO: 870518 - RNA, 19 nt, Human
ucucuauauuuguuucuga

SEQ ID NO: 870519 - RNA, 22 nt, Human
ccaggacucaguggggaaaggg

SEQ ID NO: 870520 - RNA, 22 nt, Human
aggcagcaugggccccagcucc

SEQ ID NO: 870521 - RNA, 22 nt, Human
aaagaguugaaaacuaacagug

SEQ ID NO: 870522 - RNA, 22 nt, Human
caagccugucucaccagugcua

SEQ ID NO: 870523 - RNA, 22 nt, Human
gcuguucauuagaaauagaaug

SEQ ID NO: 870524 - RNA, 16 nt, Human
uggggaagcucgugag

SEQ ID NO: 870525 - RNA, 22 nt, Human
uggcaggcagugugggagcugg

SEQ ID NO: 870526 - RNA, 22 nt, Human
ugaagccccuaagucccaggca

SEQ ID NO: 870527 - RNA, 22 nt, Human
ugccagggccauagggagucua

SEQ ID NO: 870528 - RNA, 22 nt, Human
auacacacauaugugaguuuug

SEQ ID NO: 870529 - RNA, 22 nt, Human
uugagcccaggaggccugggug

SEQ ID NO: 870530 - RNA, 22 nt, Human
agacuaaagacucauucugcug

SEQ ID NO: 870531 - RNA, 22 nt, Human
uaacacaugguuaguacacaau

SEQ ID NO: 870532 - RNA, 22 nt, Human
uuuucuguuacaaaguacagcg

SEQ ID NO: 870533 - RNA, 22 nt, Human
cugcagugcaagcccagaugga

SEQ ID NO: 870534 - RNA, 22 nt, Human
cucugggguggaggaggcugac

SEQ ID NO: 870535 - RNA, 22 nt, Human
cugggacuuuguaggccaguug

SEQ ID NO: 870536 - RNA, 18 nt, Human
gggcggaagggaagauaa

SEQ ID NO: 870537 - RNA, 22 nt, Human
ggugauucugugaggggcugac

SEQ ID NO: 870538 - RNA, 22 nt, Human
gucuagagugcuuccuagucau

SEQ ID NO: 870539 - RNA, 22 nt, Human
augcaucacuaaauagugccgu

SEQ ID NO: 870540 - RNA, 22 nt, Human
cugcuucauagcccuggucucu

SEQ ID NO: 870541 - RNA, 22 nt, Human
gaguuuggguggaaggagggua

SEQ ID NO: 870542 - RNA, 22 nt, Human
uuuaauugcauuuaaagaugga

SEQ ID NO: 870543 - RNA, 22 nt, Human
uaucaucuuguugucaugcagc

SEQ ID NO: 870544 - RNA, 22 nt, Human
auuuuuucagauugaguguuaa

SEQ ID NO: 870545 - RNA, 22 nt, Human
uuugaauagcauaggauuacau

SEQ ID NO: 870546 - RNA, 22 nt, Human
agcuccagaggcagugaugaag

SEQ ID NO: 870547 - RNA, 22 nt, Human
aggacccugcucaagcaucucc

SEQ ID NO: 870548 - RNA, 22 nt, Human
cacagcuguuuucuccaggcag

SEQ ID NO: 870549 - RNA, 22 nt, Human
ccugcaggcugcaggccaguuc

SEQ ID NO: 870550 - RNA, 22 nt, Human
gucuguccacuuggaagcuccc

SEQ ID NO: 870551 - RNA, 22 nt, Human
auacauauccacaggagauaaa

SEQ ID NO: 870552 - RNA, 22 nt, Human
uuugcuaaauaagugauuaagu

SEQ ID NO: 870553 - RNA, 22 nt, Human
ucuuucauguauaugcaaccua

SEQ ID NO: 870554 - RNA, 22 nt, Human
ggaaggggugggugagccucag

SEQ ID NO: 870555 - RNA, 22 nt, Human
ccugggagggcaagugcugaug

SEQ ID NO: 870556 - RNA, 22 nt, Human
uauuugcuuggaaaccuaaucc

SEQ ID NO: 870557 - RNA, 22 nt, Human
uguaugcaccauuguauuaccu

SEQ ID NO: 870558 - RNA, 22 nt, Human
guuucacagaugguguucauau

SEQ ID NO: 870559 - RNA, 22 nt, Human
ugcaaaaauugcuggaaucuuu

SEQ ID NO: 870560 - RNA, 22 nt, Human
aaggcaaugacugauuuagaau

SEQ ID NO: 870561 - RNA, 22 nt, Human
acuguccaagcaugccuggcuu

SEQ ID NO: 870562 - RNA, 17 nt, Human
auggcucaccugugggc

SEQ ID NO: 870563 - RNA, 22 nt, Human
aggucuugugaaggacugugcc

SEQ ID NO: 870564 - RNA, 22 nt, Human
agcucaggucauuccagggaug

SEQ ID NO: 870565 - RNA, 22 nt, Human
acauguuuacauuaggugauau

SEQ ID NO: 870566 - RNA, 22 nt, Human
uugaucugccucauucuuguuc

SEQ ID NO: 870567 - RNA, 19 nt, Human
ugcucuggagccagcucuc

SEQ ID NO: 870568 - RNA, 22 nt, Human
aagcaagaguuggagugauguu

SEQ ID NO: 870569 - RNA, 22 nt, Human
gucuuauuaugagguuagacuu

SEQ ID NO: 870570 - RNA, 22 nt, Human
guauuugaucauuagaaugauu

SEQ ID NO: 870571 - RNA, 23 nt, Human
agccccucauaucugcuuucucu

SEQ ID NO: 870572 - RNA, 22 nt, Human
aucaaauauaauaauuuucgcu

SEQ ID NO: 870573 - RNA, 22 nt, Human
uccgaugcuuccagggccaccu

SEQ ID NO: 870574 - RNA, 22 nt, Human
cuaauucugaaacagugucaau

SEQ ID NO: 870575 - RNA, 22 nt, Human
aggcacugcagauuacaggcgc

SEQ ID NO: 870576 - RNA, 21 nt, Human
cacaagacacauaggguguuu

SEQ ID NO: 870577 - RNA, 22 nt, Human
ugaacccuuguagaggauggag

SEQ ID NO: 870578 - RNA, 22 nt, Human
gaacaacuccaagggacaucau

SEQ ID NO: 870579 - RNA, 22 nt, Human
cggcugagacggccauagacac

SEQ ID NO: 870580 - RNA, 22 nt, Human
agccucccuaugcaccuucagg

SEQ ID NO: 870581 - RNA, 22 nt, Human
uuggaacucuaccaacaguagu

SEQ ID NO: 870582 - RNA, 22 nt, Human
ccuggccagggucugggcugcu

SEQ ID NO: 870583 - RNA, 22 nt, Human
aaggcugagggcuguaccuggc

SEQ ID NO: 870584 - RNA, 18 nt, Human
aagccagagaccacugcc

SEQ ID NO: 870585 - RNA, 22 nt, Human
acuguuaagaaggaggauggaa

SEQ ID NO: 870586 - RNA, 22 nt, Human
ucugagagcucuggggccccuu

SEQ ID NO: 870587 - RNA, 22 nt, Human
gaagaucagaguaagcuuuuua

SEQ ID NO: 870588 - RNA, 22 nt, Human
cugaaguuaguuaugccuaaaa

SEQ ID NO: 870589 - RNA, 22 nt, Human
uuuaguucacaccaggguagca

SEQ ID NO: 870590 - RNA, 22 nt, Human
uguccucaaggagcuucagucu

SEQ ID NO: 870591 - RNA, 22 nt, Human
gugucugugucauuacuaauag

SEQ ID NO: 870592 - RNA, 22 nt, Human
ugucccagauacuggacauaga

SEQ ID NO: 870593 - RNA, 22 nt, Human
cccaaaaugugcauguucgaau

SEQ ID NO: 870594 - RNA, 22 nt, Human
cagaaacuagauuuagacacaa

SEQ ID NO: 870595 - RNA, 22 nt, Human
ccucuggucccagcucugcugc

SEQ ID NO: 870596 - RNA, 22 nt, Human
gggagcugagcuggaagagaau

SEQ ID NO: 870597 - RNA, 22 nt, Human
uccugagacaucucugcugguc

SEQ ID NO: 870598 - RNA, 22 nt, Human
caggaucugccaauauucaacc

SEQ ID NO: 870599 - RNA, 22 nt, Human
cccugguggggccagacuugcu

SEQ ID NO: 870600 - RNA, 22 nt, Human
auuagucaguauuuguuugcca

SEQ ID NO: 870601 - RNA, 22 nt, Human
uaguuucuaaagcuuccuaggu

SEQ ID NO: 870602 - RNA, 22 nt, Human
agcugcaggccucuccugggga

SEQ ID NO: 870603 - RNA, 22 nt, Human
aagcccagguaaguggcucaug

SEQ ID NO: 870604 - RNA, 22 nt, Human
uucaagaugacccagucacacg

SEQ ID NO: 870605 - RNA, 22 nt, Human
cuggcucccguuguccuugaag

SEQ ID NO: 870606 - RNA, 21 nt, Human
gccuccagccagauggccucc

SEQ ID NO: 870607 - RNA, 22 nt, Human
auggcuagcaccgcguugcugg

SEQ ID NO: 870608 - RNA, 20 nt, Human
aggucaguagaaugauuuug

SEQ ID NO: 870609 - RNA, 19 nt, Human
uccaggcuccauuggcaga

SEQ ID NO: 870610 - RNA, 22 nt, Human
cugcuguuucucaaaauuaagu

SEQ ID NO: 870611 - RNA, 22 nt, Human
accaaugugaugauauuaggag

SEQ ID NO: 870612 - RNA, 22 nt, Human
uggcagcuggagggcaauggcc

SEQ ID NO: 870613 - RNA, 22 nt, Human
uccugggaguggccauguaaug

SEQ ID NO: 870614 - RNA, 22 nt, Human
uuuuggcaagcugggagauauu

SEQ ID NO: 870615 - RNA, 22 nt, Human
gacaaagccuaagaaguauuua

SEQ ID NO: 870616 - RNA, 22 nt, Human
cagauucuccaggggcugcaga

SEQ ID NO: 870617 - RNA, 22 nt, Human
ucucucuucuuuguuaagaaug

SEQ ID NO: 870618 - RNA, 22 nt, Human
auauuucucucagacauggaag

SEQ ID NO: 870619 - RNA, 22 nt, Human
ugcuggcucuaggcugagacag

SEQ ID NO: 870620 - RNA, 22 nt, Human
aaaguucacugaccagcacugg

SEQ ID NO: 870621 - RNA, 22 nt, Human
cuugguuauacuccaggaacca

SEQ ID NO: 870622 - RNA, 22 nt, Human
agacagacaugcuaguuuucuu

SEQ ID NO: 870623 - RNA, 18 nt, Human
ucuguccacccugugcug

SEQ ID NO: 870624 - RNA, 22 nt, Human
acagcacaaucugagucccaga

SEQ ID NO: 870625 - RNA, 22 nt, Human
aaaaguaaucgcaguuuuugcc

SEQ ID NO: 870626 - RNA, 22 nt, Human
aaucuggacuugucugugaaga

SEQ ID NO: 870627 - RNA, 22 nt, Human
ccuacucugagcgccuccgcau

SEQ ID NO: 870628 - RNA, 22 nt, Human
cccaggaggcagauguugcagu

SEQ ID NO: 870629 - RNA, 22 nt, Human
cuucauacaauuuuuugacaua

SEQ ID NO: 870630 - RNA, 22 nt, Human
cuuauuuaaugaggguuagaau

SEQ ID NO: 870631 - RNA, 22 nt, Human
agagcugaauucaagugcuggc

SEQ ID NO: 870632 - RNA, 22 nt, Human
uuguacaacguuuuaaauuuga

SEQ ID NO: 870633 - RNA, 22 nt, Human
agagggagcccagucauagcug

SEQ ID NO: 870634 - RNA, 22 nt, Human
auuauuggacacuucuucugca

SEQ ID NO: 870635 - RNA, 22 nt, Human
caaguauuuuaaggacuagugg

SEQ ID NO: 870636 - RNA, 22 nt, Human
aaaguuucaauagaggaagugg

SEQ ID NO: 870637 - RNA, 22 nt, Human
ggcuggagacaacguccugccc

SEQ ID NO: 870638 - RNA, 22 nt, Human
acaauaguaagguauauuguca

SEQ ID NO: 870639 - RNA, 17 nt, Human
uuucuacaguuggcagc

SEQ ID NO: 870640 - RNA, 22 nt, Human
agaccacagucaggcuccuggu

SEQ ID NO: 870641 - RNA, 22 nt, Human
acagcugcaugaugguccagau

SEQ ID NO: 870642 - RNA, 22 nt, Human
cacaguuugguauagaagugau

SEQ ID NO: 870643 - RNA, 22 nt, Human
ucuagcugaggguaggagaccu

SEQ ID NO: 870644 - RNA, 22 nt, Human
ugccugccuaggaagcugugaa

SEQ ID NO: 870645 - RNA, 18 nt, Human
aaggucugucugguaggu

SEQ ID NO: 870646 - RNA, 22 nt, Human
caguccucucugugucugcacc

SEQ ID NO: 870647 - RNA, 22 nt, Human
aagugucugcaaaaugacagag

SEQ ID NO: 870648 - RNA, 22 nt, Human
aggcugagauagguggaucauu

SEQ ID NO: 870649 - RNA, 22 nt, Human
ugacauuuaaucccuaaauauu

SEQ ID NO: 870650 - RNA, 22 nt, Human
uucucuaauacauuuugacaaa

SEQ ID NO: 870651 - RNA, 20 nt, Human
accagguggcugaugacacc

SEQ ID NO: 870652 - RNA, 22 nt, Human
cugugagcuggguggccaggac

SEQ ID NO: 870653 - RNA, 22 nt, Human
caagcagggagcaucaagggag

SEQ ID NO: 870654 - RNA, 22 nt, Human
gucaaaaaguagucauuucugu

SEQ ID NO: 870655 - RNA, 22 nt, Human
gggcagcagagcccugccgagu

SEQ ID NO: 870656 - RNA, 22 nt, Human
cagguucccagguccagggcuu

SEQ ID NO: 870657 - RNA, 21 nt, Human
uaagaacauuaucuucuuccu

SEQ ID NO: 870658 - RNA, 22 nt, Human
agagugcuuaguagugacaugg

SEQ ID NO: 870659 - RNA, 22 nt, Human
auuaauacauuauagggauugu

SEQ ID NO: 870660 - RNA, 22 nt, Human
aggaccuguaccucagcaucua

SEQ ID NO: 870661 - RNA, 22 nt, Human
ucaguguucagcggugugugca

SEQ ID NO: 870662 - RNA, 22 nt, Human
ucuuccucaugaauucucguau

SEQ ID NO: 870663 - RNA, 22 nt, Human
ugggcagguuguuauuugacau

SEQ ID NO: 870664 - RNA, 22 nt, Human
uacaauguuccuagcaggaaag

SEQ ID NO: 870665 - RNA, 22 nt, Human
cuucuucauguauugauagucu

SEQ ID NO: 870666 - RNA, 22 nt, Human
ucaaguauuauuacagauguag

SEQ ID NO: 870667 - RNA, 22 nt, Human
auagucuucagcacuuugauca

SEQ ID NO: 870668 - RNA, 21 nt, Human
caugggguugcuauagcaaaa

SEQ ID NO: 870669 - RNA, 21 nt, Human
ugaggcucuguugugccugca

SEQ ID NO: 870670 - RNA, 23 nt, Human
ugugcgugaugcuuuguugaagg

SEQ ID NO: 870671 - RNA, 20 nt, Human
uugaaaaugcauugugcagu

SEQ ID NO: 870672 - RNA, 22 nt, Human
acagaagauaacugggaccaga

SEQ ID NO: 870673 - RNA, 22 nt, Human
uugcuuuauauucaagagagga

SEQ ID NO: 870674 - RNA, 22 nt, Human
aucuuguuauaagagauaaugg

SEQ ID NO: 870675 - RNA, 22 nt, Human
gucuacacugaauuuccacaga

SEQ ID NO: 870676 - RNA, 21 nt, Human
caaagccaggcaacucucucc

SEQ ID NO: 870677 - RNA, 22 nt, Human
ggcuggacaugagcuuggcagu

SEQ ID NO: 870678 - RNA, 22 nt, Human
aaggcacaugaccuaggccugg

SEQ ID NO: 870679 - RNA, 22 nt, Human
acuggcagagacccugauggcc

SEQ ID NO: 870680 - RNA, 22 nt, Human
auaaagucuaccguauuaaaga

SEQ ID NO: 870681 - RNA, 22 nt, Human
uugcuuuaccauuugaucucua

SEQ ID NO: 870682 - RNA, 22 nt, Human
uaugguuauguaaucaguuguu

SEQ ID NO: 870683 - RNA, 22 nt, Human
agaacacacugggggaaacaag

SEQ ID NO: 870684 - RNA, 22 nt, Human
auuugcuugugcuaugaaaguu

SEQ ID NO: 870685 - RNA, 23 nt, Human
agcaccaggaacagugugguccu

SEQ ID NO: 870686 - RNA, 22 nt, Human
aagaaacugaaaguggcuucau

SEQ ID NO: 870687 - RNA, 22 nt, Human
cagugccaugucugagccccua

SEQ ID NO: 870688 - RNA, 22 nt, Human
uguguggcaagcuguaugcuag

SEQ ID NO: 870689 - RNA, 22 nt, Human
uuugaauaucacaaacuuucaa

SEQ ID NO: 870690 - RNA, 22 nt, Human
ccugguugugaguugaguugag

SEQ ID NO: 870691 - RNA, 22 nt, Human
cuuucauaagggguuuuauaau

SEQ ID NO: 870692 - RNA, 22 nt, Human
gcacuugauuacauuagugccu

SEQ ID NO: 870693 - RNA, 22 nt, Human
uuucauguguugaauguguaca

SEQ ID NO: 870694 - RNA, 22 nt, Human
gaggguggagcuccagaaucug

SEQ ID NO: 870695 - RNA, 22 nt, Human
uuuacagaaugucaauuucuau

SEQ ID NO: 870696 - RNA, 22 nt, Human
gucugcuggugccuggccugcg

SEQ ID NO: 870697 - RNA, 22 nt, Human
aguguuuagcaugaaguucauu

SEQ ID NO: 870698 - RNA, 22 nt, Human
ugugaagauagcuguuacaucu

SEQ ID NO: 870699 - RNA, 22 nt, Human
ugucacuucaguuuugaaacaa

SEQ ID NO: 870700 - RNA, 22 nt, Human
agucucuuuaaucacagugucu

SEQ ID NO: 870701 - RNA, 22 nt, Human
gucacccugcuguuuguccauu

SEQ ID NO: 870702 - RNA, 22 nt, Human
uuauucagugcauauauuaaaa

SEQ ID NO: 870703 - RNA, 22 nt, Human
aucaugcaauaaggugaggccu

SEQ ID NO: 870704 - RNA, 22 nt, Human
guccuucuuuucaucccugguu

SEQ ID NO: 870705 - RNA, 22 nt, Human
uuauugucaaaaacaggacacu

SEQ ID NO: 870706 - RNA, 22 nt, Human
ggagaaaguacagcaggcaaca

SEQ ID NO: 870707 - RNA, 22 nt, Human
cagguccccuccccuaccaggc

SEQ ID NO: 870708 - RNA, 21 nt, Human
cagugcucaaucugacagugg

SEQ ID NO: 870709 - RNA, 22 nt, Human
gagcggaggcuuggaggccagc

SEQ ID NO: 870710 - RNA, 22 nt, Human
acagaacugagaauucucuauc

SEQ ID NO: 870711 - RNA, 22 nt, Human
uuuccacaauuugagcagcaga

SEQ ID NO: 870712 - RNA, 22 nt, Human
cagggagcggagucccaugccu

SEQ ID NO: 870713 - RNA, 23 nt, Human
auucugagucagaaaguuugggg

SEQ ID NO: 870714 - RNA, 22 nt, Human
uucugcugcgacccaggaguua

SEQ ID NO: 870715 - RNA, 22 nt, Human
auauuaugcuaagggaaauaag

SEQ ID NO: 870716 - RNA, 22 nt, Human
cagggccacacggaagggaaca

SEQ ID NO: 870717 - RNA, 22 nt, Human
caaauacuguacugaacacugu

SEQ ID NO: 870718 - RNA, 22 nt, Human
aauacgucccaucaucuuuuuc

SEQ ID NO: 870719 - RNA, 23 nt, Human
aagaggaggcccugcucccgucc

SEQ ID NO: 870720 - RNA, 22 nt, Human
gcuccuggccagcacagggccc

SEQ ID NO: 870721 - RNA, 22 nt, Human
agugggggccaacgagggcagc

SEQ ID NO: 870722 - RNA, 23 nt, Human
ucugugccaguuuccaugucugu

SEQ ID NO: 870723 - RNA, 22 nt, Human
ugucagcaucauuuguugaagg

SEQ ID NO: 870724 - RNA, 22 nt, Human
uaggaaggaggccaucuuggcg

SEQ ID NO: 870725 - RNA, 22 nt, Human
caagggggcaggaucacacuug

SEQ ID NO: 870726 - RNA, 22 nt, Human
uccuggauggagcugcccucgc

SEQ ID NO: 870727 - RNA, 22 nt, Human
ugggaagauaugagugaccaac

SEQ ID NO: 870728 - RNA, 22 nt, Human
ccugcugaggucagccacccaa

SEQ ID NO: 870729 - RNA, 22 nt, Human
cugcagcuauauuuucccacag

SEQ ID NO: 870730 - RNA, 22 nt, Human
uccauuguguuacagagcauuc

SEQ ID NO: 870731 - RNA, 22 nt, Human
uguaauauuguagugacaguac

SEQ ID NO: 870732 - RNA, 22 nt, Human
gcauucuuuagacugagagaua

SEQ ID NO: 870733 - RNA, 22 nt, Human
aagugauuauuuaaugcgguuu

SEQ ID NO: 870734 - RNA, 22 nt, Human
auauuauaaguuauuucaaguu

SEQ ID NO: 870735 - RNA, 22 nt, Human
ggaggcugagaaguccaagauc

SEQ ID NO: 870736 - RNA, 19 nt, Human
ucucuucucccugguuuua

SEQ ID NO: 870737 - RNA, 22 nt, Human
uucuggcuuuaggcuuuucaag

SEQ ID NO: 870738 - RNA, 22 nt, Human
ggucugaggcuccaaggaggug

SEQ ID NO: 870739 - RNA, 22 nt, Human
aauguuuuuuggucugaugaau

SEQ ID NO: 870740 - RNA, 22 nt, Human
cccucaggugaaaggaaaaauu

SEQ ID NO: 870741 - RNA, 22 nt, Human
ugagaaucagcugcacagaggu

SEQ ID NO: 870742 - RNA, 22 nt, Human
uuugacagcagauaaaauaaaa

SEQ ID NO: 870743 - RNA, 22 nt, Human
uauguacauauacacgugugug

SEQ ID NO: 870744 - RNA, 22 nt, Human
auaugcuuacacuacaagauga

SEQ ID NO: 870745 - RNA, 22 nt, Human
ggccagucugggccacggucgg

SEQ ID NO: 870746 - RNA, 22 nt, Human
gccuggcuaauuuugguauuuu

SEQ ID NO: 870747 - RNA, 22 nt, Human
uauguauagagucuuuuaaauu

SEQ ID NO: 870748 - RNA, 22 nt, Human
cgaggccagcucuaagcccuac

SEQ ID NO: 870749 - RNA, 22 nt, Human
cauuuggaaagagacuagagaa

SEQ ID NO: 870750 - RNA, 22 nt, Human
aagcacagaaaaggagcaugga

SEQ ID NO: 870751 - RNA, 22 nt, Human
auaaauugugcuuuugacaucu

SEQ ID NO: 870752 - RNA, 22 nt, Human
agagcugcccacacagcagauu

SEQ ID NO: 870753 - RNA, 22 nt, Human
gugagacacccaagagucagau

SEQ ID NO: 870754 - RNA, 22 nt, Human
acacacuggcccccaguacuga

SEQ ID NO: 870755 - RNA, 22 nt, Human
gcagggggucauucacgcuggc

SEQ ID NO: 870756 - RNA, 22 nt, Human
ucugcaggagagugcccuagag

SEQ ID NO: 870757 - RNA, 22 nt, Human
gaauaauagcagaaauuagcag

SEQ ID NO: 870758 - RNA, 22 nt, Human
cugguggggaguccuggucucc

SEQ ID NO: 870759 - RNA, 22 nt, Human
ccuuggcaggggagaaauauau

SEQ ID NO: 870760 - RNA, 22 nt, Human
uggaagcacaggaucaguggaa

SEQ ID NO: 870761 - RNA, 22 nt, Human
ugggcagagucguggggaauag

SEQ ID NO: 870762 - RNA, 22 nt, Human
cuagauucauauauuuuuggag

SEQ ID NO: 870763 - RNA, 22 nt, Human
cauggcagagccugcagguggg

SEQ ID NO: 870764 - RNA, 22 nt, Human
ucaugcauauuuguaguaguuc

SEQ ID NO: 870765 - RNA, 22 nt, Human
cccuuuaaguagaauauauuau

SEQ ID NO: 870766 - RNA, 22 nt, Human
auccaaacuaugacuaguguuc

SEQ ID NO: 870767 - RNA, 22 nt, Human
acacauauaccacuguaaauga

SEQ ID NO: 870768 - RNA, 22 nt, Human
ugcugccaagcccgugcuccug

SEQ ID NO: 870769 - RNA, 22 nt, Human
ucuuuuguacucaguauugaca

SEQ ID NO: 870770 - RNA, 22 nt, Human
ugggcugcuguuacaggggcug

SEQ ID NO: 870771 - RNA, 22 nt, Human
uuauuuccucucuaauagggua

SEQ ID NO: 870772 - RNA, 22 nt, Human
agcagcaggaggccauugucuu

SEQ ID NO: 870773 - RNA, 22 nt, Human
ugaaauaauaucuggaucaauc

SEQ ID NO: 870774 - RNA, 22 nt, Human
gggugaggagcugccagucaug

SEQ ID NO: 870775 - RNA, 22 nt, Human
uacauucagaagaauggacacg

SEQ ID NO: 870776 - RNA, 23 nt, Human
gacagguaaggguugggagaauc

SEQ ID NO: 870777 - RNA, 22 nt, Human
cuacagcagagcuacacuaacu

SEQ ID NO: 870778 - RNA, 22 nt, Human
agcuucuccugguacagaacug

SEQ ID NO: 870779 - RNA, 19 nt, Human
gcucagagucccccugcgg

SEQ ID NO: 870780 - RNA, 17 nt, Human
ggccuuggggccucagu

SEQ ID NO: 870781 - RNA, 22 nt, Human
aggugccagcucucaggcagga

SEQ ID NO: 870782 - RNA, 22 nt, Human
gcauuagagcccaucaccugua

SEQ ID NO: 870783 - RNA, 22 nt, Human
gcccaggagguugggcugugca

SEQ ID NO: 870784 - RNA, 22 nt, Human
gggcagcucagccaccaugcag

SEQ ID NO: 870785 - RNA, 22 nt, Human
aaagccauuacaaaauuucaua

SEQ ID NO: 870786 - RNA, 22 nt, Human
ugacuugucucuuugggagaca

SEQ ID NO: 870787 - RNA, 22 nt, Human
uggagcugaggggaaugcugag

SEQ ID NO: 870788 - RNA, 22 nt, Human
uagcaaggcguggcacucaaau

SEQ ID NO: 870789 - RNA, 22 nt, Human
ucauuuauaaggaugcaauuaa

SEQ ID NO: 870790 - RNA, 22 nt, Human
ccugucauacuaacguaguggg

SEQ ID NO: 870791 - RNA, 22 nt, Human
caggagauguaagacuucuguu

SEQ ID NO: 870792 - RNA, 22 nt, Human
ccuuugugcaucucugcuccua

SEQ ID NO: 870793 - RNA, 22 nt, Human
gcauccagagguagccacugug

SEQ ID NO: 870794 - RNA, 22 nt, Human
uccaguccuagaaacuggagag

SEQ ID NO: 870795 - RNA, 22 nt, Human
cugccuugaaaaugaagcuuua

SEQ ID NO: 870796 - RNA, 22 nt, Human
cuggcacauagucagcacucaa

SEQ ID NO: 870797 - RNA, 22 nt, Human
uuaauugauauaaagaacuuca

SEQ ID NO: 870798 - RNA, 22 nt, Human
accuguuuucagaaaaugcaga

SEQ ID NO: 870799 - RNA, 22 nt, Human
ucugaaagggcuaaauaauuug

SEQ ID NO: 870800 - RNA, 22 nt, Human
aggaaggaagagacaccauuug

SEQ ID NO: 870801 - RNA, 22 nt, Human
uagaacaucagguugaauuugg

SEQ ID NO: 870802 - RNA, 22 nt, Human
uuaguuuucucaucuaucucac

SEQ ID NO: 870803 - RNA, 20 nt, Human
ccacaagggaauauuguuga

SEQ ID NO: 870804 - RNA, 22 nt, Human
ggauggcuguaaaaggugggaa

SEQ ID NO: 870805 - RNA, 22 nt, Human
gcagcagccgacauggauugca

SEQ ID NO: 870806 - RNA, 22 nt, Human
gcagacaaagcagcaugccuau

SEQ ID NO: 870807 - RNA, 22 nt, Human
ggacaggcccucuggucagcuu

SEQ ID NO: 870808 - RNA, 20 nt, Human
aucuucuuggccagcuugcu

SEQ ID NO: 870809 - RNA, 22 nt, Human
uguaacaacauuugauuuuuag

SEQ ID NO: 870810 - RNA, 22 nt, Human
acuguucugccaagaucaacgu

SEQ ID NO: 870811 - RNA, 22 nt, Human
cauguguggucuguggcuaucu

SEQ ID NO: 870812 - RNA, 22 nt, Human
ggccgggcaggucucagccagc

SEQ ID NO: 870813 - RNA, 22 nt, Human
ugcugucuuuuucccuuccuaa

SEQ ID NO: 870814 - RNA, 22 nt, Human
cauucauacaaguuuguuucau

SEQ ID NO: 870815 - RNA, 22 nt, Human
ccuggcuucuauaccaccaggu

SEQ ID NO: 870816 - RNA, 19 nt, Human
uggcagaggacaaggacuu

SEQ ID NO: 870817 - RNA, 20 nt, Human
uacaaaccuccacacuggug

SEQ ID NO: 870818 - RNA, 22 nt, Human
aaaugcuucaccucauuaaacu

SEQ ID NO: 870819 - RNA, 22 nt, Human
ggugugauuaugacaugugacu

SEQ ID NO: 870820 - RNA, 22 nt, Human
ucucucuugucaccccaucugc

SEQ ID NO: 870821 - RNA, 22 nt, Human
gcagaagcugggcagcgaggug

SEQ ID NO: 870822 - RNA, 22 nt, Human
gaagccugguccagagcuccca

SEQ ID NO: 870823 - RNA, 22 nt, Human
ccacaggauccaagggaaggca

SEQ ID NO: 870824 - RNA, 22 nt, Human
aguuaacacauccagaauagag

SEQ ID NO: 870825 - RNA, 22 nt, Human
caaagcaccacaaaccagguga

SEQ ID NO: 870826 - RNA, 22 nt, Human
agcuugaaacguaccaacauug

SEQ ID NO: 870827 - RNA, 22 nt, Human
aaggccagcccuaaugaugcuc

SEQ ID NO: 870828 - RNA, 20 nt, Human
ccugccugccucggcucauu

SEQ ID NO: 870829 - RNA, 22 nt, Human
uuggaauuaaaaggagaacuuc

SEQ ID NO: 870830 - RNA, 23 nt, Human
uuuaugcagcauguagaacaugg

SEQ ID NO: 870831 - RNA, 22 nt, Human
aaacaauguagauuaccauuua

SEQ ID NO: 870832 - RNA, 22 nt, Human
ccuguucuguuaauuaaacuuu

SEQ ID NO: 870833 - RNA, 18 nt, Human
ccagagggugcgucagcu

SEQ ID NO: 870834 - RNA, 22 nt, Human
ggccucagggucacucuguaga

SEQ ID NO: 870835 - RNA, 22 nt, Human
auacaaaguauugauccugagu

SEQ ID NO: 870836 - RNA, 23 nt, Human
uguuauuccagguuaauguacuu

SEQ ID NO: 870837 - RNA, 22 nt, Human
uuagcuuuugagaaugauuucu

SEQ ID NO: 870838 - RNA, 22 nt, Human
aaagccagaguguguuagagac

SEQ ID NO: 870839 - RNA, 22 nt, Human
augggcaguguauuggaaggaa

SEQ ID NO: 870840 - RNA, 18 nt, Human
cuuagaacaucauuccuu

SEQ ID NO: 870841 - RNA, 22 nt, Human
uagaaacucucaaucugggaug

SEQ ID NO: 870842 - RNA, 22 nt, Human
uaccaguugauguuuuaaauag

SEQ ID NO: 870843 - RNA, 22 nt, Human
ugucccuggaacuauggcucca

SEQ ID NO: 870844 - RNA, 22 nt, Human
agcuuagaauguguuaggaaag

SEQ ID NO: 870845 - RNA, 22 nt, Human
uuuccuucuuagcgguguucuu

SEQ ID NO: 870846 - RNA, 22 nt, Human
gcaguggccacauggaggagga

SEQ ID NO: 870847 - RNA, 22 nt, Human
gcaggcugugaggcucagaugg

SEQ ID NO: 870848 - RNA, 22 nt, Human
gaggcuggacgugcauuucuac

SEQ ID NO: 870849 - RNA, 22 nt, Human
auauucaagugaggauggcuaa

SEQ ID NO: 870850 - RNA, 18 nt, Human
ccagguggugacagagau

SEQ ID NO: 870851 - RNA, 22 nt, Human
auggaagguccuacagagcgca

SEQ ID NO: 870852 - RNA, 22 nt, Human
ccagcuucggcaagcagacuuu

SEQ ID NO: 870853 - RNA, 22 nt, Human
uacaauguaauucugauuaugu

SEQ ID NO: 870854 - RNA, 18 nt, Human
ggcugugcguggaggcug

SEQ ID NO: 870855 - RNA, 22 nt, Human
cuauagaaaauuguaucacacg

SEQ ID NO: 870856 - RNA, 22 nt, Human
cacauucacauuuuucccucua

SEQ ID NO: 870857 - RNA, 22 nt, Human
agcacagugccugacauauaug

SEQ ID NO: 870858 - RNA, 22 nt, Human
aacauugagcugguggagagga

SEQ ID NO: 870859 - RNA, 22 nt, Human
uaagguuucuaguuucuaaacu

SEQ ID NO: 870860 - RNA, 22 nt, Human
ggcuucugaaaucucugugcgu

SEQ ID NO: 870861 - RNA, 22 nt, Human
cuguccagaauaggcaaaucca

SEQ ID NO: 870862 - RNA, 22 nt, Human
aagauguugcauuagaauaccu

SEQ ID NO: 870863 - RNA, 17 nt, Human
agauaagcuucagagcu

SEQ ID NO: 870864 - RNA, 22 nt, Human
uuacauuucccccuuggaggcu

SEQ ID NO: 870865 - RNA, 22 nt, Human
gccugcugagggaaguugggca

SEQ ID NO: 870866 - RNA, 22 nt, Human
aucuuuggaucgcucccccuuc

SEQ ID NO: 870867 - RNA, 22 nt, Human
aguccuggcauauagguccuca

SEQ ID NO: 870868 - RNA, 22 nt, Human
ccugggcagguguggcuucccc

SEQ ID NO: 870869 - RNA, 22 nt, Human
auguagcagauauuugugcaca

SEQ ID NO: 870870 - RNA, 22 nt, Human
ccuggugcaccaaguaagggug

SEQ ID NO: 870871 - RNA, 22 nt, Human
gaagcagcagcuggggacaguu

SEQ ID NO: 870872 - RNA, 22 nt, Human
cugcagaggccucgccuccucu

SEQ ID NO: 870873 - RNA, 22 nt, Human
guuucauggagagcugaauauu

SEQ ID NO: 870874 - RNA, 22 nt, Human
gcccugaagcugaggguguuaa

SEQ ID NO: 870875 - RNA, 22 nt, Human
gugcucacugugagacguccug

SEQ ID NO: 870876 - RNA, 22 nt, Human
uuacacaugcucacuuauuugu

SEQ ID NO: 870877 - RNA, 22 nt, Human
ccagugugguagguccacaggu

SEQ ID NO: 870878 - RNA, 22 nt, Human
agcagcaauaauaaaguaauac

SEQ ID NO: 870879 - RNA, 22 nt, Human
uuguaacaaagacacuccaaaa

SEQ ID NO: 870880 - RNA, 20 nt, Human
acccagcucugugcccuggg

SEQ ID NO: 870881 - RNA, 22 nt, Human
uaauauuucuacccugcugccu

SEQ ID NO: 870882 - RNA, 22 nt, Human
uugcuuccuugagcuggucuga

SEQ ID NO: 870883 - RNA, 22 nt, Human
aagaacauaacagaagcugugu

SEQ ID NO: 870884 - RNA, 22 nt, Human
aaguaaaccacagagaagccac

SEQ ID NO: 870885 - RNA, 22 nt, Human
ccuagucuuccgcguccccacc

SEQ ID NO: 870886 - RNA, 22 nt, Human
cuggagcuaggaaguccaagau

SEQ ID NO: 870887 - RNA, 22 nt, Human
cauaauuuuccaugguuugcua

SEQ ID NO: 870888 - RNA, 22 nt, Human
agauucaugggucuaaccagug

SEQ ID NO: 870889 - RNA, 22 nt, Human
agcaggaguguccccuggcugu

SEQ ID NO: 870890 - RNA, 22 nt, Human
uuaacacagggggagacaaagu

SEQ ID NO: 870891 - RNA, 22 nt, Human
aacauugccaugguuaauuuua

SEQ ID NO: 870892 - RNA, 22 nt, Human
uacaacaguucaugaaaugaaa

SEQ ID NO: 870893 - RNA, 20 nt, Human
ugcucaggauggagaggugu

SEQ ID NO: 870894 - RNA, 22 nt, Human
gcagauggacuguaugaccuga

SEQ ID NO: 870895 - RNA, 22 nt, Human
uguacaaggccaucuacaugcu

SEQ ID NO: 870896 - RNA, 22 nt, Human
acagggcaugugcaagagacau

SEQ ID NO: 870897 - RNA, 22 nt, Human
agagguauugcacgugcucucu

SEQ ID NO: 870898 - RNA, 22 nt, Human
aagucaggugagacucucuggg

SEQ ID NO: 870899 - RNA, 21 nt, Human
ccagggaagaaaugagggcag

SEQ ID NO: 870900 - RNA, 21 nt, Human
ugcuguagguuucguggcacu

SEQ ID NO: 870901 - RNA, 22 nt, Human
aaaauugaggcucauguuaaau

SEQ ID NO: 870902 - RNA, 22 nt, Human
auauguguguauuucuuacuag

SEQ ID NO: 870903 - RNA, 22 nt, Human
aaaguuugaaugauauauuagu

SEQ ID NO: 870904 - RNA, 22 nt, Human
ggucagugacuuuuuucugugg

SEQ ID NO: 870905 - RNA, 22 nt, Human
agcucccagggcugggcaaguu

SEQ ID NO: 870906 - RNA, 23 nt, Human
aggugccaacugagagcugagag

SEQ ID NO: 870907 - RNA, 22 nt, Human
agaggccccaugggauggcggu

SEQ ID NO: 870908 - RNA, 22 nt, Human
uuccuuuugcaagguccucuag

SEQ ID NO: 870909 - RNA, 22 nt, Human
ggccucugccucaucugggcac

SEQ ID NO: 870910 - RNA, 22 nt, Human
ccaggcugggcggggaaccugg

SEQ ID NO: 870911 - RNA, 20 nt, Human
auauaauaaauuuugguuac

SEQ ID NO: 870912 - RNA, 22 nt, Human
agcagcagggcucugcccgugc

SEQ ID NO: 870913 - RNA, 22 nt, Human
ggagggacccacucuagaggug

SEQ ID NO: 870914 - RNA, 22 nt, Human
uaaauguuaugcccaucaucca

SEQ ID NO: 870915 - RNA, 22 nt, Human
agcuggcuugcaugcuaaggag

SEQ ID NO: 870916 - RNA, 22 nt, Human
uuuaacagaugcuaugucuacc

SEQ ID NO: 870917 - RNA, 22 nt, Human
ucaggacagggaucacaucauc

SEQ ID NO: 870918 - RNA, 22 nt, Human
guuuucauuacugcugugauuu

SEQ ID NO: 870919 - RNA, 22 nt, Human
uuccaguuggcacugcaauuua

SEQ ID NO: 870920 - RNA, 22 nt, Human
uaagagcagagguugaauaaau

SEQ ID NO: 870921 - RNA, 22 nt, Human
gcccuggauguacaggcauguu

SEQ ID NO: 870922 - RNA, 22 nt, Human
uaccagggaacagggauauuaa

SEQ ID NO: 870923 - RNA, 22 nt, Human
cucauaaugugacuguauuuga

SEQ ID NO: 870924 - RNA, 22 nt, Human
ggcugugaacccuggcagugug

SEQ ID NO: 870925 - RNA, 22 nt, Human
ggcugcauaggcagaagcugug

SEQ ID NO: 870926 - RNA, 22 nt, Human
agccugugugaagcccucagag

SEQ ID NO: 870927 - RNA, 22 nt, Human
caggggcugugggcggagccuc

SEQ ID NO: 870928 - RNA, 22 nt, Human
gaggagguuccggguggagaag

SEQ ID NO: 870929 - RNA, 22 nt, Human
uguuauuucuuugccauaucuu

SEQ ID NO: 870930 - RNA, 22 nt, Human
uuccuuuucauaugccccgcgu

SEQ ID NO: 870931 - RNA, 22 nt, Human
ggcauggccuguaagacggaga

SEQ ID NO: 870932 - RNA, 22 nt, Human
ucucagagugguggucccucug

SEQ ID NO: 870933 - RNA, 21 nt, Human
ugaaacauuugaucaaagcac

SEQ ID NO: 870934 - RNA, 22 nt, Human
agaguggccuggccuggggcau

SEQ ID NO: 870935 - RNA, 22 nt, Human
cuagggagggauguuggcauga

SEQ ID NO: 870936 - RNA, 22 nt, Human
cagguuaguuaaucuuuguuuc

SEQ ID NO: 870937 - RNA, 22 nt, Human
ugggccacggggguggagagcu

SEQ ID NO: 870938 - RNA, 22 nt, Human
cagcugcacugaagcagguuug

SEQ ID NO: 870939 - RNA, 22 nt, Human
uuguacaaaugcauauuccugg

SEQ ID NO: 870940 - RNA, 22 nt, Human
guauuucuuuccauuauaguca

SEQ ID NO: 870941 - RNA, 22 nt, Human
caccacugcuuccugccaucug

SEQ ID NO: 870942 - RNA, 22 nt, Human
caggccuggcugcagcucgccu

SEQ ID NO: 870943 - RNA, 22 nt, Human
aggcuucaguauucaccgcaug

SEQ ID NO: 870944 - RNA, 22 nt, Human
gcuggccucuggagaagggcuu

SEQ ID NO: 870945 - RNA, 22 nt, Human
uuauuccauugucuuuugacuu

SEQ ID NO: 870946 - RNA, 22 nt, Human
guauguauauauguguacacac

SEQ ID NO: 870947 - RNA, 22 nt, Human
cugggccagauccagccucaca

SEQ ID NO: 870948 - RNA, 23 nt, Human
augcuagcugugccaacaccaua

SEQ ID NO: 870949 - RNA, 22 nt, Human
uccacagcauuauuagaaggau

SEQ ID NO: 870950 - RNA, 22 nt, Human
ugcucagggagcuuccuggugg

SEQ ID NO: 870951 - RNA, 22 nt, Human
uugauucugauccugucuggag

SEQ ID NO: 870952 - RNA, 22 nt, Human
gcccugagauucuuggauucug

SEQ ID NO: 870953 - RNA, 22 nt, Human
agguggggugagcugcagacua

SEQ ID NO: 870954 - RNA, 22 nt, Human
acaugaucccaccugccuauaa

SEQ ID NO: 870955 - RNA, 22 nt, Human
ggugcagggagaggcaggcccc

SEQ ID NO: 870956 - RNA, 22 nt, Human
uaggauuuacuuugacaauauu

SEQ ID NO: 870957 - RNA, 22 nt, Human
aggaacacaacuuccugagagc

SEQ ID NO: 870958 - RNA, 22 nt, Human
uucuaagcucugaaauaaaucu

SEQ ID NO: 870959 - RNA, 22 nt, Human
cugaagaggacgcagcagcaag

SEQ ID NO: 870960 - RNA, 22 nt, Human
acuuuggaggguguuguagaug

SEQ ID NO: 870961 - RNA, 22 nt, Human
ucaaacaugaaagcuugauuuu

SEQ ID NO: 870962 - RNA, 22 nt, Human
aagcaauugagugaaaccucuu

SEQ ID NO: 870963 - RNA, 22 nt, Human
uucuagcaugccuuuuagcaca

SEQ ID NO: 870964 - RNA, 22 nt, Human
cagguggaucucuaaggacuga

SEQ ID NO: 870965 - RNA, 22 nt, Human
aacuggcauaugaacuuguucu

SEQ ID NO: 870966 - RNA, 22 nt, Human
auaaaguggagguaguauucau

SEQ ID NO: 870967 - RNA, 22 nt, Human
caccgagugacaguagccauca

SEQ ID NO: 870968 - RNA, 21 nt, Human
aucuuuauuacgcagagaaga

SEQ ID NO: 870969 - RNA, 19 nt, Human
uacauuccacacaaucucu

SEQ ID NO: 870970 - RNA, 22 nt, Human
aaagaucaauagauaaagcuac

SEQ ID NO: 870971 - RNA, 22 nt, Human
aaacaauguugucuccaagagg

SEQ ID NO: 870972 - RNA, 17 nt, Human
uuucaacaucacucagc

SEQ ID NO: 870973 - RNA, 22 nt, Human
caucacugcuucuaaaauggug

SEQ ID NO: 870974 - RNA, 22 nt, Human
uguuauuuauuucaccuccaga

SEQ ID NO: 870975 - RNA, 22 nt, Human
uuucaguuacugcuauaucauu

SEQ ID NO: 870976 - RNA, 22 nt, Human
cuggcagcgugagcagcaucca

SEQ ID NO: 870977 - RNA, 22 nt, Human
cugugcaguggcagcguguggg

SEQ ID NO: 870978 - RNA, 22 nt, Human
uggcagcaguagccaccccagc

SEQ ID NO: 870979 - RNA, 22 nt, Human
aaggucuaaagcuacugaguug

SEQ ID NO: 870980 - RNA, 22 nt, Human
gggggaggugaaugcaauaagg

SEQ ID NO: 870981 - RNA, 21 nt, Human
agagaagaggacuuucucaca

SEQ ID NO: 870982 - RNA, 22 nt, Human
uggagguggcacaagggagguc

SEQ ID NO: 870983 - RNA, 22 nt, Human
uucuacacugaguuuuuucccu

SEQ ID NO: 870984 - RNA, 22 nt, Human
gagaaguuuaaucauuagacca

SEQ ID NO: 870985 - RNA, 22 nt, Human
cugugugcuguuagggagcugc

SEQ ID NO: 870986 - RNA, 22 nt, Human
ucguuuuagguggacauugugu

SEQ ID NO: 870987 - RNA, 22 nt, Human
aaaaucaguacacuuuauuuug

SEQ ID NO: 870988 - RNA, 22 nt, Human
aauguuuucccagugcagacga

SEQ ID NO: 870989 - RNA, 22 nt, Human
ucaggacagccagggugcagac

SEQ ID NO: 870990 - RNA, 22 nt, Human
uuucauauuguccagucagcgc

SEQ ID NO: 870991 - RNA, 17 nt, Human
ccugggaggaguuauga

SEQ ID NO: 870992 - RNA, 22 nt, Human
gagccagagcuacaagugucug

SEQ ID NO: 870993 - RNA, 22 nt, Human
ccaggccagcgcuggcuggagg

SEQ ID NO: 870994 - RNA, 22 nt, Human
gccuggcuuuugccucauguuc

SEQ ID NO: 870995 - RNA, 22 nt, Human
ggccucagaggaggugugaguc

SEQ ID NO: 870996 - RNA, 22 nt, Human
uauguucugacucuacauggga

SEQ ID NO: 870997 - RNA, 22 nt, Human
ugucauuuaauagauaugaugg

SEQ ID NO: 870998 - RNA, 22 nt, Human
cagugagggaagaucucagcac

SEQ ID NO: 870999 - RNA, 21 nt, Human
ucagucccuggguguguccca

SEQ ID NO: 871000 - RNA, 22 nt, Human
uaaacagccuaaaacuuucuuu

SEQ ID NO: 871001 - RNA, 22 nt, Human
aucuguguguucaggaaguccu

SEQ ID NO: 871002 - RNA, 22 nt, Human
caccacagcauccacuagaagg

SEQ ID NO: 871003 - RNA, 22 nt, Human
gggaaggcagugggaggaacug

SEQ ID NO: 871004 - RNA, 22 nt, Human
gacagcugcauccucagacaca

SEQ ID NO: 871005 - RNA, 22 nt, Human
cugcagugaggauucuuaggug

SEQ ID NO: 871006 - RNA, 22 nt, Human
uauacacaaacaagggguuaag

SEQ ID NO: 871007 - RNA, 22 nt, Human
acaacauuuccauuuccuuggu

SEQ ID NO: 871008 - RNA, 22 nt, Human
cugcagggaccacaagcagguu

SEQ ID NO: 871009 - RNA, 22 nt, Human
cagaugaagaucauagaauagu

SEQ ID NO: 871010 - RNA, 22 nt, Human
augcacaaguuauauguaugga

SEQ ID NO: 871011 - RNA, 22 nt, Human
gagagaaaagggggaauugauu

SEQ ID NO: 871012 - RNA, 22 nt, Human
gacaugcauuaagacacacuga

SEQ ID NO: 871013 - RNA, 22 nt, Human
auucacaguuacugcugaacca

SEQ ID NO: 871014 - RNA, 22 nt, Human
cuccuggggccauggaaggaac

SEQ ID NO: 871015 - RNA, 22 nt, Human
acuaggaacgggguuugcacuc

SEQ ID NO: 871016 - RNA, 22 nt, Human
ugggaguggggcauagaaggua

SEQ ID NO: 871017 - RNA, 22 nt, Human
cacagauagaccuuaugagauu

SEQ ID NO: 871018 - RNA, 22 nt, Human
uaaaugcuuagauucauagaaa

SEQ ID NO: 871019 - RNA, 22 nt, Human
aacaagagacucuguuccagaa

SEQ ID NO: 871020 - RNA, 22 nt, Human
gcuucaugaaaaucacugguca

SEQ ID NO: 871021 - RNA, 22 nt, Human
uaacuucacuggacucagcagc

SEQ ID NO: 871022 - RNA, 22 nt, Human
gucagaagcauuuguggcugaa

SEQ ID NO: 871023 - RNA, 22 nt, Human
agugucuggucucugaacuaaa

SEQ ID NO: 871024 - RNA, 22 nt, Human
cucaggucuuaguucugucauc

SEQ ID NO: 871025 - RNA, 22 nt, Human
agcuuguagaaggccacgagca

SEQ ID NO: 871026 - RNA, 22 nt, Human
cagagcugguguuacaagucca

SEQ ID NO: 871027 - RNA, 22 nt, Human
uaucuagagcagugguucucaa

SEQ ID NO: 871028 - RNA, 22 nt, Human
ccuacuuagcauauuuucucuu

SEQ ID NO: 871029 - RNA, 22 nt, Human
ucagaaguccaauuuucgcacc

SEQ ID NO: 871030 - RNA, 22 nt, Human
aguccugugcaaaugcaucuga

SEQ ID NO: 871031 - RNA, 22 nt, Human
gagggaugugccugaaggcagg

SEQ ID NO: 871032 - RNA, 22 nt, Human
cugcagccuccaccuuuugggu

SEQ ID NO: 871033 - RNA, 19 nt, Human
ccuagagggaaggcaggac

SEQ ID NO: 871034 - RNA, 22 nt, Human
ggaguggugucacugagaggaa

SEQ ID NO: 871035 - RNA, 22 nt, Human
aaucaauguuagucaugaauuu

SEQ ID NO: 871036 - RNA, 22 nt, Human
cagcugccacaccucuuucucu

SEQ ID NO: 871037 - RNA, 22 nt, Human
uuucuucuuaauacuggcugcu

SEQ ID NO: 871038 - RNA, 23 nt, Human
agcauguugugauguuaccacug

SEQ ID NO: 871039 - RNA, 19 nt, Human
aguguguacugaaagcacu

SEQ ID NO: 871040 - RNA, 17 nt, Human
gaaagguccuagaaauc

SEQ ID NO: 871041 - RNA, 22 nt, Human
ugaugaaaguguuuacucaccu

SEQ ID NO: 871042 - RNA, 22 nt, Human
aggcagugguguuugcuggugg

SEQ ID NO: 871043 - RNA, 22 nt, Human
ggccucagagaaggcugugcgg

SEQ ID NO: 871044 - RNA, 22 nt, Human
cuuggaauggggcagaaaaugg

SEQ ID NO: 871045 - RNA, 22 nt, Human
uuucaaaguggagaauuagaca

SEQ ID NO: 871046 - RNA, 22 nt, Human
auucacaaguucuagggauuag

SEQ ID NO: 871047 - RNA, 22 nt, Human
ucuugauuuugugaauaaguug

SEQ ID NO: 871048 - RNA, 22 nt, Human
ucuagaaacagguuucuagaaa

SEQ ID NO: 871049 - RNA, 22 nt, Human
gcugcuguggcagauuggauuc

SEQ ID NO: 871050 - RNA, 22 nt, Human
auuauuaaagcuacaucaagga

SEQ ID NO: 871051 - RNA, 22 nt, Human
ucucugaagagcucagacuagu

SEQ ID NO: 871052 - RNA, 22 nt, Human
cugggaggauucauugagguga

SEQ ID NO: 871053 - RNA, 22 nt, Human
uuccaaagcugcuuuauuuagu

SEQ ID NO: 871054 - RNA, 22 nt, Human
accaggcuugaugauuugcuua

SEQ ID NO: 871055 - RNA, 22 nt, Human
cccguuugccucuuuauuuacu

SEQ ID NO: 871056 - RNA, 22 nt, Human
ugaggguggccuuguguggacu

SEQ ID NO: 871057 - RNA, 23 nt, Human
agcacucaugcugcagaagucau

SEQ ID NO: 871058 - RNA, 22 nt, Human
accugggauggggccagguuua

SEQ ID NO: 871059 - RNA, 22 nt, Human
uuuuaguuguaguuggugagga

SEQ ID NO: 871060 - RNA, 22 nt, Human
aauuggcauagcauacaauuca

SEQ ID NO: 871061 - RNA, 22 nt, Human
ggcagcuucggacggcuuauaa

SEQ ID NO: 871062 - RNA, 22 nt, Human
uagaaagacagagguuuugucu

SEQ ID NO: 871063 - RNA, 22 nt, Human
uucaaacucugaguaguucugc

SEQ ID NO: 871064 - RNA, 17 nt, Human
uacagaaggcaccacaa

SEQ ID NO: 871065 - RNA, 22 nt, Human
augguuuguguggcccagauga

SEQ ID NO: 871066 - RNA, 22 nt, Human
agaggcccugggcuggugugcu

SEQ ID NO: 871067 - RNA, 22 nt, Human
agaaacuauccugaguagcaaa

SEQ ID NO: 871068 - RNA, 22 nt, Human
uccaggcuuuuucaugcugucu

SEQ ID NO: 871069 - RNA, 22 nt, Human
guauauauuggauaaaccagag

SEQ ID NO: 871070 - RNA, 22 nt, Human
uucuaagucugcugucuucauc

SEQ ID NO: 871071 - RNA, 22 nt, Human
aaaaagacagaggaugaggcag

SEQ ID NO: 871072 - RNA, 22 nt, Human
agcugccugggcuuguacaccu

SEQ ID NO: 871073 - RNA, 22 nt, Human
aguucaauagaaaaauauauua

SEQ ID NO: 871074 - RNA, 22 nt, Human
uucuugcaucaagacagccugu

SEQ ID NO: 871075 - RNA, 22 nt, Human
caguuaaaagguaugcuaccaa

SEQ ID NO: 871076 - RNA, 22 nt, Human
ccugagcuagggaaggaagacc

SEQ ID NO: 871077 - RNA, 22 nt, Human
cagcacaggccccucucuccca

SEQ ID NO: 871078 - RNA, 22 nt, Human
guggcagcucauguuguuuuaa

SEQ ID NO: 871079 - RNA, 22 nt, Human
aggugccacucucaugggcuac

SEQ ID NO: 871080 - RNA, 22 nt, Human
cuuagaacagugucugccagag

SEQ ID NO: 871081 - RNA, 22 nt, Human
gaggcucuucaauaggucaaug

SEQ ID NO: 871082 - RNA, 22 nt, Human
aacauugagcucuggaguggaa

SEQ ID NO: 871083 - RNA, 22 nt, Human
ugcaguguuccuguagccugcc

SEQ ID NO: 871084 - RNA, 22 nt, Human
uaaauuuuuguuaacagccucu

SEQ ID NO: 871085 - RNA, 22 nt, Human
uagcagcucacuaacucugcgu

SEQ ID NO: 871086 - RNA, 22 nt, Human
uuauauguaugcuuauaaacca

SEQ ID NO: 871087 - RNA, 22 nt, Human
ugucugugaccucuuuggagcc

SEQ ID NO: 871088 - RNA, 22 nt, Human
agggacaguauccaucucacag

SEQ ID NO: 871089 - RNA, 18 nt, Human
ucaguccuccauagagcu

SEQ ID NO: 871090 - RNA, 22 nt, Human
ugugugccagccuacgaggagc

SEQ ID NO: 871091 - RNA, 23 nt, Human
agaggccaacuucuugccccucc

SEQ ID NO: 871092 - RNA, 21 nt, Human
uucuggguuguuaaucugaac

SEQ ID NO: 871093 - RNA, 22 nt, Human
uugaaaacauuuauauuagaau

SEQ ID NO: 871094 - RNA, 22 nt, Human
augcauuuauguguguacauug

SEQ ID NO: 871095 - RNA, 22 nt, Human
ccaaggacuggacacacagguu

SEQ ID NO: 871096 - RNA, 22 nt, Human
gccuuaauuuaugucuaacaua

SEQ ID NO: 871097 - RNA, 22 nt, Human
aaagcaauaguaaugguaauag

SEQ ID NO: 871098 - RNA, 22 nt, Human
gucuccuggcugcagcuaagac

SEQ ID NO: 871099 - RNA, 22 nt, Human
caccaggcuggagugcagaggu

SEQ ID NO: 871100 - RNA, 22 nt, Human
uaaugcuucaauuuccuugauu

SEQ ID NO: 871101 - RNA, 22 nt, Human
ggaggaugccaagcugugcaca

SEQ ID NO: 871102 - RNA, 22 nt, Human
gucuuauuuucugucuacuaaa

SEQ ID NO: 871103 - RNA, 22 nt, Human
gucacaguaucauguuugaaug

SEQ ID NO: 871104 - RNA, 22 nt, Human
agugcaguaaaugggcauuaug

SEQ ID NO: 871105 - RNA, 22 nt, Human
gucccugcccuccugggacuca

SEQ ID NO: 871106 - RNA, 22 nt, Human
ucauaaugacaaacauacucag

SEQ ID NO: 871107 - RNA, 22 nt, Human
ggaggggaggauuaaugacaaa

SEQ ID NO: 871108 - RNA, 22 nt, Human
ugaagcagaggggucuugagcu

SEQ ID NO: 871109 - RNA, 22 nt, Human
aauguucaacagauggauauuu

SEQ ID NO: 871110 - RNA, 22 nt, Human
agaaguuuggaugccaucauag

SEQ ID NO: 871111 - RNA, 19 nt, Human
gucaucuuuuaauaaugug

SEQ ID NO: 871112 - RNA, 22 nt, Human
gaugaaauagaauuaauuuagg

SEQ ID NO: 871113 - RNA, 22 nt, Human
ggaggaguguggggcacucugc

SEQ ID NO: 871114 - RNA, 22 nt, Human
acagcuuccaguauucuugaaa

SEQ ID NO: 871115 - RNA, 22 nt, Human
gggacaggcugagacuugagcu

SEQ ID NO: 871116 - RNA, 22 nt, Human
gugcaggauguugggaaucagg

SEQ ID NO: 871117 - RNA, 22 nt, Human
ggaggaccauccugguuucacc

SEQ ID NO: 871118 - RNA, 22 nt, Human
ugcuggaguucgacauugcaaa

SEQ ID NO: 871119 - RNA, 22 nt, Human
uggcaguucuaauugaccauuu

SEQ ID NO: 871120 - RNA, 22 nt, Human
ucucuuucuauugcaccaugcu

SEQ ID NO: 871121 - RNA, 22 nt, Human
ccuggcccagggacuuucgccu

SEQ ID NO: 871122 - RNA, 22 nt, Human
agggcagugggaaagccugcuc

SEQ ID NO: 871123 - RNA, 22 nt, Human
aggcagguuucccggcugucaa

SEQ ID NO: 871124 - RNA, 22 nt, Human
aaaucucacuggcaggcaggca

SEQ ID NO: 871125 - RNA, 22 nt, Human
agcagcugcagagggcuccccc

SEQ ID NO: 871126 - RNA, 22 nt, Human
aguuuaacuuuguaaacgugag

SEQ ID NO: 871127 - RNA, 22 nt, Human
aguuuacacuaugaaaagacua

SEQ ID NO: 871128 - RNA, 22 nt, Human
ugcugucuuuucccaauccugg

SEQ ID NO: 871129 - RNA, 23 nt, Human
cauguacacacagcuguacagug

SEQ ID NO: 871130 - RNA, 22 nt, Human
cuccuggggcacuuagaagcaa

SEQ ID NO: 871131 - RNA, 22 nt, Human
gaguccagugauguuccugguc

SEQ ID NO: 871132 - RNA, 20 nt, Human
gugcccaguuggugacagac

SEQ ID NO: 871133 - RNA, 22 nt, Human
aaugcuuuaaauccuaguguaa

SEQ ID NO: 871134 - RNA, 22 nt, Human
uaacugaauguauuacaacaga

SEQ ID NO: 871135 - RNA, 22 nt, Human
cucuccuacauuucauucacaa

SEQ ID NO: 871136 - RNA, 22 nt, Human
uaauguuaguauguaaucuuau

SEQ ID NO: 871137 - RNA, 22 nt, Human
ugucccagcacuuugggagucu

SEQ ID NO: 871138 - RNA, 22 nt, Human
aaggccacgucuccuuccagag

SEQ ID NO: 871139 - RNA, 22 nt, Human
cugcacguauaaucagucuguu

SEQ ID NO: 871140 - RNA, 22 nt, Human
agguuguuuugccucauuaucc

SEQ ID NO: 871141 - RNA, 23 nt, Human
cagugcagggcaacucagacucc

SEQ ID NO: 871142 - RNA, 22 nt, Human
acagacuguuggccuacugagc

SEQ ID NO: 871143 - RNA, 22 nt, Human
acauaggccaauauccagagcu

SEQ ID NO: 871144 - RNA, 22 nt, Human
guguguggacgucugagcccag

SEQ ID NO: 871145 - RNA, 22 nt, Human
ggccagcuucucugcugccugu

SEQ ID NO: 871146 - RNA, 22 nt, Human
guugcacaguuccucaagcagg

SEQ ID NO: 871147 - RNA, 22 nt, Human
uuucuauagcuuucuugggagu

SEQ ID NO: 871148 - RNA, 22 nt, Human
acuuugccccaggucucaugac

SEQ ID NO: 871149 - RNA, 22 nt, Human
agaguggcucugcugggcacag

SEQ ID NO: 871150 - RNA, 22 nt, Human
cugagcugugugguccugggca

SEQ ID NO: 871151 - RNA, 21 nt, Human
agugucauuugaucauuguua

SEQ ID NO: 871152 - RNA, 22 nt, Human
ggccaaauccuccaugguggcu

SEQ ID NO: 871153 - RNA, 22 nt, Human
acagcugcucuauaucucagcc

SEQ ID NO: 871154 - RNA, 22 nt, Human
cccugcucuucugacucaagcu

SEQ ID NO: 871155 - RNA, 22 nt, Human
gagaugaauguaaacaaaggca

SEQ ID NO: 871156 - RNA, 22 nt, Human
ugcuauuauugucaccacugua

SEQ ID NO: 871157 - RNA, 22 nt, Human
cuagaaaucucuguuuacauca

SEQ ID NO: 871158 - RNA, 22 nt, Human
cagcuucuccagaugacccuca

SEQ ID NO: 871159 - RNA, 22 nt, Human
cugagcugguguuucaggguca

SEQ ID NO: 871160 - RNA, 22 nt, Human
agcagcaggcuuaaggaaaagu

SEQ ID NO: 871161 - RNA, 22 nt, Human
cccaggcagggacgugcucugg

SEQ ID NO: 871162 - RNA, 22 nt, Human
caggcugggacugaccccugcu

SEQ ID NO: 871163 - RNA, 22 nt, Human
ucagggagagugacccauccac

SEQ ID NO: 871164 - RNA, 22 nt, Human
acugauggcccaccuuggucuc

SEQ ID NO: 871165 - RNA, 22 nt, Human
gcugucagaaggugaaggguaa

SEQ ID NO: 871166 - RNA, 22 nt, Human
aaucuucaaaaacaauugaggg

SEQ ID NO: 871167 - RNA, 22 nt, Human
caggaggcagagguugcagcga

SEQ ID NO: 871168 - RNA, 19 nt, Human
uaccagccuccugccugau

SEQ ID NO: 871169 - RNA, 23 nt, Human
uggccagcagaagcaaggggagc

SEQ ID NO: 871170 - RNA, 22 nt, Human
caggugccgggaaugcagcaau

SEQ ID NO: 871171 - RNA, 22 nt, Human
caggauggucucgaucuccuga

SEQ ID NO: 871172 - RNA, 22 nt, Human
acaaguauuggugaggauguag

SEQ ID NO: 871173 - RNA, 22 nt, Human
ucuagcaagcucgugcucaagg

SEQ ID NO: 871174 - RNA, 22 nt, Human
gggggugguucuaaguccuaua

SEQ ID NO: 871175 - RNA, 22 nt, Human
gagacacacauucuggagagaa

SEQ ID NO: 871176 - RNA, 22 nt, Human
gauuaggagggagaggcaagua

SEQ ID NO: 871177 - RNA, 22 nt, Human
ugggaaagacucaggacaggag

SEQ ID NO: 871178 - RNA, 22 nt, Human
aaagcagcggugucuuuacugc

SEQ ID NO: 871179 - RNA, 22 nt, Human
uucuaaagccuguccuaucaga

SEQ ID NO: 871180 - RNA, 22 nt, Human
agccaaggacucagugguaggc

SEQ ID NO: 871181 - RNA, 22 nt, Human
cuguauguuggguaagcauugc

SEQ ID NO: 871182 - RNA, 22 nt, Human
caggcccugggcaggcacagag

SEQ ID NO: 871183 - RNA, 22 nt, Human
ucagcuggugaauggacucauc

SEQ ID NO: 871184 - RNA, 22 nt, Human
augcaucaggcacuaggaauag

SEQ ID NO: 871185 - RNA, 22 nt, Human
gugaggugacuagcaggugggg

SEQ ID NO: 871186 - RNA, 22 nt, Human
aauauuuguuaguguuuuaaug

SEQ ID NO: 871187 - RNA, 22 nt, Human
aaacugggauucuucacaaggu

SEQ ID NO: 871188 - RNA, 22 nt, Human
aaauccagcuacggggcaacau

SEQ ID NO: 871189 - RNA, 22 nt, Human
acacaaagcuauugagugucau

SEQ ID NO: 871190 - RNA, 22 nt, Human
agaggcaccgucugcagcgugc

SEQ ID NO: 871191 - RNA, 22 nt, Human
ggggcggggcucugagaagcau

SEQ ID NO: 871192 - RNA, 22 nt, Human
uaauaccuacuggucauugcaa

SEQ ID NO: 871193 - RNA, 22 nt, Human
ucauucaagauuucaauagauu

SEQ ID NO: 871194 - RNA, 22 nt, Human
aggcucugaaggagaaccuguu

SEQ ID NO: 871195 - RNA, 22 nt, Human
cuucuagagcuggagcaaaugu

SEQ ID NO: 871196 - RNA, 22 nt, Human
agaaaccuccauuuauucacuc

SEQ ID NO: 871197 - RNA, 22 nt, Human
uuagugugcauggaucugugga

SEQ ID NO: 871198 - RNA, 22 nt, Human
cuccaggccaagauuaaguaau

SEQ ID NO: 871199 - RNA, 22 nt, Human
gccagccagagaggcaugguua

SEQ ID NO: 871200 - RNA, 22 nt, Human
ugcagaggcuggcucgccgggu

SEQ ID NO: 871201 - RNA, 21 nt, Human
caaauagacauggcuagagga

SEQ ID NO: 871202 - RNA, 21 nt, Human
ucaaaucauguacugaccaca

SEQ ID NO: 871203 - RNA, 22 nt, Human
gcagagccccucaagccagccu

SEQ ID NO: 871204 - RNA, 22 nt, Human
gcaggaguguauuugcauguaa

SEQ ID NO: 871205 - RNA, 22 nt, Human
aaauguacacuuugcaucuuga

SEQ ID NO: 871206 - RNA, 22 nt, Human
uuguugcauuucaaguaugaga

SEQ ID NO: 871207 - RNA, 22 nt, Human
guucaugugacuacuaugaccu

SEQ ID NO: 871208 - RNA, 22 nt, Human
auuuaauuuggagagagaaacc

SEQ ID NO: 871209 - RNA, 22 nt, Human
agguccaguuuucugacaaggg

SEQ ID NO: 871210 - RNA, 22 nt, Human
cugggcccacaaguggaaucgu

SEQ ID NO: 871211 - RNA, 22 nt, Human
gacaggccaggggcugaggugg

SEQ ID NO: 871212 - RNA, 22 nt, Human
agguaaggcuguaagcuaagcc

SEQ ID NO: 871213 - RNA, 22 nt, Human
uguguguguuucugcucauaca

SEQ ID NO: 871214 - RNA, 22 nt, Human
cugcaucaguggauaugauggu

SEQ ID NO: 871215 - RNA, 22 nt, Human
gcucccagcaauugaggcagcc

SEQ ID NO: 871216 - RNA, 21 nt, Human
aauaaaacaguuggugucaau

SEQ ID NO: 871217 - RNA, 22 nt, Human
ucauuauuugcuuuaguuaugu

SEQ ID NO: 871218 - RNA, 22 nt, Human
ggcuggagugggcuccagaguu

SEQ ID NO: 871219 - RNA, 22 nt, Human
ggaaagaauagagacuuuauca

SEQ ID NO: 871220 - RNA, 22 nt, Human
agaggcugaaugaugucaucau

SEQ ID NO: 871221 - RNA, 23 nt, Human
ucugcuucuguauuuuuucccau

SEQ ID NO: 871222 - RNA, 22 nt, Human
aagagauuaaaguaacuugccu

SEQ ID NO: 871223 - RNA, 23 nt, Human
accaggaguugucucaggaaaca

SEQ ID NO: 871224 - RNA, 22 nt, Human
uucuuacagaguuuacagagcc

SEQ ID NO: 871225 - RNA, 22 nt, Human
agcaggaaggucugugugaguc

SEQ ID NO: 871226 - RNA, 22 nt, Human
gcccagggugaagugcaguugu

SEQ ID NO: 871227 - RNA, 22 nt, Human
gauggccuggguccccuuccgg

SEQ ID NO: 871228 - RNA, 22 nt, Human
gagagagaaaaugacuccggac

SEQ ID NO: 871229 - RNA, 20 nt, Human
cuccagccccugcccugguc

SEQ ID NO: 871230 - RNA, 22 nt, Human
uuuagguuaaucaacaaacauu

SEQ ID NO: 871231 - RNA, 22 nt, Human
cuaagucauggaaagugugugu

SEQ ID NO: 871232 - RNA, 23 nt, Human
cuccuugguaugccaugcccagc

SEQ ID NO: 871233 - RNA, 21 nt, Human
ucaggaagagccaguucaugc

SEQ ID NO: 871234 - RNA, 22 nt, Human
uggcuggaggaaggaacugagg

SEQ ID NO: 871235 - RNA, 22 nt, Human
caguucucuuuccacuggaggc

SEQ ID NO: 871236 - RNA, 21 nt, Human
ggcagcacuaccugaagcaua

SEQ ID NO: 871237 - RNA, 22 nt, Human
auacaacuuuacaugcaauucc

SEQ ID NO: 871238 - RNA, 22 nt, Human
acuguaaagguuuguagcccag

SEQ ID NO: 871239 - RNA, 20 nt, Human
agagugagacuccaucucag

SEQ ID NO: 871240 - RNA, 18 nt, Human
cauuaugugguuauagaa

SEQ ID NO: 871241 - RNA, 22 nt, Human
uuugacagugacgccuguauga

SEQ ID NO: 871242 - RNA, 23 nt, Human
uagagcagggaaaucugucagag

SEQ ID NO: 871243 - RNA, 20 nt, Human
ugcucuggggguggagagac

SEQ ID NO: 871244 - RNA, 22 nt, Human
cugcgugucuccuuggggcaga

SEQ ID NO: 871245 - RNA, 22 nt, Human
aaucagcaguuggaauuagaua

SEQ ID NO: 871246 - RNA, 22 nt, Human
gaccccaacccuagagucugac

SEQ ID NO: 871247 - RNA, 22 nt, Human
agagcagauggccagggggccu

SEQ ID NO: 871248 - RNA, 22 nt, Human
cagguuccaguugcagggacuu

SEQ ID NO: 871249 - RNA, 22 nt, Human
cucugccaggcagaacggcuuu

SEQ ID NO: 871250 - RNA, 22 nt, Human
caggaacaggggagugaaccug

SEQ ID NO: 871251 - RNA, 23 nt, Human
cagaaaguuugagaagauacauc

SEQ ID NO: 871252 - RNA, 22 nt, Human
aacaguaagagauguuuuaucu

SEQ ID NO: 871253 - RNA, 22 nt, Human
gagcagcugagcuggaaugaga

SEQ ID NO: 871254 - RNA, 22 nt, Human
agcccuguucuguuuuaguagc

SEQ ID NO: 871255 - RNA, 22 nt, Human
uggcacaggagcacugcccugg

SEQ ID NO: 871256 - RNA, 22 nt, Human
uccaggagucagacagauggug

SEQ ID NO: 871257 - RNA, 22 nt, Human
aauucuauguucuugaguaaga

SEQ ID NO: 871258 - RNA, 17 nt, Human
aggccucccuccaggcc

SEQ ID NO: 871259 - RNA, 22 nt, Human
cugggcgcguccccugaggcgg

SEQ ID NO: 871260 - RNA, 22 nt, Human
aaagcagcaaguauuuguuacu

SEQ ID NO: 871261 - RNA, 22 nt, Human
uucaaugugguuauaauaacua

SEQ ID NO: 871262 - RNA, 22 nt, Human
agcaggaaggcuuuggggguuc

SEQ ID NO: 871263 - RNA, 22 nt, Human
acauuuugaaagggaaauuguu

SEQ ID NO: 871264 - RNA, 22 nt, Human
gcacaaagguggaaggaggaag

SEQ ID NO: 871265 - RNA, 22 nt, Human
cauguuaaauugaguuugcaau

SEQ ID NO: 871266 - RNA, 22 nt, Human
uugcuggggugugaaaucugau

SEQ ID NO: 871267 - RNA, 22 nt, Human
gacagcaguccuggaguuccca

SEQ ID NO: 871268 - RNA, 22 nt, Human
agcugcaggagucgccuaggau

SEQ ID NO: 871269 - RNA, 22 nt, Human
gugaagcaguugcguggguucc

SEQ ID NO: 871270 - RNA, 22 nt, Human
agguacauuugauaaaaauagc

SEQ ID NO: 871271 - RNA, 22 nt, Human
aagggggcgaagacgugauuga

SEQ ID NO: 871272 - RNA, 20 nt, Human
aauguucaguaauuguuuua

SEQ ID NO: 871273 - RNA, 22 nt, Human
agggcuccugaggcccuucugg

SEQ ID NO: 871274 - RNA, 22 nt, Human
guacccagaggcaugaucccag

SEQ ID NO: 871275 - RNA, 22 nt, Human
uuguucauccaacacaagguug

SEQ ID NO: 871276 - RNA, 22 nt, Human
auugaagagaagcuaaauagag

SEQ ID NO: 871277 - RNA, 22 nt, Human
agaaggcagguuuuaaaauguc

SEQ ID NO: 871278 - RNA, 22 nt, Human
uggaggcugguuucugcugagg

SEQ ID NO: 871279 - RNA, 22 nt, Human
ucagaagucccuugcaucuuag

SEQ ID NO: 871280 - RNA, 22 nt, Human
auguaaaucaagcagugcuggu

SEQ ID NO: 871281 - RNA, 22 nt, Human
aauuuucugaugaugaagcacg

SEQ ID NO: 871282 - RNA, 22 nt, Human
uuuaauuuucugggcccagcag

SEQ ID NO: 871283 - RNA, 22 nt, Human
ccuggcagaauauuaaagugca

SEQ ID NO: 871284 - RNA, 20 nt, Human
ggcauccuuuuggucacagc

SEQ ID NO: 871285 - RNA, 22 nt, Human
augucuucuguggagacaggua

SEQ ID NO: 871286 - RNA, 22 nt, Human
agccaugucacauauggucauc

SEQ ID NO: 871287 - RNA, 22 nt, Human
aaaggcucaacagcuguacuuu

SEQ ID NO: 871288 - RNA, 22 nt, Human
uaauuccuagaaauuauucuca

SEQ ID NO: 871289 - RNA, 22 nt, Human
uaacacaugguucugucaggaa

SEQ ID NO: 871290 - RNA, 22 nt, Human
aguuuuauggcucaaccuaaua

SEQ ID NO: 871291 - RNA, 22 nt, Human
ugcaaauauugggacagucuag

SEQ ID NO: 871292 - RNA, 22 nt, Human
ggacagagagugaauaugacau

SEQ ID NO: 871293 - RNA, 22 nt, Human
uacagcagacugaagguugugu

SEQ ID NO: 871294 - RNA, 22 nt, Human
uaaggcuuuccuugucaucuuu

SEQ ID NO: 871295 - RNA, 22 nt, Human
uuuaauaucucacacuuccaug

SEQ ID NO: 871296 - RNA, 22 nt, Human
uuuguucugaaaacucaagucc

SEQ ID NO: 871297 - RNA, 22 nt, Human
cccuuagaggcuggaggcagca

SEQ ID NO: 871298 - RNA, 22 nt, Human
aggcagagcugauguucuguga

SEQ ID NO: 871299 - RNA, 22 nt, Human
ggucagugcugccagagugacc

SEQ ID NO: 871300 - RNA, 22 nt, Human
gagcugccuguugcauagcaac

SEQ ID NO: 871301 - RNA, 22 nt, Human
uucucugggacaggaacaguuu

SEQ ID NO: 871302 - RNA, 20 nt, Human
acaugcuugagaggaugcag

SEQ ID NO: 871303 - RNA, 22 nt, Human
ccacagaggacaacugccuggc

SEQ ID NO: 871304 - RNA, 22 nt, Human
gccagcagcugugggguggcca

SEQ ID NO: 871305 - RNA, 22 nt, Human
acacaugauaagaaaguuuaaa

SEQ ID NO: 871306 - RNA, 22 nt, Human
guauuuuacugcucaaagcucu

SEQ ID NO: 871307 - RNA, 22 nt, Human
guggaaggaauuaacagacuag

SEQ ID NO: 871308 - RNA, 22 nt, Human
uuacgaauguuagauugcaucu

SEQ ID NO: 871309 - RNA, 22 nt, Human
agcugccucagucacucauggc

SEQ ID NO: 871310 - RNA, 22 nt, Human
gaaggcaagugagccaagagaa

SEQ ID NO: 871311 - RNA, 22 nt, Human
agugugucaguugaaagagauu

SEQ ID NO: 871312 - RNA, 22 nt, Human
acagcuguggggacucuugccc

SEQ ID NO: 871313 - RNA, 22 nt, Human
aucagugccccauggcuaaugc

SEQ ID NO: 871314 - RNA, 22 nt, Human
gcaggcuugggacgagcuggag

SEQ ID NO: 871315 - RNA, 22 nt, Human
ggguuacugcuucaaaaaauua

SEQ ID NO: 871316 - RNA, 21 nt, Human
aucagaguacgcaugcgcuga

SEQ ID NO: 871317 - RNA, 22 nt, Human
aacuguuuauguaaguaugcag

SEQ ID NO: 871318 - RNA, 22 nt, Human
ucuauguuagagauacauccua

SEQ ID NO: 871319 - RNA, 22 nt, Human
ggugucaggaaaaucucagugu

SEQ ID NO: 871320 - RNA, 22 nt, Human
agucaggggaucuagacuugaa

SEQ ID NO: 871321 - RNA, 18 nt, Human
ggcuguggacaagauuag

SEQ ID NO: 871322 - RNA, 22 nt, Human
cccagccugugacagccguccu

SEQ ID NO: 871323 - RNA, 22 nt, Human
gccugcuggaucaagcuuaugc

SEQ ID NO: 871324 - RNA, 22 nt, Human
uuaacacaucccugcucuaccc

SEQ ID NO: 871325 - RNA, 22 nt, Human
uuccagggaagagcaaggcagu

SEQ ID NO: 871326 - RNA, 22 nt, Human
caggcuuccgccagguuuccag

SEQ ID NO: 871327 - RNA, 22 nt, Human
caguggauccucugacucccuc

SEQ ID NO: 871328 - RNA, 19 nt, Human
ggcagucacggucaggagc

SEQ ID NO: 871329 - RNA, 22 nt, Human
aggauaauuggcauuuguaggc

SEQ ID NO: 871330 - RNA, 21 nt, Human
cccucaggaaacagaaugcac

SEQ ID NO: 871331 - RNA, 22 nt, Human
uucuucuuaauguccugggaac

SEQ ID NO: 871332 - RNA, 22 nt, Human
gugggcagauacauuugauaug

SEQ ID NO: 871333 - RNA, 22 nt, Human
aguuuggaguguggucuuugag

SEQ ID NO: 871334 - RNA, 22 nt, Human
uugucugagagauggcagaggu

SEQ ID NO: 871335 - RNA, 22 nt, Human
gcacacacaugugaguacaugc

SEQ ID NO: 871336 - RNA, 22 nt, Human
gugguccugccagccaggucca

SEQ ID NO: 871337 - RNA, 22 nt, Human
ggcuccuguagaucucuaaagc

SEQ ID NO: 871338 - RNA, 22 nt, Human
auuacaugagagaauguaaaua

SEQ ID NO: 871339 - RNA, 22 nt, Human
ugaaaaggguagaucccuaagu

SEQ ID NO: 871340 - RNA, 22 nt, Human
ggggaagaaugcucucuagaga

SEQ ID NO: 871341 - RNA, 22 nt, Human
acauguuuaaguuuaaugaaaa

SEQ ID NO: 871342 - RNA, 20 nt, Human
uaacaguaagugauguuaca

SEQ ID NO: 871343 - RNA, 21 nt, Human
uacacaaagcgugguccagag

SEQ ID NO: 871344 - RNA, 19 nt, Human
cuuggugcuugcccuuggc

SEQ ID NO: 871345 - RNA, 20 nt, Human
ccuugccaguagggcuggga

SEQ ID NO: 871346 - RNA, 22 nt, Human
caggaaggaccguccagaucag

SEQ ID NO: 871347 - RNA, 22 nt, Human
auucuuaauuccaaagacugag

SEQ ID NO: 871348 - RNA, 23 nt, Human
aaaugacuaaauguucuuauaga

SEQ ID NO: 871349 - RNA, 22 nt, Human
ugaggaaacugaggcacagaug

SEQ ID NO: 871350 - RNA, 22 nt, Human
uaaacaagcuggacugauaagu

SEQ ID NO: 871351 - RNA, 22 nt, Human
agaaacauccugcuuuccauuu

SEQ ID NO: 871352 - RNA, 22 nt, Human
cuggugugauugagcccaggug

SEQ ID NO: 871353 - RNA, 22 nt, Human
cccagugucaccaacaggacac

SEQ ID NO: 871354 - RNA, 22 nt, Human
cacccugcuacaaagccuccug

SEQ ID NO: 871355 - RNA, 22 nt, Human
caggcaggagacauuugguugg

SEQ ID NO: 871356 - RNA, 22 nt, Human
guucuauguugagauagcuaau

SEQ ID NO: 871357 - RNA, 22 nt, Human
gugugagugaaaguaguuugau

SEQ ID NO: 871358 - RNA, 22 nt, Human
ucaaacagaaauuguucaugcu

SEQ ID NO: 871359 - RNA, 22 nt, Human
ugaggggcagagagguguccag

SEQ ID NO: 871360 - RNA, 22 nt, Human
aauagauacuacuuagauguag

SEQ ID NO: 871361 - RNA, 22 nt, Human
cccagcuaccucugcuaggaga

SEQ ID NO: 871362 - RNA, 22 nt, Human
gaggcucaaaccuggacagagc

SEQ ID NO: 871363 - RNA, 22 nt, Human
uaggugucugcucuuauuuaac

SEQ ID NO: 871364 - RNA, 22 nt, Human
uaucacaauuccuauaguuugu

SEQ ID NO: 871365 - RNA, 22 nt, Human
uccuuaggcaauuugggagagu

SEQ ID NO: 871366 - RNA, 22 nt, Human
ccacgagggaaccagguggggu

SEQ ID NO: 871367 - RNA, 22 nt, Human
uaggccacagagaggagauuuc

SEQ ID NO: 871368 - RNA, 22 nt, Human
uccuuuccagccucaccucagc

SEQ ID NO: 871369 - RNA, 22 nt, Human
agcuccuggaggugcgcacucg

SEQ ID NO: 871370 - RNA, 22 nt, Human
cuaguuuaaagcagcugaaagg

SEQ ID NO: 871371 - RNA, 22 nt, Human
ugugugcaauucuuaacauaca

SEQ ID NO: 871372 - RNA, 22 nt, Human
cacuauuuccuggauuuugacg

SEQ ID NO: 871373 - RNA, 20 nt, Human
accaggagauggaggcaggg

SEQ ID NO: 871374 - RNA, 22 nt, Human
gggaguguugagcgcccugcca

SEQ ID NO: 871375 - RNA, 22 nt, Human
ggacaugauuagcagggagagc

SEQ ID NO: 871376 - RNA, 22 nt, Human
guccuugguaugaccaagguuu

SEQ ID NO: 871377 - RNA, 23 nt, Human
aaacaagcccuaaugaagagucc

SEQ ID NO: 871378 - RNA, 19 nt, Human
agacucugccacucuucuc

SEQ ID NO: 871379 - RNA, 22 nt, Human
gcagggcaugggcccugucugc

SEQ ID NO: 871380 - RNA, 22 nt, Human
ugucuuggaugaggauuaacag

SEQ ID NO: 871381 - RNA, 22 nt, Human
ggaaaaacagucuuuauuauuu

SEQ ID NO: 871382 - RNA, 22 nt, Human
aaaguguugauaugugacaucc

SEQ ID NO: 871383 - RNA, 22 nt, Human
ugucagcaguuuuuaguggagg

SEQ ID NO: 871384 - RNA, 22 nt, Human
auguguaugucuuauucaaaga

SEQ ID NO: 871385 - RNA, 22 nt, Human
auugagaauccauuugagauga

SEQ ID NO: 871386 - RNA, 22 nt, Human
guaagaggaucaaggcggugca

SEQ ID NO: 871387 - RNA, 22 nt, Human
ucucucuccuaguuuuuagugg

SEQ ID NO: 871388 - RNA, 21 nt, Human
cacaugugaauuacugaacug

SEQ ID NO: 871389 - RNA, 22 nt, Human
ggcucuggugggaagguuagau

SEQ ID NO: 871390 - RNA, 22 nt, Human
accaggaggcuacacuguccca

SEQ ID NO: 871391 - RNA, 22 nt, Human
acuguguggaccacucugaggc

SEQ ID NO: 871392 - RNA, 22 nt, Human
gacagaagaggaacuuggacag

SEQ ID NO: 871393 - RNA, 22 nt, Human
aggcuucaguuguaccuucuug

SEQ ID NO: 871394 - RNA, 22 nt, Human
cagguggcuuauuagggucagu

SEQ ID NO: 871395 - RNA, 22 nt, Human
ccuguucuugucucauuggcua

SEQ ID NO: 871396 - RNA, 22 nt, Human
auaaaguagcuuucagugccaa

SEQ ID NO: 871397 - RNA, 22 nt, Human
gucugccugucuggaugacaga

SEQ ID NO: 871398 - RNA, 22 nt, Human
gaggccagaaugagucucuggg

SEQ ID NO: 871399 - RNA, 22 nt, Human
ccccuggggaucagcuggaauu

SEQ ID NO: 871400 - RNA, 22 nt, Human
agggcccuaaggaaggcacaca

SEQ ID NO: 871401 - RNA, 22 nt, Human
uauuguaucuucuguuuagaag

SEQ ID NO: 871402 - RNA, 22 nt, Human
uuccaggacaagauguuucagg

SEQ ID NO: 871403 - RNA, 22 nt, Human
gcucugugccacaugcaguguu

SEQ ID NO: 871404 - RNA, 23 nt, Human
ucaucuuccucauuucuccaggg

SEQ ID NO: 871405 - RNA, 22 nt, Human
ucuucauucucgccuuugucgu

SEQ ID NO: 871406 - RNA, 22 nt, Human
uggcuucaaagguagcauacaa

SEQ ID NO: 871407 - RNA, 23 nt, Human
ucugucuuguuuaggccacuguu

SEQ ID NO: 871408 - RNA, 22 nt, Human
uuugacuuugggcucuaacuca

SEQ ID NO: 871409 - RNA, 22 nt, Human
uuuagcauuacuaaaaugaaaa

SEQ ID NO: 871410 - RNA, 22 nt, Human
agaaucauuauauuuauuaagc

SEQ ID NO: 871411 - RNA, 22 nt, Human
acagucaagaaauggcagagcc

SEQ ID NO: 871412 - RNA, 22 nt, Human
ucacagaagaaguagauugcau

SEQ ID NO: 871413 - RNA, 22 nt, Human
aacuuucuguuacguccccaga

SEQ ID NO: 871414 - RNA, 22 nt, Human
uucauugcaguucuucagguua

SEQ ID NO: 871415 - RNA, 22 nt, Human
uagauucaugcaguaugcuagu

SEQ ID NO: 871416 - RNA, 22 nt, Human
aaugaacacgcugguggugcaa

SEQ ID NO: 871417 - RNA, 22 nt, Human
uggcugagcugcagcguggcuu

SEQ ID NO: 871418 - RNA, 22 nt, Human
auuaacaugcagccagacacac

SEQ ID NO: 871419 - RNA, 22 nt, Human
auuagcagcuuucuggucucua

SEQ ID NO: 871420 - RNA, 22 nt, Human
ugcuggggcucugaccacucca

SEQ ID NO: 871421 - RNA, 22 nt, Human
augcugugaaaaagaaggcuga

SEQ ID NO: 871422 - RNA, 21 nt, Human
agaaguccccacucugucgca

SEQ ID NO: 871423 - RNA, 22 nt, Human
gcuggcugaguucugucgucug

SEQ ID NO: 871424 - RNA, 22 nt, Human
cagcaccauuugcagccucuuu

SEQ ID NO: 871425 - RNA, 20 nt, Human
agucucuguagugccugaga

SEQ ID NO: 871426 - RNA, 22 nt, Human
cacauacauucauguuacucua

SEQ ID NO: 871427 - RNA, 22 nt, Human
acacauugcagacaucucauua

SEQ ID NO: 871428 - RNA, 22 nt, Human
uccuuggaucuuuccuaugauu

SEQ ID NO: 871429 - RNA, 22 nt, Human
auacagaaaaguggauagccag

SEQ ID NO: 871430 - RNA, 20 nt, Human
ccagcauguacacaugugga

SEQ ID NO: 871431 - RNA, 22 nt, Human
uaugcaguguaugcacugagau

SEQ ID NO: 871432 - RNA, 20 nt, Human
uuacucaguuccugccaugc

SEQ ID NO: 871433 - RNA, 22 nt, Human
gugaccaucaucucagcuaguu

SEQ ID NO: 871434 - RNA, 22 nt, Human
auuugcuuguccuggugacugu

SEQ ID NO: 871435 - RNA, 22 nt, Human
gcccugaccuucacugacucuc

SEQ ID NO: 871436 - RNA, 22 nt, Human
aggccucaguuuccccaguugu

SEQ ID NO: 871437 - RNA, 22 nt, Human
gaguuaaaugacuugguuaagg

SEQ ID NO: 871438 - RNA, 22 nt, Human
acccaggaugauaauguucaca

SEQ ID NO: 871439 - RNA, 21 nt, Human
agaagccaugugguggagaac

SEQ ID NO: 871440 - RNA, 22 nt, Human
ggaggcggggaaggcaucccau

SEQ ID NO: 871441 - RNA, 22 nt, Human
caguccagaguaccccaagaag

SEQ ID NO: 871442 - RNA, 22 nt, Human
uggggagcacgguagggaaaug

SEQ ID NO: 871443 - RNA, 22 nt, Human
ucauaaaaauagacucuaaagu

SEQ ID NO: 871444 - RNA, 22 nt, Human
acaggaagugcuggcacuuaca

SEQ ID NO: 871445 - RNA, 22 nt, Human
aaauaggggaccaggaaaggag

SEQ ID NO: 871446 - RNA, 20 nt, Human
agcuggcccccgguggccug

SEQ ID NO: 871447 - RNA, 19 nt, Human
agacagagacugaaauaga

SEQ ID NO: 871448 - RNA, 22 nt, Human
aggucucaaucucaggugguca

SEQ ID NO: 871449 - RNA, 22 nt, Human
cugagccaaggggacagugaca

SEQ ID NO: 871450 - RNA, 22 nt, Human
ucuggaaggcuucaaggucuaa

SEQ ID NO: 871451 - RNA, 23 nt, Human
ugagcagcuaaaggugaugcggg

SEQ ID NO: 871452 - RNA, 22 nt, Human
uuagccuuagaagcuuagcaaa

SEQ ID NO: 871453 - RNA, 22 nt, Human
ugggaagacuccucaggaggcg

SEQ ID NO: 871454 - RNA, 22 nt, Human
ucaucuguuucucuguaguucu

SEQ ID NO: 871455 - RNA, 22 nt, Human
ugagacagggucuugcucuguu

SEQ ID NO: 871456 - RNA, 22 nt, Human
cuccucuggcuuccuggaggca

SEQ ID NO: 871457 - RNA, 22 nt, Human
uaucuagauaccaagaagcaca

SEQ ID NO: 871458 - RNA, 22 nt, Human
ucagaggaaagggaacauaguc

SEQ ID NO: 871459 - RNA, 22 nt, Human
uggcuucuuagaccaguggccu

SEQ ID NO: 871460 - RNA, 22 nt, Human
ccuuggagaccugggucugugc

SEQ ID NO: 871461 - RNA, 22 nt, Human
cagcccugggucccugcccugg

SEQ ID NO: 871462 - RNA, 22 nt, Human
aguggguacugggcaggcagag

SEQ ID NO: 871463 - RNA, 22 nt, Human
agagguggagcucuuggcauca

SEQ ID NO: 871464 - RNA, 22 nt, Human
gcagaggaucaggcucuggaaa

SEQ ID NO: 871465 - RNA, 22 nt, Human
ucuggaguuugagcacuucaau

SEQ ID NO: 871466 - RNA, 22 nt, Human
agggcugguauguccaugaaag

SEQ ID NO: 871467 - RNA, 22 nt, Human
acauucaaggccuucugacaca

SEQ ID NO: 871468 - RNA, 22 nt, Human
guuacacacaauauauccuaaa

SEQ ID NO: 871469 - RNA, 22 nt, Human
ucauguuuggaguuugcucacu

SEQ ID NO: 871470 - RNA, 17 nt, Human
uggcaugaggguguggg

SEQ ID NO: 871471 - RNA, 22 nt, Human
aaucuucauuuugacaagauuc

SEQ ID NO: 871472 - RNA, 22 nt, Human
uuaugagacuguuuuacacacu

SEQ ID NO: 871473 - RNA, 22 nt, Human
aaauccauucuguuuuaaaagu

SEQ ID NO: 871474 - RNA, 22 nt, Human
ugcuggcaugcaugcuguagga

SEQ ID NO: 871475 - RNA, 22 nt, Human
cugucuggccggcccagcuucc

SEQ ID NO: 871476 - RNA, 22 nt, Human
aggggucuauccugagaugguc

SEQ ID NO: 871477 - RNA, 22 nt, Human
cuggcuccauuacucagcaucu

SEQ ID NO: 871478 - RNA, 22 nt, Human
cuggguagggcaaggaacuggc

SEQ ID NO: 871479 - RNA, 22 nt, Human
ugagguaggcuugagaugggag

SEQ ID NO: 871480 - RNA, 22 nt, Human
aaaugccucccaaacagcacaa

SEQ ID NO: 871481 - RNA, 22 nt, Human
agucugugacucauuggaucuc

SEQ ID NO: 871482 - RNA, 18 nt, Human
ugaggcucagagacggug

SEQ ID NO: 871483 - RNA, 22 nt, Human
agaggggcucauauccugucau

SEQ ID NO: 871484 - RNA, 22 nt, Human
cagagcaguaaaucuggggcac

SEQ ID NO: 871485 - RNA, 22 nt, Human
ugggcugcuucuauuggugguc

SEQ ID NO: 871486 - RNA, 22 nt, Human
gcuggugguuaccgugcuaaug

SEQ ID NO: 871487 - RNA, 22 nt, Human
ugaggggagacagaguggacuc

SEQ ID NO: 871488 - RNA, 22 nt, Human
ggcucaggccagaccacgacuc

SEQ ID NO: 871489 - RNA, 22 nt, Human
gggcccuggcuuuccuguucuu

SEQ ID NO: 871490 - RNA, 22 nt, Human
uuccagugaccauagaguaugg

SEQ ID NO: 871491 - RNA, 22 nt, Human
gggcagugucuggcccccaggc

SEQ ID NO: 871492 - RNA, 22 nt, Human
ggcucaccauuuucacucucug

SEQ ID NO: 871493 - RNA, 22 nt, Human
uaacacugguauuucauuuagu

SEQ ID NO: 871494 - RNA, 22 nt, Human
uaaagcaaggcaaauuguuggu

SEQ ID NO: 871495 - RNA, 22 nt, Human
cauuuuaagaugaccugguuuc

SEQ ID NO: 871496 - RNA, 22 nt, Human
agagccuugcucuaaauuucuc

SEQ ID NO: 871497 - RNA, 22 nt, Human
augaccagccgagauaaacaga

SEQ ID NO: 871498 - RNA, 22 nt, Human
ugaggcaggaauggggaaaagu

SEQ ID NO: 871499 - RNA, 22 nt, Human
aacaauaggagugaugcaguau

SEQ ID NO: 871500 - RNA, 21 nt, Human
auacuuugaauuacagccuug

SEQ ID NO: 871501 - RNA, 22 nt, Human
acagggcccuugccagcacaag

SEQ ID NO: 871502 - RNA, 22 nt, Human
ucacaguauaaccucauauagg

SEQ ID NO: 871503 - RNA, 22 nt, Human
augaggcccaggaaucuguauu

SEQ ID NO: 871504 - RNA, 22 nt, Human
uucaauguuaagaagaauaugu

SEQ ID NO: 871505 - RNA, 22 nt, Human
aggcagcuuucuguaggggugu

SEQ ID NO: 871506 - RNA, 22 nt, Human
gaggagguggaauuccaggaau

SEQ ID NO: 871507 - RNA, 22 nt, Human
uuuaaauucugucugccgcuua

SEQ ID NO: 871508 - RNA, 22 nt, Human
cuugagaacaggguuagguaac

SEQ ID NO: 871509 - RNA, 22 nt, Human
gaacauucuuggaggaaauaac

SEQ ID NO: 871510 - RNA, 22 nt, Human
ccagaggcagacuuacacucca

SEQ ID NO: 871511 - RNA, 23 nt, Human
uuguaucucuggaaauucuucaa

SEQ ID NO: 871512 - RNA, 23 nt, Human
aggcaguggugguaacaugucaa

SEQ ID NO: 871513 - RNA, 22 nt, Human
gcagacugcgugaggcgccgcc

SEQ ID NO: 871514 - RNA, 22 nt, Human
ucugucucucaagggccguccu

SEQ ID NO: 871515 - RNA, 22 nt, Human
aaggugucggguuagcucagcc

SEQ ID NO: 871516 - RNA, 22 nt, Human
gacagccaggcauagggaguau

SEQ ID NO: 871517 - RNA, 22 nt, Human
ucagcucugcaaggucaccucc

SEQ ID NO: 871518 - RNA, 22 nt, Human
gcagauggaaagugcuugaggg

SEQ ID NO: 871519 - RNA, 22 nt, Human
gccugggagggcagcagugugg

SEQ ID NO: 871520 - RNA, 22 nt, Human
aggccacauagcuugcauguag

SEQ ID NO: 871521 - RNA, 22 nt, Human
ucugaggcagcuugccacucua

SEQ ID NO: 871522 - RNA, 19 nt, Human
ccuggaggugaagguucuc

SEQ ID NO: 871523 - RNA, 22 nt, Human
ucuggaugcucugagcccaagg

SEQ ID NO: 871524 - RNA, 22 nt, Human
ccuggcuguuugagcggggaau

SEQ ID NO: 871525 - RNA, 22 nt, Human
auuugcuuucagccuuaaggau

SEQ ID NO: 871526 - RNA, 22 nt, Human
uuccacaagauguuucuuagaa

SEQ ID NO: 871527 - RNA, 22 nt, Human
caaaauagauguuaaccuggaa

SEQ ID NO: 871528 - RNA, 22 nt, Human
acagaagagcuggcucugugcu

SEQ ID NO: 871529 - RNA, 22 nt, Human
ucaagcaaauguccuuuuguuc

SEQ ID NO: 871530 - RNA, 22 nt, Human
ccagagguuccaggcuagggag

SEQ ID NO: 871531 - RNA, 22 nt, Human
ccugcuuugagaugggcagcag

SEQ ID NO: 871532 - RNA, 22 nt, Human
agcauaaaauaaauaguuugca

SEQ ID NO: 871533 - RNA, 22 nt, Human
aagacagaugcaaccugcuagc

SEQ ID NO: 871534 - RNA, 22 nt, Human
ccucagagcagcacccagauga

SEQ ID NO: 871535 - RNA, 22 nt, Human
uuucauaaacaguagaagacua

SEQ ID NO: 871536 - RNA, 22 nt, Human
uguguugugucaccuaucaugc

SEQ ID NO: 871537 - RNA, 18 nt, Human
ggccagagggaggguccc

SEQ ID NO: 871538 - RNA, 22 nt, Human
agcagcacacgggagaaagaca

SEQ ID NO: 871539 - RNA, 22 nt, Human
ggcugaugagcuuagcuagaga

SEQ ID NO: 871540 - RNA, 22 nt, Human
cagaaacagacaugacgcagua

SEQ ID NO: 871541 - RNA, 22 nt, Human
caaugacagguucaugacuccu

SEQ ID NO: 871542 - RNA, 22 nt, Human
uaacacauauuugcaguaagca

SEQ ID NO: 871543 - RNA, 22 nt, Human
ucugggucaugacucagcguga

SEQ ID NO: 871544 - RNA, 22 nt, Human
ugugauauuugaguauugucaa

SEQ ID NO: 871545 - RNA, 23 nt, Human
ugggucagcugccuccaggacaa

SEQ ID NO: 871546 - RNA, 22 nt, Human
auacagugccccuuuucacaug

SEQ ID NO: 871547 - RNA, 22 nt, Human
agcagcugauggggaaggaguu

SEQ ID NO: 871548 - RNA, 18 nt, Human
ggcagaugacaggagaga

SEQ ID NO: 871549 - RNA, 22 nt, Human
gaagggagaagguugggugacg

SEQ ID NO: 871550 - RNA, 22 nt, Human
aaggaagggaaauagugauguc

SEQ ID NO: 871551 - RNA, 21 nt, Human
ucagaggcacugagagcaaug

SEQ ID NO: 871552 - RNA, 22 nt, Human
acauuucuccuacuuguuauuu

SEQ ID NO: 871553 - RNA, 22 nt, Human
guguuaaugguagaaucugagu

SEQ ID NO: 871554 - RNA, 22 nt, Human
uuguaucagugccuauaaaaug

SEQ ID NO: 871555 - RNA, 22 nt, Human
gcauucucucucuaaauguugu

SEQ ID NO: 871556 - RNA, 22 nt, Human
ucaccaggauugggcuguaggc

SEQ ID NO: 871557 - RNA, 22 nt, Human
cuagaaucuaugucaggaacuc

SEQ ID NO: 871558 - RNA, 23 nt, Human
ccagcugugccuggcccaggagc

SEQ ID NO: 871559 - RNA, 22 nt, Human
uggaagggagugacagucagag

SEQ ID NO: 871560 - RNA, 22 nt, Human
ccuggagggacccuggcccugu

SEQ ID NO: 871561 - RNA, 22 nt, Human
caaggcagcccgcugaaccaca

SEQ ID NO: 871562 - RNA, 19 nt, Human
aagaagcaauaagcuguga

SEQ ID NO: 871563 - RNA, 22 nt, Human
uugaaucauuacaauagauaag

SEQ ID NO: 871564 - RNA, 22 nt, Human
uagaacaugacuuauuuuugga

SEQ ID NO: 871565 - RNA, 22 nt, Human
gauguucuuauaccauuguggg

SEQ ID NO: 871566 - RNA, 22 nt, Human
ggaucaggcugaagcuaggacu

SEQ ID NO: 871567 - RNA, 22 nt, Human
gaggggcucuuuaauaguaaca

SEQ ID NO: 871568 - RNA, 22 nt, Human
acgugcgugugcgcacacauac

SEQ ID NO: 871569 - RNA, 22 nt, Human
gcucaaggcaggcagacaugag

SEQ ID NO: 871570 - RNA, 22 nt, Human
cagugauauuuauccuacucac

SEQ ID NO: 871571 - RNA, 22 nt, Human
ugaguggaguagugaaugcauu

SEQ ID NO: 871572 - RNA, 22 nt, Human
uucaagguaugguagcugguca

SEQ ID NO: 871573 - RNA, 22 nt, Human
acugggagucaugaggaaggag

SEQ ID NO: 871574 - RNA, 22 nt, Human
aagaacauucgaacuauuuucu

SEQ ID NO: 871575 - RNA, 22 nt, Human
auuuggaaauguaagaaugcaa

SEQ ID NO: 871576 - RNA, 22 nt, Human
uguguauagguugugcuaauag

SEQ ID NO: 871577 - RNA, 22 nt, Human
gcugccuggaauaacggcuggc

SEQ ID NO: 871578 - RNA, 22 nt, Human
aaguuuagggaagucugagcgc

SEQ ID NO: 871579 - RNA, 21 nt, Human
ucagagagucacagugaacug

SEQ ID NO: 871580 - RNA, 22 nt, Human
ccauuuaguaaggaagaacagc

SEQ ID NO: 871581 - RNA, 22 nt, Human
uucuaaugauuucauucaaagc

SEQ ID NO: 871582 - RNA, 22 nt, Human
uuuacagucucuauagucaaaa

SEQ ID NO: 871583 - RNA, 22 nt, Human
auguucaucaacacauuacaag

SEQ ID NO: 871584 - RNA, 22 nt, Human
ucccuguauagagaaucccuuu

SEQ ID NO: 871585 - RNA, 22 nt, Human
uggcuccagguugaacuuuggg

SEQ ID NO: 871586 - RNA, 22 nt, Human
ucaaaccugcugucuuguucau

SEQ ID NO: 871587 - RNA, 22 nt, Human
ucugggagggcugguucaguau

SEQ ID NO: 871588 - RNA, 22 nt, Human
agccucuguagaaagcagugug

SEQ ID NO: 871589 - RNA, 22 nt, Human
uaggcaacaugucgaauacugu

SEQ ID NO: 871590 - RNA, 21 nt, Human
acagcaagccuuccuuucagg

SEQ ID NO: 871591 - RNA, 22 nt, Human
auccauuuuccuuggcagcagg

SEQ ID NO: 871592 - RNA, 20 nt, Human
uaugaagauaugugaacagc

SEQ ID NO: 871593 - RNA, 20 nt, Human
gcucccagccugcagucccc

SEQ ID NO: 871594 - RNA, 22 nt, Human
gagcaguuuuauuucaugagac

SEQ ID NO: 871595 - RNA, 22 nt, Human
aggacuucuuagaugccuuccg

SEQ ID NO: 871596 - RNA, 22 nt, Human
ccaagauaagagacaagauuua

SEQ ID NO: 871597 - RNA, 22 nt, Human
caagauuuuaucuccguuucug

SEQ ID NO: 871598 - RNA, 23 nt, Human
aaucuagaaugaccuacucaucu

SEQ ID NO: 871599 - RNA, 22 nt, Human
caggcuucaugaauuaugcacc

SEQ ID NO: 871600 - RNA, 22 nt, Human
acagugaugggggugcaggaag

SEQ ID NO: 871601 - RNA, 22 nt, Human
gaggcuggaggucaaagaugaa

SEQ ID NO: 871602 - RNA, 22 nt, Human
ucuggagaagaaacuugcucug

SEQ ID NO: 871603 - RNA, 22 nt, Human
uaagaaacugucacaguacuau

SEQ ID NO: 871604 - RNA, 22 nt, Human
auuuuaacccucuuauauauac

SEQ ID NO: 871605 - RNA, 22 nt, Human
augaggccagaccacucugcau

SEQ ID NO: 871606 - RNA, 22 nt, Human
cugcagcugcgggaccggagcg

SEQ ID NO: 871607 - RNA, 22 nt, Human
uaggccacagaugagacauaag

SEQ ID NO: 871608 - RNA, 22 nt, Human
agugacaguuucaggcauuuuu

SEQ ID NO: 871609 - RNA, 22 nt, Human
aaaggaauauucaaaacaguca

SEQ ID NO: 871610 - RNA, 22 nt, Human
augcacugccccucugcaccuc

SEQ ID NO: 871611 - RNA, 23 nt, Human
uccauacucuaaacauguuauuu

SEQ ID NO: 871612 - RNA, 22 nt, Human
ugccucagcugaggccgcucca

SEQ ID NO: 871613 - RNA, 19 nt, Human
agcuccugggcucugggcc

SEQ ID NO: 871614 - RNA, 22 nt, Human
gcacacagaaucagugggcaua

SEQ ID NO: 871615 - RNA, 22 nt, Human
ugugcaguucaaacccguguug

SEQ ID NO: 871616 - RNA, 22 nt, Human
cuuggcccggagccccaugaag

SEQ ID NO: 871617 - RNA, 22 nt, Human
aguuucucuuaaucuaguaucu

SEQ ID NO: 871618 - RNA, 22 nt, Human
gaaauauuucucuugagccccu

SEQ ID NO: 871619 - RNA, 21 nt, Human
ccacugcucuucccuagggcc

SEQ ID NO: 871620 - RNA, 22 nt, Human
ggcugccucccaggagaaucug

SEQ ID NO: 871621 - RNA, 22 nt, Human
cuaagggcuugcuggagccagg

SEQ ID NO: 871622 - RNA, 22 nt, Human
ccaacaguccagaugagauggu

SEQ ID NO: 871623 - RNA, 22 nt, Human
accaggcaugauguggagcaca

SEQ ID NO: 871624 - RNA, 22 nt, Human
ucucuguggugggaggcugagu

SEQ ID NO: 871625 - RNA, 22 nt, Human
ggggccagcaauguugaggaau

SEQ ID NO: 871626 - RNA, 22 nt, Human
gcucugagugaucagcugggaa

SEQ ID NO: 871627 - RNA, 22 nt, Human
ggaacaguacucggaggccaga

SEQ ID NO: 871628 - RNA, 22 nt, Human
gugaggccgcacgccccggagu

SEQ ID NO: 871629 - RNA, 22 nt, Human
aucuucaaggaaaaaauacagu

SEQ ID NO: 871630 - RNA, 22 nt, Human
ugccugggagugaccaagacuc

SEQ ID NO: 871631 - RNA, 22 nt, Human
ugcccagcacccagcaugaugc

SEQ ID NO: 871632 - RNA, 22 nt, Human
aagacagaagugauuugaugug

SEQ ID NO: 871633 - RNA, 17 nt, Human
uuuaaacuacuacaagg

SEQ ID NO: 871634 - RNA, 22 nt, Human
caugcagggagcagaggagaca

SEQ ID NO: 871635 - RNA, 22 nt, Human
ccagucugcagccccuggggac

SEQ ID NO: 871636 - RNA, 21 nt, Human
uggcuggauagaugggaacug

SEQ ID NO: 871637 - RNA, 22 nt, Human
acagaauuuuuacacaggguaa

SEQ ID NO: 871638 - RNA, 22 nt, Human
cuguggggaaaggguccugcuc

SEQ ID NO: 871639 - RNA, 22 nt, Human
ugcagggcaguggagguugagu

SEQ ID NO: 871640 - RNA, 22 nt, Human
uagcauuucccaaaugcauuug

SEQ ID NO: 871641 - RNA, 20 nt, Human
ugccugggaaggcguggagg

SEQ ID NO: 871642 - RNA, 22 nt, Human
aagcuggagaguuucacagaug

SEQ ID NO: 871643 - RNA, 22 nt, Human
uuucagugugcuccugagggcu

SEQ ID NO: 871644 - RNA, 22 nt, Human
ucaagguugccaggaaggaaga

SEQ ID NO: 871645 - RNA, 22 nt, Human
ugguccuguagcucucuaaguu

SEQ ID NO: 871646 - RNA, 22 nt, Human
ugucacagaucguuuuugagcu

SEQ ID NO: 871647 - RNA, 22 nt, Human
uuucaaugacacaaaagagaaa

SEQ ID NO: 871648 - RNA, 22 nt, Human
ucagaggauuggacuuuuaugu

SEQ ID NO: 871649 - RNA, 22 nt, Human
auccauuugccgugcuaugugc

SEQ ID NO: 871650 - RNA, 22 nt, Human
agaagcugugguaugaaaugug

SEQ ID NO: 871651 - RNA, 22 nt, Human
ugguggccuugauggcaucugc

SEQ ID NO: 871652 - RNA, 21 nt, Human
cagggcacacagaggauggua

SEQ ID NO: 871653 - RNA, 22 nt, Human
ugaagccaaucugccaggcaga

SEQ ID NO: 871654 - RNA, 22 nt, Human
acaggccucaaauagggugccu

SEQ ID NO: 871655 - RNA, 22 nt, Human
agcugucuaccugcagaguccu

SEQ ID NO: 871656 - RNA, 19 nt, Human
agguauuugggagauauau

SEQ ID NO: 871657 - RNA, 22 nt, Human
acaugugaaaucucauaguuag

SEQ ID NO: 871658 - RNA, 22 nt, Human
ugaaauguagugaagcauggaa

SEQ ID NO: 871659 - RNA, 22 nt, Human
acauuuauuacucagguuguug

SEQ ID NO: 871660 - RNA, 22 nt, Human
auugaauagcugcuuguuguau

SEQ ID NO: 871661 - RNA, 22 nt, Human
uacuucaaccuucucuauuaga

SEQ ID NO: 871662 - RNA, 22 nt, Human
agcugcaguucguuccagcucu

SEQ ID NO: 871663 - RNA, 22 nt, Human
auuugcuuucccuucccugaca

SEQ ID NO: 871664 - RNA, 19 nt, Human
gggagcugucugcccgugg

SEQ ID NO: 871665 - RNA, 22 nt, Human
gggcagaggggcgcuucccucu

SEQ ID NO: 871666 - RNA, 22 nt, Human
gugaaccaagaagucaaagcga

SEQ ID NO: 871667 - RNA, 22 nt, Human
uuuuccuucaccucuugagccu

SEQ ID NO: 871668 - RNA, 22 nt, Human
cagacuggccacaucugcacug

SEQ ID NO: 871669 - RNA, 21 nt, Human
aguuagcagauuucugucucc

SEQ ID NO: 871670 - RNA, 22 nt, Human
agcuccaggucagugcaccccu

SEQ ID NO: 871671 - RNA, 22 nt, Human
cugcagaccucugagguccaug

SEQ ID NO: 871672 - RNA, 22 nt, Human
cucggguaccaugcuaggcacu

SEQ ID NO: 871673 - RNA, 22 nt, Human
gcauuuaaauuugaacuucaga

SEQ ID NO: 871674 - RNA, 22 nt, Human
ucuuuugugauucuucaguuac

SEQ ID NO: 871675 - RNA, 22 nt, Human
ucauuacaagauuuccaauuug

SEQ ID NO: 871676 - RNA, 22 nt, Human
gagaaguuguguggauuuaaag

SEQ ID NO: 871677 - RNA, 22 nt, Human
cauuauguucaguagcuuaaaa

SEQ ID NO: 871678 - RNA, 22 nt, Human
caaaugcaugagaaauaagagg

SEQ ID NO: 871679 - RNA, 22 nt, Human
cuuggucuaaugguaauaagca

SEQ ID NO: 871680 - RNA, 22 nt, Human
agcuaggauaagcagagacugg

SEQ ID NO: 871681 - RNA, 22 nt, Human
acaaaaccagaaaaucucuacc

SEQ ID NO: 871682 - RNA, 22 nt, Human
uacaguuuaacacuuuggagaa

SEQ ID NO: 871683 - RNA, 18 nt, Human
ugggcucaaaggauccuc

SEQ ID NO: 871684 - RNA, 22 nt, Human
aggcuccugcaggugaggugcu

SEQ ID NO: 871685 - RNA, 22 nt, Human
acagccagugacuggacaagcu

SEQ ID NO: 871686 - RNA, 19 nt, Human
ucucugcuucucuuggcau

SEQ ID NO: 871687 - RNA, 22 nt, Human
auaucauuauguuaugagcaca

SEQ ID NO: 871688 - RNA, 22 nt, Human
acucuggagauggaugucagga

SEQ ID NO: 871689 - RNA, 22 nt, Human
gccagcaguccaguccuuagug

SEQ ID NO: 871690 - RNA, 22 nt, Human
aucagcagugucuaccucggug

SEQ ID NO: 871691 - RNA, 21 nt, Human
ugucagcaacaauacuuucuc

SEQ ID NO: 871692 - RNA, 22 nt, Human
ugugugcauucacaugcaugcc

SEQ ID NO: 871693 - RNA, 22 nt, Human
cuuuuucuaaucauaauugucu

SEQ ID NO: 871694 - RNA, 22 nt, Human
gaggcugcugccaucauuaggu

SEQ ID NO: 871695 - RNA, 22 nt, Human
uugaaauacugcauuguucagu

SEQ ID NO: 871696 - RNA, 21 nt, Human
uuggaagauaaugcuuaugau

SEQ ID NO: 871697 - RNA, 22 nt, Human
gucugggucuccacagucagca

SEQ ID NO: 871698 - RNA, 22 nt, Human
ggaggagacaguaaaaagcacg

SEQ ID NO: 871699 - RNA, 22 nt, Human
cucugagguccuacagugaccc

SEQ ID NO: 871700 - RNA, 22 nt, Human
aggcagccaaucagaggcugac

SEQ ID NO: 871701 - RNA, 22 nt, Human
ccaaaucaggggccacaagcau

SEQ ID NO: 871702 - RNA, 22 nt, Human
gauguauaaccuggcuauguua

SEQ ID NO: 871703 - RNA, 22 nt, Human
cuacaucucaccuuccaggaca

SEQ ID NO: 871704 - RNA, 22 nt, Human
ccaugggcacuggguggaggua

SEQ ID NO: 871705 - RNA, 22 nt, Human
ugagccagguuaagacaggagc

SEQ ID NO: 871706 - RNA, 22 nt, Human
agggaaggagguuagaacccac

SEQ ID NO: 871707 - RNA, 22 nt, Human
agaagcagaaggaagcagggcc

SEQ ID NO: 871708 - RNA, 22 nt, Human
guuuccagccuccuggguaaag

SEQ ID NO: 871709 - RNA, 22 nt, Human
uagcaggguuuugaagaggguu

SEQ ID NO: 871710 - RNA, 18 nt, Human
agacaaacuucuucugcc

SEQ ID NO: 871711 - RNA, 22 nt, Human
agugugcucugguugccaugcu

SEQ ID NO: 871712 - RNA, 22 nt, Human
ugggguggugggaaccaaguag

SEQ ID NO: 871713 - RNA, 23 nt, Human
agcauucucuccaacauuuaaca

SEQ ID NO: 871714 - RNA, 22 nt, Human
gacagcaggagaucaugauaga

SEQ ID NO: 871715 - RNA, 22 nt, Human
gcacagcaugaagagaggaagc

SEQ ID NO: 871716 - RNA, 22 nt, Human
ggacagcauaucagcagggcag

SEQ ID NO: 871717 - RNA, 22 nt, Human
agcaaagcuaucucuauggaga

SEQ ID NO: 871718 - RNA, 21 nt, Human
ugaaaguuggagucaaaugua

SEQ ID NO: 871719 - RNA, 22 nt, Human
gaugaggaaugcucagcucaau

SEQ ID NO: 871720 - RNA, 20 nt, Human
cuguccuuuuguuggaagac

SEQ ID NO: 871721 - RNA, 22 nt, Human
gcguguuugcccagugaguggc

SEQ ID NO: 871722 - RNA, 22 nt, Human
acauugaagugucuggccuccu

SEQ ID NO: 871723 - RNA, 22 nt, Human
agcacugggaacgcauggggcc

SEQ ID NO: 871724 - RNA, 22 nt, Human
ugcagcaugcaggagaggcucu

SEQ ID NO: 871725 - RNA, 22 nt, Human
ugugccucauguaucuggauga

SEQ ID NO: 871726 - RNA, 22 nt, Human
aauacuuuccuauauaaggugc

SEQ ID NO: 871727 - RNA, 22 nt, Human
uuucagugcacguaguuuauuu

SEQ ID NO: 871728 - RNA, 22 nt, Human
uuguacaacacauauucuacag

SEQ ID NO: 871729 - RNA, 22 nt, Human
aggcagccaguucagguuucuu

SEQ ID NO: 871730 - RNA, 22 nt, Human
aguaccuuugcauggauuuuuu

SEQ ID NO: 871731 - RNA, 22 nt, Human
acauucuguugaggcuggguca

SEQ ID NO: 871732 - RNA, 22 nt, Human
ugagugugcuaggugucucggu

SEQ ID NO: 871733 - RNA, 22 nt, Human
accuccuggcuuaucauggaca

SEQ ID NO: 871734 - RNA, 22 nt, Human
cauguugaauggccuugauuuu

SEQ ID NO: 871735 - RNA, 22 nt, Human
gggcaggugugcagagcuguug

SEQ ID NO: 871736 - RNA, 23 nt, Human
agaugaggcuucuccauguuggu

SEQ ID NO: 871737 - RNA, 22 nt, Human
cagaaauggaaguucugguuua

SEQ ID NO: 871738 - RNA, 22 nt, Human
uugugcaaaggggguuaaucau

SEQ ID NO: 871739 - RNA, 22 nt, Human
aagcgccacgagaagcuggacc

SEQ ID NO: 871740 - RNA, 22 nt, Human
ccugggcauucuuugaguucuc

SEQ ID NO: 871741 - RNA, 22 nt, Human
aaacacaucauucaugucguca

SEQ ID NO: 871742 - RNA, 22 nt, Human
agcagugacuugcuuuguuucc

SEQ ID NO: 871743 - RNA, 22 nt, Human
uuugcagaagaaaacaugaaca

SEQ ID NO: 871744 - RNA, 22 nt, Human
uucuacacagugcggguuaaca

SEQ ID NO: 871745 - RNA, 22 nt, Human
agaggcaggaagagcugauuuu

SEQ ID NO: 871746 - RNA, 22 nt, Human
ucuggcucaucucuccagguaa

SEQ ID NO: 871747 - RNA, 22 nt, Human
cugagcuguuacucuguccucg

SEQ ID NO: 871748 - RNA, 22 nt, Human
auuaauuuccaggcacugugcu

SEQ ID NO: 871749 - RNA, 22 nt, Human
auuucucaucuuugugaauggu

SEQ ID NO: 871750 - RNA, 22 nt, Human
ccugccucccagagguccucua

SEQ ID NO: 871751 - RNA, 22 nt, Human
uacagggaaugggacauaaauc

SEQ ID NO: 871752 - RNA, 22 nt, Human
aaaagcaucucaaaggagcuuc

SEQ ID NO: 871753 - RNA, 22 nt, Human
aggucccaguguuagggugaca

SEQ ID NO: 871754 - RNA, 22 nt, Human
cuggccagcugacagcagggcu

SEQ ID NO: 871755 - RNA, 20 nt, Human
ucuuccagcuucugguagaa

SEQ ID NO: 871756 - RNA, 22 nt, Human
caauagaaaacucaauacuuaa

SEQ ID NO: 871757 - RNA, 22 nt, Human
ccagggcccacggccagaauag

SEQ ID NO: 871758 - RNA, 22 nt, Human
agucucaaguguuaguauuauu

SEQ ID NO: 871759 - RNA, 22 nt, Human
uaggaaauugacaccugcuuga

SEQ ID NO: 871760 - RNA, 22 nt, Human
acaggcugccacuugcauccaa

SEQ ID NO: 871761 - RNA, 22 nt, Human
gcccaggaguucaagucuagug

SEQ ID NO: 871762 - RNA, 22 nt, Human
cucuugccagagaugagacucu

SEQ ID NO: 871763 - RNA, 22 nt, Human
cacuauaauccuguuuuagaac

SEQ ID NO: 871764 - RNA, 22 nt, Human
cuucacugaguagucuagacuc

SEQ ID NO: 871765 - RNA, 22 nt, Human
ugucauuuucuaaucuguuguc

SEQ ID NO: 871766 - RNA, 22 nt, Human
aaaguccagggaaagagcgucu

SEQ ID NO: 871767 - RNA, 16 nt, Human
gcagguggggcgcgca

SEQ ID NO: 871768 - RNA, 22 nt, Human
guguucucucuacaggaauuua

SEQ ID NO: 871769 - RNA, 22 nt, Human
aggcccuggacacucaagccgg

SEQ ID NO: 871770 - RNA, 22 nt, Human
aguuuacaacaguagcuaugga

SEQ ID NO: 871771 - RNA, 22 nt, Human
cagcuucuccggccuggugcgg

SEQ ID NO: 871772 - RNA, 22 nt, Human
uugcuuuacuuugccauucguu

SEQ ID NO: 871773 - RNA, 22 nt, Human
ugggaaguaggacagugcaguu

SEQ ID NO: 871774 - RNA, 22 nt, Human
gacagcuucgaggaggugagcu

SEQ ID NO: 871775 - RNA, 22 nt, Human
auagcagcaucaguuuaucucc

SEQ ID NO: 871776 - RNA, 22 nt, Human
gggcaguggcucacgccuguaa

SEQ ID NO: 871777 - RNA, 22 nt, Human
uuggaaaccaggcuuugagacg

SEQ ID NO: 871778 - RNA, 22 nt, Human
uuugaagacagaucaauauaag

SEQ ID NO: 871779 - RNA, 22 nt, Human
acugagggccaaaggcacugag

SEQ ID NO: 871780 - RNA, 22 nt, Human
aaaugucuaucuggcauauucc

SEQ ID NO: 871781 - RNA, 22 nt, Human
ugucuuauuaagaccagugacu

SEQ ID NO: 871782 - RNA, 22 nt, Human
ggagggcugccagguggagcgg

SEQ ID NO: 871783 - RNA, 22 nt, Human
cuacaguacuggaugcucagcc

SEQ ID NO: 871784 - RNA, 22 nt, Human
cucuugggugggcagugggccu

SEQ ID NO: 871785 - RNA, 21 nt, Human
acugcaaacagcagagacuga

SEQ ID NO: 871786 - RNA, 22 nt, Human
gagaacagugucauccuauaau

SEQ ID NO: 871787 - RNA, 22 nt, Human
agggcuugacaagggcuggagc

SEQ ID NO: 871788 - RNA, 22 nt, Human
agggcucagaacaaugagugua

SEQ ID NO: 871789 - RNA, 22 nt, Human
cuuguaaaugcagauucugauu

SEQ ID NO: 871790 - RNA, 22 nt, Human
acagauggggcacaaagccaca

SEQ ID NO: 871791 - RNA, 22 nt, Human
aauucuuaaucccauaaaguga

SEQ ID NO: 871792 - RNA, 23 nt, Human
agcaccugugauuuccuagcucu

SEQ ID NO: 871793 - RNA, 22 nt, Human
agucuacaaucuuaaaugaacu

SEQ ID NO: 871794 - RNA, 18 nt, Human
gaggcacauaguuggggc

SEQ ID NO: 871795 - RNA, 22 nt, Human
caccuuugcaaaccaaaucuga

SEQ ID NO: 871796 - RNA, 22 nt, Human
aacuucugaccucaagaacugu

SEQ ID NO: 871797 - RNA, 22 nt, Human
auaaagauuuuuaggcauuucu

SEQ ID NO: 871798 - RNA, 22 nt, Human
caggcugccgugggguccaggc

SEQ ID NO: 871799 - RNA, 22 nt, Human
ccugggugacccgugagcgucc

SEQ ID NO: 871800 - RNA, 22 nt, Human
uagaaacugauagucuugugcu

SEQ ID NO: 871801 - RNA, 22 nt, Human
caucuuuaaaaugggaacaaca

SEQ ID NO: 871802 - RNA, 22 nt, Human
gcugaaauucagauuccuaggc

SEQ ID NO: 871803 - RNA, 22 nt, Human
gggcauggugcugguguucaug

SEQ ID NO: 871804 - RNA, 22 nt, Human
uccagggcagggugcgcauggg

SEQ ID NO: 871805 - RNA, 22 nt, Human
aucuuucacuuuuuguggauga

SEQ ID NO: 871806 - RNA, 22 nt, Human
uggcagcacggcauccacucuc

SEQ ID NO: 871807 - RNA, 22 nt, Human
ugaaugagugaguucagaccuc

SEQ ID NO: 871808 - RNA, 22 nt, Human
gcuggcagaagagcugguucaa

SEQ ID NO: 871809 - RNA, 22 nt, Human
ccucugcaucuggcugcugcag

SEQ ID NO: 871810 - RNA, 22 nt, Human
auagaauaaggcacagauucuu

SEQ ID NO: 871811 - RNA, 22 nt, Human
agcuguggcagcacuuuggagu

SEQ ID NO: 871812 - RNA, 18 nt, Human
acucugggaccuguuauu

SEQ ID NO: 871813 - RNA, 22 nt, Human
agcuguggucuucaaguugccu

SEQ ID NO: 871814 - RNA, 22 nt, Human
gggaugacuacuuaugggaagu

SEQ ID NO: 871815 - RNA, 22 nt, Human
uggacagaaacccgagugaucu

SEQ ID NO: 871816 - RNA, 22 nt, Human
uuuacagaauguugaauuuggg

SEQ ID NO: 871817 - RNA, 22 nt, Human
gagcuggaagucuguggucaga

SEQ ID NO: 871818 - RNA, 20 nt, Human
uccugagaccugggaagguu

SEQ ID NO: 871819 - RNA, 20 nt, Human
cugcccugcccuggguccug

SEQ ID NO: 871820 - RNA, 22 nt, Human
ccugucugaggaggugcucuuu

SEQ ID NO: 871821 - RNA, 22 nt, Human
uagcagcagugguguauuuaga

SEQ ID NO: 871822 - RNA, 22 nt, Human
ugggcagaggacagggaagauc

SEQ ID NO: 871823 - RNA, 22 nt, Human
cucuuuguggaacggcaguguc

SEQ ID NO: 871824 - RNA, 22 nt, Human
augaaauauucuuugguaagaa

SEQ ID NO: 871825 - RNA, 22 nt, Human
cagcuuuuaggacugugagaaa

SEQ ID NO: 871826 - RNA, 21 nt, Human
augugcagcaagcagcaugcu

SEQ ID NO: 871827 - RNA, 22 nt, Human
cuccaggaccagggcuccugga

SEQ ID NO: 871828 - RNA, 22 nt, Human
agcacaggcuuuggugugaggg

SEQ ID NO: 871829 - RNA, 22 nt, Human
auaaggaaccugggcuuaagag

SEQ ID NO: 871830 - RNA, 22 nt, Human
ggacagagcccugguggccuaa

SEQ ID NO: 871831 - RNA, 22 nt, Human
uggggaaggaucaccacaaucu

SEQ ID NO: 871832 - RNA, 21 nt, Human
aaugucuuuguccaugcucug

SEQ ID NO: 871833 - RNA, 22 nt, Human
gcuacuuugcagcuagcuagga

SEQ ID NO: 871834 - RNA, 22 nt, Human
gggagggucugagagcugcacc

SEQ ID NO: 871835 - RNA, 22 nt, Human
gcuaugggaugugcuguggaug

SEQ ID NO: 871836 - RNA, 22 nt, Human
gugcagggcagguguccuucca

SEQ ID NO: 871837 - RNA, 22 nt, Human
aggcugaggcgggaggaucacu

SEQ ID NO: 871838 - RNA, 22 nt, Human
agggcucacugggaggcuauaa

SEQ ID NO: 871839 - RNA, 21 nt, Human
ugcucaguaaaugcugaguga

SEQ ID NO: 871840 - RNA, 22 nt, Human
augcugcacaagccacauguag

SEQ ID NO: 871841 - RNA, 23 nt, Human
acaugggagggacauggaggcug

SEQ ID NO: 871842 - RNA, 22 nt, Human
agccagcaucuugcuucuugag

SEQ ID NO: 871843 - RNA, 22 nt, Human
ugcagcaugccaaacgaggagg

SEQ ID NO: 871844 - RNA, 22 nt, Human
gugggucuggcuuugaggguca

SEQ ID NO: 871845 - RNA, 17 nt, Human
gcugccaccuuuggagc

SEQ ID NO: 871846 - RNA, 22 nt, Human
cagcauuuggaggagaggcuuu

SEQ ID NO: 871847 - RNA, 22 nt, Human
caaauguauguuuuccuaugua

SEQ ID NO: 871848 - RNA, 22 nt, Human
uucaguuugaauucuguagaac

SEQ ID NO: 871849 - RNA, 16 nt, Human
cuacccagugagaagg

SEQ ID NO: 871850 - RNA, 22 nt, Human
uuccagcacagaaguauacauu

SEQ ID NO: 871851 - RNA, 22 nt, Human
uauauuaaagugcuuugcagug

SEQ ID NO: 871852 - RNA, 22 nt, Human
agguuauucucuaucucauccc

SEQ ID NO: 871853 - RNA, 22 nt, Human
uguauuugaguuaugaaagaga

SEQ ID NO: 871854 - RNA, 22 nt, Human
ugcccuguuaucuuggaagagu

SEQ ID NO: 871855 - RNA, 22 nt, Human
augcaaaugcuagagaauguug

SEQ ID NO: 871856 - RNA, 22 nt, Human
ugcauuccacagaagggaaaac

SEQ ID NO: 871857 - RNA, 22 nt, Human
gcaggggaguggaugauggauu

SEQ ID NO: 871858 - RNA, 22 nt, Human
cucuggccuggggccugcuccc

SEQ ID NO: 871859 - RNA, 22 nt, Human
uaaaacugcuugguauggucua

SEQ ID NO: 871860 - RNA, 21 nt, Human
agcagaggggacauguuugau

SEQ ID NO: 871861 - RNA, 22 nt, Human
aagcucuugaguaaacuaguuu

SEQ ID NO: 871862 - RNA, 22 nt, Human
aagcacauuauagcuaucuagg

SEQ ID NO: 871863 - RNA, 22 nt, Human
auagagugauguaagguaugug

SEQ ID NO: 871864 - RNA, 22 nt, Human
agcaguuaugugucucuugacu

SEQ ID NO: 871865 - RNA, 22 nt, Human
cagccacuggugccaggcuguu

SEQ ID NO: 871866 - RNA, 22 nt, Human
agaaagggucacugaaagagga

SEQ ID NO: 871867 - RNA, 22 nt, Human
uugcagggcaggaccauggaca

SEQ ID NO: 871868 - RNA, 22 nt, Human
auuacaacaagaaaaggguaag

SEQ ID NO: 871869 - RNA, 22 nt, Human
cugggccucacccuagaccaau

SEQ ID NO: 871870 - RNA, 22 nt, Human
uccaggugugcucugugcccug

SEQ ID NO: 871871 - RNA, 22 nt, Human
acuaaaguguuggagaaugagg

SEQ ID NO: 871872 - RNA, 22 nt, Human
caggaaauucuuuuguuugugc

SEQ ID NO: 871873 - RNA, 22 nt, Human
ucugggaguuguaguccggugg

SEQ ID NO: 871874 - RNA, 22 nt, Human
ggguaggcaaagcaaugacguu

SEQ ID NO: 871875 - RNA, 22 nt, Human
ucccugaugugggcugcgugac

SEQ ID NO: 871876 - RNA, 22 nt, Human
ucagaaaggaguuagaggucuc

SEQ ID NO: 871877 - RNA, 22 nt, Human
agcaggaacgaguucaugggga

SEQ ID NO: 871878 - RNA, 22 nt, Human
gaggcuuuauaacuauuuguuc

SEQ ID NO: 871879 - RNA, 22 nt, Human
cuucaugauccuaccacauuga

SEQ ID NO: 871880 - RNA, 22 nt, Human
augucacauggucaccucuagc

SEQ ID NO: 871881 - RNA, 22 nt, Human
cugccaggccuccgcugucccc

SEQ ID NO: 871882 - RNA, 22 nt, Human
augauacaagcaaaacuaauca

SEQ ID NO: 871883 - RNA, 22 nt, Human
gcugggcaggccucgugagggc

SEQ ID NO: 871884 - RNA, 22 nt, Human
ugcuugauuuggcaguguauuc

SEQ ID NO: 871885 - RNA, 22 nt, Human
acaccaaaguagaauuaaugua

SEQ ID NO: 871886 - RNA, 22 nt, Human
augcugugccuucucugugcca

SEQ ID NO: 871887 - RNA, 22 nt, Human
cuggcuuccucaggagcagugg

SEQ ID NO: 871888 - RNA, 22 nt, Human
agcuggagauucuggggacagu

SEQ ID NO: 871889 - RNA, 22 nt, Human
gaaguacauucugauagggaag

SEQ ID NO: 871890 - RNA, 22 nt, Human
ugggccagcaauugcugcucag

SEQ ID NO: 871891 - RNA, 22 nt, Human
aaagcagcugaucucagagccu

SEQ ID NO: 871892 - RNA, 22 nt, Human
ggcucuggguucugcaaugcgu

SEQ ID NO: 871893 - RNA, 22 nt, Human
guccauuuuauucagagacuuu

SEQ ID NO: 871894 - RNA, 22 nt, Human
ucuuggagaauggcagagaagc

SEQ ID NO: 871895 - RNA, 22 nt, Human
acaauagacaaagugaauggcu

SEQ ID NO: 871896 - RNA, 22 nt, Human
ucucuggguauucacugccuuc

SEQ ID NO: 871897 - RNA, 22 nt, Human
uuuggaaguaaaugaguguuuu

SEQ ID NO: 871898 - RNA, 22 nt, Human
aguguuucuggaaucaguguuu

SEQ ID NO: 871899 - RNA, 22 nt, Human
ggccagcugcucagugucucug

SEQ ID NO: 871900 - RNA, 22 nt, Human
auguucuguuucuuaaucuuga

SEQ ID NO: 871901 - RNA, 22 nt, Human
ucauaaagauacuaagugaguu

SEQ ID NO: 871902 - RNA, 22 nt, Human
gucauuuuaugggaacagauuu

SEQ ID NO: 871903 - RNA, 23 nt, Human
aggcccaacucugugagggcugc

SEQ ID NO: 871904 - RNA, 22 nt, Human
aggcucugcagugcuggaggac

SEQ ID NO: 871905 - RNA, 22 nt, Human
uguacauagaaaggauacagcu

SEQ ID NO: 871906 - RNA, 19 nt, Human
uucacuaauuguaagauuu

SEQ ID NO: 871907 - RNA, 22 nt, Human
auggcagggcagccucucagag

SEQ ID NO: 871908 - RNA, 22 nt, Human
ucccaggagcaccuuuugagcc

SEQ ID NO: 871909 - RNA, 22 nt, Human
auuucucagcacuuccuaucuc

SEQ ID NO: 871910 - RNA, 22 nt, Human
gaauauauuucucuuaccuuua

SEQ ID NO: 871911 - RNA, 22 nt, Human
uaugaaauuuaaacacagauca

SEQ ID NO: 871912 - RNA, 22 nt, Human
aggacacacccagcucacgggg

SEQ ID NO: 871913 - RNA, 22 nt, Human
ggcagcaucuugauauugguuu

SEQ ID NO: 871914 - RNA, 22 nt, Human
uauguucuaaccuugucuuucc

SEQ ID NO: 871915 - RNA, 22 nt, Human
aggcagguagaaggaucuuuau

SEQ ID NO: 871916 - RNA, 22 nt, Human
auucacauuuagccucugacau

SEQ ID NO: 871917 - RNA, 22 nt, Human
acacaguaucaaauuucaucuu

SEQ ID NO: 871918 - RNA, 22 nt, Human
auuaaaagagauaauguguguu

SEQ ID NO: 871919 - RNA, 22 nt, Human
aucuuuagugugaauuuauuga

SEQ ID NO: 871920 - RNA, 23 nt, Human
aagcugccagucugaagccuggg

SEQ ID NO: 871921 - RNA, 22 nt, Human
caguggaauauauaggggauuu

SEQ ID NO: 871922 - RNA, 22 nt, Human
acuuagcagguacuuucauauu

SEQ ID NO: 871923 - RNA, 22 nt, Human
gccuccagcuggggcauuucag

SEQ ID NO: 871924 - RNA, 22 nt, Human
uugcuuuaaugagauuuugcca

SEQ ID NO: 871925 - RNA, 22 nt, Human
caggaagaccagggcuguggcu

SEQ ID NO: 871926 - RNA, 22 nt, Human
ucugaaauauauuuugaguguu

SEQ ID NO: 871927 - RNA, 21 nt, Human
ucaagacagcauauuuaagaa

SEQ ID NO: 871928 - RNA, 22 nt, Human
ucagauauagucauuuaaauaa

SEQ ID NO: 871929 - RNA, 22 nt, Human
uaaguucuuuucuauguaauau

SEQ ID NO: 871930 - RNA, 22 nt, Human
acuguacugaaaaguaagcaag

SEQ ID NO: 871931 - RNA, 22 nt, Human
uuuguggcaggagcggagaccg

SEQ ID NO: 871932 - RNA, 22 nt, Human
gaggcagagucacaaagagucu

SEQ ID NO: 871933 - RNA, 22 nt, Human
agccuggccugggcaggcacau

SEQ ID NO: 871934 - RNA, 19 nt, Human
cugagagaugcuucacaca

SEQ ID NO: 871935 - RNA, 22 nt, Human
agcggcugcuccgcaggcuggc

SEQ ID NO: 871936 - RNA, 22 nt, Human
uuacauguuuauggggguacau

SEQ ID NO: 871937 - RNA, 22 nt, Human
cagcuucucgggagcgcaugug

SEQ ID NO: 871938 - RNA, 22 nt, Human
gccaggagagcuccuucagguu

SEQ ID NO: 871939 - RNA, 22 nt, Human
aaauggacauugggugagcucu

SEQ ID NO: 871940 - RNA, 22 nt, Human
cagccccagcacuuagcugagu

SEQ ID NO: 871941 - RNA, 22 nt, Human
gugcccugguccccagcauaua

SEQ ID NO: 871942 - RNA, 22 nt, Human
aaacauugaugggaaguuuaau

SEQ ID NO: 871943 - RNA, 20 nt, Human
cagaggcauuuucagacucu

SEQ ID NO: 871944 - RNA, 22 nt, Human
ugagaauagcagacugguaacu

SEQ ID NO: 871945 - RNA, 22 nt, Human
ucagucccuucuccaggucagc

SEQ ID NO: 871946 - RNA, 22 nt, Human
aauaaucucacuuuauguggaa

SEQ ID NO: 871947 - RNA, 22 nt, Human
caaaugauacuguuuuuagucu

SEQ ID NO: 871948 - RNA, 22 nt, Human
cugcugggggacacagguccgg

SEQ ID NO: 871949 - RNA, 22 nt, Human
cacugcaguuccccagugcgca

SEQ ID NO: 871950 - RNA, 22 nt, Human
ugccuggaucugaggacccauu

SEQ ID NO: 871951 - RNA, 22 nt, Human
uccacgccaaaauuuguagcuu

SEQ ID NO: 871952 - RNA, 22 nt, Human
gcaccaggcagcugagcaggcc

SEQ ID NO: 871953 - RNA, 22 nt, Human
aaauaucauucuggugcacaga

SEQ ID NO: 871954 - RNA, 18 nt, Human
uccagagcuacuguggug

SEQ ID NO: 871955 - RNA, 22 nt, Human
ggaauaaagaaucugguucccc

SEQ ID NO: 871956 - RNA, 22 nt, Human
aaguuacaguuaugaaacucac

SEQ ID NO: 871957 - RNA, 23 nt, Human
ccagggccccuacaccacugucc

SEQ ID NO: 871958 - RNA, 22 nt, Human
uaaaaucaugacagauugacau

SEQ ID NO: 871959 - RNA, 21 nt, Human
gccugagcaugucuucagguc

SEQ ID NO: 871960 - RNA, 22 nt, Human
agugugggggcuuuggugucac

SEQ ID NO: 871961 - RNA, 22 nt, Human
cagguuuaguuccacacagcuc

SEQ ID NO: 871962 - RNA, 22 nt, Human
caggaagauuguggaggugguu

SEQ ID NO: 871963 - RNA, 20 nt, Human
ucucugagcuucucuugggg

SEQ ID NO: 871964 - RNA, 22 nt, Human
uucuacaauaugaauaaugaag

SEQ ID NO: 871965 - RNA, 22 nt, Human
aaagaggggacuguuaauucca

SEQ ID NO: 871966 - RNA, 22 nt, Human
gucugucucccugugacugaga

SEQ ID NO: 871967 - RNA, 22 nt, Human
uucuuuggugggagauugaggu

SEQ ID NO: 871968 - RNA, 22 nt, Human
gcagcaagucuaguuuguaggc

SEQ ID NO: 871969 - RNA, 22 nt, Human
uaguuuuaugaauugguauaau

SEQ ID NO: 871970 - RNA, 22 nt, Human
ccuguggaauagaaucuucccu

SEQ ID NO: 871971 - RNA, 22 nt, Human
uggcauuugagcuggaaggaug

SEQ ID NO: 871972 - RNA, 22 nt, Human
aaggccagcuggagggaugagg

SEQ ID NO: 871973 - RNA, 22 nt, Human
aaucagaaauucuacaucacaa

SEQ ID NO: 871974 - RNA, 22 nt, Human
aagacauucacaaauguucacu

SEQ ID NO: 871975 - RNA, 22 nt, Human
aacucacuuuguggcuucugaa

SEQ ID NO: 871976 - RNA, 22 nt, Human
uuuagacauggcuugcucacuu

SEQ ID NO: 871977 - RNA, 22 nt, Human
agcuuucuucuaguuguacagu

SEQ ID NO: 871978 - RNA, 22 nt, Human
uucuguccgcuuguuuguuaga

SEQ ID NO: 871979 - RNA, 22 nt, Human
ucaacuuggagcacauuuggcu

SEQ ID NO: 871980 - RNA, 22 nt, Human
ucuucuccaguucauccuacca

SEQ ID NO: 871981 - RNA, 22 nt, Human
cucugugaaccccuccuuucuu

SEQ ID NO: 871982 - RNA, 21 nt, Human
cagggccaauccugaccucua

SEQ ID NO: 871983 - RNA, 21 nt, Human
ucccugugagcagcucuuccu

SEQ ID NO: 871984 - RNA, 22 nt, Human
ucaggaaagaguuagaugauua

SEQ ID NO: 871985 - RNA, 22 nt, Human
ugauacaaucaugagagaggac

SEQ ID NO: 871986 - RNA, 23 nt, Human
aauaaugucuugugcucucacuu

SEQ ID NO: 871987 - RNA, 22 nt, Human
ccucagaguuuaagaugucaga

SEQ ID NO: 871988 - RNA, 22 nt, Human
caugauagguauuuaauuaaau

SEQ ID NO: 871989 - RNA, 22 nt, Human
ccugggcaauauagugaggccc

SEQ ID NO: 871990 - RNA, 22 nt, Human
aguguuucaagaagcaggaagu

SEQ ID NO: 871991 - RNA, 22 nt, Human
guucuaggcuaggggaguaaga

SEQ ID NO: 871992 - RNA, 22 nt, Human
cagguggcuaacggccucauag

SEQ ID NO: 871993 - RNA, 22 nt, Human
cucccagauuccugcuguggga

SEQ ID NO: 871994 - RNA, 22 nt, Human
cucagcagcagggaagagguca

SEQ ID NO: 871995 - RNA, 22 nt, Human
uucuaacucuacacuagcuuug

SEQ ID NO: 871996 - RNA, 22 nt, Human
cauaauauacuacauugaugaa

SEQ ID NO: 871997 - RNA, 22 nt, Human
aauagcuuggacccauugcuuu

SEQ ID NO: 871998 - RNA, 22 nt, Human
aagcagggcucccuggggacuc

SEQ ID NO: 871999 - RNA, 21 nt, Human
uuugaauagaaauagugcuua

SEQ ID NO: 872000 - RNA, 22 nt, Human
gaccacagaggugugggagaga

SEQ ID NO: 872001 - RNA, 22 nt, Human
ugcugggcucaaccuccagagc

SEQ ID NO: 872002 - RNA, 22 nt, Human
ugagcagacuugaugaggcagc

SEQ ID NO: 872003 - RNA, 21 nt, Human
uggcugagccaggugugugga

SEQ ID NO: 872004 - RNA, 22 nt, Human
aaaugucucuauugccucuggu

SEQ ID NO: 872005 - RNA, 22 nt, Human
gagagagaaggccugugggugu

SEQ ID NO: 872006 - RNA, 22 nt, Human
uauuccuuggcaaaaaauauau

SEQ ID NO: 872007 - RNA, 22 nt, Human
gcugcaagucauggcuuuugca

SEQ ID NO: 872008 - RNA, 22 nt, Human
aucuagaaguggcaugaauuac

SEQ ID NO: 872009 - RNA, 22 nt, Human
aagcagcauguggguuaucggg

SEQ ID NO: 872010 - RNA, 22 nt, Human
caagacuucaccgcucugugcu

SEQ ID NO: 872011 - RNA, 22 nt, Human
augugggccgugcggguguccu

SEQ ID NO: 872012 - RNA, 22 nt, Human
ucuggcuccacuuucuucauuu

SEQ ID NO: 872013 - RNA, 19 nt, Human
cauuuucccaucauccuuu

SEQ ID NO: 872014 - RNA, 22 nt, Human
agaaggaaaaccugucuuaugu

SEQ ID NO: 872015 - RNA, 18 nt, Human
ucaggcuggaaguuugcc

SEQ ID NO: 872016 - RNA, 18 nt, Human
aaugugaauauuuacuuc

SEQ ID NO: 872017 - RNA, 22 nt, Human
cugggcacagcguugggcucuu

SEQ ID NO: 872018 - RNA, 22 nt, Human
ggcaucucgcauucuuguuucu

SEQ ID NO: 872019 - RNA, 18 nt, Human
cugacccuggcucugggu

SEQ ID NO: 872020 - RNA, 22 nt, Human
gcccugagaaugugugugucua

SEQ ID NO: 872021 - RNA, 22 nt, Human
uuuccugcacccgcugaugcca

SEQ ID NO: 872022 - RNA, 22 nt, Human
uggaggugaaaugagauuuugu

SEQ ID NO: 872023 - RNA, 22 nt, Human
aggcucuggcuacuacagagcu

SEQ ID NO: 872024 - RNA, 22 nt, Human
gggagggcuuggacccagaugu

SEQ ID NO: 872025 - RNA, 22 nt, Human
gaaaauaguucaucacaaugau

SEQ ID NO: 872026 - RNA, 22 nt, Human
auguuuuugagauacaaacaga

SEQ ID NO: 872027 - RNA, 22 nt, Human
uggaggugggagggacuguccu

SEQ ID NO: 872028 - RNA, 22 nt, Human
acagaauauugguuacuguugc

SEQ ID NO: 872029 - RNA, 22 nt, Human
uggaauguggauaagggugucu

SEQ ID NO: 872030 - RNA, 22 nt, Human
gaacauuuauauuagauagcua

SEQ ID NO: 872031 - RNA, 22 nt, Human
cugaggcaguuuaauuuuugaa

SEQ ID NO: 872032 - RNA, 22 nt, Human
aaugguuucugaaguuaggcag

SEQ ID NO: 872033 - RNA, 22 nt, Human
guuucaauuucacuuuccaggc

SEQ ID NO: 872034 - RNA, 22 nt, Human
acaauugacuguauuuuuagcu

SEQ ID NO: 872035 - RNA, 22 nt, Human
aacaaguguauuaauggaaaua

SEQ ID NO: 872036 - RNA, 17 nt, Human
gucacugucuaaugaag

SEQ ID NO: 872037 - RNA, 22 nt, Human
ugagauaacuauucugucaacu

SEQ ID NO: 872038 - RNA, 22 nt, Human
gucccauaaguagugcaacuug

SEQ ID NO: 872039 - RNA, 20 nt, Human
aguuuagaggccaacaagcc

SEQ ID NO: 872040 - RNA, 20 nt, Human
ucagcacagcugacaagguu

SEQ ID NO: 872041 - RNA, 17 nt, Human
acacagccagguucucc

SEQ ID NO: 872042 - RNA, 22 nt, Human
aaaugggccuggaaagaggaug

SEQ ID NO: 872043 - RNA, 22 nt, Human
aaaaacuguaauuacuuuugca

SEQ ID NO: 872044 - RNA, 22 nt, Human
ugucagcaacccaucacuccca

SEQ ID NO: 872045 - RNA, 22 nt, Human
uuccuauggcucaguugcauuu

SEQ ID NO: 872046 - RNA, 21 nt, Human
gggagcugacagcagcacggc

SEQ ID NO: 872047 - RNA, 22 nt, Human
gaacaggguugggugagagagg

SEQ ID NO: 872048 - RNA, 22 nt, Human
gucagcagcauguuuaaucaaa

SEQ ID NO: 872049 - RNA, 22 nt, Human
gggcagguggcaaagccagagg

SEQ ID NO: 872050 - RNA, 22 nt, Human
auuuccaagguaauuuugagua

SEQ ID NO: 872051 - RNA, 22 nt, Human
ugauuuuacuuagcaugauguu

SEQ ID NO: 872052 - RNA, 21 nt, Human
ucucugggcccuccugugggg

SEQ ID NO: 872053 - RNA, 22 nt, Human
uggccaggcagguagaacggcc

SEQ ID NO: 872054 - RNA, 22 nt, Human
uaacacugcuucauuuuggaga

SEQ ID NO: 872055 - RNA, 22 nt, Human
ucucagaagugaucaggauguu

SEQ ID NO: 872056 - RNA, 22 nt, Human
gcugucucgccugacacuggcu

SEQ ID NO: 872057 - RNA, 23 nt, Human
ugggccagggaguccgguuucuu

SEQ ID NO: 872058 - RNA, 20 nt, Human
guauucuguauucugcucag

SEQ ID NO: 872059 - RNA, 20 nt, Human
ggcaggugcuguccccuccu

SEQ ID NO: 872060 - RNA, 22 nt, Human
ucagggcccucacuugcauagg

SEQ ID NO: 872061 - RNA, 22 nt, Human
ugaagcaguucucagaaguggg

SEQ ID NO: 872062 - RNA, 22 nt, Human
uagaaacacagaucugguguca

SEQ ID NO: 872063 - RNA, 22 nt, Human
acagaugaguuaaagcagagug

SEQ ID NO: 872064 - RNA, 22 nt, Human
ccuggcuccugccucugcaggg

SEQ ID NO: 872065 - RNA, 21 nt, Human
agccaggcaagcacccccacu

SEQ ID NO: 872066 - RNA, 22 nt, Human
uccacagguauuucuccuugcu

SEQ ID NO: 872067 - RNA, 22 nt, Human
uggcugguuuuggugagcuccg

SEQ ID NO: 872068 - RNA, 22 nt, Human
ccuggcucugaaguccacauca

SEQ ID NO: 872069 - RNA, 22 nt, Human
uuaguguacuuagugcucuaag

SEQ ID NO: 872070 - RNA, 23 nt, Human
cagcuuucagggcuuuagggaag

SEQ ID NO: 872071 - RNA, 22 nt, Human
agguauuccaguggucaccaag

SEQ ID NO: 872072 - RNA, 22 nt, Human
acagaacuggaauuggaacuca

SEQ ID NO: 872073 - RNA, 22 nt, Human
uucauguggaaaagggcuuuca

SEQ ID NO: 872074 - RNA, 22 nt, Human
gaggccugguagccgagcccca

SEQ ID NO: 872075 - RNA, 22 nt, Human
augcacauguaugucaauauuu

SEQ ID NO: 872076 - RNA, 22 nt, Human
cugaaggaagcagguggccugu

SEQ ID NO: 872077 - RNA, 22 nt, Human
uuuagugauucauuuagaaaaa

SEQ ID NO: 872078 - RNA, 22 nt, Human
uacagcagcccaccuucuucug

SEQ ID NO: 872079 - RNA, 22 nt, Human
auucacaaauaacaggugcaga

SEQ ID NO: 872080 - RNA, 22 nt, Human
cuccugggaaaugaaggggcag

SEQ ID NO: 872081 - RNA, 22 nt, Human
ccugggcagggcuggacucuca

SEQ ID NO: 872082 - RNA, 22 nt, Human
ggcugccaggagaagcucagug

SEQ ID NO: 872083 - RNA, 22 nt, Human
uccacauagucauuaauuucug

SEQ ID NO: 872084 - RNA, 22 nt, Human
uuuugccugagagugaaaauaa

SEQ ID NO: 872085 - RNA, 22 nt, Human
caguguguggauugcccuugca

SEQ ID NO: 872086 - RNA, 22 nt, Human
aucagaaacucuuagagcaggg

SEQ ID NO: 872087 - RNA, 22 nt, Human
caguuucuauggcugggcucug

SEQ ID NO: 872088 - RNA, 22 nt, Human
auacuacauuauuagagccugg

SEQ ID NO: 872089 - RNA, 22 nt, Human
ucugacagaggugguagauaca

SEQ ID NO: 872090 - RNA, 22 nt, Human
ugagaagcugcugacuuagccu

SEQ ID NO: 872091 - RNA, 22 nt, Human
cagggggcuguggcuguccagu

SEQ ID NO: 872092 - RNA, 22 nt, Human
guuuucuggcaguuauuccuua

SEQ ID NO: 872093 - RNA, 22 nt, Human
ccugcgggcugguaagaggcuu

SEQ ID NO: 872094 - RNA, 22 nt, Human
auuucaugguacaucgugacuu

SEQ ID NO: 872095 - RNA, 22 nt, Human
uugcaguugucuuuccuaauuu

SEQ ID NO: 872096 - RNA, 22 nt, Human
uuguagcagggaucagaauaca

SEQ ID NO: 872097 - RNA, 23 nt, Human
gggcccagcacaggaccuggcag

SEQ ID NO: 872098 - RNA, 22 nt, Human
uaagcauauuccagucaugucc

SEQ ID NO: 872099 - RNA, 20 nt, Human
aggagaaauucgggacaccu

SEQ ID NO: 872100 - RNA, 22 nt, Human
uugagguauugauaaaacauuu

SEQ ID NO: 872101 - RNA, 22 nt, Human
agagucuggcgcugagaugaca

SEQ ID NO: 872102 - RNA, 22 nt, Human
caggaaagagcugccaggcagg

SEQ ID NO: 872103 - RNA, 22 nt, Human
gagaggggaccugugugucuag

SEQ ID NO: 872104 - RNA, 22 nt, Human
agggaauggaugauggcagguu

SEQ ID NO: 872105 - RNA, 22 nt, Human
cacagaugaaguaaacaacucu

SEQ ID NO: 872106 - RNA, 22 nt, Human
ccuagcagggagaggauaccug

SEQ ID NO: 872107 - RNA, 22 nt, Human
aauacagaggggucacaauuca

SEQ ID NO: 872108 - RNA, 17 nt, Human
ucauuucuaggcacucc

SEQ ID NO: 872109 - RNA, 22 nt, Human
ggaggccaccugaccugcuguu

SEQ ID NO: 872110 - RNA, 22 nt, Human
uucuguuuugcacagacuugaa

SEQ ID NO: 872111 - RNA, 22 nt, Human
uccagagcuacuugcucaacuu

SEQ ID NO: 872112 - RNA, 22 nt, Human
accuuggaaaguuuaauugagg

SEQ ID NO: 872113 - RNA, 22 nt, Human
agguggagacccagagaaggcg

SEQ ID NO: 872114 - RNA, 22 nt, Human
ucacucaagcaucuacagggau

SEQ ID NO: 872115 - RNA, 22 nt, Human
agccucagggcucugcgcagac

SEQ ID NO: 872116 - RNA, 22 nt, Human
agggagagaaguuauacaagau

SEQ ID NO: 872117 - RNA, 19 nt, Human
ucauugaacauaauuacuu

SEQ ID NO: 872118 - RNA, 20 nt, Human
cagcagagacccauggggag

SEQ ID NO: 872119 - RNA, 22 nt, Human
uagacauuuagauaucucgcug

SEQ ID NO: 872120 - RNA, 22 nt, Human
uaucacauuuggagauuuauga

SEQ ID NO: 872121 - RNA, 22 nt, Human
gcugaggcugggagcagccugu

SEQ ID NO: 872122 - RNA, 22 nt, Human
aucuaagagagagagcaugucu

SEQ ID NO: 872123 - RNA, 22 nt, Human
cacagacagugucccuuuguug

SEQ ID NO: 872124 - RNA, 22 nt, Human
agcaauagauaaaacauuuacc

SEQ ID NO: 872125 - RNA, 22 nt, Human
cauuuaugaagcacuuuagagu

SEQ ID NO: 872126 - RNA, 23 nt, Human
ccauggccaaugucaagcuacua

SEQ ID NO: 872127 - RNA, 22 nt, Human
uuucauaauacuguacaugaaa

SEQ ID NO: 872128 - RNA, 22 nt, Human
agugucugcuagguucaucaac

SEQ ID NO: 872129 - RNA, 22 nt, Human
gagcugcagaagggguuuuccu

SEQ ID NO: 872130 - RNA, 22 nt, Human
ucuaaacauuaugauaguagag

SEQ ID NO: 872131 - RNA, 22 nt, Human
cuuucuuauaccugucagggcc

SEQ ID NO: 872132 - RNA, 22 nt, Human
uuuacagugucuuguugacugu

SEQ ID NO: 872133 - RNA, 22 nt, Human
aggcuggcuuugguagcauggu

SEQ ID NO: 872134 - RNA, 22 nt, Human
acuugaaacaucuuuaaaugua

SEQ ID NO: 872135 - RNA, 22 nt, Human
aauucucaggaauuucaucugu

SEQ ID NO: 872136 - RNA, 22 nt, Human
cucugagaggugagaagcagca

SEQ ID NO: 872137 - RNA, 22 nt, Human
uauguuuguuaucacaacuagg

SEQ ID NO: 872138 - RNA, 22 nt, Human
ucucuuggaacacuugcucuua

SEQ ID NO: 872139 - RNA, 22 nt, Human
aaucuuaagcugaauucucucc

SEQ ID NO: 872140 - RNA, 22 nt, Human
caucugcuguuccuuggacuca

SEQ ID NO: 872141 - RNA, 22 nt, Human
uauugcaucuuaguguaaguca

SEQ ID NO: 872142 - RNA, 22 nt, Human
acugucauuaaugaauguaaua

SEQ ID NO: 872143 - RNA, 21 nt, Human
agagauagacuagaauugaug

SEQ ID NO: 872144 - RNA, 22 nt, Human
cagauauauuuuauuuggucaa

SEQ ID NO: 872145 - RNA, 22 nt, Human
uucucuaaaauuaagugaggua

SEQ ID NO: 872146 - RNA, 22 nt, Human
uucauguuuugagccauucuga

SEQ ID NO: 872147 - RNA, 22 nt, Human
acucucugguauuggcaaguuu

SEQ ID NO: 872148 - RNA, 22 nt, Human
ucacauuguucuuaguuuaccu

SEQ ID NO: 872149 - RNA, 22 nt, Human
augaggccauggcugucacuaa

SEQ ID NO: 872150 - RNA, 22 nt, Human
uggcaaauuccaaaguuaauuc

SEQ ID NO: 872151 - RNA, 22 nt, Human
cuuauacacgaacacaaggugu

SEQ ID NO: 872152 - RNA, 22 nt, Human
cuccuaggugcucacugggguc

SEQ ID NO: 872153 - RNA, 22 nt, Human
aaucucaaagauggccagaaga

SEQ ID NO: 872154 - RNA, 22 nt, Human
agacuguagggauagaggucuu

SEQ ID NO: 872155 - RNA, 22 nt, Human
acuuccuuguacugacuccauu

SEQ ID NO: 872156 - RNA, 22 nt, Human
caucuugcuggguuuuaucaua

SEQ ID NO: 872157 - RNA, 22 nt, Human
ccugagcucaagaaggugacca

SEQ ID NO: 872158 - RNA, 20 nt, Human
uuguuucugcuauuuucuaa

SEQ ID NO: 872159 - RNA, 19 nt, Human
auagaaccugcaguuucaa

SEQ ID NO: 872160 - RNA, 22 nt, Human
gcagcuggaagugacacucugu

SEQ ID NO: 872161 - RNA, 22 nt, Human
auguuucuguccuacgagauaa

SEQ ID NO: 872162 - RNA, 22 nt, Human
cugugccuccagucucgcuucu

SEQ ID NO: 872163 - RNA, 22 nt, Human
ggcugaggggcccagaggaaca

SEQ ID NO: 872164 - RNA, 22 nt, Human
uuuacagaugaggauacugagg

SEQ ID NO: 872165 - RNA, 22 nt, Human
ugccauuuacugagauuagaag

SEQ ID NO: 872166 - RNA, 17 nt, Human
uuccaaggagcauuuga

SEQ ID NO: 872167 - RNA, 22 nt, Human
caucacuacaaauuuaagaaau

SEQ ID NO: 872168 - RNA, 22 nt, Human
acuauagcucggguuauaaugu

SEQ ID NO: 872169 - RNA, 22 nt, Human
cugagcugcucccgcugcagcg

SEQ ID NO: 872170 - RNA, 22 nt, Human
gccugcuguuaacugcaggaau

SEQ ID NO: 872171 - RNA, 22 nt, Human
aagagagaguuccuaggcaaaa

SEQ ID NO: 872172 - RNA, 22 nt, Human
cuggcugcgucugcucugacag

SEQ ID NO: 872173 - RNA, 22 nt, Human
uagcagucaucggcagagaaaa

SEQ ID NO: 872174 - RNA, 22 nt, Human
uuauuuucuccucagaaagugg

SEQ ID NO: 872175 - RNA, 22 nt, Human
uucuggacacgugacucucauu

SEQ ID NO: 872176 - RNA, 22 nt, Human
augcugugccuggaaagcggcu

SEQ ID NO: 872177 - RNA, 22 nt, Human
gcugagcaggguggggaaaggc

SEQ ID NO: 872178 - RNA, 22 nt, Human
ucucagucagccuugauguccc

SEQ ID NO: 872179 - RNA, 21 nt, Human
auucugaguugucagucuuca

SEQ ID NO: 872180 - RNA, 22 nt, Human
auuucucauguacaaaaacacu

SEQ ID NO: 872181 - RNA, 22 nt, Human
agcuuccacaucugucuucagu

SEQ ID NO: 872182 - RNA, 22 nt, Human
accugaauugucauaucuuauu

SEQ ID NO: 872183 - RNA, 22 nt, Human
aucuuuagucaggcguggguau

SEQ ID NO: 872184 - RNA, 22 nt, Human
cugccucugguuuuggucccug

SEQ ID NO: 872185 - RNA, 22 nt, Human
aaagcucugguuuggagcauuu

SEQ ID NO: 872186 - RNA, 17 nt, Human
uggaugugggaucugga

SEQ ID NO: 872187 - RNA, 22 nt, Human
agaaugcucuucaaaaucuagc

SEQ ID NO: 872188 - RNA, 22 nt, Human
caucucacagcaaacugcugaa

SEQ ID NO: 872189 - RNA, 22 nt, Human
ucacccaggauauugaagucag

SEQ ID NO: 872190 - RNA, 22 nt, Human
gacaaguuacaccugugcuuga

SEQ ID NO: 872191 - RNA, 22 nt, Human
gcagauggugccaugucuugug

SEQ ID NO: 872192 - RNA, 22 nt, Human
uagcaagcagauuagaagaucc

SEQ ID NO: 872193 - RNA, 22 nt, Human
augugugguuuaagaauugaau

SEQ ID NO: 872194 - RNA, 22 nt, Human
agcuucuuccaggcagugacuc

SEQ ID NO: 872195 - RNA, 22 nt, Human
agggaaagguagugaggucaca

SEQ ID NO: 872196 - RNA, 22 nt, Human
ccucuugauugguuggaagcgg

SEQ ID NO: 872197 - RNA, 22 nt, Human
uuucaaagaccauuaacuauca

SEQ ID NO: 872198 - RNA, 22 nt, Human
aaaggucagcugccaucguucu

SEQ ID NO: 872199 - RNA, 21 nt, Human
uuuguucaggcaaguuacagu

SEQ ID NO: 872200 - RNA, 22 nt, Human
gcugggagccccgagccagcgc

SEQ ID NO: 872201 - RNA, 22 nt, Human
uguggugccgagagucuggacg

SEQ ID NO: 872202 - RNA, 22 nt, Human
agcaaacagugugcuaagaaau

SEQ ID NO: 872203 - RNA, 22 nt, Human
acagcauugcuccaucucaaga

SEQ ID NO: 872204 - RNA, 22 nt, Human
auuaagggccaauccuccagcc

SEQ ID NO: 872205 - RNA, 22 nt, Human
uggccuggugcucaggcaguag

SEQ ID NO: 872206 - RNA, 22 nt, Human
aaggaaaucuuuguaacaucuu

SEQ ID NO: 872207 - RNA, 22 nt, Human
auucucucucuaugaaaacuga

SEQ ID NO: 872208 - RNA, 22 nt, Human
cugccuggccacaacccagggu

SEQ ID NO: 872209 - RNA, 22 nt, Human
cugaggcacagugaacuucucc

SEQ ID NO: 872210 - RNA, 22 nt, Human
aaaaauagcuucucuugucccu

SEQ ID NO: 872211 - RNA, 22 nt, Human
cauauaauguuugaagaugugg

SEQ ID NO: 872212 - RNA, 22 nt, Human
gcagggcagaccuccagccuau

SEQ ID NO: 872213 - RNA, 18 nt, Human
ugggccugcauccuaguc

SEQ ID NO: 872214 - RNA, 22 nt, Human
cuguggcuguauuuggccagag

SEQ ID NO: 872215 - RNA, 22 nt, Human
auugaagauucugacaucagaa

SEQ ID NO: 872216 - RNA, 22 nt, Human
acagacugugaguaugcauagu

SEQ ID NO: 872217 - RNA, 22 nt, Human
agcaauguuggccuauauaccu

SEQ ID NO: 872218 - RNA, 22 nt, Human
aaacaguguguuucagagaggc

SEQ ID NO: 872219 - RNA, 22 nt, Human
cagcacuaggauauacauuucc

SEQ ID NO: 872220 - RNA, 22 nt, Human
aaaacacaagaagcaggguaca

SEQ ID NO: 872221 - RNA, 22 nt, Human
gagcucaguguagucauggcuu

SEQ ID NO: 872222 - RNA, 22 nt, Human
gugcauauuuugcacacagaug

SEQ ID NO: 872223 - RNA, 22 nt, Human
uaauguaaagaagauguaggaa

SEQ ID NO: 872224 - RNA, 22 nt, Human
cugacccuuaaugagcaaguaa

SEQ ID NO: 872225 - RNA, 22 nt, Human
ccaggaaggcguuguuccucuc

SEQ ID NO: 872226 - RNA, 22 nt, Human
uuaauuuuuauguauagugugu

SEQ ID NO: 872227 - RNA, 22 nt, Human
uggcugugccucuuuccaggcc

SEQ ID NO: 872228 - RNA, 22 nt, Human
cagcuuugugacuucggacaag

SEQ ID NO: 872229 - RNA, 22 nt, Human
ggaggucauagcugugcaggua

SEQ ID NO: 872230 - RNA, 22 nt, Human
ccugccugguguaagucuaagg

SEQ ID NO: 872231 - RNA, 22 nt, Human
uuuugucaccugauuugcccac

SEQ ID NO: 872232 - RNA, 22 nt, Human
gaagucuggcugacgagaguua

SEQ ID NO: 872233 - RNA, 22 nt, Human
caggaguccugaaaucugauga

SEQ ID NO: 872234 - RNA, 22 nt, Human
acaaugugauaauuuaaagaua

SEQ ID NO: 872235 - RNA, 22 nt, Human
agaagcuugaaggagcagugac

SEQ ID NO: 872236 - RNA, 23 nt, Human
uaaauuaccuuuccagugcaggg

SEQ ID NO: 872237 - RNA, 22 nt, Human
ugcugcagcuuugucacaugca

SEQ ID NO: 872238 - RNA, 20 nt, Human
uuuuagcagaaagaaagcuc

SEQ ID NO: 872239 - RNA, 22 nt, Human
ucacaagacaagacaaauugca

SEQ ID NO: 872240 - RNA, 22 nt, Human
cagccuugauggaugaggaagu

SEQ ID NO: 872241 - RNA, 22 nt, Human
uggcccagcaguucugccccag

SEQ ID NO: 872242 - RNA, 22 nt, Human
aaaguuugagugauuugacaca

SEQ ID NO: 872243 - RNA, 22 nt, Human
uuguauuugauugucauaucgu

SEQ ID NO: 872244 - RNA, 22 nt, Human
auacaaaauauauacuggagac

SEQ ID NO: 872245 - RNA, 20 nt, Human
aggacuuguuugggcagagu

SEQ ID NO: 872246 - RNA, 22 nt, Human
cugugacugggugacaguccuc

SEQ ID NO: 872247 - RNA, 20 nt, Human
acuugcuuuugucaggaaaa

SEQ ID NO: 872248 - RNA, 22 nt, Human
cugggagaggaaccucgagggu

SEQ ID NO: 872249 - RNA, 22 nt, Human
ggucucagguagggccuaggaa

SEQ ID NO: 872250 - RNA, 22 nt, Human
gaaucuagggccuagaucacag

SEQ ID NO: 872251 - RNA, 22 nt, Human
aaauaguuacuucugcugucuu

SEQ ID NO: 872252 - RNA, 22 nt, Human
uaaaagagaauggauaacagag

SEQ ID NO: 872253 - RNA, 22 nt, Human
ucagggcaucaucaugaauaua

SEQ ID NO: 872254 - RNA, 22 nt, Human
uuguuucauggggauguuuauu

SEQ ID NO: 872255 - RNA, 22 nt, Human
uagugauuuccauuucaggguu

SEQ ID NO: 872256 - RNA, 22 nt, Human
auuccuugcacaucagauaguu

SEQ ID NO: 872257 - RNA, 22 nt, Human
cagaauuucagugauguuuucu

SEQ ID NO: 872258 - RNA, 22 nt, Human
gucacaaauccccucagcaacu

SEQ ID NO: 872259 - RNA, 22 nt, Human
ucagggagggaccugaggcugg

SEQ ID NO: 872260 - RNA, 22 nt, Human
gagcagggccacuucuguaccu

SEQ ID NO: 872261 - RNA, 22 nt, Human
aaccuucacuugcuucauuuga

SEQ ID NO: 872262 - RNA, 22 nt, Human
caagacuuagagcaucuugaaa

SEQ ID NO: 872263 - RNA, 22 nt, Human
cagaggaccuguguggccagag

SEQ ID NO: 872264 - RNA, 19 nt, Human
uguccuguccugcucugac

SEQ ID NO: 872265 - RNA, 22 nt, Human
cagcagggcccccgggugcgcc

SEQ ID NO: 872266 - RNA, 22 nt, Human
uucugagccagagucaguuaug

SEQ ID NO: 872267 - RNA, 21 nt, Human
augucuaugacauauuuccuu

SEQ ID NO: 872268 - RNA, 22 nt, Human
ugccuauucaauauaugcauuu

SEQ ID NO: 872269 - RNA, 22 nt, Human
gaauauguuugacauuuaguug

SEQ ID NO: 872270 - RNA, 22 nt, Human
caggcaugcuucugucugggca

SEQ ID NO: 872271 - RNA, 22 nt, Human
ugcaucaagaagucuaaguuug

SEQ ID NO: 872272 - RNA, 22 nt, Human
caugaggguugggguggagcuu

SEQ ID NO: 872273 - RNA, 22 nt, Human
agucugaaggcaaucugcugac

SEQ ID NO: 872274 - RNA, 22 nt, Human
uccagagaaaucuagucuuaca

SEQ ID NO: 872275 - RNA, 22 nt, Human
ccauuuuuaaagagcuuaagua

SEQ ID NO: 872276 - RNA, 22 nt, Human
ucugcaggaucagagccagagg

SEQ ID NO: 872277 - RNA, 22 nt, Human
aaauuauuuucagaauggagaa

SEQ ID NO: 872278 - RNA, 22 nt, Human
cucuucuuauggccguggcuga

SEQ ID NO: 872279 - RNA, 16 nt, Human
ugccugcucugaucuc

SEQ ID NO: 872280 - RNA, 22 nt, Human
gauaaauuaucagggguuuaaa

SEQ ID NO: 872281 - RNA, 22 nt, Human
ugucuauuaacacaagaaagga

SEQ ID NO: 872282 - RNA, 22 nt, Human
uugcuaauuuaacuaccuuguu

SEQ ID NO: 872283 - RNA, 22 nt, Human
agaagcaguuauuuuuugcaca

SEQ ID NO: 872284 - RNA, 22 nt, Human
cuguccucaccuuggcaggggg

SEQ ID NO: 872285 - RNA, 22 nt, Human
acauggcaggaaucauguguuu

SEQ ID NO: 872286 - RNA, 22 nt, Human
aauuuggagagagauuaauguu

SEQ ID NO: 872287 - RNA, 22 nt, Human
ugggaaggcguggaaguagaag

SEQ ID NO: 872288 - RNA, 22 nt, Human
auccugcuuguuacuuauagag

SEQ ID NO: 872289 - RNA, 22 nt, Human
guucaaggaagggaggaaagcc

SEQ ID NO: 872290 - RNA, 22 nt, Human
uauuaucauugguaauaugguc

SEQ ID NO: 872291 - RNA, 22 nt, Human
aucagaguggguuuuaaaagug

SEQ ID NO: 872292 - RNA, 22 nt, Human
uaagaacuucggacauguuauc

SEQ ID NO: 872293 - RNA, 22 nt, Human
caguuaaaggcccaauaucugg

SEQ ID NO: 872294 - RNA, 22 nt, Human
auguuauaguuauaaaaugagg

SEQ ID NO: 872295 - RNA, 22 nt, Human
augcuguuauucuaauguguga

SEQ ID NO: 872296 - RNA, 22 nt, Human
gcacagggcccugugcguaggu

SEQ ID NO: 872297 - RNA, 22 nt, Human
uuacagauguuucaggaauacu

SEQ ID NO: 872298 - RNA, 22 nt, Human
cugggccuagcaacagaggagu

SEQ ID NO: 872299 - RNA, 22 nt, Human
cacaggagaaaggggaagcucg

SEQ ID NO: 872300 - RNA, 22 nt, Human
ccacaaggaggacagcaguugg

SEQ ID NO: 872301 - RNA, 22 nt, Human
uggggugugcucagagcagggg

SEQ ID NO: 872302 - RNA, 22 nt, Human
cauucacaaaaccacaugccau

SEQ ID NO: 872303 - RNA, 22 nt, Human
aggggucagugaccauugagga

SEQ ID NO: 872304 - RNA, 22 nt, Human
acaguucaagacaucaguauga

SEQ ID NO: 872305 - RNA, 22 nt, Human
auugcaaaugagucuuaauaua

SEQ ID NO: 872306 - RNA, 22 nt, Human
uggguaagaauugggggcucug

SEQ ID NO: 872307 - RNA, 22 nt, Human
aacuuguuagaaaugcagaauc

SEQ ID NO: 872308 - RNA, 22 nt, Human
ccagguaggagagagggauccu

SEQ ID NO: 872309 - RNA, 22 nt, Human
aggugcuggagucugggcagga

SEQ ID NO: 872310 - RNA, 22 nt, Human
uuggcagugucugcaaaaugga

SEQ ID NO: 872311 - RNA, 22 nt, Human
auguggcuauuuuaauguuaau

SEQ ID NO: 872312 - RNA, 22 nt, Human
ugagcauagcccuucuaguguu

SEQ ID NO: 872313 - RNA, 22 nt, Human
cagggccucugugggcucucuc

SEQ ID NO: 872314 - RNA, 22 nt, Human
uucaaacagaugacucugcucu

SEQ ID NO: 872315 - RNA, 22 nt, Human
gcaguggcuaggagucuggcgu

SEQ ID NO: 872316 - RNA, 22 nt, Human
ugcuguugacggacuggcugcu

SEQ ID NO: 872317 - RNA, 22 nt, Human
aggccacagauacugugaagua

SEQ ID NO: 872318 - RNA, 22 nt, Human
uuuugugaauaguuuaucuaag

SEQ ID NO: 872319 - RNA, 22 nt, Human
gacccugguguccagguccugc

SEQ ID NO: 872320 - RNA, 20 nt, Human
ucccuccugcagauagagaa

SEQ ID NO: 872321 - RNA, 22 nt, Human
aauaggcucaaauguucuucuc

SEQ ID NO: 872322 - RNA, 22 nt, Human
gcagacacuucccacugcagcg

SEQ ID NO: 872323 - RNA, 22 nt, Human
uaggcacugaguacauauuggu

SEQ ID NO: 872324 - RNA, 22 nt, Human
caacauaugcuuucaugaggua

SEQ ID NO: 872325 - RNA, 21 nt, Human
ugaaaucugaugggacaaaug

SEQ ID NO: 872326 - RNA, 22 nt, Human
uucuaugccauguucagcuacu

SEQ ID NO: 872327 - RNA, 22 nt, Human
uuaugcuaagugaaauaagcca

SEQ ID NO: 872328 - RNA, 22 nt, Human
ugggaggacuugugggcuucau

SEQ ID NO: 872329 - RNA, 22 nt, Human
ugaagugaccuggggcagugua

SEQ ID NO: 872330 - RNA, 22 nt, Human
cagagaaagggugaauuccuuc

SEQ ID NO: 872331 - RNA, 22 nt, Human
gaaauacaaaugccuagauccu

SEQ ID NO: 872332 - RNA, 22 nt, Human
uuccuccagccuggagcacuuc

SEQ ID NO: 872333 - RNA, 22 nt, Human
ucugggugccacugucuguaca

SEQ ID NO: 872334 - RNA, 22 nt, Human
gaggggccggcaugugccucuc

SEQ ID NO: 872335 - RNA, 22 nt, Human
acuggcagcagcagcccuuggg

SEQ ID NO: 872336 - RNA, 23 nt, Human
aagcagggagauucuuagcugag

SEQ ID NO: 872337 - RNA, 22 nt, Human
uuccuggggcgacuguaucuga

SEQ ID NO: 872338 - RNA, 22 nt, Human
uuauuauuuuguguacagcaaa

SEQ ID NO: 872339 - RNA, 22 nt, Human
agacuuaggagcugacaucucu

SEQ ID NO: 872340 - RNA, 22 nt, Human
ccugagaagagcuuaugaguga

SEQ ID NO: 872341 - RNA, 22 nt, Human
cucucccuugggugggcuuugg

SEQ ID NO: 872342 - RNA, 22 nt, Human
caaauguaucagcccagggauu

SEQ ID NO: 872343 - RNA, 22 nt, Human
uccaccagcuucuucaccagcu

SEQ ID NO: 872344 - RNA, 22 nt, Human
gcacccagauagcaaggauuag

SEQ ID NO: 872345 - RNA, 17 nt, Human
cagggcugucugccuag

SEQ ID NO: 872346 - RNA, 22 nt, Human
aagcaaacaggagaagagcugu

SEQ ID NO: 872347 - RNA, 22 nt, Human
uacaaaggaggugcauagaaca

SEQ ID NO: 872348 - RNA, 22 nt, Human
uucuguuuauaauuugcaguug

SEQ ID NO: 872349 - RNA, 17 nt, Human
caggucugaggccaggc

SEQ ID NO: 872350 - RNA, 19 nt, Human
aauuuaguucuuguuuaga

SEQ ID NO: 872351 - RNA, 22 nt, Human
ugggcagacauugaguuuguuc

SEQ ID NO: 872352 - RNA, 22 nt, Human
gggcugccuuuuaauucuuccc

SEQ ID NO: 872353 - RNA, 22 nt, Human
uagaaucugauuacccuaugaa

SEQ ID NO: 872354 - RNA, 22 nt, Human
uucaaguuagagauauauuuag

SEQ ID NO: 872355 - RNA, 22 nt, Human
uuuaccuaguauaaugcaaccu

SEQ ID NO: 872356 - RNA, 18 nt, Human
agcuccuggucucaggga

SEQ ID NO: 872357 - RNA, 22 nt, Human
agggaggaguccucaaagucau

SEQ ID NO: 872358 - RNA, 22 nt, Human
cucugggcaaguaugauagaaa

SEQ ID NO: 872359 - RNA, 22 nt, Human
ccaagcuggacagcagcaagga

SEQ ID NO: 872360 - RNA, 22 nt, Human
uagaauaugugguguauacuuu

SEQ ID NO: 872361 - RNA, 22 nt, Human
uucuucagagaguagaagcaag

SEQ ID NO: 872362 - RNA, 22 nt, Human
uugcuuuagguauagaauccau

SEQ ID NO: 872363 - RNA, 22 nt, Human
caauguuuuuccuuccuuaaua

SEQ ID NO: 872364 - RNA, 22 nt, Human
agaaauguaauugcaacugucu

SEQ ID NO: 872365 - RNA, 22 nt, Human
caaauguugacuaagaggguuu

SEQ ID NO: 872366 - RNA, 22 nt, Human
ugcaaggguguuugagcugccc

SEQ ID NO: 872367 - RNA, 22 nt, Human
gaguccaggcucagaaacccgu

SEQ ID NO: 872368 - RNA, 22 nt, Human
ucagcuucuuucacuuaacaug

SEQ ID NO: 872369 - RNA, 22 nt, Human
agcugugcuguggucaucuggg

SEQ ID NO: 872370 - RNA, 22 nt, Human
uugucugaaccaucucccuggc

SEQ ID NO: 872371 - RNA, 22 nt, Human
uuguauuagcuguaaauuuucu

SEQ ID NO: 872372 - RNA, 22 nt, Human
uugggguacgcaggucugggag

SEQ ID NO: 872373 - RNA, 22 nt, Human
aaagcaaugucucugccugguu

SEQ ID NO: 872374 - RNA, 22 nt, Human
uacagaauuagauuauuagaga

SEQ ID NO: 872375 - RNA, 22 nt, Human
gcaucuuucuguccauucagca

SEQ ID NO: 872376 - RNA, 22 nt, Human
uucuguauauuguaaagacuca

SEQ ID NO: 872377 - RNA, 21 nt, Human
gccagccuguuuaccuguggu

SEQ ID NO: 872378 - RNA, 22 nt, Human
cugugcuggauucugaggcuac

SEQ ID NO: 872379 - RNA, 19 nt, Human
gcucagagacaccuguugc

SEQ ID NO: 872380 - RNA, 22 nt, Human
cuucuuucccaggcauguuuua

SEQ ID NO: 872381 - RNA, 22 nt, Human
guucaguguuugauuucugcug

SEQ ID NO: 872382 - RNA, 22 nt, Human
ccagggaugcuuucccaggacu

SEQ ID NO: 872383 - RNA, 22 nt, Human
gaagagaagcaucaauagguaa

SEQ ID NO: 872384 - RNA, 22 nt, Human
aucaucauucuuggauaaagca

SEQ ID NO: 872385 - RNA, 22 nt, Human
aggacuucugaggucaagucgc

SEQ ID NO: 872386 - RNA, 19 nt, Human
uccacagugguugaacuag

SEQ ID NO: 872387 - RNA, 22 nt, Human
uggacagggcagagaccgaguc

SEQ ID NO: 872388 - RNA, 22 nt, Human
acaguuuaggaugagagaacac

SEQ ID NO: 872389 - RNA, 22 nt, Human
guucuccacugcagagucucuc

SEQ ID NO: 872390 - RNA, 19 nt, Human
gaagaagcuugagaaguag

SEQ ID NO: 872391 - RNA, 22 nt, Human
gaaaggccaccaugccagggac

SEQ ID NO: 872392 - RNA, 20 nt, Human
aaacugucugucaguaucua

SEQ ID NO: 872393 - RNA, 22 nt, Human
cagcuguuaugagguguacaug

SEQ ID NO: 872394 - RNA, 22 nt, Human
uggccagcagaguucacucucu

SEQ ID NO: 872395 - RNA, 22 nt, Human
cccagcuccgagcuccgagccg

SEQ ID NO: 872396 - RNA, 22 nt, Human
aaacagcaauggagaagccagg

SEQ ID NO: 872397 - RNA, 22 nt, Human
gacaaggcagaaagcuuaaagg

SEQ ID NO: 872398 - RNA, 22 nt, Human
aauagcaucuucugagacaaag

SEQ ID NO: 872399 - RNA, 22 nt, Human
uguuucaugaaacauguuuagg

SEQ ID NO: 872400 - RNA, 22 nt, Human
aaauggauguugaguuaaaugu

SEQ ID NO: 872401 - RNA, 22 nt, Human
gaccuuuagugucauguuauau

SEQ ID NO: 872402 - RNA, 22 nt, Human
cugugcugauucagcacaggcc

SEQ ID NO: 872403 - RNA, 22 nt, Human
cagggucuuggcgccaucaccc

SEQ ID NO: 872404 - RNA, 21 nt, Human
agaggaagaagaguguauuau

SEQ ID NO: 872405 - RNA, 22 nt, Human
ggagguccaugugaauguggcc

SEQ ID NO: 872406 - RNA, 22 nt, Human
caguauuuuccuuguuaacuua

SEQ ID NO: 872407 - RNA, 22 nt, Human
gagaggaaagaaccaaugaccc

SEQ ID NO: 872408 - RNA, 22 nt, Human
cugcucuaagcugguggagagu

SEQ ID NO: 872409 - RNA, 19 nt, Human
uucugcuguuccuaggcug

SEQ ID NO: 872410 - RNA, 22 nt, Human
aggagaggcaucaagaaaaucg

SEQ ID NO: 872411 - RNA, 22 nt, Human
acaauucuggguauuuauauag

SEQ ID NO: 872412 - RNA, 18 nt, Human
acugcaggagaggugagg

SEQ ID NO: 872413 - RNA, 22 nt, Human
aaagugacaaccagcaggacuu

SEQ ID NO: 872414 - RNA, 22 nt, Human
agugggagggccauauggugaa

SEQ ID NO: 872415 - RNA, 21 nt, Human
auacagaaggcagacucucuc

SEQ ID NO: 872416 - RNA, 22 nt, Human
uagcuuuaggcacguuugaauu

SEQ ID NO: 872417 - RNA, 23 nt, Human
aguuccagaaaaaugcucaagca

SEQ ID NO: 872418 - RNA, 22 nt, Human
uagacacaaaucucagugacac

SEQ ID NO: 872419 - RNA, 22 nt, Human
uuaccuguuuuacaugcacaac

SEQ ID NO: 872420 - RNA, 22 nt, Human
gaguucaguaguuauagucuag

SEQ ID NO: 872421 - RNA, 20 nt, Human
cucugcugcgcaucccacuu

SEQ ID NO: 872422 - RNA, 22 nt, Human
gugggagaauggccuugcaaac

SEQ ID NO: 872423 - RNA, 22 nt, Human
aaggcuaucuggccuccuugcc

SEQ ID NO: 872424 - RNA, 22 nt, Human
uguuugcaacaacuagauggag

SEQ ID NO: 872425 - RNA, 22 nt, Human
gccagggugugcagggacagga

SEQ ID NO: 872426 - RNA, 22 nt, Human
gcaaacuguuggaguagagucu

SEQ ID NO: 872427 - RNA, 22 nt, Human
guacccaggcacgccuugcuga

SEQ ID NO: 872428 - RNA, 22 nt, Human
ggcuuggcaggugcccugcgca

SEQ ID NO: 872429 - RNA, 22 nt, Human
aggcuucuaggaaacuuucugg

SEQ ID NO: 872430 - RNA, 22 nt, Human
ggaaacaaaccacucauggugg

SEQ ID NO: 872431 - RNA, 22 nt, Human
cuugggcuuagaagguaaguga

SEQ ID NO: 872432 - RNA, 22 nt, Human
guuucauagcauauacgugugu

SEQ ID NO: 872433 - RNA, 22 nt, Human
gggagcgggacugcgcaggcuu

SEQ ID NO: 872434 - RNA, 22 nt, Human
aaucuucagugucuaaaaagca

SEQ ID NO: 872435 - RNA, 18 nt, Human
acugugugaauuagcucc

SEQ ID NO: 872436 - RNA, 22 nt, Human
aagauguuuuaauauuucgagg

SEQ ID NO: 872437 - RNA, 22 nt, Human
aggcuccaugcaaaggcuguuu

SEQ ID NO: 872438 - RNA, 22 nt, Human
uacugaaacuuuucuucaacug

SEQ ID NO: 872439 - RNA, 22 nt, Human
uccugccugagcguggaggagg

SEQ ID NO: 872440 - RNA, 22 nt, Human
caugagcauaaaucagucacga

SEQ ID NO: 872441 - RNA, 22 nt, Human
gcuaggcucggaagcagcaggg

SEQ ID NO: 872442 - RNA, 22 nt, Human
ccaaagugcugggauucaggca

SEQ ID NO: 872443 - RNA, 22 nt, Human
cugagaaauucuuucuuucacu

SEQ ID NO: 872444 - RNA, 22 nt, Human
ugagcagaaaagaaugcugagc

SEQ ID NO: 872445 - RNA, 22 nt, Human
ccagcuggagccaagguggacu

SEQ ID NO: 872446 - RNA, 22 nt, Human
caagcuggcugggagaggcacg

SEQ ID NO: 872447 - RNA, 22 nt, Human
uucacaguggcccucucugagu

SEQ ID NO: 872448 - RNA, 22 nt, Human
guucugggugaugagguuggcu

SEQ ID NO: 872449 - RNA, 22 nt, Human
cggaagcguucucagcaggggc

SEQ ID NO: 872450 - RNA, 22 nt, Human
agggagagguugaaaccucagu

SEQ ID NO: 872451 - RNA, 18 nt, Human
cuguaccacccugagggc

SEQ ID NO: 872452 - RNA, 22 nt, Human
ucaauuauuuuggcuaugcuaa

SEQ ID NO: 872453 - RNA, 22 nt, Human
aacccagccguguagcugccgc

SEQ ID NO: 872454 - RNA, 22 nt, Human
aacaggcaggagaauucugccu

SEQ ID NO: 872455 - RNA, 22 nt, Human
cccauuuagaccuauucugccc

SEQ ID NO: 872456 - RNA, 20 nt, Human
cagcaucaaaggaagguuug

SEQ ID NO: 872457 - RNA, 22 nt, Human
ucuguggccugccuccucauuu

SEQ ID NO: 872458 - RNA, 22 nt, Human
uugcagagcaguaggaauauag

SEQ ID NO: 872459 - RNA, 22 nt, Human
agugccuggcacauggaaggug

SEQ ID NO: 872460 - RNA, 22 nt, Human
cuuaggaaugcguuuccugggu

SEQ ID NO: 872461 - RNA, 22 nt, Human
uaugcuaacugggggaaaagag

SEQ ID NO: 872462 - RNA, 22 nt, Human
cugcuccuccccaucaggcagc

SEQ ID NO: 872463 - RNA, 22 nt, Human
guggccagcaagugcugccucu

SEQ ID NO: 872464 - RNA, 22 nt, Human
ugacacuuccaguuaaaaauau

SEQ ID NO: 872465 - RNA, 22 nt, Human
cagcucuggggcagagugacua

SEQ ID NO: 872466 - RNA, 22 nt, Human
cuccagggagcuguggagguuu

SEQ ID NO: 872467 - RNA, 22 nt, Human
auccagcuuugucuggucuucg

SEQ ID NO: 872468 - RNA, 22 nt, Human
aauaaaguagcguuuaaggugc

SEQ ID NO: 872469 - RNA, 22 nt, Human
uggaaagugcucuagacuuucu

SEQ ID NO: 872470 - RNA, 22 nt, Human
uagcaccuuaacucugcugcgu

SEQ ID NO: 872471 - RNA, 22 nt, Human
uugaaacaguagcucauagacc

SEQ ID NO: 872472 - RNA, 22 nt, Human
auauauacaacuagauuaaaag

SEQ ID NO: 872473 - RNA, 18 nt, Human
agacagacagguuugugc

SEQ ID NO: 872474 - RNA, 22 nt, Human
uucugguguguucucucuaggc

SEQ ID NO: 872475 - RNA, 22 nt, Human
accagaaggaccagaggcaagg

SEQ ID NO: 872476 - RNA, 22 nt, Human
uagcacacacugcaucuacaaa

SEQ ID NO: 872477 - RNA, 22 nt, Human
uccacugcagcuucugauggaa

SEQ ID NO: 872478 - RNA, 22 nt, Human
uggguagguguggccugaaugu

SEQ ID NO: 872479 - RNA, 20 nt, Human
acaguggaaauugaugucug

SEQ ID NO: 872480 - RNA, 22 nt, Human
acagagaccagcaucuucugcc

SEQ ID NO: 872481 - RNA, 22 nt, Human
augcaggaagucggggagcggg

SEQ ID NO: 872482 - RNA, 22 nt, Human
cccaggcaucccauuaaggagc

SEQ ID NO: 872483 - RNA, 22 nt, Human
ucuccugccacugcuucccauu

SEQ ID NO: 872484 - RNA, 22 nt, Human
acuguaccucaaacucuggaac

SEQ ID NO: 872485 - RNA, 22 nt, Human
auguuugaaauuguaaguauau

SEQ ID NO: 872486 - RNA, 22 nt, Human
ccugaagggacuccagagagca

SEQ ID NO: 872487 - RNA, 22 nt, Human
gguuuaaugggugaaggcauga

SEQ ID NO: 872488 - RNA, 22 nt, Human
guucuuccuggaaguggauuuc

SEQ ID NO: 872489 - RNA, 22 nt, Human
uucagauguggcuuugucaggc

SEQ ID NO: 872490 - RNA, 22 nt, Human
uucuuugguguuacccagcuca

SEQ ID NO: 872491 - RNA, 22 nt, Human
aaauacaguggcagcagauaau

SEQ ID NO: 872492 - RNA, 22 nt, Human
ggagaggcuuccagagucgugc

SEQ ID NO: 872493 - RNA, 22 nt, Human
uuaguacauucacugugguagg

SEQ ID NO: 872494 - RNA, 22 nt, Human
acacauauaugugcguguauau

SEQ ID NO: 872495 - RNA, 22 nt, Human
ucugaaauauugguaauacuuu

SEQ ID NO: 872496 - RNA, 22 nt, Human
aauguguacuuuuucaugcuca

SEQ ID NO: 872497 - RNA, 22 nt, Human
aaguuuguuguacauguuagua

SEQ ID NO: 872498 - RNA, 22 nt, Human
uuaggcaauuugauuuuucaag

SEQ ID NO: 872499 - RNA, 22 nt, Human
uuauguuaugaauggaugaucu

SEQ ID NO: 872500 - RNA, 18 nt, Human
agcugguggggagacagc

SEQ ID NO: 872501 - RNA, 22 nt, Human
ugugugaaggagccacuguuca

SEQ ID NO: 872502 - RNA, 22 nt, Human
agaugggccuucgagcaugccc

SEQ ID NO: 872503 - RNA, 21 nt, Human
uagaaagucaaagcuaucagc

SEQ ID NO: 872504 - RNA, 19 nt, Human
ggagccuggcaggggcgug

SEQ ID NO: 872505 - RNA, 21 nt, Human
cuagcacgauuccaaguaaua

SEQ ID NO: 872506 - RNA, 16 nt, Human
acagugugcuaagcau

SEQ ID NO: 872507 - RNA, 22 nt, Human
uugcuuuugugugcucucugga

SEQ ID NO: 872508 - RNA, 22 nt, Human
gacauuuaauaguauuguggga

SEQ ID NO: 872509 - RNA, 22 nt, Human
ggaggggucucuagcgaggaga

SEQ ID NO: 872510 - RNA, 20 nt, Human
cucucuccaucucaguggcc

SEQ ID NO: 872511 - RNA, 22 nt, Human
cuccaggccagggaaguggaca

SEQ ID NO: 872512 - RNA, 22 nt, Human
ccagcugcuugggaaaaugucu

SEQ ID NO: 872513 - RNA, 22 nt, Human
ugcuggagacauagcaggcagc

SEQ ID NO: 872514 - RNA, 22 nt, Human
cacaggccaauacccucucucu

SEQ ID NO: 872515 - RNA, 22 nt, Human
uggccuggcugcccugucugga

SEQ ID NO: 872516 - RNA, 22 nt, Human
agcuagaaguacagccauauga

SEQ ID NO: 872517 - RNA, 22 nt, Human
aaagacuugggagcaguaugcu

SEQ ID NO: 872518 - RNA, 22 nt, Human
acaugaggugcuauaggucuac

SEQ ID NO: 872519 - RNA, 22 nt, Human
ggcaggaagcucauguggacug

SEQ ID NO: 872520 - RNA, 22 nt, Human
ggggacaguuaaagaccaagac

SEQ ID NO: 872521 - RNA, 22 nt, Human
ccuccugggcuccugucugcac

SEQ ID NO: 872522 - RNA, 22 nt, Human
aaagcagugcaccuuaauugau

SEQ ID NO: 872523 - RNA, 22 nt, Human
gcaagcugcuuaagcucauugu

SEQ ID NO: 872524 - RNA, 22 nt, Human
cagcccugcagccauggccugu

SEQ ID NO: 872525 - RNA, 22 nt, Human
cucagcccagcccaggaccagg

SEQ ID NO: 872526 - RNA, 22 nt, Human
ugaacagaucaauagaacugac

SEQ ID NO: 872527 - RNA, 22 nt, Human
aaagauuucacaucccaagccu

SEQ ID NO: 872528 - RNA, 22 nt, Human
uucauguaauuccauaagguaa

SEQ ID NO: 872529 - RNA, 22 nt, Human
gaacauuacugcuugggagagg

SEQ ID NO: 872530 - RNA, 22 nt, Human
gaguacaucuuaauuugacuaa

SEQ ID NO: 872531 - RNA, 22 nt, Human
gcuggcaccugcaccaagcagg

SEQ ID NO: 872532 - RNA, 22 nt, Human
uguucauuuggcccuuuuguau

SEQ ID NO: 872533 - RNA, 22 nt, Human
cacaaaaguaggaggcaggcgg

SEQ ID NO: 872534 - RNA, 22 nt, Human
acuuacaaguucccuuucucag

SEQ ID NO: 872535 - RNA, 22 nt, Human
ggcugccauaacagaguaccac

SEQ ID NO: 872536 - RNA, 21 nt, Human
acagucuccccagaucucucc

SEQ ID NO: 872537 - RNA, 22 nt, Human
uuguccaaaguaacacaucuag

SEQ ID NO: 872538 - RNA, 20 nt, Human
uccagcugggaacagcugau

SEQ ID NO: 872539 - RNA, 22 nt, Human
cugugugugagaagcagguuga

SEQ ID NO: 872540 - RNA, 22 nt, Human
ccaaaauuaagccucuuauguu

SEQ ID NO: 872541 - RNA, 22 nt, Human
aaaugccugaaugguauuuggu

SEQ ID NO: 872542 - RNA, 22 nt, Human
augcauauggcuugagggaaua

SEQ ID NO: 872543 - RNA, 22 nt, Human
uugaaagaacucuucagagaua

SEQ ID NO: 872544 - RNA, 17 nt, Human
gugucuuugcuguugug

SEQ ID NO: 872545 - RNA, 22 nt, Human
uucucaugaaacucgcuuccuc

SEQ ID NO: 872546 - RNA, 22 nt, Human
gauuuguagcuuuucagucugu

SEQ ID NO: 872547 - RNA, 22 nt, Human
ggagcuccuggcagugacagag

SEQ ID NO: 872548 - RNA, 22 nt, Human
guucaguuauuucugaagauau

SEQ ID NO: 872549 - RNA, 21 nt, Human
caaaagagacugauucuugga

SEQ ID NO: 872550 - RNA, 22 nt, Human
gcuguucccauguggggcucag

SEQ ID NO: 872551 - RNA, 22 nt, Human
aggacagaccuaggacuggagc

SEQ ID NO: 872552 - RNA, 22 nt, Human
aggcugcuucuuguccuuggca

SEQ ID NO: 872553 - RNA, 21 nt, Human
ggggcagagcuaggcccugca

SEQ ID NO: 872554 - RNA, 22 nt, Human
ggcccagccuugggguuucuuu

SEQ ID NO: 872555 - RNA, 22 nt, Human
ugaagacaaagucaggcccaga

SEQ ID NO: 872556 - RNA, 22 nt, Human
auguauaugugugcacgcacag

SEQ ID NO: 872557 - RNA, 21 nt, Human
gcccagcaaggugagaaggcc

SEQ ID NO: 872558 - RNA, 22 nt, Human
ucucagaguuuuuuuccaggac

SEQ ID NO: 872559 - RNA, 22 nt, Human
ggcuuuauuugcagccauuguu

SEQ ID NO: 872560 - RNA, 22 nt, Human
aagacaauauugcugugaacgu

SEQ ID NO: 872561 - RNA, 22 nt, Human
cuggcucugucacccuuucucc

SEQ ID NO: 872562 - RNA, 22 nt, Human
cuggaauguucuccagcauggc

SEQ ID NO: 872563 - RNA, 22 nt, Human
ugcagagucccaggacccagag

SEQ ID NO: 872564 - RNA, 22 nt, Human
gagggaugguaguugacacuga

SEQ ID NO: 872565 - RNA, 22 nt, Human
ugaaaaacugaauaguugagua

SEQ ID NO: 872566 - RNA, 22 nt, Human
agcacagauggauguauucauu

SEQ ID NO: 872567 - RNA, 19 nt, Human
ugucacugucauggcccag

SEQ ID NO: 872568 - RNA, 22 nt, Human
ugaguccauugauggauaguga

SEQ ID NO: 872569 - RNA, 22 nt, Human
uuuuaagaaauguaugacuguc

SEQ ID NO: 872570 - RNA, 22 nt, Human
gacaauuucucaauauagaaac

SEQ ID NO: 872571 - RNA, 22 nt, Human
ccugaggccccugaggauagca

SEQ ID NO: 872572 - RNA, 22 nt, Human
cuugccaguguugcagaagcuc

SEQ ID NO: 872573 - RNA, 22 nt, Human
aauguccaccgugaugauggaa

SEQ ID NO: 872574 - RNA, 22 nt, Human
ugugugcucgauggcccugcag

SEQ ID NO: 872575 - RNA, 19 nt, Human
auguacccagugucaaucc

SEQ ID NO: 872576 - RNA, 22 nt, Human
aauaagaauuuacuugucaaga

SEQ ID NO: 872577 - RNA, 22 nt, Human
uuucagggaaguguugaaaagg

SEQ ID NO: 872578 - RNA, 22 nt, Human
auugaagaaacccaaauaaugg

SEQ ID NO: 872579 - RNA, 22 nt, Human
agcagaaaauuggaaaugacaa

SEQ ID NO: 872580 - RNA, 22 nt, Human
uuauuucauugauuucuaagac

SEQ ID NO: 872581 - RNA, 22 nt, Human
gcugugugcucacguaguggaa

SEQ ID NO: 872582 - RNA, 22 nt, Human
uuguacaauggaugccagauga

SEQ ID NO: 872583 - RNA, 22 nt, Human
cuggccacuggagguggcaccc

SEQ ID NO: 872584 - RNA, 22 nt, Human
gcacagaggaagcacagacucu

SEQ ID NO: 872585 - RNA, 22 nt, Human
auaguucacuaauagcaaaagc

SEQ ID NO: 872586 - RNA, 22 nt, Human
aaucucacauagcuaggaguag

SEQ ID NO: 872587 - RNA, 22 nt, Human
auugauaucaguuugcugauug

SEQ ID NO: 872588 - RNA, 22 nt, Human
uccugaggccucugugauguga

SEQ ID NO: 872589 - RNA, 22 nt, Human
gagagaaagccccugcaucccu

SEQ ID NO: 872590 - RNA, 22 nt, Human
agauccaggguuggauuugcau

SEQ ID NO: 872591 - RNA, 22 nt, Human
acucuguagccuguaagagagc

SEQ ID NO: 872592 - RNA, 19 nt, Human
uaaaaugucuguggucagu

SEQ ID NO: 872593 - RNA, 18 nt, Human
aaaguucagggagaguug

SEQ ID NO: 872594 - RNA, 22 nt, Human
gcaggagguugagccaggacug

SEQ ID NO: 872595 - RNA, 22 nt, Human
acuucaaaaugaguuuccuggu

SEQ ID NO: 872596 - RNA, 22 nt, Human
auggccagagaaggcaggguca

SEQ ID NO: 872597 - RNA, 22 nt, Human
uucaguuucguuaucuaugaga

SEQ ID NO: 872598 - RNA, 22 nt, Human
gugacugugaucuuauuugcaa

SEQ ID NO: 872599 - RNA, 22 nt, Human
aggugggguucagucucagccg

SEQ ID NO: 872600 - RNA, 22 nt, Human
ugccuggcaagaggggcuggcu

SEQ ID NO: 872601 - RNA, 22 nt, Human
ugaggcuguucuaccagggcca

SEQ ID NO: 872602 - RNA, 22 nt, Human
gcuggagugagggaccauauuu

SEQ ID NO: 872603 - RNA, 22 nt, Human
acccaggcugcuucucaguggc

SEQ ID NO: 872604 - RNA, 22 nt, Human
cuacaaagaaagcugaggggaa

SEQ ID NO: 872605 - RNA, 22 nt, Human
ggcucccuggaaaucccgaggc

SEQ ID NO: 872606 - RNA, 22 nt, Human
ucaauuaugccauugcaauauu

SEQ ID NO: 872607 - RNA, 22 nt, Human
ucacuggggccuuuggucagga

SEQ ID NO: 872608 - RNA, 22 nt, Human
ccaucccugagucacaggaggg

SEQ ID NO: 872609 - RNA, 22 nt, Human
aucauguuaaauauuucaaucu

SEQ ID NO: 872610 - RNA, 22 nt, Human
cucauaaaggcacacuuguugu

SEQ ID NO: 872611 - RNA, 22 nt, Human
ugccugggccucugaggaaggc

SEQ ID NO: 872612 - RNA, 22 nt, Human
gcagacuggucuucagccuugg

SEQ ID NO: 872613 - RNA, 22 nt, Human
uaauaauuggcuaacccuggga

SEQ ID NO: 872614 - RNA, 22 nt, Human
acacaugagaaacaucaguugu

SEQ ID NO: 872615 - RNA, 22 nt, Human
agcugucucugguauuauguga

SEQ ID NO: 872616 - RNA, 22 nt, Human
aauaaagccuuauugauuuuac

SEQ ID NO: 872617 - RNA, 18 nt, Human
aagcaggguccauugugc

SEQ ID NO: 872618 - RNA, 18 nt, Human
gcagagugcgucucugug

SEQ ID NO: 872619 - RNA, 21 nt, Human
uuacacacugcuucuagaaug

SEQ ID NO: 872620 - RNA, 22 nt, Human
cacagcuugggcucugacaaua

SEQ ID NO: 872621 - RNA, 22 nt, Human
ucaagagccagguaagcacagg

SEQ ID NO: 872622 - RNA, 22 nt, Human
gugugccaacaaaagacagugc

SEQ ID NO: 872623 - RNA, 22 nt, Human
ucuuugaaguugaaguaguugg

SEQ ID NO: 872624 - RNA, 22 nt, Human
aggcuucagacaaauguuaugg

SEQ ID NO: 872625 - RNA, 22 nt, Human
guuauuuuaacuucucaguaau

SEQ ID NO: 872626 - RNA, 22 nt, Human
gcuuucugccugggcuccauuu

SEQ ID NO: 872627 - RNA, 18 nt, Human
cuccuggcugauggugag

SEQ ID NO: 872628 - RNA, 22 nt, Human
cugagaaaccaggugcucugau

SEQ ID NO: 872629 - RNA, 22 nt, Human
cacaauuuccuugcuucacuuu

SEQ ID NO: 872630 - RNA, 22 nt, Human
auuacaacuaugugcucugcaa

SEQ ID NO: 872631 - RNA, 17 nt, Human
aggcaggagauuggaga

SEQ ID NO: 872632 - RNA, 22 nt, Human
uguuuaauaauucuaugauagu

SEQ ID NO: 872633 - RNA, 22 nt, Human
uauguaucuguucaucaguuaa

SEQ ID NO: 872634 - RNA, 22 nt, Human
auugacaagcaguaugucuuag

SEQ ID NO: 872635 - RNA, 22 nt, Human
cugcaggcaucuaacugugggc

SEQ ID NO: 872636 - RNA, 22 nt, Human
ucaugacauucaggugcuacau

SEQ ID NO: 872637 - RNA, 22 nt, Human
ggcaggcuccaagcauccuaug

SEQ ID NO: 872638 - RNA, 22 nt, Human
cccacaggcaggugcaugggcu

SEQ ID NO: 872639 - RNA, 22 nt, Human
auuucuagcagggcaggaaaga

SEQ ID NO: 872640 - RNA, 22 nt, Human
aggccuggccugggcggcauug

SEQ ID NO: 872641 - RNA, 22 nt, Human
acugaacauaugcaagaccauu

SEQ ID NO: 872642 - RNA, 22 nt, Human
cuuuauguucaguacaaugcuu

SEQ ID NO: 872643 - RNA, 22 nt, Human
cugcagcaagagaagugcugac

SEQ ID NO: 872644 - RNA, 22 nt, Human
acuguggccggaacagugggac

SEQ ID NO: 872645 - RNA, 22 nt, Human
agaagccagaggcaguggguac

SEQ ID NO: 872646 - RNA, 22 nt, Human
ggcaggacucuucugugggccg

SEQ ID NO: 872647 - RNA, 22 nt, Human
ucacccagacagcuugcacuga

SEQ ID NO: 872648 - RNA, 22 nt, Human
agucuccagaaauauagcagug

SEQ ID NO: 872649 - RNA, 22 nt, Human
uaggccacucuccuuugucuca

SEQ ID NO: 872650 - RNA, 22 nt, Human
uauauuuaauuaguugcuggau

SEQ ID NO: 872651 - RNA, 22 nt, Human
caggaaagaaaugagaacacca

SEQ ID NO: 872652 - RNA, 22 nt, Human
aagccaggagcgaggccucggc

SEQ ID NO: 872653 - RNA, 22 nt, Human
uauucuccccggaucagggcaa

SEQ ID NO: 872654 - RNA, 22 nt, Human
ggcugcccugggaggcaagggu

SEQ ID NO: 872655 - RNA, 22 nt, Human
uuucaaagucaagaaggauacu

SEQ ID NO: 872656 - RNA, 22 nt, Human
gaggggaaaacaggaauuaaca

SEQ ID NO: 872657 - RNA, 22 nt, Human
aucaucuucauauuccucagcu

SEQ ID NO: 872658 - RNA, 22 nt, Human
guuuaugaauugcauucccuuu

SEQ ID NO: 872659 - RNA, 22 nt, Human
aggaauuauaguaguauuuguc

SEQ ID NO: 872660 - RNA, 22 nt, Human
uuggguccuaaccccagagucu

SEQ ID NO: 872661 - RNA, 20 nt, Human
ggcagccaaucagcgugccg

SEQ ID NO: 872662 - RNA, 22 nt, Human
ucuucauauauaaaguggaaua

SEQ ID NO: 872663 - RNA, 22 nt, Human
ugccuaggcuggaaugcagugg

SEQ ID NO: 872664 - RNA, 22 nt, Human
auguaaacaaagaucuuccugc

SEQ ID NO: 872665 - RNA, 22 nt, Human
ggcagccuucucucauagguga

SEQ ID NO: 872666 - RNA, 22 nt, Human
acauuuuuggguugaugucuga

SEQ ID NO: 872667 - RNA, 22 nt, Human
aaauggcaguagaaaagaaucc

SEQ ID NO: 872668 - RNA, 22 nt, Human
cccaggucccgccccagcucua

SEQ ID NO: 872669 - RNA, 22 nt, Human
ugccaaauuuguaucuuaagga

SEQ ID NO: 872670 - RNA, 22 nt, Human
auuuucagcccccacucguggc

SEQ ID NO: 872671 - RNA, 23 nt, Human
uaggccagggugaccuggggaga

SEQ ID NO: 872672 - RNA, 22 nt, Human
ugcugcaguauauauuucuugg

SEQ ID NO: 872673 - RNA, 22 nt, Human
uuucaaguuuaguguguucaaa

SEQ ID NO: 872674 - RNA, 22 nt, Human
cuguuguaaagcuauucauuug

SEQ ID NO: 872675 - RNA, 22 nt, Human
uguacaauguggccaguguuaa

SEQ ID NO: 872676 - RNA, 22 nt, Human
auuaaucauuucugcauuaucu

SEQ ID NO: 872677 - RNA, 22 nt, Human
acaggacaggcugggcuagacu

SEQ ID NO: 872678 - RNA, 22 nt, Human
gcuggccugggcagaggcuaug

SEQ ID NO: 872679 - RNA, 22 nt, Human
uugaaacuuuucuuggagaaac

SEQ ID NO: 872680 - RNA, 22 nt, Human
uccuguggagaggacuggaggu

SEQ ID NO: 872681 - RNA, 21 nt, Human
uuuauguacuucauagaguag

SEQ ID NO: 872682 - RNA, 22 nt, Human
ggcuucuuccuggcuccuauua

SEQ ID NO: 872683 - RNA, 22 nt, Human
caugcuccagcuccagacaggu

SEQ ID NO: 872684 - RNA, 19 nt, Human
cagcaauaaugccagaugg

SEQ ID NO: 872685 - RNA, 22 nt, Human
uuucuaagacauuugucaucuu

SEQ ID NO: 872686 - RNA, 22 nt, Human
gcagagguguagcccccuccau

SEQ ID NO: 872687 - RNA, 22 nt, Human
aucaucuaguuuaacuuucuuu

SEQ ID NO: 872688 - RNA, 22 nt, Human
aggaggcuuuugcaggugccac

SEQ ID NO: 872689 - RNA, 22 nt, Human
gaucauuucaguccaguaaaua

SEQ ID NO: 872690 - RNA, 22 nt, Human
uucagcagucguccaggaaaag

SEQ ID NO: 872691 - RNA, 22 nt, Human
uuucucuuugacaggaaucaga

SEQ ID NO: 872692 - RNA, 22 nt, Human
auugcaaaggucccauucaaga

SEQ ID NO: 872693 - RNA, 22 nt, Human
aacacagaguauuugaagcauu

SEQ ID NO: 872694 - RNA, 20 nt, Human
agugucuggauuuuguaacc

SEQ ID NO: 872695 - RNA, 22 nt, Human
ugugugcacuuaaugcaaucau

SEQ ID NO: 872696 - RNA, 20 nt, Human
cugaggggucugacuuggac

SEQ ID NO: 872697 - RNA, 22 nt, Human
gggcagguggagggcccagcca

SEQ ID NO: 872698 - RNA, 22 nt, Human
cccagccucuggguucugccgg

SEQ ID NO: 872699 - RNA, 22 nt, Human
gucuaauaacuuucagucauuu

SEQ ID NO: 872700 - RNA, 22 nt, Human
aagcacagacacaaaaggcuuu

SEQ ID NO: 872701 - RNA, 22 nt, Human
ugggcaaggcuggagccugcag

SEQ ID NO: 872702 - RNA, 22 nt, Human
gaggaagaugguugaguggucc

SEQ ID NO: 872703 - RNA, 22 nt, Human
uuggagggacugagcuucaguc

SEQ ID NO: 872704 - RNA, 22 nt, Human
cuggcuccuccaaggccuggag

SEQ ID NO: 872705 - RNA, 22 nt, Human
gcccucucuucugcagccucca

SEQ ID NO: 872706 - RNA, 22 nt, Human
agcccuggcucccagcagcgcu

SEQ ID NO: 872707 - RNA, 22 nt, Human
gcugggagcaaagccaugcaua

SEQ ID NO: 872708 - RNA, 22 nt, Human
agggccagcacuccuggcagga

SEQ ID NO: 872709 - RNA, 22 nt, Human
cacaaaguggguggaaaacuaa

SEQ ID NO: 872710 - RNA, 22 nt, Human
uuucuaaggugauccuuucuua

SEQ ID NO: 872711 - RNA, 22 nt, Human
cagaguccaauugcucagagcg

SEQ ID NO: 872712 - RNA, 22 nt, Human
uucaggagcuggcugcgaagga

SEQ ID NO: 872713 - RNA, 22 nt, Human
aaagaguuggacuuucucaggc

SEQ ID NO: 872714 - RNA, 22 nt, Human
uacaguacagucuagacucugg

SEQ ID NO: 872715 - RNA, 22 nt, Human
auuuacagaugaugcuauuuga

SEQ ID NO: 872716 - RNA, 22 nt, Human
uuccugagucccggguaaagau

SEQ ID NO: 872717 - RNA, 22 nt, Human
aaguuaucuuugauuagaaaua

SEQ ID NO: 872718 - RNA, 20 nt, Human
caggccucugggggcccugg

SEQ ID NO: 872719 - RNA, 22 nt, Human
uaagaaacuauggagaagaacu

SEQ ID NO: 872720 - RNA, 22 nt, Human
ccagcucuagccccauguggcu

SEQ ID NO: 872721 - RNA, 20 nt, Human
agcuggagaagggcccuucc

SEQ ID NO: 872722 - RNA, 22 nt, Human
cucaggaaccgcggcagcagcc

SEQ ID NO: 872723 - RNA, 22 nt, Human
cuaaggaugcauauguuuuguu

SEQ ID NO: 872724 - RNA, 22 nt, Human
agaaaguuuauuccuaucuagc

SEQ ID NO: 872725 - RNA, 22 nt, Human
uucccuggcaugaguguaagau

SEQ ID NO: 872726 - RNA, 22 nt, Human
gcuggcugccuuacuuugugga

SEQ ID NO: 872727 - RNA, 22 nt, Human
gcaguuuaguagaugacauuau

SEQ ID NO: 872728 - RNA, 22 nt, Human
aauuaaaugacaggggaagaug

SEQ ID NO: 872729 - RNA, 22 nt, Human
ccuggcacauaguaaguacuag

SEQ ID NO: 872730 - RNA, 22 nt, Human
ggaugcugggagacagcaggca

SEQ ID NO: 872731 - RNA, 22 nt, Human
agcuuuggcccuggagguuacu

SEQ ID NO: 872732 - RNA, 23 nt, Human
gcaugcaacuugcaguaguauuc

SEQ ID NO: 872733 - RNA, 22 nt, Human
agagagcaggacuucacugagc

SEQ ID NO: 872734 - RNA, 22 nt, Human
uauuucuuucagguauguguug

SEQ ID NO: 872735 - RNA, 22 nt, Human
ccagcccuuagauaaaccuggc

SEQ ID NO: 872736 - RNA, 20 nt, Human
uuccuguccucucuuucagg

SEQ ID NO: 872737 - RNA, 23 nt, Human
ugcugggcagagcuggugcugag

SEQ ID NO: 872738 - RNA, 22 nt, Human
gcagucuuugaaugugaaauag

SEQ ID NO: 872739 - RNA, 22 nt, Human
cuucacagaauaaacucauuau

SEQ ID NO: 872740 - RNA, 22 nt, Human
aaggccacuuuaccuuaaaucc

SEQ ID NO: 872741 - RNA, 22 nt, Human
acccugagccgccaggaaggcc

SEQ ID NO: 872742 - RNA, 22 nt, Human
augcaaggguaaccccagacau

SEQ ID NO: 872743 - RNA, 22 nt, Human
gaccagucauuacucaugcccu

SEQ ID NO: 872744 - RNA, 22 nt, Human
agugucuguugcuuuugcagug

SEQ ID NO: 872745 - RNA, 22 nt, Human
aaaguuuucugccuucauuaga

SEQ ID NO: 872746 - RNA, 22 nt, Human
uccccacagcagaagaucugag

SEQ ID NO: 872747 - RNA, 22 nt, Human
agccagcuuucacaaaugaaga

SEQ ID NO: 872748 - RNA, 22 nt, Human
gccaaggaaggcuuccuggaag

SEQ ID NO: 872749 - RNA, 22 nt, Human
gccacagguacuaugggagaga

SEQ ID NO: 872750 - RNA, 22 nt, Human
uaaacauuuguuauucuuguuu

SEQ ID NO: 872751 - RNA, 22 nt, Human
agagaucugugcuuacuacaag

SEQ ID NO: 872752 - RNA, 22 nt, Human
ugaggcaggaguuaaugugcuc

SEQ ID NO: 872753 - RNA, 22 nt, Human
ggauggagaugaccauggugac

SEQ ID NO: 872754 - RNA, 19 nt, Human
cuuugcaggggauggguga

SEQ ID NO: 872755 - RNA, 22 nt, Human
auaucaaaauaaacagcaugca

SEQ ID NO: 872756 - RNA, 22 nt, Human
cagggcuccccgcaccgcagcc

SEQ ID NO: 872757 - RNA, 23 nt, Human
uucaggaaaugaauacagacaca

SEQ ID NO: 872758 - RNA, 22 nt, Human
uaugaguucaguuaucuuaagu

SEQ ID NO: 872759 - RNA, 22 nt, Human
aggccacagagagugcaugugc

SEQ ID NO: 872760 - RNA, 22 nt, Human
aagcaaagacaguuugagugga

SEQ ID NO: 872761 - RNA, 22 nt, Human
ugagcccauguagcacuuccau

SEQ ID NO: 872762 - RNA, 22 nt, Human
guguguagaugugagaggacug

SEQ ID NO: 872763 - RNA, 22 nt, Human
ucugggugcccuuugcucuguu

SEQ ID NO: 872764 - RNA, 22 nt, Human
uuggcugcucuguguuuaguau

SEQ ID NO: 872765 - RNA, 18 nt, Human
agucuuuaaagauguuac

SEQ ID NO: 872766 - RNA, 20 nt, Human
cagcaaaaugaaaauggauu

SEQ ID NO: 872767 - RNA, 22 nt, Human
ucagcucucacagaucucaacc

SEQ ID NO: 872768 - RNA, 22 nt, Human
caugaguuuuuuaguucaugca

SEQ ID NO: 872769 - RNA, 22 nt, Human
caguucugguuugcagauauau

SEQ ID NO: 872770 - RNA, 22 nt, Human
gaaggcuggggccuucucaucu

SEQ ID NO: 872771 - RNA, 22 nt, Human
agauuccucagucaugaagccu

SEQ ID NO: 872772 - RNA, 22 nt, Human
acaagaaccaaagaaggauauu

SEQ ID NO: 872773 - RNA, 22 nt, Human
uauucacaaaaugagguccuca

SEQ ID NO: 872774 - RNA, 22 nt, Human
uaaagacagauggaccagccau

SEQ ID NO: 872775 - RNA, 19 nt, Human
gagcagcugcacccauuga

SEQ ID NO: 872776 - RNA, 20 nt, Human
aacacugagggcuacucuuc

SEQ ID NO: 872777 - RNA, 22 nt, Human
agcaauguggaccagcucaggg

SEQ ID NO: 872778 - RNA, 22 nt, Human
agaacaggcaguugguuggauu

SEQ ID NO: 872779 - RNA, 22 nt, Human
agcuucauggaaccugaggcua

SEQ ID NO: 872780 - RNA, 19 nt, Human
ugcuccauugaggugucuc

SEQ ID NO: 872781 - RNA, 22 nt, Human
gagggccuacuggacaugucag

SEQ ID NO: 872782 - RNA, 22 nt, Human
aggucagagcaauguauugcuu

SEQ ID NO: 872783 - RNA, 22 nt, Human
gcacuuuagcauugguuuacac

SEQ ID NO: 872784 - RNA, 22 nt, Human
agggugucagccacggaauggg

SEQ ID NO: 872785 - RNA, 22 nt, Human
uggcagggagccaccggucaug

SEQ ID NO: 872786 - RNA, 22 nt, Human
ggucuucagcuuugcaugucuu

SEQ ID NO: 872787 - RNA, 19 nt, Human
guguagcuauuggucaaaa

SEQ ID NO: 872788 - RNA, 22 nt, Human
cauuguugcugcuucaagauau

SEQ ID NO: 872789 - RNA, 22 nt, Human
ggcugcagaaguacuuccggau

SEQ ID NO: 872790 - RNA, 22 nt, Human
cagggcucaggcucugggauuc

SEQ ID NO: 872791 - RNA, 22 nt, Human
cagucccagaagagccugggag

SEQ ID NO: 872792 - RNA, 22 nt, Human
ugggggaacuguugcgcgcggg

SEQ ID NO: 872793 - RNA, 22 nt, Human
auaaagcuuugaaauggagaua

SEQ ID NO: 872794 - RNA, 21 nt, Human
uggaaagauucaaagaccagg

SEQ ID NO: 872795 - RNA, 22 nt, Human
gcaguggcaugaugugggcuca

SEQ ID NO: 872796 - RNA, 22 nt, Human
cugcagcucuagcuuuugaccu

SEQ ID NO: 872797 - RNA, 19 nt, Human
cauauuuuugggcuggcau

SEQ ID NO: 872798 - RNA, 22 nt, Human
gagccaggguuugaaacuagac

SEQ ID NO: 872799 - RNA, 22 nt, Human
uuuccucuuauacaguguuuau

SEQ ID NO: 872800 - RNA, 22 nt, Human
uuaagauguucagauaauuugg

SEQ ID NO: 872801 - RNA, 22 nt, Human
uggcuucuggcuggugagaaau

SEQ ID NO: 872802 - RNA, 22 nt, Human
uuaguacauagaugaugguuga

SEQ ID NO: 872803 - RNA, 22 nt, Human
auccuucuaccuaggacuauuu

SEQ ID NO: 872804 - RNA, 21 nt, Human
cuggagcuuggugagaagugu

SEQ ID NO: 872805 - RNA, 22 nt, Human
aggacacaccagguccagcugu

SEQ ID NO: 872806 - RNA, 22 nt, Human
uuugacaagagggcaucuucag

SEQ ID NO: 872807 - RNA, 22 nt, Human
agaaucuuucugaaugacugug

SEQ ID NO: 872808 - RNA, 22 nt, Human
ugccucugaggaagauuguguu

SEQ ID NO: 872809 - RNA, 22 nt, Human
cucugcugucucagaugggcca

SEQ ID NO: 872810 - RNA, 22 nt, Human
aguucuuugugaguaauacaga

SEQ ID NO: 872811 - RNA, 22 nt, Human
cccagaggggucgucugagggg

SEQ ID NO: 872812 - RNA, 22 nt, Human
uuuccaaagcugaguugagcaa

SEQ ID NO: 872813 - RNA, 22 nt, Human
cucuggcagagcuguagacuuc

SEQ ID NO: 872814 - RNA, 22 nt, Human
uuggggcaugauuagauuauga

SEQ ID NO: 872815 - RNA, 22 nt, Human
uccccagacagcgggaggccug

SEQ ID NO: 872816 - RNA, 22 nt, Human
ugagcagagaugacugggcauu

SEQ ID NO: 872817 - RNA, 22 nt, Human
cacuuagaaaacuugagcaagu

SEQ ID NO: 872818 - RNA, 22 nt, Human
cuuuacaaauuagcucucggga

SEQ ID NO: 872819 - RNA, 23 nt, Human
ugugaaauuugaggucagugcuu

SEQ ID NO: 872820 - RNA, 22 nt, Human
agguaugugggugagaggagga

SEQ ID NO: 872821 - RNA, 22 nt, Human
gccucucuccuuggcuugcagu

SEQ ID NO: 872822 - RNA, 22 nt, Human
auaauaaugaaagccacugugu

SEQ ID NO: 872823 - RNA, 22 nt, Human
cucucuggaauuaaagcccaau

SEQ ID NO: 872824 - RNA, 22 nt, Human
agcuucuagcccauccagcagg

SEQ ID NO: 872825 - RNA, 22 nt, Human
acugccuuagaacaaagcagga

SEQ ID NO: 872826 - RNA, 22 nt, Human
uuucagugucaguaaugcagca

SEQ ID NO: 872827 - RNA, 20 nt, Human
uggaggcaccuguggagauc

SEQ ID NO: 872828 - RNA, 22 nt, Human
augcugaauugaugcgagggag

SEQ ID NO: 872829 - RNA, 22 nt, Human
agauggagucucacucuuguug

SEQ ID NO: 872830 - RNA, 22 nt, Human
gagcuagaguuuguaggguaga

SEQ ID NO: 872831 - RNA, 22 nt, Human
gggcaaggcagaagaguuggag

SEQ ID NO: 872832 - RNA, 22 nt, Human
guggcaggucccauuggagcag

SEQ ID NO: 872833 - RNA, 22 nt, Human
auacaggugugagggucucuuu

SEQ ID NO: 872834 - RNA, 22 nt, Human
acucucaaauauuaaucuuugg

SEQ ID NO: 872835 - RNA, 23 nt, Human
ugcuggcugaaacagccaaagga

SEQ ID NO: 872836 - RNA, 22 nt, Human
ggccccagauucugggcugggu

SEQ ID NO: 872837 - RNA, 22 nt, Human
gugccagggggcacugaacaga

SEQ ID NO: 872838 - RNA, 22 nt, Human
guuucuuaaguuacaaaaucuu

SEQ ID NO: 872839 - RNA, 22 nt, Human
ugggcuccagcaccugugcucu

SEQ ID NO: 872840 - RNA, 22 nt, Human
acauuuuuauucaucaaagcag

SEQ ID NO: 872841 - RNA, 22 nt, Human
auuuggaauucgaguaauucca

SEQ ID NO: 872842 - RNA, 22 nt, Human
ccaagggcucuggacagagugg

SEQ ID NO: 872843 - RNA, 20 nt, Human
uggaauguagucggugagag

SEQ ID NO: 872844 - RNA, 22 nt, Human
gugagcguggucuucugugggu

SEQ ID NO: 872845 - RNA, 22 nt, Human
uaaauccagcuucuaauuuaga

SEQ ID NO: 872846 - RNA, 22 nt, Human
ugaggucagcccuuccuaugau

SEQ ID NO: 872847 - RNA, 22 nt, Human
agagccugaggccaggaaaaug

SEQ ID NO: 872848 - RNA, 22 nt, Human
ucuugggagucccaggacauag

SEQ ID NO: 872849 - RNA, 22 nt, Human
gccaggcucagcagucaaccug

SEQ ID NO: 872850 - RNA, 22 nt, Human
uuagaaagaauagccuggcugc

SEQ ID NO: 872851 - RNA, 22 nt, Human
uuagcaauaugaaugcauuugc

SEQ ID NO: 872852 - RNA, 22 nt, Human
agaaagcuggagucaagcagag

SEQ ID NO: 872853 - RNA, 17 nt, Human
ucagcaaagacaaagga

SEQ ID NO: 872854 - RNA, 22 nt, Human
ugacagaaagaauaugucaauc

SEQ ID NO: 872855 - RNA, 22 nt, Human
ugcagaagaaaacagcugugug

SEQ ID NO: 872856 - RNA, 22 nt, Human
ugcuucugcucagcuuccuacu

SEQ ID NO: 872857 - RNA, 22 nt, Human
gacucuggcagcacuagggggc

SEQ ID NO: 872858 - RNA, 22 nt, Human
ccagcccuugagauggaaggga

SEQ ID NO: 872859 - RNA, 22 nt, Human
aggcauuuuuguuaaucuuugg

SEQ ID NO: 872860 - RNA, 22 nt, Human
uccaccacuuccugcagccauu

SEQ ID NO: 872861 - RNA, 22 nt, Human
acaucccacagaaacauacaua

SEQ ID NO: 872862 - RNA, 21 nt, Human
uuguuacaaugcaagaguaug

SEQ ID NO: 872863 - RNA, 22 nt, Human
ggagcugcuucuugcugugggu

SEQ ID NO: 872864 - RNA, 22 nt, Human
uaguuuguagaaaucuagaaau

SEQ ID NO: 872865 - RNA, 18 nt, Human
uuuuucugauaaaacaag

SEQ ID NO: 872866 - RNA, 22 nt, Human
cccaggcuggccuccgcagugc

SEQ ID NO: 872867 - RNA, 22 nt, Human
auucagugauucauuuguacaa

SEQ ID NO: 872868 - RNA, 22 nt, Human
guauacaugugguaaaaugcac

SEQ ID NO: 872869 - RNA, 22 nt, Human
cagagcuggcggugagaagaca

SEQ ID NO: 872870 - RNA, 22 nt, Human
cccaggaugucgaggcugcagu

SEQ ID NO: 872871 - RNA, 22 nt, Human
ucaaaguauaauugcuuuuuug

SEQ ID NO: 872872 - RNA, 22 nt, Human
aaacugcaauuacuuuugcacc

SEQ ID NO: 872873 - RNA, 22 nt, Human
gacuuuguagguaauugugucu

SEQ ID NO: 872874 - RNA, 22 nt, Human
ucaaauacauggucaaucaacu

SEQ ID NO: 872875 - RNA, 22 nt, Human
ggaggaggggugacugaaugcu

SEQ ID NO: 872876 - RNA, 22 nt, Human
acacacaaaucuauuagugaau

SEQ ID NO: 872877 - RNA, 22 nt, Human
ugucaucauuugagagaagaaa

SEQ ID NO: 872878 - RNA, 22 nt, Human
uugcaaggugauaaaagaauga

SEQ ID NO: 872879 - RNA, 22 nt, Human
ucacugaaugcagauacgugac

SEQ ID NO: 872880 - RNA, 22 nt, Human
uccaguucuaggucacucucug

SEQ ID NO: 872881 - RNA, 22 nt, Human
ccagggcuuuaucugccuuuga

SEQ ID NO: 872882 - RNA, 23 nt, Human
ggccuguguuuugucugaaguac

SEQ ID NO: 872883 - RNA, 20 nt, Human
aguggguguaaguuauugcc

SEQ ID NO: 872884 - RNA, 22 nt, Human
uacauugagcacguacuaugug

SEQ ID NO: 872885 - RNA, 22 nt, Human
uagugucuagugaguuugaugc

SEQ ID NO: 872886 - RNA, 22 nt, Human
uauuccaagugccuagaagagu

SEQ ID NO: 872887 - RNA, 22 nt, Human
cugcugucaaaggaaauauuug

SEQ ID NO: 872888 - RNA, 22 nt, Human
ucugaaaugaccuuuccccacu

SEQ ID NO: 872889 - RNA, 22 nt, Human
uccagcuugggugggaggaggu

SEQ ID NO: 872890 - RNA, 23 nt, Human
ccucagggucuagcagagagaag

SEQ ID NO: 872891 - RNA, 22 nt, Human
agcucccagaaggcccugcgcc

SEQ ID NO: 872892 - RNA, 22 nt, Human
agcaagcaggauggucaaacua

SEQ ID NO: 872893 - RNA, 22 nt, Human
gcaggagcucguuuccaggcug

SEQ ID NO: 872894 - RNA, 22 nt, Human
uuaagaggugaggccuuuaaga

SEQ ID NO: 872895 - RNA, 22 nt, Human
acacagguacacauauguaccu

SEQ ID NO: 872896 - RNA, 22 nt, Human
gggcagcacagacagugaaggc

SEQ ID NO: 872897 - RNA, 23 nt, Human
ugcagcugccucuggcgggccgg

SEQ ID NO: 872898 - RNA, 19 nt, Human
aaggcuggagaaggccucu

SEQ ID NO: 872899 - RNA, 21 nt, Human
uuugagaauuggucagagugc

SEQ ID NO: 872900 - RNA, 22 nt, Human
uuguuuuugugaggcagcccau

SEQ ID NO: 872901 - RNA, 22 nt, Human
caaauuaaugugucucaaaaua

SEQ ID NO: 872902 - RNA, 20 nt, Human
uccugagccuccaccauguc

SEQ ID NO: 872903 - RNA, 22 nt, Human
gcaugcagagucccucugcauu

SEQ ID NO: 872904 - RNA, 22 nt, Human
ucauguuauugacucauaauau

SEQ ID NO: 872905 - RNA, 22 nt, Human
gguagucaguguuaguuugauu

SEQ ID NO: 872906 - RNA, 22 nt, Human
auuauuucucacucacauaaua

SEQ ID NO: 872907 - RNA, 22 nt, Human
uuguuguagacgcgaagugacu

SEQ ID NO: 872908 - RNA, 22 nt, Human
uucuucaaccaucuacauaaac

SEQ ID NO: 872909 - RNA, 22 nt, Human
uauaaaugccaggacuuuagau

SEQ ID NO: 872910 - RNA, 22 nt, Human
ucccagagccaagcuauggaug

SEQ ID NO: 872911 - RNA, 20 nt, Human
gggagacagggccagugucc

SEQ ID NO: 872912 - RNA, 21 nt, Human
gugcugggacacagccaggcu

SEQ ID NO: 872913 - RNA, 22 nt, Human
augaggccaccuucuacauuuc

SEQ ID NO: 872914 - RNA, 22 nt, Human
uugaguacaaacucagccugag

SEQ ID NO: 872915 - RNA, 22 nt, Human
gccagguguccucacagugagg

SEQ ID NO: 872916 - RNA, 22 nt, Human
cugucagcuucuccuggccaga

SEQ ID NO: 872917 - RNA, 22 nt, Human
gcugcccuaauaucacauguua

SEQ ID NO: 872918 - RNA, 22 nt, Human
cauuuauucucagauccuuguc

SEQ ID NO: 872919 - RNA, 22 nt, Human
gagaaaugagugauucacuuuu

SEQ ID NO: 872920 - RNA, 22 nt, Human
agaaaucaugacuaagagcagu

SEQ ID NO: 872921 - RNA, 22 nt, Human
gaaaauguuagcuucauaguca

SEQ ID NO: 872922 - RNA, 22 nt, Human
ccacacugaccagcugugagac

SEQ ID NO: 872923 - RNA, 22 nt, Human
ggaaggaauuccaagacuaaag

SEQ ID NO: 872924 - RNA, 19 nt, Human
agucagcaugcaugugacu

SEQ ID NO: 872925 - RNA, 22 nt, Human
acaaugcugcagggaaauuagg

SEQ ID NO: 872926 - RNA, 22 nt, Human
gaggauguccacauggacggug

SEQ ID NO: 872927 - RNA, 22 nt, Human
augucuguccaacccugcaggg

SEQ ID NO: 872928 - RNA, 22 nt, Human
ugggcucuggagggccuaggau

SEQ ID NO: 872929 - RNA, 22 nt, Human
cugcagggcccgccugagcccu

SEQ ID NO: 872930 - RNA, 22 nt, Human
aagaaaagguaaccgcuuaucu

SEQ ID NO: 872931 - RNA, 22 nt, Human
uaaagcuauuauaguuauguuu

SEQ ID NO: 872932 - RNA, 18 nt, Human
ggcagccuacccacuugu

SEQ ID NO: 872933 - RNA, 22 nt, Human
gcaggaguucaauugcccauga

SEQ ID NO: 872934 - RNA, 22 nt, Human
uuugggaaccagaaguucaaaa

SEQ ID NO: 872935 - RNA, 22 nt, Human
ugugucuguccucgguugaugc

SEQ ID NO: 872936 - RNA, 22 nt, Human
gcucugcuguggaauccucucc

SEQ ID NO: 872937 - RNA, 22 nt, Human
cuggcucugugggaccuggccu

SEQ ID NO: 872938 - RNA, 22 nt, Human
ugcagcaauuuuuuaggcauuc

SEQ ID NO: 872939 - RNA, 22 nt, Human
agcaguggccuggggcucugug

SEQ ID NO: 872940 - RNA, 22 nt, Human
gugaccaguuggcagggguggg

SEQ ID NO: 872941 - RNA, 22 nt, Human
aacauacagugagcaguggacu

SEQ ID NO: 872942 - RNA, 22 nt, Human
cugaaaggaauaaggcucuuug

SEQ ID NO: 872943 - RNA, 22 nt, Human
cggcuggaagcuggacaggccg

SEQ ID NO: 872944 - RNA, 22 nt, Human
aagacaggaaaagcuccaggcc

SEQ ID NO: 872945 - RNA, 22 nt, Human
gagcaggccagcaauggaaggg

SEQ ID NO: 872946 - RNA, 22 nt, Human
aagcccagaugagaucccugga

SEQ ID NO: 872947 - RNA, 22 nt, Human
ugugggccucagcaggacucca

SEQ ID NO: 872948 - RNA, 22 nt, Human
aauguuccuauuuacccccuaa

SEQ ID NO: 872949 - RNA, 22 nt, Human
gggagaaggaggacugugcugu

SEQ ID NO: 872950 - RNA, 22 nt, Human
ccauuggagaguuuuaagaagg

SEQ ID NO: 872951 - RNA, 22 nt, Human
gaggcucauugcauugugcauu

SEQ ID NO: 872952 - RNA, 22 nt, Human
agucugugaaaagauaggaagu

SEQ ID NO: 872953 - RNA, 22 nt, Human
uacagcagggcgcugugaugaa

SEQ ID NO: 872954 - RNA, 22 nt, Human
acaauagaaauaauuaagcaca

SEQ ID NO: 872955 - RNA, 22 nt, Human
cugcccugacugaccuuuugaa

SEQ ID NO: 872956 - RNA, 22 nt, Human
acgccaguagacugaaccuuuc

SEQ ID NO: 872957 - RNA, 22 nt, Human
ugacaagaauuugggacuguua

SEQ ID NO: 872958 - RNA, 22 nt, Human
aaaagcaaguugccuagguuga

SEQ ID NO: 872959 - RNA, 22 nt, Human
uccagggcauggggagagagug

SEQ ID NO: 872960 - RNA, 22 nt, Human
aaagacuaaaugaaugagcuca

SEQ ID NO: 872961 - RNA, 22 nt, Human
uaagacacauugagaaacacaa

SEQ ID NO: 872962 - RNA, 22 nt, Human
acagacugaagauauuuccccc

SEQ ID NO: 872963 - RNA, 22 nt, Human
ugcaaaguugaggaaggcaugg

SEQ ID NO: 872964 - RNA, 22 nt, Human
accugaauccccagggccuucc

SEQ ID NO: 872965 - RNA, 22 nt, Human
uuauguaccucuuucugcuuca

SEQ ID NO: 872966 - RNA, 22 nt, Human
gacuguacuugagagaggaacu

SEQ ID NO: 872967 - RNA, 19 nt, Human
uggcuucuucgguguuccc

SEQ ID NO: 872968 - RNA, 22 nt, Human
auuucaguguuuuaagaguuca

SEQ ID NO: 872969 - RNA, 21 nt, Human
cacaccaaacaggaacaggga

SEQ ID NO: 872970 - RNA, 22 nt, Human
uagaaacaucagcuaaccaaaa

SEQ ID NO: 872971 - RNA, 22 nt, Human
gaggggagaggcuuauggauca

SEQ ID NO: 872972 - RNA, 22 nt, Human
ugggcagcagcaaagccagacu

SEQ ID NO: 872973 - RNA, 22 nt, Human
cuauuuuaagaggccauuaggu

SEQ ID NO: 872974 - RNA, 22 nt, Human
uuuggaaugacagauaucaaua

SEQ ID NO: 872975 - RNA, 22 nt, Human
cuucagaaacuaguaacagcua

SEQ ID NO: 872976 - RNA, 22 nt, Human
auauucauugaacaccuacuac

SEQ ID NO: 872977 - RNA, 22 nt, Human
acagaguuaauggauaggcagg

SEQ ID NO: 872978 - RNA, 22 nt, Human
ccagagagaaaauggagggcca

SEQ ID NO: 872979 - RNA, 22 nt, Human
uaacaaagguugccaaacuaag

SEQ ID NO: 872980 - RNA, 22 nt, Human
agcagagaccauauagcccaga

SEQ ID NO: 872981 - RNA, 22 nt, Human
aguggcugguaguuacugagca

SEQ ID NO: 872982 - RNA, 22 nt, Human
ggcuuuauuuugcaugaaugcu

SEQ ID NO: 872983 - RNA, 17 nt, Human
ucgguuugccaggcuuc

SEQ ID NO: 872984 - RNA, 22 nt, Human
aagugacauaaaaucucccagg

SEQ ID NO: 872985 - RNA, 22 nt, Human
gaaaguuuucauauauaccaaa

SEQ ID NO: 872986 - RNA, 22 nt, Human
agcuguuuuugugggcauguga

SEQ ID NO: 872987 - RNA, 22 nt, Human
cccuuggcuucuauggguuuuc

SEQ ID NO: 872988 - RNA, 22 nt, Human
aggaagccaugguggacgucua

SEQ ID NO: 872989 - RNA, 22 nt, Human
gccuggagugcaguggcgugau

SEQ ID NO: 872990 - RNA, 22 nt, Human
uuucacaaguaaaguccuaagu

SEQ ID NO: 872991 - RNA, 22 nt, Human
uccaggccugcaaugacaaagc

SEQ ID NO: 872992 - RNA, 22 nt, Human
gccuggcugagguggggaggca

SEQ ID NO: 872993 - RNA, 18 nt, Human
auaaagugcuaauaaugg

SEQ ID NO: 872994 - RNA, 22 nt, Human
caguaaaugagaagcuaguaau

SEQ ID NO: 872995 - RNA, 22 nt, Human
agggcgaggagacggaggcaca

SEQ ID NO: 872996 - RNA, 22 nt, Human
aggagagggguaggauuaauuu

SEQ ID NO: 872997 - RNA, 21 nt, Human
ucagaggcugggggaaugccc

SEQ ID NO: 872998 - RNA, 22 nt, Human
acaguucuuuggauggaagaau

SEQ ID NO: 872999 - RNA, 22 nt, Human
ugggagaagacguacuuuagac

SEQ ID NO: 873000 - RNA, 22 nt, Human
gggccuuccgacucccaaggcc

SEQ ID NO: 873001 - RNA, 23 nt, Human
uuuuagugacuccuuuaucugcc

SEQ ID NO: 873002 - RNA, 22 nt, Human
aaggcagccaugugcuuugggu

SEQ ID NO: 873003 - RNA, 22 nt, Human
aagcacagauaaaacaggauuc

SEQ ID NO: 873004 - RNA, 23 nt, Human
auccugcugauggcccuccagga

SEQ ID NO: 873005 - RNA, 19 nt, Human
acacuguagauauagcuau

SEQ ID NO: 873006 - RNA, 22 nt, Human
uccagggcuggguuggcucagc

SEQ ID NO: 873007 - RNA, 22 nt, Human
aaugucuaugaaaugaaaggga

SEQ ID NO: 873008 - RNA, 22 nt, Human
uagcaaagaaccugauacccca

SEQ ID NO: 873009 - RNA, 20 nt, Human
uuacaaguuucuaauaacca

SEQ ID NO: 873010 - RNA, 22 nt, Human
aacacaaagaagcugcaggauc

SEQ ID NO: 873011 - RNA, 22 nt, Human
cuacccuguauuuagagaugca

SEQ ID NO: 873012 - RNA, 22 nt, Human
gcagacuguaucaaugucagua

SEQ ID NO: 873013 - RNA, 19 nt, Human
uggcaguguggcuuccaga

SEQ ID NO: 873014 - RNA, 22 nt, Human
ucagaaaggccacauggugcag

SEQ ID NO: 873015 - RNA, 22 nt, Human
acagacauuuucuguauugccu

SEQ ID NO: 873016 - RNA, 22 nt, Human
gcagcugucagaaguuggaauc

SEQ ID NO: 873017 - RNA, 22 nt, Human
acucugagaacugagauucccu

SEQ ID NO: 873018 - RNA, 22 nt, Human
ugaaggaagaauaggcaguguu

SEQ ID NO: 873019 - RNA, 22 nt, Human
uuucugaggaauuaauacagaa

SEQ ID NO: 873020 - RNA, 22 nt, Human
aaacauugcuaaauaaugcugc

SEQ ID NO: 873021 - RNA, 22 nt, Human
uaauuuuacuuccugagcaccu

SEQ ID NO: 873022 - RNA, 22 nt, Human
cauucugcauuuggaaggggca

SEQ ID NO: 873023 - RNA, 22 nt, Human
ucagggcugcauacaggagaua

SEQ ID NO: 873024 - RNA, 22 nt, Human
ugcuacuacuugucaacgguca

SEQ ID NO: 873025 - RNA, 22 nt, Human
ggugaggggcgccucugcccgg

SEQ ID NO: 873026 - RNA, 22 nt, Human
ugacccuuugcuuccucauugu

SEQ ID NO: 873027 - RNA, 22 nt, Human
gcccugaaauauuuccacggcc

SEQ ID NO: 873028 - RNA, 22 nt, Human
uucaugcugugucuacaacuua

SEQ ID NO: 873029 - RNA, 22 nt, Human
gggcacuggaggccaaggagcu

SEQ ID NO: 873030 - RNA, 22 nt, Human
cugcauaugauagaugccuugc

SEQ ID NO: 873031 - RNA, 22 nt, Human
uacauugacucucugucccuaa

SEQ ID NO: 873032 - RNA, 22 nt, Human
ucuguuuaugcauauuuaaaac

SEQ ID NO: 873033 - RNA, 22 nt, Human
gggucuucgccgccgccauaac

SEQ ID NO: 873034 - RNA, 22 nt, Human
gcaaauauuucuaauuccugaa

SEQ ID NO: 873035 - RNA, 22 nt, Human
ucugaaggugcuagagaaagcu

SEQ ID NO: 873036 - RNA, 22 nt, Human
gcaggagcuggaaagugauguu

SEQ ID NO: 873037 - RNA, 22 nt, Human
aaaugucuuuaucucauguaac

SEQ ID NO: 873038 - RNA, 22 nt, Human
cugagaaaugcauuuuuccagc

SEQ ID NO: 873039 - RNA, 22 nt, Human
aggccaggguagggcccauugu

SEQ ID NO: 873040 - RNA, 22 nt, Human
cuccuagguaacagggugguuu

SEQ ID NO: 873041 - RNA, 22 nt, Human
agggcuugccauugccuguuag

SEQ ID NO: 873042 - RNA, 23 nt, Human
uucuuuggaauugggcugcaagg

SEQ ID NO: 873043 - RNA, 22 nt, Human
ccaaguccugcugccacucuac

SEQ ID NO: 873044 - RNA, 22 nt, Human
uuucugauucucacuuuggcau

SEQ ID NO: 873045 - RNA, 18 nt, Human
gaaaauacucugggcuca

SEQ ID NO: 873046 - RNA, 22 nt, Human
ucccuuagggcugggugggugu

SEQ ID NO: 873047 - RNA, 21 nt, Human
gaccccagaccagcagacaca

SEQ ID NO: 873048 - RNA, 22 nt, Human
ggaaaucucuacuuugucauuu

SEQ ID NO: 873049 - RNA, 22 nt, Human
gaggaccacagaugagccugca

SEQ ID NO: 873050 - RNA, 22 nt, Human
gugugcagaggcaggaggugcu

SEQ ID NO: 873051 - RNA, 19 nt, Human
uacuuauuagaaauauggg

SEQ ID NO: 873052 - RNA, 22 nt, Human
gggugugucuuuugcuccugga

SEQ ID NO: 873053 - RNA, 21 nt, Human
guucaaauggguagauucaca

SEQ ID NO: 873054 - RNA, 22 nt, Human
ucagagguaagggcugagagga

SEQ ID NO: 873055 - RNA, 22 nt, Human
ugcugcuuggaaauggggcuga

SEQ ID NO: 873056 - RNA, 22 nt, Human
uggggccagcggggaggacuca

SEQ ID NO: 873057 - RNA, 21 nt, Human
cagaggucauccugaggacaa

SEQ ID NO: 873058 - RNA, 22 nt, Human
uuucaguuugucggccuuggac

SEQ ID NO: 873059 - RNA, 22 nt, Human
gagcucuggcagggcaggucug

SEQ ID NO: 873060 - RNA, 22 nt, Human
guacauauuaaaggucuauaaa

SEQ ID NO: 873061 - RNA, 22 nt, Human
uagcagcacauggugguuuuau

SEQ ID NO: 873062 - RNA, 20 nt, Human
ucucuaacaugaaugcuauc

SEQ ID NO: 873063 - RNA, 22 nt, Human
ugaagauuuaagcaucucaauu

SEQ ID NO: 873064 - RNA, 22 nt, Human
uguuggaauaagugcuugaagg

SEQ ID NO: 873065 - RNA, 22 nt, Human
auuuaguuuaggaaaaguaggu

SEQ ID NO: 873066 - RNA, 22 nt, Human
gcaggcccagagucgcuggccu

SEQ ID NO: 873067 - RNA, 22 nt, Human
uacaaagucacauugaaaugaa

SEQ ID NO: 873068 - RNA, 20 nt, Human
uacaagaauccccaguuguc

SEQ ID NO: 873069 - RNA, 22 nt, Human
uauuaucagagcuauuuggaau

SEQ ID NO: 873070 - RNA, 22 nt, Human
aaggcuuguagauuugggcuuu

SEQ ID NO: 873071 - RNA, 22 nt, Human
agacuguaugauuugaguuuau

SEQ ID NO: 873072 - RNA, 22 nt, Human
agccaccuccugcucugcucac

SEQ ID NO: 873073 - RNA, 22 nt, Human
ucaccccuacauuucccuugcu

SEQ ID NO: 873074 - RNA, 22 nt, Human
agucacauaguguuuuggaauc

SEQ ID NO: 873075 - RNA, 22 nt, Human
acuuuaugcuaaacuuuacucu

SEQ ID NO: 873076 - RNA, 22 nt, Human
guggccuagaggugcaaggaac

SEQ ID NO: 873077 - RNA, 22 nt, Human
uauuuucaccuucucuggauau

SEQ ID NO: 873078 - RNA, 22 nt, Human
ggcaggugcaccugagccaucu

SEQ ID NO: 873079 - RNA, 22 nt, Human
uggggcuguggauucucacgaa

SEQ ID NO: 873080 - RNA, 22 nt, Human
uucaaagaccuuacuuggcaaa

SEQ ID NO: 873081 - RNA, 22 nt, Human
uaagagacuuaagaauaauuga

SEQ ID NO: 873082 - RNA, 22 nt, Human
caggagucuguuccucauuugu

SEQ ID NO: 873083 - RNA, 22 nt, Human
aaugauauuuauugaauagaug

SEQ ID NO: 873084 - RNA, 22 nt, Human
gucaggagaggccaucagcuuu

SEQ ID NO: 873085 - RNA, 22 nt, Human
ugcuccuggcaucucugcgucc

SEQ ID NO: 873086 - RNA, 22 nt, Human
gucuuuggaaagacaaaguuca

SEQ ID NO: 873087 - RNA, 22 nt, Human
ucuuccuauggggcugcaggaa

SEQ ID NO: 873088 - RNA, 22 nt, Human
ugcaaacaauuuccuauaaagu

SEQ ID NO: 873089 - RNA, 22 nt, Human
gaggcuucccgcccaugcugga

SEQ ID NO: 873090 - RNA, 22 nt, Human
uggugucuccauccugcccugc

SEQ ID NO: 873091 - RNA, 20 nt, Human
auguuuaauguuguccaccc

SEQ ID NO: 873092 - RNA, 22 nt, Human
auggaauggccugucauaaucu

SEQ ID NO: 873093 - RNA, 22 nt, Human
uucugcuuuuagcuaaacuaua

SEQ ID NO: 873094 - RNA, 22 nt, Human
agcugcagucaagcugggccac

SEQ ID NO: 873095 - RNA, 22 nt, Human
uaggaagaagcagccuugcuua

SEQ ID NO: 873096 - RNA, 22 nt, Human
gggcugcuuuuuucuuagcaga

SEQ ID NO: 873097 - RNA, 22 nt, Human
aguaauaaacucuuuuuaucuc

SEQ ID NO: 873098 - RNA, 22 nt, Human
cagagcagucuggagauccagc

SEQ ID NO: 873099 - RNA, 22 nt, Human
cuguuucucccauguccaagug

SEQ ID NO: 873100 - RNA, 22 nt, Human
uaacaggcaaggucacaccuug

SEQ ID NO: 873101 - RNA, 22 nt, Human
aaauaagcacuuaacuguauca

SEQ ID NO: 873102 - RNA, 22 nt, Human
agggagcuguggucagcucagu

SEQ ID NO: 873103 - RNA, 22 nt, Human
aacuuucugucugagcugcaga

SEQ ID NO: 873104 - RNA, 23 nt, Human
acacagaagaagacccaaggaag

SEQ ID NO: 873105 - RNA, 22 nt, Human
gcaggagcaaacugcagugugg

SEQ ID NO: 873106 - RNA, 22 nt, Human
ucaaggcuauuaauucugugag

SEQ ID NO: 873107 - RNA, 22 nt, Human
uccauuuagcuggcaaacaaug

SEQ ID NO: 873108 - RNA, 21 nt, Human
guacaagcucaccaaguggac

SEQ ID NO: 873109 - RNA, 22 nt, Human
aggucucugcagaaaguaaguc

SEQ ID NO: 873110 - RNA, 22 nt, Human
gccaggugggagacagacagca

SEQ ID NO: 873111 - RNA, 22 nt, Human
cagagcugcacauucuaugaug

SEQ ID NO: 873112 - RNA, 22 nt, Human
ucagcuuugaucucaggcaauc

SEQ ID NO: 873113 - RNA, 22 nt, Human
gugguggaugucuguaaucuca

SEQ ID NO: 873114 - RNA, 22 nt, Human
ucagugcagaauagugaugcau

SEQ ID NO: 873115 - RNA, 22 nt, Human
acagcugugggcucugcauaua

SEQ ID NO: 873116 - RNA, 21 nt, Human
ucacaggcucagggagagagu

SEQ ID NO: 873117 - RNA, 22 nt, Human
guugggguaccuugaggcuggg

SEQ ID NO: 873118 - RNA, 22 nt, Human
uaguacaguuuaaauauuaaua

SEQ ID NO: 873119 - RNA, 22 nt, Human
gcugccacucugagcuugcuuc

SEQ ID NO: 873120 - RNA, 22 nt, Human
gaaaggagugaauauuugugac

SEQ ID NO: 873121 - RNA, 22 nt, Human
ucaggcaggcucagaggaaaac

SEQ ID NO: 873122 - RNA, 22 nt, Human
cacacagcuagugacaggagaa

SEQ ID NO: 873123 - RNA, 20 nt, Human
uccugagauuuaagggguuc

SEQ ID NO: 873124 - RNA, 22 nt, Human
ucagauuuauguggcuaggcuc

SEQ ID NO: 873125 - RNA, 20 nt, Human
ucaauuuucuacaacauuug

SEQ ID NO: 873126 - RNA, 22 nt, Human
guacacacaaucucuggucagu

SEQ ID NO: 873127 - RNA, 22 nt, Human
cagggccauaucuugugcacca

SEQ ID NO: 873128 - RNA, 22 nt, Human
cagaagcagugagagaugugca

SEQ ID NO: 873129 - RNA, 22 nt, Human
gaagaacacuucaugauucauu

SEQ ID NO: 873130 - RNA, 22 nt, Human
uuucuuaugggguaguccuuua

SEQ ID NO: 873131 - RNA, 22 nt, Human
aaauagcagaagcagagggggu

SEQ ID NO: 873132 - RNA, 22 nt, Human
uguucuugggaaucuuacaguu

SEQ ID NO: 873133 - RNA, 22 nt, Human
ccaagcaaauaaucacccacua

SEQ ID NO: 873134 - RNA, 22 nt, Human
ugcagaggcgccgugggugggg

SEQ ID NO: 873135 - RNA, 22 nt, Human
acaggcuguugggguccagggu

SEQ ID NO: 873136 - RNA, 22 nt, Human
ccugccugcguccucugagggc

SEQ ID NO: 873137 - RNA, 22 nt, Human
uuguuuacuaagaaccugguca

SEQ ID NO: 873138 - RNA, 22 nt, Human
ugcaugugucgggccugugcua

SEQ ID NO: 873139 - RNA, 22 nt, Human
uuucauuauaaaaaguuggcuu

SEQ ID NO: 873140 - RNA, 22 nt, Human
agaaucuuggaacucagaucac

SEQ ID NO: 873141 - RNA, 22 nt, Human
gcagggugccgacuucagggau

SEQ ID NO: 873142 - RNA, 22 nt, Human
caggaaaugaacaggaaugaac

SEQ ID NO: 873143 - RNA, 22 nt, Human
agauggggcugaaaguuccaau

SEQ ID NO: 873144 - RNA, 20 nt, Human
agaacaaguacuaaaggaga

SEQ ID NO: 873145 - RNA, 22 nt, Human
ugugacugaagugucuagaccu

SEQ ID NO: 873146 - RNA, 22 nt, Human
uuuauauuaccuggaauagcuu

SEQ ID NO: 873147 - RNA, 22 nt, Human
cccaggcuggcacugcugaagu

SEQ ID NO: 873148 - RNA, 22 nt, Human
uguguaaaaugagccuaaaguc

SEQ ID NO: 873149 - RNA, 22 nt, Human
gggaagcugaagcuagagaaaa

SEQ ID NO: 873150 - RNA, 19 nt, Human
acugccugaggcucacagg

SEQ ID NO: 873151 - RNA, 18 nt, Human
ucagccuguugucugccu

SEQ ID NO: 873152 - RNA, 22 nt, Human
auuauucagucuuguaaggagu

SEQ ID NO: 873153 - RNA, 22 nt, Human
ucugugcccucggugcugggcc

SEQ ID NO: 873154 - RNA, 22 nt, Human
ggugugggggcagcucugauau

SEQ ID NO: 873155 - RNA, 22 nt, Human
gccuggcuauggccucccccau

SEQ ID NO: 873156 - RNA, 22 nt, Human
uaacauuaaaagagauaauuga

SEQ ID NO: 873157 - RNA, 22 nt, Human
uggucugccuggaucacagccc

SEQ ID NO: 873158 - RNA, 22 nt, Human
ugugugugugcgcgcacgcaua

SEQ ID NO: 873159 - RNA, 22 nt, Human
gucaaacaaauuaacauaucca

SEQ ID NO: 873160 - RNA, 23 nt, Human
uguguacacaauagaugagguuu

SEQ ID NO: 873161 - RNA, 22 nt, Human
ucuucagguagugaguggggug

SEQ ID NO: 873162 - RNA, 22 nt, Human
gagguggcuuagucucuggaca

SEQ ID NO: 873163 - RNA, 22 nt, Human
ucauggaugauagcuucauugc

SEQ ID NO: 873164 - RNA, 22 nt, Human
gccaagcuggaugaagagguug

SEQ ID NO: 873165 - RNA, 22 nt, Human
uguccugcaagcccuaaugaau

SEQ ID NO: 873166 - RNA, 22 nt, Human
uucagcacugacugagugguua

SEQ ID NO: 873167 - RNA, 22 nt, Human
aauacuugggcugagauuuuug

SEQ ID NO: 873168 - RNA, 22 nt, Human
uaucagugauugcuguauacaa

SEQ ID NO: 873169 - RNA, 23 nt, Human
augcacaagccagcaggggacag

SEQ ID NO: 873170 - RNA, 22 nt, Human
aggugggcggauucaugagguc

SEQ ID NO: 873171 - RNA, 22 nt, Human
aacaguuaucucacauauggaa

SEQ ID NO: 873172 - RNA, 22 nt, Human
cugggucccacagccugcuggg

SEQ ID NO: 873173 - RNA, 22 nt, Human
ugggauagggcuauugcucaca

SEQ ID NO: 873174 - RNA, 22 nt, Human
ccuuuguaccuuaaauccugug

SEQ ID NO: 873175 - RNA, 22 nt, Human
ugguaaaugcuauuccuauauu

SEQ ID NO: 873176 - RNA, 22 nt, Human
ccagagcuucggggcggcugua

SEQ ID NO: 873177 - RNA, 22 nt, Human
acucucucacagcuuggcugau

SEQ ID NO: 873178 - RNA, 22 nt, Human
cugcagggacccaagucuuugg

SEQ ID NO: 873179 - RNA, 22 nt, Human
gcggggcccccggccgagcucu

SEQ ID NO: 873180 - RNA, 22 nt, Human
aaauccuaaugacaaguuuagu

SEQ ID NO: 873181 - RNA, 20 nt, Human
caggagggacauuucagcau

SEQ ID NO: 873182 - RNA, 22 nt, Human
ugucuccuaaugucuguuuccu

SEQ ID NO: 873183 - RNA, 22 nt, Human
cagccagagaaagggcacugcc

SEQ ID NO: 873184 - RNA, 22 nt, Human
uaccugggcccaccagugccug

SEQ ID NO: 873185 - RNA, 23 nt, Human
guuaccuuacuucugugaucuuc

SEQ ID NO: 873186 - RNA, 22 nt, Human
accagccaccaccaggagaucg

SEQ ID NO: 873187 - RNA, 22 nt, Human
uuggucuugaguggcuuguuaa

SEQ ID NO: 873188 - RNA, 22 nt, Human
uuccagagucagccacugggag

SEQ ID NO: 873189 - RNA, 22 nt, Human
acagaacauggauuuuugaagu

SEQ ID NO: 873190 - RNA, 22 nt, Human
agggaugugcagcauccagaca

SEQ ID NO: 873191 - RNA, 22 nt, Human
augaccugaggccuuacucuag

SEQ ID NO: 873192 - RNA, 22 nt, Human
gcugggagcaaguacucaucuu

SEQ ID NO: 873193 - RNA, 22 nt, Human
ggacacagcugcagccacaccc

SEQ ID NO: 873194 - RNA, 22 nt, Human
caccaggagcaucuaggaggcg

SEQ ID NO: 873195 - RNA, 22 nt, Human
gcuuuagacauaaaguucuuca

SEQ ID NO: 873196 - RNA, 22 nt, Human
ucagcacucgcuaccuaguaaa

SEQ ID NO: 873197 - RNA, 22 nt, Human
uccuuugguuguagacaggaau

SEQ ID NO: 873198 - RNA, 22 nt, Human
acaaauagaaaaucuggauugg

SEQ ID NO: 873199 - RNA, 18 nt, Human
gcuucucauuucuaagca

SEQ ID NO: 873200 - RNA, 22 nt, Human
uuuuguaagaaacugccaagcc

SEQ ID NO: 873201 - RNA, 22 nt, Human
uagaauucaagauucaacaggc

SEQ ID NO: 873202 - RNA, 22 nt, Human
gaauggcuaucggauuauuagg

SEQ ID NO: 873203 - RNA, 22 nt, Human
ccaaacuguuucguauuuaugc

SEQ ID NO: 873204 - RNA, 22 nt, Human
ugcaaucucggcacuuugggag

SEQ ID NO: 873205 - RNA, 22 nt, Human
auguggcuaguccaauuaauga

SEQ ID NO: 873206 - RNA, 22 nt, Human
agaaagcuggaagagcugggau

SEQ ID NO: 873207 - RNA, 22 nt, Human
acaggucagauaaaggcuggug

SEQ ID NO: 873208 - RNA, 22 nt, Human
gucuccagggcugcuggcgccu

SEQ ID NO: 873209 - RNA, 22 nt, Human
ccagagccucgcccggagccuc

SEQ ID NO: 873210 - RNA, 22 nt, Human
ucuggaauuaaacucaggagac

SEQ ID NO: 873211 - RNA, 22 nt, Human
auagaaacagggaagcaaagca

SEQ ID NO: 873212 - RNA, 22 nt, Human
ucuuuuccuccucuuguuggcc

SEQ ID NO: 873213 - RNA, 22 nt, Human
uuuugccugugaauacuaucuu

SEQ ID NO: 873214 - RNA, 22 nt, Human
ucuuucaaugugaaaccaugua

SEQ ID NO: 873215 - RNA, 22 nt, Human
ggcaggcgugguggccucagaa

SEQ ID NO: 873216 - RNA, 22 nt, Human
gugcagcaaaguuugagauaua

SEQ ID NO: 873217 - RNA, 22 nt, Human
ggcaggcaucaucaguugauca

SEQ ID NO: 873218 - RNA, 22 nt, Human
ucaagauauagaggguucuaga

SEQ ID NO: 873219 - RNA, 22 nt, Human
auuucucaguguacauuauguu

SEQ ID NO: 873220 - RNA, 22 nt, Human
uacagcuggacugguagcugug

SEQ ID NO: 873221 - RNA, 22 nt, Human
ucuggccauggcaagccgagug

SEQ ID NO: 873222 - RNA, 22 nt, Human
uucagaagguaggaaugucccu

SEQ ID NO: 873223 - RNA, 22 nt, Human
uggcuuccuccagagcaggagg

SEQ ID NO: 873224 - RNA, 22 nt, Human
aaaucaguuguuauauuaaaga

SEQ ID NO: 873225 - RNA, 22 nt, Human
uaaggugugguaguuuaguucu

SEQ ID NO: 873226 - RNA, 22 nt, Human
agucaggaaaagcuuuccugga

SEQ ID NO: 873227 - RNA, 22 nt, Human
cuggggugagcagaaacagggg

SEQ ID NO: 873228 - RNA, 22 nt, Human
guacaacaugauuuuacucucu

SEQ ID NO: 873229 - RNA, 22 nt, Human
uguggcaggaagagcuucugag

SEQ ID NO: 873230 - RNA, 22 nt, Human
gagggagaauugcagccagcgu

SEQ ID NO: 873231 - RNA, 22 nt, Human
aaaucuagaaguuuaaaaggau

SEQ ID NO: 873232 - RNA, 22 nt, Human
cagggggcucaaaggagagugc

SEQ ID NO: 873233 - RNA, 20 nt, Human
ucuguuauuauuacauugcc

SEQ ID NO: 873234 - RNA, 22 nt, Human
cugucucucuaggacacugggg

SEQ ID NO: 873235 - RNA, 22 nt, Human
cuucccccaaaucaagagaccu

SEQ ID NO: 873236 - RNA, 22 nt, Human
ggaaagaaagugugaacaacuu

SEQ ID NO: 873237 - RNA, 22 nt, Human
augcuacaggaagacgucaggc

SEQ ID NO: 873238 - RNA, 22 nt, Human
cuugcaggcagggccuccugga

SEQ ID NO: 873239 - RNA, 22 nt, Human
gggcagagacucagaaacagaa

SEQ ID NO: 873240 - RNA, 22 nt, Human
gcauugaaggacuuccauuaua

SEQ ID NO: 873241 - RNA, 22 nt, Human
uaagcaagauuuauugaauuuu

SEQ ID NO: 873242 - RNA, 22 nt, Human
cuggcuccucuacacacccaaa

SEQ ID NO: 873243 - RNA, 18 nt, Human
acacacacaccuguguau

SEQ ID NO: 873244 - RNA, 23 nt, Human
ggcaccaggccauggagcgggag

SEQ ID NO: 873245 - RNA, 22 nt, Human
augggcagagcuggugggaggc

SEQ ID NO: 873246 - RNA, 22 nt, Human
gaggaggaaacccuguuccucu

SEQ ID NO: 873247 - RNA, 22 nt, Human
agggcucagccagccugugugc

SEQ ID NO: 873248 - RNA, 22 nt, Human
uuggcugguaagccaaaugaaa

SEQ ID NO: 873249 - RNA, 22 nt, Human
uuauacauguguuuugagauga

SEQ ID NO: 873250 - RNA, 22 nt, Human
uuggaaaugauuucuauuauua

SEQ ID NO: 873251 - RNA, 22 nt, Human
cccugaguuaguacaguugagu

SEQ ID NO: 873252 - RNA, 22 nt, Human
aucuuggggaauccucugugua

SEQ ID NO: 873253 - RNA, 22 nt, Human
uccacagauaaaaacagagguu

SEQ ID NO: 873254 - RNA, 22 nt, Human
ugucugaguuagcucuucucag

SEQ ID NO: 873255 - RNA, 22 nt, Human
gaagauugaaggcugggaauua

SEQ ID NO: 873256 - RNA, 22 nt, Human
ccagugccuaucuccucuggga

SEQ ID NO: 873257 - RNA, 23 nt, Human
cugaccugacccauaagcaagga

SEQ ID NO: 873258 - RNA, 22 nt, Human
ucucuagugccaugaaaguccu

SEQ ID NO: 873259 - RNA, 22 nt, Human
auuauucucuggaggaaagauu

SEQ ID NO: 873260 - RNA, 22 nt, Human
ugacaucuggcuugugcccugc

SEQ ID NO: 873261 - RNA, 22 nt, Human
guagcagcagagcagguccucc

SEQ ID NO: 873262 - RNA, 22 nt, Human
ugugcagugugaccagggcugc

SEQ ID NO: 873263 - RNA, 21 nt, Human
gcaaggccuaucauggcagcu

SEQ ID NO: 873264 - RNA, 22 nt, Human
gggcucaggaguuugaggcugc

SEQ ID NO: 873265 - RNA, 22 nt, Human
aauaacuucaucuucaggauag

SEQ ID NO: 873266 - RNA, 22 nt, Human
ucagguccucugggucccagcc

SEQ ID NO: 873267 - RNA, 22 nt, Human
ugugugcaagugacauuagaaa

SEQ ID NO: 873268 - RNA, 22 nt, Human
ugaaggaaugaguauacuguuu

SEQ ID NO: 873269 - RNA, 18 nt, Human
caagaaucucuaaagaag

SEQ ID NO: 873270 - RNA, 22 nt, Human
ccagccucaucauauuccugcu

SEQ ID NO: 873271 - RNA, 20 nt, Human
ugagccugcuguaggaggcc

SEQ ID NO: 873272 - RNA, 22 nt, Human
cucacagaugcugugggucagg

SEQ ID NO: 873273 - RNA, 22 nt, Human
uagcacaagcaacuacugaagu

SEQ ID NO: 873274 - RNA, 22 nt, Human
gugacagagugagacccugucu

SEQ ID NO: 873275 - RNA, 22 nt, Human
ccaugugucuccccuggaagua

SEQ ID NO: 873276 - RNA, 22 nt, Human
guggccugccgugugguauggg

SEQ ID NO: 873277 - RNA, 22 nt, Human
gggaagauaguguugagggccc

SEQ ID NO: 873278 - RNA, 20 nt, Human
ugggagcuggugaggucuca

SEQ ID NO: 873279 - RNA, 22 nt, Human
cgggaaaguuccacagauggau

SEQ ID NO: 873280 - RNA, 22 nt, Human
gugacucuuaccuacccagccu

SEQ ID NO: 873281 - RNA, 22 nt, Human
gagcagagucuauuuccacacu

SEQ ID NO: 873282 - RNA, 22 nt, Human
uuucccaaguguaaacauggca

SEQ ID NO: 873283 - RNA, 22 nt, Human
ugcagggcagauaugacuguag

SEQ ID NO: 873284 - RNA, 22 nt, Human
ggcagagcauucgauggaccug

SEQ ID NO: 873285 - RNA, 21 nt, Human
uggcagagugcagucuauaca

SEQ ID NO: 873286 - RNA, 22 nt, Human
uucacauuaucaggauuguuuc

SEQ ID NO: 873287 - RNA, 22 nt, Human
uuggaauuccuguuguuucguc

SEQ ID NO: 873288 - RNA, 22 nt, Human
gcucugaggaccaauuccugug

SEQ ID NO: 873289 - RNA, 22 nt, Human
ccugcugugucccuggcuuucu

SEQ ID NO: 873290 - RNA, 22 nt, Human
gacugagaaacaguacauuacc

SEQ ID NO: 873291 - RNA, 22 nt, Human
aucucagggguuccuucuagag

SEQ ID NO: 873292 - RNA, 22 nt, Human
gagcagcaagcacucaaaggcu

SEQ ID NO: 873293 - RNA, 22 nt, Human
uuagaucauuuugaacuaauuu

SEQ ID NO: 873294 - RNA, 22 nt, Human
cuggucccugaguaguuaugca

SEQ ID NO: 873295 - RNA, 22 nt, Human
ugagaaacacaggcaugaauag

SEQ ID NO: 873296 - RNA, 22 nt, Human
gcucuaugggcacagccagugu

SEQ ID NO: 873297 - RNA, 22 nt, Human
ucagugucauaucaagaagaug

SEQ ID NO: 873298 - RNA, 22 nt, Human
gacagaugagggaguauucuca

SEQ ID NO: 873299 - RNA, 22 nt, Human
acaagcauaagugagaugaaua

SEQ ID NO: 873300 - RNA, 22 nt, Human
cccaguggugcuggcaucugug

SEQ ID NO: 873301 - RNA, 22 nt, Human
uuuacccaguaacugcuuggcu

SEQ ID NO: 873302 - RNA, 22 nt, Human
cacacccaaauucuaacaguag

SEQ ID NO: 873303 - RNA, 22 nt, Human
uuggcagcccagcuuacuagca

SEQ ID NO: 873304 - RNA, 22 nt, Human
cugagccauccauaccagcuua

SEQ ID NO: 873305 - RNA, 22 nt, Human
cugcagcuccugagcucagaga

SEQ ID NO: 873306 - RNA, 23 nt, Human
auacugaaacuguuguuuaucug

SEQ ID NO: 873307 - RNA, 22 nt, Human
caggacaagagggaaucgauaa

SEQ ID NO: 873308 - RNA, 22 nt, Human
gccacuggcgcugugcagagug

SEQ ID NO: 873309 - RNA, 22 nt, Human
auccuuccuucauuugacaggu

SEQ ID NO: 873310 - RNA, 22 nt, Human
guacaguacuucagaaccagcc

SEQ ID NO: 873311 - RNA, 22 nt, Human
cauuucacacauaaacuugggu

SEQ ID NO: 873312 - RNA, 22 nt, Human
auuuagcaaaaaaugaugaagc

SEQ ID NO: 873313 - RNA, 22 nt, Human
aucugcauguaucucucugcau

SEQ ID NO: 873314 - RNA, 22 nt, Human
acaacaaucuacccuagcuucu

SEQ ID NO: 873315 - RNA, 22 nt, Human
cuuuucaugagucuguuauggg

SEQ ID NO: 873316 - RNA, 22 nt, Human
agagguucaaacuucauaauuu

SEQ ID NO: 873317 - RNA, 22 nt, Human
gagcuggugugugcccgagcac

SEQ ID NO: 873318 - RNA, 22 nt, Human
ugcaggguguccggaggaucac

SEQ ID NO: 873319 - RNA, 22 nt, Human
uuguguguagacucagccauug

SEQ ID NO: 873320 - RNA, 22 nt, Human
gcccugacacuuugcagcugag

SEQ ID NO: 873321 - RNA, 22 nt, Human
uagcacaauaucaugucuguga

SEQ ID NO: 873322 - RNA, 22 nt, Human
aagcccugccacccauucacug

SEQ ID NO: 873323 - RNA, 22 nt, Human
aggaaugacauagaaaggggag

SEQ ID NO: 873324 - RNA, 22 nt, Human
cuagaaggaagcccagcacuuc

SEQ ID NO: 873325 - RNA, 22 nt, Human
agcagcauuaugauauaucuua

SEQ ID NO: 873326 - RNA, 22 nt, Human
uuagagauacauuuguagcuug

SEQ ID NO: 873327 - RNA, 22 nt, Human
aguucuaaacacuugaggaacc

SEQ ID NO: 873328 - RNA, 22 nt, Human
cugaggggucgugggagcccag

SEQ ID NO: 873329 - RNA, 22 nt, Human
cacauauaccucuucuugaguu

SEQ ID NO: 873330 - RNA, 22 nt, Human
ucucuuggaaagcuugcccacu

SEQ ID NO: 873331 - RNA, 22 nt, Human
aggcuccaggcaaaauuucgga

SEQ ID NO: 873332 - RNA, 22 nt, Human
ugcauacuuuuaaugacuguuu

SEQ ID NO: 873333 - RNA, 22 nt, Human
cugauaauguccugcaguaaau

SEQ ID NO: 873334 - RNA, 22 nt, Human
aaguucuaacaggaggucucuu

SEQ ID NO: 873335 - RNA, 22 nt, Human
ggcagcaucccauggaccgcau

SEQ ID NO: 873336 - RNA, 22 nt, Human
auuuaagaggcugcuagaguau

SEQ ID NO: 873337 - RNA, 22 nt, Human
uuucuagaaaccaagauauugu

SEQ ID NO: 873338 - RNA, 22 nt, Human
aucuuugaaucaaugaaucagu

SEQ ID NO: 873339 - RNA, 22 nt, Human
cucuggaggccuaaggaagugg

SEQ ID NO: 873340 - RNA, 22 nt, Human
cuacacuagaguugcaauggaa

SEQ ID NO: 873341 - RNA, 22 nt, Human
uuggaacaugccgggguccagg

SEQ ID NO: 873342 - RNA, 22 nt, Human
aaaaagagaaaugcucuagucc

SEQ ID NO: 873343 - RNA, 22 nt, Human
aaucagagcaagacauggaaca

SEQ ID NO: 873344 - RNA, 19 nt, Human
auagcagcuauacccagau

SEQ ID NO: 873345 - RNA, 22 nt, Human
agggucagggagugaguauuua

SEQ ID NO: 873346 - RNA, 22 nt, Human
uggaaugucaaaagucugcuau

SEQ ID NO: 873347 - RNA, 22 nt, Human
cagcaccugcucuuagacacgg

SEQ ID NO: 873348 - RNA, 22 nt, Human
auccugcaggggguuuuauuca

SEQ ID NO: 873349 - RNA, 22 nt, Human
cuuccuggcaugggucucauga

SEQ ID NO: 873350 - RNA, 22 nt, Human
cugcucuccccaggccagucug

SEQ ID NO: 873351 - RNA, 22 nt, Human
ccacugcccaccccgacgucua

SEQ ID NO: 873352 - RNA, 22 nt, Human
caaggcugucuccagcuuccaa

SEQ ID NO: 873353 - RNA, 22 nt, Human
gggcuccagcccgggaccaggu

SEQ ID NO: 873354 - RNA, 22 nt, Human
cucaggauauugggcuggagca

SEQ ID NO: 873355 - RNA, 22 nt, Human
caggaggagcauuagcgucuca

SEQ ID NO: 873356 - RNA, 23 nt, Human
cucaccaagcgccgccgcugugu

SEQ ID NO: 873357 - RNA, 23 nt, Human
acagacuguauucaaaguaggac

SEQ ID NO: 873358 - RNA, 22 nt, Human
uuucaaauaccauaaaccuaau

SEQ ID NO: 873359 - RNA, 21 nt, Human
ugauucucugacugucggaca

SEQ ID NO: 873360 - RNA, 22 nt, Human
ucugccugcggcugcagguggc

SEQ ID NO: 873361 - RNA, 22 nt, Human
ggggaagaaaucuggguucuuc

SEQ ID NO: 873362 - RNA, 18 nt, Human
auccugggagcagacagc

SEQ ID NO: 873363 - RNA, 21 nt, Human
agcugccuccacuucugaggc

SEQ ID NO: 873364 - RNA, 22 nt, Human
caacuuuagaccccaaguagcu

SEQ ID NO: 873365 - RNA, 22 nt, Human
gggauuucaccauguugguugg

SEQ ID NO: 873366 - RNA, 22 nt, Human
gcacugguaucaccugagagcu

SEQ ID NO: 873367 - RNA, 22 nt, Human
ccugacaguccuuuucuagugu

SEQ ID NO: 873368 - RNA, 19 nt, Human
uggcauugguccagauaaa

SEQ ID NO: 873369 - RNA, 22 nt, Human
caagguuuacauugggcuauca

SEQ ID NO: 873370 - RNA, 22 nt, Human
ccucaggccucugccucauugg

SEQ ID NO: 873371 - RNA, 22 nt, Human
gaagagagagugggguucugcg

SEQ ID NO: 873372 - RNA, 22 nt, Human
cauuuguuaaugcugcuuuuaa

SEQ ID NO: 873373 - RNA, 20 nt, Human
gcaugcuuggagagagagaa

SEQ ID NO: 873374 - RNA, 22 nt, Human
ugggaagcugcauuuuaacaag

SEQ ID NO: 873375 - RNA, 22 nt, Human
augugagggcucaggcugacug

SEQ ID NO: 873376 - RNA, 19 nt, Human
gcccucaggcagcuccauc

SEQ ID NO: 873377 - RNA, 22 nt, Human
cugggaugauagugcuaguauu

SEQ ID NO: 873378 - RNA, 22 nt, Human
cagucaggggugggaucaaggc

SEQ ID NO: 873379 - RNA, 22 nt, Human
uucuagaauccuugucuacuuu

SEQ ID NO: 873380 - RNA, 22 nt, Human
ugaggccccgaagcugagguuu

SEQ ID NO: 873381 - RNA, 22 nt, Human
cugcuguggguuaagacacugu

SEQ ID NO: 873382 - RNA, 22 nt, Human
gcagacagaagcuaaguagaca

SEQ ID NO: 873383 - RNA, 19 nt, Human
gggagagccaggcucaccc

SEQ ID NO: 873384 - RNA, 20 nt, Human
uccuggccucccuggggcuc

SEQ ID NO: 873385 - RNA, 22 nt, Human
ccacagaaugaugacacuucag

SEQ ID NO: 873386 - RNA, 22 nt, Human
agguuaggaaauagggcuguaa

SEQ ID NO: 873387 - RNA, 20 nt, Human
caaaagcaaugaaguuauga

SEQ ID NO: 873388 - RNA, 22 nt, Human
ugcaucuuacguuuugaaaggg

SEQ ID NO: 873389 - RNA, 20 nt, Human
aaaauagccccaggcucauu

SEQ ID NO: 873390 - RNA, 22 nt, Human
uuucagugugagugucuuauuu

SEQ ID NO: 873391 - RNA, 22 nt, Human
aaagagaacuuuuacccaagaa

SEQ ID NO: 873392 - RNA, 22 nt, Human
auagcaguaacacugacauuuu

SEQ ID NO: 873393 - RNA, 23 nt, Human
aggggcagcaaguuuugguguua

SEQ ID NO: 873394 - RNA, 22 nt, Human
uucagagccagcaacacuaggc

SEQ ID NO: 873395 - RNA, 22 nt, Human
ugaggcugagauaucagggagg

SEQ ID NO: 873396 - RNA, 22 nt, Human
augcuuuacgacaaaaaacuca

SEQ ID NO: 873397 - RNA, 22 nt, Human
gcaggccaagcccucgcagaga

SEQ ID NO: 873398 - RNA, 22 nt, Human
caaaaaacaccugugugaguau

SEQ ID NO: 873399 - RNA, 22 nt, Human
ugcccacucuuuugauuugugu

SEQ ID NO: 873400 - RNA, 22 nt, Human
gcuucuguggugcaucuuugcu

SEQ ID NO: 873401 - RNA, 22 nt, Human
agggccaguucuaccucugaau

SEQ ID NO: 873402 - RNA, 22 nt, Human
caugcagggacuugugcuccau

SEQ ID NO: 873403 - RNA, 22 nt, Human
ugccccugaugccuagaacaga

SEQ ID NO: 873404 - RNA, 22 nt, Human
aggagacaguuuggacguguag

SEQ ID NO: 873405 - RNA, 22 nt, Human
uuugcugggcucugugccagac

SEQ ID NO: 873406 - RNA, 16 nt, Human
uagggcugggaaggag

SEQ ID NO: 873407 - RNA, 18 nt, Human
gucuuuggaguggaggua

SEQ ID NO: 873408 - RNA, 22 nt, Human
uuucucucuauuuagacaggua

SEQ ID NO: 873409 - RNA, 22 nt, Human
ccucagaagaaguggaauugau

SEQ ID NO: 873410 - RNA, 22 nt, Human
gaugugugugcccugggccugc

SEQ ID NO: 873411 - RNA, 22 nt, Human
aagagggaagucaccuggaggu

SEQ ID NO: 873412 - RNA, 22 nt, Human
cagaggcugggaccucaggcau

SEQ ID NO: 873413 - RNA, 22 nt, Human
ucccauuuauuaauuaguuugc

SEQ ID NO: 873414 - RNA, 22 nt, Human
caugagugcuauaugugaagag

SEQ ID NO: 873415 - RNA, 22 nt, Human
guuuagaacacggaaauacuga

SEQ ID NO: 873416 - RNA, 22 nt, Human
ucaaggaagauagcuauuauga

SEQ ID NO: 873417 - RNA, 22 nt, Human
agccagggggacgcuuucuggc

SEQ ID NO: 873418 - RNA, 22 nt, Human
ucugcuguguccccugugcggg

SEQ ID NO: 873419 - RNA, 22 nt, Human
gacucugugggaggaggcucag

SEQ ID NO: 873420 - RNA, 22 nt, Human
cccaggcagcggggucuccuug

SEQ ID NO: 873421 - RNA, 22 nt, Human
uucaaaggaaaggcagugucaa

SEQ ID NO: 873422 - RNA, 22 nt, Human
gagcaggcuugcagagaagggg

SEQ ID NO: 873423 - RNA, 22 nt, Human
uugcuaauuuguauaaugaaaa

SEQ ID NO: 873424 - RNA, 22 nt, Human
uucugagcugcaacacuaacau

SEQ ID NO: 873425 - RNA, 22 nt, Human
ucuacaaagccauucaggaucu

SEQ ID NO: 873426 - RNA, 22 nt, Human
ggccucggcccacugcugcggu

SEQ ID NO: 873427 - RNA, 22 nt, Human
caaucaguaaccggaucauggu

SEQ ID NO: 873428 - RNA, 22 nt, Human
uagauauaagguccuuagaaca

SEQ ID NO: 873429 - RNA, 22 nt, Human
aagucacagaguuggaagucag

SEQ ID NO: 873430 - RNA, 22 nt, Human
ucaggacaauagugauuuuuac

SEQ ID NO: 873431 - RNA, 22 nt, Human
uuuucucaggugcuuaucuaag

SEQ ID NO: 873432 - RNA, 22 nt, Human
uaaaaugguaacuuucauuugc

SEQ ID NO: 873433 - RNA, 22 nt, Human
gugcgggccuggggguuucucu

SEQ ID NO: 873434 - RNA, 22 nt, Human
ugugcgcgugcagcggaguguu

SEQ ID NO: 873435 - RNA, 22 nt, Human
agcuccagggaaagaguggauc

SEQ ID NO: 873436 - RNA, 22 nt, Human
ggcucugcagagggcccagcuu

SEQ ID NO: 873437 - RNA, 22 nt, Human
cuuggugcaggggacagggcaa

SEQ ID NO: 873438 - RNA, 22 nt, Human
uauacacauauacguuugugug

SEQ ID NO: 873439 - RNA, 22 nt, Human
auguuuugcuggauguuggcua

SEQ ID NO: 873440 - RNA, 22 nt, Human
gauucaaaguuaaugaagaugc

SEQ ID NO: 873441 - RNA, 22 nt, Human
aaugcauauguaggcaagcagu

SEQ ID NO: 873442 - RNA, 22 nt, Human
uguuuuguuagcacucugggaa

SEQ ID NO: 873443 - RNA, 22 nt, Human
uaggccaccaggguuccauuua

SEQ ID NO: 873444 - RNA, 22 nt, Human
aggaaugacaggccucccgcag

SEQ ID NO: 873445 - RNA, 22 nt, Human
cacagggcuuugauggcugagu

SEQ ID NO: 873446 - RNA, 22 nt, Human
gucuagcaaugaugaugagcua

SEQ ID NO: 873447 - RNA, 22 nt, Human
uugagguaauaaacagccauuc

SEQ ID NO: 873448 - RNA, 22 nt, Human
uuauuauuccccaagucauuau

SEQ ID NO: 873449 - RNA, 22 nt, Human
auaaagcucuuaguagcagccu

SEQ ID NO: 873450 - RNA, 22 nt, Human
auccaaagauggaaagaacuuu

SEQ ID NO: 873451 - RNA, 23 nt, Human
aggcaaggguguaaaggaaauga

SEQ ID NO: 873452 - RNA, 22 nt, Human
ugucugugggcaacgccuccca

SEQ ID NO: 873453 - RNA, 22 nt, Human
gcugcuuuagaauugaaacaga

SEQ ID NO: 873454 - RNA, 22 nt, Human
caucuucagguucauggucaua

SEQ ID NO: 873455 - RNA, 22 nt, Human
acacuuuuaagacuuuaaugaa

SEQ ID NO: 873456 - RNA, 22 nt, Human
ugagcagagacuucaagggcag

SEQ ID NO: 873457 - RNA, 22 nt, Human
ccuagagcucugcuuuaucuaa

SEQ ID NO: 873458 - RNA, 22 nt, Human
uggagcuggaauuucugggccu

SEQ ID NO: 873459 - RNA, 22 nt, Human
caggcaguggccauguugggag

SEQ ID NO: 873460 - RNA, 22 nt, Human
ugacccugaaauguagugguuu

SEQ ID NO: 873461 - RNA, 22 nt, Human
aauuauuuaacuccuuuggaga

SEQ ID NO: 873462 - RNA, 22 nt, Human
uguggaagggacacuggacugg

SEQ ID NO: 873463 - RNA, 22 nt, Human
uuugcucuugcuggaaaaguug

SEQ ID NO: 873464 - RNA, 22 nt, Human
aggcagagagcaguggccgucu

SEQ ID NO: 873465 - RNA, 22 nt, Human
uguggcagaguaaggacccagu

SEQ ID NO: 873466 - RNA, 22 nt, Human
gugggcuggauuugcuugcaga

SEQ ID NO: 873467 - RNA, 22 nt, Human
gcauucuuccugggcugggggc

SEQ ID NO: 873468 - RNA, 22 nt, Human
gagagggauacugaguuuuggu

SEQ ID NO: 873469 - RNA, 22 nt, Human
ucagcuugcuaaaagggcaucu

SEQ ID NO: 873470 - RNA, 22 nt, Human
guaagaggagugggaagccuca

SEQ ID NO: 873471 - RNA, 22 nt, Human
uugugcucccucccgucuggcc

SEQ ID NO: 873472 - RNA, 22 nt, Human
cucaaguuggcaugaacaaauu

SEQ ID NO: 873473 - RNA, 22 nt, Human
uucuuaaguuuagcaacuugug

SEQ ID NO: 873474 - RNA, 23 nt, Human
acugggcugaaauuaaagguguc

SEQ ID NO: 873475 - RNA, 22 nt, Human
uucuuuuagaauuuccuaaggu

SEQ ID NO: 873476 - RNA, 20 nt, Human
ucuuuuauuggcagauccug

SEQ ID NO: 873477 - RNA, 22 nt, Human
caugcaucgaugaaugcguggg

SEQ ID NO: 873478 - RNA, 22 nt, Human
cccuuagaacaacauuagcaua

SEQ ID NO: 873479 - RNA, 22 nt, Human
ggaccagagcucgggcuucuca

SEQ ID NO: 873480 - RNA, 22 nt, Human
cugggagaugacucagagcagg

SEQ ID NO: 873481 - RNA, 22 nt, Human
cuuuaugugcugggcauuaagg

SEQ ID NO: 873482 - RNA, 22 nt, Human
aggguaagcuuggggcuggcag

SEQ ID NO: 873483 - RNA, 22 nt, Human
ucccacaggcccagggcggaaa

SEQ ID NO: 873484 - RNA, 22 nt, Human
aauguucauugauuaaaugaau

SEQ ID NO: 873485 - RNA, 22 nt, Human
ugaucuuugggccauuaauaaa

SEQ ID NO: 873486 - RNA, 22 nt, Human
uaagugagaucugaaaugaaau

SEQ ID NO: 873487 - RNA, 22 nt, Human
uccuggccuugcuccugaugcc

SEQ ID NO: 873488 - RNA, 22 nt, Human
cagguggggcgcccucaggcag

SEQ ID NO: 873489 - RNA, 22 nt, Human
uaagaaguguuugcccagccau

SEQ ID NO: 873490 - RNA, 22 nt, Human
cuagggcuuccaagaugccuuc

SEQ ID NO: 873491 - RNA, 22 nt, Human
gcauagaagguuuugguaucaa

SEQ ID NO: 873492 - RNA, 22 nt, Human
ggcagcauugccuuugcaguga

SEQ ID NO: 873493 - RNA, 22 nt, Human
ucucuguggcaacaauucacua

SEQ ID NO: 873494 - RNA, 22 nt, Human
cgugagcaaaauggacacuccc

SEQ ID NO: 873495 - RNA, 22 nt, Human
acugaaguucauacaacagacu

SEQ ID NO: 873496 - RNA, 22 nt, Human
gucuuuauauuuacuaaagaau

SEQ ID NO: 873497 - RNA, 18 nt, Human
ucuaggagaguaccuacc

SEQ ID NO: 873498 - RNA, 22 nt, Human
uagaaauggagaacagauuaau

SEQ ID NO: 873499 - RNA, 22 nt, Human
gaaagacucuugaugucuuugg

SEQ ID NO: 873500 - RNA, 22 nt, Human
guggccaggccgacugccaggc

SEQ ID NO: 873501 - RNA, 22 nt, Human
acaguuugguugcuacaguaaa

SEQ ID NO: 873502 - RNA, 22 nt, Human
cugugccaguguauuccuguga

SEQ ID NO: 873503 - RNA, 22 nt, Human
gcccaggaguuggaggcugcag

SEQ ID NO: 873504 - RNA, 22 nt, Human
aggcaggcacacuuccuccagg

SEQ ID NO: 873505 - RNA, 20 nt, Human
acugacagggaacuaaggcu

SEQ ID NO: 873506 - RNA, 22 nt, Human
gccucuguggcucagccuugcu

SEQ ID NO: 873507 - RNA, 22 nt, Human
uccucuggccuuggaauccuuu

SEQ ID NO: 873508 - RNA, 22 nt, Human
gggcagcucuggcugugggaag

SEQ ID NO: 873509 - RNA, 22 nt, Human
aucugcuuguugcaugucuguu

SEQ ID NO: 873510 - RNA, 22 nt, Human
aaagcacucuauccuuuguaga

SEQ ID NO: 873511 - RNA, 22 nt, Human
guguuuaaugcagaugugggug

SEQ ID NO: 873512 - RNA, 22 nt, Human
cuagacagaggcaagcgcauua

SEQ ID NO: 873513 - RNA, 22 nt, Human
uugucugaggguuugagagaau

SEQ ID NO: 873514 - RNA, 22 nt, Human
gcccuggacagugacggugacc

SEQ ID NO: 873515 - RNA, 21 nt, Human
ggccagcucggaaggucccau

SEQ ID NO: 873516 - RNA, 22 nt, Human
aagguacagggaaggagcaaga

SEQ ID NO: 873517 - RNA, 22 nt, Human
agacaggugcucgcccaagucc

SEQ ID NO: 873518 - RNA, 20 nt, Human
cauggcugugagcccacagg

SEQ ID NO: 873519 - RNA, 23 nt, Human
cccagagcacagccuccagaugc

SEQ ID NO: 873520 - RNA, 22 nt, Human
ggcucuggcuacuccacccugu

SEQ ID NO: 873521 - RNA, 22 nt, Human
cucuguaugggauuuacugguu

SEQ ID NO: 873522 - RNA, 22 nt, Human
agugauguuaauaaaugauguu

SEQ ID NO: 873523 - RNA, 22 nt, Human
gcucugugcaaauagcaccccu

SEQ ID NO: 873524 - RNA, 22 nt, Human
cacagcugugagaagggagccu

SEQ ID NO: 873525 - RNA, 22 nt, Human
aauacuugucagaugaauaaga

SEQ ID NO: 873526 - RNA, 22 nt, Human
ggucacuucuuucaucgaaacu

SEQ ID NO: 873527 - RNA, 22 nt, Human
gugugcauguauauacuuuuau

SEQ ID NO: 873528 - RNA, 21 nt, Human
ccuccaggugauuccgugcuc

SEQ ID NO: 873529 - RNA, 22 nt, Human
ccucucuccuuccuuugccaaa

SEQ ID NO: 873530 - RNA, 22 nt, Human
gugugggcuaugugcgugggca

SEQ ID NO: 873531 - RNA, 20 nt, Human
uggaggcagagccagaggga

SEQ ID NO: 873532 - RNA, 22 nt, Human
cucugggcaggaccaguggacc

SEQ ID NO: 873533 - RNA, 22 nt, Human
guucuggguucuggguuauugg

SEQ ID NO: 873534 - RNA, 22 nt, Human
uggcucuggagcuccugggccc

SEQ ID NO: 873535 - RNA, 22 nt, Human
uccaggcuggcucuucaaaauu

SEQ ID NO: 873536 - RNA, 22 nt, Human
agacccuucauguaguucccca

SEQ ID NO: 873537 - RNA, 23 nt, Human
gccaggaguggguagacuaaugc

SEQ ID NO: 873538 - RNA, 22 nt, Human
cuggguggcgucuggggccagu

SEQ ID NO: 873539 - RNA, 22 nt, Human
ccaagcagucugcuaggaguuu

SEQ ID NO: 873540 - RNA, 20 nt, Human
cugcccagccacugagggau

SEQ ID NO: 873541 - RNA, 22 nt, Human
uuugacaaccaggcagguaaga

SEQ ID NO: 873542 - RNA, 22 nt, Human
uaagauaaguggguugagaugg

SEQ ID NO: 873543 - RNA, 22 nt, Human
gacagaaggcaucuagggcacg

SEQ ID NO: 873544 - RNA, 22 nt, Human
agcccaagccuggcuggcgaug

SEQ ID NO: 873545 - RNA, 22 nt, Human
ucagaagacuacuaggacacau

SEQ ID NO: 873546 - RNA, 22 nt, Human
aaacugcaggucaugacccauu

SEQ ID NO: 873547 - RNA, 22 nt, Human
aagacauuccaaaguggcuaau

SEQ ID NO: 873548 - RNA, 22 nt, Human
gcuuuguguagaaggaggaugg

SEQ ID NO: 873549 - RNA, 22 nt, Human
auauacacagagcuuaugguga

SEQ ID NO: 873550 - RNA, 22 nt, Human
ugaaagugaaugucacuguuga

SEQ ID NO: 873551 - RNA, 22 nt, Human
agcugaaauucacaaggaucca

SEQ ID NO: 873552 - RNA, 22 nt, Human
cgugucuguaugucaaucagcu

SEQ ID NO: 873553 - RNA, 22 nt, Human
uaaaaugacuuccuccaacauc

SEQ ID NO: 873554 - RNA, 22 nt, Human
ggggccuuuucugaauguggaa

SEQ ID NO: 873555 - RNA, 22 nt, Human
ugagaaggugaaaguguggaga

SEQ ID NO: 873556 - RNA, 22 nt, Human
cgcgcugcagacagcggaggcc

SEQ ID NO: 873557 - RNA, 22 nt, Human
ugacaucagaauggcauagaaa

SEQ ID NO: 873558 - RNA, 22 nt, Human
cugaggaggcuaauuugaggau

SEQ ID NO: 873559 - RNA, 22 nt, Human
acagccuuauugcgagcaaggc

SEQ ID NO: 873560 - RNA, 22 nt, Human
uacaguuuguauggucaggaau

SEQ ID NO: 873561 - RNA, 22 nt, Human
ggcaccuggauguagcagugaa

SEQ ID NO: 873562 - RNA, 21 nt, Human
agaaauguaucauucuuuucc

SEQ ID NO: 873563 - RNA, 22 nt, Human
aagggcagaauagagaagaugg

SEQ ID NO: 873564 - RNA, 22 nt, Human
ucuuuccacauucucuguuuag

SEQ ID NO: 873565 - RNA, 19 nt, Human
uggaagaggaagggaaaua

SEQ ID NO: 873566 - RNA, 22 nt, Human
guccugggaaggaagccaggga

SEQ ID NO: 873567 - RNA, 22 nt, Human
uaaccuuuggugaaauauuaac

SEQ ID NO: 873568 - RNA, 18 nt, Human
acuagugagcaagcuagg

SEQ ID NO: 873569 - RNA, 22 nt, Human
aacauuuguacuaaagaaguuc

SEQ ID NO: 873570 - RNA, 22 nt, Human
guuugaaaguggcaaguccuug

SEQ ID NO: 873571 - RNA, 22 nt, Human
ugcagcauugaaauagcuaggc

SEQ ID NO: 873572 - RNA, 22 nt, Human
uggaaugucaagaagcaguaag

SEQ ID NO: 873573 - RNA, 19 nt, Human
uagaaugcccacuuaaaaa

SEQ ID NO: 873574 - RNA, 17 nt, Human
aaacaaugcagacaagc

SEQ ID NO: 873575 - RNA, 22 nt, Human
cagggugcugcaccaucccuca

SEQ ID NO: 873576 - RNA, 22 nt, Human
gggcccagcgugguuccaucug

SEQ ID NO: 873577 - RNA, 22 nt, Human
gcagcugccuauucagggcuug

SEQ ID NO: 873578 - RNA, 17 nt, Human
uagcauuuaucuuccuu

SEQ ID NO: 873579 - RNA, 22 nt, Human
ugcaagggugacagguugcucu

SEQ ID NO: 873580 - RNA, 22 nt, Human
ggugacggggcccagguuuccu

SEQ ID NO: 873581 - RNA, 22 nt, Human
ugaacagugggcaugugaagac

SEQ ID NO: 873582 - RNA, 18 nt, Human
ugaguucauuagacuucc

SEQ ID NO: 873583 - RNA, 22 nt, Human
guauuuuuagguaaggaaagua

SEQ ID NO: 873584 - RNA, 22 nt, Human
cccagagcuccgguccugccca

SEQ ID NO: 873585 - RNA, 18 nt, Human
guggcagccuuuggcuuu

SEQ ID NO: 873586 - RNA, 22 nt, Human
aaaggacuagguguugccaaaa

SEQ ID NO: 873587 - RNA, 22 nt, Human
uuuuccacagcaccauaagauu

SEQ ID NO: 873588 - RNA, 23 nt, Human
auucagaauuguguguuuguaua

SEQ ID NO: 873589 - RNA, 22 nt, Human
ggcacagagcuccagccuuggc

SEQ ID NO: 873590 - RNA, 22 nt, Human
guccagagauggacgagcagau

SEQ ID NO: 873591 - RNA, 22 nt, Human
cugugucuaaucuuauacauca

SEQ ID NO: 873592 - RNA, 22 nt, Human
ucuugcaggcggcucagcaacc

SEQ ID NO: 873593 - RNA, 21 nt, Human
gagacucucauguuauuugga

SEQ ID NO: 873594 - RNA, 22 nt, Human
gccaaauauaauucuccaccuu

SEQ ID NO: 873595 - RNA, 22 nt, Human
aauaaugucuaugguuccaaaa

SEQ ID NO: 873596 - RNA, 22 nt, Human
gccggggcuggggagagacaug

SEQ ID NO: 873597 - RNA, 22 nt, Human
ugagguauuuuuuaaagcacaa

SEQ ID NO: 873598 - RNA, 21 nt, Human
gacacaaaggguaguaauggu

SEQ ID NO: 873599 - RNA, 22 nt, Human
cugaggccuaagacaugaauga

SEQ ID NO: 873600 - RNA, 22 nt, Human
gagacagcuuaauuggugguca

SEQ ID NO: 873601 - RNA, 22 nt, Human
uggcaggguacaccuuaacacc

SEQ ID NO: 873602 - RNA, 22 nt, Human
agcaauuauuguauaagaacaa

SEQ ID NO: 873603 - RNA, 22 nt, Human
aggcagcagggccacuggcuga

SEQ ID NO: 873604 - RNA, 22 nt, Human
uaaagugaguacaaaaugaggg

SEQ ID NO: 873605 - RNA, 21 nt, Human
agccugggaggcggagguugc

SEQ ID NO: 873606 - RNA, 22 nt, Human
guggccuggcuggcaccaccuc

SEQ ID NO: 873607 - RNA, 22 nt, Human
aaauuggcaguucagggaauua

SEQ ID NO: 873608 - RNA, 23 nt, Human
acaguucucugauggguuuaaca

SEQ ID NO: 873609 - RNA, 23 nt, Human
agggcccaagccuggacagcagg

SEQ ID NO: 873610 - RNA, 22 nt, Human
caugcgaggcgggaggaggccu

SEQ ID NO: 873611 - RNA, 22 nt, Human
aaguucgaaauuuagggagaug

SEQ ID NO: 873612 - RNA, 22 nt, Human
cacaauguguuggguuaaguuu

SEQ ID NO: 873613 - RNA, 22 nt, Human
agacaacugcagagcaaagaau

SEQ ID NO: 873614 - RNA, 22 nt, Human
acaaugcaccagcaucuucacc

SEQ ID NO: 873615 - RNA, 23 nt, Human
aggcuucauccauauuuauugcc

SEQ ID NO: 873616 - RNA, 22 nt, Human
aagugcuuggcuaaugguuaug

SEQ ID NO: 873617 - RNA, 22 nt, Human
gaguggcaggcacugugacgga

SEQ ID NO: 873618 - RNA, 22 nt, Human
agagccaggcucuaccuggguu

SEQ ID NO: 873619 - RNA, 22 nt, Human
acagguuuuuguggauauaugu

SEQ ID NO: 873620 - RNA, 22 nt, Human
ggcugcaggcagaggcugucug

SEQ ID NO: 873621 - RNA, 22 nt, Human
uauguacaucuugagcaaugaa

SEQ ID NO: 873622 - RNA, 19 nt, Human
gccaggccuggaccugcag

SEQ ID NO: 873623 - RNA, 22 nt, Human
agugggcagcccaggaggucuu

SEQ ID NO: 873624 - RNA, 22 nt, Human
augccagaaggcagaauuuauc

SEQ ID NO: 873625 - RNA, 22 nt, Human
aaagguuugcauggaauuuacc

SEQ ID NO: 873626 - RNA, 22 nt, Human
guucccauuggggaucuugggc

SEQ ID NO: 873627 - RNA, 22 nt, Human
uuucuacauucaaaaacuacca

SEQ ID NO: 873628 - RNA, 22 nt, Human
uagaggugagaggaacuuugga

SEQ ID NO: 873629 - RNA, 22 nt, Human
agggcagcaauuugguuccugg

SEQ ID NO: 873630 - RNA, 22 nt, Human
caguuuuucaaaauuacaugau

SEQ ID NO: 873631 - RNA, 21 nt, Human
agcaauuucauuugguuuaac

SEQ ID NO: 873632 - RNA, 22 nt, Human
uuggaaggccagcaccuugagu

SEQ ID NO: 873633 - RNA, 22 nt, Human
aguaugucagagugaaaauggu

SEQ ID NO: 873634 - RNA, 22 nt, Human
agcaggguucucaguuggugcu

SEQ ID NO: 873635 - RNA, 22 nt, Human
cucaauaugccagaggggaaag

SEQ ID NO: 873636 - RNA, 22 nt, Human
ugcagaagcagagccgguggcc

SEQ ID NO: 873637 - RNA, 22 nt, Human
cucauaaacaauucuuugaggu

SEQ ID NO: 873638 - RNA, 20 nt, Human
uccaucuugggcagaagcag

SEQ ID NO: 873639 - RNA, 22 nt, Human
gggcuggaucuccugcaggcag

SEQ ID NO: 873640 - RNA, 22 nt, Human
gaagcuucguggcucuucaaau

SEQ ID NO: 873641 - RNA, 23 nt, Human
ccagggagugcuacuaucaagcc

SEQ ID NO: 873642 - RNA, 20 nt, Human
ggcagagggccugggagaag

SEQ ID NO: 873643 - RNA, 22 nt, Human
uguguauagaaaguaggaaagg

SEQ ID NO: 873644 - RNA, 22 nt, Human
ugucccauggauaccaggcuau

SEQ ID NO: 873645 - RNA, 22 nt, Human
gaccaggcccaggugcaaggga

SEQ ID NO: 873646 - RNA, 22 nt, Human
ccacagguacggauugaggacc

SEQ ID NO: 873647 - RNA, 22 nt, Human
ugcaaacaggcauuucacaaac

SEQ ID NO: 873648 - RNA, 22 nt, Human
agcaggcaggcugccagugaau

SEQ ID NO: 873649 - RNA, 18 nt, Human
ccugaggugggaggaagg

SEQ ID NO: 873650 - RNA, 23 nt, Human
acagccuucuggggcuucugggc

SEQ ID NO: 873651 - RNA, 22 nt, Human
ucaaugcauaggagguggcaga

SEQ ID NO: 873652 - RNA, 22 nt, Human
cacaugaagagagucuaguaau

SEQ ID NO: 873653 - RNA, 22 nt, Human
cccagccucuggauucugcccu

SEQ ID NO: 873654 - RNA, 19 nt, Human
ugaaggagggggauggcca

SEQ ID NO: 873655 - RNA, 22 nt, Human
caguuaaacgggccaugugagu

SEQ ID NO: 873656 - RNA, 22 nt, Human
aacagaauaguugauguacagu

SEQ ID NO: 873657 - RNA, 22 nt, Human
uucaagucagagcaagccaagu

SEQ ID NO: 873658 - RNA, 22 nt, Human
ugugaagauuaaguuacugggc

SEQ ID NO: 873659 - RNA, 22 nt, Human
ggccugugcugagaaccuggcu

SEQ ID NO: 873660 - RNA, 22 nt, Human
ugaggugggcuuguggauuugc

SEQ ID NO: 873661 - RNA, 22 nt, Human
ggcagauguuauaugaucugag

SEQ ID NO: 873662 - RNA, 22 nt, Human
agaggcucuaauaccagcaugg

SEQ ID NO: 873663 - RNA, 22 nt, Human
ucuagagccaaagucuuggggg

SEQ ID NO: 873664 - RNA, 22 nt, Human
agggcgggcucaucacaugcuc

SEQ ID NO: 873665 - RNA, 22 nt, Human
gaaugugugacucuauugagca

SEQ ID NO: 873666 - RNA, 22 nt, Human
uaauaguugugacuuuguaaag

SEQ ID NO: 873667 - RNA, 22 nt, Human
gucccaggcuuauguggagcuu

SEQ ID NO: 873668 - RNA, 22 nt, Human
aaauugcuaaggaucucaugug

SEQ ID NO: 873669 - RNA, 22 nt, Human
cagugguagaagccaaguagau

SEQ ID NO: 873670 - RNA, 22 nt, Human
ugacacccaucugugccagucc

SEQ ID NO: 873671 - RNA, 22 nt, Human
uacuuucuguccuucuguuaaa

SEQ ID NO: 873672 - RNA, 22 nt, Human
uggccagcccuucagccaugcc

SEQ ID NO: 873673 - RNA, 22 nt, Human
ucugggcugcuucagccuucgc

SEQ ID NO: 873674 - RNA, 22 nt, Human
ugggcucugaagucagucugcu

SEQ ID NO: 873675 - RNA, 22 nt, Human
uccagcuugacaaaugauuuua

SEQ ID NO: 873676 - RNA, 22 nt, Human
aucauuaguuguggaauucuug

SEQ ID NO: 873677 - RNA, 22 nt, Human
ccacagagacagagcccagggu

SEQ ID NO: 873678 - RNA, 22 nt, Human
agacaguaugauauaugaauac

SEQ ID NO: 873679 - RNA, 22 nt, Human
ugcugcagguguguucagugag

SEQ ID NO: 873680 - RNA, 22 nt, Human
aaaauaaguugguccuguccuu

SEQ ID NO: 873681 - RNA, 22 nt, Human
augacacaauuuuagagcugaa

SEQ ID NO: 873682 - RNA, 22 nt, Human
auuuacagccuugccaucuaua

SEQ ID NO: 873683 - RNA, 22 nt, Human
uugucugugaaauggaaauagu

SEQ ID NO: 873684 - RNA, 22 nt, Human
uugcacuccagcccgagcaaca

SEQ ID NO: 873685 - RNA, 22 nt, Human
agggggcaggagagaccugcug

SEQ ID NO: 873686 - RNA, 22 nt, Human
uuuauugucuucguggugccua

SEQ ID NO: 873687 - RNA, 22 nt, Human
guccuucagcuuuaucugaaca

SEQ ID NO: 873688 - RNA, 22 nt, Human
acaugcauaggagaagucuuua

SEQ ID NO: 873689 - RNA, 22 nt, Human
auguuaaguguaccauauauca

SEQ ID NO: 873690 - RNA, 22 nt, Human
cacagguuucaaggauaagaug

SEQ ID NO: 873691 - RNA, 22 nt, Human
gagcuuuucuuccaguuaauga

SEQ ID NO: 873692 - RNA, 22 nt, Human
uccuaggguaaucagcauacau

SEQ ID NO: 873693 - RNA, 22 nt, Human
agaggagguggugaugcuuuaa

SEQ ID NO: 873694 - RNA, 22 nt, Human
ugugucugaacaugcuuuguaa

SEQ ID NO: 873695 - RNA, 22 nt, Human
auuacacauagacauucguuca

SEQ ID NO: 873696 - RNA, 22 nt, Human
uauucaagauugaacuggcaga

SEQ ID NO: 873697 - RNA, 22 nt, Human
uggcucuguggauguucugacc

SEQ ID NO: 873698 - RNA, 22 nt, Human
ucagccuuguggcccugcucca

SEQ ID NO: 873699 - RNA, 22 nt, Human
ugcuuuaccuucccagaaacca

SEQ ID NO: 873700 - RNA, 22 nt, Human
gaggcaguuccugagugacaag

SEQ ID NO: 873701 - RNA, 22 nt, Human
gacuccccacguuaaggaaugu

SEQ ID NO: 873702 - RNA, 22 nt, Human
ugugaggagaggcccagcuccc

SEQ ID NO: 873703 - RNA, 22 nt, Human
ccugggcuuucaaaaccagccu

SEQ ID NO: 873704 - RNA, 22 nt, Human
ggaccagagaagugagcaccug

SEQ ID NO: 873705 - RNA, 22 nt, Human
acagaucuacauugucugaccc

SEQ ID NO: 873706 - RNA, 20 nt, Human
gccaggcacuguucucaaua

SEQ ID NO: 873707 - RNA, 22 nt, Human
acaguggcaguauuagggcaga

SEQ ID NO: 873708 - RNA, 22 nt, Human
gaguccuuuucucuguccacug

SEQ ID NO: 873709 - RNA, 22 nt, Human
cagauggggcaaggccaucugu

SEQ ID NO: 873710 - RNA, 22 nt, Human
uauuagaaaggcuauugcauag

SEQ ID NO: 873711 - RNA, 22 nt, Human
uugaccuauguuucuucaucug

SEQ ID NO: 873712 - RNA, 22 nt, Human
uggcccuguccucauuucaucu

SEQ ID NO: 873713 - RNA, 22 nt, Human
aaagcagccugcucauccugga

SEQ ID NO: 873714 - RNA, 22 nt, Human
agcuccaggcagcauuaauaaa

SEQ ID NO: 873715 - RNA, 22 nt, Human
ucuggccagcaugagaccuggu

SEQ ID NO: 873716 - RNA, 22 nt, Human
guaaaugugcuucuuuuaacuu

SEQ ID NO: 873717 - RNA, 22 nt, Human
auguguaaagcuuuucuuuguu

SEQ ID NO: 873718 - RNA, 18 nt, Human
uucucauaccucacuuag

SEQ ID NO: 873719 - RNA, 19 nt, Human
uacaggaggccugcaaucu

SEQ ID NO: 873720 - RNA, 19 nt, Human
aggcagucauuggaauaua

SEQ ID NO: 873721 - RNA, 20 nt, Human
ugggccucuggugccucugg

SEQ ID NO: 873722 - RNA, 22 nt, Human
agagacccagacugaucauugc

SEQ ID NO: 873723 - RNA, 22 nt, Human
aaaucagaggcaacaacuacuu

SEQ ID NO: 873724 - RNA, 22 nt, Human
ugaggccagggauuccaucauu

SEQ ID NO: 873725 - RNA, 22 nt, Human
aguguucacucuguggagccca

SEQ ID NO: 873726 - RNA, 22 nt, Human
acagcagcuugucuguucuuua

SEQ ID NO: 873727 - RNA, 22 nt, Human
uugcagauuaaaacacugagcu

SEQ ID NO: 873728 - RNA, 22 nt, Human
ugucauguauaagacacugugu

SEQ ID NO: 873729 - RNA, 22 nt, Human
ugucugcagaagauggcauggg

SEQ ID NO: 873730 - RNA, 22 nt, Human
auugcuuuucagacaaugaggc

SEQ ID NO: 873731 - RNA, 22 nt, Human
acuuaaaaagaaucuuuucacg

SEQ ID NO: 873732 - RNA, 22 nt, Human
gcuggcaguuuccucaccgagg

SEQ ID NO: 873733 - RNA, 22 nt, Human
auuauagaggguuacaguuaau

SEQ ID NO: 873734 - RNA, 22 nt, Human
cuccucuggaaauuccucugcc

SEQ ID NO: 873735 - RNA, 22 nt, Human
ucagauaccauugaauuuguug

SEQ ID NO: 873736 - RNA, 22 nt, Human
ucauguuuuaguaaagugaagg

SEQ ID NO: 873737 - RNA, 22 nt, Human
ugcuaucuaggcaagguggucc

SEQ ID NO: 873738 - RNA, 22 nt, Human
cuggaaggugacugucuugaau

SEQ ID NO: 873739 - RNA, 22 nt, Human
guuaacaagguguagagguuuu

SEQ ID NO: 873740 - RNA, 21 nt, Human
ccagacucagaaguuuaacca

SEQ ID NO: 873741 - RNA, 22 nt, Human
auuugcuuugggacagcuuaaa

SEQ ID NO: 873742 - RNA, 22 nt, Human
aggcagugugggccaagcuucc

SEQ ID NO: 873743 - RNA, 22 nt, Human
gccagggugagggcugagaggu

SEQ ID NO: 873744 - RNA, 22 nt, Human
uggcugcugagaaggcagcugu

SEQ ID NO: 873745 - RNA, 22 nt, Human
gcagcaagaauaauuuggguag

SEQ ID NO: 873746 - RNA, 22 nt, Human
gcaagcaaguaucuggcaggga

SEQ ID NO: 873747 - RNA, 22 nt, Human
agaauguaagaaugcaaagauu

SEQ ID NO: 873748 - RNA, 22 nt, Human
aagugauuguuccguugagugu

SEQ ID NO: 873749 - RNA, 22 nt, Human
auuucauguuucaucuaccuaa

SEQ ID NO: 873750 - RNA, 22 nt, Human
gggucaggcucagcagggcagc

SEQ ID NO: 873751 - RNA, 22 nt, Human
cagugcugugcuggaagcuguu

SEQ ID NO: 873752 - RNA, 22 nt, Human
ucaauucuaguggagagaguuu

SEQ ID NO: 873753 - RNA, 20 nt, Human
aggcaguguagagaugagua

SEQ ID NO: 873754 - RNA, 22 nt, Human
uaugcagcugguuaagaacaca

SEQ ID NO: 873755 - RNA, 22 nt, Human
gcccuggaugcucauggcauca

SEQ ID NO: 873756 - RNA, 22 nt, Human
ggccagaggugguacauagcuu

SEQ ID NO: 873757 - RNA, 22 nt, Human
agaacagugcugauaaaucaua

SEQ ID NO: 873758 - RNA, 22 nt, Human
uaugagaacaagaacaaucucc

SEQ ID NO: 873759 - RNA, 22 nt, Human
cuccuacaguguuugaguccag

SEQ ID NO: 873760 - RNA, 22 nt, Human
ugugcauagacuuucaccaccu

SEQ ID NO: 873761 - RNA, 22 nt, Human
cgcugggggaacagcgagggug

SEQ ID NO: 873762 - RNA, 22 nt, Human
caguucugacuuucauaauguc

SEQ ID NO: 873763 - RNA, 22 nt, Human
agggucagagaucggccaugug

SEQ ID NO: 873764 - RNA, 22 nt, Human
gcaagcagacugggccccugug

SEQ ID NO: 873765 - RNA, 22 nt, Human
aauugcuagacuauacuguaau

SEQ ID NO: 873766 - RNA, 22 nt, Human
uucuaaauguaaauaguaugau

SEQ ID NO: 873767 - RNA, 22 nt, Human
ucuguccacaagcacaggcucu

SEQ ID NO: 873768 - RNA, 22 nt, Human
agcagggcccacuaggggagau

SEQ ID NO: 873769 - RNA, 22 nt, Human
gccucaggccuauagcugcugu

SEQ ID NO: 873770 - RNA, 22 nt, Human
aaauguccugagauucaacuua

SEQ ID NO: 873771 - RNA, 22 nt, Human
gauucugagcugguguuuuacg

SEQ ID NO: 873772 - RNA, 22 nt, Human
ccaggagagcgcccucccggcc

SEQ ID NO: 873773 - RNA, 18 nt, Human
cccugaagggcaagauaa

SEQ ID NO: 873774 - RNA, 22 nt, Human
ugaguucagauccuggcucugc

SEQ ID NO: 873775 - RNA, 22 nt, Human
uccugccucuuuucuuauucca

SEQ ID NO: 873776 - RNA, 22 nt, Human
gcaagaaaagagccuucagugg

SEQ ID NO: 873777 - RNA, 22 nt, Human
ugcccuccacaguggcuccacc

SEQ ID NO: 873778 - RNA, 22 nt, Human
cacugcaggucugagauggggg

SEQ ID NO: 873779 - RNA, 22 nt, Human
agcuacaccccuuuacaguccu

SEQ ID NO: 873780 - RNA, 22 nt, Human
cagagagaggccacugcuauua

SEQ ID NO: 873781 - RNA, 22 nt, Human
ccagcucuggcuucuugcuggg

SEQ ID NO: 873782 - RNA, 22 nt, Human
ggcagcaaugcugugcaggcau

SEQ ID NO: 873783 - RNA, 22 nt, Human
gccuaagacugaggcuuuuguc

SEQ ID NO: 873784 - RNA, 23 nt, Human
cagggugaccaauguggccauca

SEQ ID NO: 873785 - RNA, 22 nt, Human
aauguaaagcucaggucaggag

SEQ ID NO: 873786 - RNA, 22 nt, Human
gccugggauucucaaaggggug

SEQ ID NO: 873787 - RNA, 22 nt, Human
auccacaggaggguuuggaaaa

SEQ ID NO: 873788 - RNA, 22 nt, Human
aaauaagugugggccagucaaa

SEQ ID NO: 873789 - RNA, 22 nt, Human
acaguugagaugcaacuuuggg

SEQ ID NO: 873790 - RNA, 22 nt, Human
agcugcuuguacaugaccacau

SEQ ID NO: 873791 - RNA, 22 nt, Human
aggaagaaaugugacuucaaac

SEQ ID NO: 873792 - RNA, 21 nt, Human
gugugucuaauguaguggaaa

SEQ ID NO: 873793 - RNA, 22 nt, Human
gcauugcaacugacagaucauu

SEQ ID NO: 873794 - RNA, 22 nt, Human
cuacccagagugaaucucuuaa

SEQ ID NO: 873795 - RNA, 22 nt, Human
aaggaggcacccugagccugcc

SEQ ID NO: 873796 - RNA, 22 nt, Human
guuaaaugcagauucugacuca

SEQ ID NO: 873797 - RNA, 22 nt, Human
guccucaguaagagggccucug

SEQ ID NO: 873798 - RNA, 22 nt, Human
agacagcugccuccaccacagc

SEQ ID NO: 873799 - RNA, 22 nt, Human
cuugucugauaauggggccaac

SEQ ID NO: 873800 - RNA, 22 nt, Human
gagcugccugaacaagcagcag

SEQ ID NO: 873801 - RNA, 22 nt, Human
gaaaguauuuacauuaacaucu

SEQ ID NO: 873802 - RNA, 22 nt, Human
aacacuuuuuaguaaagauuga

SEQ ID NO: 873803 - RNA, 22 nt, Human
guucauuuaugauguaacaugu

SEQ ID NO: 873804 - RNA, 22 nt, Human
uucuaguucuuagagaauuggu

SEQ ID NO: 873805 - RNA, 22 nt, Human
uaugcuaagugagaaaagacag

SEQ ID NO: 873806 - RNA, 22 nt, Human
ugaguucaaauuuuggcucugc

SEQ ID NO: 873807 - RNA, 18 nt, Human
aggaaagaaaggcaggug

SEQ ID NO: 873808 - RNA, 22 nt, Human
uuaaagcuagguggaacaaauu

SEQ ID NO: 873809 - RNA, 22 nt, Human
acaaacuuauguuucauaugua

SEQ ID NO: 873810 - RNA, 22 nt, Human
agaauauugaaaguucuugaca

SEQ ID NO: 873811 - RNA, 22 nt, Human
ggucagaggucacaagcuggca

SEQ ID NO: 873812 - RNA, 22 nt, Human
agcagaaauagaagucaaugau

SEQ ID NO: 873813 - RNA, 22 nt, Human
uuccuucuaauuuuacaccuga

SEQ ID NO: 873814 - RNA, 22 nt, Human
aagacagugacagucacaauug

SEQ ID NO: 873815 - RNA, 22 nt, Human
uuuaccacaauuuuaaacaaug

SEQ ID NO: 873816 - RNA, 22 nt, Human
ggcguggggccuucugcccgcu

SEQ ID NO: 873817 - RNA, 22 nt, Human
cuguggcucuuuaguugagcac

SEQ ID NO: 873818 - RNA, 18 nt, Human
aggcccuggccucgaaca

SEQ ID NO: 873819 - RNA, 22 nt, Human
cagugacguaaacugcaugugc

SEQ ID NO: 873820 - RNA, 22 nt, Human
gaagauuuucuccuuuaaauga

SEQ ID NO: 873821 - RNA, 22 nt, Human
aaggcaggaugcggacccaucu

SEQ ID NO: 873822 - RNA, 22 nt, Human
aaggucugaguuuugccaggcc

SEQ ID NO: 873823 - RNA, 22 nt, Human
ucaggcugccuaucagacugug

SEQ ID NO: 873824 - RNA, 22 nt, Human
uaagaagugagugcaccuucuu

SEQ ID NO: 873825 - RNA, 22 nt, Human
ucacaugcccuguauuuaccag

SEQ ID NO: 873826 - RNA, 22 nt, Human
agacuguugccugaacuuagcc

SEQ ID NO: 873827 - RNA, 22 nt, Human
ucacaagacagaaaacauuuag

SEQ ID NO: 873828 - RNA, 22 nt, Human
ggucgcacccgggcgcugcugg

SEQ ID NO: 873829 - RNA, 22 nt, Human
ugugaaauauuggcaauuucau

SEQ ID NO: 873830 - RNA, 22 nt, Human
ugcugcuguagcuaggcuuucu

SEQ ID NO: 873831 - RNA, 20 nt, Human
aauuagcuuaagucaaucag

SEQ ID NO: 873832 - RNA, 22 nt, Human
ucucugaguucuccuccagccc

SEQ ID NO: 873833 - RNA, 22 nt, Human
gugcuuuagguguuuggcugaa

SEQ ID NO: 873834 - RNA, 22 nt, Human
aaagguuaguucuuagaagugc

SEQ ID NO: 873835 - RNA, 22 nt, Human
uguauacacuaugcuauauggu

SEQ ID NO: 873836 - RNA, 22 nt, Human
auuaauguguagccaacuuaau

SEQ ID NO: 873837 - RNA, 22 nt, Human
ggucccugaagaggccuggggu

SEQ ID NO: 873838 - RNA, 22 nt, Human
cacaacugccagccaggaaagg

SEQ ID NO: 873839 - RNA, 19 nt, Human
agcaaauacaucaaaauug

SEQ ID NO: 873840 - RNA, 22 nt, Human
cugcuguaaugagucagcaucu

SEQ ID NO: 873841 - RNA, 22 nt, Human
auguaucaacaaauuguacagu

SEQ ID NO: 873842 - RNA, 22 nt, Human
uggaagaaaauucaaucgaguu

SEQ ID NO: 873843 - RNA, 22 nt, Human
aacuguuuaccauacacaguga

SEQ ID NO: 873844 - RNA, 22 nt, Human
agugcagaguacauuuguggca

SEQ ID NO: 873845 - RNA, 22 nt, Human
gagguuagaggucagugcaguc

SEQ ID NO: 873846 - RNA, 22 nt, Human
uuuuccaaauuagaaguagaga

SEQ ID NO: 873847 - RNA, 22 nt, Human
caguggcgugaucucugcucac

SEQ ID NO: 873848 - RNA, 22 nt, Human
ggcaggcaagucugcucuguga

SEQ ID NO: 873849 - RNA, 22 nt, Human
acuaaaugagauacugucuuca

SEQ ID NO: 873850 - RNA, 22 nt, Human
gagacacaggugguuccuguca

SEQ ID NO: 873851 - RNA, 22 nt, Human
ggugucugaugguggcuucuca

SEQ ID NO: 873852 - RNA, 22 nt, Human
gcccucuggggcacacagagga

SEQ ID NO: 873853 - RNA, 22 nt, Human
acagccuucucuucacuguguc

SEQ ID NO: 873854 - RNA, 22 nt, Human
cacugagagaugugucacagca

SEQ ID NO: 873855 - RNA, 22 nt, Human
uaauuauuaugacaacaauugc

SEQ ID NO: 873856 - RNA, 22 nt, Human
ugugggccaggaggccucagug

SEQ ID NO: 873857 - RNA, 22 nt, Human
ccaguggaguuuuuauacccag

SEQ ID NO: 873858 - RNA, 22 nt, Human
ugggaaggggagcuggaaagga

SEQ ID NO: 873859 - RNA, 22 nt, Human
uugccauugcucagugaacaga

SEQ ID NO: 873860 - RNA, 22 nt, Human
caggcccaggggucuggcccac

SEQ ID NO: 873861 - RNA, 22 nt, Human
ucaggaggcaaguagguauuga

SEQ ID NO: 873862 - RNA, 22 nt, Human
guagggacuuguuuuacuagua

SEQ ID NO: 873863 - RNA, 22 nt, Human
cucucucuuuagaagcgucugg

SEQ ID NO: 873864 - RNA, 23 nt, Human
gcaggugguucgaacagaaguuu

SEQ ID NO: 873865 - RNA, 22 nt, Human
cccaggagagagacuugaaucu

SEQ ID NO: 873866 - RNA, 22 nt, Human
ugcagaugagggaugaaaauga

SEQ ID NO: 873867 - RNA, 19 nt, Human
cacagaugauugacacaua

SEQ ID NO: 873868 - RNA, 22 nt, Human
uaugaguacugugaacgagaau

SEQ ID NO: 873869 - RNA, 20 nt, Human
auagacaaagacaugccaga

SEQ ID NO: 873870 - RNA, 22 nt, Human
ugcagaggagucagccugggca

SEQ ID NO: 873871 - RNA, 22 nt, Human
agggccugggauguccuccuag

SEQ ID NO: 873872 - RNA, 19 nt, Human
uauauuugagugugcaugc

SEQ ID NO: 873873 - RNA, 20 nt, Human
uucuuaaagaccucacuuug

SEQ ID NO: 873874 - RNA, 22 nt, Human
uuucacaaagcauagcacuuua

SEQ ID NO: 873875 - RNA, 22 nt, Human
ugaacacacacaucuuaauaau

SEQ ID NO: 873876 - RNA, 22 nt, Human
aauauguugagucuaucuuuau

SEQ ID NO: 873877 - RNA, 22 nt, Human
agggcucagccuccuccucagc

SEQ ID NO: 873878 - RNA, 22 nt, Human
uuugagaacuuugguauuuucc

SEQ ID NO: 873879 - RNA, 22 nt, Human
ugagaccuuaaaagguauguca

SEQ ID NO: 873880 - RNA, 22 nt, Human
aauagcaauuacauuugcacca

SEQ ID NO: 873881 - RNA, 22 nt, Human
ucucuaguauuaaauauagugu

SEQ ID NO: 873882 - RNA, 22 nt, Human
ucagcucuguguacaguuagca

SEQ ID NO: 873883 - RNA, 22 nt, Human
uggcucaaguaacaaaaauaua

SEQ ID NO: 873884 - RNA, 22 nt, Human
uuugcugaauagauuguaaacu

SEQ ID NO: 873885 - RNA, 22 nt, Human
aagcaguuuuucaacuguuuag

SEQ ID NO: 873886 - RNA, 22 nt, Human
gaggcaguguugaaaaggagag

SEQ ID NO: 873887 - RNA, 22 nt, Human
ccuuaaacuuuaucuugugaga

SEQ ID NO: 873888 - RNA, 22 nt, Human
cagauguuugucuauaugcuuu

SEQ ID NO: 873889 - RNA, 22 nt, Human
ggccaggaacuuuugggauggg

SEQ ID NO: 873890 - RNA, 20 nt, Human
acacaugugcguguucagua

SEQ ID NO: 873891 - RNA, 22 nt, Human
acagagcaauucuuggguguuu

SEQ ID NO: 873892 - RNA, 22 nt, Human
gcagacagaugagggugcuggg

SEQ ID NO: 873893 - RNA, 22 nt, Human
ucuucuuccuccacagggccca

SEQ ID NO: 873894 - RNA, 22 nt, Human
uccugcuggaaguagggaauga

SEQ ID NO: 873895 - RNA, 22 nt, Human
ugcuuuguguuugaauagauaa

SEQ ID NO: 873896 - RNA, 22 nt, Human
acacagagccagggaauacagu

SEQ ID NO: 873897 - RNA, 22 nt, Human
aauguauuccucaugcaagagu

SEQ ID NO: 873898 - RNA, 22 nt, Human
cagcccagccgagggccuggcu

SEQ ID NO: 873899 - RNA, 22 nt, Human
uuuggcggacugagaacgcggg

SEQ ID NO: 873900 - RNA, 22 nt, Human
cucagcucuuuauacuagcugu

SEQ ID NO: 873901 - RNA, 22 nt, Human
ccuggcucaggcacgcauggcu

SEQ ID NO: 873902 - RNA, 21 nt, Human
agacagagugcagucuacaua

SEQ ID NO: 873903 - RNA, 22 nt, Human
ccgugcuucuucagaugugaau

SEQ ID NO: 873904 - RNA, 22 nt, Human
ugaacacauaaggcuuuccugu

SEQ ID NO: 873905 - RNA, 21 nt, Human
cuuuucuguguuccucccugu

SEQ ID NO: 873906 - RNA, 22 nt, Human
uagaaaugugauaauagcuuaa

SEQ ID NO: 873907 - RNA, 22 nt, Human
gauuaaaaauaacccaugcuga

SEQ ID NO: 873908 - RNA, 22 nt, Human
ggcaaaaaguucccaucagugu

SEQ ID NO: 873909 - RNA, 22 nt, Human
augcaguggcagcuccuggugu

SEQ ID NO: 873910 - RNA, 22 nt, Human
ucagcuguaucuugcugcacuu

SEQ ID NO: 873911 - RNA, 22 nt, Human
cagcaagaguugggguuguugg

SEQ ID NO: 873912 - RNA, 22 nt, Human
ucaguguucgcucagggacucc

SEQ ID NO: 873913 - RNA, 22 nt, Human
gaaauaagaguccaugccaggu

SEQ ID NO: 873914 - RNA, 22 nt, Human
cacaucugcucugggcagcacu

SEQ ID NO: 873915 - RNA, 22 nt, Human
aaaugcaggaaauuaugcuuuu

SEQ ID NO: 873916 - RNA, 22 nt, Human
acauuugacuacauuuauauau

SEQ ID NO: 873917 - RNA, 20 nt, Human
ccaggccugggccugcucua

SEQ ID NO: 873918 - RNA, 22 nt, Human
agggcacaagacucugagcccc

SEQ ID NO: 873919 - RNA, 21 nt, Human
aguuacauguauagauaaagu

SEQ ID NO: 873920 - RNA, 17 nt, Human
aauacuuccaacuagug

SEQ ID NO: 873921 - RNA, 22 nt, Human
cucagggaggcccugggacccu

SEQ ID NO: 873922 - RNA, 22 nt, Human
ucuuccagaaucucagagggcu

SEQ ID NO: 873923 - RNA, 22 nt, Human
ggagaaggugcuggucacugug

SEQ ID NO: 873924 - RNA, 22 nt, Human
gacaggaacauaaauguaggag

SEQ ID NO: 873925 - RNA, 22 nt, Human
uaaucucuuuuaggacagagcc

SEQ ID NO: 873926 - RNA, 22 nt, Human
ccugcuuaacauugccaugaca

SEQ ID NO: 873927 - RNA, 22 nt, Human
uugaucucuguugcugucuuug

SEQ ID NO: 873928 - RNA, 22 nt, Human
accuaaauucuggcugauuagg

SEQ ID NO: 873929 - RNA, 22 nt, Human
uuccucagccagcacuuagggg

SEQ ID NO: 873930 - RNA, 22 nt, Human
aagauacaaaugucaauauugg

SEQ ID NO: 873931 - RNA, 22 nt, Human
auuuuaguaccucaaguaucca

SEQ ID NO: 873932 - RNA, 22 nt, Human
gugugugccaucaagagcuuuc

SEQ ID NO: 873933 - RNA, 22 nt, Human
uucuuccucagcagggcugccu

SEQ ID NO: 873934 - RNA, 22 nt, Human
aaucaggacccacucuacaguu

SEQ ID NO: 873935 - RNA, 22 nt, Human
ugggucccaaucugaaauguca

SEQ ID NO: 873936 - RNA, 21 nt, Human
agggcacccccgcugccuacc

SEQ ID NO: 873937 - RNA, 22 nt, Human
augaaaauacugugguugauag

SEQ ID NO: 873938 - RNA, 22 nt, Human
uugcuguugaugaugugauaca

SEQ ID NO: 873939 - RNA, 22 nt, Human
cauuuauugaguggccacagug

SEQ ID NO: 873940 - RNA, 22 nt, Human
aagcauuucagguagagauauu

SEQ ID NO: 873941 - RNA, 22 nt, Human
cagaacagucgccugcauggau

SEQ ID NO: 873942 - RNA, 22 nt, Human
ggagaggugcaggucaguggca

SEQ ID NO: 873943 - RNA, 22 nt, Human
gugauucucaaauugugauauc

SEQ ID NO: 873944 - RNA, 19 nt, Human
aguuuagagagacucuaaa

SEQ ID NO: 873945 - RNA, 22 nt, Human
agacacaguacuugcccucaug

SEQ ID NO: 873946 - RNA, 22 nt, Human
aagaggugccagggguuuugua

SEQ ID NO: 873947 - RNA, 22 nt, Human
aaacacugaaaauuuuggucau

SEQ ID NO: 873948 - RNA, 22 nt, Human
augaaacuaaacuacauaaguu

SEQ ID NO: 873949 - RNA, 22 nt, Human
gcucugaaucaaucagauaagg

SEQ ID NO: 873950 - RNA, 19 nt, Human
uuuaaagugacugguauuu

SEQ ID NO: 873951 - RNA, 22 nt, Human
aaaagcagaucuccaaagucua

SEQ ID NO: 873952 - RNA, 22 nt, Human
acuauaacccauggaauauaag

SEQ ID NO: 873953 - RNA, 22 nt, Human
agacccugcaccucucgugggc

SEQ ID NO: 873954 - RNA, 22 nt, Human
cucuccugggcugaccguccga

SEQ ID NO: 873955 - RNA, 22 nt, Human
ucagagaucuggaguacaacug

SEQ ID NO: 873956 - RNA, 22 nt, Human
gacagcaggaugugaggggaug

SEQ ID NO: 873957 - RNA, 22 nt, Human
uggcuucuccagaaaucuuggu

SEQ ID NO: 873958 - RNA, 22 nt, Human
ggccucuguucugcauuccucc

SEQ ID NO: 873959 - RNA, 22 nt, Human
cuaaauguucacaugcaauuuu

SEQ ID NO: 873960 - RNA, 22 nt, Human
gauauaguaauauuccugaacu

SEQ ID NO: 873961 - RNA, 22 nt, Human
gauuuccucacuaacauccauc

SEQ ID NO: 873962 - RNA, 22 nt, Human
gcuucaugccaggagguuuaag

SEQ ID NO: 873963 - RNA, 22 nt, Human
ucaaaggcugcuugucuucugg

SEQ ID NO: 873964 - RNA, 22 nt, Human
augacauugacagaccugcugc

SEQ ID NO: 873965 - RNA, 22 nt, Human
aguaaacaguaggaacugagaa

SEQ ID NO: 873966 - RNA, 22 nt, Human
ccuccagcugccucagucucuu

SEQ ID NO: 873967 - RNA, 22 nt, Human
ccagcccuugcugaaggguggc

SEQ ID NO: 873968 - RNA, 22 nt, Human
gaugguccuccugcugccucuc

SEQ ID NO: 873969 - RNA, 22 nt, Human
gccugagaguugaaguucagug

SEQ ID NO: 873970 - RNA, 22 nt, Human
caccuagggcaucccugcccca

SEQ ID NO: 873971 - RNA, 22 nt, Human
ucccaccaggugaccauuucau

SEQ ID NO: 873972 - RNA, 22 nt, Human
ggcuggaacuucuucuggcauu

SEQ ID NO: 873973 - RNA, 22 nt, Human
uguuugaauaacuuggauauau

SEQ ID NO: 873974 - RNA, 22 nt, Human
agcagcaggcuguguggacuga

SEQ ID NO: 873975 - RNA, 20 nt, Human
caggaggcaaggucaagguc

SEQ ID NO: 873976 - RNA, 22 nt, Human
gugaaauauuuuguuuauguca

SEQ ID NO: 873977 - RNA, 22 nt, Human
ucuggcucucauacucgccagu

SEQ ID NO: 873978 - RNA, 22 nt, Human
agggaagagcuugcaagaaacc

SEQ ID NO: 873979 - RNA, 22 nt, Human
uacaggagcauggggaagggau

SEQ ID NO: 873980 - RNA, 22 nt, Human
aggugucugugaugggagcgau

SEQ ID NO: 873981 - RNA, 21 nt, Human
ggcagaaguagcauggacggg

SEQ ID NO: 873982 - RNA, 22 nt, Human
ccuggagggcagcccauucugg

SEQ ID NO: 873983 - RNA, 22 nt, Human
uuuuacaggugaaaaaugaaga

SEQ ID NO: 873984 - RNA, 22 nt, Human
uccugggugaaagaacaggcag

SEQ ID NO: 873985 - RNA, 22 nt, Human
ggccucugccccagccacaccu

SEQ ID NO: 873986 - RNA, 22 nt, Human
aggaaauuuugaaucagugucu

SEQ ID NO: 873987 - RNA, 22 nt, Human
cagccagugguugaagaugcag

SEQ ID NO: 873988 - RNA, 22 nt, Human
cuuuaugagccuugugaaggag

SEQ ID NO: 873989 - RNA, 22 nt, Human
ucugaaauaggaaagcaaaugg

SEQ ID NO: 873990 - RNA, 22 nt, Human
cuggcugaggucaccaguagcu

SEQ ID NO: 873991 - RNA, 17 nt, Human
uccagagaggcuucccu

SEQ ID NO: 873992 - RNA, 22 nt, Human
ucagcuguuaucacugucuguc

SEQ ID NO: 873993 - RNA, 22 nt, Human
uucuuucucagugggcagauac

SEQ ID NO: 873994 - RNA, 22 nt, Human
cccaggcaggagugugguggcu

SEQ ID NO: 873995 - RNA, 21 nt, Human
caggccccaggccuggggugc

SEQ ID NO: 873996 - RNA, 22 nt, Human
uauauuagugagauuuauccau

SEQ ID NO: 873997 - RNA, 22 nt, Human
cugugucccuugucccagagcc

SEQ ID NO: 873998 - RNA, 22 nt, Human
ugaaguuuccucugaggccagu

SEQ ID NO: 873999 - RNA, 22 nt, Human
acuggacucuggagguuucgua

SEQ ID NO: 874000 - RNA, 22 nt, Human
cuccccauggcaacaguuaugg

SEQ ID NO: 874001 - RNA, 22 nt, Human
cucuucuuuccaucccuagcca

SEQ ID NO: 874002 - RNA, 22 nt, Human
gccuggcucacagagcagccuu

SEQ ID NO: 874003 - RNA, 22 nt, Human
ugugaacaguaugucauuucac

SEQ ID NO: 874004 - RNA, 22 nt, Human
uuuaggaucaaugagaaagucu

SEQ ID NO: 874005 - RNA, 22 nt, Human
aagcaggaagcucagguccuug

SEQ ID NO: 874006 - RNA, 20 nt, Human
aagagcccgcagggcagugc

SEQ ID NO: 874007 - RNA, 22 nt, Human
aggcaagauuaggaccagaaga

SEQ ID NO: 874008 - RNA, 22 nt, Human
uagcagcacagaaagccuggag

SEQ ID NO: 874009 - RNA, 22 nt, Human
ugcuggccaauggcagaggcgg

SEQ ID NO: 874010 - RNA, 22 nt, Human
gugucccaaagauuagaaauca

SEQ ID NO: 874011 - RNA, 22 nt, Human
ucuaacaccugucagaugugau

SEQ ID NO: 874012 - RNA, 22 nt, Human
auugucgucaauggacacauag

SEQ ID NO: 874013 - RNA, 22 nt, Human
acacaggagaaaagaucuccca

SEQ ID NO: 874014 - RNA, 18 nt, Human
ucucaaaaauaauggcuu

SEQ ID NO: 874015 - RNA, 22 nt, Human
gugcacacauacaugaacgcug

SEQ ID NO: 874016 - RNA, 22 nt, Human
uagaaaccaucucacugcucag

SEQ ID NO: 874017 - RNA, 22 nt, Human
ugguauggaugguguggcuuuc

SEQ ID NO: 874018 - RNA, 22 nt, Human
ucugcgcugccuugauccuugg

SEQ ID NO: 874019 - RNA, 22 nt, Human
uccuacagauacuaaggagauc

SEQ ID NO: 874020 - RNA, 22 nt, Human
gcuggcaguguauuguuagcug

SEQ ID NO: 874021 - RNA, 22 nt, Human
agagugcuagccugagggaggu

SEQ ID NO: 874022 - RNA, 22 nt, Human
uggccuggcucacagugagauu

SEQ ID NO: 874023 - RNA, 22 nt, Human
uaaucuguugacuaacuuggga

SEQ ID NO: 874024 - RNA, 22 nt, Human
auuugaaaaccugagccucccg

SEQ ID NO: 874025 - RNA, 22 nt, Human
uauguaaaggauugagaugaau

SEQ ID NO: 874026 - RNA, 22 nt, Human
aagaguuuaauuuugucuagac

SEQ ID NO: 874027 - RNA, 22 nt, Human
acaaggcaauggcaggauuuca

SEQ ID NO: 874028 - RNA, 22 nt, Human
uucuggaauacuaaguuccuuu

SEQ ID NO: 874029 - RNA, 22 nt, Human
auggacagaagguagcaccuau

SEQ ID NO: 874030 - RNA, 22 nt, Human
cagugugccugaaucaaguguu

SEQ ID NO: 874031 - RNA, 22 nt, Human
ccuccugguaauuagcgaaagg

SEQ ID NO: 874032 - RNA, 22 nt, Human
agucuuauggccaucucugauu

SEQ ID NO: 874033 - RNA, 22 nt, Human
augccuguaaaacagcacccag

SEQ ID NO: 874034 - RNA, 22 nt, Human
auuauagggaauucuagaaguc

SEQ ID NO: 874035 - RNA, 22 nt, Human
gcuuucugugcagugaacacua

SEQ ID NO: 874036 - RNA, 22 nt, Human
cugcagcugcaguucugagaga

SEQ ID NO: 874037 - RNA, 22 nt, Human
ggccacagaacagcuacaggac

SEQ ID NO: 874038 - RNA, 22 nt, Human
cagagcugugauaaauagauau

SEQ ID NO: 874039 - RNA, 22 nt, Human
gguuuccauuauuuuaugggug

SEQ ID NO: 874040 - RNA, 22 nt, Human
aaaagaggagugguuuaugaca

SEQ ID NO: 874041 - RNA, 22 nt, Human
ggcacugggagaggugagacgg

SEQ ID NO: 874042 - RNA, 22 nt, Human
ucaguaacccugcuguucagag

SEQ ID NO: 874043 - RNA, 21 nt, Human
ugcaggcaggcagagaugcug

SEQ ID NO: 874044 - RNA, 22 nt, Human
uuuuaaacuauagcuggaugcu

SEQ ID NO: 874045 - RNA, 22 nt, Human
gcugguggugggccaguucugu

SEQ ID NO: 874046 - RNA, 22 nt, Human
ucuaagaauacucauaucuucu

SEQ ID NO: 874047 - RNA, 19 nt, Human
agacagagcucaguggguu

SEQ ID NO: 874048 - RNA, 22 nt, Human
aaguguuaaaagauuaaaugcu

SEQ ID NO: 874049 - RNA, 22 nt, Human
gggcaguguugugguucucuau

SEQ ID NO: 874050 - RNA, 22 nt, Human
acuuaaaaacagauccagcagg

SEQ ID NO: 874051 - RNA, 22 nt, Human
auaaagucauggcagcuagaau

SEQ ID NO: 874052 - RNA, 22 nt, Human
ggcuccugaggaccaggcacag

SEQ ID NO: 874053 - RNA, 22 nt, Human
uggcugcagaaccuccucagga

SEQ ID NO: 874054 - RNA, 22 nt, Human
guuuguuuauacaaaagauccu

SEQ ID NO: 874055 - RNA, 23 nt, Human
ucugcuggugacacggucacauu

SEQ ID NO: 874056 - RNA, 22 nt, Human
auuugccuguaagacaaggccu

SEQ ID NO: 874057 - RNA, 22 nt, Human
cugucugugccucuucucccag

SEQ ID NO: 874058 - RNA, 22 nt, Human
ucauuacaucuuggccaaaacu

SEQ ID NO: 874059 - RNA, 22 nt, Human
ucucugagaagcugaggcuggg

SEQ ID NO: 874060 - RNA, 22 nt, Human
uaauacuugcuuuggauguaug

SEQ ID NO: 874061 - RNA, 22 nt, Human
gccucccugagucacccaagca

SEQ ID NO: 874062 - RNA, 22 nt, Human
gauguauacaggguugacucau

SEQ ID NO: 874063 - RNA, 22 nt, Human
cuucuuuuacaggucuuggguu

SEQ ID NO: 874064 - RNA, 22 nt, Human
gaagagcugcacacuggggacu

SEQ ID NO: 874065 - RNA, 22 nt, Human
gugcugaaauagaggagguggc

SEQ ID NO: 874066 - RNA, 22 nt, Human
cuggcucuuucagccgcuggag

SEQ ID NO: 874067 - RNA, 22 nt, Human
ggcuggcacgaagcccugcugg

SEQ ID NO: 874068 - RNA, 22 nt, Human
auagcaaagaugucaauucccc

SEQ ID NO: 874069 - RNA, 22 nt, Human
agcagggggcauccuugcccuu

SEQ ID NO: 874070 - RNA, 22 nt, Human
gagcuggcacagaaggaucuua

SEQ ID NO: 874071 - RNA, 22 nt, Human
cugggcucagaugagaggaagg

SEQ ID NO: 874072 - RNA, 21 nt, Human
cucaggauggcggccuggugg

SEQ ID NO: 874073 - RNA, 22 nt, Human
gcuucagacuggagcagaggaa

SEQ ID NO: 874074 - RNA, 22 nt, Human
uaugugcacauuagagagaugg

SEQ ID NO: 874075 - RNA, 22 nt, Human
agcugccucugaacuuuaauuc

SEQ ID NO: 874076 - RNA, 22 nt, Human
ccccucccugaccugguugggc

SEQ ID NO: 874077 - RNA, 21 nt, Human
ugacccuugccgagcuacauu

SEQ ID NO: 874078 - RNA, 16 nt, Human
uuucucucugcuauuu

SEQ ID NO: 874079 - RNA, 22 nt, Human
gggccaggucggugaaugguca

SEQ ID NO: 874080 - RNA, 22 nt, Human
ucaguaacuuggccgaggucau

SEQ ID NO: 874081 - RNA, 22 nt, Human
aggaaagguagcgugccagcag

SEQ ID NO: 874082 - RNA, 22 nt, Human
uucaaucauugcaaaguaaugg

SEQ ID NO: 874083 - RNA, 22 nt, Human
auuuacuacugcuaucuagaag

SEQ ID NO: 874084 - RNA, 22 nt, Human
auaaagcauacuuuguaugacu

SEQ ID NO: 874085 - RNA, 22 nt, Human
uuucaagaggccagagcgaggc

SEQ ID NO: 874086 - RNA, 22 nt, Human
uucuaaagugcaaucugacaga

SEQ ID NO: 874087 - RNA, 22 nt, Human
cacaugagagcccccaagagca

SEQ ID NO: 874088 - RNA, 23 nt, Human
augagcauuuuuaauuucugugg

SEQ ID NO: 874089 - RNA, 18 nt, Human
gugcucuaugucuguuau

SEQ ID NO: 874090 - RNA, 22 nt, Human
caaggcaugcacaagaaggggg

SEQ ID NO: 874091 - RNA, 22 nt, Human
ucuuuggcuaugauuuacuguu

SEQ ID NO: 874092 - RNA, 22 nt, Human
uagacucuuggggaaaucugca

SEQ ID NO: 874093 - RNA, 22 nt, Human
auuucacagcugucaguguuac

SEQ ID NO: 874094 - RNA, 22 nt, Human
ccuuagaaaaucauggaauauu

SEQ ID NO: 874095 - RNA, 22 nt, Human
gcagggaggaagagaugcuucc

SEQ ID NO: 874096 - RNA, 22 nt, Human
uaagacacauucauaucugucu

SEQ ID NO: 874097 - RNA, 22 nt, Human
uuggagauaugugaaaaaaaca

SEQ ID NO: 874098 - RNA, 22 nt, Human
ucugucauccaggcuggaauau

SEQ ID NO: 874099 - RNA, 22 nt, Human
uggaaggccuguuguguccuag

SEQ ID NO: 874100 - RNA, 22 nt, Human
ggccggccuuugcgagcauucu

SEQ ID NO: 874101 - RNA, 22 nt, Human
agaaaucugacugcugugcaca

SEQ ID NO: 874102 - RNA, 22 nt, Human
guguggcugugggagauguuca

SEQ ID NO: 874103 - RNA, 22 nt, Human
aaggugcucguuauggccagug

SEQ ID NO: 874104 - RNA, 22 nt, Human
gcuacagacugagcauggcucu

SEQ ID NO: 874105 - RNA, 22 nt, Human
ugcuugugugagggccugggag

SEQ ID NO: 874106 - RNA, 22 nt, Human
ggugccaggcucccagcucagg

SEQ ID NO: 874107 - RNA, 22 nt, Human
uggggagaggaauuugaaugau

SEQ ID NO: 874108 - RNA, 22 nt, Human
ugcagcucuguaugcugauuau

SEQ ID NO: 874109 - RNA, 22 nt, Human
guggcccacuuacgucaugugu

SEQ ID NO: 874110 - RNA, 22 nt, Human
uccugugccaucucuagagacu

SEQ ID NO: 874111 - RNA, 22 nt, Human
aaaugcuguguuuuaacauaga

SEQ ID NO: 874112 - RNA, 23 nt, Human
agaggggagcaucugcuggcuga

SEQ ID NO: 874113 - RNA, 22 nt, Human
ucaggaaguauaaucagauuca

SEQ ID NO: 874114 - RNA, 22 nt, Human
gauuuucaugauaaacuuguga

SEQ ID NO: 874115 - RNA, 20 nt, Human
gaagccagaggggaaaggag

SEQ ID NO: 874116 - RNA, 22 nt, Human
acacaugcugauaagaauauaa

SEQ ID NO: 874117 - RNA, 22 nt, Human
uaguggaggccuguugugugca

SEQ ID NO: 874118 - RNA, 22 nt, Human
ggagggggacugacacugauuu

SEQ ID NO: 874119 - RNA, 18 nt, Human
agugcaugcuaggggaag

SEQ ID NO: 874120 - RNA, 22 nt, Human
ugcagaaguauuccaggcccca

SEQ ID NO: 874121 - RNA, 22 nt, Human
uugugugguagcuucauugaac

SEQ ID NO: 874122 - RNA, 22 nt, Human
augugucugugggcacacacac

SEQ ID NO: 874123 - RNA, 23 nt, Human
acagggcuuaucugucacucauc

SEQ ID NO: 874124 - RNA, 22 nt, Human
cuguccucuguccucagcagga

SEQ ID NO: 874125 - RNA, 22 nt, Human
ccucugagcuggccuguggggc

SEQ ID NO: 874126 - RNA, 22 nt, Human
guggggcuggaagauggguacu

SEQ ID NO: 874127 - RNA, 22 nt, Human
ccccagaaagccuggcacuagg

SEQ ID NO: 874128 - RNA, 22 nt, Human
uuggaaagcaacuuuugagagu

SEQ ID NO: 874129 - RNA, 22 nt, Human
ccaggcuuucccagccucucca

SEQ ID NO: 874130 - RNA, 22 nt, Human
agguagcuauccagacgcugaa

SEQ ID NO: 874131 - RNA, 19 nt, Human
gagcaggccacacaugugu

SEQ ID NO: 874132 - RNA, 22 nt, Human
gcugagagugagcacuggauau

SEQ ID NO: 874133 - RNA, 22 nt, Human
gaccugaaagugugggcgaccu

SEQ ID NO: 874134 - RNA, 22 nt, Human
agaggccacuuugccugugaug

SEQ ID NO: 874135 - RNA, 22 nt, Human
uucaauacaccauaggaauagu

SEQ ID NO: 874136 - RNA, 22 nt, Human
aauucaaucuaagaaaugauca

SEQ ID NO: 874137 - RNA, 22 nt, Human
cagagccuuuguguccacauuu

SEQ ID NO: 874138 - RNA, 22 nt, Human
cuacauuucauccagggagagc

SEQ ID NO: 874139 - RNA, 22 nt, Human
agugcauucugucaucuugguu

SEQ ID NO: 874140 - RNA, 22 nt, Human
uuggaacagaaacagacaaaua

SEQ ID NO: 874141 - RNA, 22 nt, Human
uuuaucugaaaaaacucuugga

SEQ ID NO: 874142 - RNA, 22 nt, Human
ccaggguuuaaauucugacuau

SEQ ID NO: 874143 - RNA, 22 nt, Human
uugcaagacacuuggaagcaca

SEQ ID NO: 874144 - RNA, 18 nt, Human
agcagcugugccacacug

SEQ ID NO: 874145 - RNA, 22 nt, Human
uaucuagauaguuuagccaucu

SEQ ID NO: 874146 - RNA, 22 nt, Human
ggcuggcacugaggagagcucu

SEQ ID NO: 874147 - RNA, 22 nt, Human
gcgcagcucagugagggaacuu

SEQ ID NO: 874148 - RNA, 22 nt, Human
gaggacaagcugugaguggggu

SEQ ID NO: 874149 - RNA, 22 nt, Human
gcuuuggaaacuggcccugcgc

SEQ ID NO: 874150 - RNA, 22 nt, Human
auaaaaucaacuggcuccaguu

SEQ ID NO: 874151 - RNA, 22 nt, Human
uuccuaacacaguguaagcaag

SEQ ID NO: 874152 - RNA, 22 nt, Human
gaggccuggcugucagucccca

SEQ ID NO: 874153 - RNA, 22 nt, Human
cagguggcauugucccgccagc

SEQ ID NO: 874154 - RNA, 22 nt, Human
cagcacuucaaugagcauuuca

SEQ ID NO: 874155 - RNA, 20 nt, Human
aaugucuugagacauuucag

SEQ ID NO: 874156 - RNA, 22 nt, Human
ucuuugaaguaucuuaaauggu

SEQ ID NO: 874157 - RNA, 22 nt, Human
uaugugugcauguauacauuaa

SEQ ID NO: 874158 - RNA, 22 nt, Human
aagggccuccuggggagccugg

SEQ ID NO: 874159 - RNA, 22 nt, Human
aagauacagacagagccaaaau

SEQ ID NO: 874160 - RNA, 22 nt, Human
ccuggugcuuaccagagcuuuu

SEQ ID NO: 874161 - RNA, 22 nt, Human
uccaggaguccuggguggcccc

SEQ ID NO: 874162 - RNA, 21 nt, Human
ugacuaauugugauaaagugc

SEQ ID NO: 874163 - RNA, 22 nt, Human
cuugucugggcagcuugggagu

SEQ ID NO: 874164 - RNA, 22 nt, Human
ugauucugagggagcauucugc

SEQ ID NO: 874165 - RNA, 22 nt, Human
uucagaaguagcuaagcaguca

SEQ ID NO: 874166 - RNA, 22 nt, Human
uaagcauuaacucugcugcaag

SEQ ID NO: 874167 - RNA, 22 nt, Human
auagacaaugguuugccaagaa

SEQ ID NO: 874168 - RNA, 22 nt, Human
ucuuugcauuccugugugcuuu

SEQ ID NO: 874169 - RNA, 22 nt, Human
uaaugcuuuguuuugaucuaac

SEQ ID NO: 874170 - RNA, 22 nt, Human
gcaccuuaauuaagaaauugcc

SEQ ID NO: 874171 - RNA, 19 nt, Human
ugcuucuggaaccaugauc

SEQ ID NO: 874172 - RNA, 22 nt, Human
ugcauggacgugacuuggccaa

SEQ ID NO: 874173 - RNA, 22 nt, Human
ucaggccaaagaaacagcauga

SEQ ID NO: 874174 - RNA, 22 nt, Human
uaugucugcuugguuuuggaau

SEQ ID NO: 874175 - RNA, 22 nt, Human
ugggcucagugggagaaagggc

SEQ ID NO: 874176 - RNA, 22 nt, Human
acagggaauggagggaucagua

SEQ ID NO: 874177 - RNA, 22 nt, Human
ggcuuggcuacaagccaugggc

SEQ ID NO: 874178 - RNA, 22 nt, Human
gaaggaaaaauacucuguaagg

SEQ ID NO: 874179 - RNA, 22 nt, Human
gaaucucaguggaagcaggaag

SEQ ID NO: 874180 - RNA, 18 nt, Human
ggaaggugcuggagugca

SEQ ID NO: 874181 - RNA, 22 nt, Human
uccaggagguugagacugcagu

SEQ ID NO: 874182 - RNA, 22 nt, Human
ucauaugucacucaugggcaua

SEQ ID NO: 874183 - RNA, 22 nt, Human
gcugcaagucacagaaacagug

SEQ ID NO: 874184 - RNA, 22 nt, Human
gcugugugccaggggaaggcug

SEQ ID NO: 874185 - RNA, 19 nt, Human
ucccuucuauaguaauaaa

SEQ ID NO: 874186 - RNA, 20 nt, Human
aaagcaguaugcaaguagag

SEQ ID NO: 874187 - RNA, 21 nt, Human
ugaggcucaucuuauguggcu

SEQ ID NO: 874188 - RNA, 22 nt, Human
auuuccacauaagggaaauaag

SEQ ID NO: 874189 - RNA, 22 nt, Human
gggaagugcccucuucaggaga

SEQ ID NO: 874190 - RNA, 19 nt, Human
uccagacuguccaggcuau

SEQ ID NO: 874191 - RNA, 23 nt, Human
uccuggguuugaauucuagucuu

SEQ ID NO: 874192 - RNA, 19 nt, Human
acacugaauguagaauugg

SEQ ID NO: 874193 - RNA, 22 nt, Human
ucccugcacagccgagccaugc

SEQ ID NO: 874194 - RNA, 22 nt, Human
ucaggacauuugucagcaggag

SEQ ID NO: 874195 - RNA, 22 nt, Human
uccuuggaaauuucaucagaca

SEQ ID NO: 874196 - RNA, 22 nt, Human
aacuucauuccuuuuuaugacu

SEQ ID NO: 874197 - RNA, 22 nt, Human
ccuggacuuucaggacuacugu

SEQ ID NO: 874198 - RNA, 22 nt, Human
acaauaugggauauacauuuua

SEQ ID NO: 874199 - RNA, 22 nt, Human
cuuccucccggcccaugcucug

SEQ ID NO: 874200 - RNA, 19 nt, Human
uggcagguagugagcaguc

SEQ ID NO: 874201 - RNA, 22 nt, Human
aaagaguuacacaguuucagaa

SEQ ID NO: 874202 - RNA, 22 nt, Human
gccugccuuuuggaggcacauu

SEQ ID NO: 874203 - RNA, 22 nt, Human
auguacaagcuguuuuacugca

SEQ ID NO: 874204 - RNA, 22 nt, Human
aggacacacugcaagagccugg

SEQ ID NO: 874205 - RNA, 22 nt, Human
ccucacugcuauguguuugcuc

SEQ ID NO: 874206 - RNA, 22 nt, Human
ucauauagagggcauacaaaug

SEQ ID NO: 874207 - RNA, 22 nt, Human
cccagacucaucccugggagcu

SEQ ID NO: 874208 - RNA, 22 nt, Human
agauggaggaaggcugaacuca

SEQ ID NO: 874209 - RNA, 22 nt, Human
uauucacauguacauaugcuca

SEQ ID NO: 874210 - RNA, 22 nt, Human
ugucauaaguguuugcacccag

SEQ ID NO: 874211 - RNA, 22 nt, Human
gggcuacugagcuggaacuggg

SEQ ID NO: 874212 - RNA, 22 nt, Human
uggcagagcccagaacugagca

SEQ ID NO: 874213 - RNA, 22 nt, Human
ugcagcauucugguaaaaggca

SEQ ID NO: 874214 - RNA, 22 nt, Human
gagaggcugaaaucacaggagc

SEQ ID NO: 874215 - RNA, 22 nt, Human
ucuacuucuccuucauuuccca

SEQ ID NO: 874216 - RNA, 22 nt, Human
gugcucuauguugauuccuuga

SEQ ID NO: 874217 - RNA, 22 nt, Human
ugcuuuauaggggauugcaggc

SEQ ID NO: 874218 - RNA, 22 nt, Human
gcaaagcacacccucagaguuu

SEQ ID NO: 874219 - RNA, 22 nt, Human
cagcaagauuaagggcagaaaa

SEQ ID NO: 874220 - RNA, 22 nt, Human
ucuugcaguugcgcagugcaug

SEQ ID NO: 874221 - RNA, 22 nt, Human
ucccacaugugaauccucaggu

SEQ ID NO: 874222 - RNA, 22 nt, Human
gccaggcagacaggucaucagg

SEQ ID NO: 874223 - RNA, 22 nt, Human
guucagauuugacugguuucuc

SEQ ID NO: 874224 - RNA, 22 nt, Human
ucauaaauuggguuggcugggu

SEQ ID NO: 874225 - RNA, 22 nt, Human
uucuaaucugggcuucugcagu

SEQ ID NO: 874226 - RNA, 22 nt, Human
agauuucccacuccauguauug

SEQ ID NO: 874227 - RNA, 22 nt, Human
aggagcuggccuagaaaggaga

SEQ ID NO: 874228 - RNA, 22 nt, Human
auucuucaaagagugucaaagu

SEQ ID NO: 874229 - RNA, 22 nt, Human
uccaggagugauaaggccacug

SEQ ID NO: 874230 - RNA, 22 nt, Human
gcaguggggcaaucauagcuca

SEQ ID NO: 874231 - RNA, 22 nt, Human
caggcagcugcuggguucagcc

SEQ ID NO: 874232 - RNA, 22 nt, Human
auccaaacauguaccacacuaa

SEQ ID NO: 874233 - RNA, 22 nt, Human
acugggcaccaucaugagauag

SEQ ID NO: 874234 - RNA, 22 nt, Human
augguuuguaacccaauacucc

SEQ ID NO: 874235 - RNA, 22 nt, Human
gcuguuucuuuggcaaacugau

SEQ ID NO: 874236 - RNA, 22 nt, Human
ggcuggccuguguggccgccac

SEQ ID NO: 874237 - RNA, 22 nt, Human
cagucaggaaugccuccuuccu

SEQ ID NO: 874238 - RNA, 22 nt, Human
uucaucauuacagucauguuau

SEQ ID NO: 874239 - RNA, 22 nt, Human
gagaggaguagacacuuugguu

SEQ ID NO: 874240 - RNA, 22 nt, Human
cagucaccaccagguggcagua

SEQ ID NO: 874241 - RNA, 22 nt, Human
uucaaguuuucagaauagccac

SEQ ID NO: 874242 - RNA, 22 nt, Human
ccccugcuggccugcugguuuc

SEQ ID NO: 874243 - RNA, 22 nt, Human
cccagcuggccagguggcuuug

SEQ ID NO: 874244 - RNA, 19 nt, Human
cuagggcuuggcagcaggc

SEQ ID NO: 874245 - RNA, 20 nt, Human
aaagauacuuuuuguaaugg

SEQ ID NO: 874246 - RNA, 22 nt, Human
ucuccauaggcaguucauaaca

SEQ ID NO: 874247 - RNA, 19 nt, Human
agguaggcaguggcaugga

SEQ ID NO: 874248 - RNA, 22 nt, Human
ugggagaacacugcucuggaug

SEQ ID NO: 874249 - RNA, 18 nt, Human
ggccucagccuggccgga

SEQ ID NO: 874250 - RNA, 22 nt, Human
uuucaaagggaaguuaugaagu

SEQ ID NO: 874251 - RNA, 22 nt, Human
uuacagaaggaacacuacucag

SEQ ID NO: 874252 - RNA, 22 nt, Human
agcaugcugguuacguguagca

SEQ ID NO: 874253 - RNA, 22 nt, Human
uuucgagggccuuaaguauucc

SEQ ID NO: 874254 - RNA, 22 nt, Human
aagcaccaaguucaacauuccc

SEQ ID NO: 874255 - RNA, 22 nt, Human
cugaagcaaaggaucgagcuaa

SEQ ID NO: 874256 - RNA, 22 nt, Human
gggccagaccucuucucaggga

SEQ ID NO: 874257 - RNA, 22 nt, Human
acacaguugauugucacucagg

SEQ ID NO: 874258 - RNA, 22 nt, Human
uuucucuagcuauucauuaaau

SEQ ID NO: 874259 - RNA, 22 nt, Human
ggcuuuauuucacuguaccaua

SEQ ID NO: 874260 - RNA, 22 nt, Human
cagaagacgccugggugcugua

SEQ ID NO: 874261 - RNA, 22 nt, Human
accagagauggggcuucucugu

SEQ ID NO: 874262 - RNA, 22 nt, Human
gacagcuguacacuccugguua

SEQ ID NO: 874263 - RNA, 22 nt, Human
cucaggccauuccuaccaaggg

SEQ ID NO: 874264 - RNA, 22 nt, Human
guggcuauauuugaggauacgu

SEQ ID NO: 874265 - RNA, 22 nt, Human
aggcccuguuaugagccacugu

SEQ ID NO: 874266 - RNA, 22 nt, Human
guaacauucuagaaacuuaaca

SEQ ID NO: 874267 - RNA, 15 nt, Human
cuguggcuaaccuaa

SEQ ID NO: 874268 - RNA, 22 nt, Human
ugucaauaucaggcagaccuaa

SEQ ID NO: 874269 - RNA, 22 nt, Human
ugggaagggaguuucuuggagu

SEQ ID NO: 874270 - RNA, 22 nt, Human
aagacugucugggacaagauga

SEQ ID NO: 874271 - RNA, 20 nt, Human
uuuuccacuccucaaaacag

SEQ ID NO: 874272 - RNA, 22 nt, Human
aacaggagaguaaauauaugau

SEQ ID NO: 874273 - RNA, 18 nt, Human
cccacacagcaguagcuc

SEQ ID NO: 874274 - RNA, 22 nt, Human
agggcagccugagugcuggccc

SEQ ID NO: 874275 - RNA, 22 nt, Human
ggcuccugauuugagggggcug

SEQ ID NO: 874276 - RNA, 19 nt, Human
ccagccucucuuccacccc

SEQ ID NO: 874277 - RNA, 22 nt, Human
uucugauugcugaugaggccca

SEQ ID NO: 874278 - RNA, 22 nt, Human
uucacaauagcuggcaucaucu

SEQ ID NO: 874279 - RNA, 22 nt, Human
uucacaagucauuagcugcaua

SEQ ID NO: 874280 - RNA, 22 nt, Human
augguuuauugcuuuaaugaaa

SEQ ID NO: 874281 - RNA, 22 nt, Human
aggacacacuguucucacguaa

SEQ ID NO: 874282 - RNA, 22 nt, Human
uuuaugauuauuuuaaagcagc

SEQ ID NO: 874283 - RNA, 23 nt, Human
gcucagagguuuuucucuggaug

SEQ ID NO: 874284 - RNA, 22 nt, Human
aagaaaacaugaucuaauuuaa

SEQ ID NO: 874285 - RNA, 22 nt, Human
acauuucagauguaaugugaug

SEQ ID NO: 874286 - RNA, 22 nt, Human
gcugccuccacuggcucccagu

SEQ ID NO: 874287 - RNA, 22 nt, Human
cauucucugaucuucacauacc

SEQ ID NO: 874288 - RNA, 22 nt, Human
uuaaaugagauguucagauauu

SEQ ID NO: 874289 - RNA, 22 nt, Human
ggcggugguugagaggacggcg

SEQ ID NO: 874290 - RNA, 22 nt, Human
aaugagaauguaagugaagaga

SEQ ID NO: 874291 - RNA, 22 nt, Human
agugaacaguuuggaacacaug

SEQ ID NO: 874292 - RNA, 22 nt, Human
ucucugggacacugggucaguu

SEQ ID NO: 874293 - RNA, 22 nt, Human
cuggcucccucgcugaggugcu

SEQ ID NO: 874294 - RNA, 22 nt, Human
ucauuucaugucucaggcacug

SEQ ID NO: 874295 - RNA, 22 nt, Human
gucuuagauuucaccgauaaug

SEQ ID NO: 874296 - RNA, 22 nt, Human
aaggaugaacauuaauacauca

SEQ ID NO: 874297 - RNA, 22 nt, Human
caacacugauuauggcugagcu

SEQ ID NO: 874298 - RNA, 22 nt, Human
uggcuucaucugcagcacugcc

SEQ ID NO: 874299 - RNA, 22 nt, Human
uagggcuggcgugcucagggaa

SEQ ID NO: 874300 - RNA, 22 nt, Human
aagauggagcacgagcagaagc

SEQ ID NO: 874301 - RNA, 22 nt, Human
aaggagucugggccauucagag

SEQ ID NO: 874302 - RNA, 22 nt, Human
ccagggugggguccaggaacca

SEQ ID NO: 874303 - RNA, 22 nt, Human
uucucuggagggcugcccggcc

SEQ ID NO: 874304 - RNA, 22 nt, Human
gauuuucauuugcacucuagaa

SEQ ID NO: 874305 - RNA, 22 nt, Human
auggacuuaagagucagaagcu

SEQ ID NO: 874306 - RNA, 22 nt, Human
uaacacaugaaagcaccuucuu

SEQ ID NO: 874307 - RNA, 22 nt, Human
agaaaucucaguaucucaggga

SEQ ID NO: 874308 - RNA, 22 nt, Human
ugcucaggcccugggccauccu

SEQ ID NO: 874309 - RNA, 22 nt, Human
cuggggaacgcagcgagcagcg

SEQ ID NO: 874310 - RNA, 22 nt, Human
aagucuuaaccaaauaaauguu

SEQ ID NO: 874311 - RNA, 22 nt, Human
ccagcagagugggguuuagagu

SEQ ID NO: 874312 - RNA, 22 nt, Human
gcugagcaacguggagaguuuu

SEQ ID NO: 874313 - RNA, 22 nt, Human
aucagagcuaguacuugcaggu

SEQ ID NO: 874314 - RNA, 20 nt, Human
accccagccccucuaucuga

SEQ ID NO: 874315 - RNA, 22 nt, Human
agucaguuaaccucacagcauc

SEQ ID NO: 874316 - RNA, 22 nt, Human
ccuuucucuggcagcaggacag

SEQ ID NO: 874317 - RNA, 22 nt, Human
aggugugggaaacgggugaccu

SEQ ID NO: 874318 - RNA, 22 nt, Human
agaugugggugucaggcaguga

SEQ ID NO: 874319 - RNA, 22 nt, Human
ggcuccugggcagcugcucccu

SEQ ID NO: 874320 - RNA, 22 nt, Human
gauuucuuuguacccacaaucc

SEQ ID NO: 874321 - RNA, 22 nt, Human
agagguggccaugggcgcugga

SEQ ID NO: 874322 - RNA, 22 nt, Human
aaauggcagcccagagguaagg

SEQ ID NO: 874323 - RNA, 22 nt, Human
cugugaugacaggcagggccaa

SEQ ID NO: 874324 - RNA, 22 nt, Human
uuuagugauaagaauuaugaaa

SEQ ID NO: 874325 - RNA, 22 nt, Human
guccugagagaggcuccuugcc

SEQ ID NO: 874326 - RNA, 22 nt, Human
aguucuuuuaccaaggcaaaug

SEQ ID NO: 874327 - RNA, 22 nt, Human
agcucaagcuacacacagaguc

SEQ ID NO: 874328 - RNA, 22 nt, Human
gcauugaaggcauuuuaucuac

SEQ ID NO: 874329 - RNA, 22 nt, Human
uuuacaacauaggccccaagaa

SEQ ID NO: 874330 - RNA, 22 nt, Human
ucauugaaugcucugcagguug

SEQ ID NO: 874331 - RNA, 22 nt, Human
auuuauauuuugggagcuccug

SEQ ID NO: 874332 - RNA, 20 nt, Human
cugcugugguccuuuauuuu

SEQ ID NO: 874333 - RNA, 22 nt, Human
uaagcaaaagucgagugugagc

SEQ ID NO: 874334 - RNA, 21 nt, Human
agaagccaugccaguaaaauu

SEQ ID NO: 874335 - RNA, 22 nt, Human
uacaguuccaggaucauagggu

SEQ ID NO: 874336 - RNA, 22 nt, Human
acgugcaucuuuccauaugugg

SEQ ID NO: 874337 - RNA, 22 nt, Human
gaggccuggagccgccuaggcg

SEQ ID NO: 874338 - RNA, 22 nt, Human
uccaggcuagccugguagagaa

SEQ ID NO: 874339 - RNA, 22 nt, Human
agaccacuaaaacuuucucuau

SEQ ID NO: 874340 - RNA, 22 nt, Human
uacauugacuuggauuguuaga

SEQ ID NO: 874341 - RNA, 22 nt, Human
agcagcaucaacccucccgugu

SEQ ID NO: 874342 - RNA, 22 nt, Human
acuuccuuccaaacauucauuu

SEQ ID NO: 874343 - RNA, 22 nt, Human
aaaugcuuauuagugucacaaa

SEQ ID NO: 874344 - RNA, 22 nt, Human
ccagcagcugacaccaguccca

SEQ ID NO: 874345 - RNA, 22 nt, Human
aggccuggugaaugaaguaucu

SEQ ID NO: 874346 - RNA, 22 nt, Human
uuucaaaguugggaauuguaau

SEQ ID NO: 874347 - RNA, 22 nt, Human
agccuggaggccaggagacagu

SEQ ID NO: 874348 - RNA, 22 nt, Human
ucuucagagugaaagucuguga

SEQ ID NO: 874349 - RNA, 19 nt, Human
cuugaaacuacuguugaga

SEQ ID NO: 874350 - RNA, 22 nt, Human
aggcuaguuaguauuuacaaaa

SEQ ID NO: 874351 - RNA, 22 nt, Human
auuuacaguuuagcauuucaag

SEQ ID NO: 874352 - RNA, 22 nt, Human
cagcagcaccuauuauaguguu

SEQ ID NO: 874353 - RNA, 22 nt, Human
ccagcugguguuccuuaggacc

SEQ ID NO: 874354 - RNA, 22 nt, Human
cacagggcuaaaugaaggguug

SEQ ID NO: 874355 - RNA, 22 nt, Human
guguguguucaauaaauuuaag

SEQ ID NO: 874356 - RNA, 20 nt, Human
auuuuguuuauguuccucuc

SEQ ID NO: 874357 - RNA, 22 nt, Human
uuuaugucccuucaaauguuua

SEQ ID NO: 874358 - RNA, 22 nt, Human
ucucagugaagaguauaacaaa

SEQ ID NO: 874359 - RNA, 22 nt, Human
ucuuugaucagccuuucacuga

SEQ ID NO: 874360 - RNA, 22 nt, Human
uucuguauguacauauguguau

SEQ ID NO: 874361 - RNA, 22 nt, Human
ggagggagguuagauucaagcu

SEQ ID NO: 874362 - RNA, 22 nt, Human
aaggcugguuuccuugauguuu

SEQ ID NO: 874363 - RNA, 22 nt, Human
uaaggugagcuguauaacaggg

SEQ ID NO: 874364 - RNA, 22 nt, Human
ugucaaaaauaagagagauugu

SEQ ID NO: 874365 - RNA, 22 nt, Human
aaggcagcaccgccuccugaaa

SEQ ID NO: 874366 - RNA, 22 nt, Human
cugacagaucuggaucugaacu

SEQ ID NO: 874367 - RNA, 22 nt, Human
ucuuuccauggccacacagucu

SEQ ID NO: 874368 - RNA, 22 nt, Human
augcaagcaaucugagcuuugg

SEQ ID NO: 874369 - RNA, 22 nt, Human
gucauaaagacagaaacauucc

SEQ ID NO: 874370 - RNA, 22 nt, Human
aguggcagaagccaagucugca

SEQ ID NO: 874371 - RNA, 22 nt, Human
ucacccauccuggaugagauuc

SEQ ID NO: 874372 - RNA, 22 nt, Human
ggaaggguuuggaaagccgaga

SEQ ID NO: 874373 - RNA, 22 nt, Human
auaagcaugauuaccgggagca

SEQ ID NO: 874374 - RNA, 22 nt, Human
gagguggauguugcagugagcu

SEQ ID NO: 874375 - RNA, 22 nt, Human
gugagaguguuuggaaauagaa

SEQ ID NO: 874376 - RNA, 22 nt, Human
uuucauaauauccagagauuuu

SEQ ID NO: 874377 - RNA, 22 nt, Human
agguauuuguuacagcagcacc

SEQ ID NO: 874378 - RNA, 22 nt, Human
uuucacauauaggggaagcuac

SEQ ID NO: 874379 - RNA, 19 nt, Human
agggcugcucuggccuggg

SEQ ID NO: 874380 - RNA, 20 nt, Human
agagagagguaaauugagca

SEQ ID NO: 874381 - RNA, 22 nt, Human
ugugaaggagcaugcagagggg

SEQ ID NO: 874382 - RNA, 22 nt, Human
uuugucuuggccucaguuuucu

SEQ ID NO: 874383 - RNA, 20 nt, Human
cuggcaggagcgagucuacc

SEQ ID NO: 874384 - RNA, 22 nt, Human
uuccacaggacuaaaugucauc

SEQ ID NO: 874385 - RNA, 22 nt, Human
caggguggggaaauagcgcccu

SEQ ID NO: 874386 - RNA, 22 nt, Human
auuugucucucuggguuuacuu

SEQ ID NO: 874387 - RNA, 21 nt, Human
agagacugucacugcaguacc

SEQ ID NO: 874388 - RNA, 22 nt, Human
uguaguguagcagggugggaca

SEQ ID NO: 874389 - RNA, 22 nt, Human
ggaaggaggggcaaagcaguuc

SEQ ID NO: 874390 - RNA, 22 nt, Human
aguuucuaccgguacauucagg

SEQ ID NO: 874391 - RNA, 22 nt, Human
ccugccagcccgcguucaugcc

SEQ ID NO: 874392 - RNA, 22 nt, Human
gcagcaggaauaggauaagcaa

SEQ ID NO: 874393 - RNA, 22 nt, Human
accuguguuucuguagugguca

SEQ ID NO: 874394 - RNA, 22 nt, Human
ccuugcccugagcaggggucag

SEQ ID NO: 874395 - RNA, 22 nt, Human
auggccagcccuucccgcagcu

SEQ ID NO: 874396 - RNA, 22 nt, Human
agcugagguugaagagugaacg

SEQ ID NO: 874397 - RNA, 22 nt, Human
gccacagggauuguuuugugag

SEQ ID NO: 874398 - RNA, 22 nt, Human
gucuggcuguuccugccuguga

SEQ ID NO: 874399 - RNA, 22 nt, Human
uggcaguuuuguauuugagcau

SEQ ID NO: 874400 - RNA, 22 nt, Human
cacaggcugcccgcagcuggga

SEQ ID NO: 874401 - RNA, 22 nt, Human
cagggccucucaucccacgggc

SEQ ID NO: 874402 - RNA, 19 nt, Human
uccagccugcuguuucucu

SEQ ID NO: 874403 - RNA, 22 nt, Human
gcucacaggcaguguugggaga

SEQ ID NO: 874404 - RNA, 22 nt, Human
uacaauguacuuccuugcacag

SEQ ID NO: 874405 - RNA, 22 nt, Human
uuaugcauauagcagauacgag

SEQ ID NO: 874406 - RNA, 22 nt, Human
gcagaggacacaggagggcaag

SEQ ID NO: 874407 - RNA, 22 nt, Human
cuggcugguuacuauuucuggu

SEQ ID NO: 874408 - RNA, 22 nt, Human
gggagcugcugaacacaagggu

SEQ ID NO: 874409 - RNA, 22 nt, Human
gcaguucuacuuauccauagac

SEQ ID NO: 874410 - RNA, 22 nt, Human
uuucauaauagugcaguuuguu

SEQ ID NO: 874411 - RNA, 22 nt, Human
augucuucauagcuuauaucca

SEQ ID NO: 874412 - RNA, 22 nt, Human
agguuggccucagggaggcucu

SEQ ID NO: 874413 - RNA, 22 nt, Human
caauacugaguuuacauucauc

SEQ ID NO: 874414 - RNA, 22 nt, Human
auuuuccagccuuucuagaacu

SEQ ID NO: 874415 - RNA, 22 nt, Human
agaaaguuguuuuagccaaacc

SEQ ID NO: 874416 - RNA, 22 nt, Human
agguauuucccaaaguggcaug

SEQ ID NO: 874417 - RNA, 22 nt, Human
cagauugagucugggaaaaggc

SEQ ID NO: 874418 - RNA, 22 nt, Human
caaggcagucccuacucccugc

SEQ ID NO: 874419 - RNA, 22 nt, Human
cuuccaaagcacuuuauggacc

SEQ ID NO: 874420 - RNA, 22 nt, Human
auuccaggcaugcaggaacaag

SEQ ID NO: 874421 - RNA, 22 nt, Human
uaguggcauuguugugaggauu

SEQ ID NO: 874422 - RNA, 22 nt, Human
ugauuuaaaagaaacauugucu

SEQ ID NO: 874423 - RNA, 22 nt, Human
aaaaagauagcauugugcuccu

SEQ ID NO: 874424 - RNA, 22 nt, Human
cugggaagcuucgagcaggaaa

SEQ ID NO: 874425 - RNA, 22 nt, Human
uuucuaaaauagauuuuauggu

SEQ ID NO: 874426 - RNA, 22 nt, Human
ucaggaaaugucccagguugug

SEQ ID NO: 874427 - RNA, 22 nt, Human
gacagacuaaauggcuguagga

SEQ ID NO: 874428 - RNA, 23 nt, Human
uucuucagccuuauagcccuggg

SEQ ID NO: 874429 - RNA, 22 nt, Human
augcuuuuuaaacuuaauugga

SEQ ID NO: 874430 - RNA, 22 nt, Human
gauuuuaauuauaggagguccu

SEQ ID NO: 874431 - RNA, 22 nt, Human
uaggaaagaaaugaguagugau

SEQ ID NO: 874432 - RNA, 22 nt, Human
aggcuuuuggagaagcauaugc

SEQ ID NO: 874433 - RNA, 20 nt, Human
ucauuucuugggguuccaag

SEQ ID NO: 874434 - RNA, 22 nt, Human
ugcuggccuguccacgggcugu

SEQ ID NO: 874435 - RNA, 22 nt, Human
gggauggacuuggggacuccag

SEQ ID NO: 874436 - RNA, 22 nt, Human
aucagagcaauggauaaaauca

SEQ ID NO: 874437 - RNA, 22 nt, Human
cuccugagaggaucucuguugu

SEQ ID NO: 874438 - RNA, 22 nt, Human
aggcugccucgugagcucgcug

SEQ ID NO: 874439 - RNA, 22 nt, Human
auguuaaaaaccaguacaguug

SEQ ID NO: 874440 - RNA, 22 nt, Human
aucaacaugacaggagaagaga

SEQ ID NO: 874441 - RNA, 22 nt, Human
caggcaccccaggugagcacug

SEQ ID NO: 874442 - RNA, 22 nt, Human
gaguggcuggguguuugaaucc

SEQ ID NO: 874443 - RNA, 22 nt, Human
uuggcacaaauuucugaaauaa

SEQ ID NO: 874444 - RNA, 22 nt, Human
augagaaaguuaaucaucauga

SEQ ID NO: 874445 - RNA, 22 nt, Human
uaggcugggaagaaagauucuc

SEQ ID NO: 874446 - RNA, 22 nt, Human
aaguaacaugggaacaucugaa

SEQ ID NO: 874447 - RNA, 22 nt, Human
uucuuugugcauccaauuuucu

SEQ ID NO: 874448 - RNA, 21 nt, Human
aaauccaaacacuaguccaca

SEQ ID NO: 874449 - RNA, 22 nt, Human
uuuaucuguuguacauuuaugc

SEQ ID NO: 874450 - RNA, 22 nt, Human
aucuuuguuaucucagaucuug

SEQ ID NO: 874451 - RNA, 22 nt, Human
uggcccugacugauguggaggg

SEQ ID NO: 874452 - RNA, 22 nt, Human
aagaauaagaggauuuagaaca

SEQ ID NO: 874453 - RNA, 22 nt, Human
uuuaguuugauguucuacuccu

SEQ ID NO: 874454 - RNA, 22 nt, Human
ucaggcccuucucccaggacuc

SEQ ID NO: 874455 - RNA, 22 nt, Human
ugaaguuuuacauccucuccaa

SEQ ID NO: 874456 - RNA, 22 nt, Human
cuucuaauauaaagucuuugca

SEQ ID NO: 874457 - RNA, 22 nt, Human
ggccacagucucuggaaggaug

SEQ ID NO: 874458 - RNA, 22 nt, Human
uuguucaucuggaacccagagc

SEQ ID NO: 874459 - RNA, 22 nt, Human
cacagaauaauucacauggcuc

SEQ ID NO: 874460 - RNA, 22 nt, Human
ccaggaggcagagguuguagug

SEQ ID NO: 874461 - RNA, 22 nt, Human
gaggcugaggguuagagaguca

SEQ ID NO: 874462 - RNA, 22 nt, Human
gcagggugauagugaggcucag

SEQ ID NO: 874463 - RNA, 22 nt, Human
cuuuccuaguuggucccagcac

SEQ ID NO: 874464 - RNA, 22 nt, Human
ggccugugucugugccuguccu

SEQ ID NO: 874465 - RNA, 23 nt, Human
aggaagaggcaauuucucuuaga

SEQ ID NO: 874466 - RNA, 22 nt, Human
gaagugacagaagggaugggca

SEQ ID NO: 874467 - RNA, 22 nt, Human
ucuggccacuugcuucacacug

SEQ ID NO: 874468 - RNA, 22 nt, Human
aggcaaauuauuguaugcaguu

SEQ ID NO: 874469 - RNA, 22 nt, Human
cuguccuggagggcauaggacg

SEQ ID NO: 874470 - RNA, 22 nt, Human
aaugaaaauuggacccuagaac

SEQ ID NO: 874471 - RNA, 19 nt, Human
ccagaggacuguuaaugaa

SEQ ID NO: 874472 - RNA, 22 nt, Human
ucugggacauucucuccauagu

SEQ ID NO: 874473 - RNA, 23 nt, Human
uccuaacucaauucagggguguc

SEQ ID NO: 874474 - RNA, 22 nt, Human
gauuuuaucgucauccuucugg

SEQ ID NO: 874475 - RNA, 22 nt, Human
cucccagacaugugccuccuug

SEQ ID NO: 874476 - RNA, 22 nt, Human
aguggggacuuaugccagcauu

SEQ ID NO: 874477 - RNA, 22 nt, Human
acaugugugacaacagagguga

SEQ ID NO: 874478 - RNA, 22 nt, Human
cuuuauguguacuuuccauuuu

SEQ ID NO: 874479 - RNA, 22 nt, Human
uauauucuauuguaccucuccu

SEQ ID NO: 874480 - RNA, 22 nt, Human
cuggcucuaucuccaaggcugg

SEQ ID NO: 874481 - RNA, 22 nt, Human
aggagccagggaagcugcuuuc

SEQ ID NO: 874482 - RNA, 22 nt, Human
ugaacccaggagguugcaguga

SEQ ID NO: 874483 - RNA, 22 nt, Human
uuaaauugucauuugagcaaug

SEQ ID NO: 874484 - RNA, 22 nt, Human
cugggcucugcggugucgcucu

SEQ ID NO: 874485 - RNA, 22 nt, Human
uggagaaaagguugaauccauc

SEQ ID NO: 874486 - RNA, 22 nt, Human
agucugacuagacucugcucac

SEQ ID NO: 874487 - RNA, 22 nt, Human
aaaagagaguugccagucugua

SEQ ID NO: 874488 - RNA, 22 nt, Human
ucacauuuguucuugaaucuaa

SEQ ID NO: 874489 - RNA, 22 nt, Human
cuguggagugcuuggcucagug

SEQ ID NO: 874490 - RNA, 20 nt, Human
aguuuauuccaggagaacug

SEQ ID NO: 874491 - RNA, 22 nt, Human
ugaacuuuuucucuacgggcca

SEQ ID NO: 874492 - RNA, 22 nt, Human
aacaaaugaccugauuucuucc

SEQ ID NO: 874493 - RNA, 22 nt, Human
cugucuguugaccauaguuugc

SEQ ID NO: 874494 - RNA, 22 nt, Human
aaaucacugauuaaaguuagaa

SEQ ID NO: 874495 - RNA, 22 nt, Human
gagguggcccuugcucagccuu

SEQ ID NO: 874496 - RNA, 22 nt, Human
uacuaacaaugagaacaagcca

SEQ ID NO: 874497 - RNA, 22 nt, Human
gcccaagguauaucagagacag

SEQ ID NO: 874498 - RNA, 22 nt, Human
agguagggaagaaggcaugaaa

SEQ ID NO: 874499 - RNA, 22 nt, Human
ccagagagaaauggauuugagu

SEQ ID NO: 874500 - RNA, 22 nt, Human
gaaucucaggaagaucucugca

SEQ ID NO: 874501 - RNA, 22 nt, Human
acugcacuuuaggccaacuagg

SEQ ID NO: 874502 - RNA, 22 nt, Human
ugccaucugaaaauuacauccu

SEQ ID NO: 874503 - RNA, 22 nt, Human
uuaguugcucacuacaagguua

SEQ ID NO: 874504 - RNA, 22 nt, Human
uuguuucuucauuuagaagcuu

SEQ ID NO: 874505 - RNA, 22 nt, Human
agugucugccugggaggagcau

SEQ ID NO: 874506 - RNA, 22 nt, Human
gggcaugccugcgcagugcaug

SEQ ID NO: 874507 - RNA, 22 nt, Human
aacaggcuauuucuuuacaaac

SEQ ID NO: 874508 - RNA, 22 nt, Human
agcucugccgccuuucaggcug

SEQ ID NO: 874509 - RNA, 23 nt, Human
uaucuuuuucaauguuggaaaua

SEQ ID NO: 874510 - RNA, 22 nt, Human
cauuagcaaucauaaaccuuua

SEQ ID NO: 874511 - RNA, 22 nt, Human
ggugccagccuagugcaguggu

SEQ ID NO: 874512 - RNA, 22 nt, Human
cuuucuugcauaauuugaaacc

SEQ ID NO: 874513 - RNA, 22 nt, Human
aauugacagaaaguuuacgagg

SEQ ID NO: 874514 - RNA, 22 nt, Human
ugaaaugagagcacagaauaaa

SEQ ID NO: 874515 - RNA, 22 nt, Human
ugaaauguagauuaggcauucu

SEQ ID NO: 874516 - RNA, 22 nt, Human
auaaucauuuuaauuagugguu

SEQ ID NO: 874517 - RNA, 22 nt, Human
agccugguguggggcugcagag

SEQ ID NO: 874518 - RNA, 22 nt, Human
caugugucuuuauggagccaca

SEQ ID NO: 874519 - RNA, 22 nt, Human
uaggccaguggcagguugugug

SEQ ID NO: 874520 - RNA, 22 nt, Human
uauauguuuuucuaauuaggga

SEQ ID NO: 874521 - RNA, 18 nt, Human
cuggagucacagugggga

SEQ ID NO: 874522 - RNA, 22 nt, Human
uuaugcuaaguggaauaagcca

SEQ ID NO: 874523 - RNA, 21 nt, Human
auccauucuccgguuaaugag

SEQ ID NO: 874524 - RNA, 22 nt, Human
uuugugaagggaacagaagugu

SEQ ID NO: 874525 - RNA, 22 nt, Human
aagaugcgguugaccauggugu

SEQ ID NO: 874526 - RNA, 22 nt, Human
acagacugagucaucuucuuaa

SEQ ID NO: 874527 - RNA, 19 nt, Human
ucuccaguugcuuucaggg

SEQ ID NO: 874528 - RNA, 22 nt, Human
gucucucaaaacuagaagagaa

SEQ ID NO: 874529 - RNA, 22 nt, Human
ccaggccagggcugcagcgagc

SEQ ID NO: 874530 - RNA, 22 nt, Human
agaggccaugcuagaggccugg

SEQ ID NO: 874531 - RNA, 22 nt, Human
cagcaucuguuggauggauaag

SEQ ID NO: 874532 - RNA, 22 nt, Human
uguuuuguuuaugagagcacag

SEQ ID NO: 874533 - RNA, 22 nt, Human
uucagaagugcuuucacacucu

SEQ ID NO: 874534 - RNA, 22 nt, Human
uuucaagaacagcagcauucca

SEQ ID NO: 874535 - RNA, 22 nt, Human
ucugaagcuggaggaagcuuug

SEQ ID NO: 874536 - RNA, 22 nt, Human
uaggaaauggcucaguuacugc

SEQ ID NO: 874537 - RNA, 22 nt, Human
augauuuaaagucauugugaac

SEQ ID NO: 874538 - RNA, 22 nt, Human
uuaucaguuguguguauacacg

SEQ ID NO: 874539 - RNA, 22 nt, Human
cagaaacacuuguagagaaguu

SEQ ID NO: 874540 - RNA, 22 nt, Human
aggcaaugcagauagaugaaug

SEQ ID NO: 874541 - RNA, 22 nt, Human
cacuuugaugcagggcucagua

SEQ ID NO: 874542 - RNA, 22 nt, Human
gagccugcccagcccuguccac

SEQ ID NO: 874543 - RNA, 22 nt, Human
guccugggagaugggacccuga

SEQ ID NO: 874544 - RNA, 22 nt, Human
caacaauuucccaguuucccau

SEQ ID NO: 874545 - RNA, 22 nt, Human
ugaauuuaaaauaaauguaguu

SEQ ID NO: 874546 - RNA, 22 nt, Human
uggaaugaguggcuaagauuca

SEQ ID NO: 874547 - RNA, 22 nt, Human
cauuuaguuauacuaaaacauu

SEQ ID NO: 874548 - RNA, 22 nt, Human
cacugcuugguugcaacauugc

SEQ ID NO: 874549 - RNA, 22 nt, Human
ccaggcuggagugcaguagugu

SEQ ID NO: 874550 - RNA, 22 nt, Human
gcugucagucacauuguuacag

SEQ ID NO: 874551 - RNA, 22 nt, Human
cccuggagucagguuggccugg

SEQ ID NO: 874552 - RNA, 19 nt, Human
uguuuuguuaaagcagucc

SEQ ID NO: 874553 - RNA, 22 nt, Human
gcugccucuguagcuuuggacc

SEQ ID NO: 874554 - RNA, 22 nt, Human
ccauuucacucuuccugaagga

SEQ ID NO: 874555 - RNA, 23 nt, Human
ugucugguuucuuuuauuuagca

SEQ ID NO: 874556 - RNA, 22 nt, Human
uuauaacaacaguuuacuuuaa

SEQ ID NO: 874557 - RNA, 22 nt, Human
ugacccuuccccucuggguucu

SEQ ID NO: 874558 - RNA, 22 nt, Human
auuggugcaauagucaggagcu

SEQ ID NO: 874559 - RNA, 22 nt, Human
acauagcacgucucaauuugga

SEQ ID NO: 874560 - RNA, 20 nt, Human
aaaguguaagcauauaauua

SEQ ID NO: 874561 - RNA, 22 nt, Human
gccagacacuccccugggcagg

SEQ ID NO: 874562 - RNA, 22 nt, Human
cagggaugagcagauggagcaa

SEQ ID NO: 874563 - RNA, 22 nt, Human
aucauucagugaccacuuccca

SEQ ID NO: 874564 - RNA, 22 nt, Human
gggccucacuaugugguccagg

SEQ ID NO: 874565 - RNA, 22 nt, Human
cugugggcauuugagugugggu

SEQ ID NO: 874566 - RNA, 22 nt, Human
aaacacugugggacaucuuacu

SEQ ID NO: 874567 - RNA, 22 nt, Human
augcacagacccaaaggccauc

SEQ ID NO: 874568 - RNA, 22 nt, Human
caaugauagauuuuacaaauua

SEQ ID NO: 874569 - RNA, 22 nt, Human
uaguggagaguuguuuugugca

SEQ ID NO: 874570 - RNA, 22 nt, Human
agugugcauuccucuccucagg

SEQ ID NO: 874571 - RNA, 22 nt, Human
ggaagccaggcccagagaugcu

SEQ ID NO: 874572 - RNA, 22 nt, Human
aggcagguccccuggaaggcac

SEQ ID NO: 874573 - RNA, 22 nt, Human
cuucucucccuggcacucagac

SEQ ID NO: 874574 - RNA, 22 nt, Human
cuggcccggcugccuggucauu

SEQ ID NO: 874575 - RNA, 22 nt, Human
ugcagggcuauaacuccauucu

SEQ ID NO: 874576 - RNA, 22 nt, Human
agauacaguguuacauuuuuau

SEQ ID NO: 874577 - RNA, 22 nt, Human
aaaugucagaggaacauauuga

SEQ ID NO: 874578 - RNA, 22 nt, Human
ccugugcccucugcauagcagc

SEQ ID NO: 874579 - RNA, 22 nt, Human
agccccucuguggcucugccuc

SEQ ID NO: 874580 - RNA, 22 nt, Human
ggacaacauguuuuaauuaagg

SEQ ID NO: 874581 - RNA, 22 nt, Human
uauguacaugauuucauuugcu

SEQ ID NO: 874582 - RNA, 22 nt, Human
ugaggccagagaguuugcauuu

SEQ ID NO: 874583 - RNA, 22 nt, Human
uagaaucuguguucaaaccuac

SEQ ID NO: 874584 - RNA, 22 nt, Human
auaccugaucaaggcaaaaaug

SEQ ID NO: 874585 - RNA, 22 nt, Human
aaaugcagauucuuaggcccca

SEQ ID NO: 874586 - RNA, 22 nt, Human
gggacuuaaugcagagagggac

SEQ ID NO: 874587 - RNA, 22 nt, Human
caguuucuucaucugcagaauc

SEQ ID NO: 874588 - RNA, 22 nt, Human
aaugucauuuaaaauaauucug

SEQ ID NO: 874589 - RNA, 22 nt, Human
agggcaugaagcaguggacagc

SEQ ID NO: 874590 - RNA, 22 nt, Human
cuuuaugaaaaccagauugggg

SEQ ID NO: 874591 - RNA, 22 nt, Human
ucacuucuucccuugcacauau

SEQ ID NO: 874592 - RNA, 22 nt, Human
cacaauuauagaagaaagcaua

SEQ ID NO: 874593 - RNA, 22 nt, Human
uguccagguggccucugcugcu

SEQ ID NO: 874594 - RNA, 22 nt, Human
aauccacgggauuauucuaacu

SEQ ID NO: 874595 - RNA, 22 nt, Human
gacagcaagagacagagcaucc

SEQ ID NO: 874596 - RNA, 22 nt, Human
gcauuucauguagauugagaac

SEQ ID NO: 874597 - RNA, 22 nt, Human
gaagucucucuggagaguagaa

SEQ ID NO: 874598 - RNA, 22 nt, Human
gcuuacaggugaggcagcaaga

SEQ ID NO: 874599 - RNA, 22 nt, Human
cagagacacuuaacaggaaugg

SEQ ID NO: 874600 - RNA, 21 nt, Human
ggccagcagcguccacugugg

SEQ ID NO: 874601 - RNA, 22 nt, Human
aagaaucucucuacuuuauuac

SEQ ID NO: 874602 - RNA, 22 nt, Human
gcaggaagccuuaccaagccca

SEQ ID NO: 874603 - RNA, 22 nt, Human
ggcugaguucucuugcugaauc

SEQ ID NO: 874604 - RNA, 22 nt, Human
cgcagcuggauaucaugugccu

SEQ ID NO: 874605 - RNA, 22 nt, Human
acaagccaauuacugugccagg

SEQ ID NO: 874606 - RNA, 17 nt, Human
uccuggauccauggugg

SEQ ID NO: 874607 - RNA, 22 nt, Human
cuggccugcugggugagguccu

SEQ ID NO: 874608 - RNA, 20 nt, Human
uauauguguacauacacaca

SEQ ID NO: 874609 - RNA, 22 nt, Human
aggcugagcggggucccagagc

SEQ ID NO: 874610 - RNA, 22 nt, Human
uuuaaaaucagaugggaguugg

SEQ ID NO: 874611 - RNA, 22 nt, Human
acagagacugggaugccugccu

SEQ ID NO: 874612 - RNA, 22 nt, Human
ucuggccuacuggaguccauga

SEQ ID NO: 874613 - RNA, 22 nt, Human
caggugccauagacgggccugg

SEQ ID NO: 874614 - RNA, 22 nt, Human
aaaggcuuuaaaauguacauau

SEQ ID NO: 874615 - RNA, 22 nt, Human
gccaggcuggaaagaacagaca

SEQ ID NO: 874616 - RNA, 22 nt, Human
cuuucauuugauaagaaugcca

SEQ ID NO: 874617 - RNA, 22 nt, Human
gggcuucucuuuagugagcuga

SEQ ID NO: 874618 - RNA, 22 nt, Human
cugggcuguuuguucuggucuc

SEQ ID NO: 874619 - RNA, 22 nt, Human
cauuuguucaaccauucucgcu

SEQ ID NO: 874620 - RNA, 22 nt, Human
uuuaucuuuaggacuuugcaga

SEQ ID NO: 874621 - RNA, 22 nt, Human
cugaagaugucugagaugcuca

SEQ ID NO: 874622 - RNA, 21 nt, Human
cauuucaugauuauagaaaug

SEQ ID NO: 874623 - RNA, 22 nt, Human
ccuuuucuauguaccagcagug

SEQ ID NO: 874624 - RNA, 22 nt, Human
cauuccagcucucauacucugg

SEQ ID NO: 874625 - RNA, 22 nt, Human
uguuucugggugugucucaccu

SEQ ID NO: 874626 - RNA, 22 nt, Human
aacagcuguucgcagauguagg

SEQ ID NO: 874627 - RNA, 20 nt, Human
gcugucugacaguucccaga

SEQ ID NO: 874628 - RNA, 22 nt, Human
aagcagagccugagacagggau

SEQ ID NO: 874629 - RNA, 19 nt, Human
acacaaugacacauauaua

SEQ ID NO: 874630 - RNA, 22 nt, Human
ugcagaaggccugacauugcac

SEQ ID NO: 874631 - RNA, 22 nt, Human
ggguggggccaggcaauuugca

SEQ ID NO: 874632 - RNA, 22 nt, Human
gucugccauguggagaaagcca

SEQ ID NO: 874633 - RNA, 22 nt, Human
agccagcuguggcuauggcucc

SEQ ID NO: 874634 - RNA, 22 nt, Human
aggcugcaggucugggucaugu

SEQ ID NO: 874635 - RNA, 22 nt, Human
augcuuuuccuaaaaugaugcc

SEQ ID NO: 874636 - RNA, 22 nt, Human
aagagcuucccuguuguagagg

SEQ ID NO: 874637 - RNA, 22 nt, Human
cugggcucuaggaaccauuccu

SEQ ID NO: 874638 - RNA, 20 nt, Human
acagagacugagacacuugc

SEQ ID NO: 874639 - RNA, 22 nt, Human
uugaaaaugguaagcaugauau

SEQ ID NO: 874640 - RNA, 22 nt, Human
gcugcugugugggagacaggcg

SEQ ID NO: 874641 - RNA, 22 nt, Human
uucaaguuuguauuucuguauu

SEQ ID NO: 874642 - RNA, 22 nt, Human
agcucagguagacucagcaucu

SEQ ID NO: 874643 - RNA, 22 nt, Human
uucucuaaggucccguucugga

SEQ ID NO: 874644 - RNA, 22 nt, Human
agcagcuuccuguuugcaggca

SEQ ID NO: 874645 - RNA, 22 nt, Human
cccugagcgugaggaggaagua

SEQ ID NO: 874646 - RNA, 22 nt, Human
uuggucccucauggacacauga

SEQ ID NO: 874647 - RNA, 22 nt, Human
aaguucuauagucuuucuacua

SEQ ID NO: 874648 - RNA, 22 nt, Human
gggaagagauuuccacaucauu

SEQ ID NO: 874649 - RNA, 22 nt, Human
aggagcagaacugauucugacu

SEQ ID NO: 874650 - RNA, 22 nt, Human
cugaaagcauuaacuccacuuc

SEQ ID NO: 874651 - RNA, 21 nt, Human
gaacaggaaaagcuggcuuca

SEQ ID NO: 874652 - RNA, 22 nt, Human
ugagaggcuagaucagcucugu

SEQ ID NO: 874653 - RNA, 22 nt, Human
ucauggggcucuucaaguggag

SEQ ID NO: 874654 - RNA, 22 nt, Human
auccacauuuaggucucuaaaa

SEQ ID NO: 874655 - RNA, 22 nt, Human
uaaagucaucuuuaaacaugcc

SEQ ID NO: 874656 - RNA, 22 nt, Human
agucaacaaaaauguggagccu

SEQ ID NO: 874657 - RNA, 22 nt, Human
uuuguacugccacagcugacgu

SEQ ID NO: 874658 - RNA, 22 nt, Human
uuuuugaucugagcaguuggag

SEQ ID NO: 874659 - RNA, 22 nt, Human
agaguuauauugguugagaauu

SEQ ID NO: 874660 - RNA, 22 nt, Human
agucuagauguguacuagguua

SEQ ID NO: 874661 - RNA, 22 nt, Human
uuacaagugucagguacuggca

SEQ ID NO: 874662 - RNA, 22 nt, Human
uauaccaugugugcacacuccc

SEQ ID NO: 874663 - RNA, 22 nt, Human
ugccugucuuuccucccucgua

SEQ ID NO: 874664 - RNA, 21 nt, Human
cuaacuuugaguccuggcccc

SEQ ID NO: 874665 - RNA, 22 nt, Human
ucaaagaugaugcugaaguuau

SEQ ID NO: 874666 - RNA, 22 nt, Human
ugagguggcuagggaggcacuc

SEQ ID NO: 874667 - RNA, 22 nt, Human
gcucaaaggcuaucaauagugu

SEQ ID NO: 874668 - RNA, 22 nt, Human
auaucaaagcuaguggaaauuu

SEQ ID NO: 874669 - RNA, 22 nt, Human
aggacagauuuuuggccaccag

SEQ ID NO: 874670 - RNA, 21 nt, Human
uucuuucugaaucugaaguau

SEQ ID NO: 874671 - RNA, 22 nt, Human
ucucccagaaguccucaguaca

SEQ ID NO: 874672 - RNA, 23 nt, Human
caggaaauguucuugaagccuga

SEQ ID NO: 874673 - RNA, 22 nt, Human
uuccuugguagggacaacucug

SEQ ID NO: 874674 - RNA, 22 nt, Human
gcacagggaggcuggccuggcc

SEQ ID NO: 874675 - RNA, 22 nt, Human
ugggagagauaggcuucuggac

SEQ ID NO: 874676 - RNA, 22 nt, Human
aaacaucauaggcaugcaugau

SEQ ID NO: 874677 - RNA, 23 nt, Human
uuuugcaauaagucacuggaaua

SEQ ID NO: 874678 - RNA, 22 nt, Human
ugacauuuaucuucuacaauga

SEQ ID NO: 874679 - RNA, 22 nt, Human
uccagagagaaaaacaagcuuu

SEQ ID NO: 874680 - RNA, 22 nt, Human
uaagagaugcuuuucuaaauaa

SEQ ID NO: 874681 - RNA, 22 nt, Human
gcccagugcccuagaaugcacu

SEQ ID NO: 874682 - RNA, 22 nt, Human
cucagugcaaccaaagugaucu

SEQ ID NO: 874683 - RNA, 22 nt, Human
aaggcuaaauucuguacugcau

SEQ ID NO: 874684 - RNA, 22 nt, Human
aacaaguaaguuuauauauauu

SEQ ID NO: 874685 - RNA, 22 nt, Human
uuccaaauuaaaauguacaaug

SEQ ID NO: 874686 - RNA, 22 nt, Human
uuaaagaguuuauuacuuguaa

SEQ ID NO: 874687 - RNA, 22 nt, Human
cagugaaaucacaacuuuaguu

SEQ ID NO: 874688 - RNA, 22 nt, Human
aaauuguccuuuuaagaaacag

SEQ ID NO: 874689 - RNA, 20 nt, Human
acugaucuuguucuuacucc

SEQ ID NO: 874690 - RNA, 22 nt, Human
aggcacagggaugcggagccag

SEQ ID NO: 874691 - RNA, 22 nt, Human
aaaaacacugggcugggaguca

SEQ ID NO: 874692 - RNA, 22 nt, Human
uggcuucacccguccuccccac

SEQ ID NO: 874693 - RNA, 22 nt, Human
gcagcuggggccacacuuaggc

SEQ ID NO: 874694 - RNA, 22 nt, Human
uggcagcagaacaugaaaccca

SEQ ID NO: 874695 - RNA, 22 nt, Human
uuacuguugguguauccauagc

SEQ ID NO: 874696 - RNA, 22 nt, Human
uaaagacaaaugacauuacggc

SEQ ID NO: 874697 - RNA, 22 nt, Human
acuguauaguauuuauucuuag

SEQ ID NO: 874698 - RNA, 22 nt, Human
ggcagguggcacugcugcuccc

SEQ ID NO: 874699 - RNA, 22 nt, Human
aggcccugcuuuccagagcuca

SEQ ID NO: 874700 - RNA, 22 nt, Human
acugcaucugaaacauggguca

SEQ ID NO: 874701 - RNA, 22 nt, Human
cagcuuugcaggcuggucagug

SEQ ID NO: 874702 - RNA, 22 nt, Human
cagagcaguccuugucaaucag

SEQ ID NO: 874703 - RNA, 22 nt, Human
gggugcaggggacccuagggac

SEQ ID NO: 874704 - RNA, 22 nt, Human
cugucucaagacugcaggcacu

SEQ ID NO: 874705 - RNA, 20 nt, Human
ggccauggguugccugaggu

SEQ ID NO: 874706 - RNA, 22 nt, Human
ggcaacaugaugucaaccagga

SEQ ID NO: 874707 - RNA, 22 nt, Human
ugcguguguguauauacacagg

SEQ ID NO: 874708 - RNA, 22 nt, Human
ugugaagcauagauucuguaga

SEQ ID NO: 874709 - RNA, 22 nt, Human
gccucugcaucaucacuccagc

SEQ ID NO: 874710 - RNA, 22 nt, Human
accccacagcauacaaaggcac

SEQ ID NO: 874711 - RNA, 22 nt, Human
aggacagugguguucuggagug

SEQ ID NO: 874712 - RNA, 22 nt, Human
cgcaggcuuuagaaucugcuac

SEQ ID NO: 874713 - RNA, 23 nt, Human
cuuuuaacuagaguaucagcugc

SEQ ID NO: 874714 - RNA, 22 nt, Human
acaguuuauguaaagcugccaa

SEQ ID NO: 874715 - RNA, 22 nt, Human
gcuggaaggcuaggcucaguug

SEQ ID NO: 874716 - RNA, 22 nt, Human
uccagcuuggcagagcuaccug

SEQ ID NO: 874717 - RNA, 22 nt, Human
agccacagucuguagccagcuu

SEQ ID NO: 874718 - RNA, 19 nt, Human
aaguagucaucccauucuu

SEQ ID NO: 874719 - RNA, 22 nt, Human
uaacacagugucuaccauuauu

SEQ ID NO: 874720 - RNA, 22 nt, Human
agacagcuccaagugucucugu

SEQ ID NO: 874721 - RNA, 22 nt, Human
aacagcugcuucuaucuuuuca

SEQ ID NO: 874722 - RNA, 22 nt, Human
uaaagguaacaugaacugcuuu

SEQ ID NO: 874723 - RNA, 22 nt, Human
cccugggcucagagcagguagc

SEQ ID NO: 874724 - RNA, 22 nt, Human
gcccaagccggagcugggagag

SEQ ID NO: 874725 - RNA, 22 nt, Human
uucuggaggccagcugccaccu

SEQ ID NO: 874726 - RNA, 22 nt, Human
caguuacaugcucaugucauca

SEQ ID NO: 874727 - RNA, 22 nt, Human
gucccucugugucccugcaguc

SEQ ID NO: 874728 - RNA, 22 nt, Human
gugagagcugcuagacuguuau

SEQ ID NO: 874729 - RNA, 20 nt, Human
acugugugaucuggaaagcu

SEQ ID NO: 874730 - RNA, 19 nt, Human
aacaaguaggaauggaaga

SEQ ID NO: 874731 - RNA, 22 nt, Human
cuggggcugcgguggaggagcc

SEQ ID NO: 874732 - RNA, 20 nt, Human
guucaugucucaaauagaaa

SEQ ID NO: 874733 - RNA, 22 nt, Human
aaguacacaucguuggccccga

SEQ ID NO: 874734 - RNA, 22 nt, Human
uagacucagacagaaaaugugu

SEQ ID NO: 874735 - RNA, 22 nt, Human
ccagcuccugggucuuagucag

SEQ ID NO: 874736 - RNA, 22 nt, Human
ggcuucugagugcucugcuguu

SEQ ID NO: 874737 - RNA, 22 nt, Human
aagguauuggggaauauuugac

SEQ ID NO: 874738 - RNA, 22 nt, Human
uugaccuggaaggugcuuccug

SEQ ID NO: 874739 - RNA, 22 nt, Human
cacagguagaugccaugcagca

SEQ ID NO: 874740 - RNA, 22 nt, Human
cuuuccuagauggccaucuuuc

SEQ ID NO: 874741 - RNA, 22 nt, Human
guaggaaagggagugaagggaa

SEQ ID NO: 874742 - RNA, 22 nt, Human
ugucaggacacagcuuucugug

SEQ ID NO: 874743 - RNA, 22 nt, Human
cagcugcuguucaguuuuguuu

SEQ ID NO: 874744 - RNA, 20 nt, Human
ugaggcaggagaauggcaug

SEQ ID NO: 874745 - RNA, 22 nt, Human
caaacauagugaagcaaugaca

SEQ ID NO: 874746 - RNA, 22 nt, Human
ggauuugggcuugcagcagagc

SEQ ID NO: 874747 - RNA, 23 nt, Human
gugagguauauugaaaucaugcu

SEQ ID NO: 874748 - RNA, 22 nt, Human
cccagcuccagagccagaaaca

SEQ ID NO: 874749 - RNA, 16 nt, Human
uccuggccccuaugga

SEQ ID NO: 874750 - RNA, 22 nt, Human
agguggaacguucaggugcuag

SEQ ID NO: 874751 - RNA, 22 nt, Human
ugcugccaaaugcgagcucugu

SEQ ID NO: 874752 - RNA, 16 nt, Human
ccucugggccugcaag

SEQ ID NO: 874753 - RNA, 22 nt, Human
uaccaaaaccaagccauuaucu

SEQ ID NO: 874754 - RNA, 22 nt, Human
caggagcccguugcuccggcgg

SEQ ID NO: 874755 - RNA, 22 nt, Human
gcugaaguccuaaucccaagua

SEQ ID NO: 874756 - RNA, 22 nt, Human
gaggaaaauggaguguaauuaa

SEQ ID NO: 874757 - RNA, 22 nt, Human
agggggugcauuugugaaugaa

SEQ ID NO: 874758 - RNA, 22 nt, Human
cucuuggccagacacagaggca

SEQ ID NO: 874759 - RNA, 22 nt, Human
agugcaaaauucagaagcaauu

SEQ ID NO: 874760 - RNA, 22 nt, Human
ccaggccuagccccugagggua

SEQ ID NO: 874761 - RNA, 18 nt, Human
gaauaucuagcacauagu

SEQ ID NO: 874762 - RNA, 22 nt, Human
uauucucagcaacacacaugga

SEQ ID NO: 874763 - RNA, 22 nt, Human
ugcaaauaggggacaacucuuu

SEQ ID NO: 874764 - RNA, 22 nt, Human
aggcagcugugaggacuggauu

SEQ ID NO: 874765 - RNA, 22 nt, Human
ugucucuuggagggucuaguga

SEQ ID NO: 874766 - RNA, 23 nt, Human
gaaguucuuucuucucaugcugu

SEQ ID NO: 874767 - RNA, 17 nt, Human
ucacaucacacaagcaa

SEQ ID NO: 874768 - RNA, 22 nt, Human
cagaaguggcaucauucaagag

SEQ ID NO: 874769 - RNA, 16 nt, Human
ucccaggaggcggaac

SEQ ID NO: 874770 - RNA, 22 nt, Human
ggcagggugccuggcuccuguu

SEQ ID NO: 874771 - RNA, 22 nt, Human
uugaaaaaauugguagaggaug

SEQ ID NO: 874772 - RNA, 22 nt, Human
gcuuccucgcugggcagaggca

SEQ ID NO: 874773 - RNA, 20 nt, Human
aagcaucuggauguagcaau

SEQ ID NO: 874774 - RNA, 20 nt, Human
agcauucuacuagacuuuuc

SEQ ID NO: 874775 - RNA, 22 nt, Human
auauaaguguguggcuguuagu

SEQ ID NO: 874776 - RNA, 22 nt, Human
ccacaaggggacucguuaaaug

SEQ ID NO: 874777 - RNA, 23 nt, Human
acagagacaaugguuucaucuug

SEQ ID NO: 874778 - RNA, 22 nt, Human
caacugugaauuuuaugauacc

SEQ ID NO: 874779 - RNA, 22 nt, Human
ggccucugcaacuggcuguggc

SEQ ID NO: 874780 - RNA, 22 nt, Human
augacaacacauggugcugaau

SEQ ID NO: 874781 - RNA, 19 nt, Human
uggcaggcccaggauggac

SEQ ID NO: 874782 - RNA, 22 nt, Human
cagaagguuuacacuggacugu

SEQ ID NO: 874783 - RNA, 23 nt, Human
gaggccuggcccugccacaucuc

SEQ ID NO: 874784 - RNA, 22 nt, Human
ggucugagauauuuguucagcu

SEQ ID NO: 874785 - RNA, 22 nt, Human
cagcucugcugguggugccagg

SEQ ID NO: 874786 - RNA, 22 nt, Human
cuaaacaggaaggagcaccuga

SEQ ID NO: 874787 - RNA, 22 nt, Human
ggagagaacugaccugaaagga

SEQ ID NO: 874788 - RNA, 22 nt, Human
ggguguguuccuaaggaaacca

SEQ ID NO: 874789 - RNA, 22 nt, Human
gacaggcaccuugucugucuug

SEQ ID NO: 874790 - RNA, 22 nt, Human
gacauucaacuuugaugauuau

SEQ ID NO: 874791 - RNA, 22 nt, Human
cagugauuacugugcuuuuggu

SEQ ID NO: 874792 - RNA, 22 nt, Human
acauuucuuccacaugcugcug

SEQ ID NO: 874793 - RNA, 18 nt, Human
uccugccugcgggcuccc

SEQ ID NO: 874794 - RNA, 22 nt, Human
gcugugugacugagagccuggc

SEQ ID NO: 874795 - RNA, 22 nt, Human
agcagcagaucaaacaggcuug

SEQ ID NO: 874796 - RNA, 22 nt, Human
aggcuggaaagggaccagagug

SEQ ID NO: 874797 - RNA, 22 nt, Human
acagcuuugggcaaugcuauga

SEQ ID NO: 874798 - RNA, 22 nt, Human
ggaggucaaauggagggcuggg

SEQ ID NO: 874799 - RNA, 22 nt, Human
ucaaugcaaccuccaccucccg

SEQ ID NO: 874800 - RNA, 22 nt, Human
ccugggccuauccuagaaccaa

SEQ ID NO: 874801 - RNA, 22 nt, Human
ggccagcucaggguccuugggc

SEQ ID NO: 874802 - RNA, 22 nt, Human
agagaagagucuugucaaauua

SEQ ID NO: 874803 - RNA, 22 nt, Human
uucacauuggugauauguuucu

SEQ ID NO: 874804 - RNA, 22 nt, Human
auacaaucuagucugucagcaa

SEQ ID NO: 874805 - RNA, 22 nt, Human
auguuuaagaaagucuuccaua

SEQ ID NO: 874806 - RNA, 22 nt, Human
ucccaaggccaggcaucuagaa

SEQ ID NO: 874807 - RNA, 22 nt, Human
auguaccagauguauguucuca

SEQ ID NO: 874808 - RNA, 22 nt, Human
ggcaaaaaccgcaauaacuucu

SEQ ID NO: 874809 - RNA, 23 nt, Human
uuuauagcagcaugauuuauagu

SEQ ID NO: 874810 - RNA, 22 nt, Human
ugaaaugcuguagagacuguau

SEQ ID NO: 874811 - RNA, 22 nt, Human
ggcaggcuguucaccugcuuuu

SEQ ID NO: 874812 - RNA, 22 nt, Human
uguggaguggucugaaggcucc

SEQ ID NO: 874813 - RNA, 22 nt, Human
aaacuguauagggaaaaguaga

SEQ ID NO: 874814 - RNA, 22 nt, Human
acaguacaagcaugauacauaa

SEQ ID NO: 874815 - RNA, 22 nt, Human
ugcugucccuaagucucuucaa

SEQ ID NO: 874816 - RNA, 22 nt, Human
auuucacaaaccauccugauuu

SEQ ID NO: 874817 - RNA, 22 nt, Human
agaaaucacuuaaugaacguag

SEQ ID NO: 874818 - RNA, 22 nt, Human
ugguuuuauuuauguugaguca

SEQ ID NO: 874819 - RNA, 22 nt, Human
cuggacuuacuugcugaggacu

SEQ ID NO: 874820 - RNA, 22 nt, Human
gccuguggccgacugagagccu

SEQ ID NO: 874821 - RNA, 22 nt, Human
cccaagggugcccagcagagga

SEQ ID NO: 874822 - RNA, 22 nt, Human
gauuucagaguuuauuagguua

SEQ ID NO: 874823 - RNA, 22 nt, Human
acacauauauacauauuugugc

SEQ ID NO: 874824 - RNA, 22 nt, Human
uuuucauuguuacuaugagcua

SEQ ID NO: 874825 - RNA, 22 nt, Human
ccugcucuccauacacuuucua

SEQ ID NO: 874826 - RNA, 22 nt, Human
uguggacuugaaauuacuuuuc

SEQ ID NO: 874827 - RNA, 22 nt, Human
ccagaugguuugcaugggaggg

SEQ ID NO: 874828 - RNA, 22 nt, Human
ucaccuugugaucucccugccu

SEQ ID NO: 874829 - RNA, 22 nt, Human
auguggcuugucgauauuagca

SEQ ID NO: 874830 - RNA, 22 nt, Human
ccagcaagccaggucuguggcu

SEQ ID NO: 874831 - RNA, 22 nt, Human
accuaacuuaccuagguccaca

SEQ ID NO: 874832 - RNA, 22 nt, Human
aaagacaugacacauuggagag

SEQ ID NO: 874833 - RNA, 22 nt, Human
aacacuuucuuccuugcucagg

SEQ ID NO: 874834 - RNA, 22 nt, Human
aggaagaauguuuacauaucaa

SEQ ID NO: 874835 - RNA, 22 nt, Human
ucacugaagacugggcucuaaa

SEQ ID NO: 874836 - RNA, 22 nt, Human
auguccagggcacacagcagug

SEQ ID NO: 874837 - RNA, 22 nt, Human
agcaugaaagcauaggacaguc

SEQ ID NO: 874838 - RNA, 22 nt, Human
aauuuauuuccugccaguacac

SEQ ID NO: 874839 - RNA, 22 nt, Human
gucaucuuugcccugugcagga

SEQ ID NO: 874840 - RNA, 22 nt, Human
acauguauacaauguguaauga

SEQ ID NO: 874841 - RNA, 22 nt, Human
aguucuggcgcccaugagcaga

SEQ ID NO: 874842 - RNA, 22 nt, Human
guucaaaauucaaaugguauac

SEQ ID NO: 874843 - RNA, 22 nt, Human
uuuccaauucaagcuuuuacgu

SEQ ID NO: 874844 - RNA, 22 nt, Human
auucuucaucacuaccuuguga

SEQ ID NO: 874845 - RNA, 22 nt, Human
cugaggagcccccucucagcau

SEQ ID NO: 874846 - RNA, 22 nt, Human
cucaggcugugccaccugugug

SEQ ID NO: 874847 - RNA, 22 nt, Human
aaugauaagacaugaguagagg

SEQ ID NO: 874848 - RNA, 22 nt, Human
gagcagaacuacucacauaucg

SEQ ID NO: 874849 - RNA, 22 nt, Human
gggagccagcagggcauggagc

SEQ ID NO: 874850 - RNA, 22 nt, Human
agacagggccacucauccucac

SEQ ID NO: 874851 - RNA, 22 nt, Human
ucucuccuccacaccgggugcu

SEQ ID NO: 874852 - RNA, 22 nt, Human
gagggagaaggacuaucaggcu

SEQ ID NO: 874853 - RNA, 22 nt, Human
agugaggggcagcugagugggc

SEQ ID NO: 874854 - RNA, 22 nt, Human
agccaugggcucccaguccuuu

SEQ ID NO: 874855 - RNA, 22 nt, Human
augugagaauaacucaaaacaa

SEQ ID NO: 874856 - RNA, 22 nt, Human
cagggaggcugucuuaugccug

SEQ ID NO: 874857 - RNA, 23 nt, Human
ugggugcuaaucugcucugugga

SEQ ID NO: 874858 - RNA, 22 nt, Human
cugaaugagggauucugagggc

SEQ ID NO: 874859 - RNA, 22 nt, Human
auggagcagcagaaggggcuug

SEQ ID NO: 874860 - RNA, 22 nt, Human
ucuagaacuucucuaaaaugaa

SEQ ID NO: 874861 - RNA, 22 nt, Human
uuucauaaccucaagcuacagu

SEQ ID NO: 874862 - RNA, 22 nt, Human
gcaacaguuggauuccagagga

SEQ ID NO: 874863 - RNA, 22 nt, Human
agagggagcuuuauuuuucugu

SEQ ID NO: 874864 - RNA, 22 nt, Human
aggacugaugauggugcugaca

SEQ ID NO: 874865 - RNA, 22 nt, Human
agugcuggguacuguucccauu

SEQ ID NO: 874866 - RNA, 22 nt, Human
agcagcugagaugguaagauuc

SEQ ID NO: 874867 - RNA, 22 nt, Human
ggcguggcagucaggaaaaggu

SEQ ID NO: 874868 - RNA, 22 nt, Human
auaacagagagcuacugaacug

SEQ ID NO: 874869 - RNA, 22 nt, Human
aggcccagagagccaguuagug

SEQ ID NO: 874870 - RNA, 22 nt, Human
augcaaggguugccuuuccagc

SEQ ID NO: 874871 - RNA, 22 nt, Human
auuccacaggacuaccaaugug

SEQ ID NO: 874872 - RNA, 22 nt, Human
cgaggccaccgugguuuccgag

SEQ ID NO: 874873 - RNA, 20 nt, Human
uccugcugaccuucacaagc

SEQ ID NO: 874874 - RNA, 21 nt, Human
ucaacccuugcgucaccaagc

SEQ ID NO: 874875 - RNA, 20 nt, Human
accugggaaaaccuuuuccu

SEQ ID NO: 874876 - RNA, 22 nt, Human
caggggccuggcugucuaggaa

SEQ ID NO: 874877 - RNA, 20 nt, Human
uguaacacaugagcuuugag

SEQ ID NO: 874878 - RNA, 22 nt, Human
ccucagaggcagaugguaagaa

SEQ ID NO: 874879 - RNA, 22 nt, Human
uaaaagaccacaaggugguaau

SEQ ID NO: 874880 - RNA, 21 nt, Human
auaaacagcaugugauccaug

SEQ ID NO: 874881 - RNA, 22 nt, Human
gccuacaguuggcugagggccu

SEQ ID NO: 874882 - RNA, 22 nt, Human
ugaagcuuguauuuaaauaagu

SEQ ID NO: 874883 - RNA, 22 nt, Human
gcacagcuggacucugccuggc

SEQ ID NO: 874884 - RNA, 22 nt, Human
acagcugugauuucuaucauga

SEQ ID NO: 874885 - RNA, 22 nt, Human
ugggugagggacaaaaguuucu

SEQ ID NO: 874886 - RNA, 22 nt, Human
uccaggcucuaggcugcucucc

SEQ ID NO: 874887 - RNA, 22 nt, Human
ggcagcuggguuggccagaaac

SEQ ID NO: 874888 - RNA, 22 nt, Human
caaccucuaucggucaggaagc

SEQ ID NO: 874889 - RNA, 22 nt, Human
cagcagcucacugaauaaugac

SEQ ID NO: 874890 - RNA, 23 nt, Human
acaugcaaaaaucacagucuccu

SEQ ID NO: 874891 - RNA, 22 nt, Human
ucucugaauucugaugcaagug

SEQ ID NO: 874892 - RNA, 22 nt, Human
aaggggaauagaguggguugug

SEQ ID NO: 874893 - RNA, 22 nt, Human
gcucuugggggacagauggagu

SEQ ID NO: 874894 - RNA, 22 nt, Human
auucacaguuuccucauauucu

SEQ ID NO: 874895 - RNA, 22 nt, Human
gggugagacagaaagagcaaaa

SEQ ID NO: 874896 - RNA, 22 nt, Human
gaaaggagggaaacagagcggu

SEQ ID NO: 874897 - RNA, 22 nt, Human
aaguccaagaggaaagguuucc

SEQ ID NO: 874898 - RNA, 21 nt, Human
cccuaacucuaaaggauccau

SEQ ID NO: 874899 - RNA, 22 nt, Human
cuucagugacauuccuucccuc

SEQ ID NO: 874900 - RNA, 22 nt, Human
cugagguggccucugccgggga

SEQ ID NO: 874901 - RNA, 22 nt, Human
guuaauuuaguagaguccagau

SEQ ID NO: 874902 - RNA, 22 nt, Human
ugucagcagaaguggugcacuc

SEQ ID NO: 874903 - RNA, 22 nt, Human
cacaggaagcugacugcuggca

SEQ ID NO: 874904 - RNA, 22 nt, Human
uagacaaacugauacuuggcga

SEQ ID NO: 874905 - RNA, 22 nt, Human
uacgaauccuguggaugaaugu

SEQ ID NO: 874906 - RNA, 22 nt, Human
uuuuaucuucauuccuaucuac

SEQ ID NO: 874907 - RNA, 22 nt, Human
auguucauuagucaacauuucu

SEQ ID NO: 874908 - RNA, 22 nt, Human
agagauucauguuuacuguagg

SEQ ID NO: 874909 - RNA, 22 nt, Human
caaacauugcuaccagagguuu

SEQ ID NO: 874910 - RNA, 22 nt, Human
gggccucagguucuggagaagg

SEQ ID NO: 874911 - RNA, 22 nt, Human
uggcuucucugugguggcuccc

SEQ ID NO: 874912 - RNA, 22 nt, Human
ugauauuuuaugagcuuucaua

SEQ ID NO: 874913 - RNA, 22 nt, Human
gcagggcaaacccagguguuca

SEQ ID NO: 874914 - RNA, 23 nt, Human
aacuuuacuauuuugaauaaugc

SEQ ID NO: 874915 - RNA, 22 nt, Human
acaaaugacuauuugguacagg

SEQ ID NO: 874916 - RNA, 17 nt, Human
ggcagagcugacagggc

SEQ ID NO: 874917 - RNA, 22 nt, Human
ccacaguuugccagccaggaau

SEQ ID NO: 874918 - RNA, 22 nt, Human
uagcagcaccuacacgucagag

SEQ ID NO: 874919 - RNA, 22 nt, Human
ggaguggcagagaggguauacu

SEQ ID NO: 874920 - RNA, 22 nt, Human
acagaacugggaaaugcacaua

SEQ ID NO: 874921 - RNA, 22 nt, Human
uuacaguagauacaaugaguaa

SEQ ID NO: 874922 - RNA, 22 nt, Human
aggcuggguaccugucauaugc

SEQ ID NO: 874923 - RNA, 22 nt, Human
auuaaauguuccuuaaauuaua

SEQ ID NO: 874924 - RNA, 21 nt, Human
gcucccuggcugugugaccug

SEQ ID NO: 874925 - RNA, 19 nt, Human
gcuggcagauguggccgug

SEQ ID NO: 874926 - RNA, 22 nt, Human
ccugaguggggagcuaagugag

SEQ ID NO: 874927 - RNA, 22 nt, Human
cuggcaggcggagguugcagug

SEQ ID NO: 874928 - RNA, 22 nt, Human
uaucuguuaugggcugaauugc

SEQ ID NO: 874929 - RNA, 22 nt, Human
augcuggcagccgagugcucca

SEQ ID NO: 874930 - RNA, 22 nt, Human
agcaaagcaccauauggcaguu

SEQ ID NO: 874931 - RNA, 22 nt, Human
gaggugucaugagggccugcuc

SEQ ID NO: 874932 - RNA, 22 nt, Human
gggguguggacggcugugccag

SEQ ID NO: 874933 - RNA, 21 nt, Human
cugcacugugauuuaaaaugu

SEQ ID NO: 874934 - RNA, 22 nt, Human
aguguggggucaccggcccagg

SEQ ID NO: 874935 - RNA, 22 nt, Human
uccugcugaccaguaaaugaau

SEQ ID NO: 874936 - RNA, 22 nt, Human
ucccaaagguccgagcgggaau

SEQ ID NO: 874937 - RNA, 22 nt, Human
ucugaggcccuacccugagccu

SEQ ID NO: 874938 - RNA, 22 nt, Human
acuguacacagugguguacugu

SEQ ID NO: 874939 - RNA, 22 nt, Human
aggagccccucuucaguccugg

SEQ ID NO: 874940 - RNA, 22 nt, Human
aggcuccucggggcugacggcg

SEQ ID NO: 874941 - RNA, 22 nt, Human
aacucuauuuacccuacuaaac

SEQ ID NO: 874942 - RNA, 22 nt, Human
uaugaguacaaggaaggaugga

SEQ ID NO: 874943 - RNA, 22 nt, Human
ugcaggagcuuggcucuguccc

SEQ ID NO: 874944 - RNA, 22 nt, Human
gcuauuuauuaaaauggugaag

SEQ ID NO: 874945 - RNA, 22 nt, Human
agguuaggaagauacagaaugu

SEQ ID NO: 874946 - RNA, 22 nt, Human
guuuuucuagacugggaguuug

SEQ ID NO: 874947 - RNA, 22 nt, Human
uuucuguuguacuuaaacuagg

SEQ ID NO: 874948 - RNA, 22 nt, Human
cuguccaugacuugcacuauaa

SEQ ID NO: 874949 - RNA, 22 nt, Human
uuucauuggcagagccuguuuu

SEQ ID NO: 874950 - RNA, 22 nt, Human
aaacaccaagagcuagcuauua

SEQ ID NO: 874951 - RNA, 22 nt, Human
caccugaauggaacuuugaacc

SEQ ID NO: 874952 - RNA, 22 nt, Human
uggggugguaauacaccguucu

SEQ ID NO: 874953 - RNA, 22 nt, Human
uccagccaugacucggacagug

SEQ ID NO: 874954 - RNA, 22 nt, Human
uacaguaaaugugguagaaacu

SEQ ID NO: 874955 - RNA, 22 nt, Human
cugguguggcggcgcccuguag

SEQ ID NO: 874956 - RNA, 19 nt, Human
uguccucacagagcauaac

SEQ ID NO: 874957 - RNA, 22 nt, Human
aaaagcaguuaucugggaggaa

SEQ ID NO: 874958 - RNA, 22 nt, Human
uccugccuugccugggacauca

SEQ ID NO: 874959 - RNA, 22 nt, Human
agccagcagggcuuagaggaca

SEQ ID NO: 874960 - RNA, 22 nt, Human
agggcuggcaagggauugaaau

SEQ ID NO: 874961 - RNA, 22 nt, Human
uggcagguggcucuggcauucu

SEQ ID NO: 874962 - RNA, 22 nt, Human
aaaguuugcaauuuauguuaau

SEQ ID NO: 874963 - RNA, 22 nt, Human
gcuguguaaacuuguacagugc

SEQ ID NO: 874964 - RNA, 23 nt, Human
gcugucaguuguuuuugucucua

SEQ ID NO: 874965 - RNA, 22 nt, Human
aggggacacggcuucuccaggg

SEQ ID NO: 874966 - RNA, 22 nt, Human
agcagcagagcucuggucugca

SEQ ID NO: 874967 - RNA, 22 nt, Human
acaugcuuuucccacaauuaua

SEQ ID NO: 874968 - RNA, 22 nt, Human
gggaccugaggagggguuucag

SEQ ID NO: 874969 - RNA, 22 nt, Human
cauuacauuucaaaauguuucc

SEQ ID NO: 874970 - RNA, 22 nt, Human
aggucuaggagucugaaaguau

SEQ ID NO: 874971 - RNA, 22 nt, Human
uggugggggaggcugucuagca

SEQ ID NO: 874972 - RNA, 22 nt, Human
uccaaauuuaccuuacagauau

SEQ ID NO: 874973 - RNA, 22 nt, Human
ggcuucucagcacacuguccac

SEQ ID NO: 874974 - RNA, 22 nt, Human
cuagcuguguaaaccgagcugc

SEQ ID NO: 874975 - RNA, 22 nt, Human
cugaaaggagagcugcaaggau

SEQ ID NO: 874976 - RNA, 22 nt, Human
uccuggcuucugucuccuuauu

SEQ ID NO: 874977 - RNA, 22 nt, Human
cugcagcuuaaaggaguucaau

SEQ ID NO: 874978 - RNA, 22 nt, Human
uuagcaaauaucuugaaacagg

SEQ ID NO: 874979 - RNA, 22 nt, Human
guggggcaguggccugggagca

SEQ ID NO: 874980 - RNA, 22 nt, Human
cugggcccugaagacagucagg

SEQ ID NO: 874981 - RNA, 20 nt, Human
aaaaagacaaaacgaguugg

SEQ ID NO: 874982 - RNA, 20 nt, Human
gugcaauggcaccaucucag

SEQ ID NO: 874983 - RNA, 21 nt, Human
ucauaucugcuuugcugucug

SEQ ID NO: 874984 - RNA, 22 nt, Human
uugacagaugugaaagugagca

SEQ ID NO: 874985 - RNA, 22 nt, Human
ggccaagguguucugauaugcc

SEQ ID NO: 874986 - RNA, 22 nt, Human
cuucuggguauuccagauaccu

SEQ ID NO: 874987 - RNA, 22 nt, Human
gggaggagugaagauucaccug

SEQ ID NO: 874988 - RNA, 22 nt, Human
auucuucuugagucuuggacuc

SEQ ID NO: 874989 - RNA, 23 nt, Human
cagaggcaucggauucaacauca

SEQ ID NO: 874990 - RNA, 22 nt, Human
ccuagacuagaggcagggagcc

SEQ ID NO: 874991 - RNA, 22 nt, Human
ugccagcuucuuacggcugccu

SEQ ID NO: 874992 - RNA, 22 nt, Human
acaguggagaagcaaaugcagu

SEQ ID NO: 874993 - RNA, 22 nt, Human
ggcucuggagacauguggagag

SEQ ID NO: 874994 - RNA, 22 nt, Human
uguuugaguucuagcgcauuua

SEQ ID NO: 874995 - RNA, 22 nt, Human
ugagccaugggacuccaaggga

SEQ ID NO: 874996 - RNA, 22 nt, Human
auuucucaaccaggucaaaaag

SEQ ID NO: 874997 - RNA, 22 nt, Human
cucaaauccccguuccucauuc

SEQ ID NO: 874998 - RNA, 22 nt, Human
agaaucuaaauaugcaauuuga

SEQ ID NO: 874999 - RNA, 23 nt, Human
auaauaauuauggcagcaaagug

SEQ ID NO: 875000 - RNA, 22 nt, Human
gugagagccugucuggaugucg

SEQ ID NO: 875001 - RNA, 22 nt, Human
cagagucauaucagagaauaug

SEQ ID NO: 875002 - RNA, 22 nt, Human
aagaacagauucagccugaacu

SEQ ID NO: 875003 - RNA, 22 nt, Human
cuguguagccucaugugggcuu

SEQ ID NO: 875004 - RNA, 22 nt, Human
ugcguacuguuuauacaugugu

SEQ ID NO: 875005 - RNA, 22 nt, Human
uacacagaggcugaugucuuag

SEQ ID NO: 875006 - RNA, 22 nt, Human
uauuugaugaagguaaagucuu

SEQ ID NO: 875007 - RNA, 22 nt, Human
auaauuaucucagacacuuguu

SEQ ID NO: 875008 - RNA, 22 nt, Human
uagcaguauuccggaauacuuu

SEQ ID NO: 875009 - RNA, 22 nt, Human
cugugggagggugagagaacca

SEQ ID NO: 875010 - RNA, 22 nt, Human
cuguggcugcagccuugguccu

SEQ ID NO: 875011 - RNA, 22 nt, Human
cuucuuccaguuauaagagcuu

SEQ ID NO: 875012 - RNA, 22 nt, Human
uuuuaauccucuugguaucuua

SEQ ID NO: 875013 - RNA, 22 nt, Human
cugcauguguuucugcuggguu

SEQ ID NO: 875014 - RNA, 22 nt, Human
uggaccugcuggaugggcaggu

SEQ ID NO: 875015 - RNA, 22 nt, Human
uggaggggcaauggagcgcgga

SEQ ID NO: 875016 - RNA, 22 nt, Human
ucagcucuacacacaccugugu

SEQ ID NO: 875017 - RNA, 22 nt, Human
agcuucugcaucuuuucuuccc

SEQ ID NO: 875018 - RNA, 22 nt, Human
ugugugcacgcugggagcugga

SEQ ID NO: 875019 - RNA, 22 nt, Human
acaaugaaaaaauuuacugugg

SEQ ID NO: 875020 - RNA, 22 nt, Human
aacacuguaacagcaucauuuu

SEQ ID NO: 875021 - RNA, 22 nt, Human
ugcaagaaguccucucugggug

SEQ ID NO: 875022 - RNA, 22 nt, Human
aggaacuggugaaguguaguga

SEQ ID NO: 875023 - RNA, 22 nt, Human
agauguggaacacuagacugcu

SEQ ID NO: 875024 - RNA, 22 nt, Human
ugcacaggugagacucaggaag

SEQ ID NO: 875025 - RNA, 22 nt, Human
gaggcucaguuauuuuagccug

SEQ ID NO: 875026 - RNA, 22 nt, Human
uccaguccuaucugcccuugga

SEQ ID NO: 875027 - RNA, 22 nt, Human
ucucugagcucaggagcugcag

SEQ ID NO: 875028 - RNA, 22 nt, Human
caggcaaguucauuuccaggca

SEQ ID NO: 875029 - RNA, 22 nt, Human
cauaagaauauuccauccuuug

SEQ ID NO: 875030 - RNA, 22 nt, Human
aagaaaucagaaaagcauucgu

SEQ ID NO: 875031 - RNA, 22 nt, Human
uggcagccacaucucguggauu

SEQ ID NO: 875032 - RNA, 21 nt, Human
gagugggacaugggagugguu

SEQ ID NO: 875033 - RNA, 22 nt, Human
auugcaggccaguguccugggc

SEQ ID NO: 875034 - RNA, 22 nt, Human
aaagcagguuaugaccauggcc

SEQ ID NO: 875035 - RNA, 22 nt, Human
aaauauuguuuugguaagcuuc

SEQ ID NO: 875036 - RNA, 22 nt, Human
ccuggacuguguccugugguca

SEQ ID NO: 875037 - RNA, 22 nt, Human
acccuguaugcuauaucccuaa

SEQ ID NO: 875038 - RNA, 22 nt, Human
aggggcugggacagagccaagc

SEQ ID NO: 875039 - RNA, 22 nt, Human
agcuaaaugugaaaugucaacc

SEQ ID NO: 875040 - RNA, 22 nt, Human
augcauauuucaugaaucuuug

SEQ ID NO: 875041 - RNA, 22 nt, Human
ggauucaggguaaaguuucagu

SEQ ID NO: 875042 - RNA, 22 nt, Human
uccuggaguauuucuguggugu

SEQ ID NO: 875043 - RNA, 22 nt, Human
uaggcuugcaauuaggauggaa

SEQ ID NO: 875044 - RNA, 22 nt, Human
acuggcucagaguuccuagaga

SEQ ID NO: 875045 - RNA, 22 nt, Human
agaacagccaauaaaagagggg

SEQ ID NO: 875046 - RNA, 22 nt, Human
auaagaggaauuacagaagagg

SEQ ID NO: 875047 - RNA, 22 nt, Human
cugcugugggcaggguagcugg

SEQ ID NO: 875048 - RNA, 22 nt, Human
ggcaaaaaucaccccugguuca

SEQ ID NO: 875049 - RNA, 22 nt, Human
uaacaguuuugaguuuugcuuc

SEQ ID NO: 875050 - RNA, 22 nt, Human
aucuucaaagggauguccaugg

SEQ ID NO: 875051 - RNA, 22 nt, Human
uaugaagaaguucugugaaaug

SEQ ID NO: 875052 - RNA, 22 nt, Human
ugagagcugccacgugaccaug

SEQ ID NO: 875053 - RNA, 22 nt, Human
uuguacagacccugaaaagcuc

SEQ ID NO: 875054 - RNA, 20 nt, Human
auacagaugguuccagcugg

SEQ ID NO: 875055 - RNA, 22 nt, Human
cgccuucaggcccuuuuuguug

SEQ ID NO: 875056 - RNA, 18 nt, Human
ucaggcugggccuccuuc

SEQ ID NO: 875057 - RNA, 22 nt, Human
cagagccucugcccugggcacu

SEQ ID NO: 875058 - RNA, 22 nt, Human
ucuuugggagaaggggucccag

SEQ ID NO: 875059 - RNA, 22 nt, Human
cuuaacauccugcauuuuucuu

SEQ ID NO: 875060 - RNA, 22 nt, Human
uccuggagggaggcggugcuac

SEQ ID NO: 875061 - RNA, 22 nt, Human
aggacugacuuuugccaugaaa

SEQ ID NO: 875062 - RNA, 22 nt, Human
aaauucuuuggccuacuuugaa

SEQ ID NO: 875063 - RNA, 22 nt, Human
uccagccuuccuuuucacucuc

SEQ ID NO: 875064 - RNA, 22 nt, Human
ugaacauacaauuauuaagaac

SEQ ID NO: 875065 - RNA, 23 nt, Human
gcccugcccuuagcacacucaca

SEQ ID NO: 875066 - RNA, 22 nt, Human
cuggcagcugcccgagaugccc

SEQ ID NO: 875067 - RNA, 22 nt, Human
ugugagcagcucuguggacuca

SEQ ID NO: 875068 - RNA, 22 nt, Human
gggcaguguugcucucaaaguc

SEQ ID NO: 875069 - RNA, 22 nt, Human
augaacaguaugcaacaugauu

SEQ ID NO: 875070 - RNA, 22 nt, Human
gcacacaucuuguaauccugag

SEQ ID NO: 875071 - RNA, 22 nt, Human
uuccaacuucccaucccugcug

SEQ ID NO: 875072 - RNA, 22 nt, Human
uagucccauuuugagguauuug

SEQ ID NO: 875073 - RNA, 22 nt, Human
gccucagcuguugcaggggccc

SEQ ID NO: 875074 - RNA, 22 nt, Human
uuuguaugaacugguauguagg

SEQ ID NO: 875075 - RNA, 22 nt, Human
aagugcaggaguggggaaagua

SEQ ID NO: 875076 - RNA, 16 nt, Human
ccaggaggcugacacc

SEQ ID NO: 875077 - RNA, 17 nt, Human
ugcgaugucuguguuug

SEQ ID NO: 875078 - RNA, 22 nt, Human
aaaacaggaguuuugguaggcu

SEQ ID NO: 875079 - RNA, 22 nt, Human
uaguuaaaccaccauucuggua

SEQ ID NO: 875080 - RNA, 22 nt, Human
acaggcagagaguggcggacuc

SEQ ID NO: 875081 - RNA, 22 nt, Human
uuucccuucuuuccugaguaau

SEQ ID NO: 875082 - RNA, 22 nt, Human
uaacacauuuuccucauacgga

SEQ ID NO: 875083 - RNA, 22 nt, Human
caaggcucuggaccaaauccca

SEQ ID NO: 875084 - RNA, 22 nt, Human
ggaugcugcuaucaggcuucga

SEQ ID NO: 875085 - RNA, 22 nt, Human
uacugucuauacacuugauuac

SEQ ID NO: 875086 - RNA, 22 nt, Human
uggaugaaauauugcauuuaug

SEQ ID NO: 875087 - RNA, 22 nt, Human
uucugccacgagcaguuucuuc

SEQ ID NO: 875088 - RNA, 22 nt, Human
ccaggcugcucacaagcugccc

SEQ ID NO: 875089 - RNA, 22 nt, Human
gggcagcauucugugggcaggu

SEQ ID NO: 875090 - RNA, 22 nt, Human
auaccacaacauggcucagagg

SEQ ID NO: 875091 - RNA, 22 nt, Human
uggagggcaugcuguccauggg

SEQ ID NO: 875092 - RNA, 22 nt, Human
uuugcuugacccuugugcugaa

SEQ ID NO: 875093 - RNA, 22 nt, Human
gugugggcagggccgugcuccc

SEQ ID NO: 875094 - RNA, 22 nt, Human
cugggcugaaaguguuccuuga

SEQ ID NO: 875095 - RNA, 22 nt, Human
uggcacugggacagaugcucuc

SEQ ID NO: 875096 - RNA, 22 nt, Human
acaacaaaaugaggaagugguc

SEQ ID NO: 875097 - RNA, 22 nt, Human
gugggcagagcaagggaacuca

SEQ ID NO: 875098 - RNA, 22 nt, Human
uugcuuccuggaugugacuuug

SEQ ID NO: 875099 - RNA, 21 nt, Human
ccugggccaaauucccuggac

SEQ ID NO: 875100 - RNA, 22 nt, Human
ccuuggcaguggagugaggugg

SEQ ID NO: 875101 - RNA, 23 nt, Human
auaguucugcuuagaaaucagug

SEQ ID NO: 875102 - RNA, 22 nt, Human
acacugugagcugaagggcugc

SEQ ID NO: 875103 - RNA, 22 nt, Human
gcugccacuuggucaugucaug

SEQ ID NO: 875104 - RNA, 22 nt, Human
cagcccucaucccgccugcguu

SEQ ID NO: 875105 - RNA, 22 nt, Human
cuagaaucuccaaguuuacuca

SEQ ID NO: 875106 - RNA, 23 nt, Human
uaaggcauuuuuucuguaucagu

SEQ ID NO: 875107 - RNA, 22 nt, Human
ugaggcuuagagaagaugggau

SEQ ID NO: 875108 - RNA, 22 nt, Human
uagacaauauuugaaaguagug

SEQ ID NO: 875109 - RNA, 22 nt, Human
uuuuucauugcagccucucucc

SEQ ID NO: 875110 - RNA, 22 nt, Human
aagugaagaaauacaugagaau

SEQ ID NO: 875111 - RNA, 22 nt, Human
gugaaggcugugugaaaguucu

SEQ ID NO: 875112 - RNA, 17 nt, Human
ucugaagccagucugcu

SEQ ID NO: 875113 - RNA, 22 nt, Human
guccacagagggcugggcaggc

SEQ ID NO: 875114 - RNA, 22 nt, Human
augguccuuuuugccuggaugc

SEQ ID NO: 875115 - RNA, 22 nt, Human
ugacauuugagcauacauguaa

SEQ ID NO: 875116 - RNA, 22 nt, Human
uuacauguaaucuaaaauaauu

SEQ ID NO: 875117 - RNA, 22 nt, Human
uucagggagagcgggacgggug

SEQ ID NO: 875118 - RNA, 22 nt, Human
gccagcaaagcaaguugucagc

SEQ ID NO: 875119 - RNA, 22 nt, Human
gugggugcggggagccgaggcg

SEQ ID NO: 875120 - RNA, 22 nt, Human
caguggagagacuuuuacucuu

SEQ ID NO: 875121 - RNA, 22 nt, Human
agcgugaauuaguugguacaca

SEQ ID NO: 875122 - RNA, 22 nt, Human
gaggcugccaaugugugcaugu

SEQ ID NO: 875123 - RNA, 19 nt, Human
uagcugauagcuacuuuau

SEQ ID NO: 875124 - RNA, 22 nt, Human
uuugaugaaagcuacuauuuac

SEQ ID NO: 875125 - RNA, 20 nt, Human
aagguccaaacucuguguuc

SEQ ID NO: 875126 - RNA, 22 nt, Human
gaguccaguaguuaggacagag

SEQ ID NO: 875127 - RNA, 19 nt, Human
acagccuguugguggggcu

SEQ ID NO: 875128 - RNA, 19 nt, Human
uuccaaaaucaggauuuga

SEQ ID NO: 875129 - RNA, 22 nt, Human
uuguaugaauguauccuaauuu

SEQ ID NO: 875130 - RNA, 22 nt, Human
agcugccuguccuaggccauca

SEQ ID NO: 875131 - RNA, 22 nt, Human
ucaggccugcaggcuuccugga

SEQ ID NO: 875132 - RNA, 22 nt, Human
ugucauuuggacuuugguauua

SEQ ID NO: 875133 - RNA, 22 nt, Human
ggucugaguggugcugacucag

SEQ ID NO: 875134 - RNA, 19 nt, Human
uccaggagcaaagccaguu

SEQ ID NO: 875135 - RNA, 22 nt, Human
caucacauuuaaggggaaggac

SEQ ID NO: 875136 - RNA, 22 nt, Human
cuggcuguggucacagguaacu

SEQ ID NO: 875137 - RNA, 19 nt, Human
cccagcuguucuuccacca

SEQ ID NO: 875138 - RNA, 22 nt, Human
aaaggauuagagauaccaugcc

SEQ ID NO: 875139 - RNA, 22 nt, Human
agagccacggcaggccuaggaa

SEQ ID NO: 875140 - RNA, 22 nt, Human
aguuggauggauuggaaugaag

SEQ ID NO: 875141 - RNA, 16 nt, Human
ugaggccagccauuuc

SEQ ID NO: 875142 - RNA, 22 nt, Human
uucaaauuaccacauuugcuua

SEQ ID NO: 875143 - RNA, 22 nt, Human
gcaaugcauauguggguagcau

SEQ ID NO: 875144 - RNA, 22 nt, Human
ugcuucccaagguuucaugugc

SEQ ID NO: 875145 - RNA, 21 nt, Human
cccugcuuggggcagaacaac

SEQ ID NO: 875146 - RNA, 22 nt, Human
cuggguucuuggcacagcagga

SEQ ID NO: 875147 - RNA, 22 nt, Human
caggucugaagagucacaugcc

SEQ ID NO: 875148 - RNA, 22 nt, Human
ucacauuguaggucauuugcaa

SEQ ID NO: 875149 - RNA, 22 nt, Human
gaggaaaucauuccagaaaagg

SEQ ID NO: 875150 - RNA, 22 nt, Human
aagagcaacuuggaaacacuca

SEQ ID NO: 875151 - RNA, 22 nt, Human
uucauugagugguuuauucuaa

SEQ ID NO: 875152 - RNA, 22 nt, Human
uauuuguauuucaugcaguaaa

SEQ ID NO: 875153 - RNA, 22 nt, Human
uccagggguaccggccaggcag

SEQ ID NO: 875154 - RNA, 22 nt, Human
gggcccagcacuggcugggauc

SEQ ID NO: 875155 - RNA, 22 nt, Human
agggucagguuaagggagucau

SEQ ID NO: 875156 - RNA, 21 nt, Human
caauuacuuuugcaccgacuu

SEQ ID NO: 875157 - RNA, 22 nt, Human
agacccugucaguguuaggaaa

SEQ ID NO: 875158 - RNA, 22 nt, Human
guguccugagugaggccuggcc

SEQ ID NO: 875159 - RNA, 22 nt, Human
ugcagguguagaguugggcucc

SEQ ID NO: 875160 - RNA, 22 nt, Human
aggggagcaucugugaugguua

SEQ ID NO: 875161 - RNA, 18 nt, Human
uugcagguaccucuaucu

SEQ ID NO: 875162 - RNA, 23 nt, Human
gcuaggugcuuccacacgugcug

SEQ ID NO: 875163 - RNA, 19 nt, Human
aaguauucuuuguuagcag

SEQ ID NO: 875164 - RNA, 22 nt, Human
aaugacagagcacugaacuugg

SEQ ID NO: 875165 - RNA, 22 nt, Human
cugggcucaagaagucuucccu

SEQ ID NO: 875166 - RNA, 22 nt, Human
uuuguucguucaugcacgguag

SEQ ID NO: 875167 - RNA, 22 nt, Human
gcaggagcugcucuccugacga

SEQ ID NO: 875168 - RNA, 21 nt, Human
aaacaucucugcuuuuguguc

SEQ ID NO: 875169 - RNA, 22 nt, Human
cuggccugugggcugucuccgg

SEQ ID NO: 875170 - RNA, 22 nt, Human
uggaggcaccacuggcugcccg

SEQ ID NO: 875171 - RNA, 22 nt, Human
uaucaguaggguugaacuuugg

SEQ ID NO: 875172 - RNA, 23 nt, Human
aggcaggcaguucagcuguuguu

SEQ ID NO: 875173 - RNA, 22 nt, Human
ucaguuuuuguuugccagauag

SEQ ID NO: 875174 - RNA, 22 nt, Human
caaaugcuaugauuuugaguuu

SEQ ID NO: 875175 - RNA, 22 nt, Human
aagguaaugaaacagcagcuaa

SEQ ID NO: 875176 - RNA, 22 nt, Human
aaaguuuuuaagcaagacccuu

SEQ ID NO: 875177 - RNA, 22 nt, Human
cuaggaagagaaggaauucccc

SEQ ID NO: 875178 - RNA, 22 nt, Human
gacauaaaguucuugcuugaau

SEQ ID NO: 875179 - RNA, 22 nt, Human
acaggcucucuauugagugcag

SEQ ID NO: 875180 - RNA, 22 nt, Human
uuccaauccaaacuucaccuuu

SEQ ID NO: 875181 - RNA, 22 nt, Human
auuuggaaguuuggagugaagg

SEQ ID NO: 875182 - RNA, 22 nt, Human
uaauuacagguccaaaacaauc

SEQ ID NO: 875183 - RNA, 22 nt, Human
gccauuuggcaaaacugacuuc

SEQ ID NO: 875184 - RNA, 22 nt, Human
aacacugcugcuggguucugug

SEQ ID NO: 875185 - RNA, 18 nt, Human
cuggucucccuucgcuuu

SEQ ID NO: 875186 - RNA, 22 nt, Human
auuagcugaccucuaaggagcc

SEQ ID NO: 875187 - RNA, 22 nt, Human
cacagccuugagcgaggacaag

SEQ ID NO: 875188 - RNA, 22 nt, Human
gugugcaucuuuucugcuugau

SEQ ID NO: 875189 - RNA, 22 nt, Human
uccccuccaacuccaacuaugg

SEQ ID NO: 875190 - RNA, 22 nt, Human
aggagauaagaggcuggugugg

SEQ ID NO: 875191 - RNA, 22 nt, Human
cuggugcacuacagccuggaac

SEQ ID NO: 875192 - RNA, 22 nt, Human
gcugugagcugccugugucaca

SEQ ID NO: 875193 - RNA, 22 nt, Human
gaggcaagcccagugggucuaa

SEQ ID NO: 875194 - RNA, 22 nt, Human
aaguuccugggccaaguccagg

SEQ ID NO: 875195 - RNA, 21 nt, Human
ugauuuccaucuuaaaauaaa

SEQ ID NO: 875196 - RNA, 22 nt, Human
cccuuccucaaggagcuguguu

SEQ ID NO: 875197 - RNA, 22 nt, Human
aagcuggcuaaauaaaaggucc

SEQ ID NO: 875198 - RNA, 22 nt, Human
gcuggugagauuuuauguuucc

SEQ ID NO: 875199 - RNA, 22 nt, Human
aacacugaccucuacccucagu

SEQ ID NO: 875200 - RNA, 22 nt, Human
agggcagcuggaagguggcuuc

SEQ ID NO: 875201 - RNA, 22 nt, Human
uuggcacuauucacuccauggg

SEQ ID NO: 875202 - RNA, 22 nt, Human
uccucagaaaccccugugaggu

SEQ ID NO: 875203 - RNA, 22 nt, Human
agguuuauuaaguaaauagagc

SEQ ID NO: 875204 - RNA, 22 nt, Human
ugugugcucuaaugccuaguac

SEQ ID NO: 875205 - RNA, 22 nt, Human
agaucuggcccucagcuugauu

SEQ ID NO: 875206 - RNA, 22 nt, Human
ccuucaugucauuggacaccuu

SEQ ID NO: 875207 - RNA, 22 nt, Human
ccagccaggcuggcuguggagg

SEQ ID NO: 875208 - RNA, 17 nt, Human
gaggccaaggcaggcgg

SEQ ID NO: 875209 - RNA, 22 nt, Human
gaggcagaggaagguggucucu

SEQ ID NO: 875210 - RNA, 22 nt, Human
auuaaggcacuugagcaugaug

SEQ ID NO: 875211 - RNA, 22 nt, Human
gcuggagcuugagaggacaggg

SEQ ID NO: 875212 - RNA, 22 nt, Human
ugugggugaugaauuuguucuu

SEQ ID NO: 875213 - RNA, 22 nt, Human
acucagaggcagcugcucaccc

SEQ ID NO: 875214 - RNA, 20 nt, Human
gcugccuguuucuguaagua

SEQ ID NO: 875215 - RNA, 22 nt, Human
gggcucagucuggcguggaaug

SEQ ID NO: 875216 - RNA, 23 nt, Human
uucuaaccuuaaagcccuuugga

SEQ ID NO: 875217 - RNA, 22 nt, Human
ggccuggagucagggaaagcaa

SEQ ID NO: 875218 - RNA, 22 nt, Human
agcuagagcugagaagcacuug

SEQ ID NO: 875219 - RNA, 22 nt, Human
gcugauuaacuucauuguaguu

SEQ ID NO: 875220 - RNA, 22 nt, Human
augcuguggaaguuccugaagc

SEQ ID NO: 875221 - RNA, 22 nt, Human
uagcaccaaaacugaagaacau

SEQ ID NO: 875222 - RNA, 20 nt, Human
gcaaggcacagugaggaggg

SEQ ID NO: 875223 - RNA, 22 nt, Human
uaagugagggagcugggacuug

SEQ ID NO: 875224 - RNA, 22 nt, Human
gauguacaggaguuuuucaagg

SEQ ID NO: 875225 - RNA, 22 nt, Human
gagcuguguucaugaggagaaa

SEQ ID NO: 875226 - RNA, 22 nt, Human
ugaaggccuaacuuccagugcu

SEQ ID NO: 875227 - RNA, 22 nt, Human
augcaagacauaaauaaucuuu

SEQ ID NO: 875228 - RNA, 22 nt, Human
auggaaugugaacaugauggca

SEQ ID NO: 875229 - RNA, 22 nt, Human
aaaugcagauuuugaugcagca

SEQ ID NO: 875230 - RNA, 22 nt, Human
uuggucaagucuuaaagaaaaa

SEQ ID NO: 875231 - RNA, 22 nt, Human
uccuuggagcucuccaagggau

SEQ ID NO: 875232 - RNA, 22 nt, Human
uaggaaaaauacagaauuauau

SEQ ID NO: 875233 - RNA, 22 nt, Human
ucuaaacuuguaaacaagcaua

SEQ ID NO: 875234 - RNA, 22 nt, Human
guugaauauuuuaagaguuuug

SEQ ID NO: 875235 - RNA, 19 nt, Human
aaaguuuuauucucauuug

SEQ ID NO: 875236 - RNA, 22 nt, Human
acuaaauagccucugguaguug

SEQ ID NO: 875237 - RNA, 22 nt, Human
ugcuuccacuaaugagcugugu

SEQ ID NO: 875238 - RNA, 22 nt, Human
ucaguuuccugguuuugacauu

SEQ ID NO: 875239 - RNA, 22 nt, Human
aacuaaaucuggcauuuagagc

SEQ ID NO: 875240 - RNA, 22 nt, Human
ugaggaugguguuggagagggc

SEQ ID NO: 875241 - RNA, 22 nt, Human
uccaggaggguuuucugccuuc

SEQ ID NO: 875242 - RNA, 22 nt, Human
cuccaggagggggauggcugua

SEQ ID NO: 875243 - RNA, 22 nt, Human
agcagcuguggggacaagggua

SEQ ID NO: 875244 - RNA, 22 nt, Human
auuuauuaugggauuuggcaca

SEQ ID NO: 875245 - RNA, 22 nt, Human
augcacacguacccuacaaggc

SEQ ID NO: 875246 - RNA, 22 nt, Human
acugccuuauaugcugugugug

SEQ ID NO: 875247 - RNA, 22 nt, Human
gacaagacaccucucuccaucc

SEQ ID NO: 875248 - RNA, 22 nt, Human
ucagagcuuuggagaccaggaa

SEQ ID NO: 875249 - RNA, 22 nt, Human
cuuucagucaguuaacucagaa

SEQ ID NO: 875250 - RNA, 22 nt, Human
acacauguauaugcuugugugu

SEQ ID NO: 875251 - RNA, 22 nt, Human
uuccucaguuagugccugaggc

SEQ ID NO: 875252 - RNA, 22 nt, Human
gaggcugcauucuucccacugc

SEQ ID NO: 875253 - RNA, 22 nt, Human
caaaugcaaaauauaacccugu

SEQ ID NO: 875254 - RNA, 20 nt, Human
agagcagcaguuggugaggu

SEQ ID NO: 875255 - RNA, 22 nt, Human
aacaaaccuucccuauacgucu

SEQ ID NO: 875256 - RNA, 22 nt, Human
uggggacaggagacuuacagcu

SEQ ID NO: 875257 - RNA, 22 nt, Human
gcuggcagagcucugggcuggg

SEQ ID NO: 875258 - RNA, 22 nt, Human
aggccaagugcugggacaggug

SEQ ID NO: 875259 - RNA, 22 nt, Human
uccagaguuugagucuccuucc

SEQ ID NO: 875260 - RNA, 22 nt, Human
ugcauguguuucccagcaagcu

SEQ ID NO: 875261 - RNA, 22 nt, Human
aaacaaugaaauauuuuuaugg

SEQ ID NO: 875262 - RNA, 22 nt, Human
cucuugcugucaaagcagggua

SEQ ID NO: 875263 - RNA, 22 nt, Human
uuacauaacuuuaaaaugccgu

SEQ ID NO: 875264 - RNA, 22 nt, Human
aaggcuggguuugggaugugau

SEQ ID NO: 875265 - RNA, 22 nt, Human
aaagaagagcuggaaggagucu

SEQ ID NO: 875266 - RNA, 22 nt, Human
cuaacuuuagcuuagauuauca

SEQ ID NO: 875267 - RNA, 22 nt, Human
caggggccaggcugucugcugu

SEQ ID NO: 875268 - RNA, 22 nt, Human
ucaagcaaagauacaaauggaa

SEQ ID NO: 875269 - RNA, 17 nt, Human
ggccagaggcggggcug

SEQ ID NO: 875270 - RNA, 22 nt, Human
cuuuacagauaggaacuacuca

SEQ ID NO: 875271 - RNA, 22 nt, Human
aggaagcugggaaacugacauu

SEQ ID NO: 875272 - RNA, 22 nt, Human
acacugagcaucucuagaggca

SEQ ID NO: 875273 - RNA, 22 nt, Human
ucucaucuuuaaaugaaaauuu

SEQ ID NO: 875274 - RNA, 22 nt, Human
ccagaccacccuggccaugcac

SEQ ID NO: 875275 - RNA, 22 nt, Human
auuuggugccugggaaaucucu

SEQ ID NO: 875276 - RNA, 22 nt, Human
guuaaguaaacuaugauuuauc

SEQ ID NO: 875277 - RNA, 22 nt, Human
ucuccaaauaguuauauuuaga

SEQ ID NO: 875278 - RNA, 22 nt, Human
uuagauuuauaugugagaaugg

SEQ ID NO: 875279 - RNA, 22 nt, Human
ucuugagagauauacuacugaa

SEQ ID NO: 875280 - RNA, 22 nt, Human
gaacuucagaaucagcauaucu

SEQ ID NO: 875281 - RNA, 22 nt, Human
cauucauauuugcaguauaccu

SEQ ID NO: 875282 - RNA, 22 nt, Human
acauuugauugaugaaucaaau

SEQ ID NO: 875283 - RNA, 22 nt, Human
aauauuucguugcguggcuaga

SEQ ID NO: 875284 - RNA, 22 nt, Human
gcuccacuugcagcuaggcuug

SEQ ID NO: 875285 - RNA, 22 nt, Human
cugagguagucauuuucuacuc

SEQ ID NO: 875286 - RNA, 22 nt, Human
uagcuguuggcuuacaucuguu

SEQ ID NO: 875287 - RNA, 23 nt, Human
ugaggcugauugauuuuugcuca

SEQ ID NO: 875288 - RNA, 22 nt, Human
ugaggaagcaaaggcuugugug

SEQ ID NO: 875289 - RNA, 22 nt, Human
uucuucuccgaggagggcuggu

SEQ ID NO: 875290 - RNA, 22 nt, Human
uuauugaaauggaagcuauaac

SEQ ID NO: 875291 - RNA, 19 nt, Human
ggcagaagguguaggggga

SEQ ID NO: 875292 - RNA, 22 nt, Human
augacagacccucuaaagacaa

SEQ ID NO: 875293 - RNA, 18 nt, Human
aggucugaggaagagccu

SEQ ID NO: 875294 - RNA, 22 nt, Human
aauucugugcaggcagagcuau

SEQ ID NO: 875295 - RNA, 22 nt, Human
cagcugcaguucaaugcuugcu

SEQ ID NO: 875296 - RNA, 22 nt, Human
guggcugcagcggcuguggaga

SEQ ID NO: 875297 - RNA, 22 nt, Human
ggcuggucacaccacugcaggg

SEQ ID NO: 875298 - RNA, 22 nt, Human
uauguauaugguagaaguaugu

SEQ ID NO: 875299 - RNA, 22 nt, Human
ccauaaaguaggaaacacuaca

SEQ ID NO: 875300 - RNA, 22 nt, Human
aggcauuuucacugaugucauc

SEQ ID NO: 875301 - RNA, 22 nt, Human
cugagcucuaaugucagccuug

SEQ ID NO: 875302 - RNA, 22 nt, Human
uauauguagauuguaccaaugu

SEQ ID NO: 875303 - RNA, 22 nt, Human
gcucucugccauaugaggauac

SEQ ID NO: 875304 - RNA, 22 nt, Human
cuuggaggaugugcggcugccc

SEQ ID NO: 875305 - RNA, 22 nt, Human
uccaauuuuacgucuguauaaa

SEQ ID NO: 875306 - RNA, 22 nt, Human
acaguagaaacaggcaggcaga

SEQ ID NO: 875307 - RNA, 22 nt, Human
ugguccauguccuccaucucuc

SEQ ID NO: 875308 - RNA, 22 nt, Human
uguuuuguucacugcauugucc

SEQ ID NO: 875309 - RNA, 22 nt, Human
agccaccaccacugaaagguua

SEQ ID NO: 875310 - RNA, 22 nt, Human
ucaaacauaaaacuaaaucgag

SEQ ID NO: 875311 - RNA, 22 nt, Human
uuccuugguguaacugcuccua

SEQ ID NO: 875312 - RNA, 22 nt, Human
ccuuaaauucuccauuugaaag

SEQ ID NO: 875313 - RNA, 22 nt, Human
gaaaguuuucucacacaguaau

SEQ ID NO: 875314 - RNA, 18 nt, Human
cccagcacuuugggagcc

SEQ ID NO: 875315 - RNA, 22 nt, Human
ggucuuguuuauauaagguggu

SEQ ID NO: 875316 - RNA, 20 nt, Human
cacguuuuuccacuagcaaa

SEQ ID NO: 875317 - RNA, 22 nt, Human
uaggcacaaaaugaaaauggca

SEQ ID NO: 875318 - RNA, 22 nt, Human
ggacucucaggcugucggcuuc

SEQ ID NO: 875319 - RNA, 22 nt, Human
ccacaaguuucagcacccagag

SEQ ID NO: 875320 - RNA, 22 nt, Human
uuucuaacguagacagggaggu

SEQ ID NO: 875321 - RNA, 22 nt, Human
gagaggaacucccagugccugg

SEQ ID NO: 875322 - RNA, 22 nt, Human
uguggacgucauuaaagcagug

SEQ ID NO: 875323 - RNA, 22 nt, Human
ugcauauuguccuugauauuau

SEQ ID NO: 875324 - RNA, 22 nt, Human
cuuuacauuaauuucuacugau

SEQ ID NO: 875325 - RNA, 22 nt, Human
aaguuuuacugaggacacaugu

SEQ ID NO: 875326 - RNA, 22 nt, Human
uuguaacagcuguuuauauagu

SEQ ID NO: 875327 - RNA, 22 nt, Human
aaacaauguugcugggugcggu

SEQ ID NO: 875328 - RNA, 22 nt, Human
ugggcucagucugcuugguccu

SEQ ID NO: 875329 - RNA, 22 nt, Human
uugacaaaacaacacagauuuc

SEQ ID NO: 875330 - RNA, 20 nt, Human
cugggcugggcuacaggguc

SEQ ID NO: 875331 - RNA, 22 nt, Human
gcucuaacuauuaagaggucau

SEQ ID NO: 875332 - RNA, 22 nt, Human
uucuuugggcaauugcuggccc

SEQ ID NO: 875333 - RNA, 22 nt, Human
auguacaaaauguuuugaaaug

SEQ ID NO: 875334 - RNA, 22 nt, Human
cagaaggcaaggccugccacgc

SEQ ID NO: 875335 - RNA, 19 nt, Human
uauuucaaagugccgucua

SEQ ID NO: 875336 - RNA, 22 nt, Human
caccccagcuucucaggauaga

SEQ ID NO: 875337 - RNA, 22 nt, Human
gagggccucugugggugcucac

SEQ ID NO: 875338 - RNA, 22 nt, Human
cacauugauaauuaaggccucc

SEQ ID NO: 875339 - RNA, 22 nt, Human
ugagguaauguguacguuaauu

SEQ ID NO: 875340 - RNA, 22 nt, Human
acaucuucaaagugcuuugcaa

SEQ ID NO: 875341 - RNA, 22 nt, Human
gacagcagggaaaguccagacc

SEQ ID NO: 875342 - RNA, 22 nt, Human
uuccacaacaaccaagcauaua

SEQ ID NO: 875343 - RNA, 22 nt, Human
cagguccaacuauuuaucugug

SEQ ID NO: 875344 - RNA, 22 nt, Human
gagagcugauagaugagcuacu

SEQ ID NO: 875345 - RNA, 22 nt, Human
ucuguccagaacguacaucuug

SEQ ID NO: 875346 - RNA, 22 nt, Human
gaguaagagcuggcuuuggugu

SEQ ID NO: 875347 - RNA, 22 nt, Human
aguucucaagguuaggaaaagu

SEQ ID NO: 875348 - RNA, 22 nt, Human
agggcugcuuaccuggaauggc

SEQ ID NO: 875349 - RNA, 22 nt, Human
ucacugcuucuuggagaauguc

SEQ ID NO: 875350 - RNA, 22 nt, Human
gggcugagugggccucuuacuu

SEQ ID NO: 875351 - RNA, 22 nt, Human
cugaggcuuguccucucagcuu

SEQ ID NO: 875352 - RNA, 22 nt, Human
auguguaugcaugcacuaagau

SEQ ID NO: 875353 - RNA, 22 nt, Human
auaagcauuucacagguguguu

SEQ ID NO: 875354 - RNA, 22 nt, Human
gaaacuuacuuacucacauuuc

SEQ ID NO: 875355 - RNA, 22 nt, Human
gggcacagagggucuugaagaa

SEQ ID NO: 875356 - RNA, 22 nt, Human
ccuggcucuagaggccacuccu

SEQ ID NO: 875357 - RNA, 22 nt, Human
uauaggaaguauucaaagacug

SEQ ID NO: 875358 - RNA, 22 nt, Human
cagugcugccaaagggaccuug

SEQ ID NO: 875359 - RNA, 22 nt, Human
aggcucuguuauucuagagggc

SEQ ID NO: 875360 - RNA, 22 nt, Human
ucugggagagggaaagaagacu

SEQ ID NO: 875361 - RNA, 22 nt, Human
ugacaacauugaguuaugugca

SEQ ID NO: 875362 - RNA, 22 nt, Human
cagcuucuauuuaucuuugugu

SEQ ID NO: 875363 - RNA, 22 nt, Human
ucuucauguugcuuauucuggg

SEQ ID NO: 875364 - RNA, 22 nt, Human
guccuuucgagggugagugaaa

SEQ ID NO: 875365 - RNA, 22 nt, Human
uguucauuaaacuacugugugg

SEQ ID NO: 875366 - RNA, 22 nt, Human
auuuagaagcuaauuuuucaga

SEQ ID NO: 875367 - RNA, 22 nt, Human
ugugagugaaugggucugaagu

SEQ ID NO: 875368 - RNA, 22 nt, Human
ucucugcccauccucaguccac

SEQ ID NO: 875369 - RNA, 22 nt, Human
cucccagggucuaggcugcugg

SEQ ID NO: 875370 - RNA, 22 nt, Human
ugaggggccgcccaagcacuuc

SEQ ID NO: 875371 - RNA, 22 nt, Human
aaacacuucaaggacuucuguc

SEQ ID NO: 875372 - RNA, 22 nt, Human
ugcuucuguucuuucaccuacg

SEQ ID NO: 875373 - RNA, 22 nt, Human
ugaaucugauuucccuggaggc

SEQ ID NO: 875374 - RNA, 22 nt, Human
cugaaagguauaaauaagacuu

SEQ ID NO: 875375 - RNA, 22 nt, Human
ggaggggagguccagcugaucu

SEQ ID NO: 875376 - RNA, 22 nt, Human
uucauugaaccacuuuauucuu

SEQ ID NO: 875377 - RNA, 22 nt, Human
ugccaggccacguagcuucaag

SEQ ID NO: 875378 - RNA, 20 nt, Human
cuguuaaaagguaugaauuc

SEQ ID NO: 875379 - RNA, 22 nt, Human
uuuguuaaauauuuauugagug

SEQ ID NO: 875380 - RNA, 22 nt, Human
gcaaauacauguugagcaccua

SEQ ID NO: 875381 - RNA, 22 nt, Human
uuggcaaaggacucaaagcagg

SEQ ID NO: 875382 - RNA, 22 nt, Human
gaccacagagcacggccugcuu

SEQ ID NO: 875383 - RNA, 22 nt, Human
uguuaguuguucauguuaagag

SEQ ID NO: 875384 - RNA, 22 nt, Human
uuuuggugauuuuacugaaggu

SEQ ID NO: 875385 - RNA, 22 nt, Human
ggaucugggguagagcaguggg

SEQ ID NO: 875386 - RNA, 22 nt, Human
cauuacaaaguuauaaacaguu

SEQ ID NO: 875387 - RNA, 22 nt, Human
gcaagguguuuuaacaggaaaa

SEQ ID NO: 875388 - RNA, 22 nt, Human
uguguguggggaggcagcagau

SEQ ID NO: 875389 - RNA, 19 nt, Human
cacagggcaggucucaugu

SEQ ID NO: 875390 - RNA, 22 nt, Human
ggcacucaauaaauguugccaa

SEQ ID NO: 875391 - RNA, 22 nt, Human
ccugggcaggccggacgcuggg

SEQ ID NO: 875392 - RNA, 22 nt, Human
uccuuucugucuuuacucugga

SEQ ID NO: 875393 - RNA, 23 nt, Human
aguacaauaaguauaauucuuuc

SEQ ID NO: 875394 - RNA, 22 nt, Human
cugcagugaaaucaggaagcaa

SEQ ID NO: 875395 - RNA, 22 nt, Human
ccagccagcugcccuuggggcc

SEQ ID NO: 875396 - RNA, 22 nt, Human
uuccuucuagagcuuguuuagg

SEQ ID NO: 875397 - RNA, 22 nt, Human
agaaacucuggaagaacuuuua

SEQ ID NO: 875398 - RNA, 22 nt, Human
cagaaaggacuuugguuggcuu

SEQ ID NO: 875399 - RNA, 19 nt, Human
ugagacagagaccaguucu

SEQ ID NO: 875400 - RNA, 22 nt, Human
agggccaggaacaccugaaggg

SEQ ID NO: 875401 - RNA, 22 nt, Human
agaaaucuaagaugcucaagga

SEQ ID NO: 875402 - RNA, 22 nt, Human
ugcuaaacaauguacaguguau

SEQ ID NO: 875403 - RNA, 22 nt, Human
guuucuuauuugcagguugcuu

SEQ ID NO: 875404 - RNA, 22 nt, Human
agcucugguuauugaagcaggg

SEQ ID NO: 875405 - RNA, 22 nt, Human
aagacaacagagaugacagacu

SEQ ID NO: 875406 - RNA, 22 nt, Human
gaguggcuguguacaugcccag

SEQ ID NO: 875407 - RNA, 22 nt, Human
aagggcaugggaugaaaaguag

SEQ ID NO: 875408 - RNA, 22 nt, Human
ucugggguggagcccuggaguc

SEQ ID NO: 875409 - RNA, 21 nt, Human
uauaggaaucagucacaucug

SEQ ID NO: 875410 - RNA, 22 nt, Human
uggcagaguuggagguggaaga

SEQ ID NO: 875411 - RNA, 22 nt, Human
gcugcaggagcuggagcugugg

SEQ ID NO: 875412 - RNA, 22 nt, Human
ucuuagcaaauacuacuuagaa

SEQ ID NO: 875413 - RNA, 22 nt, Human
uuccuugaaagcuggacauggg

SEQ ID NO: 875414 - RNA, 22 nt, Human
gagagacccagacaccaugcau

SEQ ID NO: 875415 - RNA, 22 nt, Human
agcucacaccucaucagggugg

SEQ ID NO: 875416 - RNA, 18 nt, Human
cagccucugauugguugc

SEQ ID NO: 875417 - RNA, 22 nt, Human
uauuguauuaaggauucaagua

SEQ ID NO: 875418 - RNA, 22 nt, Human
ugcauuuuugagguuaacucaa

SEQ ID NO: 875419 - RNA, 22 nt, Human
uuaaaucaggcaucauuucagu

SEQ ID NO: 875420 - RNA, 22 nt, Human
agcauuuauugaccugcugcug

SEQ ID NO: 875421 - RNA, 22 nt, Human
gcuccaggaggaugaccuuccu

SEQ ID NO: 875422 - RNA, 22 nt, Human
gugcgugaggccccugagcgaa

SEQ ID NO: 875423 - RNA, 22 nt, Human
cuggaaugagagcccggggauc

SEQ ID NO: 875424 - RNA, 22 nt, Human
uggccuggggaccugugagacc

SEQ ID NO: 875425 - RNA, 22 nt, Human
gagaggagacuuauccagauug

SEQ ID NO: 875426 - RNA, 22 nt, Human
ucucuguggcauccacucaacu

SEQ ID NO: 875427 - RNA, 22 nt, Human
ugcaguguuuggaugcugaguc

SEQ ID NO: 875428 - RNA, 22 nt, Human
uucuacagaauaaauguuuaca

SEQ ID NO: 875429 - RNA, 22 nt, Human
aauaucuguggccauacaauuu

SEQ ID NO: 875430 - RNA, 19 nt, Human
ucccaggcaaaggcuucuc

SEQ ID NO: 875431 - RNA, 22 nt, Human
gagcacaggcuuugguggacac

SEQ ID NO: 875432 - RNA, 22 nt, Human
cagcccuuccaggcagaauucu

SEQ ID NO: 875433 - RNA, 22 nt, Human
gcacaagaauaaccauauuuaa

SEQ ID NO: 875434 - RNA, 22 nt, Human
caggucagcacuuggaggugca

SEQ ID NO: 875435 - RNA, 22 nt, Human
cuugaaagaagggucuuuuaau

SEQ ID NO: 875436 - RNA, 22 nt, Human
ucaggaagaaagaagggagugu

SEQ ID NO: 875437 - RNA, 22 nt, Human
caugaauauuuaguauuuacuu

SEQ ID NO: 875438 - RNA, 22 nt, Human
caucuuuagggaccauuauucu

SEQ ID NO: 875439 - RNA, 22 nt, Human
aagcagcagccaucccccaagg

SEQ ID NO: 875440 - RNA, 22 nt, Human
ucagugcacaaugacgguggcu

SEQ ID NO: 875441 - RNA, 22 nt, Human
cucugugcccuacugcucagcu

SEQ ID NO: 875442 - RNA, 22 nt, Human
cugucuaguuaggaugccagca

SEQ ID NO: 875443 - RNA, 22 nt, Human
gacaaguuguggagaagagggu

SEQ ID NO: 875444 - RNA, 22 nt, Human
uacaaaugccugacacacagau

SEQ ID NO: 875445 - RNA, 22 nt, Human
cugcuguggugucaagcaucuc

SEQ ID NO: 875446 - RNA, 22 nt, Human
caagagacuuauguggaaaccu

SEQ ID NO: 875447 - RNA, 22 nt, Human
aaauuuucagagcacuagagaa

SEQ ID NO: 875448 - RNA, 20 nt, Human
agaagaggauacaaccaggc

SEQ ID NO: 875449 - RNA, 22 nt, Human
cucugguucagggcucccuggc

SEQ ID NO: 875450 - RNA, 22 nt, Human
aguuuauguuguuuauaagcca

SEQ ID NO: 875451 - RNA, 22 nt, Human
uucuuugcccauguuuccuaag

SEQ ID NO: 875452 - RNA, 20 nt, Human
accugggguugccugugcuc

SEQ ID NO: 875453 - RNA, 22 nt, Human
uuauuuauguuaacagucgaga

SEQ ID NO: 875454 - RNA, 22 nt, Human
gggaccuggggacuccuuguuc

SEQ ID NO: 875455 - RNA, 22 nt, Human
augaugugugcugaucaagcuu

SEQ ID NO: 875456 - RNA, 22 nt, Human
guuaacaaauguaaagcaauua

SEQ ID NO: 875457 - RNA, 22 nt, Human
uugucaccuauacugagcuuaa

SEQ ID NO: 875458 - RNA, 22 nt, Human
ugcaaacauccgacugaaagcc

SEQ ID NO: 875459 - RNA, 22 nt, Human
aucauugaauauaagugcuauu

SEQ ID NO: 875460 - RNA, 23 nt, Human
gacacaggagcacccagcugagc

SEQ ID NO: 875461 - RNA, 22 nt, Human
ucagggcaucucuuaaguggug

SEQ ID NO: 875462 - RNA, 22 nt, Human
uguguucaccaaaguguagaaa

SEQ ID NO: 875463 - RNA, 22 nt, Human
acacugguugguugaauuuacu

SEQ ID NO: 875464 - RNA, 22 nt, Human
uuuaguuuugaugaaaaugcca

SEQ ID NO: 875465 - RNA, 22 nt, Human
caguuuauaugaggguaucaag

SEQ ID NO: 875466 - RNA, 22 nt, Human
auauuuggaaagaaaaucauug

SEQ ID NO: 875467 - RNA, 22 nt, Human
ggagauggaauagauucugacu

SEQ ID NO: 875468 - RNA, 22 nt, Human
gaugaaauucagaauugagggg

SEQ ID NO: 875469 - RNA, 22 nt, Human
uauaugucugcuacuguauaaa

SEQ ID NO: 875470 - RNA, 22 nt, Human
caggaaagguagucacaaugua

SEQ ID NO: 875471 - RNA, 22 nt, Human
ccugagacaugaaccaggcucc

SEQ ID NO: 875472 - RNA, 22 nt, Human
acagcugcuguggagguuuuca

SEQ ID NO: 875473 - RNA, 22 nt, Human
ucacauguauaugcagcacagc

SEQ ID NO: 875474 - RNA, 22 nt, Human
gcucugagagugggugauucug

SEQ ID NO: 875475 - RNA, 22 nt, Human
gaacacuugcuguuaauaagug

SEQ ID NO: 875476 - RNA, 22 nt, Human
uugagauagguggaaucucuuu

SEQ ID NO: 875477 - RNA, 22 nt, Human
aacaaauguguggcaguguggg

SEQ ID NO: 875478 - RNA, 22 nt, Human
ucuugauuuuguuaaaauuaga

SEQ ID NO: 875479 - RNA, 22 nt, Human
cuggggcccaucgagggcugag

SEQ ID NO: 875480 - RNA, 22 nt, Human
agaaaugaaaccaaagccuaga

SEQ ID NO: 875481 - RNA, 22 nt, Human
acauuucucuuagaguuggacu

SEQ ID NO: 875482 - RNA, 22 nt, Human
uuuggaaacugccucagcucuu

SEQ ID NO: 875483 - RNA, 22 nt, Human
uguacaugacagagagagccaa

SEQ ID NO: 875484 - RNA, 22 nt, Human
aucugcuucagugauaugugaa

SEQ ID NO: 875485 - RNA, 22 nt, Human
uccccugcagaugagggcagug

SEQ ID NO: 875486 - RNA, 22 nt, Human
ucacugcaaccucugccuuccg

SEQ ID NO: 875487 - RNA, 22 nt, Human
gcugccagcccucggggucuga

SEQ ID NO: 875488 - RNA, 22 nt, Human
uucauucagugagacuaggacg

SEQ ID NO: 875489 - RNA, 22 nt, Human
gccuggcucccucugcagcucc

SEQ ID NO: 875490 - RNA, 22 nt, Human
uggcuaaucuuaaggcuuuugc

SEQ ID NO: 875491 - RNA, 22 nt, Human
cagacacagcaauucuguguug

SEQ ID NO: 875492 - RNA, 22 nt, Human
aaggccacacuugcuggccagc

SEQ ID NO: 875493 - RNA, 22 nt, Human
gggaggagcugagugugugugc

SEQ ID NO: 875494 - RNA, 23 nt, Human
aaauggguuucuguuuuguggac

SEQ ID NO: 875495 - RNA, 21 nt, Human
uccucccugagcuguggggga

SEQ ID NO: 875496 - RNA, 22 nt, Human
aggaagaaccuaagaaagucuc

SEQ ID NO: 875497 - RNA, 22 nt, Human
ugcuggaauugaccuagaagga

SEQ ID NO: 875498 - RNA, 23 nt, Human
gcucuauguguuauagcuguuuu

SEQ ID NO: 875499 - RNA, 22 nt, Human
gugucccagcagcacauuggcu

SEQ ID NO: 875500 - RNA, 22 nt, Human
ugaacuuuuauuugaugacagg

SEQ ID NO: 875501 - RNA, 22 nt, Human
auacaguaauuuguaacucauc

SEQ ID NO: 875502 - RNA, 22 nt, Human
aucugaaagcuaggaguucuca

SEQ ID NO: 875503 - RNA, 22 nt, Human
auuacaguggacagcuaugcac

SEQ ID NO: 875504 - RNA, 17 nt, Human
cugcagcuggagggcca

SEQ ID NO: 875505 - RNA, 22 nt, Human
agguggggcugggaaagauucc

SEQ ID NO: 875506 - RNA, 22 nt, Human
agggggugucucugauuggguu

SEQ ID NO: 875507 - RNA, 20 nt, Human
uuuuaugucaccuuccuguc

SEQ ID NO: 875508 - RNA, 22 nt, Human
acugugagagagguucuuggua

SEQ ID NO: 875509 - RNA, 22 nt, Human
guauuucugguuaaaugugcua

SEQ ID NO: 875510 - RNA, 22 nt, Human
ggaggaagugcaguucuacuac

SEQ ID NO: 875511 - RNA, 22 nt, Human
gggcaucugguggagccucagg

SEQ ID NO: 875512 - RNA, 22 nt, Human
gggaagcagcauugugcuggcu

SEQ ID NO: 875513 - RNA, 22 nt, Human
uaucugugaaauguguuuguau

SEQ ID NO: 875514 - RNA, 22 nt, Human
auuuagucucccuuaucaagga

SEQ ID NO: 875515 - RNA, 22 nt, Human
acaguguuguggcucuuaauag

SEQ ID NO: 875516 - RNA, 22 nt, Human
ggcgcaggccuuggauccuggu

SEQ ID NO: 875517 - RNA, 22 nt, Human
ccaguguguuaguggauuuccc

SEQ ID NO: 875518 - RNA, 23 nt, Human
caggaaaucaauucuuccagcau

SEQ ID NO: 875519 - RNA, 21 nt, Human
aucucuucaaggcugauuuac

SEQ ID NO: 875520 - RNA, 22 nt, Human
uucugcauucaaauuaugugag

SEQ ID NO: 875521 - RNA, 22 nt, Human
uccagcuuucacgcuccugccu

SEQ ID NO: 875522 - RNA, 22 nt, Human
ugaggccaagaaaagcugggug

SEQ ID NO: 875523 - RNA, 22 nt, Human
cagggccaguucucgcagcagu

SEQ ID NO: 875524 - RNA, 22 nt, Human
ucuuuggacauguugagguugc

SEQ ID NO: 875525 - RNA, 22 nt, Human
ccucccuccauugccaucgucu

SEQ ID NO: 875526 - RNA, 22 nt, Human
uguuaaaaauucagcucuagau

SEQ ID NO: 875527 - RNA, 22 nt, Human
gcugagaguccaggaaaacauc

SEQ ID NO: 875528 - RNA, 22 nt, Human
gggcuccagggcccgagucguc

SEQ ID NO: 875529 - RNA, 22 nt, Human
uggguccaguguccuggcuaug

SEQ ID NO: 875530 - RNA, 22 nt, Human
ucauauaucugcaaagcaguau

SEQ ID NO: 875531 - RNA, 22 nt, Human
agucaccaucuguggcagccug

SEQ ID NO: 875532 - RNA, 21 nt, Human
ggcugcagggagcccuggggu

SEQ ID NO: 875533 - RNA, 22 nt, Human
uggcaggcggagguugcaguga

SEQ ID NO: 875534 - RNA, 20 nt, Human
gaugagacccaugcaugaga

SEQ ID NO: 875535 - RNA, 22 nt, Human
uuccaaaguuauucaagcagua

SEQ ID NO: 875536 - RNA, 21 nt, Human
cccaggaggcugagaagagca

SEQ ID NO: 875537 - RNA, 22 nt, Human
gcaggacuugaauccaggcagu

SEQ ID NO: 875538 - RNA, 22 nt, Human
caccagcuugcagucuuaaccc

SEQ ID NO: 875539 - RNA, 22 nt, Human
gugcuacagacugaguacacuu

SEQ ID NO: 875540 - RNA, 22 nt, Human
aggaacagaagagcaaugcagg

SEQ ID NO: 875541 - RNA, 22 nt, Human
gaagagcuccaaaaacagugag

SEQ ID NO: 875542 - RNA, 19 nt, Human
ugggagaggcaacagagua

SEQ ID NO: 875543 - RNA, 21 nt, Human
aggagaccggcuuguuugugc

SEQ ID NO: 875544 - RNA, 22 nt, Human
cacaggggcaaacuguagggga

SEQ ID NO: 875545 - RNA, 22 nt, Human
uucauauaaauggaaucagaau

SEQ ID NO: 875546 - RNA, 17 nt, Human
acaggccugcuugcacu

SEQ ID NO: 875547 - RNA, 22 nt, Human
ugugacagaucuuuaaauaaug

SEQ ID NO: 875548 - RNA, 22 nt, Human
guggcagcagguacucacgcac

SEQ ID NO: 875549 - RNA, 22 nt, Human
uguacaaauucauugaacugua

SEQ ID NO: 875550 - RNA, 22 nt, Human
cugcacuugacaugcucucaga

SEQ ID NO: 875551 - RNA, 22 nt, Human
gccugcugaagccagagugugu

SEQ ID NO: 875552 - RNA, 22 nt, Human
gggcuccagauugcagcgauca

SEQ ID NO: 875553 - RNA, 22 nt, Human
aaacuucagggaauaaaagagu

SEQ ID NO: 875554 - RNA, 19 nt, Human
uccuugugacugugugaaa

SEQ ID NO: 875555 - RNA, 22 nt, Human
ccagugcccagcugcccaggca

SEQ ID NO: 875556 - RNA, 20 nt, Human
aaaagcagccagagauggua

SEQ ID NO: 875557 - RNA, 22 nt, Human
uucacagauugacuggauuccu

SEQ ID NO: 875558 - RNA, 22 nt, Human
guggccagccagggugcugaug

SEQ ID NO: 875559 - RNA, 22 nt, Human
caauguaaauauuuucuaauca

SEQ ID NO: 875560 - RNA, 22 nt, Human
uauuucuguuuauuuguacauc

SEQ ID NO: 875561 - RNA, 22 nt, Human
ugagagcugaagauauguuaac

SEQ ID NO: 875562 - RNA, 22 nt, Human
cagcaguuuugaaguguggaga

SEQ ID NO: 875563 - RNA, 22 nt, Human
cuaaacauggcuuagaacacuc

SEQ ID NO: 875564 - RNA, 23 nt, Human
gaggccacauuccccugcuugag

SEQ ID NO: 875565 - RNA, 22 nt, Human
augugugcauguuagagagagu

SEQ ID NO: 875566 - RNA, 22 nt, Human
gcugucugucuucacaucucgc

SEQ ID NO: 875567 - RNA, 22 nt, Human
ucuagauguacugcugaagagu

SEQ ID NO: 875568 - RNA, 22 nt, Human
caguuuauuguugcguucacau

SEQ ID NO: 875569 - RNA, 22 nt, Human
auaauucuccaauuuuuguugu

SEQ ID NO: 875570 - RNA, 23 nt, Human
aggucaaccacaagcugacaaac

SEQ ID NO: 875571 - RNA, 23 nt, Human
ucaaacauauugugagacacagg

SEQ ID NO: 875572 - RNA, 22 nt, Human
cugaggcucccucgggucugcu

SEQ ID NO: 875573 - RNA, 22 nt, Human
agacagcagggagcaggauuca

SEQ ID NO: 875574 - RNA, 22 nt, Human
acugccuucaaacagcgccacc

SEQ ID NO: 875575 - RNA, 22 nt, Human
caguuguucccagcaaugaaag

SEQ ID NO: 875576 - RNA, 22 nt, Human
cuagagguagaggcagugggaa

SEQ ID NO: 875577 - RNA, 22 nt, Human
agcggcugucggccagccggag

SEQ ID NO: 875578 - RNA, 22 nt, Human
gguaacaaacuucugacuuaag

SEQ ID NO: 875579 - RNA, 22 nt, Human
cuggcuccauccuugagcucug

SEQ ID NO: 875580 - RNA, 22 nt, Human
ggccaggaucuguuuguccacc

SEQ ID NO: 875581 - RNA, 22 nt, Human
ggagugacucucggggccacua

SEQ ID NO: 875582 - RNA, 22 nt, Human
agcuuccugucuucugcacaaa

SEQ ID NO: 875583 - RNA, 22 nt, Human
gcccaggagaggccagggcuga

SEQ ID NO: 875584 - RNA, 22 nt, Human
ggcaccagggaaggaaggcugg

SEQ ID NO: 875585 - RNA, 22 nt, Human
ucaaauagguaugaguagaaau

SEQ ID NO: 875586 - RNA, 22 nt, Human
auuguacuagaaauuguauuca

SEQ ID NO: 875587 - RNA, 22 nt, Human
uuucugagaaauuaaacacuuu

SEQ ID NO: 875588 - RNA, 22 nt, Human
guuagacaugagugugcuuaca

SEQ ID NO: 875589 - RNA, 22 nt, Human
augcauaucacagucuccaugu

SEQ ID NO: 875590 - RNA, 22 nt, Human
cacaauuccauggcauucuuug

SEQ ID NO: 875591 - RNA, 22 nt, Human
cuccuuccugcagaucugagau

SEQ ID NO: 875592 - RNA, 22 nt, Human
ucaggaaagaagaugcucagug

SEQ ID NO: 875593 - RNA, 19 nt, Human
gucuguguauuuguugcug

SEQ ID NO: 875594 - RNA, 22 nt, Human
cugugggagcacaugacagaua

SEQ ID NO: 875595 - RNA, 22 nt, Human
uuuugcuuuuguaacacagugu

SEQ ID NO: 875596 - RNA, 22 nt, Human
ggcaggagcucuccaguuugcc

SEQ ID NO: 875597 - RNA, 22 nt, Human
caaggccuucuugggagagauu

SEQ ID NO: 875598 - RNA, 22 nt, Human
ugucauuuccugaaugcugagu

SEQ ID NO: 875599 - RNA, 19 nt, Human
acuucugaggaacugcaca

SEQ ID NO: 875600 - RNA, 22 nt, Human
agauggcucuuugaaggggaau

SEQ ID NO: 875601 - RNA, 20 nt, Human
acagaauaugcugguugugg

SEQ ID NO: 875602 - RNA, 22 nt, Human
agguccuguguccaggggccug

SEQ ID NO: 875603 - RNA, 22 nt, Human
aagauaacaggaggaguuugua

SEQ ID NO: 875604 - RNA, 22 nt, Human
aaauagaaaccaacaaggucag

SEQ ID NO: 875605 - RNA, 22 nt, Human
cuacauaaauuuaucacagacu

SEQ ID NO: 875606 - RNA, 21 nt, Human
ccugagugagaccuggcccgu

SEQ ID NO: 875607 - RNA, 22 nt, Human
guggaaaugcccccaaauagug

SEQ ID NO: 875608 - RNA, 22 nt, Human
gagcccuguaggaaucucucaa

SEQ ID NO: 875609 - RNA, 22 nt, Human
gcucuggauccggcugggucug

SEQ ID NO: 875610 - RNA, 22 nt, Human
ugugugcagccucugucuuugg

SEQ ID NO: 875611 - RNA, 22 nt, Human
acaaugcauaaguuucucccag

SEQ ID NO: 875612 - RNA, 22 nt, Human
cugugacuguguuggaugcaca

SEQ ID NO: 875613 - RNA, 22 nt, Human
uguuuucuagaaacaaugccua

SEQ ID NO: 875614 - RNA, 21 nt, Human
gcagucacucgguuggcuacc

SEQ ID NO: 875615 - RNA, 22 nt, Human
uccagcagguccgagacaaguu

SEQ ID NO: 875616 - RNA, 21 nt, Human
uguauacacguguugaaaaca

SEQ ID NO: 875617 - RNA, 22 nt, Human
ugggcuccucgucacucgcugu

SEQ ID NO: 875618 - RNA, 21 nt, Human
auugaaagucaacaaucaguu

SEQ ID NO: 875619 - RNA, 22 nt, Human
ggagccuguggcugcuugaagc

SEQ ID NO: 875620 - RNA, 22 nt, Human
augcaacaggucagccaggaag

SEQ ID NO: 875621 - RNA, 22 nt, Human
uggcaggguuggccaccuuacc

SEQ ID NO: 875622 - RNA, 22 nt, Human
cugaggccucuguucaccagaa

SEQ ID NO: 875623 - RNA, 22 nt, Human
cucugagcagaggccguggcua

SEQ ID NO: 875624 - RNA, 22 nt, Human
cuuccucucaauaagaugagaa

SEQ ID NO: 875625 - RNA, 22 nt, Human
ggaggccagccugaggcugagg

SEQ ID NO: 875626 - RNA, 22 nt, Human
ccauagugaauugucucagacg

SEQ ID NO: 875627 - RNA, 22 nt, Human
uagcagcaauuacacaguccgu

SEQ ID NO: 875628 - RNA, 22 nt, Human
ugcuuaaaguaguggauuguua

SEQ ID NO: 875629 - RNA, 22 nt, Human
acaaggcacuuuaugaagagga

SEQ ID NO: 875630 - RNA, 22 nt, Human
acagguggucuuugcuccuuuu

SEQ ID NO: 875631 - RNA, 22 nt, Human
uuuugaaagccagguuuguaug

SEQ ID NO: 875632 - RNA, 22 nt, Human
cugcaggcugagcgccugccgg

SEQ ID NO: 875633 - RNA, 23 nt, Human
gcagauggccccagagugcugcc

SEQ ID NO: 875634 - RNA, 18 nt, Human
gcacagagcaaguuucau

SEQ ID NO: 875635 - RNA, 22 nt, Human
cagggacagagacugcaccuug

SEQ ID NO: 875636 - RNA, 22 nt, Human
uaucuuugaugccagauguuac

SEQ ID NO: 875637 - RNA, 22 nt, Human
aguggcugauuacaaacugagu

SEQ ID NO: 875638 - RNA, 22 nt, Human
aaagcagcuguuugacuuucca

SEQ ID NO: 875639 - RNA, 22 nt, Human
ggaacaguugagaugauguacc

SEQ ID NO: 875640 - RNA, 22 nt, Human
uuuuaaacugcagaauuuagaa

SEQ ID NO: 875641 - RNA, 22 nt, Human
agggcagcggugcuuguguuau

SEQ ID NO: 875642 - RNA, 22 nt, Human
agaucugguuggaguccugaca

SEQ ID NO: 875643 - RNA, 22 nt, Human
auguuuauggagcagguauuag

SEQ ID NO: 875644 - RNA, 22 nt, Human
cucuagaagcugaggggcccaa

SEQ ID NO: 875645 - RNA, 22 nt, Human
auaauuaggucuuauaacgucu

SEQ ID NO: 875646 - RNA, 22 nt, Human
uucaauaucucuaagaaugagg

SEQ ID NO: 875647 - RNA, 22 nt, Human
agucuuuacauguguuauauau

SEQ ID NO: 875648 - RNA, 22 nt, Human
aauaacagauuuucaagcugug

SEQ ID NO: 875649 - RNA, 22 nt, Human
uaaauacugaguuggaguuggc

SEQ ID NO: 875650 - RNA, 22 nt, Human
aaaucagaggucagcuguacca

SEQ ID NO: 875651 - RNA, 22 nt, Human
cccagaggugcuucagaggugc

SEQ ID NO: 875652 - RNA, 22 nt, Human
agcccugggaggccagcuugua

SEQ ID NO: 875653 - RNA, 22 nt, Human
aggcuccacccuacagagcucc

SEQ ID NO: 875654 - RNA, 22 nt, Human
gcauaugaucacgugugucggu

SEQ ID NO: 875655 - RNA, 22 nt, Human
gguagucauggauagcuaugag

SEQ ID NO: 875656 - RNA, 22 nt, Human
uaauuuacuugcaaauaacaau

SEQ ID NO: 875657 - RNA, 22 nt, Human
aguucugguuaaccugcaaccu

SEQ ID NO: 875658 - RNA, 22 nt, Human
cuggcugucuucugggagcugu

SEQ ID NO: 875659 - RNA, 19 nt, Human
cucugccucuggcuguggc

SEQ ID NO: 875660 - RNA, 22 nt, Human
uggcaauaauuguaauucaauu

SEQ ID NO: 875661 - RNA, 22 nt, Human
caaagugcugggauuauaggca

SEQ ID NO: 875662 - RNA, 22 nt, Human
caacaguuccuccauccucucu

SEQ ID NO: 875663 - RNA, 15 nt, Human
aagaaucugaagcuu

SEQ ID NO: 875664 - RNA, 22 nt, Human
ucucagaaauacuauguuguca

SEQ ID NO: 875665 - RNA, 22 nt, Human
aguauuuggccucuacagucuc

SEQ ID NO: 875666 - RNA, 22 nt, Human
ugcagaagcugcaggucagugg

SEQ ID NO: 875667 - RNA, 22 nt, Human
cucacagguuaguuguguggau

SEQ ID NO: 875668 - RNA, 22 nt, Human
aaagccagcaaggugaguuuca

SEQ ID NO: 875669 - RNA, 19 nt, Human
cugcucuccuugacuugga

SEQ ID NO: 875670 - RNA, 22 nt, Human
ugguggcuguugcagaacugag

SEQ ID NO: 875671 - RNA, 22 nt, Human
cagguaaaaauaaauuugugag

SEQ ID NO: 875672 - RNA, 22 nt, Human
guuccaggacccuggccucuga

SEQ ID NO: 875673 - RNA, 22 nt, Human
gauugaaaggaaaaccagagug

SEQ ID NO: 875674 - RNA, 22 nt, Human
aaaaucuaaguagcgaguaagg

SEQ ID NO: 875675 - RNA, 20 nt, Human
aauuuacucacagaaugaau

SEQ ID NO: 875676 - RNA, 22 nt, Human
cagcaggauuugaaaggaagag

SEQ ID NO: 875677 - RNA, 22 nt, Human
guccuaaauauagugauucaug

SEQ ID NO: 875678 - RNA, 22 nt, Human
cagaaauguuuguuaauauugu

SEQ ID NO: 875679 - RNA, 22 nt, Human
cagaacauucacucauaugugg

SEQ ID NO: 875680 - RNA, 22 nt, Human
gagucaggcuagggugacaggc

SEQ ID NO: 875681 - RNA, 22 nt, Human
cugugugcauaguugugcucaa

SEQ ID NO: 875682 - RNA, 22 nt, Human
augcuguggggagugaggguag

SEQ ID NO: 875683 - RNA, 22 nt, Human
gccugcagccucaagggcugag

SEQ ID NO: 875684 - RNA, 22 nt, Human
uagcaaaauguggauguaguug

SEQ ID NO: 875685 - RNA, 22 nt, Human
ucagaggagaaguugggaaaau

SEQ ID NO: 875686 - RNA, 22 nt, Human
augcaauguuccuuucuucacc

SEQ ID NO: 875687 - RNA, 22 nt, Human
acagcagaguggagaugagcac

SEQ ID NO: 875688 - RNA, 22 nt, Human
ucccuguacacuaacuugagac

SEQ ID NO: 875689 - RNA, 22 nt, Human
uauuauguaaagguuauugcag

SEQ ID NO: 875690 - RNA, 22 nt, Human
ucacagugacagccaauguuuu

SEQ ID NO: 875691 - RNA, 21 nt, Human
aggugggcagguggaguggcc

SEQ ID NO: 875692 - RNA, 22 nt, Human
cagugguggaaugaggaauugu

SEQ ID NO: 875693 - RNA, 19 nt, Human
ugcagccacgugagagacu

SEQ ID NO: 875694 - RNA, 22 nt, Human
ugcagggaaagggcacugggcu

SEQ ID NO: 875695 - RNA, 22 nt, Human
gugccuggaacuggguaggcug

SEQ ID NO: 875696 - RNA, 22 nt, Human
gugugcaggugucagugcagcu

SEQ ID NO: 875697 - RNA, 22 nt, Human
gagaggcuccaugaccccggca

SEQ ID NO: 875698 - RNA, 22 nt, Human
agcuucaucuuuauguacagga

SEQ ID NO: 875699 - RNA, 22 nt, Human
caagccagcuccugccacagag

SEQ ID NO: 875700 - RNA, 22 nt, Human
aggucagcugcugauaggcagc

SEQ ID NO: 875701 - RNA, 22 nt, Human
gucaugagaaaucuuugaaggu

SEQ ID NO: 875702 - RNA, 22 nt, Human
ucacaaggauaagccacauaua

SEQ ID NO: 875703 - RNA, 20 nt, Human
cucuuugcaaugcagaagac

SEQ ID NO: 875704 - RNA, 22 nt, Human
cuguguuuuuggucugaucuau

SEQ ID NO: 875705 - RNA, 22 nt, Human
gagagcugggggacuguggaug

SEQ ID NO: 875706 - RNA, 22 nt, Human
guuccacaucacacuacuugau

SEQ ID NO: 875707 - RNA, 22 nt, Human
gcagagauccuugcuggaugac

SEQ ID NO: 875708 - RNA, 22 nt, Human
ucaguguuaaucagugguaccu

SEQ ID NO: 875709 - RNA, 22 nt, Human
aguaacacaagagguccuugcg

SEQ ID NO: 875710 - RNA, 22 nt, Human
ggacacaggcagcugggugggu

SEQ ID NO: 875711 - RNA, 22 nt, Human
cucuugaacuuucuaguuucau

SEQ ID NO: 875712 - RNA, 22 nt, Human
ggccagcagaccucagggacuc

SEQ ID NO: 875713 - RNA, 22 nt, Human
ugaaaaacacuaauuggaaagc

SEQ ID NO: 875714 - RNA, 20 nt, Human
guggccuguccuguuguggg

SEQ ID NO: 875715 - RNA, 22 nt, Human
ccugggcccucaccgccggugg

SEQ ID NO: 875716 - RNA, 19 nt, Human
cuccucagucccagagguc

SEQ ID NO: 875717 - RNA, 22 nt, Human
ccagcugcagguguuccagaug

SEQ ID NO: 875718 - RNA, 22 nt, Human
ccagaaaguucagcugugaaug

SEQ ID NO: 875719 - RNA, 21 nt, Human
guuuaugaaucuuguccugcu

SEQ ID NO: 875720 - RNA, 22 nt, Human
gcaguguguuucugagauaugg

SEQ ID NO: 875721 - RNA, 22 nt, Human
uucucugagauagacuaagugg

SEQ ID NO: 875722 - RNA, 19 nt, Human
ugugccuccucgucuccua

SEQ ID NO: 875723 - RNA, 22 nt, Human
ccuggcugcaguuuuugcagaa

SEQ ID NO: 875724 - RNA, 22 nt, Human
aaguucuaugaaucuacuccaa

SEQ ID NO: 875725 - RNA, 22 nt, Human
ucaacaagagcccaugcuuuuu

SEQ ID NO: 875726 - RNA, 22 nt, Human
uguugggaucgaaugguggaac

SEQ ID NO: 875727 - RNA, 22 nt, Human
augaagcauuacaggaugacag

SEQ ID NO: 875728 - RNA, 22 nt, Human
gagcugcagagcucgaaggaac

SEQ ID NO: 875729 - RNA, 22 nt, Human
cuuguccuuuacuugagacuca

SEQ ID NO: 875730 - RNA, 20 nt, Human
aacagggggcugcagagggc

SEQ ID NO: 875731 - RNA, 23 nt, Human
aacuuaauacugggauaagaugc

SEQ ID NO: 875732 - RNA, 22 nt, Human
uagagcugcuggacuguaacag

SEQ ID NO: 875733 - RNA, 20 nt, Human
aggaaggagaaucugagcaa

SEQ ID NO: 875734 - RNA, 22 nt, Human
cagaaauggagcccaggaaucu

SEQ ID NO: 875735 - RNA, 22 nt, Human
uccaaauaucuuggugguuagg

SEQ ID NO: 875736 - RNA, 22 nt, Human
uggcagagacuccuccugggag

SEQ ID NO: 875737 - RNA, 22 nt, Human
ccacuggagaugucagacaggu

SEQ ID NO: 875738 - RNA, 22 nt, Human
gcaggucucaaucugagcaggc

SEQ ID NO: 875739 - RNA, 22 nt, Human
auaggacuuuguaucaggauga

SEQ ID NO: 875740 - RNA, 22 nt, Human
cagugagauaccacagagcaaa

SEQ ID NO: 875741 - RNA, 22 nt, Human
gcucagcugagcgaaggacaug

SEQ ID NO: 875742 - RNA, 22 nt, Human
ugucuuuacuuaauaaauauac

SEQ ID NO: 875743 - RNA, 22 nt, Human
agaaccuucagcuugcaacaag

SEQ ID NO: 875744 - RNA, 22 nt, Human
agcagagccugggcuaggggug

SEQ ID NO: 875745 - RNA, 22 nt, Human
uuugcacagccuuucuggcugc

SEQ ID NO: 875746 - RNA, 22 nt, Human
ccugucacgaugacugcacucu

SEQ ID NO: 875747 - RNA, 22 nt, Human
uucacaucuauaacuuagauaa

SEQ ID NO: 875748 - RNA, 22 nt, Human
ccugcccacugcccggucagcc

SEQ ID NO: 875749 - RNA, 22 nt, Human
gcugucugcaucucuagagcuu

SEQ ID NO: 875750 - RNA, 22 nt, Human
uaucuaaauggaauauuccaga

SEQ ID NO: 875751 - RNA, 22 nt, Human
uuuaggauauuaauguucagag

SEQ ID NO: 875752 - RNA, 22 nt, Human
ugucagugguagacccagaggu

SEQ ID NO: 875753 - RNA, 22 nt, Human
gcugucuggauaucuuggaauu

SEQ ID NO: 875754 - RNA, 22 nt, Human
ccacucugcugugcuccaugau

SEQ ID NO: 875755 - RNA, 22 nt, Human
ccuggagggcgccgcacagucc

SEQ ID NO: 875756 - RNA, 22 nt, Human
agggccugacacccuugccagc

SEQ ID NO: 875757 - RNA, 22 nt, Human
aaagugaggacuugaguacugu

SEQ ID NO: 875758 - RNA, 18 nt, Human
ucagaggagauaccuaaa

SEQ ID NO: 875759 - RNA, 22 nt, Human
cugucucugucuuaacucccag

SEQ ID NO: 875760 - RNA, 22 nt, Human
auucuaucucuauauuucugca

SEQ ID NO: 875761 - RNA, 22 nt, Human
gucuuucauggauauucaguuu

SEQ ID NO: 875762 - RNA, 22 nt, Human
ugaaguuucacgcgucauucaa

SEQ ID NO: 875763 - RNA, 22 nt, Human
uauguagauuucucuguuuuuc

SEQ ID NO: 875764 - RNA, 22 nt, Human
uuccucagcuggccugauuggg

SEQ ID NO: 875765 - RNA, 22 nt, Human
aguacaaugucugacacaguag

SEQ ID NO: 875766 - RNA, 22 nt, Human
cuggucccauccuggcuucaug

SEQ ID NO: 875767 - RNA, 22 nt, Human
ugggccagagaguaagaaaggu

SEQ ID NO: 875768 - RNA, 22 nt, Human
agggcagcacagcugugcuccu

SEQ ID NO: 875769 - RNA, 22 nt, Human
uuacaguagcuuuauuuggagu

SEQ ID NO: 875770 - RNA, 22 nt, Human
cucaggagaugacagaagguau

SEQ ID NO: 875771 - RNA, 22 nt, Human
ucuccucugugccacagcuugg

SEQ ID NO: 875772 - RNA, 19 nt, Human
guggcagcagauuuggugu

SEQ ID NO: 875773 - RNA, 23 nt, Human
ggguuuccuucuggcuccuccuu

SEQ ID NO: 875774 - RNA, 22 nt, Human
gggagccacaguuuauagugau

SEQ ID NO: 875775 - RNA, 20 nt, Human
auuccauaguuggcacuuuu

SEQ ID NO: 875776 - RNA, 22 nt, Human
guaccagucucugugggcaccu

SEQ ID NO: 875777 - RNA, 22 nt, Human
auguuacaguugaguaaauuaa

SEQ ID NO: 875778 - RNA, 22 nt, Human
aacacagggacucccaggagaa

SEQ ID NO: 875779 - RNA, 22 nt, Human
aggcuuguggauuggagcgagu

SEQ ID NO: 875780 - RNA, 22 nt, Human
ucuggcagcaagauaacaaugg

SEQ ID NO: 875781 - RNA, 22 nt, Human
ucuggccccuggcaguccugga

SEQ ID NO: 875782 - RNA, 22 nt, Human
uguggcagaaagcauguggaca

SEQ ID NO: 875783 - RNA, 22 nt, Human
gaccuucuugcuguguccuaac

SEQ ID NO: 875784 - RNA, 22 nt, Human
uggacccuacccggcccucggc

SEQ ID NO: 875785 - RNA, 22 nt, Human
aggcagaagccagccagggucc

SEQ ID NO: 875786 - RNA, 22 nt, Human
ugcuuuuaagaacaaugcugcu

SEQ ID NO: 875787 - RNA, 22 nt, Human
uaguaaacaggcaagggaccac

SEQ ID NO: 875788 - RNA, 22 nt, Human
aaugaacagauacacauaggca

SEQ ID NO: 875789 - RNA, 22 nt, Human
auuguuaaaguaauaaccaugg

SEQ ID NO: 875790 - RNA, 22 nt, Human
guucccaugccuccaagcuuca

SEQ ID NO: 875791 - RNA, 22 nt, Human
ucuucagggucugccccagggg

SEQ ID NO: 875792 - RNA, 22 nt, Human
ucugaaauacugcagguucucu

SEQ ID NO: 875793 - RNA, 22 nt, Human
cuguggcuucugggucaguuca

SEQ ID NO: 875794 - RNA, 22 nt, Human
uuucaguuuuugcucgauguau

SEQ ID NO: 875795 - RNA, 22 nt, Human
cugcuucacccugccugagaac

SEQ ID NO: 875796 - RNA, 22 nt, Human
cagcugguacucaguucuuguc

SEQ ID NO: 875797 - RNA, 22 nt, Human
uuggugaguauggacacagaga

SEQ ID NO: 875798 - RNA, 22 nt, Human
agagacaggaguucuguuucca

SEQ ID NO: 875799 - RNA, 22 nt, Human
caugaaauguguuaaucucuug

SEQ ID NO: 875800 - RNA, 22 nt, Human
aaugucuucaguucuguauugu

SEQ ID NO: 875801 - RNA, 22 nt, Human
agcugaagaaaugggaagcauu

SEQ ID NO: 875802 - RNA, 21 nt, Human
ucucuacacuuucacuaggcu

SEQ ID NO: 875803 - RNA, 22 nt, Human
gcugucucucccaggauccaug

SEQ ID NO: 875804 - RNA, 22 nt, Human
ucuagaaucacuguuuccaucu

SEQ ID NO: 875805 - RNA, 22 nt, Human
acuuauuucauggaucauaaug

SEQ ID NO: 875806 - RNA, 22 nt, Human
gagcagcucaggcacuuagcca

SEQ ID NO: 875807 - RNA, 22 nt, Human
ucugugaagcucugaacagcag

SEQ ID NO: 875808 - RNA, 22 nt, Human
ugcuugugacagaacugugucc

SEQ ID NO: 875809 - RNA, 22 nt, Human
augcuacacuccgcgaaaaugu

SEQ ID NO: 875810 - RNA, 22 nt, Human
acagauggcaccuuuuugcugu

SEQ ID NO: 875811 - RNA, 22 nt, Human
cugcuucauauuucauagugau

SEQ ID NO: 875812 - RNA, 22 nt, Human
gagcacagcagggcucugggug

SEQ ID NO: 875813 - RNA, 22 nt, Human
agcuugcaguuucugcuguuuu

SEQ ID NO: 875814 - RNA, 22 nt, Human
cugcucuagguccauugcggga

SEQ ID NO: 875815 - RNA, 22 nt, Human
ucugaggcugucucugggcucc

SEQ ID NO: 875816 - RNA, 22 nt, Human
aagucacacaguuaacaugagg

SEQ ID NO: 875817 - RNA, 22 nt, Human
gggugccacagagcuuccacuu

SEQ ID NO: 875818 - RNA, 23 nt, Human
uuuguucaucauuagagucuagc

SEQ ID NO: 875819 - RNA, 22 nt, Human
uuggaacuggauuucauguagc

SEQ ID NO: 875820 - RNA, 22 nt, Human
caucucauccugcccuaaaaca

SEQ ID NO: 875821 - RNA, 22 nt, Human
cuggccuggggccucagcugcu

SEQ ID NO: 875822 - RNA, 22 nt, Human
uccaagaacccaagcgaaugcc

SEQ ID NO: 875823 - RNA, 22 nt, Human
ucuuuggaaggagcaguuuuug

SEQ ID NO: 875824 - RNA, 22 nt, Human
ucagugccuacuuugaucaauu

SEQ ID NO: 875825 - RNA, 22 nt, Human
caaagccauagaguagauaaga

SEQ ID NO: 875826 - RNA, 22 nt, Human
cucccuccaaauaagacucggg

SEQ ID NO: 875827 - RNA, 22 nt, Human
ggcugcuggggacgugggagag

SEQ ID NO: 875828 - RNA, 16 nt, Human
gggcugggggauucug

SEQ ID NO: 875829 - RNA, 22 nt, Human
guucccuucucaugggguccag

SEQ ID NO: 875830 - RNA, 22 nt, Human
uuguaaauaguaguaagaugcc

SEQ ID NO: 875831 - RNA, 22 nt, Human
uugucauauuuauaaaauguaa

SEQ ID NO: 875832 - RNA, 22 nt, Human
auauuuguuagagucuaugugu

SEQ ID NO: 875833 - RNA, 22 nt, Human
gucugugcuuauucagcagggg

SEQ ID NO: 875834 - RNA, 22 nt, Human
aacaaggcacaagcuggcuguu

SEQ ID NO: 875835 - RNA, 22 nt, Human
uaauacuugucauaaaggcauu

SEQ ID NO: 875836 - RNA, 22 nt, Human
gucagcugucuccccagagugg

SEQ ID NO: 875837 - RNA, 22 nt, Human
agucucuuacccaagcagaaug

SEQ ID NO: 875838 - RNA, 22 nt, Human
aguggcagaucucuggucugga

SEQ ID NO: 875839 - RNA, 18 nt, Human
uuuuccuuccaccuugaa

SEQ ID NO: 875840 - RNA, 23 nt, Human
uucuuucaagaaguucacagugc

SEQ ID NO: 875841 - RNA, 19 nt, Human
aaaggcaguggguggcgug

SEQ ID NO: 875842 - RNA, 18 nt, Human
caguggugcugggaugug

SEQ ID NO: 875843 - RNA, 22 nt, Human
uuccaagagccuuucuucuaga

SEQ ID NO: 875844 - RNA, 22 nt, Human
auucuguauuuggauauaaggg

SEQ ID NO: 875845 - RNA, 22 nt, Human
aauguuuuauagcucaagcaau

SEQ ID NO: 875846 - RNA, 22 nt, Human
acccaggacuuggcaaccucau

SEQ ID NO: 875847 - RNA, 22 nt, Human
ggccaggcacugugugagauau

SEQ ID NO: 875848 - RNA, 22 nt, Human
ccagggcacguugggacaguac

SEQ ID NO: 875849 - RNA, 22 nt, Human
caggaggcuuugggauccaagu

SEQ ID NO: 875850 - RNA, 22 nt, Human
aaacuuuuccugcucuuguccu

SEQ ID NO: 875851 - RNA, 22 nt, Human
uaaauuacccuuuagggaauug

SEQ ID NO: 875852 - RNA, 22 nt, Human
gcugucugacuccaaguuggag

SEQ ID NO: 875853 - RNA, 22 nt, Human
gacacaggauuccuggcucugc

SEQ ID NO: 875854 - RNA, 22 nt, Human
aaaucucaauuugaauuguagc

SEQ ID NO: 875855 - RNA, 22 nt, Human
gaaauguuuccuuuuguaugcu

SEQ ID NO: 875856 - RNA, 22 nt, Human
uggucaacaggcagggaugaaa

SEQ ID NO: 875857 - RNA, 22 nt, Human
agaaaauauucauugagaggcu

SEQ ID NO: 875858 - RNA, 22 nt, Human
uucaaguuuacuuugaaguuua

SEQ ID NO: 875859 - RNA, 19 nt, Human
caaguuaaaaugaggucau

SEQ ID NO: 875860 - RNA, 22 nt, Human
gggcacugcuuugcucugucac

SEQ ID NO: 875861 - RNA, 22 nt, Human
aaauuacuuuacacuuucaucu

SEQ ID NO: 875862 - RNA, 22 nt, Human
gcucugaggagccaagaaugug

SEQ ID NO: 875863 - RNA, 22 nt, Human
guucuucaccaaggucagaggc

SEQ ID NO: 875864 - RNA, 22 nt, Human
ggcauugucuauuugcauucau

SEQ ID NO: 875865 - RNA, 22 nt, Human
uccuggggccagcacuggugga

SEQ ID NO: 875866 - RNA, 21 nt, Human
agcugcccagaguagggaagg

SEQ ID NO: 875867 - RNA, 22 nt, Human
uccgaggcgcaccggcgcuccu

SEQ ID NO: 875868 - RNA, 22 nt, Human
uauguguaaccuugugauuuau

SEQ ID NO: 875869 - RNA, 22 nt, Human
uuucuucauugacaaggaaaaa

SEQ ID NO: 875870 - RNA, 20 nt, Human
agcaguguggggagacugug

SEQ ID NO: 875871 - RNA, 22 nt, Human
uuuaauuugaaaugaguaaccc

SEQ ID NO: 875872 - RNA, 22 nt, Human
auguaaacacucacugugcccc

SEQ ID NO: 875873 - RNA, 20 nt, Human
gcaggcagggaaugggggug

SEQ ID NO: 875874 - RNA, 22 nt, Human
agcaguguuggugggagcaucu

SEQ ID NO: 875875 - RNA, 22 nt, Human
uuuauuuggcauccagggagaa

SEQ ID NO: 875876 - RNA, 22 nt, Human
aaggacaggagaaaacgggauc

SEQ ID NO: 875877 - RNA, 23 nt, Human
agaguccacaagauuuuccagug

SEQ ID NO: 875878 - RNA, 22 nt, Human
agacagacuuugaucuggaugu

SEQ ID NO: 875879 - RNA, 22 nt, Human
guagagcaggacuugagauguu

SEQ ID NO: 875880 - RNA, 22 nt, Human
ugacaaaccaguagcaauaaag

SEQ ID NO: 875881 - RNA, 22 nt, Human
cccaggcuccugcuguguugac

SEQ ID NO: 875882 - RNA, 22 nt, Human
cagaggcaggaagaugggcagu

SEQ ID NO: 875883 - RNA, 22 nt, Human
agugggagcggcagucggggac

SEQ ID NO: 875884 - RNA, 22 nt, Human
ggagugggaacaaugacauggu

SEQ ID NO: 875885 - RNA, 17 nt, Human
acagcaggcccggaggg

SEQ ID NO: 875886 - RNA, 21 nt, Human
ugcagaaaugguuuuucuaag

SEQ ID NO: 875887 - RNA, 22 nt, Human
acugggcaaggauaugaugggu

SEQ ID NO: 875888 - RNA, 22 nt, Human
uugaaacucaucuuagugaugu

SEQ ID NO: 875889 - RNA, 22 nt, Human
auuguauuuccagcuugaaugu

SEQ ID NO: 875890 - RNA, 22 nt, Human
ucauauuuggggguguguguuu

SEQ ID NO: 875891 - RNA, 22 nt, Human
agcaucuucaacaggcauuuua

SEQ ID NO: 875892 - RNA, 22 nt, Human
gcucccaggaugaggagccagg

SEQ ID NO: 875893 - RNA, 21 nt, Human
auggaaaaacagguagagcau

SEQ ID NO: 875894 - RNA, 22 nt, Human
ucccacagaguggcucaccuag

SEQ ID NO: 875895 - RNA, 22 nt, Human
ggaaggaagugcagacuuuaaa

SEQ ID NO: 875896 - RNA, 22 nt, Human
uggccacacccaccuagaggag

SEQ ID NO: 875897 - RNA, 18 nt, Human
uggcagcaggaagccauu

SEQ ID NO: 875898 - RNA, 22 nt, Human
uuaguugaugcuaagggauccc

SEQ ID NO: 875899 - RNA, 22 nt, Human
auggccagucugacuaguuucc

SEQ ID NO: 875900 - RNA, 22 nt, Human
aaggcauugagcaguuacagua

SEQ ID NO: 875901 - RNA, 22 nt, Human
ggacuugcuaagguggcugaac

SEQ ID NO: 875902 - RNA, 22 nt, Human
aaggcauuggacuaguaucaga

SEQ ID NO: 875903 - RNA, 22 nt, Human
agggcugaguggugcagucaaa

SEQ ID NO: 875904 - RNA, 22 nt, Human
cugccagggaggcugggaaguu

SEQ ID NO: 875905 - RNA, 22 nt, Human
ucacacacauggauaguauuuu

SEQ ID NO: 875906 - RNA, 22 nt, Human
gcugucacucuccggccuuccc

SEQ ID NO: 875907 - RNA, 22 nt, Human
acaaguguugcauuuugccauu

SEQ ID NO: 875908 - RNA, 22 nt, Human
gcuggcucagggacuagaguuu

SEQ ID NO: 875909 - RNA, 22 nt, Human
acugcaucugaacugugaaugg

SEQ ID NO: 875910 - RNA, 22 nt, Human
gaacccaggaggcagagguugc

SEQ ID NO: 875911 - RNA, 22 nt, Human
gucugucaucugagauggagug

SEQ ID NO: 875912 - RNA, 22 nt, Human
gcagggcugcugaaacuuguuu

SEQ ID NO: 875913 - RNA, 22 nt, Human
uugcucuguccagccagcaggu

SEQ ID NO: 875914 - RNA, 22 nt, Human
uuuucugugauucugagguugg

SEQ ID NO: 875915 - RNA, 18 nt, Human
cccagcccaccauuucuc

SEQ ID NO: 875916 - RNA, 22 nt, Human
aacaaaagccgaaguagguguc

SEQ ID NO: 875917 - RNA, 22 nt, Human
uauuugcaaagaacuacacuag

SEQ ID NO: 875918 - RNA, 22 nt, Human
uuauuugguugcugacuuggaa

SEQ ID NO: 875919 - RNA, 22 nt, Human
ugggccuggguuccuccugggc

SEQ ID NO: 875920 - RNA, 22 nt, Human
gaagccacccuccuuccagccc

SEQ ID NO: 875921 - RNA, 22 nt, Human
gcucucugcaagucagcagccu

SEQ ID NO: 875922 - RNA, 22 nt, Human
cagugcuuuuaaaacaacauca

SEQ ID NO: 875923 - RNA, 21 nt, Human
gacuggagagaggaagucugg

SEQ ID NO: 875924 - RNA, 22 nt, Human
ucaucuaagagucuuacauuua

SEQ ID NO: 875925 - RNA, 22 nt, Human
aacugauuguuggaugauagug

SEQ ID NO: 875926 - RNA, 22 nt, Human
gucagugcuugaagggcagaga

SEQ ID NO: 875927 - RNA, 22 nt, Human
acauacacgggaaaccucuuuu

SEQ ID NO: 875928 - RNA, 22 nt, Human
uccacagacguguuauuaguug

SEQ ID NO: 875929 - RNA, 22 nt, Human
ucuguucuuggugcagcuggga

SEQ ID NO: 875930 - RNA, 22 nt, Human
cuuaggcauccaggguucuucc

SEQ ID NO: 875931 - RNA, 22 nt, Human
uuugauaauuaaaaauuguagu

SEQ ID NO: 875932 - RNA, 22 nt, Human
ugucaacaaaacgguucaaaug

SEQ ID NO: 875933 - RNA, 22 nt, Human
uccacagggccuuucuggugug

SEQ ID NO: 875934 - RNA, 22 nt, Human
cagcugccuucugcgggaaguc

SEQ ID NO: 875935 - RNA, 22 nt, Human
uauuuccaccuauuauuuucug

SEQ ID NO: 875936 - RNA, 22 nt, Human
cugcccugggugcuggggaucc

SEQ ID NO: 875937 - RNA, 22 nt, Human
caaguuauggcuucccaguagg

SEQ ID NO: 875938 - RNA, 22 nt, Human
caggcacuagcagaaugaggcu

SEQ ID NO: 875939 - RNA, 22 nt, Human
uguuucaaauuacuugaggauu

SEQ ID NO: 875940 - RNA, 22 nt, Human
gaaaauacaaauagccuugaaa

SEQ ID NO: 875941 - RNA, 22 nt, Human
acacacuguugcucauccaggc

SEQ ID NO: 875942 - RNA, 22 nt, Human
aaauagauuuccuagcauugga

SEQ ID NO: 875943 - RNA, 22 nt, Human
gccagagacacuuggagguaga

SEQ ID NO: 875944 - RNA, 22 nt, Human
ucagaauuagagcucuucuuga

SEQ ID NO: 875945 - RNA, 22 nt, Human
cuggcaggaaguuagaugguaa

SEQ ID NO: 875946 - RNA, 22 nt, Human
agcaguggcuggauggugugcu

SEQ ID NO: 875947 - RNA, 22 nt, Human
ugcagggcuuccucuuggaguu

SEQ ID NO: 875948 - RNA, 22 nt, Human
ugauuuuuagcuauucugaaga

SEQ ID NO: 875949 - RNA, 17 nt, Human
caguugaaauguuugga

SEQ ID NO: 875950 - RNA, 22 nt, Human
uuccaguuugcaguugacacua

SEQ ID NO: 875951 - RNA, 22 nt, Human
aguucagcaaauaaaacauagu

SEQ ID NO: 875952 - RNA, 22 nt, Human
uaguccuugcugggcacagagu

SEQ ID NO: 875953 - RNA, 22 nt, Human
gaguuaaaggaaaauaacuuua

SEQ ID NO: 875954 - RNA, 22 nt, Human
accaguaagauccuguacauac

SEQ ID NO: 875955 - RNA, 21 nt, Human
auacugaaccucauaagccca

SEQ ID NO: 875956 - RNA, 22 nt, Human
gugcaugucggggugcauguca

SEQ ID NO: 875957 - RNA, 22 nt, Human
gaaagcuaaaugaggucuuaca

SEQ ID NO: 875958 - RNA, 22 nt, Human
gggcaccagcggccgcacugcc

SEQ ID NO: 875959 - RNA, 22 nt, Human
ccugcacaggccaggcaucuga

SEQ ID NO: 875960 - RNA, 22 nt, Human
uuuucauuguaaaucaggaaac

SEQ ID NO: 875961 - RNA, 22 nt, Human
acuuucaaaagagaagucauga

SEQ ID NO: 875962 - RNA, 22 nt, Human
gacuuugccacugaccuccaac

SEQ ID NO: 875963 - RNA, 22 nt, Human
ucugagaaaguacuguauguuc

SEQ ID NO: 875964 - RNA, 22 nt, Human
cugguccauucucucccugaag

SEQ ID NO: 875965 - RNA, 22 nt, Human
gcagcauuuguggaaugggccc

SEQ ID NO: 875966 - RNA, 22 nt, Human
aauguuuaauguuagugguaau

SEQ ID NO: 875967 - RNA, 22 nt, Human
aggauugugccuccagucagaa

SEQ ID NO: 875968 - RNA, 22 nt, Human
gcagaggccugaagguggcggg

SEQ ID NO: 875969 - RNA, 22 nt, Human
uuucuagguuuacaauacugca

SEQ ID NO: 875970 - RNA, 22 nt, Human
ugggagaguaaccaauuccuuc

SEQ ID NO: 875971 - RNA, 19 nt, Human
ucagggcaguccggucccc

SEQ ID NO: 875972 - RNA, 22 nt, Human
uagggcuggguacacucuugcc

SEQ ID NO: 875973 - RNA, 17 nt, Human
aaagagcuuggaguguu

SEQ ID NO: 875974 - RNA, 21 nt, Human
gggcaggucucugaugucaac

SEQ ID NO: 875975 - RNA, 22 nt, Human
auggcaguuucacucugggauu

SEQ ID NO: 875976 - RNA, 22 nt, Human
aggaaaggugagagcggccgcg

SEQ ID NO: 875977 - RNA, 22 nt, Human
ugaaagcugggcacaagauucu

SEQ ID NO: 875978 - RNA, 22 nt, Human
uggaaauuuaucaagauauaca

SEQ ID NO: 875979 - RNA, 23 nt, Human
auggaagucacuguuuucuuguc

SEQ ID NO: 875980 - RNA, 22 nt, Human
ucagggcagccuaaggcaccuc

SEQ ID NO: 875981 - RNA, 20 nt, Human
caccaggcgcucugagaaca

SEQ ID NO: 875982 - RNA, 19 nt, Human
auacaguaagguguuugcc

SEQ ID NO: 875983 - RNA, 22 nt, Human
ccagcagaggggcggagugcag

SEQ ID NO: 875984 - RNA, 22 nt, Human
ccuggccagccagggcuggggu

SEQ ID NO: 875985 - RNA, 21 nt, Human
ugcuggugagcucauguggcu

SEQ ID NO: 875986 - RNA, 22 nt, Human
cauguccauuuaugcacagaaa

SEQ ID NO: 875987 - RNA, 22 nt, Human
agucaggaaccucagcaagucu

SEQ ID NO: 875988 - RNA, 22 nt, Human
ccagagcugauuccugggacuu

SEQ ID NO: 875989 - RNA, 22 nt, Human
aggcuggagacccgccaagaaa

SEQ ID NO: 875990 - RNA, 22 nt, Human
cagguccuggcaucaggcaggu

SEQ ID NO: 875991 - RNA, 22 nt, Human
gaauagauccucauuuauugau

SEQ ID NO: 875992 - RNA, 22 nt, Human
cagaggccuauccaguguccau

SEQ ID NO: 875993 - RNA, 22 nt, Human
gguccccguggaggcuggagcg

SEQ ID NO: 875994 - RNA, 22 nt, Human
cucaggagguuuccugucuagg

SEQ ID NO: 875995 - RNA, 22 nt, Human
cacaauuguaucagaaaauagu

SEQ ID NO: 875996 - RNA, 22 nt, Human
auucacaaugauacauaagcga

SEQ ID NO: 875997 - RNA, 22 nt, Human
aucaagaauguucauucuucua

SEQ ID NO: 875998 - RNA, 22 nt, Human
cugcccuguuuggacagcccgg

SEQ ID NO: 875999 - RNA, 22 nt, Human
auuguggacugaucagggcuag

SEQ ID NO: 876000 - RNA, 22 nt, Human
auuuccuauccuggucuuaaaa

SEQ ID NO: 876001 - RNA, 22 nt, Human
auaaucugagcuauuucaugag

SEQ ID NO: 876002 - RNA, 21 nt, Human
gcugggcuccagucugccgcu

SEQ ID NO: 876003 - RNA, 22 nt, Human
ugcagaagacacaagguaacgu

SEQ ID NO: 876004 - RNA, 22 nt, Human
agcucugguuuagaaggggaaa

SEQ ID NO: 876005 - RNA, 22 nt, Human
ucuggaaagaucauuaaaucca

SEQ ID NO: 876006 - RNA, 22 nt, Human
cugcaggauuucaugggcugac

SEQ ID NO: 876007 - RNA, 22 nt, Human
gcaggaugggagcuucacucug

SEQ ID NO: 876008 - RNA, 22 nt, Human
aaaguuacacgacuauuuaugu

SEQ ID NO: 876009 - RNA, 22 nt, Human
aagacauuggacaauccagagg

SEQ ID NO: 876010 - RNA, 22 nt, Human
aagcagcaugcuaugcuggugg

SEQ ID NO: 876011 - RNA, 22 nt, Human
ucccugggaacaaaggaugaga

SEQ ID NO: 876012 - RNA, 22 nt, Human
acaucacacgccuuccaggagg

SEQ ID NO: 876013 - RNA, 22 nt, Human
cugugcuugcggguguggagcc

SEQ ID NO: 876014 - RNA, 18 nt, Human
gucuguguggcuugggga

SEQ ID NO: 876015 - RNA, 23 nt, Human
acagacaacacugaugagagaaa

SEQ ID NO: 876016 - RNA, 22 nt, Human
cacaauuucaguugcaugcaac

SEQ ID NO: 876017 - RNA, 22 nt, Human
cacuuugugugggaucaggggu

SEQ ID NO: 876018 - RNA, 22 nt, Human
ugcauuuuugauaacuguguac

SEQ ID NO: 876019 - RNA, 22 nt, Human
aggcucccaugguguggcagga

SEQ ID NO: 876020 - RNA, 22 nt, Human
agagcaagugacagaaacaggg

SEQ ID NO: 876021 - RNA, 22 nt, Human
acaaugauuuuuuagaguaguu

SEQ ID NO: 876022 - RNA, 22 nt, Human
ucauaaauaguugugccugaau

SEQ ID NO: 876023 - RNA, 22 nt, Human
auaguuuugcugucagguccua

SEQ ID NO: 876024 - RNA, 22 nt, Human
ggcuuuugaauuccaaggcauu

SEQ ID NO: 876025 - RNA, 22 nt, Human
acgauugaagaauagucuuaac

SEQ ID NO: 876026 - RNA, 22 nt, Human
uuguccauggacagcaccacag

SEQ ID NO: 876027 - RNA, 22 nt, Human
ugcaugucaaggcacucaggau

SEQ ID NO: 876028 - RNA, 22 nt, Human
ucagaaauguaagcugaugacu

SEQ ID NO: 876029 - RNA, 22 nt, Human
uucccauuugugguagugaauu

SEQ ID NO: 876030 - RNA, 22 nt, Human
ugccaggcgugguggugcgcac

SEQ ID NO: 876031 - RNA, 23 nt, Human
acauucuugauucaggccuuagc

SEQ ID NO: 876032 - RNA, 22 nt, Human
cagagggucaccaggaagugca

SEQ ID NO: 876033 - RNA, 22 nt, Human
aucugaauaaauuucuuuuagu

SEQ ID NO: 876034 - RNA, 22 nt, Human
aagcagaauuuaauagaaaggu

SEQ ID NO: 876035 - RNA, 22 nt, Human
agccucaguuucaggccuccuc

SEQ ID NO: 876036 - RNA, 22 nt, Human
uuaaggaauuacgaaaauauuu

SEQ ID NO: 876037 - RNA, 22 nt, Human
ugcugacacuauucuaaaaagc

SEQ ID NO: 876038 - RNA, 22 nt, Human
gggcugagcacauacugacagc

SEQ ID NO: 876039 - RNA, 22 nt, Human
uguuuauugagugccuacuaua

SEQ ID NO: 876040 - RNA, 22 nt, Human
uuguccauuuuauuggauggug

SEQ ID NO: 876041 - RNA, 22 nt, Human
cacugcccaccaaguggcuggu

SEQ ID NO: 876042 - RNA, 22 nt, Human
ggaagaaaagcuuccagcgccu

SEQ ID NO: 876043 - RNA, 21 nt, Human
agauaguugggcaugcagcug

SEQ ID NO: 876044 - RNA, 22 nt, Human
agaacugauuugaagguugggg

SEQ ID NO: 876045 - RNA, 22 nt, Human
cugugccacugccccaggccuc

SEQ ID NO: 876046 - RNA, 22 nt, Human
uucaacagugauggccuuugua

SEQ ID NO: 876047 - RNA, 22 nt, Human
ugggucagacagccagugggcc

SEQ ID NO: 876048 - RNA, 21 nt, Human
ggguaaggaaaaugauucuuc

SEQ ID NO: 876049 - RNA, 22 nt, Human
uccauuuuagaagaaaauccac

SEQ ID NO: 876050 - RNA, 22 nt, Human
ugugggaggaacacagccagaa

SEQ ID NO: 876051 - RNA, 22 nt, Human
guuucuuaaaagaggaguuaga

SEQ ID NO: 876052 - RNA, 22 nt, Human
guggcagagccaggcuuugaac

SEQ ID NO: 876053 - RNA, 22 nt, Human
gacagacacuauugguaugccu

SEQ ID NO: 876054 - RNA, 22 nt, Human
agccaggcugcaguuggcuggc

SEQ ID NO: 876055 - RNA, 22 nt, Human
cuagaacuacaucuuuuaauag

SEQ ID NO: 876056 - RNA, 21 nt, Human
aucagaaguuuuggucaguag

SEQ ID NO: 876057 - RNA, 22 nt, Human
cugaggcuggcguuugaggaag

SEQ ID NO: 876058 - RNA, 22 nt, Human
cacaggaaaauaaaagaucuaa

SEQ ID NO: 876059 - RNA, 22 nt, Human
acugcauugagguuucauacuu

SEQ ID NO: 876060 - RNA, 20 nt, Human
acaguuuauuuuacuugguu

SEQ ID NO: 876061 - RNA, 22 nt, Human
gaggagcaagaaauagugccca

SEQ ID NO: 876062 - RNA, 22 nt, Human
uuugagcuaugggcuuggauuu

SEQ ID NO: 876063 - RNA, 21 nt, Human
ucaaagcacauauuugcacau

SEQ ID NO: 876064 - RNA, 18 nt, Human
cagagugggccaagagac

SEQ ID NO: 876065 - RNA, 22 nt, Human
cuguuauauugguauauuuaca

SEQ ID NO: 876066 - RNA, 22 nt, Human
uuuuaugagaaugcgccacuug

SEQ ID NO: 876067 - RNA, 22 nt, Human
ccaggaaguaugacccaacaga

SEQ ID NO: 876068 - RNA, 22 nt, Human
cugcagcugucucuacugggca

SEQ ID NO: 876069 - RNA, 22 nt, Human
acacuugccaugcugcacacug

SEQ ID NO: 876070 - RNA, 22 nt, Human
uaacacauagauauuuuaacuu

SEQ ID NO: 876071 - RNA, 22 nt, Human
cacagcugucagcugaccuagg

SEQ ID NO: 876072 - RNA, 22 nt, Human
uuaugauuuagaaagauucacu

SEQ ID NO: 876073 - RNA, 22 nt, Human
aagauuucugcuuuuggaggca

SEQ ID NO: 876074 - RNA, 22 nt, Human
uugaagaaagucauauauaaug

SEQ ID NO: 876075 - RNA, 22 nt, Human
uuauuuggaaauauggcuucug

SEQ ID NO: 876076 - RNA, 22 nt, Human
ggccaugggaagagguggagag

SEQ ID NO: 876077 - RNA, 22 nt, Human
auuuucuagauagaugaugcau

SEQ ID NO: 876078 - RNA, 22 nt, Human
ugucuucaaauauugaaauccu

SEQ ID NO: 876079 - RNA, 22 nt, Human
auguuugcuauuguucuagugg

SEQ ID NO: 876080 - RNA, 22 nt, Human
guccaggcuaagucccuucugc

SEQ ID NO: 876081 - RNA, 17 nt, Human
ccuguguuugcuccuuc

SEQ ID NO: 876082 - RNA, 22 nt, Human
ugagaugguugaccagagagca

SEQ ID NO: 876083 - RNA, 22 nt, Human
uacugcauguguuugaugaugg

SEQ ID NO: 876084 - RNA, 17 nt, Human
uuacacaggagagcucu

SEQ ID NO: 876085 - RNA, 22 nt, Human
ugaaaauuaagcagaugaauga

SEQ ID NO: 876086 - RNA, 22 nt, Human
gcagcuggcccugacacgcaga

SEQ ID NO: 876087 - RNA, 22 nt, Human
gugcuugggggaaguaacagac

SEQ ID NO: 876088 - RNA, 22 nt, Human
gaugauuguuggcucucuugau

SEQ ID NO: 876089 - RNA, 22 nt, Human
cuggaugauaacagcaauauuu

SEQ ID NO: 876090 - RNA, 22 nt, Human
auggaaggcuuuaugacucaaa

SEQ ID NO: 876091 - RNA, 22 nt, Human
aggcccauaguagcucugggca

SEQ ID NO: 876092 - RNA, 22 nt, Human
uugacagagcuaggucaacucu

SEQ ID NO: 876093 - RNA, 22 nt, Human
ucuggagaagcccagggagcug

SEQ ID NO: 876094 - RNA, 22 nt, Human
gagaggaagccaggggguguug

SEQ ID NO: 876095 - RNA, 22 nt, Human
guggcagaggcucugggaccag

SEQ ID NO: 876096 - RNA, 22 nt, Human
cauuuguaucauauguaucuua

SEQ ID NO: 876097 - RNA, 22 nt, Human
uugguaaauacuauaaucaaau

SEQ ID NO: 876098 - RNA, 22 nt, Human
gagggggagaugugcacacacu

SEQ ID NO: 876099 - RNA, 21 nt, Human
ucucugacccaggaagagggc

SEQ ID NO: 876100 - RNA, 22 nt, Human
gcagggccagguacaagaagca

SEQ ID NO: 876101 - RNA, 22 nt, Human
agaaccauuuugacagauauac

SEQ ID NO: 876102 - RNA, 22 nt, Human
aucucuguuagaucugcuuaaa

SEQ ID NO: 876103 - RNA, 22 nt, Human
guacaggcagcaaacaccauaa

SEQ ID NO: 876104 - RNA, 22 nt, Human
ugggaccugaagcagguuggca

SEQ ID NO: 876105 - RNA, 22 nt, Human
aaucuucuacuugacaguucuc

SEQ ID NO: 876106 - RNA, 22 nt, Human
gcuaagaggcuauaucuuucuc

SEQ ID NO: 876107 - RNA, 22 nt, Human
ggcacagcugaugcagacacac

SEQ ID NO: 876108 - RNA, 22 nt, Human
aguggcuugcucugccucagcc

SEQ ID NO: 876109 - RNA, 22 nt, Human
uccucauucuuggugcaucaaa

SEQ ID NO: 876110 - RNA, 22 nt, Human
uuuguucuaacuucugcagaca

SEQ ID NO: 876111 - RNA, 22 nt, Human
uuugagaagaguuugagguauu

SEQ ID NO: 876112 - RNA, 22 nt, Human
uagcauuaaagguaagacauua

SEQ ID NO: 876113 - RNA, 22 nt, Human
aaggacaaguaguauuugcauc

SEQ ID NO: 876114 - RNA, 22 nt, Human
uuuguacauauauaaaaucugu

SEQ ID NO: 876115 - RNA, 22 nt, Human
uguaaaguaucugugagcucuc

SEQ ID NO: 876116 - RNA, 22 nt, Human
aaacaugaucacuccggcuuuu

SEQ ID NO: 876117 - RNA, 22 nt, Human
gggccaugagagguucaucaac

SEQ ID NO: 876118 - RNA, 22 nt, Human
uucaacaggaaagcacuuuaca

SEQ ID NO: 876119 - RNA, 22 nt, Human
uuccagcaggcagacaggagau

SEQ ID NO: 876120 - RNA, 22 nt, Human
aggcccugcugaggccucccuc

SEQ ID NO: 876121 - RNA, 22 nt, Human
aggcagacaaggacacaguggg

SEQ ID NO: 876122 - RNA, 22 nt, Human
ucuccaggugagggugguuaga

SEQ ID NO: 876123 - RNA, 22 nt, Human
gccuccaggguagaggaggaag

SEQ ID NO: 876124 - RNA, 20 nt, Human
uacauucaaaacaaacucug

SEQ ID NO: 876125 - RNA, 22 nt, Human
auaguacagagggcuacugguu

SEQ ID NO: 876126 - RNA, 22 nt, Human
ucugcacaucccccaaaguauu

SEQ ID NO: 876127 - RNA, 22 nt, Human
ugcugaaggcaggggagguggc

SEQ ID NO: 876128 - RNA, 22 nt, Human
auggcaguuguaugggcuguau

SEQ ID NO: 876129 - RNA, 22 nt, Human
acuggggccuccuccaugcucu

SEQ ID NO: 876130 - RNA, 23 nt, Human
aucuagaaaccugaugacucugu

SEQ ID NO: 876131 - RNA, 22 nt, Human
ucuguugacuccuagcagccau

SEQ ID NO: 876132 - RNA, 22 nt, Human
ucugcaggagcagggcguggag

SEQ ID NO: 876133 - RNA, 22 nt, Human
gccuaacuuggcuuuguucacc

SEQ ID NO: 876134 - RNA, 19 nt, Human
cuucuugauaagguucuuu

SEQ ID NO: 876135 - RNA, 22 nt, Human
aacacauauuuauauaugcaca

SEQ ID NO: 876136 - RNA, 22 nt, Human
ugcuuaaaaugaugauuauuuu

SEQ ID NO: 876137 - RNA, 22 nt, Human
accaggaguaacagugaguggu

SEQ ID NO: 876138 - RNA, 22 nt, Human
ugaggaaacuuacaaggcagaa

SEQ ID NO: 876139 - RNA, 22 nt, Human
cuguucauguugaggcauaggg

SEQ ID NO: 876140 - RNA, 20 nt, Human
uccagcaguaugcuauacuu

SEQ ID NO: 876141 - RNA, 22 nt, Human
ugcugccauggucgcugguguc

SEQ ID NO: 876142 - RNA, 17 nt, Human
agaaugcaaagcaggcu

SEQ ID NO: 876143 - RNA, 22 nt, Human
ugccucugcugcuguggcauca

SEQ ID NO: 876144 - RNA, 22 nt, Human
guuuauucuucagcaacaucug

SEQ ID NO: 876145 - RNA, 20 nt, Human
uguguauaaauauauguuuc

SEQ ID NO: 876146 - RNA, 22 nt, Human
ggugcaggacgaaguggggguu

SEQ ID NO: 876147 - RNA, 22 nt, Human
ucacugaaaguaauucuaguga

SEQ ID NO: 876148 - RNA, 22 nt, Human
uuaacaaaaauaucaggcauca

SEQ ID NO: 876149 - RNA, 22 nt, Human
cuccaguggugauggggaagaa

SEQ ID NO: 876150 - RNA, 23 nt, Human
acaccugugcuguagucacuaca

SEQ ID NO: 876151 - RNA, 22 nt, Human
aaaguucugagacugauggcua

SEQ ID NO: 876152 - RNA, 22 nt, Human
aaugcauuccacugagauuugu

SEQ ID NO: 876153 - RNA, 22 nt, Human
cggggcugaggcaacgcggaga

SEQ ID NO: 876154 - RNA, 22 nt, Human
ucuggagaaggaagagucuuug

SEQ ID NO: 876155 - RNA, 18 nt, Human
uggggucucucagguaag

SEQ ID NO: 876156 - RNA, 22 nt, Human
agccagggacgcugcaggcuac

SEQ ID NO: 876157 - RNA, 22 nt, Human
uuuccucugaugcugacuugga

SEQ ID NO: 876158 - RNA, 22 nt, Human
acagcaaaagacaagaacuuaa

SEQ ID NO: 876159 - RNA, 22 nt, Human
aaggcuggaccuggaugaaucu

SEQ ID NO: 876160 - RNA, 22 nt, Human
acagauuugacugguaccuggc

SEQ ID NO: 876161 - RNA, 21 nt, Human
cuggacugaggagacagucgc

SEQ ID NO: 876162 - RNA, 22 nt, Human
agaaaucaggaacaguaaggag

SEQ ID NO: 876163 - RNA, 22 nt, Human
gacacaggaaucaccuuggaug

SEQ ID NO: 876164 - RNA, 22 nt, Human
ccagugugaaaggucauuuauc

SEQ ID NO: 876165 - RNA, 23 nt, Human
aaacugcaucucugagccucagc

SEQ ID NO: 876166 - RNA, 17 nt, Human
ccugcccagagacagau

SEQ ID NO: 876167 - RNA, 22 nt, Human
ucucaguuucucauuauaaaag

SEQ ID NO: 876168 - RNA, 22 nt, Human
gggcuccaguuguccccaggau

SEQ ID NO: 876169 - RNA, 22 nt, Human
gugcagggagcccagaaggucc

SEQ ID NO: 876170 - RNA, 22 nt, Human
gucccaggaguugcugggccuu

SEQ ID NO: 876171 - RNA, 22 nt, Human
acagugcuuagcacagaguaga

SEQ ID NO: 876172 - RNA, 22 nt, Human
aacaucucuguauuuuauagac

SEQ ID NO: 876173 - RNA, 22 nt, Human
gcauucuuuccacgaggaggua

SEQ ID NO: 876174 - RNA, 19 nt, Human
ucucuaaccucaagagguu

SEQ ID NO: 876175 - RNA, 22 nt, Human
gcuggcugagcacugguuuaua

SEQ ID NO: 876176 - RNA, 22 nt, Human
uggagaaggccggccaggagug

SEQ ID NO: 876177 - RNA, 22 nt, Human
aaguccaucucugccccacaca

SEQ ID NO: 876178 - RNA, 22 nt, Human
aauauaauuuuauuccuagagu

SEQ ID NO: 876179 - RNA, 22 nt, Human
ccggcgggcagcggcagugagc

SEQ ID NO: 876180 - RNA, 22 nt, Human
uuucaucuaacacuacauaggg

SEQ ID NO: 876181 - RNA, 22 nt, Human
uguuuccccaaccccacaagua

SEQ ID NO: 876182 - RNA, 22 nt, Human
cuggaauguaugggaacccaaa

SEQ ID NO: 876183 - RNA, 19 nt, Human
uucuuuggugguggugacc

SEQ ID NO: 876184 - RNA, 22 nt, Human
ccaguuugaggaagaaguagau

SEQ ID NO: 876185 - RNA, 22 nt, Human
cugccuccucacguccacagug

SEQ ID NO: 876186 - RNA, 22 nt, Human
cugugcacacgugcccaacagu

SEQ ID NO: 876187 - RNA, 22 nt, Human
auuuaugauuagccuauuguug

SEQ ID NO: 876188 - RNA, 22 nt, Human
agcugccacugagggugcacag

SEQ ID NO: 876189 - RNA, 22 nt, Human
ccacacuccccgcaggcguagg

SEQ ID NO: 876190 - RNA, 22 nt, Human
cugugcacuaaccacacccacg

SEQ ID NO: 876191 - RNA, 22 nt, Human
gugucccaauguucaggacggc

SEQ ID NO: 876192 - RNA, 22 nt, Human
gagauuuaauuggauuaacuua

SEQ ID NO: 876193 - RNA, 22 nt, Human
cugaggagaaaugggaugguuc

SEQ ID NO: 876194 - RNA, 22 nt, Human
agcuguauuugugaauauuuaa

SEQ ID NO: 876195 - RNA, 22 nt, Human
aagcugaggauacaugaagccu

SEQ ID NO: 876196 - RNA, 22 nt, Human
uaggaacuagacucaugacuca

SEQ ID NO: 876197 - RNA, 22 nt, Human
uugggcaggcuggcagacugcu

SEQ ID NO: 876198 - RNA, 19 nt, Human
gagaggccugugcuugaag

SEQ ID NO: 876199 - RNA, 22 nt, Human
agggcagaaguacagacacuua

SEQ ID NO: 876200 - RNA, 22 nt, Human
auuuccuauacaguuguccaua

SEQ ID NO: 876201 - RNA, 22 nt, Human
gcuggcugguccagcaggggcu

SEQ ID NO: 876202 - RNA, 23 nt, Human
gugcagcagugucugcagucaug

SEQ ID NO: 876203 - RNA, 22 nt, Human
uacagcugcuggugcuccaugc

SEQ ID NO: 876204 - RNA, 22 nt, Human
ccugagcuugauccuucugucu

SEQ ID NO: 876205 - RNA, 22 nt, Human
uuugagaaggugacaaauucua

SEQ ID NO: 876206 - RNA, 22 nt, Human
gcaggucuagaagcugccucug

SEQ ID NO: 876207 - RNA, 22 nt, Human
agcugugggccugggagagcug

SEQ ID NO: 876208 - RNA, 22 nt, Human
gaggcuucuguaacccuguccu

SEQ ID NO: 876209 - RNA, 19 nt, Human
aaaugcuguggagggcucc

SEQ ID NO: 876210 - RNA, 22 nt, Human
aaaauuauagaucuagugccug

SEQ ID NO: 876211 - RNA, 22 nt, Human
ugggcagauuaaugcaguggcu

SEQ ID NO: 876212 - RNA, 22 nt, Human
uuuugugacagaaagauuaagu

SEQ ID NO: 876213 - RNA, 22 nt, Human
ccgggagcaggcgccaccgcca

SEQ ID NO: 876214 - RNA, 22 nt, Human
cuuuuuuaagguagcuccuccu

SEQ ID NO: 876215 - RNA, 18 nt, Human
ggcaggauuucaacuuuc

SEQ ID NO: 876216 - RNA, 22 nt, Human
acagcauuuaaagaaaaugaac

SEQ ID NO: 876217 - RNA, 22 nt, Human
ucuaggaguaaugagcuagcac

SEQ ID NO: 876218 - RNA, 22 nt, Human
cugcagggagaggggacagccu

SEQ ID NO: 876219 - RNA, 22 nt, Human
gggaacacagacuugaugauga

SEQ ID NO: 876220 - RNA, 20 nt, Human
ugucuggauguuuaagcaga

SEQ ID NO: 876221 - RNA, 22 nt, Human
ugucucugugcauuugugcuuc

SEQ ID NO: 876222 - RNA, 22 nt, Human
acuuuaaaaagagccuucuaac

SEQ ID NO: 876223 - RNA, 22 nt, Human
uacaaagcaaaucaucuaagag

SEQ ID NO: 876224 - RNA, 22 nt, Human
uccugcagagucccacugauuu

SEQ ID NO: 876225 - RNA, 22 nt, Human
uagaauuuucugcuuugauagu

SEQ ID NO: 876226 - RNA, 22 nt, Human
agcacccucagccuuauccaga

SEQ ID NO: 876227 - RNA, 22 nt, Human
acacuucuuugucaccugcuuc

SEQ ID NO: 876228 - RNA, 22 nt, Human
ucugcaggucacgcuccagccu

SEQ ID NO: 876229 - RNA, 22 nt, Human
ucaaacagaggaacaauuguuu

SEQ ID NO: 876230 - RNA, 22 nt, Human
aaggcaauguaaauuacagcuu

SEQ ID NO: 876231 - RNA, 22 nt, Human
gccagcugggccuuagggcugg

SEQ ID NO: 876232 - RNA, 22 nt, Human
acucccuccaaaucugcacagu

SEQ ID NO: 876233 - RNA, 23 nt, Human
ucucagaaaggagaaguaauuug

SEQ ID NO: 876234 - RNA, 22 nt, Human
aucuauucucuacaguagacag

SEQ ID NO: 876235 - RNA, 22 nt, Human
caaguguccaugauagucuuag

SEQ ID NO: 876236 - RNA, 22 nt, Human
gaggggaguguccuccgggccc

SEQ ID NO: 876237 - RNA, 22 nt, Human
aggaccugacauuguguuuucu

SEQ ID NO: 876238 - RNA, 22 nt, Human
aauaugacauagaauugagaug

SEQ ID NO: 876239 - RNA, 22 nt, Human
gacagaugugggugacagcagc

SEQ ID NO: 876240 - RNA, 22 nt, Human
uaacaaacuggaaauugacauu

SEQ ID NO: 876241 - RNA, 19 nt, Human
gcgaggaagucacuguggu

SEQ ID NO: 876242 - RNA, 22 nt, Human
uggcuucaggagcaccuggcuu

SEQ ID NO: 876243 - RNA, 22 nt, Human
ucagggaaaagucacacugggu

SEQ ID NO: 876244 - RNA, 22 nt, Human
uuggucugcucugauguuuucu

SEQ ID NO: 876245 - RNA, 22 nt, Human
caguagacacauuaauauggaa

SEQ ID NO: 876246 - RNA, 22 nt, Human
ggccaaauuuauuugcagcugg

SEQ ID NO: 876247 - RNA, 22 nt, Human
gcucacagagggugcuuaauac

SEQ ID NO: 876248 - RNA, 22 nt, Human
uauuuauucauucagcaagcau

SEQ ID NO: 876249 - RNA, 22 nt, Human
cacauugcagacguauauuauu

SEQ ID NO: 876250 - RNA, 22 nt, Human
uccucaguggggcauucauuau

SEQ ID NO: 876251 - RNA, 22 nt, Human
cucuggcuuaguaugcuccaaa

SEQ ID NO: 876252 - RNA, 22 nt, Human
agggcucaauggugggcaugua

SEQ ID NO: 876253 - RNA, 22 nt, Human
guguccagagaaacucacagcu

SEQ ID NO: 876254 - RNA, 18 nt, Human
cacaggagaugaccugac

SEQ ID NO: 876255 - RNA, 21 nt, Human
ugucauauuucaauacaguuu

SEQ ID NO: 876256 - RNA, 22 nt, Human
uucaagaucgaguuuaaaguga

SEQ ID NO: 876257 - RNA, 22 nt, Human
aagaauaucuguuuuauuuagg

SEQ ID NO: 876258 - RNA, 22 nt, Human
uagaaccuccagaguggccccc

SEQ ID NO: 876259 - RNA, 22 nt, Human
gacaucauggagaggauaaaua

SEQ ID NO: 876260 - RNA, 19 nt, Human
ucucugccgaucagggccc

SEQ ID NO: 876261 - RNA, 22 nt, Human
uagcagcaauucaggugugaug

SEQ ID NO: 876262 - RNA, 22 nt, Human
gagagcauguggucuaguuuua

SEQ ID NO: 876263 - RNA, 22 nt, Human
auauugcaguguguuuauguga

SEQ ID NO: 876264 - RNA, 22 nt, Human
uaauacagauacaaaggaggac

SEQ ID NO: 876265 - RNA, 22 nt, Human
gugcuccauggccuguguccau

SEQ ID NO: 876266 - RNA, 22 nt, Human
aagcagaugcagcuaauaaagc

SEQ ID NO: 876267 - RNA, 22 nt, Human
ccaggaggucugaguguggaca

SEQ ID NO: 876268 - RNA, 22 nt, Human
ggaagcuggggagcuuuggaga

SEQ ID NO: 876269 - RNA, 22 nt, Human
ugucuuauggcauguccacugg

SEQ ID NO: 876270 - RNA, 22 nt, Human
cugcagcagccuccagccuugg

SEQ ID NO: 876271 - RNA, 22 nt, Human
uguaggaauuccagugacuuca

SEQ ID NO: 876272 - RNA, 22 nt, Human
cagauuuaggucacuagaauuu

SEQ ID NO: 876273 - RNA, 20 nt, Human
ugacaacaugccuuuugcuu

SEQ ID NO: 876274 - RNA, 22 nt, Human
uggagcuggaauuugagcugga

SEQ ID NO: 876275 - RNA, 22 nt, Human
cccauuuuagcaagggguggcg

SEQ ID NO: 876276 - RNA, 22 nt, Human
agcaaauaauugucuuugaggg

SEQ ID NO: 876277 - RNA, 23 nt, Human
gaguggggagaaauugguuaaac

SEQ ID NO: 876278 - RNA, 19 nt, Human
acuguguggaagugugauu

SEQ ID NO: 876279 - RNA, 22 nt, Human
cagagacauguggccugcacgu

SEQ ID NO: 876280 - RNA, 23 nt, Human
aguguugguugggaagccaagca

SEQ ID NO: 876281 - RNA, 22 nt, Human
gcccaccuaaccugcucaccuu

SEQ ID NO: 876282 - RNA, 22 nt, Human
gccaggaagcaguuagaugggu

SEQ ID NO: 876283 - RNA, 22 nt, Human
ucuggcaguaauaggggagaga

SEQ ID NO: 876284 - RNA, 22 nt, Human
agcacagguacggagaugcuac

SEQ ID NO: 876285 - RNA, 22 nt, Human
aucugcuguucuucacagcuug

SEQ ID NO: 876286 - RNA, 22 nt, Human
uacaucaagauaaaaacuguca

SEQ ID NO: 876287 - RNA, 22 nt, Human
uuguggcugugcaccgcugccu

SEQ ID NO: 876288 - RNA, 23 nt, Human
ugccuuaguuagcacauuucuaa

SEQ ID NO: 876289 - RNA, 22 nt, Human
agcagcagauucagcaggaaug

SEQ ID NO: 876290 - RNA, 22 nt, Human
gagcaggucuuucauggugcau

SEQ ID NO: 876291 - RNA, 22 nt, Human
aagcuggcaugucaccugagaa

SEQ ID NO: 876292 - RNA, 22 nt, Human
cauuucaagcauugacuucuau

SEQ ID NO: 876293 - RNA, 22 nt, Human
gcuggccucuacaggccggcca

SEQ ID NO: 876294 - RNA, 22 nt, Human
auaaagcaugcuuguuuggaga

SEQ ID NO: 876295 - RNA, 22 nt, Human
uuacuaggccaguuuucacuuu

SEQ ID NO: 876296 - RNA, 22 nt, Human
uggcaauuucagaaaauagaau

SEQ ID NO: 876297 - RNA, 22 nt, Human
ucuaacauuuauggccacugga

SEQ ID NO: 876298 - RNA, 22 nt, Human
agauacagaaguuuuucccuau

SEQ ID NO: 876299 - RNA, 22 nt, Human
uccugggcgguuaugugaucug

SEQ ID NO: 876300 - RNA, 20 nt, Human
uggcuucucuucacuccugu

SEQ ID NO: 876301 - RNA, 22 nt, Human
uuaccacacuuauuuacauugg

SEQ ID NO: 876302 - RNA, 22 nt, Human
uuuucagaggccuaagagguuu

SEQ ID NO: 876303 - RNA, 23 nt, Human
acaaggcucuguucugcaguuuc

SEQ ID NO: 876304 - RNA, 22 nt, Human
auucuaggacuugagagcuaag

SEQ ID NO: 876305 - RNA, 22 nt, Human
agacccugguaaacacuccagg

SEQ ID NO: 876306 - RNA, 22 nt, Human
ggcaccagggacaauccucuuc

SEQ ID NO: 876307 - RNA, 22 nt, Human
uaaaagcugagauauccuguac

SEQ ID NO: 876308 - RNA, 22 nt, Human
uaaauuauguuccauguccuuu

SEQ ID NO: 876309 - RNA, 22 nt, Human
acacauuccugcagacaugaug

SEQ ID NO: 876310 - RNA, 22 nt, Human
caggacaaccucagguugcugc

SEQ ID NO: 876311 - RNA, 22 nt, Human
gucuagagccugaugaggauga

SEQ ID NO: 876312 - RNA, 22 nt, Human
aaagugcaaucaguuagaccau

SEQ ID NO: 876313 - RNA, 22 nt, Human
aaguucuuucuggaaggucugc

SEQ ID NO: 876314 - RNA, 22 nt, Human
auacuucuggugacaaagucuu

SEQ ID NO: 876315 - RNA, 22 nt, Human
agacaauacauuuauucccuuu

SEQ ID NO: 876316 - RNA, 22 nt, Human
uauucacaggcacgaaauauug

SEQ ID NO: 876317 - RNA, 22 nt, Human
uccucacauggugagccacaca

SEQ ID NO: 876318 - RNA, 22 nt, Human
accugcagguguuuccacacuu

SEQ ID NO: 876319 - RNA, 19 nt, Human
uauaggaagugugguuaag

SEQ ID NO: 876320 - RNA, 22 nt, Human
cccuccagugucccagugggga

SEQ ID NO: 876321 - RNA, 22 nt, Human
uuucauagcugaaaauguugaa

SEQ ID NO: 876322 - RNA, 22 nt, Human
ucucugagcugcuucuugcaua

SEQ ID NO: 876323 - RNA, 22 nt, Human
cugccgugagcuuucgcgagcc

SEQ ID NO: 876324 - RNA, 21 nt, Human
uggcucugagccucauggcug

SEQ ID NO: 876325 - RNA, 22 nt, Human
uaaggcaugaguuuauuucaua

SEQ ID NO: 876326 - RNA, 22 nt, Human
ggcugagccaugggcacugcag

SEQ ID NO: 876327 - RNA, 17 nt, Human
ggcaggugcggggccgc

SEQ ID NO: 876328 - RNA, 22 nt, Human
auguauuaugguuuuccuuaag

SEQ ID NO: 876329 - RNA, 22 nt, Human
uggcagagaacacggcugaucu

SEQ ID NO: 876330 - RNA, 22 nt, Human
uguauucucucaauauuucaua

SEQ ID NO: 876331 - RNA, 22 nt, Human
gacugaggcuccccuaggcuca

SEQ ID NO: 876332 - RNA, 22 nt, Human
acucaaguggccuugauggcuu

SEQ ID NO: 876333 - RNA, 22 nt, Human
aguucucuuggaaguuauguga

SEQ ID NO: 876334 - RNA, 22 nt, Human
gcugucuccauagcuguguguc

SEQ ID NO: 876335 - RNA, 22 nt, Human
cucacauaguaagcagucagua

SEQ ID NO: 876336 - RNA, 22 nt, Human
uguggacuaguguuuggauuuu

SEQ ID NO: 876337 - RNA, 22 nt, Human
gcagcagcucucaaaguggucu

SEQ ID NO: 876338 - RNA, 22 nt, Human
cuucucagucuugguuagagag

SEQ ID NO: 876339 - RNA, 22 nt, Human
cagaaggagcgcuaagguccca

SEQ ID NO: 876340 - RNA, 22 nt, Human
cuuggucaugcaagauaucgau

SEQ ID NO: 876341 - RNA, 22 nt, Human
ugggacugugaccuccagggua

SEQ ID NO: 876342 - RNA, 22 nt, Human
aaggcuuccuggaggagguguc

SEQ ID NO: 876343 - RNA, 22 nt, Human
uaaguguuguuuucaagagaua

SEQ ID NO: 876344 - RNA, 22 nt, Human
gaggcagccucaguggaccucg

SEQ ID NO: 876345 - RNA, 22 nt, Human
aauaaauguuaagauugucuca

SEQ ID NO: 876346 - RNA, 22 nt, Human
accugggaaaaggaguggccau

SEQ ID NO: 876347 - RNA, 22 nt, Human
aagaaucucugaucaggcuuua

SEQ ID NO: 876348 - RNA, 22 nt, Human
ccuuccuuugcaggucagguca

SEQ ID NO: 876349 - RNA, 19 nt, Human
cccacaggaggacauaugg

SEQ ID NO: 876350 - RNA, 20 nt, Human
auguccagugacuggaccau

SEQ ID NO: 876351 - RNA, 22 nt, Human
auccaacaggacaaagaaagga

SEQ ID NO: 876352 - RNA, 22 nt, Human
cuaggcagauggagaaguggcu

SEQ ID NO: 876353 - RNA, 22 nt, Human
ugggcugcuucucaaaugucuc

SEQ ID NO: 876354 - RNA, 22 nt, Human
gaggcucuuucuuuggacuuca

SEQ ID NO: 876355 - RNA, 22 nt, Human
agauggggcucaguguggaggc

SEQ ID NO: 876356 - RNA, 19 nt, Human
acugaaguuacccaaaugg

SEQ ID NO: 876357 - RNA, 22 nt, Human
ccagggcugguggcugcagagg

SEQ ID NO: 876358 - RNA, 22 nt, Human
acuuaaaguuauaauuugcuaa

SEQ ID NO: 876359 - RNA, 22 nt, Human
acugcaucgcucgcuuaggucc

SEQ ID NO: 876360 - RNA, 22 nt, Human
uuauuguuuggguauaauuuga

SEQ ID NO: 876361 - RNA, 22 nt, Human
aggacuuguuuaaaguuugugc

SEQ ID NO: 876362 - RNA, 22 nt, Human
uuacuuaaacagaaaugcagaa

SEQ ID NO: 876363 - RNA, 22 nt, Human
gaaggagaggauugugaggcug

SEQ ID NO: 876364 - RNA, 22 nt, Human
aaagcccauguggaaguacagg

SEQ ID NO: 876365 - RNA, 22 nt, Human
gcaggggcaggagaucucaggc

SEQ ID NO: 876366 - RNA, 22 nt, Human
uucucuucaucucaguaaaugu

SEQ ID NO: 876367 - RNA, 22 nt, Human
caaaccuuguaaaugccaaacu

SEQ ID NO: 876368 - RNA, 22 nt, Human
uggcaggcucugaguagcaccu

SEQ ID NO: 876369 - RNA, 22 nt, Human
agccaaggucgccccagggcaa

SEQ ID NO: 876370 - RNA, 22 nt, Human
gucuccaguguucaggugacug

SEQ ID NO: 876371 - RNA, 22 nt, Human
agcugcucauuacuuucuguug

SEQ ID NO: 876372 - RNA, 19 nt, Human
guucaaacacugauucagc

SEQ ID NO: 876373 - RNA, 22 nt, Human
aagugcugagacuacaggcaug

SEQ ID NO: 876374 - RNA, 22 nt, Human
agcuaaaucacuuauucuuuca

SEQ ID NO: 876375 - RNA, 22 nt, Human
caaguauuuccugauggccugu

SEQ ID NO: 876376 - RNA, 22 nt, Human
uaucuguuuccuaugcauguga

SEQ ID NO: 876377 - RNA, 17 nt, Human
ucugaugacuagaggaa

SEQ ID NO: 876378 - RNA, 22 nt, Human
uggcugaguguuccaaggagca

SEQ ID NO: 876379 - RNA, 22 nt, Human
uagcagggaagaugaucagaau

SEQ ID NO: 876380 - RNA, 22 nt, Human
uugaagacaagggcagggguuc

SEQ ID NO: 876381 - RNA, 22 nt, Human
uucuuaagugagaaagcaggag

SEQ ID NO: 876382 - RNA, 22 nt, Human
uggcuuggacuaaauggaccgu

SEQ ID NO: 876383 - RNA, 22 nt, Human
uucucacaaauccauccaggag

SEQ ID NO: 876384 - RNA, 22 nt, Human
aaagacuuuagguuagaggcau

SEQ ID NO: 876385 - RNA, 22 nt, Human
auccacaggucauguaaugugg

SEQ ID NO: 876386 - RNA, 19 nt, Human
aggcugcccagucucugcc

SEQ ID NO: 876387 - RNA, 22 nt, Human
uccugagcuacaguaguaugau

SEQ ID NO: 876388 - RNA, 22 nt, Human
guguguggggccuucggguccu

SEQ ID NO: 876389 - RNA, 19 nt, Human
gcaggccaggaggcggagg

SEQ ID NO: 876390 - RNA, 22 nt, Human
ugaaccuuuugaauaaggacca

SEQ ID NO: 876391 - RNA, 22 nt, Human
gucugccucuuucuuucugggu

SEQ ID NO: 876392 - RNA, 22 nt, Human
ccagcugguaagugauggagcc

SEQ ID NO: 876393 - RNA, 19 nt, Human
ggcacuggggccaggacca

SEQ ID NO: 876394 - RNA, 22 nt, Human
aaaugcacaauaaaguaaaggc

SEQ ID NO: 876395 - RNA, 22 nt, Human
auuuggaugcacuaaauaaaau

SEQ ID NO: 876396 - RNA, 21 nt, Human
cuugagaauuaacuguucauu

SEQ ID NO: 876397 - RNA, 22 nt, Human
cccaggaaauagccaggaggug

SEQ ID NO: 876398 - RNA, 22 nt, Human
cagugaaguuuaaaguguagau

SEQ ID NO: 876399 - RNA, 22 nt, Human
ucuuuacacaagacaagaauaa

SEQ ID NO: 876400 - RNA, 22 nt, Human
uguggcauuccaagacgcuuaa

SEQ ID NO: 876401 - RNA, 22 nt, Human
guccagaguagucgaguauucu

SEQ ID NO: 876402 - RNA, 22 nt, Human
auuauaaaccuuugaggguggg

SEQ ID NO: 876403 - RNA, 22 nt, Human
uugacaaagauauauucaugcu

SEQ ID NO: 876404 - RNA, 22 nt, Human
ugcauauuuuauaaagauggaa

SEQ ID NO: 876405 - RNA, 22 nt, Human
augaaugauuuuauguaaauga

SEQ ID NO: 876406 - RNA, 22 nt, Human
uauuugcaggacauagauaugg

SEQ ID NO: 876407 - RNA, 22 nt, Human
gcagcccuaaccugucauagug

SEQ ID NO: 876408 - RNA, 22 nt, Human
gcaggagucagcccuaccuuga

SEQ ID NO: 876409 - RNA, 22 nt, Human
ucacagugcaccccucacaggg

SEQ ID NO: 876410 - RNA, 21 nt, Human
aauuuagucaacagacugugg

SEQ ID NO: 876411 - RNA, 22 nt, Human
uccugggacucugccucaggcu

SEQ ID NO: 876412 - RNA, 22 nt, Human
cuugggaguagaggcaggagca

SEQ ID NO: 876413 - RNA, 22 nt, Human
uaauuuugucccccugcacaua

SEQ ID NO: 876414 - RNA, 22 nt, Human
aacuaaaagugugucucuugua

SEQ ID NO: 876415 - RNA, 18 nt, Human
cccagaggaaugccugga

SEQ ID NO: 876416 - RNA, 22 nt, Human
gggaagagaggaggugguuucg

SEQ ID NO: 876417 - RNA, 15 nt, Human
gauacacaugacugg

SEQ ID NO: 876418 - RNA, 22 nt, Human
agaggacagacggaaagugcca

SEQ ID NO: 876419 - RNA, 22 nt, Human
uauccauuauguuggcuagucu

SEQ ID NO: 876420 - RNA, 22 nt, Human
uccugggugugauauucauaga

SEQ ID NO: 876421 - RNA, 22 nt, Human
caggcugaggcaguaggguuug

SEQ ID NO: 876422 - RNA, 22 nt, Human
aaagaugucauacacauuaaga

SEQ ID NO: 876423 - RNA, 22 nt, Human
uuuuagauugggaaauguaaag

SEQ ID NO: 876424 - RNA, 20 nt, Human
accccacagaguccauugca

SEQ ID NO: 876425 - RNA, 22 nt, Human
uacaguggggagcucaggagag

SEQ ID NO: 876426 - RNA, 22 nt, Human
ugagauucagggaugcagagca

SEQ ID NO: 876427 - RNA, 22 nt, Human
cagacugaaaaucccugguagu

SEQ ID NO: 876428 - RNA, 22 nt, Human
gaggcagcauucgcauagacag

SEQ ID NO: 876429 - RNA, 22 nt, Human
gaauaacauuuuuuccuuuaca

SEQ ID NO: 876430 - RNA, 22 nt, Human
cuggggcucacuccagcccugg

SEQ ID NO: 876431 - RNA, 22 nt, Human
caggcaugaugggaagugccug

SEQ ID NO: 876432 - RNA, 22 nt, Human
ucucuuggacauguggcucugc

SEQ ID NO: 876433 - RNA, 22 nt, Human
aaaugcaguuuccugagaccca

SEQ ID NO: 876434 - RNA, 22 nt, Human
aaucacaugaaaacuguguguu

SEQ ID NO: 876435 - RNA, 22 nt, Human
guagaaauuccauuuacuuuga

SEQ ID NO: 876436 - RNA, 22 nt, Human
uggggcuccuccuggcaggagg

SEQ ID NO: 876437 - RNA, 22 nt, Human
uacauguucaaauuugucuuuc

SEQ ID NO: 876438 - RNA, 22 nt, Human
ccugcauccgaaagugaucaua

SEQ ID NO: 876439 - RNA, 22 nt, Human
uagcccagagagccaggggcuu

SEQ ID NO: 876440 - RNA, 21 nt, Human
ccucugcucgggcaugcguuu

SEQ ID NO: 876441 - RNA, 19 nt, Human
uuugaauauaaugcagcua

SEQ ID NO: 876442 - RNA, 22 nt, Human
acugccagaaucauucaaggaa

SEQ ID NO: 876443 - RNA, 22 nt, Human
acaagacugugcucuaagagug

SEQ ID NO: 876444 - RNA, 22 nt, Human
ucacagagaacuauaauccauc

SEQ ID NO: 876445 - RNA, 20 nt, Human
ccaaugcaguaucucguucc

SEQ ID NO: 876446 - RNA, 22 nt, Human
uuguacuugccauagaacaaca

SEQ ID NO: 876447 - RNA, 22 nt, Human
uggcuucauggcaagucuuagu

SEQ ID NO: 876448 - RNA, 22 nt, Human
agaauaagccugacgaaaccua

SEQ ID NO: 876449 - RNA, 22 nt, Human
gaaaucugaacaacagcuguca

SEQ ID NO: 876450 - RNA, 22 nt, Human
ccucccacauccuagcucugcu

SEQ ID NO: 876451 - RNA, 22 nt, Human
cagggcaguuuuacuucucucu

SEQ ID NO: 876452 - RNA, 22 nt, Human
uguggcagaacugggacucaaa

SEQ ID NO: 876453 - RNA, 22 nt, Human
gagcaugguuccauagguuggu

SEQ ID NO: 876454 - RNA, 22 nt, Human
aagcagaugccaagauuuacca

SEQ ID NO: 876455 - RNA, 22 nt, Human
aaauugucucuauuuugauucg

SEQ ID NO: 876456 - RNA, 22 nt, Human
aauuaaaagauaacccaugagu

SEQ ID NO: 876457 - RNA, 20 nt, Human
uccagggcccuggcuccucu

SEQ ID NO: 876458 - RNA, 22 nt, Human
ugcccaggcuucacccucagag

SEQ ID NO: 876459 - RNA, 22 nt, Human
gaggaagaauugguuauuggag

SEQ ID NO: 876460 - RNA, 22 nt, Human
cuguugucuucauugucauauc

SEQ ID NO: 876461 - RNA, 22 nt, Human
ugagagaaacguuccuuacauc

SEQ ID NO: 876462 - RNA, 22 nt, Human
acccagugacauccuuuaccug

SEQ ID NO: 876463 - RNA, 20 nt, Human
agcugcaacagacuguaugg

SEQ ID NO: 876464 - RNA, 22 nt, Human
uuacaagauaacggagaaagca

SEQ ID NO: 876465 - RNA, 19 nt, Human
acaaagcugugagcagcuu

SEQ ID NO: 876466 - RNA, 22 nt, Human
guucucguuucugaagaaaagu

SEQ ID NO: 876467 - RNA, 22 nt, Human
gggcuggcaucgguugcugaga

SEQ ID NO: 876468 - RNA, 22 nt, Human
ccagagcagauguggccuuggu

SEQ ID NO: 876469 - RNA, 22 nt, Human
gggcccugggauucagagcaag

SEQ ID NO: 876470 - RNA, 22 nt, Human
uuagaaaaauguucaguaguuu

SEQ ID NO: 876471 - RNA, 19 nt, Human
gguguccuagagauaagag

SEQ ID NO: 876472 - RNA, 22 nt, Human
gcucucaugcccucugggcuug

SEQ ID NO: 876473 - RNA, 22 nt, Human
uggcaaggcugugggggcagag

SEQ ID NO: 876474 - RNA, 22 nt, Human
agugauuuacuaccauauuggg

SEQ ID NO: 876475 - RNA, 22 nt, Human
uggguggcacuucuggggucca

SEQ ID NO: 876476 - RNA, 22 nt, Human
uacagagauuuauugcuaaggc

SEQ ID NO: 876477 - RNA, 22 nt, Human
aagcugcaugaaguugaguaga

SEQ ID NO: 876478 - RNA, 22 nt, Human
uguuccugaggcaugugucaau

SEQ ID NO: 876479 - RNA, 22 nt, Human
uggaaagggacuuaugaguucc

SEQ ID NO: 876480 - RNA, 22 nt, Human
cagagacccuaggcaggugaca

SEQ ID NO: 876481 - RNA, 22 nt, Human
cugagcugggcucucuugaggg

SEQ ID NO: 876482 - RNA, 22 nt, Human
cccaggagaugcacuccauugg

SEQ ID NO: 876483 - RNA, 22 nt, Human
uggcuggaggguuagugagaua

SEQ ID NO: 876484 - RNA, 22 nt, Human
cacugacuaaguuugugaaggu

SEQ ID NO: 876485 - RNA, 22 nt, Human
guggcucuugcauggggucucu

SEQ ID NO: 876486 - RNA, 22 nt, Human
ugggagcacccugaggagcuuc

SEQ ID NO: 876487 - RNA, 22 nt, Human
gaagauuugcccaugcacuuuu

SEQ ID NO: 876488 - RNA, 22 nt, Human
gagggcugcugccagauaugcc

SEQ ID NO: 876489 - RNA, 22 nt, Human
uauaggcagaucugagaauauu

SEQ ID NO: 876490 - RNA, 22 nt, Human
aucacagagauugcuuuuaaaa

SEQ ID NO: 876491 - RNA, 22 nt, Human
uguaaacaaaugcauucuugcu

SEQ ID NO: 876492 - RNA, 22 nt, Human
guccaggaaucaaaagauggaa

SEQ ID NO: 876493 - RNA, 22 nt, Human
gccaaggcugaggcccugggcu

SEQ ID NO: 876494 - RNA, 22 nt, Human
acagugagcgguagugauugcu

SEQ ID NO: 876495 - RNA, 22 nt, Human
ugcaggaagcaaccagguccaa

SEQ ID NO: 876496 - RNA, 22 nt, Human
gcaugcagacagucugagacca

SEQ ID NO: 876497 - RNA, 19 nt, Human
acuagauacaacaugcaga

SEQ ID NO: 876498 - RNA, 21 nt, Human
uccagggcuuugauucucuca

SEQ ID NO: 876499 - RNA, 21 nt, Human
gaacauuuggguuguuucuac

SEQ ID NO: 876500 - RNA, 22 nt, Human
gugccucucauuggcugagccc

SEQ ID NO: 876501 - RNA, 17 nt, Human
ucacaguuggucucagu

SEQ ID NO: 876502 - RNA, 22 nt, Human
aagcugcagaugugccugugga

SEQ ID NO: 876503 - RNA, 22 nt, Human
cccuggugcccugggucagccu

SEQ ID NO: 876504 - RNA, 22 nt, Human
auuacauauguuggcaacauuu

SEQ ID NO: 876505 - RNA, 22 nt, Human
gaaaauuauugaaaauggcucu

SEQ ID NO: 876506 - RNA, 22 nt, Human
ucagagguucuucucaguggcc

SEQ ID NO: 876507 - RNA, 22 nt, Human
cugacucagcagcugaugaucc

SEQ ID NO: 876508 - RNA, 22 nt, Human
caguuuaaaugagugacugcag

SEQ ID NO: 876509 - RNA, 22 nt, Human
ucaggcaccccuugaguagggg

SEQ ID NO: 876510 - RNA, 22 nt, Human
ggaccaggcaagcugaggcggg

SEQ ID NO: 876511 - RNA, 19 nt, Human
uuguacagcaaccaacccu

SEQ ID NO: 876512 - RNA, 18 nt, Human
ucagggaagagaauauga

SEQ ID NO: 876513 - RNA, 22 nt, Human
cuccaggagggcuuccugugau

SEQ ID NO: 876514 - RNA, 22 nt, Human
uuugaaauuggcucauugguuu

SEQ ID NO: 876515 - RNA, 22 nt, Human
ccugaggcuuaaucugucccaa

SEQ ID NO: 876516 - RNA, 22 nt, Human
aguaaauuucugcauguguacu

SEQ ID NO: 876517 - RNA, 22 nt, Human
agaaaugaagagagucaagguu

SEQ ID NO: 876518 - RNA, 22 nt, Human
ggcuuagcaacuccugaggcuc

SEQ ID NO: 876519 - RNA, 23 nt, Human
uauuacaauuggucuuauuaaga

SEQ ID NO: 876520 - RNA, 22 nt, Human
aguucucuggcuccuuuccaga

SEQ ID NO: 876521 - RNA, 20 nt, Human
cugcacugaacaugucugag

SEQ ID NO: 876522 - RNA, 22 nt, Human
cuugcugggguaagucugugcu

SEQ ID NO: 876523 - RNA, 22 nt, Human
caaauaguaugagcaaugauuc

SEQ ID NO: 876524 - RNA, 22 nt, Human
auucaacuagugauuguguuau

SEQ ID NO: 876525 - RNA, 22 nt, Human
agccuggcccugcugaacucug

SEQ ID NO: 876526 - RNA, 22 nt, Human
gcuccaggaagggaaaucucca

SEQ ID NO: 876527 - RNA, 22 nt, Human
gccaaauaugguggacaguuug

SEQ ID NO: 876528 - RNA, 22 nt, Human
cacuggcaucuaagggugguag

SEQ ID NO: 876529 - RNA, 22 nt, Human
aucuuugaugacuaaugcuuug

SEQ ID NO: 876530 - RNA, 22 nt, Human
gugcugaaauggaccucaggaa

SEQ ID NO: 876531 - RNA, 22 nt, Human
gaaugcagauggcugguguaug

SEQ ID NO: 876532 - RNA, 22 nt, Human
uacuuuuuagcacagugugugc

SEQ ID NO: 876533 - RNA, 22 nt, Human
gcuucuguggauuggcuggcuu

SEQ ID NO: 876534 - RNA, 22 nt, Human
cuuuguuuuacucagaggcaug

SEQ ID NO: 876535 - RNA, 22 nt, Human
ccacagugacacgggcuggccc

SEQ ID NO: 876536 - RNA, 22 nt, Human
gcugaagggagugcugagucug

SEQ ID NO: 876537 - RNA, 22 nt, Human
ugagagccagaagggccugagg

SEQ ID NO: 876538 - RNA, 22 nt, Human
uuguuaaauggaugcagaauaa

SEQ ID NO: 876539 - RNA, 22 nt, Human
agcuggcuauacuugaaaaguc

SEQ ID NO: 876540 - RNA, 22 nt, Human
gcagggucuugagaggcagcca

SEQ ID NO: 876541 - RNA, 22 nt, Human
uugcagggauaaaacaagugaa

SEQ ID NO: 876542 - RNA, 22 nt, Human
ugcagcaagaccggauaugucg

SEQ ID NO: 876543 - RNA, 22 nt, Human
uaacaguauauuuaccaaaccu

SEQ ID NO: 876544 - RNA, 22 nt, Human
gcaagcagacauucagguaggu

SEQ ID NO: 876545 - RNA, 22 nt, Human
caucuguguaucugugcuuaga

SEQ ID NO: 876546 - RNA, 22 nt, Human
agugugcuuaaguuuaucagga

SEQ ID NO: 876547 - RNA, 22 nt, Human
auuuauuauugugguuacuucu

SEQ ID NO: 876548 - RNA, 22 nt, Human
ucuggcuccuggcuccacugcc

SEQ ID NO: 876549 - RNA, 22 nt, Human
aggcuccuugcucacaggcuca

SEQ ID NO: 876550 - RNA, 22 nt, Human
caggucaaagguuaguuauguu

SEQ ID NO: 876551 - RNA, 22 nt, Human
acaaagauaagucagaaaguca

SEQ ID NO: 876552 - RNA, 22 nt, Human
aauuugauuuucuuaaaccaua

SEQ ID NO: 876553 - RNA, 22 nt, Human
augcagggaccuuugcuuuggu

SEQ ID NO: 876554 - RNA, 22 nt, Human
caguaguguugcugagugucag

SEQ ID NO: 876555 - RNA, 22 nt, Human
uuuuccuuugauucccagaugu

SEQ ID NO: 876556 - RNA, 22 nt, Human
uuaagguagcucacuaaauaug

SEQ ID NO: 876557 - RNA, 22 nt, Human
ugguggagagacaguguauugg

SEQ ID NO: 876558 - RNA, 22 nt, Human
ucagagagcuggugggcagagg

SEQ ID NO: 876559 - RNA, 21 nt, Human
caguagugcgucgcagaggac

SEQ ID NO: 876560 - RNA, 22 nt, Human
agauaucaccucuaggcuggug

SEQ ID NO: 876561 - RNA, 22 nt, Human
ucuagggaauugugguuuucuu

SEQ ID NO: 876562 - RNA, 20 nt, Human
ucaggugacacacguggcac

SEQ ID NO: 876563 - RNA, 22 nt, Human
ugguggaggugcauuucggagc

SEQ ID NO: 876564 - RNA, 22 nt, Human
ugacccuuagaagcugcagcga

SEQ ID NO: 876565 - RNA, 22 nt, Human
uagcuuaucccacagugcccag

SEQ ID NO: 876566 - RNA, 22 nt, Human
uggaggaugccuggggaggccu

SEQ ID NO: 876567 - RNA, 19 nt, Human
ggccuggcuaucccugcug

SEQ ID NO: 876568 - RNA, 22 nt, Human
uuguuuuuagagaagcccugaa

SEQ ID NO: 876569 - RNA, 22 nt, Human
uuacacuucuaaaaaaagcagg

SEQ ID NO: 876570 - RNA, 22 nt, Human
uuccaguucacuccauuucugg

SEQ ID NO: 876571 - RNA, 22 nt, Human
gaggcucacugggcaaagacuc

SEQ ID NO: 876572 - RNA, 22 nt, Human
agcagcuuaucuuggagaggca

SEQ ID NO: 876573 - RNA, 22 nt, Human
caaauacaaauacgggcagcuu

SEQ ID NO: 876574 - RNA, 22 nt, Human
uguguguguaaaagcauuuaua

SEQ ID NO: 876575 - RNA, 22 nt, Human
cagguucuugaagccuucuggc

SEQ ID NO: 876576 - RNA, 22 nt, Human
agucacaauaccgugugucagu

SEQ ID NO: 876577 - RNA, 22 nt, Human
uuaagcauggaagugaaauaau

SEQ ID NO: 876578 - RNA, 22 nt, Human
cagcugugcuagaagccacgaa

SEQ ID NO: 876579 - RNA, 22 nt, Human
uucuuucuuuguaguccugaac

SEQ ID NO: 876580 - RNA, 22 nt, Human
gcaguggggaaugcuggggaga

SEQ ID NO: 876581 - RNA, 21 nt, Human
cucuuugggaucuuuggaaag

SEQ ID NO: 876582 - RNA, 22 nt, Human
uguguuggaaauagggucuuug

SEQ ID NO: 876583 - RNA, 23 nt, Human
uugcaaauuucaguuaguucaug

SEQ ID NO: 876584 - RNA, 22 nt, Human
uaaaaguaggaaugaaacgcau

SEQ ID NO: 876585 - RNA, 22 nt, Human
ucaucauucugacaagucuaca

SEQ ID NO: 876586 - RNA, 22 nt, Human
uuucuucucgacaccuuauccc

SEQ ID NO: 876587 - RNA, 22 nt, Human
aagcauuuuugaaaugguagga

SEQ ID NO: 876588 - RNA, 19 nt, Human
gaggaggcuucagcuuucu

SEQ ID NO: 876589 - RNA, 22 nt, Human
cuaauuuaaugaaugagucuua

SEQ ID NO: 876590 - RNA, 22 nt, Human
ugugucuggaccggggaggagc

SEQ ID NO: 876591 - RNA, 22 nt, Human
ggcuccuguggcaagacagcuu

SEQ ID NO: 876592 - RNA, 22 nt, Human
cagcugagcucccaggccauca

SEQ ID NO: 876593 - RNA, 22 nt, Human
ucuuccaggcccugccacagcu

SEQ ID NO: 876594 - RNA, 22 nt, Human
ggaguggcuauuugugcugguu

SEQ ID NO: 876595 - RNA, 21 nt, Human
cugugcuucuuccuaagccag

SEQ ID NO: 876596 - RNA, 22 nt, Human
agaauacaauuguucaguaaua

SEQ ID NO: 876597 - RNA, 22 nt, Human
aaaucaguuggaacacaagcag

SEQ ID NO: 876598 - RNA, 22 nt, Human
uguaacaaguaauccaugggag

SEQ ID NO: 876599 - RNA, 22 nt, Human
gcagccugaggcccuuucuggc

SEQ ID NO: 876600 - RNA, 22 nt, Human
ucuugcaggcaugaaaggacuc

SEQ ID NO: 876601 - RNA, 22 nt, Human
ggcccugagcugaaguacugug

SEQ ID NO: 876602 - RNA, 22 nt, Human
gacaggaggcagagcucaggug

SEQ ID NO: 876603 - RNA, 20 nt, Human
auguuaaauagcauuuagag

SEQ ID NO: 876604 - RNA, 22 nt, Human
ccagcuggagcucgcagauagg

SEQ ID NO: 876605 - RNA, 22 nt, Human
ccuaggagagggaaaaucuagg

SEQ ID NO: 876606 - RNA, 22 nt, Human
aacagaauaucaaaagauuaug

SEQ ID NO: 876607 - RNA, 22 nt, Human
augcaggagagcauguuuaaga

SEQ ID NO: 876608 - RNA, 22 nt, Human
gcuggcucuuuuugccgggcuc

SEQ ID NO: 876609 - RNA, 22 nt, Human
auucugaugcuucacaaaggua

SEQ ID NO: 876610 - RNA, 22 nt, Human
ugagccguggucucugagggug

SEQ ID NO: 876611 - RNA, 22 nt, Human
aagaggugagaagcuacacuua

SEQ ID NO: 876612 - RNA, 22 nt, Human
ucugcagggcccuuggcuccug

SEQ ID NO: 876613 - RNA, 22 nt, Human
ccuugaaaugagaaaaaguugg

SEQ ID NO: 876614 - RNA, 22 nt, Human
uaagccagauacaccacugaaa

SEQ ID NO: 876615 - RNA, 22 nt, Human
uaauaucuggcauucaaacaug

SEQ ID NO: 876616 - RNA, 22 nt, Human
cuggcccauugccuucucucuc

SEQ ID NO: 876617 - RNA, 20 nt, Human
uggcugcacaccaggacagg

SEQ ID NO: 876618 - RNA, 22 nt, Human
gccaguggcuugccaggcagga

SEQ ID NO: 876619 - RNA, 20 nt, Human
ugguaaaggagggcuggagg

SEQ ID NO: 876620 - RNA, 22 nt, Human
ugaaacaaaccaguaauuuugu

SEQ ID NO: 876621 - RNA, 22 nt, Human
aaugaacuggagaacaaugacc

SEQ ID NO: 876622 - RNA, 22 nt, Human
auugcugacuuuaauauuauau

SEQ ID NO: 876623 - RNA, 22 nt, Human
ccugaggcucuccugaauaaug

SEQ ID NO: 876624 - RNA, 22 nt, Human
aggccagaaaaagacagcucca

SEQ ID NO: 876625 - RNA, 22 nt, Human
cuuucauucuuagauauuagug

SEQ ID NO: 876626 - RNA, 20 nt, Human
agggucagagagcgugagug

SEQ ID NO: 876627 - RNA, 20 nt, Human
gcagggcgacacgggggagg

SEQ ID NO: 876628 - RNA, 22 nt, Human
aaugaagauaaaaugggaugga

SEQ ID NO: 876629 - RNA, 21 nt, Human
ucuaaauguccagcaauagaa

SEQ ID NO: 876630 - RNA, 22 nt, Human
cagaggcugccagccaugugca

SEQ ID NO: 876631 - RNA, 23 nt, Human
ucugggccacuugucugcacuuc

SEQ ID NO: 876632 - RNA, 22 nt, Human
cugccugccuuggccuccagga

SEQ ID NO: 876633 - RNA, 22 nt, Human
gccuggagcucuccacuugggg

SEQ ID NO: 876634 - RNA, 22 nt, Human
uuugacaggacuaacauauggc

SEQ ID NO: 876635 - RNA, 22 nt, Human
cauagugucugguaacauagua

SEQ ID NO: 876636 - RNA, 22 nt, Human
agauuuacaaaggauuugcuuu

SEQ ID NO: 876637 - RNA, 22 nt, Human
gcugagggcauguguggcgacu

SEQ ID NO: 876638 - RNA, 22 nt, Human
ucaucaucugggcuugggggug

SEQ ID NO: 876639 - RNA, 22 nt, Human
acugugggagcgcaguggcagc

SEQ ID NO: 876640 - RNA, 22 nt, Human
ugcuucaugcuucugacaauag

SEQ ID NO: 876641 - RNA, 22 nt, Human
uccugagagucaagaaugcagg

SEQ ID NO: 876642 - RNA, 22 nt, Human
cagagaaacucagauagcugau

SEQ ID NO: 876643 - RNA, 22 nt, Human
ggcccucuuuuauccaucauaa

SEQ ID NO: 876644 - RNA, 22 nt, Human
uacugauagcacaaaugacauu

SEQ ID NO: 876645 - RNA, 22 nt, Human
uggucaaaugccaaucuguagu

SEQ ID NO: 876646 - RNA, 22 nt, Human
uuggcacagagcugcagccugg

SEQ ID NO: 876647 - RNA, 22 nt, Human
uacugaaaagccacaaggacca

SEQ ID NO: 876648 - RNA, 22 nt, Human
auaaacuaauugggguauaguu

SEQ ID NO: 876649 - RNA, 22 nt, Human
cauugagagugacuuggacaau

SEQ ID NO: 876650 - RNA, 22 nt, Human
ccagggaaacuuuggaguggag

SEQ ID NO: 876651 - RNA, 22 nt, Human
ucucaggggccuggaguccugg

SEQ ID NO: 876652 - RNA, 22 nt, Human
gaggcacaucacuuggugcauu

SEQ ID NO: 876653 - RNA, 22 nt, Human
ucauuuucccacugaagcuguc

SEQ ID NO: 876654 - RNA, 22 nt, Human
ugaaacaaaauuaagauucucg

SEQ ID NO: 876655 - RNA, 22 nt, Human
gggcaagcuuugaacaucagca

SEQ ID NO: 876656 - RNA, 22 nt, Human
ucagggccacaacaccagaguc

SEQ ID NO: 876657 - RNA, 23 nt, Human
guuuucaacacaauaaauguaac

SEQ ID NO: 876658 - RNA, 22 nt, Human
uucauugaaggagggacuugcu

SEQ ID NO: 876659 - RNA, 22 nt, Human
uauucuuguauacuacaaucuu

SEQ ID NO: 876660 - RNA, 22 nt, Human
cagcacuuggugccauugagug

SEQ ID NO: 876661 - RNA, 22 nt, Human
gcaguguuauguuuucuauaau

SEQ ID NO: 876662 - RNA, 22 nt, Human
aauguauaaccauaggaaauuu

SEQ ID NO: 876663 - RNA, 22 nt, Human
caagccaguuuguaguucucuc

SEQ ID NO: 876664 - RNA, 22 nt, Human
aguccagaccccggcagcuggu

SEQ ID NO: 876665 - RNA, 17 nt, Human
ggcaggugacagacacc

SEQ ID NO: 876666 - RNA, 22 nt, Human
cucuuuggggcuggaagccuag

SEQ ID NO: 876667 - RNA, 22 nt, Human
augaaauuugcugcuaaguucc

SEQ ID NO: 876668 - RNA, 22 nt, Human
uguggcucuccuccugcugccc

SEQ ID NO: 876669 - RNA, 22 nt, Human
cucuuuguggccaccuaaucuu

SEQ ID NO: 876670 - RNA, 22 nt, Human
ucuccagggacauguuucugga

SEQ ID NO: 876671 - RNA, 22 nt, Human
aggcuguugcaugccacagaua

SEQ ID NO: 876672 - RNA, 22 nt, Human
uaacacaguucucuguugcaca

SEQ ID NO: 876673 - RNA, 22 nt, Human
ccugggcaucucaugcaccugc

SEQ ID NO: 876674 - RNA, 22 nt, Human
aaauagcagccuuuaguuaaca

SEQ ID NO: 876675 - RNA, 22 nt, Human
cuguggccccacccucuuggcc

SEQ ID NO: 876676 - RNA, 21 nt, Human
ccagugcuacagcugccugac

SEQ ID NO: 876677 - RNA, 22 nt, Human
gugggcagucaugaaaucuaga

SEQ ID NO: 876678 - RNA, 22 nt, Human
auggaauguuuccucuuuuauu

SEQ ID NO: 876679 - RNA, 22 nt, Human
gguggaaggccuggaaggaggc

SEQ ID NO: 876680 - RNA, 22 nt, Human
gagcugugcuuauaccaauuca

SEQ ID NO: 876681 - RNA, 19 nt, Human
ugaggcacaugauaagaac

SEQ ID NO: 876682 - RNA, 21 nt, Human
acauaggcgaauguucgggag

SEQ ID NO: 876683 - RNA, 22 nt, Human
ggcccucuggcuuccgcauggg

SEQ ID NO: 876684 - RNA, 18 nt, Human
ccuggaggucuucggggu

SEQ ID NO: 876685 - RNA, 22 nt, Human
uucccagauuggagggcagggg

SEQ ID NO: 876686 - RNA, 22 nt, Human
uuggaaaaugaggcacagagag

SEQ ID NO: 876687 - RNA, 22 nt, Human
uggcacagcccauucagagaag

SEQ ID NO: 876688 - RNA, 22 nt, Human
uggccugcccagagcagcucug

SEQ ID NO: 876689 - RNA, 22 nt, Human
gccugggaacucugaucuccug

SEQ ID NO: 876690 - RNA, 21 nt, Human
ucauggauuuucucugcuuuu

SEQ ID NO: 876691 - RNA, 22 nt, Human
uccagacuguucacauuggcau

SEQ ID NO: 876692 - RNA, 22 nt, Human
ugauuuguuuagugccaaguuu

SEQ ID NO: 876693 - RNA, 23 nt, Human
acuuuauugaccccaggucaguu

SEQ ID NO: 876694 - RNA, 22 nt, Human
uuauuuguaaagguccauagua

SEQ ID NO: 876695 - RNA, 22 nt, Human
ucacuuuggauuauguaauuuc

SEQ ID NO: 876696 - RNA, 22 nt, Human
caggaaaggugugucaugaugg

SEQ ID NO: 876697 - RNA, 22 nt, Human
ucaguguuuguggcaaauguua

SEQ ID NO: 876698 - RNA, 22 nt, Human
uagcaucagccacaccuuguac

SEQ ID NO: 876699 - RNA, 22 nt, Human
ucucugugcaggaugcugaguu

SEQ ID NO: 876700 - RNA, 22 nt, Human
gcccugagcuagugugggcagg

SEQ ID NO: 876701 - RNA, 22 nt, Human
uuacuguuuugguaccucauug

SEQ ID NO: 876702 - RNA, 22 nt, Human
aggccagcuucuacccucuguu

SEQ ID NO: 876703 - RNA, 19 nt, Human
gacucacaccuuccgcugu

SEQ ID NO: 876704 - RNA, 22 nt, Human
uaccuugugagcuuucuaacau

SEQ ID NO: 876705 - RNA, 22 nt, Human
uuugacagauagauguuauguu

SEQ ID NO: 876706 - RNA, 22 nt, Human
ucagauuuaugaauauacuaug

SEQ ID NO: 876707 - RNA, 22 nt, Human
uuuccucuucgauuaaguuugg

SEQ ID NO: 876708 - RNA, 22 nt, Human
cagggagcuggcuggcgugagu

SEQ ID NO: 876709 - RNA, 22 nt, Human
gaggcugugugucccucuggac

SEQ ID NO: 876710 - RNA, 22 nt, Human
cagggaguuuuuguuccucuag

SEQ ID NO: 876711 - RNA, 22 nt, Human
uccaggcuagagugcaguggcc

SEQ ID NO: 876712 - RNA, 22 nt, Human
auagaagaggaaacugagguug

SEQ ID NO: 876713 - RNA, 22 nt, Human
cuccagagaguccagcucuggg

SEQ ID NO: 876714 - RNA, 22 nt, Human
uuuuuacagucauggucacuca

SEQ ID NO: 876715 - RNA, 22 nt, Human
agcagcugagccccagcuguga

SEQ ID NO: 876716 - RNA, 22 nt, Human
aguguuuguaaacuacagaucu

SEQ ID NO: 876717 - RNA, 22 nt, Human
ucaguuucacuugaagaaaaga

SEQ ID NO: 876718 - RNA, 22 nt, Human
acauauuuugaaagcuuucuaa

SEQ ID NO: 876719 - RNA, 22 nt, Human
ugugccaggcacuugcccaggc

SEQ ID NO: 876720 - RNA, 22 nt, Human
aaggugcucacgggcucaggga

SEQ ID NO: 876721 - RNA, 23 nt, Human
augcaaagugcugucauguagac

SEQ ID NO: 876722 - RNA, 22 nt, Human
acagcagaucuggcuacagguu

SEQ ID NO: 876723 - RNA, 22 nt, Human
ugagcagaggaggcugccaacu

SEQ ID NO: 876724 - RNA, 23 nt, Human
cuguccaggauucuugagagaac

SEQ ID NO: 876725 - RNA, 22 nt, Human
gaggcucacuaggcauccuggg

SEQ ID NO: 876726 - RNA, 22 nt, Human
agccagcucccuccccugcagg

SEQ ID NO: 876727 - RNA, 22 nt, Human
ugcccugcccaucuacccuguc

SEQ ID NO: 876728 - RNA, 22 nt, Human
gcaggcagagguggaggagaca

SEQ ID NO: 876729 - RNA, 22 nt, Human
auauucuucuuguucagacuau

SEQ ID NO: 876730 - RNA, 22 nt, Human
aguacaaaugcagccagaguag

SEQ ID NO: 876731 - RNA, 22 nt, Human
gaguaaaaguuggauuacaaag

SEQ ID NO: 876732 - RNA, 22 nt, Human
acauuucuaucauccuguaaug

SEQ ID NO: 876733 - RNA, 22 nt, Human
cagcauauuacuuuaaaaaauc

SEQ ID NO: 876734 - RNA, 22 nt, Human
ggcuuggaaaugguaaugagcu

SEQ ID NO: 876735 - RNA, 22 nt, Human
aucuuugggauccugauuuacu

SEQ ID NO: 876736 - RNA, 22 nt, Human
uggcagcacaagguggcccaug

SEQ ID NO: 876737 - RNA, 22 nt, Human
acacaguaccccaaggcugggc

SEQ ID NO: 876738 - RNA, 22 nt, Human
aagucuggugcuguccucaccc

SEQ ID NO: 876739 - RNA, 22 nt, Human
aaucagagcccucugagcuuca

SEQ ID NO: 876740 - RNA, 22 nt, Human
acagggcuauauuccucagagc

SEQ ID NO: 876741 - RNA, 22 nt, Human
uuauaauucuggcauaggcugu

SEQ ID NO: 876742 - RNA, 22 nt, Human
acugauuaaaaacagacauuua

SEQ ID NO: 876743 - RNA, 22 nt, Human
ccaggcugugguuuagauagag

SEQ ID NO: 876744 - RNA, 22 nt, Human
cugggggucgcgccucugggca

SEQ ID NO: 876745 - RNA, 22 nt, Human
auucaguguuugcagcaacuuu

SEQ ID NO: 876746 - RNA, 22 nt, Human
augucuuucucacagccaguuc

SEQ ID NO: 876747 - RNA, 22 nt, Human
uugaggaaagagugcaaagagg

SEQ ID NO: 876748 - RNA, 22 nt, Human
uuuugaaagaguccugcuacag

SEQ ID NO: 876749 - RNA, 22 nt, Human
ggcuggcaggggaugucagaug

SEQ ID NO: 876750 - RNA, 22 nt, Human
augugcaacuuuucugucuuuu

SEQ ID NO: 876751 - RNA, 22 nt, Human
uuguuuaaaagaaaucauagaa

SEQ ID NO: 876752 - RNA, 20 nt, Human
auguccugcuucuccucacc

SEQ ID NO: 876753 - RNA, 22 nt, Human
aguggugcuagguggaauauag

SEQ ID NO: 876754 - RNA, 22 nt, Human
caaacuuuugaggaguucagga

SEQ ID NO: 876755 - RNA, 22 nt, Human
ucugugccaucagucuccagag

SEQ ID NO: 876756 - RNA, 22 nt, Human
ucuccagguggcuugggcuucu

SEQ ID NO: 876757 - RNA, 22 nt, Human
cuuuucuuauguggacguaccu

SEQ ID NO: 876758 - RNA, 22 nt, Human
uaagaauuguguugaauagagu

SEQ ID NO: 876759 - RNA, 22 nt, Human
aggccaaguagcuagcauugaa

SEQ ID NO: 876760 - RNA, 22 nt, Human
caaaugauaccuauuacuaggc

SEQ ID NO: 876761 - RNA, 22 nt, Human
acuuguuuacaagcaguucuga

SEQ ID NO: 876762 - RNA, 23 nt, Human
ucuggcuuugcuggaaguuuuga

SEQ ID NO: 876763 - RNA, 22 nt, Human
uucugcugguaacuauguuuca

SEQ ID NO: 876764 - RNA, 22 nt, Human
agauacacagcccugccaucac

SEQ ID NO: 876765 - RNA, 19 nt, Human
ucagggggcugauaggagg

SEQ ID NO: 876766 - RNA, 22 nt, Human
augugaagcuugugcuaacaua

SEQ ID NO: 876767 - RNA, 22 nt, Human
ugaaccaggaggcagccagcac

SEQ ID NO: 876768 - RNA, 22 nt, Human
uaucaacaauagccaguguuua

SEQ ID NO: 876769 - RNA, 22 nt, Human
aacucuuuuuuuaaguguagcc

SEQ ID NO: 876770 - RNA, 22 nt, Human
uacccagugcaacuggagucuc

SEQ ID NO: 876771 - RNA, 22 nt, Human
aggucuccuugugggucuugcc

SEQ ID NO: 876772 - RNA, 22 nt, Human
augcgugugugcaaaccauugc

SEQ ID NO: 876773 - RNA, 22 nt, Human
caaacuuugcaaaacuuacagu

SEQ ID NO: 876774 - RNA, 22 nt, Human
ucaacgcaugcuccaagaaaga

SEQ ID NO: 876775 - RNA, 21 nt, Human
ccucucucauuguaaugaagu

SEQ ID NO: 876776 - RNA, 22 nt, Human
gauuuauaguaugugcuuucag

SEQ ID NO: 876777 - RNA, 18 nt, Human
ugugaacacauuuuucug

SEQ ID NO: 876778 - RNA, 22 nt, Human
ucugugcugcaggagucugcau

SEQ ID NO: 876779 - RNA, 22 nt, Human
cucugagguuuccucacaagcu

SEQ ID NO: 876780 - RNA, 21 nt, Human
uggcacagaaaggaaaguuca

SEQ ID NO: 876781 - RNA, 22 nt, Human
uggagacagagauagccaauug

SEQ ID NO: 876782 - RNA, 22 nt, Human
cuguuaauggaggacuacagga

SEQ ID NO: 876783 - RNA, 22 nt, Human
uuuauagcugugagaccuuggg

SEQ ID NO: 876784 - RNA, 22 nt, Human
aaagccaguuugucucuuuaaa

SEQ ID NO: 876785 - RNA, 22 nt, Human
uggcuggaggcaugcaagcucc

SEQ ID NO: 876786 - RNA, 22 nt, Human
ugagccugggagauggaggcug

SEQ ID NO: 876787 - RNA, 22 nt, Human
agacaaauugggacauuguguu

SEQ ID NO: 876788 - RNA, 22 nt, Human
gcucucuggcuaguccaucggg

SEQ ID NO: 876789 - RNA, 20 nt, Human
ucagggcaugggacagcccc

SEQ ID NO: 876790 - RNA, 22 nt, Human
guggggggagcugcaagcugga

SEQ ID NO: 876791 - RNA, 22 nt, Human
ucagcccugggcuuccucaugg

SEQ ID NO: 876792 - RNA, 22 nt, Human
cugugggagaggugccuggauu

SEQ ID NO: 876793 - RNA, 22 nt, Human
aggagcagcccacuccuguccu

SEQ ID NO: 876794 - RNA, 22 nt, Human
augggugugaaaauggucaucu

SEQ ID NO: 876795 - RNA, 22 nt, Human
caaaaguuauugcgguuuuugc

SEQ ID NO: 876796 - RNA, 21 nt, Human
acacagaggcaucaucacuuu

SEQ ID NO: 876797 - RNA, 23 nt, Human
acagacauuguacaucuuguuuu

SEQ ID NO: 876798 - RNA, 22 nt, Human
ggggugagcugggccugugccu

SEQ ID NO: 876799 - RNA, 22 nt, Human
ccugguguuaucauaggucaug

SEQ ID NO: 876800 - RNA, 22 nt, Human
ggcuccacccugcuuccagaag

SEQ ID NO: 876801 - RNA, 22 nt, Human
uguucauucuguauaugcugua

SEQ ID NO: 876802 - RNA, 22 nt, Human
agaguacugcugcuggguacug

SEQ ID NO: 876803 - RNA, 22 nt, Human
cacaugccuauuaaccaaacga

SEQ ID NO: 876804 - RNA, 22 nt, Human
agagggggaaaauagagguguu

SEQ ID NO: 876805 - RNA, 22 nt, Human
uucugggcauguuacauucugu

SEQ ID NO: 876806 - RNA, 22 nt, Human
uguuugcauuaauuagaaggua

SEQ ID NO: 876807 - RNA, 22 nt, Human
uuuagcauuccugggaugauuu

SEQ ID NO: 876808 - RNA, 23 nt, Human
cuguggcugaguccuguuggagu

SEQ ID NO: 876809 - RNA, 22 nt, Human
aggcuucugauaccaugagaga

SEQ ID NO: 876810 - RNA, 22 nt, Human
auuucuuaugaauauugacugu

SEQ ID NO: 876811 - RNA, 22 nt, Human
ggcagagucagaggugguucug

SEQ ID NO: 876812 - RNA, 22 nt, Human
uugccucaagauuuuuuauuga

SEQ ID NO: 876813 - RNA, 22 nt, Human
ucuguuucuucuucuguuauau

SEQ ID NO: 876814 - RNA, 22 nt, Human
auuacccaggguaggaauuccu

SEQ ID NO: 876815 - RNA, 22 nt, Human
gcgagugccgagagggcagggc

SEQ ID NO: 876816 - RNA, 23 nt, Human
cacauauagcagccacuaagguc

SEQ ID NO: 876817 - RNA, 22 nt, Human
aaaugucagaaaacauggagug

SEQ ID NO: 876818 - RNA, 20 nt, Human
gccuaagagcuagcugucac

SEQ ID NO: 876819 - RNA, 22 nt, Human
uguagaugagucagggugcaug

SEQ ID NO: 876820 - RNA, 22 nt, Human
aaacaagagcuuacauggcugc

SEQ ID NO: 876821 - RNA, 22 nt, Human
agggccucgaaggcagagggau

SEQ ID NO: 876822 - RNA, 22 nt, Human
cauggcugcuggcucggucccu

SEQ ID NO: 876823 - RNA, 21 nt, Human
caaggcuuaaacauuaaucua

SEQ ID NO: 876824 - RNA, 22 nt, Human
uaaaugcuuucuaugaaagagg

SEQ ID NO: 876825 - RNA, 22 nt, Human
acaaaggcaggauugacuuagu

SEQ ID NO: 876826 - RNA, 22 nt, Human
cugugugagugacugcaucuca

SEQ ID NO: 876827 - RNA, 21 nt, Human
uagaugaaaucagaguauuuc

SEQ ID NO: 876828 - RNA, 22 nt, Human
aaaugacagagcugggacuagu

SEQ ID NO: 876829 - RNA, 22 nt, Human
acaucacaguaguuaagccaga

SEQ ID NO: 876830 - RNA, 22 nt, Human
acugaaaugaaaucuaucaucu

SEQ ID NO: 876831 - RNA, 22 nt, Human
gagcagcuccagccgcaugacu

SEQ ID NO: 876832 - RNA, 22 nt, Human
acaggcaauuagcaagcuguua

SEQ ID NO: 876833 - RNA, 22 nt, Human
gauaauuuaagucuugggggcu

SEQ ID NO: 876834 - RNA, 20 nt, Human
acauguacuaaugaauacag

SEQ ID NO: 876835 - RNA, 22 nt, Human
aggcuggaaaucacuagauucc

SEQ ID NO: 876836 - RNA, 22 nt, Human
gcucagaguuaaauauagugcu

SEQ ID NO: 876837 - RNA, 18 nt, Human
acccaggcucaugguccu

SEQ ID NO: 876838 - RNA, 22 nt, Human
auauagguuaucauauuugccc

SEQ ID NO: 876839 - RNA, 22 nt, Human
aaggcccagcgugaccucagug

SEQ ID NO: 876840 - RNA, 22 nt, Human
acagacuguuugguucaugucu

SEQ ID NO: 876841 - RNA, 22 nt, Human
uauuugaagauucuucugaugu

SEQ ID NO: 876842 - RNA, 22 nt, Human
gcccggccaggaacagaguaua

SEQ ID NO: 876843 - RNA, 22 nt, Human
uuugaaaacuuaauuuggucgu

SEQ ID NO: 876844 - RNA, 22 nt, Human
gugcucuagaaauagucagugg

SEQ ID NO: 876845 - RNA, 22 nt, Human
acacugucugggacucaggagu

SEQ ID NO: 876846 - RNA, 22 nt, Human
cagggcuuacuggaggcugcuu

SEQ ID NO: 876847 - RNA, 17 nt, Human
guguccaggccgauggc

SEQ ID NO: 876848 - RNA, 19 nt, Human
gcccugcaggagguggggc

SEQ ID NO: 876849 - RNA, 18 nt, Human
uguuuccuccuggaggcu

SEQ ID NO: 876850 - RNA, 22 nt, Human
uuuacaacuuucuguucuguau

SEQ ID NO: 876851 - RNA, 23 nt, Human
acuauaaaguuguucugauuuac

SEQ ID NO: 876852 - RNA, 22 nt, Human
ccugcucuuauagcuguuucca

SEQ ID NO: 876853 - RNA, 22 nt, Human
gcccagcugagaagcgcggggc

SEQ ID NO: 876854 - RNA, 22 nt, Human
aucaaaacccagacaggcugga

SEQ ID NO: 876855 - RNA, 22 nt, Human
caaagcugugaauuccuacaaa

SEQ ID NO: 876856 - RNA, 22 nt, Human
gccaggugcauggcugagucuc

SEQ ID NO: 876857 - RNA, 22 nt, Human
agggaagcaauauuagauauca

SEQ ID NO: 876858 - RNA, 22 nt, Human
aguuauuucaguaacauaauag

SEQ ID NO: 876859 - RNA, 22 nt, Human
ucaggucuguacuauugucuug

SEQ ID NO: 876860 - RNA, 19 nt, Human
gcagguggauguggucagc

SEQ ID NO: 876861 - RNA, 22 nt, Human
auuuccuucccagauuugguuc

SEQ ID NO: 876862 - RNA, 22 nt, Human
gccuggcugucaaacccagaag

SEQ ID NO: 876863 - RNA, 22 nt, Human
aaagauuucagaagccugugcc

SEQ ID NO: 876864 - RNA, 22 nt, Human
cuccuccagcucucccuggggg

SEQ ID NO: 876865 - RNA, 22 nt, Human
ggaaggguuuaagcaggagagu

SEQ ID NO: 876866 - RNA, 22 nt, Human
aguuaagaauacacaucauaau

SEQ ID NO: 876867 - RNA, 18 nt, Human
uguaaacacuuucauucu

SEQ ID NO: 876868 - RNA, 22 nt, Human
ucucuucccuuuaugguaugug

SEQ ID NO: 876869 - RNA, 22 nt, Human
guccagagaguaaaggggguaa

SEQ ID NO: 876870 - RNA, 22 nt, Human
aggcuucacucgacaugccaau

SEQ ID NO: 876871 - RNA, 22 nt, Human
ucagaauuggacaauagaagca

SEQ ID NO: 876872 - RNA, 22 nt, Human
acuuuagagaaauguagaagua

SEQ ID NO: 876873 - RNA, 22 nt, Human
gcugggcaaggcugaagcuacc

SEQ ID NO: 876874 - RNA, 22 nt, Human
acagaguccuagcugcaaagaa

SEQ ID NO: 876875 - RNA, 22 nt, Human
aagugucuacauuugcuaacca

SEQ ID NO: 876876 - RNA, 22 nt, Human
cacugaggcuuccuuaggcaau

SEQ ID NO: 876877 - RNA, 21 nt, Human
aggcagcaucugauuuauaug

SEQ ID NO: 876878 - RNA, 22 nt, Human
auaaagucugggccaggcaugg

SEQ ID NO: 876879 - RNA, 22 nt, Human
acaggucuccagagugagagga

SEQ ID NO: 876880 - RNA, 21 nt, Human
ggaaaacuuuccuugucugaa

SEQ ID NO: 876881 - RNA, 22 nt, Human
ccaggacagggagacgggagcc

SEQ ID NO: 876882 - RNA, 22 nt, Human
gcugucugcugggucgcucagg

SEQ ID NO: 876883 - RNA, 22 nt, Human
uuuauaaacaguaccacggugc

SEQ ID NO: 876884 - RNA, 22 nt, Human
gccuggcuggucacugccuggc

SEQ ID NO: 876885 - RNA, 20 nt, Human
ugcagcacgggcccuuucca

SEQ ID NO: 876886 - RNA, 22 nt, Human
ggaauguuugcucccuucaggg

SEQ ID NO: 876887 - RNA, 22 nt, Human
auggcagagaaagcgagccaca

SEQ ID NO: 876888 - RNA, 22 nt, Human
acagcuuuuuacuaauagauug

SEQ ID NO: 876889 - RNA, 22 nt, Human
aguggcaggcagaagcuucuca

SEQ ID NO: 876890 - RNA, 22 nt, Human
uaagaacucgugaucauuugaa

SEQ ID NO: 876891 - RNA, 22 nt, Human
uuacacaauuuuauugaccuaa

SEQ ID NO: 876892 - RNA, 22 nt, Human
guacauauuacagacaaagcuu

SEQ ID NO: 876893 - RNA, 22 nt, Human
aaagggcugaaguagucucugu

SEQ ID NO: 876894 - RNA, 22 nt, Human
aucucugcguccccagcaucga

SEQ ID NO: 876895 - RNA, 22 nt, Human
augcaucauggaaaacucaguu

SEQ ID NO: 876896 - RNA, 20 nt, Human
aagaggcuguggauccuacu

SEQ ID NO: 876897 - RNA, 22 nt, Human
cagagggcugcccugaguucgu

SEQ ID NO: 876898 - RNA, 22 nt, Human
caaagguuguugagagugcagg

SEQ ID NO: 876899 - RNA, 22 nt, Human
cacaaaauaucaagcacuuuua

SEQ ID NO: 876900 - RNA, 22 nt, Human
aaaguguggucguucauuuugu

SEQ ID NO: 876901 - RNA, 22 nt, Human
ugaaugcagagacugugggaaa

SEQ ID NO: 876902 - RNA, 22 nt, Human
cagugagguggauggauggccu

SEQ ID NO: 876903 - RNA, 22 nt, Human
uugacacagucaacuugauuuu

SEQ ID NO: 876904 - RNA, 22 nt, Human
guuucuuaaauguagcaggacc

SEQ ID NO: 876905 - RNA, 22 nt, Human
ggaaagagcuaaaagggugaga

SEQ ID NO: 876906 - RNA, 22 nt, Human
agcuuuaugaggagaccuuagu

SEQ ID NO: 876907 - RNA, 22 nt, Human
aaagucucaggcaaaccaggac

SEQ ID NO: 876908 - RNA, 22 nt, Human
cucagggacggaggcuugcgga

SEQ ID NO: 876909 - RNA, 17 nt, Human
accugacaguacagugu

SEQ ID NO: 876910 - RNA, 22 nt, Human
ggagcccugcccuaggcagcuc

SEQ ID NO: 876911 - RNA, 22 nt, Human
auacaguuagaaaaaaagccuu

SEQ ID NO: 876912 - RNA, 22 nt, Human
gcugccucacuccagcccaaua

SEQ ID NO: 876913 - RNA, 22 nt, Human
accagagaauuuagccaagaaa

SEQ ID NO: 876914 - RNA, 21 nt, Human
ugaggcaggggugcuuuuguc

SEQ ID NO: 876915 - RNA, 22 nt, Human
gcuuuaugagugaggcaggaua

SEQ ID NO: 876916 - RNA, 22 nt, Human
caguguuuccgucaguauguga

SEQ ID NO: 876917 - RNA, 22 nt, Human
gggagcaggacauaauagcaau

SEQ ID NO: 876918 - RNA, 22 nt, Human
cagccucucuguaucucaggau

SEQ ID NO: 876919 - RNA, 22 nt, Human
acucauuuaaacauuuacugaa

SEQ ID NO: 876920 - RNA, 22 nt, Human
acauuugauauggaguugugua

SEQ ID NO: 876921 - RNA, 23 nt, Human
gcucagguggcucagggacugau

SEQ ID NO: 876922 - RNA, 22 nt, Human
ucucaucuauucacauuaacug

SEQ ID NO: 876923 - RNA, 22 nt, Human
ggcugaaguguaguggcucacu

SEQ ID NO: 876924 - RNA, 22 nt, Human
aagugaauguagcaaacuugaa

SEQ ID NO: 876925 - RNA, 22 nt, Human
ugggcucaugcuggagaugaga

SEQ ID NO: 876926 - RNA, 22 nt, Human
ugucaccuggaaaucacucuaa

SEQ ID NO: 876927 - RNA, 22 nt, Human
ucacuggugugagaggagcaaa

SEQ ID NO: 876928 - RNA, 22 nt, Human
uauaacaguuuaggugguguca

SEQ ID NO: 876929 - RNA, 22 nt, Human
aagcugccacacggugaguacu

SEQ ID NO: 876930 - RNA, 21 nt, Human
caguguugauauuuaauacau

SEQ ID NO: 876931 - RNA, 22 nt, Human
auucuugcuucacacuccucug

SEQ ID NO: 876932 - RNA, 22 nt, Human
ugaaggcccagccacagaaugg

SEQ ID NO: 876933 - RNA, 22 nt, Human
ugcuugcugggccaauggcaau

SEQ ID NO: 876934 - RNA, 22 nt, Human
gccugcccugaaagaggugaag

SEQ ID NO: 876935 - RNA, 22 nt, Human
acauaugagguguuauucuaug

SEQ ID NO: 876936 - RNA, 22 nt, Human
uccauugcucaauauagaguuu

SEQ ID NO: 876937 - RNA, 22 nt, Human
cagugcauagauccugaggccu

SEQ ID NO: 876938 - RNA, 22 nt, Human
agcagcaaaagagaauaguuug

SEQ ID NO: 876939 - RNA, 22 nt, Human
uuugaaaguccuaggagagucc

SEQ ID NO: 876940 - RNA, 21 nt, Human
agguggggcugcaccucugcu

SEQ ID NO: 876941 - RNA, 22 nt, Human
ggcagccauggacacuggcuag

SEQ ID NO: 876942 - RNA, 21 nt, Human
aaguuucucccuaauuguugc

SEQ ID NO: 876943 - RNA, 22 nt, Human
cuuagaacauucugccugggaa

SEQ ID NO: 876944 - RNA, 22 nt, Human
ggcaguggguggaucucaggga

SEQ ID NO: 876945 - RNA, 22 nt, Human
uuugucaccaguggcuuuggua

SEQ ID NO: 876946 - RNA, 22 nt, Human
cucucccuaugccucccaggag

SEQ ID NO: 876947 - RNA, 20 nt, Human
cucucucuccauucccaggg

SEQ ID NO: 876948 - RNA, 22 nt, Human
gaaagguucuugggaguucaca

SEQ ID NO: 876949 - RNA, 22 nt, Human
cuuguaaaauauccaguuaagg

SEQ ID NO: 876950 - RNA, 22 nt, Human
uaggaagaaacuuucccugcag

SEQ ID NO: 876951 - RNA, 22 nt, Human
ugggucacaaaggccagaugau

SEQ ID NO: 876952 - RNA, 22 nt, Human
agcuccagcccaucugcucgug

SEQ ID NO: 876953 - RNA, 22 nt, Human
ugcccugguuacacuggagucc

SEQ ID NO: 876954 - RNA, 22 nt, Human
ugacaaacccugcaaauagcuc

SEQ ID NO: 876955 - RNA, 20 nt, Human
ugcaguguccucacuuguca

SEQ ID NO: 876956 - RNA, 22 nt, Human
ggcuucagugagcugagcucac

SEQ ID NO: 876957 - RNA, 22 nt, Human
uaauacaguagcuuuuacacag

SEQ ID NO: 876958 - RNA, 17 nt, Human
uguuuucugcuaccuuu

SEQ ID NO: 876959 - RNA, 22 nt, Human
cggcuggggcuguccccaugac

SEQ ID NO: 876960 - RNA, 22 nt, Human
acagagacucaugaaagaugac

SEQ ID NO: 876961 - RNA, 22 nt, Human
cugagcagugcuuugcaguggg

SEQ ID NO: 876962 - RNA, 22 nt, Human
agcugccucagcaacacagacc

SEQ ID NO: 876963 - RNA, 22 nt, Human
cuggagcauuuucugcuucugc

SEQ ID NO: 876964 - RNA, 22 nt, Human
ugcauuuguaacauucaagaau

SEQ ID NO: 876965 - RNA, 22 nt, Human
aaacaguucucauuuguuuaga

SEQ ID NO: 876966 - RNA, 22 nt, Human
acugagggguuggagagugagg

SEQ ID NO: 876967 - RNA, 22 nt, Human
gauucaaaaauaagcuccuauu

SEQ ID NO: 876968 - RNA, 22 nt, Human
uugggacaucuggcauacaguu

SEQ ID NO: 876969 - RNA, 22 nt, Human
ggagcugugggacgcuguccca

SEQ ID NO: 876970 - RNA, 22 nt, Human
augacacccccacagcauuguu

SEQ ID NO: 876971 - RNA, 22 nt, Human
agaaagggaugagguagcugcu

SEQ ID NO: 876972 - RNA, 22 nt, Human
ugucuuaauaugugcauucugu

SEQ ID NO: 876973 - RNA, 22 nt, Human
aaagcaugguuaaagacagugg

SEQ ID NO: 876974 - RNA, 22 nt, Human
cuggagccuucaccaggggaaa

SEQ ID NO: 876975 - RNA, 22 nt, Human
auuuccaguacuauuuucugcu

SEQ ID NO: 876976 - RNA, 22 nt, Human
ugcaguccuggugaggggacau

SEQ ID NO: 876977 - RNA, 22 nt, Human
agaguggcccguuggccugaac

SEQ ID NO: 876978 - RNA, 22 nt, Human
ccagcaucgacuuccugccuga

SEQ ID NO: 876979 - RNA, 22 nt, Human
aggcagcauuugaauccagguc

SEQ ID NO: 876980 - RNA, 22 nt, Human
acccugaagaaacuucuaagug

SEQ ID NO: 876981 - RNA, 22 nt, Human
uaguuuuacuugcgaugauaau

SEQ ID NO: 876982 - RNA, 22 nt, Human
agacagcugggaguguccuucu

SEQ ID NO: 876983 - RNA, 22 nt, Human
uaaagugcccagggaaagcggg

SEQ ID NO: 876984 - RNA, 22 nt, Human
ucagggccacgcggaggugacg

SEQ ID NO: 876985 - RNA, 22 nt, Human
cugcccuggguuuuaugggagu

SEQ ID NO: 876986 - RNA, 22 nt, Human
ccuuucccgcuuugagggcaag

SEQ ID NO: 876987 - RNA, 22 nt, Human
gagcugccaguguaugaauucu

SEQ ID NO: 876988 - RNA, 22 nt, Human
ucuauacugaugggauacuauu

SEQ ID NO: 876989 - RNA, 22 nt, Human
agcacagauucugaagaguccu

SEQ ID NO: 876990 - RNA, 22 nt, Human
aggaauuauuugucuuagucuu

SEQ ID NO: 876991 - RNA, 22 nt, Human
aguuuggaagucaggcuuuucu

SEQ ID NO: 876992 - RNA, 22 nt, Human
uuuagagaguguaaaaauauau

SEQ ID NO: 876993 - RNA, 23 nt, Human
uagacugcaggcuccuugagggc

SEQ ID NO: 876994 - RNA, 23 nt, Human
agauuuggaaagcugaguggcgu

SEQ ID NO: 876995 - RNA, 22 nt, Human
cagggugggcacccagccucca

SEQ ID NO: 876996 - RNA, 22 nt, Human
uggcagcugguacagugggucu

SEQ ID NO: 876997 - RNA, 22 nt, Human
ucuagggaaccuauccuaugau

SEQ ID NO: 876998 - RNA, 22 nt, Human
aggccuggccuuuauguucaag

SEQ ID NO: 876999 - RNA, 22 nt, Human
agcgggcucaaguggccagcag

SEQ ID NO: 877000 - RNA, 22 nt, Human
uaggaaugggcaagacaaagaa

SEQ ID NO: 877001 - RNA, 22 nt, Human
uaagacauccguugcuuauaau

SEQ ID NO: 877002 - RNA, 20 nt, Human
acaaaugcauucugugacau

SEQ ID NO: 877003 - RNA, 22 nt, Human
uagcagaaacuguuacagaagg

SEQ ID NO: 877004 - RNA, 22 nt, Human
aucagucauauccaaauuagca

SEQ ID NO: 877005 - RNA, 22 nt, Human
cugagcaggcgguggagcggcu

SEQ ID NO: 877006 - RNA, 22 nt, Human
auacccaggcuuauguugguca

SEQ ID NO: 877007 - RNA, 22 nt, Human
uuuggaaugguaccuucaguug

SEQ ID NO: 877008 - RNA, 22 nt, Human
ccuggagauuauuugguccaau

SEQ ID NO: 877009 - RNA, 22 nt, Human
ugcucccagcuccugcagcaac

SEQ ID NO: 877010 - RNA, 22 nt, Human
acagugcccuaugaacagcucu

SEQ ID NO: 877011 - RNA, 22 nt, Human
aucaaagugguuuucugugcuu

SEQ ID NO: 877012 - RNA, 22 nt, Human
uuuggaaaauauugaacugguu

SEQ ID NO: 877013 - RNA, 22 nt, Human
uucauguuucauuuguuacuau

SEQ ID NO: 877014 - RNA, 22 nt, Human
aguguuauuuuucaaaggcccu

SEQ ID NO: 877015 - RNA, 22 nt, Human
accugggaaagccguggaaagg

SEQ ID NO: 877016 - RNA, 22 nt, Human
ggcagcauccgcccggcacccu

SEQ ID NO: 877017 - RNA, 22 nt, Human
ccuggcucugggaucuucgcuu

SEQ ID NO: 877018 - RNA, 22 nt, Human
ggagaaggaauauuggaguagg

SEQ ID NO: 877019 - RNA, 17 nt, Human
ugcugucugcuucccua

SEQ ID NO: 877020 - RNA, 22 nt, Human
uccaggagguagugcuuaauuu

SEQ ID NO: 877021 - RNA, 22 nt, Human
cuucagugaauguugaguaagg

SEQ ID NO: 877022 - RNA, 22 nt, Human
ccauucuuucagugucucaugu

SEQ ID NO: 877023 - RNA, 23 nt, Human
ugcucaauagaccauaauaucca

SEQ ID NO: 877024 - RNA, 22 nt, Human
uuccuggcaaagugagcaucac

SEQ ID NO: 877025 - RNA, 22 nt, Human
ugucuucacaugauaagccauu

SEQ ID NO: 877026 - RNA, 22 nt, Human
acagaagcaaaagcaggaucuu

SEQ ID NO: 877027 - RNA, 19 nt, Human
gccagcagaaugaugaggc

SEQ ID NO: 877028 - RNA, 22 nt, Human
aaccuaggacuauagauaucau

SEQ ID NO: 877029 - RNA, 22 nt, Human
uaacacuguccaaagaauucca

SEQ ID NO: 877030 - RNA, 22 nt, Human
aucucuaauuuaaaaaguaaca

SEQ ID NO: 877031 - RNA, 22 nt, Human
caugaaaaauuuacuguuaaca

SEQ ID NO: 877032 - RNA, 22 nt, Human
gguggccucgguggugcacagg

SEQ ID NO: 877033 - RNA, 22 nt, Human
gcugcccugccucagacuccuc

SEQ ID NO: 877034 - RNA, 22 nt, Human
ugggcacaaacaucugccuguu

SEQ ID NO: 877035 - RNA, 22 nt, Human
ugaguccaagagccagugggaa

SEQ ID NO: 877036 - RNA, 22 nt, Human
uaacauauuguguggcacuagg

SEQ ID NO: 877037 - RNA, 19 nt, Human
ugugugcccucaccacaua

SEQ ID NO: 877038 - RNA, 22 nt, Human
aggcagcagcuugcugguugcc

SEQ ID NO: 877039 - RNA, 22 nt, Human
ugacugaaauugcauuuuaaaa

SEQ ID NO: 877040 - RNA, 22 nt, Human
ucccagagcaguacuccaggag

SEQ ID NO: 877041 - RNA, 22 nt, Human
ucauggggugaauuaguaugcu

SEQ ID NO: 877042 - RNA, 22 nt, Human
guccucagagugggcagguccu

SEQ ID NO: 877043 - RNA, 22 nt, Human
uucauucacccaggaaacaucu

SEQ ID NO: 877044 - RNA, 22 nt, Human
augggcaguaacaguggcaguc

SEQ ID NO: 877045 - RNA, 22 nt, Human
uggaauguaaucagaauaugaa

SEQ ID NO: 877046 - RNA, 22 nt, Human
auuucagcccaguaugagcccc

SEQ ID NO: 877047 - RNA, 22 nt, Human
uuauguguaccucaaucugagg

SEQ ID NO: 877048 - RNA, 21 nt, Human
ugggagagcguugcuguccuc

SEQ ID NO: 877049 - RNA, 22 nt, Human
agaagccagccuugccuccuuu

SEQ ID NO: 877050 - RNA, 22 nt, Human
aaaguucuauguaauguuuuuu

SEQ ID NO: 877051 - RNA, 22 nt, Human
ucuggaauagguccugaguauu

SEQ ID NO: 877052 - RNA, 22 nt, Human
ccuucucucugaagaccccaaa

SEQ ID NO: 877053 - RNA, 22 nt, Human
augagaugugucuaauggaacc

SEQ ID NO: 877054 - RNA, 23 nt, Human
uggcccugaaucuguccuggagg

SEQ ID NO: 877055 - RNA, 17 nt, Human
acagugagaagucaucu

SEQ ID NO: 877056 - RNA, 22 nt, Human
ugaggggagcccgcccuggacg

SEQ ID NO: 877057 - RNA, 22 nt, Human
aggaggaagggaagacaaguaa

SEQ ID NO: 877058 - RNA, 22 nt, Human
guagacagcaaccaaaccaggu

SEQ ID NO: 877059 - RNA, 22 nt, Human
gaauguaagugggcagaagaca

SEQ ID NO: 877060 - RNA, 22 nt, Human
acaggucuacuggcaagcagug

SEQ ID NO: 877061 - RNA, 22 nt, Human
caguaacauuucaagguagagg

SEQ ID NO: 877062 - RNA, 22 nt, Human
cuugagaaugugagccacagau

SEQ ID NO: 877063 - RNA, 22 nt, Human
uacaaagcuguauagccugguc

SEQ ID NO: 877064 - RNA, 22 nt, Human
gucaauauagaucaaugcacag

SEQ ID NO: 877065 - RNA, 22 nt, Human
gugugcagucugcuaggcaggg

SEQ ID NO: 877066 - RNA, 22 nt, Human
uggcaacucaauuucuacaaga

SEQ ID NO: 877067 - RNA, 19 nt, Human
ccaggcuuuaugcaaauac

SEQ ID NO: 877068 - RNA, 22 nt, Human
ugcuuaaaaagcuccaucaaua

SEQ ID NO: 877069 - RNA, 22 nt, Human
ucaauucugguccucaggaacu

SEQ ID NO: 877070 - RNA, 17 nt, Human
ugaggcucggugaggag

SEQ ID NO: 877071 - RNA, 22 nt, Human
auuucuuuucaagagggugcuu

SEQ ID NO: 877072 - RNA, 22 nt, Human
uacauacauauucauacaggug

SEQ ID NO: 877073 - RNA, 22 nt, Human
ucuccagggagguagcccagug

SEQ ID NO: 877074 - RNA, 22 nt, Human
uucuagaacaggcaaaaccaau

SEQ ID NO: 877075 - RNA, 22 nt, Human
ggccugcugggccccacagucc

SEQ ID NO: 877076 - RNA, 22 nt, Human
ggcuagggaaauccugauccaa

SEQ ID NO: 877077 - RNA, 22 nt, Human
uucuaucucauauguguucuag

SEQ ID NO: 877078 - RNA, 22 nt, Human
guaagcaaacagcaaaugauuu

SEQ ID NO: 877079 - RNA, 22 nt, Human
gcugucugggaugucacugcug

SEQ ID NO: 877080 - RNA, 22 nt, Human
aaguggugguaugaaccgaggg

SEQ ID NO: 877081 - RNA, 22 nt, Human
ucacucuggccucugcagcagu

SEQ ID NO: 877082 - RNA, 22 nt, Human
uaacacugugucugccauaucc

SEQ ID NO: 877083 - RNA, 22 nt, Human
ucuccccagggguauggguauu

SEQ ID NO: 877084 - RNA, 22 nt, Human
gcuccuggcucuggccaaggga

SEQ ID NO: 877085 - RNA, 16 nt, Human
cucagcuaaggagagg

SEQ ID NO: 877086 - RNA, 22 nt, Human
agcugccuguaaaaugugugau

SEQ ID NO: 877087 - RNA, 22 nt, Human
ggccagaaguuggaaaagagcc

SEQ ID NO: 877088 - RNA, 22 nt, Human
ugagguggaaggauccuuugaa

SEQ ID NO: 877089 - RNA, 22 nt, Human
ucugacccagauggcaccgugg

SEQ ID NO: 877090 - RNA, 22 nt, Human
ucugcgugaauuugcauugugg

SEQ ID NO: 877091 - RNA, 22 nt, Human
uggcuucugcauauuuuuagag

SEQ ID NO: 877092 - RNA, 22 nt, Human
ugugggaggauucagaauuggg

SEQ ID NO: 877093 - RNA, 22 nt, Human
ccagcucucugcagaaaggacu

SEQ ID NO: 877094 - RNA, 19 nt, Human
uaguaguagaaaacaauac

SEQ ID NO: 877095 - RNA, 22 nt, Human
agagcuggagaugcagguuucg

SEQ ID NO: 877096 - RNA, 23 nt, Human
aggaagcuaccaauuuuguaggc

SEQ ID NO: 877097 - RNA, 22 nt, Human
gcuucgggguccaagcgcgugu

SEQ ID NO: 877098 - RNA, 22 nt, Human
cugcauguguuauauuugguuc

SEQ ID NO: 877099 - RNA, 22 nt, Human
uggagcaggugcucaggguaau

SEQ ID NO: 877100 - RNA, 19 nt, Human
cgcaggagccgaggugacc

SEQ ID NO: 877101 - RNA, 22 nt, Human
gagguuggcgcccugccuggcc

SEQ ID NO: 877102 - RNA, 22 nt, Human
caguggggggacugaggccuga

SEQ ID NO: 877103 - RNA, 22 nt, Human
cuuggagauacagaggacauuu

SEQ ID NO: 877104 - RNA, 22 nt, Human
cagagggaucaucuuccugaag

SEQ ID NO: 877105 - RNA, 22 nt, Human
gcugagccuagcugucuccugu

SEQ ID NO: 877106 - RNA, 22 nt, Human
gugagacaucuugggaagugau

SEQ ID NO: 877107 - RNA, 22 nt, Human
ugcaagggcuuagggggcugug

SEQ ID NO: 877108 - RNA, 22 nt, Human
uccaguugcccaucucucuucu

SEQ ID NO: 877109 - RNA, 22 nt, Human
acaaaagugagugugucucaga

SEQ ID NO: 877110 - RNA, 22 nt, Human
gcuggacucaggggacucaggg

SEQ ID NO: 877111 - RNA, 22 nt, Human
ucuccaggcuuaaucucagcuu

SEQ ID NO: 877112 - RNA, 22 nt, Human
uugcuguuucucugugucuggu

SEQ ID NO: 877113 - RNA, 22 nt, Human
aaaugaguuugccucuagauag

SEQ ID NO: 877114 - RNA, 18 nt, Human
ucacagaauauugagugg

SEQ ID NO: 877115 - RNA, 22 nt, Human
aaagcagcugauagucucaucu

SEQ ID NO: 877116 - RNA, 22 nt, Human
ccuccugggccuugcucuguga

SEQ ID NO: 877117 - RNA, 22 nt, Human
agugguuacucaagcaaaucuc

SEQ ID NO: 877118 - RNA, 22 nt, Human
cucugggaccauggcaagugcg

SEQ ID NO: 877119 - RNA, 20 nt, Human
aaacucuaccucaaucguca

SEQ ID NO: 877120 - RNA, 22 nt, Human
aauuuccugggauaaaaagcca

SEQ ID NO: 877121 - RNA, 22 nt, Human
ggcuaggggaauaaucuguggu

SEQ ID NO: 877122 - RNA, 22 nt, Human
agacagacauucuagagccacc

SEQ ID NO: 877123 - RNA, 22 nt, Human
gcacccagagggcagggucucc

SEQ ID NO: 877124 - RNA, 22 nt, Human
gagaaucuuuccccacagaagg

SEQ ID NO: 877125 - RNA, 22 nt, Human
ugguggcagugagaaggagagg

SEQ ID NO: 877126 - RNA, 22 nt, Human
uucccacauucuuuacauucau

SEQ ID NO: 877127 - RNA, 22 nt, Human
uccagcccgacugggccugccg

SEQ ID NO: 877128 - RNA, 22 nt, Human
cagcugugauaugccugccuga

SEQ ID NO: 877129 - RNA, 22 nt, Human
aguucauauugaaagcagguga

SEQ ID NO: 877130 - RNA, 22 nt, Human
ucucuugacugcuaaaauuaga

SEQ ID NO: 877131 - RNA, 22 nt, Human
caugcagucuggagccuucugu

SEQ ID NO: 877132 - RNA, 22 nt, Human
ugggagaguuuguuuagaguga

SEQ ID NO: 877133 - RNA, 22 nt, Human
aaaguugaccgaaagauuuuga

SEQ ID NO: 877134 - RNA, 22 nt, Human
ggugcagaguccacagaaagcu

SEQ ID NO: 877135 - RNA, 22 nt, Human
gcugcccucccagggcaagcuu

SEQ ID NO: 877136 - RNA, 22 nt, Human
auacagcagcccuugcuuugca

SEQ ID NO: 877137 - RNA, 22 nt, Human
gcugugugacccuagccaguag

SEQ ID NO: 877138 - RNA, 22 nt, Human
acugggccuguacagagaaaac

SEQ ID NO: 877139 - RNA, 20 nt, Human
aauguauauuuuaugccagg

SEQ ID NO: 877140 - RNA, 22 nt, Human
aagcaacauucucuguggcauu

SEQ ID NO: 877141 - RNA, 22 nt, Human
uucuauuucuuaaucuuggcug

SEQ ID NO: 877142 - RNA, 20 nt, Human
ccugggcuccaggagccccg

SEQ ID NO: 877143 - RNA, 22 nt, Human
aaggaccugauuuugagcaucu

SEQ ID NO: 877144 - RNA, 22 nt, Human
auuuaaaugcuuaagaggguuu

SEQ ID NO: 877145 - RNA, 22 nt, Human
aaaguugcuguccuagcuggcu

SEQ ID NO: 877146 - RNA, 22 nt, Human
gcacagccacugagugagaacc

SEQ ID NO: 877147 - RNA, 22 nt, Human
gcagaggacagggauuuagauu

SEQ ID NO: 877148 - RNA, 22 nt, Human
aacauccccuucaugucaugau

SEQ ID NO: 877149 - RNA, 22 nt, Human
gucuuuaagggacugaauuugg

SEQ ID NO: 877150 - RNA, 22 nt, Human
aauugcauauauaugaggccau

SEQ ID NO: 877151 - RNA, 22 nt, Human
uuugugaacaaacaugaagaug

SEQ ID NO: 877152 - RNA, 22 nt, Human
gucuuauuaaaaaucuaauccc

SEQ ID NO: 877153 - RNA, 22 nt, Human
cccugaggagagcgcuucccga

SEQ ID NO: 877154 - RNA, 22 nt, Human
aguucucuuuagcucauauggu

SEQ ID NO: 877155 - RNA, 22 nt, Human
gaagguguccacuucucaccuc

SEQ ID NO: 877156 - RNA, 22 nt, Human
uauagaacaaguuauuuaugcu

SEQ ID NO: 877157 - RNA, 22 nt, Human
gagagaggccuccauguacuga

SEQ ID NO: 877158 - RNA, 22 nt, Human
aucuacauaaaacgaauacaua

SEQ ID NO: 877159 - RNA, 22 nt, Human
uuguaaaugaccuuuucuaauu

SEQ ID NO: 877160 - RNA, 22 nt, Human
ugucuuauguagauacugagaa

SEQ ID NO: 877161 - RNA, 22 nt, Human
gcuacacaauagcguucacuua

SEQ ID NO: 877162 - RNA, 17 nt, Human
ucugaggccucuaggag

SEQ ID NO: 877163 - RNA, 22 nt, Human
ggcgccagcccaggccgucgug

SEQ ID NO: 877164 - RNA, 17 nt, Human
aaauaugaccucaaagu

SEQ ID NO: 877165 - RNA, 22 nt, Human
cuucacaguaaauccagaagaa

SEQ ID NO: 877166 - RNA, 22 nt, Human
uauguacucuaauuugucucau

SEQ ID NO: 877167 - RNA, 22 nt, Human
uagagucuaguguauacaaagu

SEQ ID NO: 877168 - RNA, 19 nt, Human
acucaagucuaaugaaauc

SEQ ID NO: 877169 - RNA, 22 nt, Human
gcccagcuccucugcagacccu

SEQ ID NO: 877170 - RNA, 22 nt, Human
gcccucugcucagcuccucagc

SEQ ID NO: 877171 - RNA, 22 nt, Human
ggagccuggccuggcucugugu

SEQ ID NO: 877172 - RNA, 22 nt, Human
gcuuaaugagcagagaaucuac

SEQ ID NO: 877173 - RNA, 22 nt, Human
ucacagcacccugaggugcugg

SEQ ID NO: 877174 - RNA, 22 nt, Human
gaguauaaguaauuucaagcaa

SEQ ID NO: 877175 - RNA, 22 nt, Human
uaacuguaguuauaaagcuauc

SEQ ID NO: 877176 - RNA, 22 nt, Human
uucacaaaacacuauuuucugg

SEQ ID NO: 877177 - RNA, 20 nt, Human
cuccaaggcuugcaggaggc

SEQ ID NO: 877178 - RNA, 22 nt, Human
uauagaagagacaugugcauag

SEQ ID NO: 877179 - RNA, 22 nt, Human
cagccagaggcugcgaggggcc

SEQ ID NO: 877180 - RNA, 22 nt, Human
uucuguucugauacuuguuucu

SEQ ID NO: 877181 - RNA, 22 nt, Human
accaggacuuuguauucagcuu

SEQ ID NO: 877182 - RNA, 22 nt, Human
gcauuuguguucuuccuagagc

SEQ ID NO: 877183 - RNA, 22 nt, Human
uuuuuauaugaaggauagugcg

SEQ ID NO: 877184 - RNA, 22 nt, Human
aaaauggcuguggucuggcaag

SEQ ID NO: 877185 - RNA, 22 nt, Human
ucugccuguugagccuaaggcc

SEQ ID NO: 877186 - RNA, 22 nt, Human
ugugaggaugugagcgugaacc

SEQ ID NO: 877187 - RNA, 22 nt, Human
cggcagagcggcgagccccucc

SEQ ID NO: 877188 - RNA, 22 nt, Human
uggcucagccagcccuaggaac

SEQ ID NO: 877189 - RNA, 22 nt, Human
ucagaagucacuuaggaaaggg

SEQ ID NO: 877190 - RNA, 19 nt, Human
caggacaguuugccaagaa

SEQ ID NO: 877191 - RNA, 22 nt, Human
cucacugacugcaagucaaguu

SEQ ID NO: 877192 - RNA, 22 nt, Human
ucaauuauuugauaugaaaggg

SEQ ID NO: 877193 - RNA, 22 nt, Human
agauucagaaaauucucuguuc

SEQ ID NO: 877194 - RNA, 20 nt, Human
aacauugaaagucuagaaga

SEQ ID NO: 877195 - RNA, 22 nt, Human
agccacagcuccuugguggaga

SEQ ID NO: 877196 - RNA, 22 nt, Human
uccugccucuugccuucuucac

SEQ ID NO: 877197 - RNA, 20 nt, Human
ggcuucacucugcaccacca

SEQ ID NO: 877198 - RNA, 22 nt, Human
auuucucaggacuccaugggcg

SEQ ID NO: 877199 - RNA, 21 nt, Human
uagaaucacuaauaagaugua

SEQ ID NO: 877200 - RNA, 19 nt, Human
cuggcuucaagcaguccuc

SEQ ID NO: 877201 - RNA, 22 nt, Human
ccacugucuuuuccaggcugaa

SEQ ID NO: 877202 - RNA, 22 nt, Human
aagcccaguaccuucagugagg

SEQ ID NO: 877203 - RNA, 22 nt, Human
uauuugcugugcuuauuccauu

SEQ ID NO: 877204 - RNA, 22 nt, Human
aaaugaguuuccucaauguccu

SEQ ID NO: 877205 - RNA, 23 nt, Human
gggagaauaugaggaugauggug

SEQ ID NO: 877206 - RNA, 22 nt, Human
guuugacacggugcgucuucag

SEQ ID NO: 877207 - RNA, 22 nt, Human
gugccuggaaugcgccucggcg

SEQ ID NO: 877208 - RNA, 22 nt, Human
cuaugaccccagcaugaauaag

SEQ ID NO: 877209 - RNA, 22 nt, Human
ugugccagugccuuggguauua

SEQ ID NO: 877210 - RNA, 22 nt, Human
ugucuccuauuuccugcuaagg

SEQ ID NO: 877211 - RNA, 22 nt, Human
acaguggccucaaagaaagaga

SEQ ID NO: 877212 - RNA, 22 nt, Human
agugucuguuacgcuugcagaa

SEQ ID NO: 877213 - RNA, 22 nt, Human
agagcuggccagggaucacucu

SEQ ID NO: 877214 - RNA, 22 nt, Human
aaaaugcaaaccuaccuacaua

SEQ ID NO: 877215 - RNA, 22 nt, Human
agaaaucacaggaggcagaagg

SEQ ID NO: 877216 - RNA, 22 nt, Human
aggcccuggguuagggcccacu

SEQ ID NO: 877217 - RNA, 22 nt, Human
caagaggcuaaacugggcuauu

SEQ ID NO: 877218 - RNA, 22 nt, Human
gggaacagaggaggguguugcu

SEQ ID NO: 877219 - RNA, 22 nt, Human
ggaaaccaggacugcaccgucu

SEQ ID NO: 877220 - RNA, 22 nt, Human
uggcuggaaacaggagauucag

SEQ ID NO: 877221 - RNA, 23 nt, Human
ggcuccuggauucaaauccugcc

SEQ ID NO: 877222 - RNA, 22 nt, Human
uggcuuuaaaucuguauucaua

SEQ ID NO: 877223 - RNA, 22 nt, Human
aagccucaccuuuuagaagcua

SEQ ID NO: 877224 - RNA, 22 nt, Human
acaggcagagaacucagccaga

SEQ ID NO: 877225 - RNA, 22 nt, Human
augucugauaaauaaugcauaa

SEQ ID NO: 877226 - RNA, 22 nt, Human
uuccucuggaggcucuaggaga

SEQ ID NO: 877227 - RNA, 22 nt, Human
gaaucuuauuuuuaaaucuucc

SEQ ID NO: 877228 - RNA, 22 nt, Human
ggcaggaagaggagggugaacu

SEQ ID NO: 877229 - RNA, 22 nt, Human
ggcagcaggagccaucugguag

SEQ ID NO: 877230 - RNA, 22 nt, Human
aagaugaaaauuuacugugaug

SEQ ID NO: 877231 - RNA, 22 nt, Human
gcuuacaagaucgugcuccagu

SEQ ID NO: 877232 - RNA, 22 nt, Human
ucaucauaauauggaaucuugu

SEQ ID NO: 877233 - RNA, 22 nt, Human
cagagacaggcuugcccuccac

SEQ ID NO: 877234 - RNA, 22 nt, Human
agggagguccaucccugcagag

SEQ ID NO: 877235 - RNA, 22 nt, Human
caggugucaaaauacuaagugg

SEQ ID NO: 877236 - RNA, 22 nt, Human
ccucagcucuucccugugcaca

SEQ ID NO: 877237 - RNA, 22 nt, Human
uuugagaaguaauucaagacau

SEQ ID NO: 877238 - RNA, 22 nt, Human
gugcccaggugucccugagaag

SEQ ID NO: 877239 - RNA, 22 nt, Human
auguucuucuaucuuuauuaaa

SEQ ID NO: 877240 - RNA, 22 nt, Human
gggcagugggaccaggcaccag

SEQ ID NO: 877241 - RNA, 20 nt, Human
cucuccuugccgacuuggca

SEQ ID NO: 877242 - RNA, 22 nt, Human
guggagcccugccuugcucaug

SEQ ID NO: 877243 - RNA, 22 nt, Human
uggcauuuggcuuacuuauguu

SEQ ID NO: 877244 - RNA, 22 nt, Human
gugaauaauuuuuuaguauaag

SEQ ID NO: 877245 - RNA, 20 nt, Human
aaagccacuggcaagagacu

SEQ ID NO: 877246 - RNA, 22 nt, Human
cagggugccuguccucagcaaa

SEQ ID NO: 877247 - RNA, 22 nt, Human
cagugcugacagggaggaaccu

SEQ ID NO: 877248 - RNA, 20 nt, Human
ccucugccccggggcugcua

SEQ ID NO: 877249 - RNA, 22 nt, Human
agggccagcccauaaugccaaa

SEQ ID NO: 877250 - RNA, 22 nt, Human
uccugagcugacacuuggggag

SEQ ID NO: 877251 - RNA, 22 nt, Human
uccugacuaggagggcuaaggu

SEQ ID NO: 877252 - RNA, 22 nt, Human
aaacauugaccucauccuggca

SEQ ID NO: 877253 - RNA, 22 nt, Human
auuacacacucaaguccuguua

SEQ ID NO: 877254 - RNA, 22 nt, Human
ucuccacaccagaaggagcuga

SEQ ID NO: 877255 - RNA, 22 nt, Human
ugcugggcuagaagcugaggcc

SEQ ID NO: 877256 - RNA, 19 nt, Human
agcuguggggccuagcacc

SEQ ID NO: 877257 - RNA, 22 nt, Human
ugcagcccaggcgucagguggu

SEQ ID NO: 877258 - RNA, 22 nt, Human
auucaaaguagaugaaguuuca

SEQ ID NO: 877259 - RNA, 22 nt, Human
caagaacaguuugccaaauugg

SEQ ID NO: 877260 - RNA, 21 nt, Human
uacaagaccggauucgggccc

SEQ ID NO: 877261 - RNA, 22 nt, Human
gaggaggaaaggaguugaaaug

SEQ ID NO: 877262 - RNA, 22 nt, Human
aauguuucguaaauugucuaug

SEQ ID NO: 877263 - RNA, 22 nt, Human
guccucuggccuuucccaggac

SEQ ID NO: 877264 - RNA, 22 nt, Human
aagccagguuccauggaggagc

SEQ ID NO: 877265 - RNA, 22 nt, Human
aacaggaauugcaggcagaucu

SEQ ID NO: 877266 - RNA, 22 nt, Human
aucagcugaugaauggaugaau

SEQ ID NO: 877267 - RNA, 22 nt, Human
agagccaggaaguggcgugggg

SEQ ID NO: 877268 - RNA, 22 nt, Human
acagucuucccuuauuccacuc

SEQ ID NO: 877269 - RNA, 22 nt, Human
uuucuucauagaccuugucuug

SEQ ID NO: 877270 - RNA, 22 nt, Human
cugaaguuuuucaauuuauguu

SEQ ID NO: 877271 - RNA, 22 nt, Human
aaugaagccacugaagacaauc

SEQ ID NO: 877272 - RNA, 22 nt, Human
auuaaauacugcaggcuaagca

SEQ ID NO: 877273 - RNA, 22 nt, Human
uguuggcaucucugagagaguu

SEQ ID NO: 877274 - RNA, 22 nt, Human
gcccaagcagcuucccgagcuu

SEQ ID NO: 877275 - RNA, 22 nt, Human
cagaagaaaguggggagacaag

SEQ ID NO: 877276 - RNA, 22 nt, Human
caggcccugccuuggcaugugu

SEQ ID NO: 877277 - RNA, 22 nt, Human
agucagcagccuggccaggaga

SEQ ID NO: 877278 - RNA, 22 nt, Human
ccagccuugcaccgagccagcc

SEQ ID NO: 877279 - RNA, 22 nt, Human
uagaggugucacuuugggaagu

SEQ ID NO: 877280 - RNA, 23 nt, Human
aauagcugguaaugauagcacaa

SEQ ID NO: 877281 - RNA, 22 nt, Human
uuccuuaguugacugucuuagu

SEQ ID NO: 877282 - RNA, 22 nt, Human
aacagcauaccaauguacauau

SEQ ID NO: 877283 - RNA, 22 nt, Human
aggcaagcagucagucuaugag

SEQ ID NO: 877284 - RNA, 22 nt, Human
ucugaagggcugaguggaggag

SEQ ID NO: 877285 - RNA, 22 nt, Human
gccaccagggggugcaaggucc

SEQ ID NO: 877286 - RNA, 22 nt, Human
cauugaaaccuaacauaggcug

SEQ ID NO: 877287 - RNA, 20 nt, Human
acacagagugagucugcuug

SEQ ID NO: 877288 - RNA, 22 nt, Human
aucuuuggggcauccaggaaaa

SEQ ID NO: 877289 - RNA, 22 nt, Human
guacaaaugcagguuuguuaca

SEQ ID NO: 877290 - RNA, 22 nt, Human
aagaaagauaagguuugcuugg

SEQ ID NO: 877291 - RNA, 22 nt, Human
aaguucuaacaucuacguggaa

SEQ ID NO: 877292 - RNA, 22 nt, Human
uguaaacaugcugaggcuggag

SEQ ID NO: 877293 - RNA, 22 nt, Human
aagcaggagaugcaggaaugua

SEQ ID NO: 877294 - RNA, 21 nt, Human
aggugcagagccagggaccag

SEQ ID NO: 877295 - RNA, 22 nt, Human
agcuccuggggguuccaagcag

SEQ ID NO: 877296 - RNA, 22 nt, Human
ggaacaggaaaggagggaugcu

SEQ ID NO: 877297 - RNA, 23 nt, Human
ugauuuccagugagucaguggga

SEQ ID NO: 877298 - RNA, 22 nt, Human
accugggaacgcuuuguggagg

SEQ ID NO: 877299 - RNA, 22 nt, Human
cugagaaagugaggguuaaaca

SEQ ID NO: 877300 - RNA, 22 nt, Human
ugaggcaggacuugcauaaagu

SEQ ID NO: 877301 - RNA, 20 nt, Human
uggaccugucucuuuaggga

SEQ ID NO: 877302 - RNA, 22 nt, Human
aacuauacauauuuacauagac

SEQ ID NO: 877303 - RNA, 18 nt, Human
cuccuuggagaagaggcc

SEQ ID NO: 877304 - RNA, 22 nt, Human
gggaccugaggcccugcuccac

SEQ ID NO: 877305 - RNA, 22 nt, Human
acguuauaucugaaaaaaguga

SEQ ID NO: 877306 - RNA, 22 nt, Human
cuguuuccugucuucucacuau

SEQ ID NO: 877307 - RNA, 22 nt, Human
ccugcucggggugcagugggcu

SEQ ID NO: 877308 - RNA, 22 nt, Human
uggccuggaaccuggcagggac

SEQ ID NO: 877309 - RNA, 22 nt, Human
uccacaggucagggagauaggc

SEQ ID NO: 877310 - RNA, 22 nt, Human
uaagcauacauucucuccuuuc

SEQ ID NO: 877311 - RNA, 22 nt, Human
ggaaauacaaagauacaccacu

SEQ ID NO: 877312 - RNA, 22 nt, Human
uccagcagaaccagagaccugg

SEQ ID NO: 877313 - RNA, 22 nt, Human
ugacagggucagagcugagcug

SEQ ID NO: 877314 - RNA, 22 nt, Human
gagagaaaacaaguucuccauu

SEQ ID NO: 877315 - RNA, 22 nt, Human
uuuguucugaagcaaguaggga

SEQ ID NO: 877316 - RNA, 22 nt, Human
aaauuauaggugccaccuugga

SEQ ID NO: 877317 - RNA, 22 nt, Human
uaacagaguuguacaguuacgu

SEQ ID NO: 877318 - RNA, 22 nt, Human
aggcugggcaccguuuugaucc

SEQ ID NO: 877319 - RNA, 22 nt, Human
uaacuacaagggcggucucugu

SEQ ID NO: 877320 - RNA, 22 nt, Human
gaugcgggcccgcuccacugcc

SEQ ID NO: 877321 - RNA, 22 nt, Human
ugguaggagauauggucuccga

SEQ ID NO: 877322 - RNA, 22 nt, Human
gcacccucugagcuccgcuccg

SEQ ID NO: 877323 - RNA, 22 nt, Human
uaauaccacugugcucauuaua

SEQ ID NO: 877324 - RNA, 22 nt, Human
gcugggacaggcuuggcccugu

SEQ ID NO: 877325 - RNA, 22 nt, Human
ccucuggccacaugggacauag

SEQ ID NO: 877326 - RNA, 22 nt, Human
uggcccuauuuggaaauagagc

SEQ ID NO: 877327 - RNA, 22 nt, Human
augauucucauuuuauaaacuu

SEQ ID NO: 877328 - RNA, 22 nt, Human
uuuugauaucaugaugaacaga

SEQ ID NO: 877329 - RNA, 22 nt, Human
agcugccacagagccuggccag

SEQ ID NO: 877330 - RNA, 22 nt, Human
aucaacauacugcucaggcauu

SEQ ID NO: 877331 - RNA, 22 nt, Human
auguuuccauguucaauuuacu

SEQ ID NO: 877332 - RNA, 22 nt, Human
gcuccaggcugcucugucccau

SEQ ID NO: 877333 - RNA, 22 nt, Human
cuggagagaaaugacaaagcua

SEQ ID NO: 877334 - RNA, 22 nt, Human
agcagggcuccauuucacugcc

SEQ ID NO: 877335 - RNA, 22 nt, Human
caggaagauuagaccaagagcu

SEQ ID NO: 877336 - RNA, 22 nt, Human
ggugcccaccugucuuccugga

SEQ ID NO: 877337 - RNA, 19 nt, Human
ugcugcagucaggcgaggg

SEQ ID NO: 877338 - RNA, 18 nt, Human
cucugucauaagugucau

SEQ ID NO: 877339 - RNA, 22 nt, Human
ugccugcucuugagacuuacaa

SEQ ID NO: 877340 - RNA, 22 nt, Human
cucccuggcacagcgagagguu

SEQ ID NO: 877341 - RNA, 19 nt, Human
ggcagacacaguugacaug

SEQ ID NO: 877342 - RNA, 22 nt, Human
cuuagaacauacuuagugugau

SEQ ID NO: 877343 - RNA, 22 nt, Human
aggcuugucucagaagaugcug

SEQ ID NO: 877344 - RNA, 22 nt, Human
ugcuuccuugagcucuccaauc

SEQ ID NO: 877345 - RNA, 22 nt, Human
aaagcuauucaacacgaacaug

SEQ ID NO: 877346 - RNA, 22 nt, Human
uugugcucuguguuauuuaagg

SEQ ID NO: 877347 - RNA, 22 nt, Human
ugucuuuggggcuguaccuguu

SEQ ID NO: 877348 - RNA, 22 nt, Human
uuuauccacaguauccaaaauc

SEQ ID NO: 877349 - RNA, 22 nt, Human
ucuuucaaaguaacaaccacga

SEQ ID NO: 877350 - RNA, 20 nt, Human
agaagcugauacugauggaa

SEQ ID NO: 877351 - RNA, 22 nt, Human
gccuuaauuaguaacagaccau

SEQ ID NO: 877352 - RNA, 22 nt, Human
uccucacagaugggugcauagc

SEQ ID NO: 877353 - RNA, 22 nt, Human
cucuggagguggagguugcagu

SEQ ID NO: 877354 - RNA, 22 nt, Human
cacaaaugguuguagacauuaa

SEQ ID NO: 877355 - RNA, 22 nt, Human
cugagcagaagggugcacgugc

SEQ ID NO: 877356 - RNA, 22 nt, Human
cugcuggagguuggagcaugca

SEQ ID NO: 877357 - RNA, 19 nt, Human
ccagguggaacugagguag

SEQ ID NO: 877358 - RNA, 21 nt, Human
accucaagcaacaaccaaggu

SEQ ID NO: 877359 - RNA, 22 nt, Human
caggaggcaguuucagaaguca

SEQ ID NO: 877360 - RNA, 22 nt, Human
accagggcugacaaucugaugg

SEQ ID NO: 877361 - RNA, 22 nt, Human
uuacacaggcacuuaaaaugca

SEQ ID NO: 877362 - RNA, 22 nt, Human
cauaaaauggcuuguucuuuaa

SEQ ID NO: 877363 - RNA, 21 nt, Human
gucugcagaccccuucauugc

SEQ ID NO: 877364 - RNA, 22 nt, Human
cgggguggcacucuaaauagaa

SEQ ID NO: 877365 - RNA, 22 nt, Human
gcuccuggcuucacugacauca

SEQ ID NO: 877366 - RNA, 21 nt, Human
uucaauacuauuucaauaguc

SEQ ID NO: 877367 - RNA, 20 nt, Human
uucaaagacccucaggucca

SEQ ID NO: 877368 - RNA, 22 nt, Human
guggguccgcuugguuccggug

SEQ ID NO: 877369 - RNA, 22 nt, Human
acagcaagccagcuugucacug

SEQ ID NO: 877370 - RNA, 22 nt, Human
uugaaauagaugcgucagagau

SEQ ID NO: 877371 - RNA, 22 nt, Human
guccaagagucaagaagggggc

SEQ ID NO: 877372 - RNA, 21 nt, Human
uuucuucccuuggcuucugag

SEQ ID NO: 877373 - RNA, 22 nt, Human
acagucucuuggaauuuucaga

SEQ ID NO: 877374 - RNA, 22 nt, Human
ucagaugagugcuuucagcugc

SEQ ID NO: 877375 - RNA, 22 nt, Human
cugaaauguuaaauacuuggcu

SEQ ID NO: 877376 - RNA, 22 nt, Human
gcuggaggaggaagugugaggg

SEQ ID NO: 877377 - RNA, 22 nt, Human
ggaagcugccaguccaccagcu

SEQ ID NO: 877378 - RNA, 22 nt, Human
cuucuagaguuucugaugcaac

SEQ ID NO: 877379 - RNA, 22 nt, Human
ugaaagcuuguuggaaauguag

SEQ ID NO: 877380 - RNA, 22 nt, Human
gccuggcugcuagccagaggca

SEQ ID NO: 877381 - RNA, 22 nt, Human
uguuuuauuucuccaagaggga

SEQ ID NO: 877382 - RNA, 22 nt, Human
cuguuauuuggaggaugcuugg

SEQ ID NO: 877383 - RNA, 22 nt, Human
gccuuaauuuuuuauaaucucu

SEQ ID NO: 877384 - RNA, 22 nt, Human
cugaacaggcucugauggauuc

SEQ ID NO: 877385 - RNA, 22 nt, Human
uauauaauuuguaaaagcaccu

SEQ ID NO: 877386 - RNA, 22 nt, Human
acuggaaugaaguuaaucugau

SEQ ID NO: 877387 - RNA, 22 nt, Human
ggcaagcauaaccuguacagcc

SEQ ID NO: 877388 - RNA, 22 nt, Human
cagucucucuuguagugcagcu

SEQ ID NO: 877389 - RNA, 17 nt, Human
cccaggccgccgggagc

SEQ ID NO: 877390 - RNA, 19 nt, Human
cgcaggcuucgggucgcuc

SEQ ID NO: 877391 - RNA, 22 nt, Human
ggccugacaagugggaagaggc

SEQ ID NO: 877392 - RNA, 22 nt, Human
uggaaugacaaguuguucagag

SEQ ID NO: 877393 - RNA, 20 nt, Human
uccucccccaccuuugcagc

SEQ ID NO: 877394 - RNA, 20 nt, Human
ugugcccaauguccagguuc

SEQ ID NO: 877395 - RNA, 22 nt, Human
gagcuccagcaucucugccaaa

SEQ ID NO: 877396 - RNA, 22 nt, Human
ggugagcaaagcuucaucugua

SEQ ID NO: 877397 - RNA, 22 nt, Human
acuuauauuugcuuuaugcuuc

SEQ ID NO: 877398 - RNA, 22 nt, Human
caguucuggaguuucauucuuu

SEQ ID NO: 877399 - RNA, 22 nt, Human
cuguuuguuggcuauugacagu

SEQ ID NO: 877400 - RNA, 22 nt, Human
auuuccauuaucaugacaaauu

SEQ ID NO: 877401 - RNA, 20 nt, Human
uuggcagcagcucagccacc

SEQ ID NO: 877402 - RNA, 22 nt, Human
gugauaaaggggaggaagugug

SEQ ID NO: 877403 - RNA, 22 nt, Human
gcuagggaaccucuucugagga

SEQ ID NO: 877404 - RNA, 22 nt, Human
gagguccaacacaauggguguu

SEQ ID NO: 877405 - RNA, 18 nt, Human
ugucaguaaagugacaga

SEQ ID NO: 877406 - RNA, 22 nt, Human
aauuuuaucucuaagcaggcuu

SEQ ID NO: 877407 - RNA, 21 nt, Human
agcugggccucagccugcagu

SEQ ID NO: 877408 - RNA, 22 nt, Human
caguggcauacuuggcugauau

SEQ ID NO: 877409 - RNA, 22 nt, Human
uggcauggacuagugcugaggu

SEQ ID NO: 877410 - RNA, 22 nt, Human
aggcugugacuacgcagggaag

SEQ ID NO: 877411 - RNA, 22 nt, Human
gcagcagaggcccuacucuuug

SEQ ID NO: 877412 - RNA, 18 nt, Human
caaauacuguugucuuau

SEQ ID NO: 877413 - RNA, 22 nt, Human
ugcagccagcaagugaauacau

SEQ ID NO: 877414 - RNA, 22 nt, Human
acauaaauagauuauugggagg

SEQ ID NO: 877415 - RNA, 22 nt, Human
uauaggacugaucacauuuuca

SEQ ID NO: 877416 - RNA, 22 nt, Human
cucuggaggccguuggcccuua

SEQ ID NO: 877417 - RNA, 22 nt, Human
ugaaucaaugaauugcacuuca

SEQ ID NO: 877418 - RNA, 22 nt, Human
acgggcagacagagcuacucgc

SEQ ID NO: 877419 - RNA, 22 nt, Human
uugagcaggauggcuaugcaca

SEQ ID NO: 877420 - RNA, 22 nt, Human
agaggucuaugcuaggggaacu

SEQ ID NO: 877421 - RNA, 22 nt, Human
ugggcaggcaagugaauaccuu

SEQ ID NO: 877422 - RNA, 22 nt, Human
ucaggcugggagacaaucacug

SEQ ID NO: 877423 - RNA, 22 nt, Human
caggaacacaaugagucucaaa

SEQ ID NO: 877424 - RNA, 22 nt, Human
gacacagggggauguguggacg

SEQ ID NO: 877425 - RNA, 22 nt, Human
ucugaagaacugaguaaacaug

SEQ ID NO: 877426 - RNA, 22 nt, Human
uaaugcugccaagccaugcaga

SEQ ID NO: 877427 - RNA, 22 nt, Human
gcaccugcuggggcugaugaga

SEQ ID NO: 877428 - RNA, 22 nt, Human
gcugcagggagcuggaaggcuc

SEQ ID NO: 877429 - RNA, 21 nt, Human
acagggcaugcagcuggcugu

SEQ ID NO: 877430 - RNA, 22 nt, Human
ucugucugggugccucgaguac

SEQ ID NO: 877431 - RNA, 19 nt, Human
cacagcuggcgcugaccgc

SEQ ID NO: 877432 - RNA, 22 nt, Human
uacauaauuaaucuuuaaguuc

SEQ ID NO: 877433 - RNA, 22 nt, Human
ugaggcagaaauuccuguuuuc

SEQ ID NO: 877434 - RNA, 22 nt, Human
uaauacagaaguguauuaaaau

SEQ ID NO: 877435 - RNA, 22 nt, Human
caagauuugccaguggccaacu

SEQ ID NO: 877436 - RNA, 22 nt, Human
acagaauagguacagucaguca

SEQ ID NO: 877437 - RNA, 22 nt, Human
aggagggcaggcuggcugccua

SEQ ID NO: 877438 - RNA, 22 nt, Human
ggggauggugggaaggcaaucu

SEQ ID NO: 877439 - RNA, 22 nt, Human
gagaaagauuguccuucagggg

SEQ ID NO: 877440 - RNA, 22 nt, Human
ugccucuuggagccuuuccucu

SEQ ID NO: 877441 - RNA, 22 nt, Human
caggcagcaucagucugcugua

SEQ ID NO: 877442 - RNA, 22 nt, Human
agcauugagguggguuucucuu

SEQ ID NO: 877443 - RNA, 22 nt, Human
uuccauaauaaccugagagaaa

SEQ ID NO: 877444 - RNA, 22 nt, Human
ucacccagcagcugcuucugcu

SEQ ID NO: 877445 - RNA, 22 nt, Human
guuuaacauuguaccaacaccu

SEQ ID NO: 877446 - RNA, 22 nt, Human
auggaaaucgaugucuaaguua

SEQ ID NO: 877447 - RNA, 22 nt, Human
gagcucagcaaaggucugugug

SEQ ID NO: 877448 - RNA, 22 nt, Human
cagugcagaggugcaagcaugu

SEQ ID NO: 877449 - RNA, 22 nt, Human
uccacaauggcagagaaauguc

SEQ ID NO: 877450 - RNA, 22 nt, Human
ucucugagaucagccacugacu

SEQ ID NO: 877451 - RNA, 22 nt, Human
aauguuacaguuuuaauucuga

SEQ ID NO: 877452 - RNA, 22 nt, Human
cacagggccuugugugacugca

SEQ ID NO: 877453 - RNA, 22 nt, Human
uaaugcaauuuucucaguccau

SEQ ID NO: 877454 - RNA, 22 nt, Human
ucacaaaugucuccuguccugu

SEQ ID NO: 877455 - RNA, 20 nt, Human
gugcagaggcagccuguggg

SEQ ID NO: 877456 - RNA, 22 nt, Human
ccacaggaaguuaugaguacua

SEQ ID NO: 877457 - RNA, 22 nt, Human
augugugccccuuuuacucuuu

SEQ ID NO: 877458 - RNA, 22 nt, Human
agugacaaagauucuccuuguu

SEQ ID NO: 877459 - RNA, 22 nt, Human
caguuuucuaaagucucuuuaa

SEQ ID NO: 877460 - RNA, 22 nt, Human
uuauacuuuauacuacaucauu

SEQ ID NO: 877461 - RNA, 22 nt, Human
caucagagucagagcucuuucu

SEQ ID NO: 877462 - RNA, 22 nt, Human
aucuguccugugacagugggag

SEQ ID NO: 877463 - RNA, 22 nt, Human
guggaaaagaaagucuuccuug

SEQ ID NO: 877464 - RNA, 22 nt, Human
cagcccugugcggagggcccug

SEQ ID NO: 877465 - RNA, 22 nt, Human
cggagccugcuuguugcagcug

SEQ ID NO: 877466 - RNA, 22 nt, Human
ucagugucuauagauaagguuu

SEQ ID NO: 877467 - RNA, 22 nt, Human
ucagugucuugaccugggugug

SEQ ID NO: 877468 - RNA, 22 nt, Human
cacauguuugcuacauuuuucu

SEQ ID NO: 877469 - RNA, 21 nt, Human
aaaauguuuccuuguugguua

SEQ ID NO: 877470 - RNA, 22 nt, Human
gcuggccacacugcugauggag

SEQ ID NO: 877471 - RNA, 23 nt, Human
ucuuuagaagaacaucagaaaug

SEQ ID NO: 877472 - RNA, 22 nt, Human
caauucaaaccagucugucucu

SEQ ID NO: 877473 - RNA, 22 nt, Human
agucucuauguuccugcaauau

SEQ ID NO: 877474 - RNA, 22 nt, Human
uguuaauuucuuuagaagugga

SEQ ID NO: 877475 - RNA, 22 nt, Human
uggcucauucuggggaagucag

SEQ ID NO: 877476 - RNA, 23 nt, Human
uaucaguaagcaucccugaaccc

SEQ ID NO: 877477 - RNA, 22 nt, Human
gggaggaaaugugcagcgaauu

SEQ ID NO: 877478 - RNA, 22 nt, Human
cagauaaaauuaauauuaccaa

SEQ ID NO: 877479 - RNA, 21 nt, Human
acagccuugugauggagacag

SEQ ID NO: 877480 - RNA, 22 nt, Human
uuguguuugaugcugacacgca

SEQ ID NO: 877481 - RNA, 22 nt, Human
ugugagagagugcauuugcaua

SEQ ID NO: 877482 - RNA, 22 nt, Human
agaagaaaugugaaggccacug

SEQ ID NO: 877483 - RNA, 22 nt, Human
auuugacaacuucugguggcau

SEQ ID NO: 877484 - RNA, 23 nt, Human
gcugccucuguuggucuucaguu

SEQ ID NO: 877485 - RNA, 23 nt, Human
ucaaacuguuauauugccagagu

SEQ ID NO: 877486 - RNA, 22 nt, Human
ugggaggugauuaaauuauggg

SEQ ID NO: 877487 - RNA, 22 nt, Human
ucaugcaaauacuguuccagaa

SEQ ID NO: 877488 - RNA, 22 nt, Human
uucuagcagagggcaucugcug

SEQ ID NO: 877489 - RNA, 22 nt, Human
aagggcaggugggcauuucugg

SEQ ID NO: 877490 - RNA, 22 nt, Human
ucauuugugugagugauuugac

SEQ ID NO: 877491 - RNA, 22 nt, Human
gugggcagacaugauagaagga

SEQ ID NO: 877492 - RNA, 22 nt, Human
ugacagaaugugacucucagau

SEQ ID NO: 877493 - RNA, 22 nt, Human
aacaucaucaugaacaacuaau

SEQ ID NO: 877494 - RNA, 22 nt, Human
cuggggagugaaauucuuaaau

SEQ ID NO: 877495 - RNA, 22 nt, Human
cugagaggcggagcuugcagug

SEQ ID NO: 877496 - RNA, 22 nt, Human
ugauaaacuggagagguggagg

SEQ ID NO: 877497 - RNA, 22 nt, Human
cuggcuggucugagcagucgca

SEQ ID NO: 877498 - RNA, 22 nt, Human
auguguuuuuauucuggcaugu

SEQ ID NO: 877499 - RNA, 22 nt, Human
uggaagauaugcugauucucug

SEQ ID NO: 877500 - RNA, 22 nt, Human
guuucaaagggaagacgcugga

SEQ ID NO: 877501 - RNA, 22 nt, Human
gaaaucacuuuuuucauaguug

SEQ ID NO: 877502 - RNA, 22 nt, Human
accagggcccgggagagcucuc

SEQ ID NO: 877503 - RNA, 22 nt, Human
gccagcuguaagcuggggugau

SEQ ID NO: 877504 - RNA, 21 nt, Human
ggaacauuguuaauagucucu

SEQ ID NO: 877505 - RNA, 22 nt, Human
uauuagugaaagaauuaguuug

SEQ ID NO: 877506 - RNA, 22 nt, Human
cucuagaaugaauuagcgcagg

SEQ ID NO: 877507 - RNA, 22 nt, Human
cacauugggcuugcaugcacgg

SEQ ID NO: 877508 - RNA, 22 nt, Human
uggcuucugagucuccugacau

SEQ ID NO: 877509 - RNA, 21 nt, Human
aggaaaggaaguccccagggu

SEQ ID NO: 877510 - RNA, 22 nt, Human
aaguguguugacugaauugggg

SEQ ID NO: 877511 - RNA, 22 nt, Human
ucuuuagagcacgggaaaaaca

SEQ ID NO: 877512 - RNA, 22 nt, Human
ucagauacuguggcuuaugggc

SEQ ID NO: 877513 - RNA, 17 nt, Human
agccgggcauggaccag

SEQ ID NO: 877514 - RNA, 22 nt, Human
aggggccuggacauggacgcgc

SEQ ID NO: 877515 - RNA, 20 nt, Human
uggagcuccagcguccaugu

SEQ ID NO: 877516 - RNA, 22 nt, Human
agccucugacugucagcaaggu

SEQ ID NO: 877517 - RNA, 22 nt, Human
ucauaaauucuggugcugugag

SEQ ID NO: 877518 - RNA, 22 nt, Human
caacacuucuuauacuuacuga

SEQ ID NO: 877519 - RNA, 22 nt, Human
gaggccuggaauuccagccugg

SEQ ID NO: 877520 - RNA, 22 nt, Human
gcauucuuuuuaggagguuccu

SEQ ID NO: 877521 - RNA, 22 nt, Human
auauaauuguucugaaguguuu

SEQ ID NO: 877522 - RNA, 22 nt, Human
caauucugcaagugacugaccu

SEQ ID NO: 877523 - RNA, 22 nt, Human
uuuccaguuguucuagaaagcu

SEQ ID NO: 877524 - RNA, 21 nt, Human
agcauucugcuucuuuccugg

SEQ ID NO: 877525 - RNA, 22 nt, Human
cugccugcaucccacagugggg

SEQ ID NO: 877526 - RNA, 22 nt, Human
cacugcccucacugugguucuc

SEQ ID NO: 877527 - RNA, 22 nt, Human
caaauguaauaaggaguuuccc

SEQ ID NO: 877528 - RNA, 22 nt, Human
uuucauaaugucacagucaaaa

SEQ ID NO: 877529 - RNA, 22 nt, Human
gggagggaggugcugguucacg

SEQ ID NO: 877530 - RNA, 22 nt, Human
augaagaaaaauccagcugucc

SEQ ID NO: 877531 - RNA, 22 nt, Human
uggaauguaaaggguaugggau

SEQ ID NO: 877532 - RNA, 22 nt, Human
cauggcuuaccccaggagcagc

SEQ ID NO: 877533 - RNA, 16 nt, Human
ccagaggccuggccuc

SEQ ID NO: 877534 - RNA, 22 nt, Human
uggaugagucugagauugggca

SEQ ID NO: 877535 - RNA, 22 nt, Human
cagaaguaagauuacugugaga

SEQ ID NO: 877536 - RNA, 18 nt, Human
aggcacagagcauacaua

SEQ ID NO: 877537 - RNA, 22 nt, Human
acaacaaagacacuugaaauga

SEQ ID NO: 877538 - RNA, 22 nt, Human
aucuagaacuuaaagucaguca

SEQ ID NO: 877539 - RNA, 22 nt, Human
uggcuuucccccagcccaguug

SEQ ID NO: 877540 - RNA, 22 nt, Human
gaagcaguucgaaagcaguugg

SEQ ID NO: 877541 - RNA, 22 nt, Human
uaaagccauacugaaagccacu

SEQ ID NO: 877542 - RNA, 22 nt, Human
cucuuuggauagaauuacaaag

SEQ ID NO: 877543 - RNA, 22 nt, Human
aaauguucaccagauccaugac

SEQ ID NO: 877544 - RNA, 22 nt, Human
accuuggaaaugcccauugccu

SEQ ID NO: 877545 - RNA, 22 nt, Human
cagcagcuggugagacacagcc

SEQ ID NO: 877546 - RNA, 22 nt, Human
uugcuuucccaaggcagaacau

SEQ ID NO: 877547 - RNA, 22 nt, Human
agagguauauauucuccauauu

SEQ ID NO: 877548 - RNA, 20 nt, Human
gcuuucaagcuugucauugu

SEQ ID NO: 877549 - RNA, 20 nt, Human
cacaggaaagcuacucaguu

SEQ ID NO: 877550 - RNA, 22 nt, Human
gagcugaacaucauggaaaggc

SEQ ID NO: 877551 - RNA, 22 nt, Human
aggccagcauucucucuccagg

SEQ ID NO: 877552 - RNA, 22 nt, Human
ugaaaguauuugauuucuauua

SEQ ID NO: 877553 - RNA, 22 nt, Human
cccagcagccuugucccuucuc

SEQ ID NO: 877554 - RNA, 22 nt, Human
ucucauucauacccuacaugcu

SEQ ID NO: 877555 - RNA, 22 nt, Human
ugcuauuugugagugucuucgu

SEQ ID NO: 877556 - RNA, 22 nt, Human
agagcacaggugcuggagccca

SEQ ID NO: 877557 - RNA, 22 nt, Human
cauaguaaauaaugcagaugau

SEQ ID NO: 877558 - RNA, 22 nt, Human
ucccugcagacguccugcgggu

SEQ ID NO: 877559 - RNA, 22 nt, Human
agaggcuccuucacucuggcac

SEQ ID NO: 877560 - RNA, 22 nt, Human
agccucugucaagcuuuucaaa

SEQ ID NO: 877561 - RNA, 21 nt, Human
cccaagggaggcaggauaagg

SEQ ID NO: 877562 - RNA, 16 nt, Human
ugggugggaggagcgg

SEQ ID NO: 877563 - RNA, 22 nt, Human
ggucauguguccaggagguagc

SEQ ID NO: 877564 - RNA, 22 nt, Human
ggaggagggguuuacauuggaa

SEQ ID NO: 877565 - RNA, 22 nt, Human
cuacagaauggagggucagaga

SEQ ID NO: 877566 - RNA, 22 nt, Human
accagcugugugaccugaggca

SEQ ID NO: 877567 - RNA, 22 nt, Human
ccacaggacacaacugcugacc

SEQ ID NO: 877568 - RNA, 22 nt, Human
uguguuaacacugcaugauaau

SEQ ID NO: 877569 - RNA, 22 nt, Human
auuugucaguggaagugauuca

SEQ ID NO: 877570 - RNA, 19 nt, Human
uuugugaagaaaaugaugc

SEQ ID NO: 877571 - RNA, 18 nt, Human
ccuggcagccaugcgcgc

SEQ ID NO: 877572 - RNA, 22 nt, Human
aagcagcaaguuuauuucuauc

SEQ ID NO: 877573 - RNA, 22 nt, Human
auuugcugauggcauuugagcu

SEQ ID NO: 877574 - RNA, 22 nt, Human
uaaauacuuaguuuugugucua

SEQ ID NO: 877575 - RNA, 22 nt, Human
acagugcucaugugacauggug

SEQ ID NO: 877576 - RNA, 22 nt, Human
aauggucaaaaagauacguaaa

SEQ ID NO: 877577 - RNA, 22 nt, Human
aaguuacaggagaaagagauca

SEQ ID NO: 877578 - RNA, 22 nt, Human
ggcaauuaaaguacugugaaug

SEQ ID NO: 877579 - RNA, 22 nt, Human
aguaaacagaaagcaagaugau

SEQ ID NO: 877580 - RNA, 22 nt, Human
cacuucauugggaccagggcug

SEQ ID NO: 877581 - RNA, 18 nt, Human
uggagacauagacaaugu

SEQ ID NO: 877582 - RNA, 22 nt, Human
aaauugcagguaggugggugau

SEQ ID NO: 877583 - RNA, 22 nt, Human
uacaaguauguuuuaaaauguu

SEQ ID NO: 877584 - RNA, 23 nt, Human
uauuuuccuggcaacaggggaac

SEQ ID NO: 877585 - RNA, 19 nt, Human
agcuggcacuagaauccag

SEQ ID NO: 877586 - RNA, 20 nt, Human
ggcccagugaaccaggacgg

SEQ ID NO: 877587 - RNA, 22 nt, Human
auuugcaagaguaagaauuucu

SEQ ID NO: 877588 - RNA, 22 nt, Human
auguuugaggacucagaagacg

SEQ ID NO: 877589 - RNA, 22 nt, Human
caaaaguaauugcgguuuuugc

SEQ ID NO: 877590 - RNA, 22 nt, Human
guggggaggcauucuucucccu

SEQ ID NO: 877591 - RNA, 22 nt, Human
caaauagaacucacagacaaga

SEQ ID NO: 877592 - RNA, 22 nt, Human
cugccccaggaccucuucugga

SEQ ID NO: 877593 - RNA, 22 nt, Human
uuacaggaggugcuagguguuu

SEQ ID NO: 877594 - RNA, 22 nt, Human
gaucucuguggacucuuagcac

SEQ ID NO: 877595 - RNA, 22 nt, Human
uccuuguaaaggagcucuaaca

SEQ ID NO: 877596 - RNA, 22 nt, Human
ccuuucucauuuuaagcauuag

SEQ ID NO: 877597 - RNA, 22 nt, Human
uuuuaaucaugcuucuaugucc

SEQ ID NO: 877598 - RNA, 22 nt, Human
gaagugacaagaugcuaggauc

SEQ ID NO: 877599 - RNA, 22 nt, Human
acucugaaauagaggcuggugg

SEQ ID NO: 877600 - RNA, 22 nt, Human
uucuugauucuuccuugaagga

SEQ ID NO: 877601 - RNA, 22 nt, Human
aggcaaggugcuacagacagug

SEQ ID NO: 877602 - RNA, 22 nt, Human
cagcagagcugggaauaaaauu

SEQ ID NO: 877603 - RNA, 22 nt, Human
aagaguuucuuacuggcaucua

SEQ ID NO: 877604 - RNA, 22 nt, Human
auuuacauuuauuugagaaggu

SEQ ID NO: 877605 - RNA, 22 nt, Human
ugcagggccuugggaugugucc

SEQ ID NO: 877606 - RNA, 21 nt, Human
cugagaccugcauuagagagg

SEQ ID NO: 877607 - RNA, 22 nt, Human
aaaggccaauaaagacaagcug

SEQ ID NO: 877608 - RNA, 23 nt, Human
uccaggagaaccccugucugucc

SEQ ID NO: 877609 - RNA, 22 nt, Human
cugagguggggccugggcauca

SEQ ID NO: 877610 - RNA, 22 nt, Human
agcuggccggccuccaggugga

SEQ ID NO: 877611 - RNA, 22 nt, Human
ucccgauucuuccuauacagga

SEQ ID NO: 877612 - RNA, 22 nt, Human
acacaguauugugacuauaacu

SEQ ID NO: 877613 - RNA, 23 nt, Human
ucuguccacgcgaggcccuugcu

SEQ ID NO: 877614 - RNA, 22 nt, Human
uagaauaaguugaugauauaug

SEQ ID NO: 877615 - RNA, 22 nt, Human
uguaauuauguuguuagaguau

SEQ ID NO: 877616 - RNA, 22 nt, Human
ucaucuauuuauguagaacaag

SEQ ID NO: 877617 - RNA, 22 nt, Human
uaccaugucuucaauaagucua

SEQ ID NO: 877618 - RNA, 22 nt, Human
acagagaucagaggcauaagca

SEQ ID NO: 877619 - RNA, 22 nt, Human
aagggcaggagaagacggauau

SEQ ID NO: 877620 - RNA, 22 nt, Human
cuuagcaagcauucaagugccu

SEQ ID NO: 877621 - RNA, 22 nt, Human
uacauugugauguuucaauaca

SEQ ID NO: 877622 - RNA, 22 nt, Human
uuucuauucuggaucuguggca

SEQ ID NO: 877623 - RNA, 22 nt, Human
uaugacaagaaauacagaggua

SEQ ID NO: 877624 - RNA, 22 nt, Human
uuggaaaguuuuuacugaagac

SEQ ID NO: 877625 - RNA, 21 nt, Human
gcagaugggaagagacgaggc

SEQ ID NO: 877626 - RNA, 22 nt, Human
uaaggaaugcuugaauguuccu

SEQ ID NO: 877627 - RNA, 22 nt, Human
agaaacaagguguagguugacc

SEQ ID NO: 877628 - RNA, 22 nt, Human
aacuccagcucacacagugacc

SEQ ID NO: 877629 - RNA, 18 nt, Human
cugugggcuggugcauga

SEQ ID NO: 877630 - RNA, 22 nt, Human
auguuaccucuauuagaauauu

SEQ ID NO: 877631 - RNA, 22 nt, Human
ccucaggggucacugugaggag

SEQ ID NO: 877632 - RNA, 22 nt, Human
ugguccugucucaaggagccuu

SEQ ID NO: 877633 - RNA, 22 nt, Human
gcugauccuuuuaugucuagcu

SEQ ID NO: 877634 - RNA, 22 nt, Human
caucugaaaucugccuacaagc

SEQ ID NO: 877635 - RNA, 23 nt, Human
cagcccuggagaugugggaggca

SEQ ID NO: 877636 - RNA, 22 nt, Human
acagcuucuauuucucuguacu

SEQ ID NO: 877637 - RNA, 22 nt, Human
agccuucaguaaauccacugug

SEQ ID NO: 877638 - RNA, 22 nt, Human
acugccuguagcucuucaucuc

SEQ ID NO: 877639 - RNA, 19 nt, Human
gugaggauacugcucagag

SEQ ID NO: 877640 - RNA, 22 nt, Human
gaaauugccagaucuaguagau

SEQ ID NO: 877641 - RNA, 22 nt, Human
uaaauaucaguccagcucuucc

SEQ ID NO: 877642 - RNA, 22 nt, Human
gccagaagggguggauccaggc

SEQ ID NO: 877643 - RNA, 19 nt, Human
gccagugugugguacagug

SEQ ID NO: 877644 - RNA, 22 nt, Human
gggcuccacgcacgcgagaggu

SEQ ID NO: 877645 - RNA, 22 nt, Human
ucagugucuugggcuugaaugc

SEQ ID NO: 877646 - RNA, 17 nt, Human
gcaaucucagucuccuu

SEQ ID NO: 877647 - RNA, 22 nt, Human
ccacauuuuugauacucucacu

SEQ ID NO: 877648 - RNA, 22 nt, Human
ucucuggggaugcuuauucuug

SEQ ID NO: 877649 - RNA, 22 nt, Human
uucauucuugucuuuguauagu

SEQ ID NO: 877650 - RNA, 22 nt, Human
acaggaugauaaaggauggcca

SEQ ID NO: 877651 - RNA, 22 nt, Human
ugacaguguuugcacuucaggu

SEQ ID NO: 877652 - RNA, 20 nt, Human
gucugcaguaagagggaaua

SEQ ID NO: 877653 - RNA, 22 nt, Human
uguuucaaaacagugauaauuu

SEQ ID NO: 877654 - RNA, 22 nt, Human
aucugaaguccuuauaaucuga

SEQ ID NO: 877655 - RNA, 22 nt, Human
acauucuugaagugaaguuuau

SEQ ID NO: 877656 - RNA, 22 nt, Human
auguuuccauagaagucacagu

SEQ ID NO: 877657 - RNA, 22 nt, Human
gagauggagaaggaagcuguuu

SEQ ID NO: 877658 - RNA, 22 nt, Human
agacagugugguuggugguucc

SEQ ID NO: 877659 - RNA, 22 nt, Human
caggacagaccaagaucgugcu

SEQ ID NO: 877660 - RNA, 22 nt, Human
uacaaucaggauaauaauagug

SEQ ID NO: 877661 - RNA, 22 nt, Human
ugauucugccacguacuggcug

SEQ ID NO: 877662 - RNA, 22 nt, Human
cucuagggaagaaugagagccc

SEQ ID NO: 877663 - RNA, 22 nt, Human
uucaacagacccuucuuucuuu

SEQ ID NO: 877664 - RNA, 22 nt, Human
uuauugcaacuccuaaauagag

SEQ ID NO: 877665 - RNA, 22 nt, Human
caguguuuuguuacuugggcac

SEQ ID NO: 877666 - RNA, 22 nt, Human
aagacacacacauaugcugagu

SEQ ID NO: 877667 - RNA, 22 nt, Human
acugcacagaauuaugguuggu

SEQ ID NO: 877668 - RNA, 22 nt, Human
uuuuaaaggauacucuugucua

SEQ ID NO: 877669 - RNA, 22 nt, Human
gccagucugauaggggagaagu

SEQ ID NO: 877670 - RNA, 22 nt, Human
ccuggaggagcgcugaccagcu

SEQ ID NO: 877671 - RNA, 22 nt, Human
guuuacaacaugccaacugggc

SEQ ID NO: 877672 - RNA, 22 nt, Human
aagguauaucugauccaugagg

SEQ ID NO: 877673 - RNA, 22 nt, Human
gaauucuaggguaaauauccua

SEQ ID NO: 877674 - RNA, 22 nt, Human
cagcagaggcacgucugugaau

SEQ ID NO: 877675 - RNA, 20 nt, Human
uagacuuuucaucaaccuua

SEQ ID NO: 877676 - RNA, 22 nt, Human
caggcuugauuauucagacaau

SEQ ID NO: 877677 - RNA, 22 nt, Human
agcagcuguuuguugaauuggu

SEQ ID NO: 877678 - RNA, 22 nt, Human
aaaauccucuaauucuagaaua

SEQ ID NO: 877679 - RNA, 22 nt, Human
aucucccaaacucauuucuuca

SEQ ID NO: 877680 - RNA, 22 nt, Human
ucugccaguuagaaacugguua

SEQ ID NO: 877681 - RNA, 22 nt, Human
uagaaaguagccacuuacagag

SEQ ID NO: 877682 - RNA, 20 nt, Human
caguccaaucagaggccacc

SEQ ID NO: 877683 - RNA, 23 nt, Human
aggcaauacaaggcaucucugga

SEQ ID NO: 877684 - RNA, 22 nt, Human
aucuuacagcagcaaggaagua

SEQ ID NO: 877685 - RNA, 22 nt, Human
uuuuggaaccaacagugcaccu

SEQ ID NO: 877686 - RNA, 22 nt, Human
gacuccaggugcaggaggagcc

SEQ ID NO: 877687 - RNA, 22 nt, Human
caaaguaugaaccaguuucucu

SEQ ID NO: 877688 - RNA, 22 nt, Human
uguggaacaaaauguugggaga

SEQ ID NO: 877689 - RNA, 22 nt, Human
gucuggaguggggccugagaau

SEQ ID NO: 877690 - RNA, 22 nt, Human
augauguacagaaaguuggcgg

SEQ ID NO: 877691 - RNA, 22 nt, Human
acuguuacagagcaggaaauug

SEQ ID NO: 877692 - RNA, 22 nt, Human
ucuauacacacaaagaaugcuu

SEQ ID NO: 877693 - RNA, 19 nt, Human
auacacauacguaaacuga

SEQ ID NO: 877694 - RNA, 22 nt, Human
augauuuuuucuaacacagucg

SEQ ID NO: 877695 - RNA, 22 nt, Human
cagaucaagcuguauggucaga

SEQ ID NO: 877696 - RNA, 22 nt, Human
agaaagaacguugguuaucuua

SEQ ID NO: 877697 - RNA, 22 nt, Human
agagccuggcucccagcuaccg

SEQ ID NO: 877698 - RNA, 19 nt, Human
acaugacaacaggggaggc

SEQ ID NO: 877699 - RNA, 22 nt, Human
gagcccagguucugcuuccagc

SEQ ID NO: 877700 - RNA, 22 nt, Human
aggggagaaaaaugccuucugu

SEQ ID NO: 877701 - RNA, 22 nt, Human
aauauuuuaggcuuuccaggcu

SEQ ID NO: 877702 - RNA, 22 nt, Human
ugauuuccuagcugacaugaaa

SEQ ID NO: 877703 - RNA, 19 nt, Human
cuccagaauacauguuccu

SEQ ID NO: 877704 - RNA, 22 nt, Human
caggccuggagugcaauggcac

SEQ ID NO: 877705 - RNA, 18 nt, Human
acuguucucuccugcccu

SEQ ID NO: 877706 - RNA, 22 nt, Human
aaugcuaacauugguuuauauc

SEQ ID NO: 877707 - RNA, 18 nt, Human
uccagucccagcucugcc

SEQ ID NO: 877708 - RNA, 22 nt, Human
uguggaagugccaaugacaaau

SEQ ID NO: 877709 - RNA, 22 nt, Human
aagggcuggucuagaaagggag

SEQ ID NO: 877710 - RNA, 22 nt, Human
ggguaggaaauccagagguggc

SEQ ID NO: 877711 - RNA, 21 nt, Human
auuacaucccuggugauacau

SEQ ID NO: 877712 - RNA, 22 nt, Human
auucagugucuacuccauugcc

SEQ ID NO: 877713 - RNA, 22 nt, Human
cuguacagaguucugaguguac

SEQ ID NO: 877714 - RNA, 22 nt, Human
ugucauuuaucuuauaguaauc

SEQ ID NO: 877715 - RNA, 22 nt, Human
agggauggaagcucgucugcaa

SEQ ID NO: 877716 - RNA, 22 nt, Human
gaucauuuuguauagcaaaggu

SEQ ID NO: 877717 - RNA, 22 nt, Human
gaacuuuaaucccuugggcuua

SEQ ID NO: 877718 - RNA, 22 nt, Human
guacuauagguaauguagacca

SEQ ID NO: 877719 - RNA, 22 nt, Human
uggccacauccuuuccuuguca

SEQ ID NO: 877720 - RNA, 21 nt, Human
agaaauacagcagggaugauc

SEQ ID NO: 877721 - RNA, 22 nt, Human
aaguaaguuucucucuccaaga

SEQ ID NO: 877722 - RNA, 22 nt, Human
aaacaugaguuaaaaguaacug

SEQ ID NO: 877723 - RNA, 22 nt, Human
ggaguaaggcucagaggaaaug

SEQ ID NO: 877724 - RNA, 22 nt, Human
uggauggguugaaaugugagcc

SEQ ID NO: 877725 - RNA, 22 nt, Human
ugacacaaaggaaagcauaauc

SEQ ID NO: 877726 - RNA, 23 nt, Human
acagcugcaccuggccgccuggc

SEQ ID NO: 877727 - RNA, 20 nt, Human
gcuccaggucagagaggacg

SEQ ID NO: 877728 - RNA, 22 nt, Human
acagcugcuguuuuugaaggac

SEQ ID NO: 877729 - RNA, 22 nt, Human
ucaaauaaggagucaugaccau

SEQ ID NO: 877730 - RNA, 22 nt, Human
ggcucuugggagcucagaguug

SEQ ID NO: 877731 - RNA, 22 nt, Human
gccuuuaucuugggccaaguuu

SEQ ID NO: 877732 - RNA, 22 nt, Human
cccugugccucaguuuccucau

SEQ ID NO: 877733 - RNA, 19 nt, Human
aaugaguuccaugaaaaga

SEQ ID NO: 877734 - RNA, 22 nt, Human
ugcagggaauccagucuagggu

SEQ ID NO: 877735 - RNA, 22 nt, Human
cucagcagcuacaggauucggg

SEQ ID NO: 877736 - RNA, 22 nt, Human
cauuugugcuuuuauaaaauag

SEQ ID NO: 877737 - RNA, 22 nt, Human
uagauaauuuggcaucauauug

SEQ ID NO: 877738 - RNA, 22 nt, Human
ccacagaaucgcuaguggagca

SEQ ID NO: 877739 - RNA, 22 nt, Human
ugggagagcagagaacccucuu

SEQ ID NO: 877740 - RNA, 23 nt, Human
aguaacaugcaaauaacagucug

SEQ ID NO: 877741 - RNA, 22 nt, Human
cugaaguuuugacaucucauuu

SEQ ID NO: 877742 - RNA, 22 nt, Human
gcacaugguaggcauuugaugu

SEQ ID NO: 877743 - RNA, 22 nt, Human
gugugaccucaucuuaacugga

SEQ ID NO: 877744 - RNA, 22 nt, Human
agaccacaggcaugcacagagc

SEQ ID NO: 877745 - RNA, 22 nt, Human
gcccuagggggaaccgaggacu

SEQ ID NO: 877746 - RNA, 22 nt, Human
aauguuuuagauuacugcuggg

SEQ ID NO: 877747 - RNA, 22 nt, Human
caguaaauccuagagcccucau

SEQ ID NO: 877748 - RNA, 22 nt, Human
cugcccacaguucucugccaug

SEQ ID NO: 877749 - RNA, 19 nt, Human
ucauaaaaaugguaaccca

SEQ ID NO: 877750 - RNA, 22 nt, Human
aucugucuggaggccuggcaug

SEQ ID NO: 877751 - RNA, 22 nt, Human
agaacuucagcaaaaccaguua

SEQ ID NO: 877752 - RNA, 22 nt, Human
ucucauaauagcauuucucacc

SEQ ID NO: 877753 - RNA, 23 nt, Human
uacuauaacgcugugucagcucc

SEQ ID NO: 877754 - RNA, 22 nt, Human
ugugggcucuaauggcagcaga

SEQ ID NO: 877755 - RNA, 22 nt, Human
caaaugcaggucauaaccugag

SEQ ID NO: 877756 - RNA, 22 nt, Human
auacccagcucuuucguuuugg

SEQ ID NO: 877757 - RNA, 22 nt, Human
ugaaauguuuggguccagaagu

SEQ ID NO: 877758 - RNA, 22 nt, Human
cagccugccgucagccagguag

SEQ ID NO: 877759 - RNA, 22 nt, Human
cauuucaauacaguuuguaaau

SEQ ID NO: 877760 - RNA, 22 nt, Human
agacagcagaaacuagagcacu

SEQ ID NO: 877761 - RNA, 22 nt, Human
ggauacaacuagaagauggcag

SEQ ID NO: 877762 - RNA, 22 nt, Human
auucugggcgccuauggcugca

SEQ ID NO: 877763 - RNA, 19 nt, Human
ccugcagggaugagagguu

SEQ ID NO: 877764 - RNA, 22 nt, Human
caggcagggagcuggaaaggau

SEQ ID NO: 877765 - RNA, 22 nt, Human
auauaaagaaguggaaaaugag

SEQ ID NO: 877766 - RNA, 22 nt, Human
aaaguucuggcauuuucugucu

SEQ ID NO: 877767 - RNA, 22 nt, Human
gacagcuuagugaaaauguaaa

SEQ ID NO: 877768 - RNA, 22 nt, Human
caggaauguaugauacaguggu

SEQ ID NO: 877769 - RNA, 22 nt, Human
auuucugauacccggucacccu

SEQ ID NO: 877770 - RNA, 22 nt, Human
ggaaugaagaaauagauggugu

SEQ ID NO: 877771 - RNA, 22 nt, Human
ugcuucuguauuuugggcuuga

SEQ ID NO: 877772 - RNA, 22 nt, Human
acugccuucaugcagaccccug

SEQ ID NO: 877773 - RNA, 22 nt, Human
guggcagcuacauuuaaugcaa

SEQ ID NO: 877774 - RNA, 21 nt, Human
acccccacaccuccuuaguuc

SEQ ID NO: 877775 - RNA, 22 nt, Human
gaaacauugagcagaaggagaa

SEQ ID NO: 877776 - RNA, 22 nt, Human
uguucuuagcaggagcaucuau

SEQ ID NO: 877777 - RNA, 22 nt, Human
cagcauggugccagugagucca

SEQ ID NO: 877778 - RNA, 22 nt, Human
cacauuucugugagucaauauu

SEQ ID NO: 877779 - RNA, 22 nt, Human
uauguaucuuuuguuuucccug

SEQ ID NO: 877780 - RNA, 22 nt, Human
ucuauauaaccuccacuucuac

SEQ ID NO: 877781 - RNA, 22 nt, Human
uagcugccuuugggcuccugcu

SEQ ID NO: 877782 - RNA, 22 nt, Human
agagguagagguugcagugagc

SEQ ID NO: 877783 - RNA, 22 nt, Human
ugcuuucuuuagcuccugaguc

SEQ ID NO: 877784 - RNA, 22 nt, Human
caaggcaagucauaugggcaag

SEQ ID NO: 877785 - RNA, 22 nt, Human
cucuuaaaaacuugauauauuu

SEQ ID NO: 877786 - RNA, 23 nt, Human
uauacacauguggcaguauagug

SEQ ID NO: 877787 - RNA, 22 nt, Human
cuuuggaggaccuaugugcaau

SEQ ID NO: 877788 - RNA, 22 nt, Human
ugcccaggauugugaggucagg

SEQ ID NO: 877789 - RNA, 20 nt, Human
gcaauuaauuuuugguuaca

SEQ ID NO: 877790 - RNA, 22 nt, Human
gcuguucucuguaacaugcauu

SEQ ID NO: 877791 - RNA, 21 nt, Human
cugugucgcucucgcugggag

SEQ ID NO: 877792 - RNA, 22 nt, Human
caacuucagggaaacaugaagc

SEQ ID NO: 877793 - RNA, 22 nt, Human
cugcagagcauaaaucugaaua

SEQ ID NO: 877794 - RNA, 22 nt, Human
uuaaaagagacuuccuuuguuu

SEQ ID NO: 877795 - RNA, 22 nt, Human
ggugcagcuggacagagaagcc

SEQ ID NO: 877796 - RNA, 22 nt, Human
ucuuuggaguguuaucaguaau

SEQ ID NO: 877797 - RNA, 22 nt, Human
acuacagugugauaagaggggc

SEQ ID NO: 877798 - RNA, 22 nt, Human
caggcagagaggagcauuuaau

SEQ ID NO: 877799 - RNA, 20 nt, Human
guaaugaauguaaacaguaa

SEQ ID NO: 877800 - RNA, 20 nt, Human
ucuuuguuaauuuuaucucc

SEQ ID NO: 877801 - RNA, 19 nt, Human
ugcaagugucuuggacaag

SEQ ID NO: 877802 - RNA, 22 nt, Human
aggcucagauccuuguguccug

SEQ ID NO: 877803 - RNA, 22 nt, Human
uaagagaaggaucuguuccagg

SEQ ID NO: 877804 - RNA, 22 nt, Human
acucuuacucccucaggcacug

SEQ ID NO: 877805 - RNA, 22 nt, Human
gggaaggcauaccugagggaga

SEQ ID NO: 877806 - RNA, 22 nt, Human
uugggcugggcaagaaucaaug

SEQ ID NO: 877807 - RNA, 22 nt, Human
ggggcagagagaaggaagcuug

SEQ ID NO: 877808 - RNA, 22 nt, Human
gcugcagcccugcggaucacuu

SEQ ID NO: 877809 - RNA, 22 nt, Human
ugggcucuagacuuuagugugg

SEQ ID NO: 877810 - RNA, 22 nt, Human
auggcaguacguugaaaauuuu

SEQ ID NO: 877811 - RNA, 17 nt, Human
ccuguuguugccuuugc

SEQ ID NO: 877812 - RNA, 22 nt, Human
ggugcugauguuauugaugcug

SEQ ID NO: 877813 - RNA, 22 nt, Human
aaacagcuuguuucaggaaagu

SEQ ID NO: 877814 - RNA, 22 nt, Human
uuucuucaauugcuaacaagga

SEQ ID NO: 877815 - RNA, 19 nt, Human
ccaggagcaguggugagcu

SEQ ID NO: 877816 - RNA, 22 nt, Human
auguggccuuagguucuagugg

SEQ ID NO: 877817 - RNA, 18 nt, Human
cugccuguugcugagagg

SEQ ID NO: 877818 - RNA, 22 nt, Human
aagcugugaaauagauuacaca

SEQ ID NO: 877819 - RNA, 22 nt, Human
auauauaagcugaugagccaca

SEQ ID NO: 877820 - RNA, 22 nt, Human
uggccacaguguccagcagcag

SEQ ID NO: 877821 - RNA, 22 nt, Human
aauguucaaacagaucacuuag

SEQ ID NO: 877822 - RNA, 22 nt, Human
ugccuuccuggagcugaaggcu

SEQ ID NO: 877823 - RNA, 22 nt, Human
auacacauguguaugugcaugc

SEQ ID NO: 877824 - RNA, 22 nt, Human
cucugggaauucugagcaagca

SEQ ID NO: 877825 - RNA, 22 nt, Human
cuuuccaacucuagugaaauuu

SEQ ID NO: 877826 - RNA, 18 nt, Human
acagggaugggguaagug

SEQ ID NO: 877827 - RNA, 22 nt, Human
ggucagguagcucugacaggcc

SEQ ID NO: 877828 - RNA, 22 nt, Human
aggagccaccuaggagcuguuu

SEQ ID NO: 877829 - RNA, 22 nt, Human
ucugcuguguugaaugauuggu

SEQ ID NO: 877830 - RNA, 22 nt, Human
agcccagccacuauuaaauguu

SEQ ID NO: 877831 - RNA, 22 nt, Human
gugcuagggacaaagcagugaa

SEQ ID NO: 877832 - RNA, 22 nt, Human
agcaguuugaaucaauggccag

SEQ ID NO: 877833 - RNA, 21 nt, Human
gggcuggauauuggaaagagg

SEQ ID NO: 877834 - RNA, 22 nt, Human
uuucuuuuccaauaucccuacu

SEQ ID NO: 877835 - RNA, 21 nt, Human
agucuucuccagaggcugggg

SEQ ID NO: 877836 - RNA, 22 nt, Human
cacaggaacaaagaagacaauu

SEQ ID NO: 877837 - RNA, 22 nt, Human
accaggaaauuuggcaacaaag

SEQ ID NO: 877838 - RNA, 17 nt, Human
auuccacagggaaucug

SEQ ID NO: 877839 - RNA, 23 nt, Human
gcaguggaaugucucuguuugga

SEQ ID NO: 877840 - RNA, 22 nt, Human
uaaguacauuugggaccaccug

SEQ ID NO: 877841 - RNA, 18 nt, Human
ugcacugugcugaguggc

SEQ ID NO: 877842 - RNA, 19 nt, Human
ggucagagagauccaggcu

SEQ ID NO: 877843 - RNA, 22 nt, Human
uuguucuagccuccuguuuuga

SEQ ID NO: 877844 - RNA, 22 nt, Human
ugaaauguuaaacaaguggcuc

SEQ ID NO: 877845 - RNA, 22 nt, Human
guggcacaaggcuuacacagca

SEQ ID NO: 877846 - RNA, 20 nt, Human
gcagagugugagagggugaa

SEQ ID NO: 877847 - RNA, 22 nt, Human
uuggcccuccaccuggcugugc

SEQ ID NO: 877848 - RNA, 22 nt, Human
auuuuuucuguaaacuggccuu

SEQ ID NO: 877849 - RNA, 17 nt, Human
auacauuguuaaaguau

SEQ ID NO: 877850 - RNA, 22 nt, Human
uaugucuuaauccuuccuuagg

SEQ ID NO: 877851 - RNA, 22 nt, Human
ccuuuacaguaugguuguauca

SEQ ID NO: 877852 - RNA, 21 nt, Human
aaggggcaaacccaggacacc

SEQ ID NO: 877853 - RNA, 19 nt, Human
ucugcagacuauauuguga

SEQ ID NO: 877854 - RNA, 22 nt, Human
aauuaauauuuguggaauuaau

SEQ ID NO: 877855 - RNA, 22 nt, Human
caggguccccgggucuccugug

SEQ ID NO: 877856 - RNA, 22 nt, Human
ucucugcugagaagggcuggca

SEQ ID NO: 877857 - RNA, 22 nt, Human
ucuccccaaaggacucacucuc

SEQ ID NO: 877858 - RNA, 22 nt, Human
gaaauagaucucugggaugcaa

SEQ ID NO: 877859 - RNA, 22 nt, Human
uggaaaaugugacuauucuaaa

SEQ ID NO: 877860 - RNA, 22 nt, Human
caugacauuuuaaaaagaacau

SEQ ID NO: 877861 - RNA, 22 nt, Human
ugaggcaguugagcuuccugag

SEQ ID NO: 877862 - RNA, 21 nt, Human
caguuacagccaggacaaggc

SEQ ID NO: 877863 - RNA, 22 nt, Human
uuuuauguaauccuuacugucg

SEQ ID NO: 877864 - RNA, 21 nt, Human
aaagagacaaauggcauauac

SEQ ID NO: 877865 - RNA, 22 nt, Human
acacauuaggcagugcuuaaau

SEQ ID NO: 877866 - RNA, 22 nt, Human
ugaggucacagcuggggaugga

SEQ ID NO: 877867 - RNA, 22 nt, Human
uuugcuuguucaagauuucugu

SEQ ID NO: 877868 - RNA, 22 nt, Human
agugucugaaccaccggggcau

SEQ ID NO: 877869 - RNA, 21 nt, Human
auuuacaaaacagucccuucc

SEQ ID NO: 877870 - RNA, 22 nt, Human
acuuaggccuugcuaagcauuu

SEQ ID NO: 877871 - RNA, 22 nt, Human
agauacauuugugugcauguau

SEQ ID NO: 877872 - RNA, 19 nt, Human
ggcugugguggugccuugc

SEQ ID NO: 877873 - RNA, 22 nt, Human
acguuagaaaagcaggagcuca

SEQ ID NO: 877874 - RNA, 22 nt, Human
aaauugaaugauuaagugguga

SEQ ID NO: 877875 - RNA, 18 nt, Human
gcucugguuccuucaacc

SEQ ID NO: 877876 - RNA, 22 nt, Human
cugcuuuagguggaauguucua

SEQ ID NO: 877877 - RNA, 22 nt, Human
ugcuggaagaauuccaugcugg

SEQ ID NO: 877878 - RNA, 23 nt, Human
cuguauuugacuugagcggaaau

SEQ ID NO: 877879 - RNA, 22 nt, Human
uaaauguuguaaguacaucuaa

SEQ ID NO: 877880 - RNA, 21 nt, Human
ugagccaggcugacggcugug

SEQ ID NO: 877881 - RNA, 22 nt, Human
agccagcuucuuuacgguggca

SEQ ID NO: 877882 - RNA, 18 nt, Human
gcugucugaggucugagg

SEQ ID NO: 877883 - RNA, 22 nt, Human
ggugggagggcugcguuccucu

SEQ ID NO: 877884 - RNA, 22 nt, Human
aguaacaaauauucauuggauu

SEQ ID NO: 877885 - RNA, 22 nt, Human
cugcagccucaaccuccugagc

SEQ ID NO: 877886 - RNA, 22 nt, Human
uuguccauugugacaagugugg

SEQ ID NO: 877887 - RNA, 22 nt, Human
auauaguuuaagaaaguacagu

SEQ ID NO: 877888 - RNA, 21 nt, Human
ugacugaggcuucuucacaca

SEQ ID NO: 877889 - RNA, 22 nt, Human
cagggcagugaagaacacacgu

SEQ ID NO: 877890 - RNA, 22 nt, Human
uggaaauggaucugaugagucu

SEQ ID NO: 877891 - RNA, 22 nt, Human
cacacugacuggaaucaaggau

SEQ ID NO: 877892 - RNA, 22 nt, Human
cugguccuaaagcccuacucca

SEQ ID NO: 877893 - RNA, 20 nt, Human
uaagcacaugaacaguccuc

SEQ ID NO: 877894 - RNA, 22 nt, Human
ggugacagccgcuuggcgcuag

SEQ ID NO: 877895 - RNA, 22 nt, Human
agacaugacagauaguugcuag

SEQ ID NO: 877896 - RNA, 22 nt, Human
acauucauuccaggucagucag

SEQ ID NO: 877897 - RNA, 22 nt, Human
cccagcugcaccucuauggccu

SEQ ID NO: 877898 - RNA, 16 nt, Human
ucauuuugagugacag

SEQ ID NO: 877899 - RNA, 22 nt, Human
uuuuaugucauaaggacacuca

SEQ ID NO: 877900 - RNA, 22 nt, Human
cagggcucgcucgcucgcucgc

SEQ ID NO: 877901 - RNA, 22 nt, Human
gaggggaguaaagucauguuac

SEQ ID NO: 877902 - RNA, 19 nt, Human
gggaucagcccagggcucu

SEQ ID NO: 877903 - RNA, 22 nt, Human
gggguagggugauugugaagua

SEQ ID NO: 877904 - RNA, 22 nt, Human
agggaagggcagggucuaugca

SEQ ID NO: 877905 - RNA, 22 nt, Human
ggugaaauuccuuguggaaagu

SEQ ID NO: 877906 - RNA, 22 nt, Human
ccaggaggcagagguuacagug

SEQ ID NO: 877907 - RNA, 21 nt, Human
agguuuauuucaacuucagga

SEQ ID NO: 877908 - RNA, 22 nt, Human
uccuugggucagugagugaggu

SEQ ID NO: 877909 - RNA, 18 nt, Human
ucacagacuuacugggcc

SEQ ID NO: 877910 - RNA, 22 nt, Human
ucaccagggagcuuguccucug

SEQ ID NO: 877911 - RNA, 22 nt, Human
aaagauaauguuuccuuauucu

SEQ ID NO: 877912 - RNA, 22 nt, Human
agcagcagauuauggucuacau

SEQ ID NO: 877913 - RNA, 22 nt, Human
ugucuacuugggcucuacagca

SEQ ID NO: 877914 - RNA, 22 nt, Human
uuuguucugcaucacagaaaaa

SEQ ID NO: 877915 - RNA, 22 nt, Human
acaauuucuuauaguucaauuc

SEQ ID NO: 877916 - RNA, 22 nt, Human
uugauguaauacuuugcaacca

SEQ ID NO: 877917 - RNA, 22 nt, Human
gcucuggacuggggccugagaa

SEQ ID NO: 877918 - RNA, 22 nt, Human
aggcucaggcaggaauggcgga

SEQ ID NO: 877919 - RNA, 22 nt, Human
aagagagacaauagguagcauu

SEQ ID NO: 877920 - RNA, 22 nt, Human
ggagcugcuuugaucugaagaa

SEQ ID NO: 877921 - RNA, 22 nt, Human
guuuagaagccaagauuugggu

SEQ ID NO: 877922 - RNA, 22 nt, Human
ugcugguucuuaggagagagau

SEQ ID NO: 877923 - RNA, 22 nt, Human
ccuuacaaugcaguuuacuuag

SEQ ID NO: 877924 - RNA, 22 nt, Human
auacagauguuaaagcaauuuc

SEQ ID NO: 877925 - RNA, 22 nt, Human
aggagaggcucuaacucugugu

SEQ ID NO: 877926 - RNA, 19 nt, Human
ugaagcagcaaacucucag

SEQ ID NO: 877927 - RNA, 22 nt, Human
cuuauuuugcugaugacccagg

SEQ ID NO: 877928 - RNA, 22 nt, Human
aguauuugauacagucuucuag

SEQ ID NO: 877929 - RNA, 19 nt, Human
ccagagguuugcugggccu

SEQ ID NO: 877930 - RNA, 22 nt, Human
cacugcugauuucauaggcagg

SEQ ID NO: 877931 - RNA, 22 nt, Human
uagcagaaccagucagugagcc

SEQ ID NO: 877932 - RNA, 22 nt, Human
uaggauuuaggcuuuaacaucu

SEQ ID NO: 877933 - RNA, 22 nt, Human
uucauguaauaggauguguuaa

SEQ ID NO: 877934 - RNA, 21 nt, Human
cccaggaguccuauuuaaaug

SEQ ID NO: 877935 - RNA, 20 nt, Human
gcacccagcuucuuguucua

SEQ ID NO: 877936 - RNA, 22 nt, Human
gccuuccuuuuaccaccagcca

SEQ ID NO: 877937 - RNA, 22 nt, Human
auucuaaauguaauuuagaauu

SEQ ID NO: 877938 - RNA, 22 nt, Human
acugggaggcaucuggagcuga

SEQ ID NO: 877939 - RNA, 22 nt, Human
ugcugauuuugccuacugaucc

SEQ ID NO: 877940 - RNA, 22 nt, Human
gacagggaggaaagagacugcu

SEQ ID NO: 877941 - RNA, 22 nt, Human
uuuccuaacacaaugcaugaga

SEQ ID NO: 877942 - RNA, 22 nt, Human
ucugcagaagcucacuaaaucc

SEQ ID NO: 877943 - RNA, 22 nt, Human
ggggcagccuccaggaaagcug

SEQ ID NO: 877944 - RNA, 22 nt, Human
uucucuuaucuggcauuauugg

SEQ ID NO: 877945 - RNA, 22 nt, Human
ucacagagaaauguggcacaaa

SEQ ID NO: 877946 - RNA, 22 nt, Human
aaaugcaucagcucauaagaga

SEQ ID NO: 877947 - RNA, 22 nt, Human
gauauuuugagaaauccuauga

SEQ ID NO: 877948 - RNA, 22 nt, Human
uucucucuuuuggguaggaggu

SEQ ID NO: 877949 - RNA, 22 nt, Human
cagagcccauggcacaugugga

SEQ ID NO: 877950 - RNA, 21 nt, Human
gaaaggucuuaacuuacagag

SEQ ID NO: 877951 - RNA, 20 nt, Human
uaggagcaaugagaguagaa

SEQ ID NO: 877952 - RNA, 20 nt, Human
auacaguaggugcucaauau

SEQ ID NO: 877953 - RNA, 22 nt, Human
uggagcagagaugguggccuuc

SEQ ID NO: 877954 - RNA, 22 nt, Human
agagggggcagcggaccaguga

SEQ ID NO: 877955 - RNA, 22 nt, Human
uauuucuucgggauucaagcua

SEQ ID NO: 877956 - RNA, 22 nt, Human
cccuccagcucaaagcaaccgg

SEQ ID NO: 877957 - RNA, 22 nt, Human
uugcaaaaacugcaauuacuuu

SEQ ID NO: 877958 - RNA, 22 nt, Human
cucuccaguuauagcugauuug

SEQ ID NO: 877959 - RNA, 22 nt, Human
cccaggccagaacuugguugcu

SEQ ID NO: 877960 - RNA, 22 nt, Human
gcugaaguaacucacaucguua

SEQ ID NO: 877961 - RNA, 22 nt, Human
caucaauaggguuugaaagcaa

SEQ ID NO: 877962 - RNA, 22 nt, Human
agaaccaguuuaagauuugggu

SEQ ID NO: 877963 - RNA, 22 nt, Human
cuggcagccaagugggauacuc

SEQ ID NO: 877964 - RNA, 22 nt, Human
gcaaagcaucaguagaaauguu

SEQ ID NO: 877965 - RNA, 22 nt, Human
aagacagccuuucccuggugcc

SEQ ID NO: 877966 - RNA, 22 nt, Human
uagaaaucuuguuacuaugugu

SEQ ID NO: 877967 - RNA, 23 nt, Human
gagcuuuuguaguagucacugug

SEQ ID NO: 877968 - RNA, 22 nt, Human
cccucugcucaggugcauaggc

SEQ ID NO: 877969 - RNA, 22 nt, Human
agugucaacugucuacagggag

SEQ ID NO: 877970 - RNA, 22 nt, Human
gagcugagaagcagcgcuugau

SEQ ID NO: 877971 - RNA, 22 nt, Human
caugggcuacagaagcaugcug

SEQ ID NO: 877972 - RNA, 22 nt, Human
cagcaagauggugaaugagacg

SEQ ID NO: 877973 - RNA, 22 nt, Human
uuccugagggccccagaggagg

SEQ ID NO: 877974 - RNA, 22 nt, Human
agacagaacagaauaauuguug

SEQ ID NO: 877975 - RNA, 22 nt, Human
ucuuugguauucacuugugaag

SEQ ID NO: 877976 - RNA, 22 nt, Human
gaggccagaaugagcugaaugc

SEQ ID NO: 877977 - RNA, 22 nt, Human
gaggugaaaguuauucauuuau

SEQ ID NO: 877978 - RNA, 22 nt, Human
cagaggaacguuuggauugauu

SEQ ID NO: 877979 - RNA, 22 nt, Human
uucuuacauuacuuuacaugug

SEQ ID NO: 877980 - RNA, 22 nt, Human
ccaggcagagugcuccagaaag

SEQ ID NO: 877981 - RNA, 22 nt, Human
gcagggcucauugccaggcauu

SEQ ID NO: 877982 - RNA, 22 nt, Human
cugugccagccugucccaggag

SEQ ID NO: 877983 - RNA, 22 nt, Human
uugcuaugugagauggcucaag

SEQ ID NO: 877984 - RNA, 22 nt, Human
auguccagcaugacacauucuc

SEQ ID NO: 877985 - RNA, 22 nt, Human
aauuagaagcuguuagcaaaau

SEQ ID NO: 877986 - RNA, 22 nt, Human
guauuguauauuugcaaauaca

SEQ ID NO: 877987 - RNA, 22 nt, Human
ggaaagagcccagcagugcuug

SEQ ID NO: 877988 - RNA, 22 nt, Human
gagggcucugaaaggaggucac

SEQ ID NO: 877989 - RNA, 22 nt, Human
auacuuuuaauuccuucugagu

SEQ ID NO: 877990 - RNA, 22 nt, Human
gaugaaaaaagacgagcauaua

SEQ ID NO: 877991 - RNA, 22 nt, Human
cagugcugguguaggcugacca

SEQ ID NO: 877992 - RNA, 22 nt, Human
uuuuucaagacaaccugcaugu

SEQ ID NO: 877993 - RNA, 22 nt, Human
ggaugaggaaaccacagugucc

SEQ ID NO: 877994 - RNA, 22 nt, Human
uccucccaacuuuuccaucuca

SEQ ID NO: 877995 - RNA, 19 nt, Human
aguuccacacuuuaucugg

SEQ ID NO: 877996 - RNA, 22 nt, Human
auuuccuauggauacaggcaga

SEQ ID NO: 877997 - RNA, 22 nt, Human
acagaugagaaggcugaccagu

SEQ ID NO: 877998 - RNA, 22 nt, Human
gcuuaauucuggcucaguuucc

SEQ ID NO: 877999 - RNA, 22 nt, Human
uuaaaguaugguuuaagggcuu

SEQ ID NO: 878000 - RNA, 22 nt, Human
gaggccagccccucuugaaggc

SEQ ID NO: 878001 - RNA, 22 nt, Human
ccuugagacacagccaaagaug

SEQ ID NO: 878002 - RNA, 22 nt, Human
augcauaagugcagcagauuug

SEQ ID NO: 878003 - RNA, 17 nt, Human
cccagggaccacugcuu

SEQ ID NO: 878004 - RNA, 22 nt, Human
ugcuuuaucugacuuggcgcug

SEQ ID NO: 878005 - RNA, 20 nt, Human
uggcccagcacgacgaggac

SEQ ID NO: 878006 - RNA, 22 nt, Human
uuguacaaaggauuuggaagag

SEQ ID NO: 878007 - RNA, 22 nt, Human
auggggugagacuaggauuaaa

SEQ ID NO: 878008 - RNA, 22 nt, Human
ccuguguggccaggcuggaguc

SEQ ID NO: 878009 - RNA, 22 nt, Human
cugugaaugcuaguaagagugc

SEQ ID NO: 878010 - RNA, 22 nt, Human
gagaauuagggcguaauucaga

SEQ ID NO: 878011 - RNA, 22 nt, Human
acccucagacauauuccaucau

SEQ ID NO: 878012 - RNA, 23 nt, Human
acaaaguaauuccugcuuccaaa

SEQ ID NO: 878013 - RNA, 22 nt, Human
aggugcagcaugaguccaacgg

SEQ ID NO: 878014 - RNA, 22 nt, Human
uggggaaggcggagcuugcagc

SEQ ID NO: 878015 - RNA, 22 nt, Human
uucuuccucacacucucaccca

SEQ ID NO: 878016 - RNA, 22 nt, Human
caggcaaggagcuggcucaagu

SEQ ID NO: 878017 - RNA, 22 nt, Human
agaguggguuauaggcagacuu

SEQ ID NO: 878018 - RNA, 22 nt, Human
uccaccagagcccucuuugcgg

SEQ ID NO: 878019 - RNA, 18 nt, Human
acagacaaaauggaaaug

SEQ ID NO: 878020 - RNA, 22 nt, Human
ugauaaacagcugaugaagacc

SEQ ID NO: 878021 - RNA, 22 nt, Human
guggcaucaagauuuagauuca

SEQ ID NO: 878022 - RNA, 22 nt, Human
auccaucccaucuucaccaggg

SEQ ID NO: 878023 - RNA, 21 nt, Human
uuuacugagcacuuacuaugu

SEQ ID NO: 878024 - RNA, 22 nt, Human
gaaauguagaauugcuuaacug

SEQ ID NO: 878025 - RNA, 22 nt, Human
ugugaguugcucuuuugcuacu

SEQ ID NO: 878026 - RNA, 22 nt, Human
caugcacuuaccugaaauucaa

SEQ ID NO: 878027 - RNA, 22 nt, Human
aaagcaaugaugguagacacgu

SEQ ID NO: 878028 - RNA, 22 nt, Human
uggcacugccaaccugcuaggu

SEQ ID NO: 878029 - RNA, 22 nt, Human
gcuccuggcucucugagggcug

SEQ ID NO: 878030 - RNA, 22 nt, Human
uacaguaccagaaaugcuaaga

SEQ ID NO: 878031 - RNA, 22 nt, Human
caggugaguaacaaugggugau

SEQ ID NO: 878032 - RNA, 22 nt, Human
gccuggugaaaggcagagagcg

SEQ ID NO: 878033 - RNA, 22 nt, Human
ugcagggaccccgaggcucucu

SEQ ID NO: 878034 - RNA, 22 nt, Human
uaaauagaaucuaaacugcuca

SEQ ID NO: 878035 - RNA, 19 nt, Human
uaauaagcaauauggaagu

SEQ ID NO: 878036 - RNA, 22 nt, Human
acuaggggcucaggcccaggga

SEQ ID NO: 878037 - RNA, 20 nt, Human
gugugaccuccuguggaugc

SEQ ID NO: 878038 - RNA, 22 nt, Human
aaauuacagaucaccaaugcau

SEQ ID NO: 878039 - RNA, 22 nt, Human
aagugcaagcaggacuuaguuu

SEQ ID NO: 878040 - RNA, 22 nt, Human
aggagcugguagucucauuggg

SEQ ID NO: 878041 - RNA, 22 nt, Human
aauuccauccauuuguuucaac

SEQ ID NO: 878042 - RNA, 22 nt, Human
uagcccagaugauugaaccaug

SEQ ID NO: 878043 - RNA, 19 nt, Human
caggugguaaucugagccu

SEQ ID NO: 878044 - RNA, 22 nt, Human
acuguggauaagucagagaugu

SEQ ID NO: 878045 - RNA, 22 nt, Human
cagaaacuuuugaugaguguau

SEQ ID NO: 878046 - RNA, 22 nt, Human
cauguauauuuuauguggagag

SEQ ID NO: 878047 - RNA, 22 nt, Human
agugggcugagcuugcugggug

SEQ ID NO: 878048 - RNA, 22 nt, Human
uaaugaacaucuuaaucugaaa

SEQ ID NO: 878049 - RNA, 22 nt, Human
caguuuaaguagaacugagaau

SEQ ID NO: 878050 - RNA, 22 nt, Human
aggcuggcugaaaaacacccuu

SEQ ID NO: 878051 - RNA, 22 nt, Human
ucaaaggaguuuaaguuacugg

SEQ ID NO: 878052 - RNA, 22 nt, Human
auggaaaagggucuuucauuuc

SEQ ID NO: 878053 - RNA, 22 nt, Human
gggcuucucucaggggcaugag

SEQ ID NO: 878054 - RNA, 19 nt, Human
auuuccaagaauuggagag

SEQ ID NO: 878055 - RNA, 22 nt, Human
uucucugccucuagcuauauuc

SEQ ID NO: 878056 - RNA, 22 nt, Human
uccaggcaucuguauuuuuuaa

SEQ ID NO: 878057 - RNA, 22 nt, Human
ucuuaauugagaacaguguagg

SEQ ID NO: 878058 - RNA, 22 nt, Human
uugcaauugcuauggagagcgu

SEQ ID NO: 878059 - RNA, 22 nt, Human
acagaggggucacagccugaag

SEQ ID NO: 878060 - RNA, 22 nt, Human
guugaauaucccguaucuuaaa

SEQ ID NO: 878061 - RNA, 22 nt, Human
auagcauggccugugacacuuu

SEQ ID NO: 878062 - RNA, 22 nt, Human
aguucacuuucuguaguggaag

SEQ ID NO: 878063 - RNA, 21 nt, Human
agccaagccuugggagccagg

SEQ ID NO: 878064 - RNA, 22 nt, Human
uagcaaaugccugguuaauuag

SEQ ID NO: 878065 - RNA, 22 nt, Human
ccagccucacuggcaucaccua

SEQ ID NO: 878066 - RNA, 22 nt, Human
cccagggcuuuucucacuagac

SEQ ID NO: 878067 - RNA, 22 nt, Human
ccagcaagguccagcauaggga

SEQ ID NO: 878068 - RNA, 22 nt, Human
aggcuaguaucaucuacuuuug

SEQ ID NO: 878069 - RNA, 22 nt, Human
aggaaugaacucgagugaucug

SEQ ID NO: 878070 - RNA, 22 nt, Human
uagaaugaccuccucuuagcuu

SEQ ID NO: 878071 - RNA, 22 nt, Human
cggcugaggaucuccaggccug

SEQ ID NO: 878072 - RNA, 22 nt, Human
ugcaggguauccuugucucugc

SEQ ID NO: 878073 - RNA, 22 nt, Human
cugcggugggcugggcuguccc

SEQ ID NO: 878074 - RNA, 22 nt, Human
agagugcuuaaagcuggcuuug

SEQ ID NO: 878075 - RNA, 22 nt, Human
gggacgggcaguccaagggguc

SEQ ID NO: 878076 - RNA, 22 nt, Human
gcuuguuucuauuuaucaagua

SEQ ID NO: 878077 - RNA, 22 nt, Human
ucaggauaaaauguaauggcaa

SEQ ID NO: 878078 - RNA, 22 nt, Human
ucagugaugagguggcuuucaa

SEQ ID NO: 878079 - RNA, 22 nt, Human
aauucauccaugaacaauucca

SEQ ID NO: 878080 - RNA, 22 nt, Human
ggacaugauauuucaggaagac

SEQ ID NO: 878081 - RNA, 22 nt, Human
uacuuuuuaugauaagaacuga

SEQ ID NO: 878082 - RNA, 22 nt, Human
acaguaaacaaugcagcaaauu

SEQ ID NO: 878083 - RNA, 21 nt, Human
ccaggcuccugaggcugguca

SEQ ID NO: 878084 - RNA, 21 nt, Human
uauugcauaacaaauuacccu

SEQ ID NO: 878085 - RNA, 18 nt, Human
aauuucuuugacaacuua

SEQ ID NO: 878086 - RNA, 22 nt, Human
ugcaggcucaucucaagaguag

SEQ ID NO: 878087 - RNA, 18 nt, Human
ccuguggcucagcccaca

SEQ ID NO: 878088 - RNA, 22 nt, Human
ucucucagaacugcagcugcag

SEQ ID NO: 878089 - RNA, 22 nt, Human
ucuuuggaauuugcuggaaaua

SEQ ID NO: 878090 - RNA, 22 nt, Human
gagaucgguaaagagcaugcac

SEQ ID NO: 878091 - RNA, 22 nt, Human
ugcaucaaaacuggacuccuuc

SEQ ID NO: 878092 - RNA, 22 nt, Human
aaguguuuagguuugcagucga

SEQ ID NO: 878093 - RNA, 22 nt, Human
ggcagcugucucugaguuagca

SEQ ID NO: 878094 - RNA, 22 nt, Human
auaaaaaugagggcgguagcua

SEQ ID NO: 878095 - RNA, 22 nt, Human
agaggggcgggaacucaaccuc

SEQ ID NO: 878096 - RNA, 22 nt, Human
agcuggagaucaugcugauacu

SEQ ID NO: 878097 - RNA, 22 nt, Human
ugaaaucaucugccaauaaguu

SEQ ID NO: 878098 - RNA, 22 nt, Human
uggccugggugcugcugacauc

SEQ ID NO: 878099 - RNA, 22 nt, Human
uuuguaagcaaaaaguccauuc

SEQ ID NO: 878100 - RNA, 22 nt, Human
ggggcagaaguagugccccuga

SEQ ID NO: 878101 - RNA, 22 nt, Human
cugcuggaaguuugcuguggau

SEQ ID NO: 878102 - RNA, 22 nt, Human
ggucagagggugggcugccugu

SEQ ID NO: 878103 - RNA, 22 nt, Human
cccugaggcugaggauaggugg

SEQ ID NO: 878104 - RNA, 22 nt, Human
agcaaagcugauuaagagcaca

SEQ ID NO: 878105 - RNA, 22 nt, Human
cccauggguuuuccucccugcc

SEQ ID NO: 878106 - RNA, 22 nt, Human
auagaauaugacuuuuagaucc

SEQ ID NO: 878107 - RNA, 22 nt, Human
auaaagucauuucaaaaguuga

SEQ ID NO: 878108 - RNA, 22 nt, Human
gaccacagcagugcaagaggag

SEQ ID NO: 878109 - RNA, 22 nt, Human
ugguggcaaaagaggcaaagug

SEQ ID NO: 878110 - RNA, 22 nt, Human
cauuagagcagauaauaugugu

SEQ ID NO: 878111 - RNA, 22 nt, Human
agcuuuaucccuugcccaucga

SEQ ID NO: 878112 - RNA, 22 nt, Human
cagacaucacacucagauugca

SEQ ID NO: 878113 - RNA, 22 nt, Human
agaagccaagaacagacagugc

SEQ ID NO: 878114 - RNA, 22 nt, Human
ucaguugcuagaagggggaacc

SEQ ID NO: 878115 - RNA, 22 nt, Human
uccucaggucaaagcaggagaa

SEQ ID NO: 878116 - RNA, 22 nt, Human
caggcugcugacaggcuuggag

SEQ ID NO: 878117 - RNA, 22 nt, Human
cacagguccuuccugcccuggg

SEQ ID NO: 878118 - RNA, 22 nt, Human
aaauagaauuggaagcagaguu

SEQ ID NO: 878119 - RNA, 22 nt, Human
auggaaauaucuuuagagcuua

SEQ ID NO: 878120 - RNA, 22 nt, Human
gcacccagaggucagcagugcu

SEQ ID NO: 878121 - RNA, 22 nt, Human
agccagccgggggaccacagug

SEQ ID NO: 878122 - RNA, 18 nt, Human
ggaaaccacaggguucug

SEQ ID NO: 878123 - RNA, 22 nt, Human
aacauuuacaaauccuucugca

SEQ ID NO: 878124 - RNA, 22 nt, Human
cucacagauacggcuauuccug

SEQ ID NO: 878125 - RNA, 22 nt, Human
agcccagguucuaaagccaaac

SEQ ID NO: 878126 - RNA, 22 nt, Human
cagggaugucucuggaagggag

SEQ ID NO: 878127 - RNA, 20 nt, Human
gcugggggugugcugaguga

SEQ ID NO: 878128 - RNA, 22 nt, Human
uauaagaaacaaggcaaauuuu

SEQ ID NO: 878129 - RNA, 23 nt, Human
aagauacagguguggaaugguuu

SEQ ID NO: 878130 - RNA, 22 nt, Human
auguacacuuuggaagagucac

SEQ ID NO: 878131 - RNA, 22 nt, Human
ucuguucuuuccaacaagacag

SEQ ID NO: 878132 - RNA, 18 nt, Human
ucauucaaagucuacuga

SEQ ID NO: 878133 - RNA, 22 nt, Human
uuacccaggaaagaaaugguau

SEQ ID NO: 878134 - RNA, 22 nt, Human
agacgcuauuuugaggggucua

SEQ ID NO: 878135 - RNA, 22 nt, Human
agaaaacuugcucgagccuguu

SEQ ID NO: 878136 - RNA, 22 nt, Human
uguaaccaugaugagcagguau

SEQ ID NO: 878137 - RNA, 22 nt, Human
uguucaaguggauguggcuuuu

SEQ ID NO: 878138 - RNA, 22 nt, Human
ccucugaguguuuuccccgggu

SEQ ID NO: 878139 - RNA, 22 nt, Human
gcagcagaguagacagagcccu

SEQ ID NO: 878140 - RNA, 22 nt, Human
ugcaauaacccaguaucuguga

SEQ ID NO: 878141 - RNA, 23 nt, Human
gcccucaguagaaaauguuagaa

SEQ ID NO: 878142 - RNA, 22 nt, Human
aucaugaaucuuguguucuaug

SEQ ID NO: 878143 - RNA, 22 nt, Human
agauacauuaguaguuacuugu

SEQ ID NO: 878144 - RNA, 22 nt, Human
uaggacuuagucuaauuuuucu

SEQ ID NO: 878145 - RNA, 20 nt, Human
uucuagcauacuuacaagga

SEQ ID NO: 878146 - RNA, 22 nt, Human
gucacccugcuggcuguucagc

SEQ ID NO: 878147 - RNA, 22 nt, Human
cauguaaauccuucuuuaggcc

SEQ ID NO: 878148 - RNA, 22 nt, Human
gauaggauuauucccauuucca

SEQ ID NO: 878149 - RNA, 22 nt, Human
ugcacgugggcucucugcucuu

SEQ ID NO: 878150 - RNA, 20 nt, Human
cucucccagcacagcuuccu

SEQ ID NO: 878151 - RNA, 20 nt, Human
agugacagagacuguguggc

SEQ ID NO: 878152 - RNA, 22 nt, Human
agggcugccugcucugcauuga

SEQ ID NO: 878153 - RNA, 22 nt, Human
ugucagggcaugcgguccagcc

SEQ ID NO: 878154 - RNA, 22 nt, Human
ccucuggcuuacuguuggguuu

SEQ ID NO: 878155 - RNA, 22 nt, Human
uauucagaggguugaauuuuua

SEQ ID NO: 878156 - RNA, 22 nt, Human
guugaauaauucauagaagcua

SEQ ID NO: 878157 - RNA, 22 nt, Human
cagcaccauuuuccuggucagc

SEQ ID NO: 878158 - RNA, 22 nt, Human
cuuccaggugcuggccuggccu

SEQ ID NO: 878159 - RNA, 22 nt, Human
caggaaauauaggaaaaggaac

SEQ ID NO: 878160 - RNA, 22 nt, Human
ugaugucugccaggguccuggg

SEQ ID NO: 878161 - RNA, 22 nt, Human
uuugacuccuguguuucuggaa

SEQ ID NO: 878162 - RNA, 21 nt, Human
ucuuccugcuccacacucccc

SEQ ID NO: 878163 - RNA, 22 nt, Human
aaggaucauaguaaacauugau

SEQ ID NO: 878164 - RNA, 22 nt, Human
uccugcugcucuugggaaaccu

SEQ ID NO: 878165 - RNA, 22 nt, Human
ugaaagaagugucacauugcca

SEQ ID NO: 878166 - RNA, 22 nt, Human
cccagcuccuuggaugggcagg

SEQ ID NO: 878167 - RNA, 22 nt, Human
aucuucaauauuuuuguguaga

SEQ ID NO: 878168 - RNA, 22 nt, Human
uucugguggccagaagucugaa

SEQ ID NO: 878169 - RNA, 22 nt, Human
gagaggugaaauaguuguccgg

SEQ ID NO: 878170 - RNA, 22 nt, Human
cagcccuggcuagggcgagggc

SEQ ID NO: 878171 - RNA, 22 nt, Human
gaggcaggcccugaaugaguca

SEQ ID NO: 878172 - RNA, 22 nt, Human
gugauaucuuacaauucucuuu

SEQ ID NO: 878173 - RNA, 22 nt, Human
ccacuuuucuacccacugugac

SEQ ID NO: 878174 - RNA, 22 nt, Human
gcaggaguggagaccaugggga

SEQ ID NO: 878175 - RNA, 22 nt, Human
ucuggcucuccagugcucuuag

SEQ ID NO: 878176 - RNA, 22 nt, Human
ugucuuaaacuugugggacuuc

SEQ ID NO: 878177 - RNA, 20 nt, Human
ugucuuuccauggcuggauc

SEQ ID NO: 878178 - RNA, 22 nt, Human
gaccugaaaugggggccugucc

SEQ ID NO: 878179 - RNA, 22 nt, Human
agggcucacuacaacccuggga

SEQ ID NO: 878180 - RNA, 22 nt, Human
uacauagaauauuucacuuaaa

SEQ ID NO: 878181 - RNA, 22 nt, Human
auaauauugagucaggaccuga

SEQ ID NO: 878182 - RNA, 22 nt, Human
caggccagcagggccuccgugg

SEQ ID NO: 878183 - RNA, 22 nt, Human
ugaaaauucaucucauagcaga

SEQ ID NO: 878184 - RNA, 22 nt, Human
uuccuucuaauauucugccugu

SEQ ID NO: 878185 - RNA, 22 nt, Human
uuaaagcaucacacuauuaauu

SEQ ID NO: 878186 - RNA, 22 nt, Human
aaggggcucuugucaggcgcag

SEQ ID NO: 878187 - RNA, 23 nt, Human
gcucaggcaucauucuuccuggc

SEQ ID NO: 878188 - RNA, 22 nt, Human
uauuuaaaauagugcuccagca

SEQ ID NO: 878189 - RNA, 22 nt, Human
ccugggugucaugggcagcugg

SEQ ID NO: 878190 - RNA, 21 nt, Human
uaaauaauaaguugcugagau

SEQ ID NO: 878191 - RNA, 22 nt, Human
gccaggguucgaauccguaugg

SEQ ID NO: 878192 - RNA, 20 nt, Human
ccaauguuuacagauuacuu

SEQ ID NO: 878193 - RNA, 22 nt, Human
gccacugauuccaagucaauuu

SEQ ID NO: 878194 - RNA, 22 nt, Human
ccucugcccuuuuccuguauca

SEQ ID NO: 878195 - RNA, 21 nt, Human
gcucugugaaauuucaccagg

SEQ ID NO: 878196 - RNA, 22 nt, Human
ggcccacacugacagcugagcu

SEQ ID NO: 878197 - RNA, 22 nt, Human
aaaguguuuacauugcuauaag

SEQ ID NO: 878198 - RNA, 22 nt, Human
uuauaguauuagguacucaaca

SEQ ID NO: 878199 - RNA, 22 nt, Human
uuaauccauggcaguuauuaaa

SEQ ID NO: 878200 - RNA, 22 nt, Human
uguuaaauugauucaccuuucu

SEQ ID NO: 878201 - RNA, 22 nt, Human
uguccaggucagcagcagggac

SEQ ID NO: 878202 - RNA, 22 nt, Human
gagaggcccugaagcccacaga

SEQ ID NO: 878203 - RNA, 22 nt, Human
ggcagugagaggucuccugguc

SEQ ID NO: 878204 - RNA, 22 nt, Human
uggaagagacacuuacauucag

SEQ ID NO: 878205 - RNA, 22 nt, Human
ggaaaggcuaacagucauggaa

SEQ ID NO: 878206 - RNA, 21 nt, Human
agagcugguagguagguaggu

SEQ ID NO: 878207 - RNA, 22 nt, Human
gaugagggccugguggcugugc

SEQ ID NO: 878208 - RNA, 22 nt, Human
accucugggaaaaguauggaaa

SEQ ID NO: 878209 - RNA, 22 nt, Human
gaagaaggugcuacacagggca

SEQ ID NO: 878210 - RNA, 22 nt, Human
agacaguaauaaaauagguaag

SEQ ID NO: 878211 - RNA, 22 nt, Human
aaguucuaauuuugcauucagg

SEQ ID NO: 878212 - RNA, 22 nt, Human
uacaaugcugugcauguaaugg

SEQ ID NO: 878213 - RNA, 22 nt, Human
gcaagagacuuuuaugucugcc

SEQ ID NO: 878214 - RNA, 22 nt, Human
cuguccugaggcagguggccug

SEQ ID NO: 878215 - RNA, 19 nt, Human
cccaaggcccugggcaggc

SEQ ID NO: 878216 - RNA, 22 nt, Human
gggaccaggucagggcucugac

SEQ ID NO: 878217 - RNA, 22 nt, Human
ugcucaggaggaggcugugagg

SEQ ID NO: 878218 - RNA, 22 nt, Human
uucacauuacaaggccauauuu

SEQ ID NO: 878219 - RNA, 22 nt, Human
uuuacuacuugugauaacugaa

SEQ ID NO: 878220 - RNA, 18 nt, Human
gaaagugcggggcagggg

SEQ ID NO: 878221 - RNA, 22 nt, Human
gcugccaugccacagcacucac

SEQ ID NO: 878222 - RNA, 22 nt, Human
auucuaagucuuguucacauuc

SEQ ID NO: 878223 - RNA, 22 nt, Human
cugggagucaccaggagcaagg

SEQ ID NO: 878224 - RNA, 22 nt, Human
guggaaggaagagauggcccca

SEQ ID NO: 878225 - RNA, 22 nt, Human
caguaauaacacagaaaguuug

SEQ ID NO: 878226 - RNA, 22 nt, Human
caugggcccgugagaggcaggg

SEQ ID NO: 878227 - RNA, 22 nt, Human
uucaaacacagacagcagcaug

SEQ ID NO: 878228 - RNA, 22 nt, Human
ucuccucucuuaccugguacaa

SEQ ID NO: 878229 - RNA, 22 nt, Human
auguggcucagcaggcucccgu

SEQ ID NO: 878230 - RNA, 22 nt, Human
cacagguaauagccuaggcuau

SEQ ID NO: 878231 - RNA, 22 nt, Human
cugagguggaacagaggugaag

SEQ ID NO: 878232 - RNA, 22 nt, Human
uuagaaaacauaagugguaaag

SEQ ID NO: 878233 - RNA, 22 nt, Human
aagcaaagugcuuugccuccag

SEQ ID NO: 878234 - RNA, 20 nt, Human
aaugaucagcauagcaagga

SEQ ID NO: 878235 - RNA, 22 nt, Human
aggcagcucuguggccucccag

SEQ ID NO: 878236 - RNA, 23 nt, Human
acaaugucuguucauaaaauacc

SEQ ID NO: 878237 - RNA, 21 nt, Human
agagagaaggccauauggucc

SEQ ID NO: 878238 - RNA, 22 nt, Human
uagcuucucuuuucaacaucuu

SEQ ID NO: 878239 - RNA, 22 nt, Human
agugaacaaggaugccaccucu

SEQ ID NO: 878240 - RNA, 22 nt, Human
gagaaggacuacacaucuggcc

SEQ ID NO: 878241 - RNA, 22 nt, Human
guguggggagcugcagccacau

SEQ ID NO: 878242 - RNA, 22 nt, Human
ggcuggauaccaggagacaggg

SEQ ID NO: 878243 - RNA, 22 nt, Human
cuacucucccaugauucucugu

SEQ ID NO: 878244 - RNA, 22 nt, Human
ccugccugcaaaaugggacaag

SEQ ID NO: 878245 - RNA, 22 nt, Human
gccuggagggucccucucugga

SEQ ID NO: 878246 - RNA, 18 nt, Human
ugaacuuuuccugcugcu

SEQ ID NO: 878247 - RNA, 15 nt, Human
ugauuuccuacuaac

SEQ ID NO: 878248 - RNA, 21 nt, Human
caaguucugugucuuacuccu

SEQ ID NO: 878249 - RNA, 22 nt, Human
cuuguacauugauuucugcauu

SEQ ID NO: 878250 - RNA, 22 nt, Human
gaguggcuacaggcagcuuaca

SEQ ID NO: 878251 - RNA, 22 nt, Human
auauuuguugaguucuuaugau

SEQ ID NO: 878252 - RNA, 22 nt, Human
gggucuggcaugcugagaugga

SEQ ID NO: 878253 - RNA, 22 nt, Human
cccaggagacugagcuguaacc

SEQ ID NO: 878254 - RNA, 23 nt, Human
ggaaagagaggaguugugcauag

SEQ ID NO: 878255 - RNA, 22 nt, Human
cugaggccugggggcguggacg

SEQ ID NO: 878256 - RNA, 22 nt, Human
gaauuucacaaggugaggauaa

SEQ ID NO: 878257 - RNA, 22 nt, Human
cagacagagucuucccaucagu

SEQ ID NO: 878258 - RNA, 22 nt, Human
uacaaaacagugcucugguccu

SEQ ID NO: 878259 - RNA, 22 nt, Human
cucagugcuuuggauccuggau

SEQ ID NO: 878260 - RNA, 22 nt, Human
agacauuuauucacacauuuau

SEQ ID NO: 878261 - RNA, 22 nt, Human
cccauuuaaguaaugauaaacu

SEQ ID NO: 878262 - RNA, 23 nt, Human
uggcuucaacucugucggcagcc

SEQ ID NO: 878263 - RNA, 22 nt, Human
cagacugugucugaaccugguc

SEQ ID NO: 878264 - RNA, 19 nt, Human
cgcagguggaaggagccgc

SEQ ID NO: 878265 - RNA, 22 nt, Human
aaagccuucuucggucugugau

SEQ ID NO: 878266 - RNA, 22 nt, Human
uuucuccaauguaucagcacac

SEQ ID NO: 878267 - RNA, 22 nt, Human
agcugagaaucuuccccagugu

SEQ ID NO: 878268 - RNA, 22 nt, Human
gaaugaaagauuugcauucuau

SEQ ID NO: 878269 - RNA, 22 nt, Human
ccugaaacaucuucuguaaaua

SEQ ID NO: 878270 - RNA, 22 nt, Human
gaggggcucuugggcaugaagg

SEQ ID NO: 878271 - RNA, 22 nt, Human
agcucccagagcucgagaguaa

SEQ ID NO: 878272 - RNA, 22 nt, Human
aagaggaggauugaugugggag

SEQ ID NO: 878273 - RNA, 22 nt, Human
auuccacaagaccauaaauuag

SEQ ID NO: 878274 - RNA, 22 nt, Human
cccaggaggccaagguugcagu

SEQ ID NO: 878275 - RNA, 22 nt, Human
gucacacagagcccugugcuca

SEQ ID NO: 878276 - RNA, 22 nt, Human
acucugagucaugcacuccuug

SEQ ID NO: 878277 - RNA, 22 nt, Human
aaaugcuuuggugcugguacag

SEQ ID NO: 878278 - RNA, 22 nt, Human
ugcaggaaugagguucucaguu

SEQ ID NO: 878279 - RNA, 22 nt, Human
augugugcucuugagccuucac

SEQ ID NO: 878280 - RNA, 22 nt, Human
uaucuguucauguuuauauguc

SEQ ID NO: 878281 - RNA, 22 nt, Human
cucuccagccaggggcuuccug

SEQ ID NO: 878282 - RNA, 22 nt, Human
auguuuccagauaugucacccu

SEQ ID NO: 878283 - RNA, 22 nt, Human
cuggaaggguacauaggaaacu

SEQ ID NO: 878284 - RNA, 22 nt, Human
uaaaagauaucuuagggauuug

SEQ ID NO: 878285 - RNA, 22 nt, Human
gggagccaugcuggucuucuuu

SEQ ID NO: 878286 - RNA, 22 nt, Human
gggcugcacguauucugcucac

SEQ ID NO: 878287 - RNA, 22 nt, Human
ggcacagcaggagcuaugugaa

SEQ ID NO: 878288 - RNA, 22 nt, Human
cuggagccuagguugaccuggg

SEQ ID NO: 878289 - RNA, 19 nt, Human
cagaggugauauaugccca

SEQ ID NO: 878290 - RNA, 22 nt, Human
uccucugccccagaugaaauuu

SEQ ID NO: 878291 - RNA, 22 nt, Human
uuaugacaggaaaaucacagaa

SEQ ID NO: 878292 - RNA, 22 nt, Human
ucaacagacauuuuuaagcacu

SEQ ID NO: 878293 - RNA, 22 nt, Human
cagcagcucaggcugcuuccca

SEQ ID NO: 878294 - RNA, 22 nt, Human
gaggccugguuugcaugagaau

SEQ ID NO: 878295 - RNA, 22 nt, Human
auacagcuuacaguucuaaugc

SEQ ID NO: 878296 - RNA, 22 nt, Human
auacagaaaaugaugcagaguu

SEQ ID NO: 878297 - RNA, 22 nt, Human
ugaggccauggaacuagcuugg

SEQ ID NO: 878298 - RNA, 19 nt, Human
ugaagcaauaccauuuuug

SEQ ID NO: 878299 - RNA, 22 nt, Human
cuuuaguuuguaagagcaagag

SEQ ID NO: 878300 - RNA, 22 nt, Human
uaaaguauaagcauuggaguau

SEQ ID NO: 878301 - RNA, 22 nt, Human
cagcucaguuucaauaccaggu

SEQ ID NO: 878302 - RNA, 23 nt, Human
cugcugugaaacaugguuuuggu

SEQ ID NO: 878303 - RNA, 22 nt, Human
gucaccaucuacagcuccaaac

SEQ ID NO: 878304 - RNA, 22 nt, Human
agcccaugguguacucuguggc

SEQ ID NO: 878305 - RNA, 23 nt, Human
agggccaggugcggaaacagcuc

SEQ ID NO: 878306 - RNA, 22 nt, Human
ccugagagcauuccacacugaa

SEQ ID NO: 878307 - RNA, 22 nt, Human
gagguggucgaggagggguacc

SEQ ID NO: 878308 - RNA, 19 nt, Human
gcaucagagcagaaggggu

SEQ ID NO: 878309 - RNA, 22 nt, Human
uuuguauaaauuggagcaaugu

SEQ ID NO: 878310 - RNA, 22 nt, Human
uauuaaauuauggauuuaggag

SEQ ID NO: 878311 - RNA, 22 nt, Human
cucucuuucugaaugaggacua

SEQ ID NO: 878312 - RNA, 23 nt, Human
agaagcagcuucuggaguaucgg

SEQ ID NO: 878313 - RNA, 22 nt, Human
cagcagugacaagacuaagaag

SEQ ID NO: 878314 - RNA, 23 nt, Human
agaaggguccuuggcagcgacag

SEQ ID NO: 878315 - RNA, 22 nt, Human
aggugggcaccaggcuuguggu

SEQ ID NO: 878316 - RNA, 22 nt, Human
uguuucauguggacauaguugu

SEQ ID NO: 878317 - RNA, 22 nt, Human
uguuaaaugagauuggaauuug

SEQ ID NO: 878318 - RNA, 22 nt, Human
caggggccggcuguccgugccc

SEQ ID NO: 878319 - RNA, 22 nt, Human
ccuggggauucugacacggagu

SEQ ID NO: 878320 - RNA, 20 nt, Human
cuggcccaucuaccgcucug

SEQ ID NO: 878321 - RNA, 22 nt, Human
gaacaguaacugucugcugugu

SEQ ID NO: 878322 - RNA, 22 nt, Human
guccccuuaaacaugcucucuu

SEQ ID NO: 878323 - RNA, 21 nt, Human
ggcagcugugguuaauugaac

SEQ ID NO: 878324 - RNA, 22 nt, Human
cagcagagcugugugggaaggg

SEQ ID NO: 878325 - RNA, 22 nt, Human
gugauucucacucuagugcuug

SEQ ID NO: 878326 - RNA, 22 nt, Human
ggcagucauuuaaucccugcau

SEQ ID NO: 878327 - RNA, 22 nt, Human
uuuuucuuaaauguggguuggc

SEQ ID NO: 878328 - RNA, 22 nt, Human
uuuguacaugaaugugcaccca

SEQ ID NO: 878329 - RNA, 22 nt, Human
uccagagaucacacugggcagg

SEQ ID NO: 878330 - RNA, 22 nt, Human
ugcagcucaggauucucagggc

SEQ ID NO: 878331 - RNA, 22 nt, Human
uaacaagauuuguaaaauugua

SEQ ID NO: 878332 - RNA, 22 nt, Human
uuacaguuagaaucugaugaaa

SEQ ID NO: 878333 - RNA, 22 nt, Human
agaggcugggcaggacccacag

SEQ ID NO: 878334 - RNA, 22 nt, Human
gaaaaugccucuggcauuaaac

SEQ ID NO: 878335 - RNA, 21 nt, Human
ucugccugagacuuugcuggu

SEQ ID NO: 878336 - RNA, 22 nt, Human
cuucuggcaaaacaggcagaaa

SEQ ID NO: 878337 - RNA, 22 nt, Human
cucaacaugccuacucagucug

SEQ ID NO: 878338 - RNA, 22 nt, Human
aucacaaaggcugcuucaugau

SEQ ID NO: 878339 - RNA, 22 nt, Human
aacauuuguuuggcuucaauua

SEQ ID NO: 878340 - RNA, 22 nt, Human
guuacaauguccuuacaugaaa

SEQ ID NO: 878341 - RNA, 22 nt, Human
cucuuugguuaaucacacagau

SEQ ID NO: 878342 - RNA, 22 nt, Human
aagguagauucuggaucgaagg

SEQ ID NO: 878343 - RNA, 22 nt, Human
gugcauauaugcacauaugugu

SEQ ID NO: 878344 - RNA, 22 nt, Human
augaggcaucugcagucacuag

SEQ ID NO: 878345 - RNA, 22 nt, Human
uucuccaguuucucccuucagu

SEQ ID NO: 878346 - RNA, 22 nt, Human
gcaagugucugagguuuuguau

SEQ ID NO: 878347 - RNA, 22 nt, Human
cagaauaauauuggucucauag

SEQ ID NO: 878348 - RNA, 22 nt, Human
ucucugagcgcauuccuccggc

SEQ ID NO: 878349 - RNA, 22 nt, Human
augccaaguaugauucacaugu

SEQ ID NO: 878350 - RNA, 22 nt, Human
caggaaauaucucaacacuuua

SEQ ID NO: 878351 - RNA, 22 nt, Human
acuuccuuuucaaccauacagc

SEQ ID NO: 878352 - RNA, 22 nt, Human
cccagugccaggcacaggcagc

SEQ ID NO: 878353 - RNA, 22 nt, Human
ggcugccugcuccuccugcacg

SEQ ID NO: 878354 - RNA, 22 nt, Human
aguucaucuuacuuagaguaca

SEQ ID NO: 878355 - RNA, 22 nt, Human
aggccucaguuugucaucugua

SEQ ID NO: 878356 - RNA, 22 nt, Human
acaaauuguugcuucaugaaug

SEQ ID NO: 878357 - RNA, 16 nt, Human
gagggcagaggcggaa

SEQ ID NO: 878358 - RNA, 22 nt, Human
ggcagaggagcuggaaacaugg

SEQ ID NO: 878359 - RNA, 22 nt, Human
uaguuucucagggaggaaagaa

SEQ ID NO: 878360 - RNA, 22 nt, Human
cuuuccuagaaauauauacuua

SEQ ID NO: 878361 - RNA, 22 nt, Human
cugugcugaggaugcaguuucu

SEQ ID NO: 878362 - RNA, 22 nt, Human
gcagggugaaggucacauagaa

SEQ ID NO: 878363 - RNA, 19 nt, Human
uucugggcagcacaugaau

SEQ ID NO: 878364 - RNA, 22 nt, Human
cccaggcugaugggaugggcca

SEQ ID NO: 878365 - RNA, 20 nt, Human
ggaagccagggugcagggga

SEQ ID NO: 878366 - RNA, 22 nt, Human
gaggaggggcacuugucuccua

SEQ ID NO: 878367 - RNA, 22 nt, Human
aaauaagaaauucuucuuugca

SEQ ID NO: 878368 - RNA, 22 nt, Human
ucccugccuccuggcagugcca

SEQ ID NO: 878369 - RNA, 17 nt, Human
guaauauaauaagccuu

SEQ ID NO: 878370 - RNA, 22 nt, Human
caguggaugauuuggcugcuag

SEQ ID NO: 878371 - RNA, 22 nt, Human
uccugugucaauuccucauucu

SEQ ID NO: 878372 - RNA, 23 nt, Human
gugcaugugucuuuacaguagca

SEQ ID NO: 878373 - RNA, 22 nt, Human
ucucacauuuuaaaaggacaua

SEQ ID NO: 878374 - RNA, 22 nt, Human
cuggcccuguggaggcaggaac

SEQ ID NO: 878375 - RNA, 22 nt, Human
agcagcugaucaaagcacuuau

SEQ ID NO: 878376 - RNA, 22 nt, Human
ucaaaggcaccaaggucacugc

SEQ ID NO: 878377 - RNA, 22 nt, Human
uuuagacagcggcucugaacca

SEQ ID NO: 878378 - RNA, 22 nt, Human
uucugacaugugagauuuuguu

SEQ ID NO: 878379 - RNA, 22 nt, Human
caggcuguguuccuggaacccc

SEQ ID NO: 878380 - RNA, 22 nt, Human
ccuccaguacuccaguccagcg

SEQ ID NO: 878381 - RNA, 22 nt, Human
augacaccauauuagccuagag

SEQ ID NO: 878382 - RNA, 22 nt, Human
ucuggcaggccuugucaaucug

SEQ ID NO: 878383 - RNA, 22 nt, Human
uuagaacuuuucaacuccauuc

SEQ ID NO: 878384 - RNA, 22 nt, Human
ucucugagcccaauguagcaau

SEQ ID NO: 878385 - RNA, 22 nt, Human
gaugaaaugugaaaguucuggg

SEQ ID NO: 878386 - RNA, 22 nt, Human
agcuguuuaaaugacuuacuuu

SEQ ID NO: 878387 - RNA, 22 nt, Human
ucagcauuucagaaguggcaua

SEQ ID NO: 878388 - RNA, 22 nt, Human
uacagguaaaauuaucagaaac

SEQ ID NO: 878389 - RNA, 22 nt, Human
uuuauccaucaucugcugaagg

SEQ ID NO: 878390 - RNA, 22 nt, Human
cuuccucugaggcuucugaguc

SEQ ID NO: 878391 - RNA, 22 nt, Human
uagacauuauuucuacccacaa

SEQ ID NO: 878392 - RNA, 22 nt, Human
caguuaucaaauacuaugaagg

SEQ ID NO: 878393 - RNA, 22 nt, Human
aggcaacaugacucacuugcac

SEQ ID NO: 878394 - RNA, 22 nt, Human
cauucucuugacaggacagccc

SEQ ID NO: 878395 - RNA, 22 nt, Human
aaaauugucgaacaguaguaac

SEQ ID NO: 878396 - RNA, 22 nt, Human
uuccugggaggcuguguacuug

SEQ ID NO: 878397 - RNA, 22 nt, Human
uugucugaaucuggagcucucu

SEQ ID NO: 878398 - RNA, 22 nt, Human
cagagcaggaauaggguguuga

SEQ ID NO: 878399 - RNA, 22 nt, Human
gcuccucuccucggagucgggg

SEQ ID NO: 878400 - RNA, 22 nt, Human
gcagagugaagcaguauggaaa

SEQ ID NO: 878401 - RNA, 22 nt, Human
acacccagcugggccaccucca

SEQ ID NO: 878402 - RNA, 21 nt, Human
aggcucagagaucaaacagua

SEQ ID NO: 878403 - RNA, 22 nt, Human
cagcucagucuugaagcacugg

SEQ ID NO: 878404 - RNA, 22 nt, Human
uaagugaugagcacaguaauua

SEQ ID NO: 878405 - RNA, 22 nt, Human
gccaccucggcuuucucugcuc

SEQ ID NO: 878406 - RNA, 22 nt, Human
ugacuucugauugcuucuauuu

SEQ ID NO: 878407 - RNA, 22 nt, Human
auucuagcugaguaucagcccc

SEQ ID NO: 878408 - RNA, 22 nt, Human
ucagcagggaggcucugugccc

SEQ ID NO: 878409 - RNA, 22 nt, Human
agccuggccaggccugcccagg

SEQ ID NO: 878410 - RNA, 22 nt, Human
agaaucuuguuucuuguguguu

SEQ ID NO: 878411 - RNA, 22 nt, Human
agaugaguaaauggagucuucc

SEQ ID NO: 878412 - RNA, 22 nt, Human
uacaguacccugaugaacuaaa

SEQ ID NO: 878413 - RNA, 22 nt, Human
ccuucaaagaguauuuccugag

SEQ ID NO: 878414 - RNA, 22 nt, Human
ucuuuuaaccuaacuagcuugg

SEQ ID NO: 878415 - RNA, 22 nt, Human
agauucaguuaaggcugguaga

SEQ ID NO: 878416 - RNA, 22 nt, Human
ccauggcaacuggcguccaggg

SEQ ID NO: 878417 - RNA, 22 nt, Human
ugcauauuauguguaucugucu

SEQ ID NO: 878418 - RNA, 22 nt, Human
aacaguauaugaaauguuagga

SEQ ID NO: 878419 - RNA, 22 nt, Human
auaguuuaaggaacuaugcgau

SEQ ID NO: 878420 - RNA, 22 nt, Human
caauuucuaacauuccauggau

SEQ ID NO: 878421 - RNA, 22 nt, Human
uguuuacaaaaccgugguacug

SEQ ID NO: 878422 - RNA, 22 nt, Human
aagauaauauucauuaacuaga

SEQ ID NO: 878423 - RNA, 22 nt, Human
aaagcagcagaaucucucaggg

SEQ ID NO: 878424 - RNA, 22 nt, Human
ccagcagcaggccaggcccucc

SEQ ID NO: 878425 - RNA, 22 nt, Human
uuugacaggagguggcuacuca

SEQ ID NO: 878426 - RNA, 22 nt, Human
acugcacuucacccugggugac

SEQ ID NO: 878427 - RNA, 22 nt, Human
augaaucaagugagaacagcau

SEQ ID NO: 878428 - RNA, 21 nt, Human
agcaccaguuuuaugccaggc

SEQ ID NO: 878429 - RNA, 22 nt, Human
cagagcugauuggauccagaga

SEQ ID NO: 878430 - RNA, 22 nt, Human
ggucuagaugaaauuaaauguu

SEQ ID NO: 878431 - RNA, 22 nt, Human
auuacaguggguaaacagaauu

SEQ ID NO: 878432 - RNA, 22 nt, Human
uccacaguuuugccacuagcug

SEQ ID NO: 878433 - RNA, 22 nt, Human
auugacaguguuaaaguugccu

SEQ ID NO: 878434 - RNA, 22 nt, Human
gggcauggugaugugcaccugu

SEQ ID NO: 878435 - RNA, 20 nt, Human
uguauuuaaugaaggcuuuu

SEQ ID NO: 878436 - RNA, 22 nt, Human
gcacagagaggcugugagcgcc

SEQ ID NO: 878437 - RNA, 22 nt, Human
gugucacaagagcccaggaaac

SEQ ID NO: 878438 - RNA, 22 nt, Human
aggcgcagacauacagggucug

SEQ ID NO: 878439 - RNA, 22 nt, Human
ucugggagaagcugaugugaag

SEQ ID NO: 878440 - RNA, 22 nt, Human
uuugcugucagccgcuauuuuc

SEQ ID NO: 878441 - RNA, 23 nt, Human
cccagaccuugugcugcccuugg

SEQ ID NO: 878442 - RNA, 22 nt, Human
uucaaguuuuauauccauggcu

SEQ ID NO: 878443 - RNA, 22 nt, Human
auuauaggcuugagccaccgug

SEQ ID NO: 878444 - RNA, 22 nt, Human
caggcuggacauuagauacaua

SEQ ID NO: 878445 - RNA, 22 nt, Human
ggcagcucgucaggcugcggcg

SEQ ID NO: 878446 - RNA, 22 nt, Human
acuuuacaauauccugugacuu

SEQ ID NO: 878447 - RNA, 22 nt, Human
gaaaauaggcagaugcauugua

SEQ ID NO: 878448 - RNA, 22 nt, Human
cuggcaagugguugggauggau

SEQ ID NO: 878449 - RNA, 22 nt, Human
auggcagcaugggauugguaga

SEQ ID NO: 878450 - RNA, 22 nt, Human
aucuguuaacaaagaagacagc

SEQ ID NO: 878451 - RNA, 22 nt, Human
cacuauuuucucuucagauggc

SEQ ID NO: 878452 - RNA, 22 nt, Human
ugggucagagcugugcugccca

SEQ ID NO: 878453 - RNA, 22 nt, Human
cuccuccacagaguccuugcca

SEQ ID NO: 878454 - RNA, 23 nt, Human
ucaaaggaggcaucguucugcag

SEQ ID NO: 878455 - RNA, 19 nt, Human
ggcuggcaagugacagugu

SEQ ID NO: 878456 - RNA, 22 nt, Human
uacagaguuuuccugccaagaa

SEQ ID NO: 878457 - RNA, 22 nt, Human
cacugccugcuggcugucacuu

SEQ ID NO: 878458 - RNA, 22 nt, Human
auugucaguuuaauauagucaa

SEQ ID NO: 878459 - RNA, 22 nt, Human
augccuccccugugucuuuuau

SEQ ID NO: 878460 - RNA, 22 nt, Human
uguaggaauggauucuagaagg

SEQ ID NO: 878461 - RNA, 22 nt, Human
cuggagcucuccagagccccgu

SEQ ID NO: 878462 - RNA, 22 nt, Human
caggaccugaagacaggcaggu

SEQ ID NO: 878463 - RNA, 22 nt, Human
caaagcccuggaaagaugaaga

SEQ ID NO: 878464 - RNA, 22 nt, Human
cuggugcuuugcucauuugaua

SEQ ID NO: 878465 - RNA, 22 nt, Human
aggcuccuaucgcuuucagcaa

SEQ ID NO: 878466 - RNA, 22 nt, Human
gcugcccuguccggcucuccug

SEQ ID NO: 878467 - RNA, 22 nt, Human
agucugugugaaugugggcuuu

SEQ ID NO: 878468 - RNA, 22 nt, Human
acauugcagauguguuuaaugu

SEQ ID NO: 878469 - RNA, 22 nt, Human
gagggggacguauccugguaug

SEQ ID NO: 878470 - RNA, 22 nt, Human
ucuuuucacagacaaauggaga

SEQ ID NO: 878471 - RNA, 22 nt, Human
gaugaggggucauuggcuggga

SEQ ID NO: 878472 - RNA, 22 nt, Human
ccugucucuuucaaucugagag

SEQ ID NO: 878473 - RNA, 22 nt, Human
cagaauaagcuguguugucaag

SEQ ID NO: 878474 - RNA, 22 nt, Human
aggacagagcccuaguuucaua

SEQ ID NO: 878475 - RNA, 22 nt, Human
ccucccugcuccucaacuggca

SEQ ID NO: 878476 - RNA, 22 nt, Human
ggcccugggcagaggagugggc

SEQ ID NO: 878477 - RNA, 22 nt, Human
gcagcaggagaguaauagcggu

SEQ ID NO: 878478 - RNA, 22 nt, Human
ugacacuucugaaacggaaguu

SEQ ID NO: 878479 - RNA, 22 nt, Human
uggaagguggauauccuaguca

SEQ ID NO: 878480 - RNA, 22 nt, Human
cugguggaauggcagagggaac

SEQ ID NO: 878481 - RNA, 22 nt, Human
uacagacauuuacuccacuccu

SEQ ID NO: 878482 - RNA, 22 nt, Human
uaagaagugcugaauugaauau

SEQ ID NO: 878483 - RNA, 22 nt, Human
ucaugaacaucucaaauaacca

SEQ ID NO: 878484 - RNA, 22 nt, Human
aaagugcucggauuacagguau

SEQ ID NO: 878485 - RNA, 22 nt, Human
ucuuccucuagaucugaggccc

SEQ ID NO: 878486 - RNA, 22 nt, Human
cacugcucgcugcagcauggcc

SEQ ID NO: 878487 - RNA, 22 nt, Human
aaaugcagauuccuaggcccca

SEQ ID NO: 878488 - RNA, 23 nt, Human
uugugucuacuuccuaucuaggg

SEQ ID NO: 878489 - RNA, 22 nt, Human
ccuggcuuccauauggcacaua

SEQ ID NO: 878490 - RNA, 22 nt, Human
ccaguguggacucucuccuuug

SEQ ID NO: 878491 - RNA, 22 nt, Human
gcagggaaggggacggaaccag

SEQ ID NO: 878492 - RNA, 22 nt, Human
acucuguaucccucucaaauug

SEQ ID NO: 878493 - RNA, 22 nt, Human
agaaacaucauuggaacacaag

SEQ ID NO: 878494 - RNA, 22 nt, Human
uuauaagaguauauaguguacu

SEQ ID NO: 878495 - RNA, 22 nt, Human
uccacacacauuucuaugugca

SEQ ID NO: 878496 - RNA, 22 nt, Human
ccaggcuccccaggaggcccuu

SEQ ID NO: 878497 - RNA, 22 nt, Human
ugaaggugucuuugugaacauc

SEQ ID NO: 878498 - RNA, 22 nt, Human
aucaggcuaguguguguguuca

SEQ ID NO: 878499 - RNA, 22 nt, Human
uacacauauguguguauaugug

SEQ ID NO: 878500 - RNA, 22 nt, Human
gggcuucagauccagggaccuc

SEQ ID NO: 878501 - RNA, 21 nt, Human
acugggcuagccugacuucug

SEQ ID NO: 878502 - RNA, 22 nt, Human
gagcagugaugggaggacguca

SEQ ID NO: 878503 - RNA, 22 nt, Human
cuuauauuuuaggaacagacaa

SEQ ID NO: 878504 - RNA, 22 nt, Human
cuggcugugaaauggcaguguc

SEQ ID NO: 878505 - RNA, 19 nt, Human
uuuccuaaaaagcugugcu

SEQ ID NO: 878506 - RNA, 22 nt, Human
ccuuuuauauggcucaucacag

SEQ ID NO: 878507 - RNA, 23 nt, Human
agagcuuucuaaaauguaaaucu

SEQ ID NO: 878508 - RNA, 22 nt, Human
gcagcuguucagcuggccagau

SEQ ID NO: 878509 - RNA, 22 nt, Human
cacauuuagagguuagcauggu

SEQ ID NO: 878510 - RNA, 22 nt, Human
gauaaaauucuuauuuuacccg

SEQ ID NO: 878511 - RNA, 22 nt, Human
uauggcagaggagaggcacuag

SEQ ID NO: 878512 - RNA, 22 nt, Human
uaaggcuuauauacuuagacau

SEQ ID NO: 878513 - RNA, 22 nt, Human
aaggccagagcguguccugccu

SEQ ID NO: 878514 - RNA, 22 nt, Human
gcagaagaccaugguggaaaga

SEQ ID NO: 878515 - RNA, 22 nt, Human
gaggcuguuggcugaucugagu

SEQ ID NO: 878516 - RNA, 22 nt, Human
acacaccaugauuuauuuaccc

SEQ ID NO: 878517 - RNA, 22 nt, Human
uggcaugggccagggagagcug

SEQ ID NO: 878518 - RNA, 20 nt, Human
uugaccugcaagucaucauu

SEQ ID NO: 878519 - RNA, 22 nt, Human
ugagauaauaaacaucuccuua

SEQ ID NO: 878520 - RNA, 22 nt, Human
uuacaaagagaaguuguagaau

SEQ ID NO: 878521 - RNA, 22 nt, Human
gcagcaagagguuucuguugac

SEQ ID NO: 878522 - RNA, 22 nt, Human
ggauaaucugggagaaaacuga

SEQ ID NO: 878523 - RNA, 22 nt, Human
aggcuccaggcccuucaccagc

SEQ ID NO: 878524 - RNA, 22 nt, Human
gcagaaagcuccuugcgaucug

SEQ ID NO: 878525 - RNA, 22 nt, Human
uacaggaacugggcaggacauu

SEQ ID NO: 878526 - RNA, 22 nt, Human
uggagauggguuaauggagaga

SEQ ID NO: 878527 - RNA, 22 nt, Human
cagggucaagagacuccagcag

SEQ ID NO: 878528 - RNA, 22 nt, Human
uacccaguuccacacacugaug

SEQ ID NO: 878529 - RNA, 22 nt, Human
ucaggaagugguaaaggauguu

SEQ ID NO: 878530 - RNA, 22 nt, Human
gugggcaggagugagcaacagg

SEQ ID NO: 878531 - RNA, 22 nt, Human
ggaggucauaaguguauagaug

SEQ ID NO: 878532 - RNA, 22 nt, Human
gaggagacggggugccuggagc

SEQ ID NO: 878533 - RNA, 22 nt, Human
agaacagcacaggaaguguauc

SEQ ID NO: 878534 - RNA, 23 nt, Human
uuucugaugagggaugugguaug

SEQ ID NO: 878535 - RNA, 22 nt, Human
uguccaugggcgucaggcagga

SEQ ID NO: 878536 - RNA, 22 nt, Human
ugccuuagaggauagugaagcc

SEQ ID NO: 878537 - RNA, 22 nt, Human
cuggaauauuuguaggaugaaa

SEQ ID NO: 878538 - RNA, 22 nt, Human
acuguacauauggauucuaaga

SEQ ID NO: 878539 - RNA, 22 nt, Human
ucaguuuucaauuucaucagag

SEQ ID NO: 878540 - RNA, 20 nt, Human
cuugcaggaguggguagagu

SEQ ID NO: 878541 - RNA, 22 nt, Human
agcaccugugugguagggaggu

SEQ ID NO: 878542 - RNA, 22 nt, Human
aagaaucauccugcaagagucu

SEQ ID NO: 878543 - RNA, 22 nt, Human
cuagcagcaucacaggaagacu

SEQ ID NO: 878544 - RNA, 22 nt, Human
gaaguucugggaguggcgcccu

SEQ ID NO: 878545 - RNA, 22 nt, Human
uuauucugagaguugaaguaau

SEQ ID NO: 878546 - RNA, 22 nt, Human
gccacagucacugcugcagggg

SEQ ID NO: 878547 - RNA, 23 nt, Human
uucucaggagcccccaggucagg

SEQ ID NO: 878548 - RNA, 22 nt, Human
agcagccuggacuuggaugugg

SEQ ID NO: 878549 - RNA, 22 nt, Human
gaggcauggccugaggcuagga

SEQ ID NO: 878550 - RNA, 22 nt, Human
ggggugggcgugcagggacacc

SEQ ID NO: 878551 - RNA, 22 nt, Human
aaauuccagaaacucaguauau

SEQ ID NO: 878552 - RNA, 22 nt, Human
uaccacugcucccugccuguga

SEQ ID NO: 878553 - RNA, 22 nt, Human
uucuagaagaacuagccaggaa

SEQ ID NO: 878554 - RNA, 19 nt, Human
uagcagcugccaaaggaga

SEQ ID NO: 878555 - RNA, 22 nt, Human
cucugggcggcccaggccaacc

SEQ ID NO: 878556 - RNA, 22 nt, Human
uaguaacacacugguauuugga

SEQ ID NO: 878557 - RNA, 20 nt, Human
guggagaggcuggcgggacu

SEQ ID NO: 878558 - RNA, 19 nt, Human
acagagggcaacugagaaa

SEQ ID NO: 878559 - RNA, 22 nt, Human
ccuccagcgcgauccacuccgg

SEQ ID NO: 878560 - RNA, 22 nt, Human
cugucaguucuuccagauagag

SEQ ID NO: 878561 - RNA, 19 nt, Human
cugaggugcaguaagaggc

SEQ ID NO: 878562 - RNA, 22 nt, Human
uuucuugugccuaauuuugggc

SEQ ID NO: 878563 - RNA, 20 nt, Human
aggcucugcauuucugagug

SEQ ID NO: 878564 - RNA, 22 nt, Human
uuucaggauuaguuuaagcagg

SEQ ID NO: 878565 - RNA, 22 nt, Human
uaguaacacauugaacgaucgc

SEQ ID NO: 878566 - RNA, 22 nt, Human
auagacaacacuuauuauuccu

SEQ ID NO: 878567 - RNA, 22 nt, Human
cucagauaaucuuugagucuuc

SEQ ID NO: 878568 - RNA, 22 nt, Human
ugacagcccaccucacaggauu

SEQ ID NO: 878569 - RNA, 23 nt, Human
uggccacaguccaugcaugccca

SEQ ID NO: 878570 - RNA, 22 nt, Human
acggaguauuuacaagaggaaa

SEQ ID NO: 878571 - RNA, 22 nt, Human
aaacuuuaaauuuguaccucug

SEQ ID NO: 878572 - RNA, 22 nt, Human
auacaacuuuaucuguaaugag

SEQ ID NO: 878573 - RNA, 22 nt, Human
acauucuagauauguuauauuu

SEQ ID NO: 878574 - RNA, 22 nt, Human
agugaucuuuuaaaaagaagug

SEQ ID NO: 878575 - RNA, 22 nt, Human
guccugugagauucaugcucaa

SEQ ID NO: 878576 - RNA, 22 nt, Human
uuuggaaauuucaucaauagcc

SEQ ID NO: 878577 - RNA, 20 nt, Human
cugcucugcuuugcaggugg

SEQ ID NO: 878578 - RNA, 22 nt, Human
ggagcuggaauauauugaaacc

SEQ ID NO: 878579 - RNA, 22 nt, Human
ucagaagugcuguccuuauccc

SEQ ID NO: 878580 - RNA, 22 nt, Human
ugcauacuuguauguguuacau

SEQ ID NO: 878581 - RNA, 19 nt, Human
aaggacacaacagagauag

SEQ ID NO: 878582 - RNA, 22 nt, Human
ucugugcuagcacgcagcaagg

SEQ ID NO: 878583 - RNA, 22 nt, Human
uacaaggcaaauccaugauguc

SEQ ID NO: 878584 - RNA, 22 nt, Human
aagcuuuaaggaauuuuaugga

SEQ ID NO: 878585 - RNA, 22 nt, Human
uguaaacugaggguagcugauu

SEQ ID NO: 878586 - RNA, 23 nt, Human
ugcucccaggugacgcugcuguu

SEQ ID NO: 878587 - RNA, 22 nt, Human
caguggcaugguugacugcagu

SEQ ID NO: 878588 - RNA, 22 nt, Human
gaauugucuuggccagugagaa

SEQ ID NO: 878589 - RNA, 22 nt, Human
guucagcaagaauguuucuauu

SEQ ID NO: 878590 - RNA, 19 nt, Human
caggaacauggagggaggg

SEQ ID NO: 878591 - RNA, 22 nt, Human
gaaagaaucaacuaugucucug

SEQ ID NO: 878592 - RNA, 22 nt, Human
accacaggaauugcucuguggu

SEQ ID NO: 878593 - RNA, 22 nt, Human
auguacauacugcauuuucaaa

SEQ ID NO: 878594 - RNA, 22 nt, Human
cuucacaaucaccuuuucggaa

SEQ ID NO: 878595 - RNA, 22 nt, Human
uaacaguaaaguaaguuagcuu

SEQ ID NO: 878596 - RNA, 22 nt, Human
uuacagauguaggaacugaagu

SEQ ID NO: 878597 - RNA, 23 nt, Human
uuucagcauucuaguucagguuc

SEQ ID NO: 878598 - RNA, 22 nt, Human
gccgaggcucugcccagcugcu

SEQ ID NO: 878599 - RNA, 22 nt, Human
ugcaucaaccuaauaucagcuc

SEQ ID NO: 878600 - RNA, 22 nt, Human
guuuggugagcagcuuggguau

SEQ ID NO: 878601 - RNA, 22 nt, Human
cugggccugagcucugaagagu

SEQ ID NO: 878602 - RNA, 22 nt, Human
agccucugcuggcccuggcacu

SEQ ID NO: 878603 - RNA, 22 nt, Human
agugucugcucagacagcuaca

SEQ ID NO: 878604 - RNA, 22 nt, Human
aaguauuuggaauggcauuuuu

SEQ ID NO: 878605 - RNA, 22 nt, Human
ucauuguugcguuaaugucuuc

SEQ ID NO: 878606 - RNA, 22 nt, Human
uguguugguagaucugaggucu

SEQ ID NO: 878607 - RNA, 22 nt, Human
aaaguuuggauccagcaaaaga

SEQ ID NO: 878608 - RNA, 22 nt, Human
cacauuuacauauaaaacuuuc

SEQ ID NO: 878609 - RNA, 18 nt, Human
acacaguggaugccuggu

SEQ ID NO: 878610 - RNA, 22 nt, Human
gccugccuguuggcugaggugc

SEQ ID NO: 878611 - RNA, 22 nt, Human
cucugucuaucccauucugugc

SEQ ID NO: 878612 - RNA, 22 nt, Human
ccacaggaccagaggagaucac

SEQ ID NO: 878613 - RNA, 22 nt, Human
aagaagcacuuuccuacauguu

SEQ ID NO: 878614 - RNA, 22 nt, Human
ucucuucagcccauuauaaggg

SEQ ID NO: 878615 - RNA, 22 nt, Human
ucugugcuaaugcuucacaaua

SEQ ID NO: 878616 - RNA, 22 nt, Human
ucugcguggcugcugugagcgu

SEQ ID NO: 878617 - RNA, 22 nt, Human
acagagacacggaagcuaaaga

SEQ ID NO: 878618 - RNA, 22 nt, Human
uaguggaggguguagcugcugg

SEQ ID NO: 878619 - RNA, 22 nt, Human
caggcuuggcagggaggcuggu

SEQ ID NO: 878620 - RNA, 22 nt, Human
gggcccugccuaaggaacacac

SEQ ID NO: 878621 - RNA, 22 nt, Human
ugggcagagaguagaggcaacg

SEQ ID NO: 878622 - RNA, 19 nt, Human
uagaaccuggauuucagga

SEQ ID NO: 878623 - RNA, 22 nt, Human
cugaggccggagcacugaagag

SEQ ID NO: 878624 - RNA, 22 nt, Human
cagcacaguacaaggcacggau

SEQ ID NO: 878625 - RNA, 22 nt, Human
cuucugggugccugugaguguu

SEQ ID NO: 878626 - RNA, 23 nt, Human
acauaaacagaaggugugcuucc

SEQ ID NO: 878627 - RNA, 22 nt, Human
guccugugggcccaccaugagc

SEQ ID NO: 878628 - RNA, 22 nt, Human
uguuauuaucuguuagguguuc

SEQ ID NO: 878629 - RNA, 22 nt, Human
ucugauuacuugaguuauuuag

SEQ ID NO: 878630 - RNA, 22 nt, Human
gcaggcaguuugcuuuucccuc

SEQ ID NO: 878631 - RNA, 22 nt, Human
uucuguuucuggggucucugac

SEQ ID NO: 878632 - RNA, 22 nt, Human
aaacuaucccugccauaauuuu

SEQ ID NO: 878633 - RNA, 22 nt, Human
aggcugccaaagcuucugucuc

SEQ ID NO: 878634 - RNA, 22 nt, Human
augugcuuugcuggaaauguca

SEQ ID NO: 878635 - RNA, 22 nt, Human
cagaaaauaaaguuucuacgca

SEQ ID NO: 878636 - RNA, 22 nt, Human
augcuuuaaaacguauguguaa

SEQ ID NO: 878637 - RNA, 22 nt, Human
gacagcuucuagaaauggucac

SEQ ID NO: 878638 - RNA, 22 nt, Human
uaacagcccucccuccauccug

SEQ ID NO: 878639 - RNA, 22 nt, Human
uguauacaauucacacuuccca

SEQ ID NO: 878640 - RNA, 22 nt, Human
ucagcaggcaccggaaguguuu

SEQ ID NO: 878641 - RNA, 22 nt, Human
ggaagcuggacaggcuuugagu

SEQ ID NO: 878642 - RNA, 22 nt, Human
uauuggaaugcacugggagaga

SEQ ID NO: 878643 - RNA, 22 nt, Human
ggggaaugagugcccagaaagc

SEQ ID NO: 878644 - RNA, 23 nt, Human
ucauuucagguugcaugguacca

SEQ ID NO: 878645 - RNA, 22 nt, Human
gcaggaugagugaguacauuua

SEQ ID NO: 878646 - RNA, 23 nt, Human
agagaaagggauaacacguugaa

SEQ ID NO: 878647 - RNA, 22 nt, Human
aaauguauccuacuuccugagu

SEQ ID NO: 878648 - RNA, 22 nt, Human
ggcugccuguugaguauguccc

SEQ ID NO: 878649 - RNA, 23 nt, Human
agagcaaggaaaugaggugugau

SEQ ID NO: 878650 - RNA, 22 nt, Human
cugggccugguagggcuugaaa

SEQ ID NO: 878651 - RNA, 22 nt, Human
caaggcagcguuccuuucugga

SEQ ID NO: 878652 - RNA, 20 nt, Human
uugcuuuaucagacaugaua

SEQ ID NO: 878653 - RNA, 22 nt, Human
gugcaggguagcgacggcagga

SEQ ID NO: 878654 - RNA, 22 nt, Human
gccuggagaggaagccggugga

SEQ ID NO: 878655 - RNA, 22 nt, Human
gagcagcaaagggaggguaaau

SEQ ID NO: 878656 - RNA, 22 nt, Human
uauaguacauggaaucuucaua

SEQ ID NO: 878657 - RNA, 21 nt, Human
gcucuaagcuuugggaagaau

SEQ ID NO: 878658 - RNA, 22 nt, Human
uaagagcuaggauuuuaaauca

SEQ ID NO: 878659 - RNA, 22 nt, Human
cuuaggaauauccacagcaggu

SEQ ID NO: 878660 - RNA, 22 nt, Human
agggcucuguuggggucagcac

SEQ ID NO: 878661 - RNA, 22 nt, Human
cugugcuuucgagaugugaucu

SEQ ID NO: 878662 - RNA, 22 nt, Human
auuacuagauugucaagauuua

SEQ ID NO: 878663 - RNA, 22 nt, Human
ugagccuggccugcagagacca

SEQ ID NO: 878664 - RNA, 22 nt, Human
auaauggcuugugguguuauuc

SEQ ID NO: 878665 - RNA, 22 nt, Human
ugaagccaccgaaccagaagag

SEQ ID NO: 878666 - RNA, 22 nt, Human
uccugggagcacaugguccugc

SEQ ID NO: 878667 - RNA, 22 nt, Human
uccuucucuacaaauccaggca

SEQ ID NO: 878668 - RNA, 23 nt, Human
ugugaagguggguccaagggcug

SEQ ID NO: 878669 - RNA, 22 nt, Human
cuggcucccgucugguggccau

SEQ ID NO: 878670 - RNA, 22 nt, Human
aggccugggucucgugccuacc

SEQ ID NO: 878671 - RNA, 22 nt, Human
aaaugguaagacaacacauuau

SEQ ID NO: 878672 - RNA, 22 nt, Human
ugugcaugucugggccuguaag

SEQ ID NO: 878673 - RNA, 22 nt, Human
ccagcucuuuuggcugagugag

SEQ ID NO: 878674 - RNA, 23 nt, Human
cagguauugauuuuucuucuagg

SEQ ID NO: 878675 - RNA, 22 nt, Human
guggguggaggcgucgagggca

SEQ ID NO: 878676 - RNA, 22 nt, Human
auuggaaauacugagagauaaa

SEQ ID NO: 878677 - RNA, 22 nt, Human
cuuugagcaauucugagaugca

SEQ ID NO: 878678 - RNA, 22 nt, Human
uuaaucuucagggacucuugcu

SEQ ID NO: 878679 - RNA, 21 nt, Human
ccugugccagucuauguguuc

SEQ ID NO: 878680 - RNA, 19 nt, Human
uggaacaaacugcaaugac

SEQ ID NO: 878681 - RNA, 22 nt, Human
gaaaggaagaaaggucauuuua

SEQ ID NO: 878682 - RNA, 22 nt, Human
gucuucuguucugugaggcuuc

SEQ ID NO: 878683 - RNA, 22 nt, Human
cucacugcaaguuccaccuacc

SEQ ID NO: 878684 - RNA, 22 nt, Human
aagcugaaacauuagccuaaac

SEQ ID NO: 878685 - RNA, 22 nt, Human
uuuaguaaguucacugcaaagc

SEQ ID NO: 878686 - RNA, 22 nt, Human
cuccuguggucaagggugggac

SEQ ID NO: 878687 - RNA, 22 nt, Human
gaguauaaugauuuucauucac

SEQ ID NO: 878688 - RNA, 22 nt, Human
caagcucuuuaaacuuauguca

SEQ ID NO: 878689 - RNA, 22 nt, Human
cucccagguuccgacgccucuu

SEQ ID NO: 878690 - RNA, 22 nt, Human
uggcacagacagcacagcaaug

SEQ ID NO: 878691 - RNA, 22 nt, Human
ccugccuggggacaaaggaggg

SEQ ID NO: 878692 - RNA, 22 nt, Human
uauuugaugguucuaaaacagc

SEQ ID NO: 878693 - RNA, 22 nt, Human
uggccaguguuggcuagggaca

SEQ ID NO: 878694 - RNA, 22 nt, Human
uccaucaccauuucugcgagcu

SEQ ID NO: 878695 - RNA, 22 nt, Human
ggaguguggagaggacaugggu

SEQ ID NO: 878696 - RNA, 22 nt, Human
ugagguaauaaguguuuguuuu

SEQ ID NO: 878697 - RNA, 22 nt, Human
ggucagagccauggagcaacug

SEQ ID NO: 878698 - RNA, 22 nt, Human
ggcuaaagauguguucuuugga

SEQ ID NO: 878699 - RNA, 22 nt, Human
agaaucaggaagacagccuggc

SEQ ID NO: 878700 - RNA, 22 nt, Human
caugccaguuuugagaugcacc

SEQ ID NO: 878701 - RNA, 22 nt, Human
cugcugcaggaugggcacucug

SEQ ID NO: 878702 - RNA, 22 nt, Human
gggcagcugccagaggccaugg

SEQ ID NO: 878703 - RNA, 22 nt, Human
agaaagcacucugucuuuuacc

SEQ ID NO: 878704 - RNA, 22 nt, Human
aagagcaucgguggagccccca

SEQ ID NO: 878705 - RNA, 22 nt, Human
ugcugaaguucuuccccuaaug

SEQ ID NO: 878706 - RNA, 22 nt, Human
cucacaggcaucucaucaggcu

SEQ ID NO: 878707 - RNA, 22 nt, Human
gcaaacaucuuuauuuggcaag

SEQ ID NO: 878708 - RNA, 22 nt, Human
gaugaaauccagaucacaggug

SEQ ID NO: 878709 - RNA, 22 nt, Human
ugaggcucagagcaccugcucc

SEQ ID NO: 878710 - RNA, 22 nt, Human
gaugaaauagcaaaggcauuug

SEQ ID NO: 878711 - RNA, 22 nt, Human
ugccugggcucaccgccucuuu

SEQ ID NO: 878712 - RNA, 22 nt, Human
uuugauaugcaaaauuauggac

SEQ ID NO: 878713 - RNA, 22 nt, Human
ugcuggcuuuuugugucaaaga

SEQ ID NO: 878714 - RNA, 22 nt, Human
ccuggcagcgccgaagcuggcc

SEQ ID NO: 878715 - RNA, 22 nt, Human
agcagagguuuguuggaaaccu

SEQ ID NO: 878716 - RNA, 22 nt, Human
ucauaguuuaguuaguaugauu

SEQ ID NO: 878717 - RNA, 22 nt, Human
ucagcuucccuaucugaccaua

SEQ ID NO: 878718 - RNA, 22 nt, Human
gagccuggauugucaccgacuu

SEQ ID NO: 878719 - RNA, 22 nt, Human
ucuuuauaaaagucauuauguc

SEQ ID NO: 878720 - RNA, 22 nt, Human
agugugaguuacaaagugugaa

SEQ ID NO: 878721 - RNA, 22 nt, Human
agggaggaucugcuccuugucu

SEQ ID NO: 878722 - RNA, 22 nt, Human
aggcaguggagcuggaauaggc

SEQ ID NO: 878723 - RNA, 22 nt, Human
cauucaaagcaggaaaggccuu

SEQ ID NO: 878724 - RNA, 22 nt, Human
gcuucucuuucuccccuggcgg

SEQ ID NO: 878725 - RNA, 22 nt, Human
aauuaguauugcgauucauuag

SEQ ID NO: 878726 - RNA, 22 nt, Human
aaaugucugagacuucugaacu

SEQ ID NO: 878727 - RNA, 22 nt, Human
caggacagacagaaugccuaac

SEQ ID NO: 878728 - RNA, 22 nt, Human
ggccccagccucaguccccuga

SEQ ID NO: 878729 - RNA, 22 nt, Human
acugcacagaugaagcuguaaa

SEQ ID NO: 878730 - RNA, 22 nt, Human
uaagaaacuaaugcaauaagag

SEQ ID NO: 878731 - RNA, 22 nt, Human
agguguggcuggggcagaggcc

SEQ ID NO: 878732 - RNA, 22 nt, Human
aacaggcagcagacugaaucug

SEQ ID NO: 878733 - RNA, 22 nt, Human
agagagaggcagcagugcucac

SEQ ID NO: 878734 - RNA, 20 nt, Human
uguggaugagguaaggauag

SEQ ID NO: 878735 - RNA, 22 nt, Human
uuuaauucuggcauaauagcuc

SEQ ID NO: 878736 - RNA, 22 nt, Human
uuagucaauagugaauauagag

SEQ ID NO: 878737 - RNA, 23 nt, Human
ggggacagagggcagcccgcauc

SEQ ID NO: 878738 - RNA, 22 nt, Human
agacaauuguucuaaguaaaaa

SEQ ID NO: 878739 - RNA, 22 nt, Human
ugacacagggcaugcagcagaa

SEQ ID NO: 878740 - RNA, 22 nt, Human
ugagguggugcuaaucucugcu

SEQ ID NO: 878741 - RNA, 20 nt, Human
ucacaggggaccaggagcag

SEQ ID NO: 878742 - RNA, 22 nt, Human
gcaaacaugcugagaaauaaga

SEQ ID NO: 878743 - RNA, 22 nt, Human
cauagaaaucaggugagaaucu

SEQ ID NO: 878744 - RNA, 22 nt, Human
acauuucagcgugcaugacaug

SEQ ID NO: 878745 - RNA, 22 nt, Human
auguaaauuguacugacacacg

SEQ ID NO: 878746 - RNA, 22 nt, Human
agccuggcuuagcucucucacu

SEQ ID NO: 878747 - RNA, 22 nt, Human
acuuucauggaucucuguucag

SEQ ID NO: 878748 - RNA, 21 nt, Human
cugccaggauagcaugcaggc

SEQ ID NO: 878749 - RNA, 21 nt, Human
uaauaauuccacuacagagua

SEQ ID NO: 878750 - RNA, 22 nt, Human
gaugcagggaacuuagugggcu

SEQ ID NO: 878751 - RNA, 22 nt, Human
uguggcccagaugagugugcua

SEQ ID NO: 878752 - RNA, 18 nt, Human
uauaaacacacuuagguu

SEQ ID NO: 878753 - RNA, 22 nt, Human
ugaggcugaaacuggcgauaga

SEQ ID NO: 878754 - RNA, 22 nt, Human
ggcauacaagagaaauauaaga

SEQ ID NO: 878755 - RNA, 20 nt, Human
augugucuuagagcaucagg

SEQ ID NO: 878756 - RNA, 22 nt, Human
ggggccgaccgcgguucaggcc

SEQ ID NO: 878757 - RNA, 22 nt, Human
uucugauaauaccacaucgcag

SEQ ID NO: 878758 - RNA, 22 nt, Human
uuuggaagggaaccaaaacaug

SEQ ID NO: 878759 - RNA, 22 nt, Human
cugcugugauugggagaaaccg

SEQ ID NO: 878760 - RNA, 22 nt, Human
ggccccagggauuaggccaacc

SEQ ID NO: 878761 - RNA, 22 nt, Human
ggccucuguuuggagccaggau

SEQ ID NO: 878762 - RNA, 22 nt, Human
uuuuucucuucuguaaaguggu

SEQ ID NO: 878763 - RNA, 22 nt, Human
aacauugauugcaucuguucac

SEQ ID NO: 878764 - RNA, 22 nt, Human
uuguaaacuuguuugaagguau

SEQ ID NO: 878765 - RNA, 22 nt, Human
ugaggcucaagaaucugcauuu

SEQ ID NO: 878766 - RNA, 22 nt, Human
cuccaaauacaauauuguuguu

SEQ ID NO: 878767 - RNA, 22 nt, Human
caggcugcggccgugugagcau

SEQ ID NO: 878768 - RNA, 22 nt, Human
uucuagcacugccuggaagaca

SEQ ID NO: 878769 - RNA, 22 nt, Human
ucuggguggcuucagaggccac

SEQ ID NO: 878770 - RNA, 20 nt, Human
cuuguuaaauaugcagguag

SEQ ID NO: 878771 - RNA, 22 nt, Human
auggcagcaaaugucuggcugg

SEQ ID NO: 878772 - RNA, 22 nt, Human
ugagugagacauccugucuuaa

SEQ ID NO: 878773 - RNA, 22 nt, Human
augauugccugugugugagaaa

SEQ ID NO: 878774 - RNA, 22 nt, Human
gucauuuucuagaauuauuuga

SEQ ID NO: 878775 - RNA, 22 nt, Human
ucaauuucuugguuugauaaua

SEQ ID NO: 878776 - RNA, 23 nt, Human
uggaagaaaaugguuuggcugug

SEQ ID NO: 878777 - RNA, 22 nt, Human
aaguagcauuuucaaaauguau

SEQ ID NO: 878778 - RNA, 22 nt, Human
agcuucuucugauuugucaguc

SEQ ID NO: 878779 - RNA, 22 nt, Human
ugccuggcucuaucaguggugg

SEQ ID NO: 878780 - RNA, 22 nt, Human
ucuucaauuuagaauggauuua

SEQ ID NO: 878781 - RNA, 22 nt, Human
auuugcugagcucaaagaaaag

SEQ ID NO: 878782 - RNA, 22 nt, Human
uuagucucuuugcauugccaua

SEQ ID NO: 878783 - RNA, 22 nt, Human
auaugcuugggacugauacagu

SEQ ID NO: 878784 - RNA, 22 nt, Human
cuacaacaccaggcacggagug

SEQ ID NO: 878785 - RNA, 22 nt, Human
aguucaauuguuuuguaaaagu

SEQ ID NO: 878786 - RNA, 22 nt, Human
ugggacagugaccccagagguc

SEQ ID NO: 878787 - RNA, 22 nt, Human
agguccuuaacauagugauauc

SEQ ID NO: 878788 - RNA, 22 nt, Human
aagauacaccaagagccuagua

SEQ ID NO: 878789 - RNA, 22 nt, Human
acaugcagagggagggccaggc

SEQ ID NO: 878790 - RNA, 22 nt, Human
uccaggagacacccuugugugu

SEQ ID NO: 878791 - RNA, 21 nt, Human
agcugccuuuagagagaacca

SEQ ID NO: 878792 - RNA, 22 nt, Human
acacuuuuguguauauccaguu

SEQ ID NO: 878793 - RNA, 22 nt, Human
agagggcaugcuugguggccug

SEQ ID NO: 878794 - RNA, 22 nt, Human
accagagagccuaggcugggca

SEQ ID NO: 878795 - RNA, 22 nt, Human
cugggcagugcagcuauagaac

SEQ ID NO: 878796 - RNA, 22 nt, Human
ucuggccaggauggcaagacca

SEQ ID NO: 878797 - RNA, 22 nt, Human
uugauuugggaauggucuggca

SEQ ID NO: 878798 - RNA, 22 nt, Human
cagggcggggucugccggcccu

SEQ ID NO: 878799 - RNA, 22 nt, Human
gcaugcagucaaccaguaaggg

SEQ ID NO: 878800 - RNA, 22 nt, Human
ugugugggcgaagacagccuuu

SEQ ID NO: 878801 - RNA, 22 nt, Human
guaaacaauagcauugccugau

SEQ ID NO: 878802 - RNA, 22 nt, Human
accaggccuggcugggcagcca

SEQ ID NO: 878803 - RNA, 22 nt, Human
aaauacagaguuauggaccuca

SEQ ID NO: 878804 - RNA, 18 nt, Human
uccagcucacagaugggc

SEQ ID NO: 878805 - RNA, 22 nt, Human
ugcuucaugaggcugagagaag

SEQ ID NO: 878806 - RNA, 22 nt, Human
cagccugcccuggaagcccagc

SEQ ID NO: 878807 - RNA, 22 nt, Human
cucaaauauaagcuaaaugugg

SEQ ID NO: 878808 - RNA, 22 nt, Human
ugggguaggagucagcgagaga

SEQ ID NO: 878809 - RNA, 22 nt, Human
cauggccccaaaucccaugcau

SEQ ID NO: 878810 - RNA, 22 nt, Human
uggcccuguucuguaccucaua

SEQ ID NO: 878811 - RNA, 22 nt, Human
cagcacagggcuugagaggugu

SEQ ID NO: 878812 - RNA, 22 nt, Human
uuuuagauaguuuaacugcacu

SEQ ID NO: 878813 - RNA, 22 nt, Human
ggaagaggaggagccaggcuuu

SEQ ID NO: 878814 - RNA, 22 nt, Human
ccaggagagcaggcgugcagcu

SEQ ID NO: 878815 - RNA, 22 nt, Human
uucagugcacaguacugagacu

SEQ ID NO: 878816 - RNA, 22 nt, Human
uacaauaugugaacuuuggugu

SEQ ID NO: 878817 - RNA, 22 nt, Human
ggcaugaguggcagugggcagu

SEQ ID NO: 878818 - RNA, 22 nt, Human
acaccagggauaugaggaagga

SEQ ID NO: 878819 - RNA, 18 nt, Human
auauucaagaagacagag

SEQ ID NO: 878820 - RNA, 22 nt, Human
cccucccaagcacucugacaua

SEQ ID NO: 878821 - RNA, 22 nt, Human
agaggugagucauuaccuagug

SEQ ID NO: 878822 - RNA, 22 nt, Human
uuguuucagcuguaugcuaugu

SEQ ID NO: 878823 - RNA, 22 nt, Human
acagugaggaagcagcugugcu

SEQ ID NO: 878824 - RNA, 22 nt, Human
ucccuagucgcaucuguggaga

SEQ ID NO: 878825 - RNA, 22 nt, Human
uugagaaauaagcaugucuaga

SEQ ID NO: 878826 - RNA, 18 nt, Human
ucaaaauauuucugugga

SEQ ID NO: 878827 - RNA, 22 nt, Human
cagcaauauacacagucuaugg

SEQ ID NO: 878828 - RNA, 20 nt, Human
uccuguggacauugcuggcc

SEQ ID NO: 878829 - RNA, 22 nt, Human
uccuuuuuauaguuagagaaac

SEQ ID NO: 878830 - RNA, 22 nt, Human
uugggaagaauggaggugguua

SEQ ID NO: 878831 - RNA, 22 nt, Human
acaggcuucuuuugaaaucaga

SEQ ID NO: 878832 - RNA, 22 nt, Human
aagcaaguagguauuugacaaa

SEQ ID NO: 878833 - RNA, 22 nt, Human
uacaucauguaagcagaaucau

SEQ ID NO: 878834 - RNA, 17 nt, Human
ugcaugcgucugugaua

SEQ ID NO: 878835 - RNA, 17 nt, Human
gcucagaguacacgugu

SEQ ID NO: 878836 - RNA, 22 nt, Human
gacagacacaauugauccauga

SEQ ID NO: 878837 - RNA, 22 nt, Human
uacuuguuaucccuuacucuug

SEQ ID NO: 878838 - RNA, 22 nt, Human
uuucuuccccaagugaauuuua

SEQ ID NO: 878839 - RNA, 22 nt, Human
uggguccacggaagacuuaggg

SEQ ID NO: 878840 - RNA, 22 nt, Human
guucguugcuugguuuccucua

SEQ ID NO: 878841 - RNA, 22 nt, Human
cagcugagaaauggggaaaggg

SEQ ID NO: 878842 - RNA, 22 nt, Human
aguaaugugccugaaauacuug

SEQ ID NO: 878843 - RNA, 22 nt, Human
aaggcucccucuucucgagugu

SEQ ID NO: 878844 - RNA, 22 nt, Human
caggccucagagaguggcgggg

SEQ ID NO: 878845 - RNA, 22 nt, Human
uugaggagucaggggcacggaa

SEQ ID NO: 878846 - RNA, 22 nt, Human
uacaccagguuaccaaucacug

SEQ ID NO: 878847 - RNA, 22 nt, Human
ugggcccugacuucaagcaucc

SEQ ID NO: 878848 - RNA, 22 nt, Human
ugcccagcuucuuacuuuuaaa

SEQ ID NO: 878849 - RNA, 19 nt, Human
uuucaauggcuuagagaaa

SEQ ID NO: 878850 - RNA, 22 nt, Human
gggaagugugcagaguucucuu

SEQ ID NO: 878851 - RNA, 21 nt, Human
uacuguauagauguguucuug

SEQ ID NO: 878852 - RNA, 22 nt, Human
auguaacaaaugguauacaugu

SEQ ID NO: 878853 - RNA, 22 nt, Human
guacauauccuuuacguuuugu

SEQ ID NO: 878854 - RNA, 22 nt, Human
gcuuucucuucacugauguuca

SEQ ID NO: 878855 - RNA, 22 nt, Human
aaccuagaaguuagaguaucau

SEQ ID NO: 878856 - RNA, 22 nt, Human
gagggcugccacguugggcgag

SEQ ID NO: 878857 - RNA, 19 nt, Human
ccaacaguacugaagcacu

SEQ ID NO: 878858 - RNA, 22 nt, Human
acuuuacauuugaucucucuaa

SEQ ID NO: 878859 - RNA, 19 nt, Human
gcaggcccagucgggcugg

SEQ ID NO: 878860 - RNA, 22 nt, Human
cauggcaggaaggacaugcacu

SEQ ID NO: 878861 - RNA, 22 nt, Human
cagaauuuagcacaauguaugg

SEQ ID NO: 878862 - RNA, 22 nt, Human
augagaaagaguuguaucuaga

SEQ ID NO: 878863 - RNA, 22 nt, Human
agccacaggccaugagauacca

SEQ ID NO: 878864 - RNA, 22 nt, Human
aucaccugcacaaauguguucc

SEQ ID NO: 878865 - RNA, 22 nt, Human
gcaggcugauagaggauuccau

SEQ ID NO: 878866 - RNA, 22 nt, Human
augcaggguuauuucaaaaaua

SEQ ID NO: 878867 - RNA, 22 nt, Human
aacaugucuuacuuugcuuucu

SEQ ID NO: 878868 - RNA, 22 nt, Human
uccaggaggugaggggaccaaa

SEQ ID NO: 878869 - RNA, 22 nt, Human
ggcuggcuggcuuagcagagga

SEQ ID NO: 878870 - RNA, 22 nt, Human
acaguggagcucagaugaaaau

SEQ ID NO: 878871 - RNA, 22 nt, Human
ucaggaaaguguucucagagga

SEQ ID NO: 878872 - RNA, 22 nt, Human
gauacaguguguuaacgagaaa

SEQ ID NO: 878873 - RNA, 22 nt, Human
agaagugccgaaaggaagacag

SEQ ID NO: 878874 - RNA, 22 nt, Human
caccagcuacagacuacugugu

SEQ ID NO: 878875 - RNA, 22 nt, Human
uguguucuggaaagcucacuga

SEQ ID NO: 878876 - RNA, 22 nt, Human
acaauucaagaugagauucagg

SEQ ID NO: 878877 - RNA, 22 nt, Human
gcucacagaacuucucuuccca

SEQ ID NO: 878878 - RNA, 22 nt, Human
aggcucugcuuuucuggauaua

SEQ ID NO: 878879 - RNA, 22 nt, Human
cccuggugguacggcacuggca

SEQ ID NO: 878880 - RNA, 22 nt, Human
cacagagacagaucuauuuugc

SEQ ID NO: 878881 - RNA, 18 nt, Human
gagcugccauauuuaguu

SEQ ID NO: 878882 - RNA, 17 nt, Human
gaaaggaggcaacacug

SEQ ID NO: 878883 - RNA, 22 nt, Human
ugcuuggcuagcuuggcagcuc

SEQ ID NO: 878884 - RNA, 22 nt, Human
gagcaaagcuuuuagggccuuu

SEQ ID NO: 878885 - RNA, 22 nt, Human
aucaaaguuucccagaaguugu

SEQ ID NO: 878886 - RNA, 21 nt, Human
cuguuucuugugaagugacac

SEQ ID NO: 878887 - RNA, 22 nt, Human
gcagcagcaggcgcucggccgu

SEQ ID NO: 878888 - RNA, 22 nt, Human
cacaugcuccauacagaauggg

SEQ ID NO: 878889 - RNA, 22 nt, Human
uggcaauuuguagaguaaauua

SEQ ID NO: 878890 - RNA, 22 nt, Human
ccaugggcgcacaggccuggag

SEQ ID NO: 878891 - RNA, 22 nt, Human
uucagagguaagggucucagaa

SEQ ID NO: 878892 - RNA, 22 nt, Human
uuccacagguuucagacuguuc

SEQ ID NO: 878893 - RNA, 22 nt, Human
uagcaagaucgugucucuaaaa

SEQ ID NO: 878894 - RNA, 22 nt, Human
acaaguauuuaagguuaguaua

SEQ ID NO: 878895 - RNA, 22 nt, Human
ucaaugacauuguaucagaguu

SEQ ID NO: 878896 - RNA, 22 nt, Human
gucacccacucccugcugcugu

SEQ ID NO: 878897 - RNA, 22 nt, Human
gugcugaacauuugggacuugu

SEQ ID NO: 878898 - RNA, 22 nt, Human
ugccacaggguccucaggccag

SEQ ID NO: 878899 - RNA, 22 nt, Human
ucccugaaccacuagugaugag

SEQ ID NO: 878900 - RNA, 22 nt, Human
agggugcaaaagcaaggacagu

SEQ ID NO: 878901 - RNA, 22 nt, Human
ucaauuacuaaccaaauaaugu

SEQ ID NO: 878902 - RNA, 22 nt, Human
aagcugcaaaaaauuucugucu

SEQ ID NO: 878903 - RNA, 22 nt, Human
aaaaaccucaauuacuuuugca

SEQ ID NO: 878904 - RNA, 22 nt, Human
uucaaucauuagaaucucaggc

SEQ ID NO: 878905 - RNA, 22 nt, Human
gcugccacgaucucugcuguag

SEQ ID NO: 878906 - RNA, 22 nt, Human
uguuacugauuugauauacagu

SEQ ID NO: 878907 - RNA, 22 nt, Human
acagacagaggcuccaugagga

SEQ ID NO: 878908 - RNA, 22 nt, Human
ccacccuuccauucuuccucuu

SEQ ID NO: 878909 - RNA, 22 nt, Human
aacuuccuuggguaugaaaaca

SEQ ID NO: 878910 - RNA, 22 nt, Human
gcucccaggaagagaagggcca

SEQ ID NO: 878911 - RNA, 20 nt, Human
ggagaugcagcccaggugcc

SEQ ID NO: 878912 - RNA, 22 nt, Human
gggcagcaggcuccacguuccu

SEQ ID NO: 878913 - RNA, 23 nt, Human
ccacauggcaagaugaugcauuc

SEQ ID NO: 878914 - RNA, 22 nt, Human
acccccacggaaggccguacgc

SEQ ID NO: 878915 - RNA, 22 nt, Human
uguuccugacggccaaagaggu

SEQ ID NO: 878916 - RNA, 22 nt, Human
acacuucauagcaagguuggag

SEQ ID NO: 878917 - RNA, 22 nt, Human
gacagcaggugcuugggaaagg

SEQ ID NO: 878918 - RNA, 22 nt, Human
ccaggaaggccuggaugccccc

SEQ ID NO: 878919 - RNA, 22 nt, Human
uaggacuuggaaggagcuccca

SEQ ID NO: 878920 - RNA, 22 nt, Human
uccugaggaaaguucaugaaug

SEQ ID NO: 878921 - RNA, 22 nt, Human
agggccaguucagaggacaugg

SEQ ID NO: 878922 - RNA, 22 nt, Human
ccccaaaguguuggauaauuga

SEQ ID NO: 878923 - RNA, 22 nt, Human
uggcuggaguauaggaguagga

SEQ ID NO: 878924 - RNA, 22 nt, Human
agggccugcaucaggagcuugg

SEQ ID NO: 878925 - RNA, 22 nt, Human
aucuucucauguguaaugaggu

SEQ ID NO: 878926 - RNA, 22 nt, Human
aaugcuuucaaaaaugugcagu

SEQ ID NO: 878927 - RNA, 22 nt, Human
aacuaaaacugguuuguucucu

SEQ ID NO: 878928 - RNA, 18 nt, Human
uccuaacuuagauacucc

SEQ ID NO: 878929 - RNA, 22 nt, Human
auugucagcucgaaaugcauca

SEQ ID NO: 878930 - RNA, 22 nt, Human
uaucaaccaacuacucguguug

SEQ ID NO: 878931 - RNA, 19 nt, Human
ucucugugucucuguuuau

SEQ ID NO: 878932 - RNA, 22 nt, Human
aauugucuuggugcaaucauga

SEQ ID NO: 878933 - RNA, 22 nt, Human
gucaugugaauaaguguggggu

SEQ ID NO: 878934 - RNA, 22 nt, Human
gagcagcuguccccaaagcuuc

SEQ ID NO: 878935 - RNA, 21 nt, Human
aggagcuggagaaaacuuucc

SEQ ID NO: 878936 - RNA, 22 nt, Human
gaacagaauuaccgaagaucug

SEQ ID NO: 878937 - RNA, 22 nt, Human
cacauuaaaauccuaacuucca

SEQ ID NO: 878938 - RNA, 22 nt, Human
ggccuugggcagacacgucaca

SEQ ID NO: 878939 - RNA, 22 nt, Human
uuguccaaggucccacaguuag

SEQ ID NO: 878940 - RNA, 22 nt, Human
acaggcuugcacuaggguggca

SEQ ID NO: 878941 - RNA, 22 nt, Human
acagggcaccugagguaggaag

SEQ ID NO: 878942 - RNA, 22 nt, Human
ucugaaagcccuaguuuguaau

SEQ ID NO: 878943 - RNA, 22 nt, Human
uggcucaggaucuaagcagaau

SEQ ID NO: 878944 - RNA, 21 nt, Human
gcugugcacauaguagaagug

SEQ ID NO: 878945 - RNA, 22 nt, Human
gcaaugcauaacagagugggcc

SEQ ID NO: 878946 - RNA, 22 nt, Human
uagcaacagaaaauaggagugc

SEQ ID NO: 878947 - RNA, 22 nt, Human
uugaaucucucugagauucagu

SEQ ID NO: 878948 - RNA, 19 nt, Human
uagacucuaauguuaagcu

SEQ ID NO: 878949 - RNA, 22 nt, Human
ggcacacagcuuggcaggagau

SEQ ID NO: 878950 - RNA, 18 nt, Human
uagggcucuagggaguga

SEQ ID NO: 878951 - RNA, 23 nt, Human
cccauuuagcggaugagggaagu

SEQ ID NO: 878952 - RNA, 22 nt, Human
ucauacaucuuguauaucuauc

SEQ ID NO: 878953 - RNA, 22 nt, Human
cugagcaguuucuuagggcuca

SEQ ID NO: 878954 - RNA, 22 nt, Human
agcagacaacccagaugaccca

SEQ ID NO: 878955 - RNA, 22 nt, Human
gauucucucuggaucccaugga

SEQ ID NO: 878956 - RNA, 22 nt, Human
gcagcagcucaguucugggagg

SEQ ID NO: 878957 - RNA, 22 nt, Human
gcucugagucacacugcccugu

SEQ ID NO: 878958 - RNA, 22 nt, Human
ugggccuguugccugaguccau

SEQ ID NO: 878959 - RNA, 22 nt, Human
cucuggcacacuccuuccaggu

SEQ ID NO: 878960 - RNA, 22 nt, Human
ucaguccccagaugugugcugu

SEQ ID NO: 878961 - RNA, 21 nt, Human
cccaggaggagcuccggcucc

SEQ ID NO: 878962 - RNA, 22 nt, Human
gaggcagcagaacauggaagag

SEQ ID NO: 878963 - RNA, 22 nt, Human
agaugucagcaggguugguuuc

SEQ ID NO: 878964 - RNA, 20 nt, Human
auacacauucauagaaaaau

SEQ ID NO: 878965 - RNA, 22 nt, Human
agucucugcaugccugcugugc

SEQ ID NO: 878966 - RNA, 22 nt, Human
ggccagggggcuucagacucca

SEQ ID NO: 878967 - RNA, 22 nt, Human
uauuauuauauuggaugagacu

SEQ ID NO: 878968 - RNA, 22 nt, Human
cacuauaucucuuucaucuuuu

SEQ ID NO: 878969 - RNA, 22 nt, Human
uuuaaugaauaauucaaaucug

SEQ ID NO: 878970 - RNA, 22 nt, Human
uggccugccuucgcugagcuga

SEQ ID NO: 878971 - RNA, 19 nt, Human
agcuucuuuggaaacauuu

SEQ ID NO: 878972 - RNA, 22 nt, Human
agccucagcacgcagcucugug

SEQ ID NO: 878973 - RNA, 22 nt, Human
cuggcugaggcagagccugggg

SEQ ID NO: 878974 - RNA, 22 nt, Human
accuggcuuguuucuaccuccu

SEQ ID NO: 878975 - RNA, 22 nt, Human
gucccaggugcccagugggcag

SEQ ID NO: 878976 - RNA, 22 nt, Human
cugagccuguguuucucuggca

SEQ ID NO: 878977 - RNA, 22 nt, Human
uucaucaccuugguagcacucc

SEQ ID NO: 878978 - RNA, 22 nt, Human
ugggcucagccucagucugugg

SEQ ID NO: 878979 - RNA, 22 nt, Human
ccugggcuugcaucugugcugg

SEQ ID NO: 878980 - RNA, 22 nt, Human
uuacaaugcacucaccuuuaga

SEQ ID NO: 878981 - RNA, 22 nt, Human
uauugucucacaguuuuggagg

SEQ ID NO: 878982 - RNA, 22 nt, Human
aaggugggcagaucacaagguc

SEQ ID NO: 878983 - RNA, 22 nt, Human
gguggggccugcuccagcggcc

SEQ ID NO: 878984 - RNA, 21 nt, Human
uggcggggacuuguggcugcc

SEQ ID NO: 878985 - RNA, 22 nt, Human
agugaccgaggcacuuggcaac

SEQ ID NO: 878986 - RNA, 22 nt, Human
agccuggcugggaagagccucu

SEQ ID NO: 878987 - RNA, 22 nt, Human
ucuggucccugcucacuucuug

SEQ ID NO: 878988 - RNA, 22 nt, Human
aaggaagagcaaagaauuaugu

SEQ ID NO: 878989 - RNA, 22 nt, Human
cugugcccuuucgcugcacugu

SEQ ID NO: 878990 - RNA, 22 nt, Human
gcccagagagaugaagugaugg

SEQ ID NO: 878991 - RNA, 22 nt, Human
ggagccugugcccaagcccaga

SEQ ID NO: 878992 - RNA, 22 nt, Human
uuggacugagaguuccaccauu

SEQ ID NO: 878993 - RNA, 22 nt, Human
uuuaucugggauuuugcagucu

SEQ ID NO: 878994 - RNA, 22 nt, Human
ucaccauuaaggacuuucagcu

SEQ ID NO: 878995 - RNA, 22 nt, Human
agcauauugucuuuggugucuc

SEQ ID NO: 878996 - RNA, 22 nt, Human
ugacuuuagacuuagucaaguu

SEQ ID NO: 878997 - RNA, 22 nt, Human
cggagcugccugccaagccugc

SEQ ID NO: 878998 - RNA, 22 nt, Human
agaaggcugagacugggaugaa

SEQ ID NO: 878999 - RNA, 22 nt, Human
uuucuuguuucauggugucuca

SEQ ID NO: 879000 - RNA, 22 nt, Human
uuucuaagcuuaguaugaggca

SEQ ID NO: 879001 - RNA, 22 nt, Human
cacaaguggcuggggaaaggga

SEQ ID NO: 879002 - RNA, 22 nt, Human
ccugcagguugcagaggcggaa

SEQ ID NO: 879003 - RNA, 21 nt, Human
acagcugucuuagcuugggcu

SEQ ID NO: 879004 - RNA, 22 nt, Human
uauguuucauucuuuucuggua

SEQ ID NO: 879005 - RNA, 22 nt, Human
auguacacaugcaugcaugugc

SEQ ID NO: 879006 - RNA, 22 nt, Human
ugcacacacaggagucuccucc

SEQ ID NO: 879007 - RNA, 22 nt, Human
guuugcugcccucuccuguccg

SEQ ID NO: 879008 - RNA, 19 nt, Human
ucucuggggacacuuucac

SEQ ID NO: 879009 - RNA, 22 nt, Human
aggucuuaggagcauggugcug

SEQ ID NO: 879010 - RNA, 22 nt, Human
cauggcccucuucuggagcaau

SEQ ID NO: 879011 - RNA, 22 nt, Human
ggagaaagggacugaucugcuc

SEQ ID NO: 879012 - RNA, 21 nt, Human
agaguaauuccugcuggaaag

SEQ ID NO: 879013 - RNA, 22 nt, Human
gcagcauggagaaguagcuaga

SEQ ID NO: 879014 - RNA, 22 nt, Human
uagaacaguauaggcuaaacau

SEQ ID NO: 879015 - RNA, 22 nt, Human
cagcaguugaaauugacaugug

SEQ ID NO: 879016 - RNA, 22 nt, Human
gagccuguguuuccuguagcca

SEQ ID NO: 879017 - RNA, 23 nt, Human
ucuucauggccaucugguucuuc

SEQ ID NO: 879018 - RNA, 22 nt, Human
gagacagaugcugcuggagcau

SEQ ID NO: 879019 - RNA, 22 nt, Human
uucucuuccagccgggcuugca

SEQ ID NO: 879020 - RNA, 22 nt, Human
ugcuggaauuauagaaaaauag

SEQ ID NO: 879021 - RNA, 22 nt, Human
uaaaugcaguacaaauuguucu

SEQ ID NO: 879022 - RNA, 22 nt, Human
uuuaaaccuaucuaagaaauag

SEQ ID NO: 879023 - RNA, 22 nt, Human
gaauauuuuuaaagggacuaau

SEQ ID NO: 879024 - RNA, 22 nt, Human
gacagcugggaggaugacauaa

SEQ ID NO: 879025 - RNA, 22 nt, Human
aaucagaaaauucaguggaauu

SEQ ID NO: 879026 - RNA, 22 nt, Human
cuguauuucuuggacaguugcu

SEQ ID NO: 879027 - RNA, 22 nt, Human
cuguacagaccuauuagcccag

SEQ ID NO: 879028 - RNA, 22 nt, Human
cagggagaggcugguggaguaa

SEQ ID NO: 879029 - RNA, 22 nt, Human
ugaaggagaaauggaaaguggg

SEQ ID NO: 879030 - RNA, 22 nt, Human
auuauuuuaugugcggccugau

SEQ ID NO: 879031 - RNA, 22 nt, Human
ugcccuggagucaguggcuauu

SEQ ID NO: 879032 - RNA, 22 nt, Human
auggcaguauuucugaaaggcu

SEQ ID NO: 879033 - RNA, 22 nt, Human
acagaguuuauguguguacaaa

SEQ ID NO: 879034 - RNA, 22 nt, Human
gccuugaucugcuguguuugag

SEQ ID NO: 879035 - RNA, 22 nt, Human
gggcggcgucggcgaggccauc

SEQ ID NO: 879036 - RNA, 21 nt, Human
ugaugaggucauagcacccuc

SEQ ID NO: 879037 - RNA, 22 nt, Human
agcauuuaccucaaugcaucug

SEQ ID NO: 879038 - RNA, 22 nt, Human
acagacaugcuguuuggguggu

SEQ ID NO: 879039 - RNA, 22 nt, Human
gagcagcucugugccuggagac

SEQ ID NO: 879040 - RNA, 22 nt, Human
ccaggcucugacauagauggga

SEQ ID NO: 879041 - RNA, 22 nt, Human
cugggccagaccuuguggucuu

SEQ ID NO: 879042 - RNA, 22 nt, Human
auaauguugaugauugucuuug

SEQ ID NO: 879043 - RNA, 22 nt, Human
uccugggcgaguggugguacac

SEQ ID NO: 879044 - RNA, 18 nt, Human
gaggauggaaggagaugc

SEQ ID NO: 879045 - RNA, 22 nt, Human
ggcugccugccgcccacuuggc

SEQ ID NO: 879046 - RNA, 22 nt, Human
uggcugagagcaauugacucug

SEQ ID NO: 879047 - RNA, 22 nt, Human
agauacaaaaagggagaagauu

SEQ ID NO: 879048 - RNA, 22 nt, Human
uauauagaaaagcagauguugg

SEQ ID NO: 879049 - RNA, 22 nt, Human
aagagaaugacaaggagaaccu

SEQ ID NO: 879050 - RNA, 22 nt, Human
ggacugggcaugggugcucugc

SEQ ID NO: 879051 - RNA, 22 nt, Human
aaggucagagcaggaaggaguc

SEQ ID NO: 879052 - RNA, 22 nt, Human
uaaguucagaguucucauuugu

SEQ ID NO: 879053 - RNA, 22 nt, Human
agucuauuugcuguccgagcaa

SEQ ID NO: 879054 - RNA, 22 nt, Human
aggauacaagucucagaaugcu

SEQ ID NO: 879055 - RNA, 22 nt, Human
auuuugaaaccaaguuauuucc

SEQ ID NO: 879056 - RNA, 22 nt, Human
ccuggagcgcgggucaagcugg

SEQ ID NO: 879057 - RNA, 22 nt, Human
ugauucucugauggagaaagac

SEQ ID NO: 879058 - RNA, 19 nt, Human
auggaaaaugccagacuga

SEQ ID NO: 879059 - RNA, 22 nt, Human
uucagugucacaagagcaagcc

SEQ ID NO: 879060 - RNA, 22 nt, Human
gaggcugucuguuagccuggga

SEQ ID NO: 879061 - RNA, 22 nt, Human
aaacaagcugcagacaagccau

SEQ ID NO: 879062 - RNA, 22 nt, Human
gaguuuauuugacuggauucuc

SEQ ID NO: 879063 - RNA, 22 nt, Human
aggcugcagaggugcugccaga

SEQ ID NO: 879064 - RNA, 22 nt, Human
gcucagggcuaaggcugagggg

SEQ ID NO: 879065 - RNA, 22 nt, Human
uuugcaaauuagccacccuguu

SEQ ID NO: 879066 - RNA, 22 nt, Human
uccagggaagagcagaggcuac

SEQ ID NO: 879067 - RNA, 22 nt, Human
ccugccuggcugucagcagagc

SEQ ID NO: 879068 - RNA, 22 nt, Human
ucugcaagauggucuuagaggu

SEQ ID NO: 879069 - RNA, 22 nt, Human
ucauguuuuagcugcaaaauga

SEQ ID NO: 879070 - RNA, 22 nt, Human
uucaauguuucuuaucaaguug

SEQ ID NO: 879071 - RNA, 22 nt, Human
gagucuuaggcaaaaauaaugg

SEQ ID NO: 879072 - RNA, 22 nt, Human
uugagguaggcauuguucaaaa

SEQ ID NO: 879073 - RNA, 22 nt, Human
uucacauuccgcggcuauuuuc

SEQ ID NO: 879074 - RNA, 19 nt, Human
gacaggaaggcuaccagua

SEQ ID NO: 879075 - RNA, 22 nt, Human
ggagcagggaauuacagcgcag

SEQ ID NO: 879076 - RNA, 22 nt, Human
cagcaucuguaggacuccucuu

SEQ ID NO: 879077 - RNA, 22 nt, Human
uccugggaggaacauuuaccua

SEQ ID NO: 879078 - RNA, 22 nt, Human
ugugugccagggcaugcacagg

SEQ ID NO: 879079 - RNA, 22 nt, Human
cccuggaggaccccaauguggc

SEQ ID NO: 879080 - RNA, 22 nt, Human
aauacuggcugucaaagaugga

SEQ ID NO: 879081 - RNA, 22 nt, Human
aggugggggcuguguccuugac

SEQ ID NO: 879082 - RNA, 22 nt, Human
aaaauaacuucuacuauuugca

SEQ ID NO: 879083 - RNA, 22 nt, Human
guaaauuauuucaagaucaucu

SEQ ID NO: 879084 - RNA, 22 nt, Human
cuuugaaauucuucagcugaag

SEQ ID NO: 879085 - RNA, 22 nt, Human
aauguuguuggcucuucaugau

SEQ ID NO: 879086 - RNA, 22 nt, Human
uccuccuguuucucaggccugg

SEQ ID NO: 879087 - RNA, 22 nt, Human
uuuguaaauagcaguacucaug

SEQ ID NO: 879088 - RNA, 22 nt, Human
gagcuaggauaucaugagggua

SEQ ID NO: 879089 - RNA, 22 nt, Human
guucaaauugauuuugguaaag

SEQ ID NO: 879090 - RNA, 23 nt, Human
cugagguaaaauauucugaagga

SEQ ID NO: 879091 - RNA, 22 nt, Human
aaaucauagcccccauccgauu

SEQ ID NO: 879092 - RNA, 22 nt, Human
ccucuucuaggacguccuugug

SEQ ID NO: 879093 - RNA, 22 nt, Human
cauccugguuaccccauaguca

SEQ ID NO: 879094 - RNA, 22 nt, Human
uggccugggucacaccaggguc

SEQ ID NO: 879095 - RNA, 22 nt, Human
uuucuacagaagauacacugcu

SEQ ID NO: 879096 - RNA, 22 nt, Human
uuccuccacgugacaggagcca

SEQ ID NO: 879097 - RNA, 22 nt, Human
cuagggccaaaggcugugaugc

SEQ ID NO: 879098 - RNA, 22 nt, Human
aacaguuuaucaaguuuuuaca

SEQ ID NO: 879099 - RNA, 20 nt, Human
cuucuucaguaguuuguucu

SEQ ID NO: 879100 - RNA, 22 nt, Human
ggagcugcacgcucugaagccu

SEQ ID NO: 879101 - RNA, 22 nt, Human
uucucauagagacaugauuaua

SEQ ID NO: 879102 - RNA, 22 nt, Human
guuuccaaccccaccaaagugc

SEQ ID NO: 879103 - RNA, 22 nt, Human
ucagaggacaagcucccuggug

SEQ ID NO: 879104 - RNA, 22 nt, Human
acuauuagcauaucaugaaugg

SEQ ID NO: 879105 - RNA, 22 nt, Human
aauauuugcaucauuagcuauu

SEQ ID NO: 879106 - RNA, 22 nt, Human
gugaggagggcuggucccaggc

SEQ ID NO: 879107 - RNA, 22 nt, Human
gaggaaaauauucagggagguu

SEQ ID NO: 879108 - RNA, 22 nt, Human
uuauagcagcaugauuuacaau

SEQ ID NO: 879109 - RNA, 22 nt, Human
ugagugcuuuaaauguuauuuu

SEQ ID NO: 879110 - RNA, 22 nt, Human
gggcucuggauggagccugcag

SEQ ID NO: 879111 - RNA, 22 nt, Human
ggcagcaagagagguucagcuu

SEQ ID NO: 879112 - RNA, 23 nt, Human
gcugauggagacuuguggccucc

SEQ ID NO: 879113 - RNA, 22 nt, Human
cugccaggcacugggcucugca

SEQ ID NO: 879114 - RNA, 21 nt, Human
ucauauuucucuugcuauugu

SEQ ID NO: 879115 - RNA, 20 nt, Human
gauaaauugucucuuaagug

SEQ ID NO: 879116 - RNA, 22 nt, Human
ugacauuuuaucaauaucacag

SEQ ID NO: 879117 - RNA, 22 nt, Human
gcuggcaggagccuuucccuuu

SEQ ID NO: 879118 - RNA, 22 nt, Human
ccaagcagaaccauucaggcac

SEQ ID NO: 879119 - RNA, 22 nt, Human
gagggagugagacacaaaagaa

SEQ ID NO: 879120 - RNA, 22 nt, Human
caguucugagcuuucccagaag

SEQ ID NO: 879121 - RNA, 22 nt, Human
uuucacagucaauuuggaguca

SEQ ID NO: 879122 - RNA, 22 nt, Human
gagucaguaauggauaugucau

SEQ ID NO: 879123 - RNA, 22 nt, Human
uagagguguugacgccaaggua

SEQ ID NO: 879124 - RNA, 22 nt, Human
auccacaggguguguuaagaug

SEQ ID NO: 879125 - RNA, 22 nt, Human
cugaggccccucuugugagcau

SEQ ID NO: 879126 - RNA, 22 nt, Human
cgcagccccaacaaaugggaca

SEQ ID NO: 879127 - RNA, 19 nt, Human
uaggaauguagaauccuag

SEQ ID NO: 879128 - RNA, 22 nt, Human
ggaggaggggcgcuuugucuau

SEQ ID NO: 879129 - RNA, 22 nt, Human
aaguuuagcgcucucucaagga

SEQ ID NO: 879130 - RNA, 22 nt, Human
uauuauguagaguaaggguuaa

SEQ ID NO: 879131 - RNA, 22 nt, Human
aggccacaggauugcacagcau

SEQ ID NO: 879132 - RNA, 22 nt, Human
ugucaccaaguugaugaaugca

SEQ ID NO: 879133 - RNA, 22 nt, Human
aggagcugagucagcccgacag

SEQ ID NO: 879134 - RNA, 22 nt, Human
gaauacaaacuuaaggcuuuac

SEQ ID NO: 879135 - RNA, 22 nt, Human
cuagaaacauuacauguguuaa

SEQ ID NO: 879136 - RNA, 22 nt, Human
ccugucaggguuugccucagaa

SEQ ID NO: 879137 - RNA, 22 nt, Human
cauaacuagagugaaauguuga

SEQ ID NO: 879138 - RNA, 22 nt, Human
augcugaagaguucaugauuau

SEQ ID NO: 879139 - RNA, 22 nt, Human
gauguauauaccugguguggaa

SEQ ID NO: 879140 - RNA, 22 nt, Human
augauauuuuaguaaagugaua

SEQ ID NO: 879141 - RNA, 22 nt, Human
ucauaauguaguucauggcugg

SEQ ID NO: 879142 - RNA, 22 nt, Human
cuuaggaaugucccuucccaca

SEQ ID NO: 879143 - RNA, 22 nt, Human
uagcagcaccuuucuaaucuga

SEQ ID NO: 879144 - RNA, 20 nt, Human
gcagggcaagggauaugaaa

SEQ ID NO: 879145 - RNA, 22 nt, Human
cuauauauaucaucuuccaguu

SEQ ID NO: 879146 - RNA, 22 nt, Human
aucagaaaucuaggauucagaa

SEQ ID NO: 879147 - RNA, 22 nt, Human
uacaagaagaggcagagcugga

SEQ ID NO: 879148 - RNA, 22 nt, Human
gagcucagagccuauaguuggu

SEQ ID NO: 879149 - RNA, 22 nt, Human
ucacaguugauugaaacacagc

SEQ ID NO: 879150 - RNA, 22 nt, Human
uagcagggauacaaggucgccu

SEQ ID NO: 879151 - RNA, 22 nt, Human
ucugauuagagcauucuugagu

SEQ ID NO: 879152 - RNA, 22 nt, Human
aaagauguuaugaaauaacuau

SEQ ID NO: 879153 - RNA, 22 nt, Human
aucuuaaacagaggaaugacuu

SEQ ID NO: 879154 - RNA, 18 nt, Human
ggagagugacagagucgu

SEQ ID NO: 879155 - RNA, 22 nt, Human
caaggccagagccagcgauaag

SEQ ID NO: 879156 - RNA, 22 nt, Human
aacacugaguaucagaguuggg

SEQ ID NO: 879157 - RNA, 22 nt, Human
gcaaagcaagauucagauguag

SEQ ID NO: 879158 - RNA, 22 nt, Human
cagcugccccauaaaucacagu

SEQ ID NO: 879159 - RNA, 22 nt, Human
auucuucugccuacuuucaucc

SEQ ID NO: 879160 - RNA, 22 nt, Human
cagggcuuugaacaggcaucaa

SEQ ID NO: 879161 - RNA, 22 nt, Human
ugucaccacuggcugaaacacc

SEQ ID NO: 879162 - RNA, 18 nt, Human
aaaauguucccccauuaa

SEQ ID NO: 879163 - RNA, 22 nt, Human
agggauguuaguugugagcuca

SEQ ID NO: 879164 - RNA, 22 nt, Human
auugaagaucagggaaagauuc

SEQ ID NO: 879165 - RNA, 22 nt, Human
gauauuuucgcagggagaauuc

SEQ ID NO: 879166 - RNA, 22 nt, Human
gucuucugccuccauuagaguu

SEQ ID NO: 879167 - RNA, 22 nt, Human
gccuagggguaagaguacuggc

SEQ ID NO: 879168 - RNA, 22 nt, Human
gcccaaagucacucagcuagga

SEQ ID NO: 879169 - RNA, 22 nt, Human
gcccagcaggggauggcagcuc

SEQ ID NO: 879170 - RNA, 20 nt, Human
cuggguggcaagcaaggggg

SEQ ID NO: 879171 - RNA, 22 nt, Human
auacacagcgaugagaggaggc

SEQ ID NO: 879172 - RNA, 22 nt, Human
cucucagggacccagccagccu

SEQ ID NO: 879173 - RNA, 22 nt, Human
ccagcucagggucacauggcac

SEQ ID NO: 879174 - RNA, 22 nt, Human
auucucucuagaagcugagaug

SEQ ID NO: 879175 - RNA, 22 nt, Human
ugaaggcacuugccuaggggca

SEQ ID NO: 879176 - RNA, 22 nt, Human
gacaccagagacugaugaggcc

SEQ ID NO: 879177 - RNA, 22 nt, Human
ucugaggagugacccucuugca

SEQ ID NO: 879178 - RNA, 22 nt, Human
gccucagggauaggaugagcau

SEQ ID NO: 879179 - RNA, 18 nt, Human
gggaagccgggaagccgg

SEQ ID NO: 879180 - RNA, 22 nt, Human
cugcucuagagagcauuaguca

SEQ ID NO: 879181 - RNA, 22 nt, Human
aaggccagaguacuagaggcug

SEQ ID NO: 879182 - RNA, 22 nt, Human
aauaaugucugcuauuuuaaaa

SEQ ID NO: 879183 - RNA, 21 nt, Human
uugcacagaaaaccauagaga

SEQ ID NO: 879184 - RNA, 22 nt, Human
acaggcuggaggaggaccaaga

SEQ ID NO: 879185 - RNA, 22 nt, Human
caucugcucugucugccauguu

SEQ ID NO: 879186 - RNA, 17 nt, Human
uuguuucuucucugugg

SEQ ID NO: 879187 - RNA, 22 nt, Human
caaauguuagugcccaucccuc

SEQ ID NO: 879188 - RNA, 22 nt, Human
aguauuuggugugguauugacc

SEQ ID NO: 879189 - RNA, 22 nt, Human
uggcagcuauuacaaggaaguc

SEQ ID NO: 879190 - RNA, 22 nt, Human
gcagguggagcaguagucuggu

SEQ ID NO: 879191 - RNA, 22 nt, Human
cuacauacuguguguaaagaau

SEQ ID NO: 879192 - RNA, 22 nt, Human
uggcaacaccuggaagacaugg

SEQ ID NO: 879193 - RNA, 22 nt, Human
uuucauguacugucgaaguuga

SEQ ID NO: 879194 - RNA, 21 nt, Human
ggacaguaguagucaggagag

SEQ ID NO: 879195 - RNA, 22 nt, Human
agcagcugucccuuaacaucag

SEQ ID NO: 879196 - RNA, 22 nt, Human
cugcagguuaggagcacuccuu

SEQ ID NO: 879197 - RNA, 22 nt, Human
uggcagcuggcucugcgcaggc

SEQ ID NO: 879198 - RNA, 22 nt, Human
cucauggcagagucaccugucc

SEQ ID NO: 879199 - RNA, 22 nt, Human
ccuguauggcuauuccuuggac

SEQ ID NO: 879200 - RNA, 22 nt, Human
aauauagaaucacuuuccuuca

SEQ ID NO: 879201 - RNA, 22 nt, Human
uuacuuaaaaauucuaagcccc

SEQ ID NO: 879202 - RNA, 22 nt, Human
caggcaagauuagagaugagca

SEQ ID NO: 879203 - RNA, 22 nt, Human
uccagagccugcgcacuggcug

SEQ ID NO: 879204 - RNA, 22 nt, Human
uguccuguccuuccuggaaguc

SEQ ID NO: 879205 - RNA, 22 nt, Human
uuagaaucuuuagagucucacu

SEQ ID NO: 879206 - RNA, 22 nt, Human
uugcagcauauugaucuccugu

SEQ ID NO: 879207 - RNA, 22 nt, Human
ggcagaccucuccagccccaca

SEQ ID NO: 879208 - RNA, 22 nt, Human
ugguauaugcauggagguauca

SEQ ID NO: 879209 - RNA, 22 nt, Human
cagggccuccccggcagucuuu

SEQ ID NO: 879210 - RNA, 22 nt, Human
uaaucuuagcaaccuccagugu

SEQ ID NO: 879211 - RNA, 22 nt, Human
uggauaaauagauacacuugca

SEQ ID NO: 879212 - RNA, 22 nt, Human
gauugcccagaauauucucauu

SEQ ID NO: 879213 - RNA, 22 nt, Human
cucucucuaugcguuguuccua

SEQ ID NO: 879214 - RNA, 17 nt, Human
gcugagaggcagcacag

SEQ ID NO: 879215 - RNA, 22 nt, Human
ucagcaggucugaggcggggcc

SEQ ID NO: 879216 - RNA, 22 nt, Human
ucucuccuguguucugauguuu

SEQ ID NO: 879217 - RNA, 22 nt, Human
cacucacuuauuucuaacagaa

SEQ ID NO: 879218 - RNA, 22 nt, Human
ugccugcugcuaagcucuuugu

SEQ ID NO: 879219 - RNA, 22 nt, Human
gggaugagagcugggacagaag

SEQ ID NO: 879220 - RNA, 19 nt, Human
cucuuuggagauccuugga

SEQ ID NO: 879221 - RNA, 20 nt, Human
cugcaagcagguuauuccag

SEQ ID NO: 879222 - RNA, 22 nt, Human
agcuacuucccuguaggaaaca

SEQ ID NO: 879223 - RNA, 22 nt, Human
gagccagccgcaagagcuguga

SEQ ID NO: 879224 - RNA, 22 nt, Human
caacauuugaguaaagaaaugg

SEQ ID NO: 879225 - RNA, 22 nt, Human
auggcugggaugggguagagaa

SEQ ID NO: 879226 - RNA, 18 nt, Human
gcccagaggucugggccc

SEQ ID NO: 879227 - RNA, 23 nt, Human
cuggggcuuucaaaucugggcag

SEQ ID NO: 879228 - RNA, 22 nt, Human
ucuaggaaauuguuacuauauu

SEQ ID NO: 879229 - RNA, 22 nt, Human
aagaaaaucaguucuggucagu

SEQ ID NO: 879230 - RNA, 22 nt, Human
augcaggggcuguguuuugggu

SEQ ID NO: 879231 - RNA, 22 nt, Human
caggcaccuuugugcaugggca

SEQ ID NO: 879232 - RNA, 21 nt, Human
uauugcauaccaugaaucuga

SEQ ID NO: 879233 - RNA, 22 nt, Human
uccuccuccucacagucaccug

SEQ ID NO: 879234 - RNA, 23 nt, Human
cuucuagagucagcuccaaguuu

SEQ ID NO: 879235 - RNA, 22 nt, Human
uaguguuuucuagaaugguuuu

SEQ ID NO: 879236 - RNA, 22 nt, Human
uccagccaacugccuagggagc

SEQ ID NO: 879237 - RNA, 20 nt, Human
uacuucugaggcacucugaa

SEQ ID NO: 879238 - RNA, 22 nt, Human
aaugucuacaccguauguuguu

SEQ ID NO: 879239 - RNA, 22 nt, Human
agacauauauugcaauucacug

SEQ ID NO: 879240 - RNA, 19 nt, Human
auagaaaggguuaaagaca

SEQ ID NO: 879241 - RNA, 22 nt, Human
aucuuauugcuguugccagaua

SEQ ID NO: 879242 - RNA, 22 nt, Human
ccugcuggacguggaggagggg

SEQ ID NO: 879243 - RNA, 22 nt, Human
uuuaauuguuguggguacauag

SEQ ID NO: 879244 - RNA, 22 nt, Human
uaguuaaugcuaauuaacaaau

SEQ ID NO: 879245 - RNA, 22 nt, Human
ugcaagaaacauauuccacaag

SEQ ID NO: 879246 - RNA, 22 nt, Human
agggcaucagguauuuuaugcu

SEQ ID NO: 879247 - RNA, 21 nt, Human
aaguuuggaagaaagcaaggg

SEQ ID NO: 879248 - RNA, 22 nt, Human
aaggccagacucuggaaugaca

SEQ ID NO: 879249 - RNA, 22 nt, Human
cugagacaugguuugacuggca

SEQ ID NO: 879250 - RNA, 22 nt, Human
caaguucuacugggacaucagu

SEQ ID NO: 879251 - RNA, 22 nt, Human
ucugccuggcggacucccggaa

SEQ ID NO: 879252 - RNA, 22 nt, Human
augcucuauaaauaugacaugu

SEQ ID NO: 879253 - RNA, 22 nt, Human
gugcugagaacaaaaguggaca

SEQ ID NO: 879254 - RNA, 22 nt, Human
ccuugagaggaaguuuguagaa

SEQ ID NO: 879255 - RNA, 22 nt, Human
ucugggaauuuauuggcacuuu

SEQ ID NO: 879256 - RNA, 22 nt, Human
ccuaggcccuaggcuuccauca

SEQ ID NO: 879257 - RNA, 22 nt, Human
caucuucagugauuaccuaaaa

SEQ ID NO: 879258 - RNA, 22 nt, Human
aauauccauugggagcaaaugg

SEQ ID NO: 879259 - RNA, 22 nt, Human
agguccaggauuuguggggucu

SEQ ID NO: 879260 - RNA, 22 nt, Human
uccaaauauucggucuuucuga

SEQ ID NO: 879261 - RNA, 22 nt, Human
ugcuggggcagaagagccaaga

SEQ ID NO: 879262 - RNA, 22 nt, Human
ucuucaaaauauuccauccauu

SEQ ID NO: 879263 - RNA, 22 nt, Human
ggaguggcagcgaggaucagau

SEQ ID NO: 879264 - RNA, 22 nt, Human
accugggaggcagagguugcag

SEQ ID NO: 879265 - RNA, 22 nt, Human
gacaaaggaucagagguuggga

SEQ ID NO: 879266 - RNA, 22 nt, Human
gggcaaaggcagaaagcggugu

SEQ ID NO: 879267 - RNA, 22 nt, Human
caggacgggcaaacaggauggu

SEQ ID NO: 879268 - RNA, 22 nt, Human
uucaagguucagggagaaauug

SEQ ID NO: 879269 - RNA, 22 nt, Human
uagcagaagaacaacaugaucu

SEQ ID NO: 879270 - RNA, 22 nt, Human
ugucuucagauaggcauucuuc

SEQ ID NO: 879271 - RNA, 22 nt, Human
ucauggaugggcccagcucugu

SEQ ID NO: 879272 - RNA, 22 nt, Human
gacuccucccgcucccaugccg

SEQ ID NO: 879273 - RNA, 22 nt, Human
augcuacaacauuaucuggggu

SEQ ID NO: 879274 - RNA, 17 nt, Human
ggauugcauauacagug

SEQ ID NO: 879275 - RNA, 22 nt, Human
aguuugaagaaggugagaugca

SEQ ID NO: 879276 - RNA, 22 nt, Human
ccuuuggagaguuuguuagggg

SEQ ID NO: 879277 - RNA, 22 nt, Human
ggaggaugagcuacgaggagcu

SEQ ID NO: 879278 - RNA, 22 nt, Human
aaucaacauuguuuuaagucaa

SEQ ID NO: 879279 - RNA, 22 nt, Human
cagcuuccaucuccacugcccu

SEQ ID NO: 879280 - RNA, 22 nt, Human
gccagagccggcuucacaggau

SEQ ID NO: 879281 - RNA, 22 nt, Human
aaggaggcccucuccuucugga

SEQ ID NO: 879282 - RNA, 22 nt, Human
uccugaggaugguugaagugca

SEQ ID NO: 879283 - RNA, 22 nt, Human
cugccugcugauuaguauuguc

SEQ ID NO: 879284 - RNA, 23 nt, Human
agcccagcagagaaccuaggucc

SEQ ID NO: 879285 - RNA, 18 nt, Human
guuuugaauugucuuaca

SEQ ID NO: 879286 - RNA, 22 nt, Human
agcuccugggcaccucuuucac

SEQ ID NO: 879287 - RNA, 19 nt, Human
caaaguaccuggcacagug

SEQ ID NO: 879288 - RNA, 22 nt, Human
agauuuccuaugguaauuauag

SEQ ID NO: 879289 - RNA, 22 nt, Human
ugcauuaagggccuggagauac

SEQ ID NO: 879290 - RNA, 22 nt, Human
aaggcuggagaugguuggaaug

SEQ ID NO: 879291 - RNA, 22 nt, Human
ggagggggaauucagccccagc

SEQ ID NO: 879292 - RNA, 18 nt, Human
cugagggcaacagaggcu

SEQ ID NO: 879293 - RNA, 22 nt, Human
ugaguaauucacaaaacagaug

SEQ ID NO: 879294 - RNA, 22 nt, Human
agucuggaauuuggccugagca

SEQ ID NO: 879295 - RNA, 22 nt, Human
uguguauacauacauacacacg

SEQ ID NO: 879296 - RNA, 22 nt, Human
ugcacagauagugauagauagc

SEQ ID NO: 879297 - RNA, 22 nt, Human
agagcuuuguuugauugucaga

SEQ ID NO: 879298 - RNA, 17 nt, Human
ugucuuaucuguccugu

SEQ ID NO: 879299 - RNA, 22 nt, Human
ugggugugcccagauggugucc

SEQ ID NO: 879300 - RNA, 22 nt, Human
cuggaggcaguugccccaguca

SEQ ID NO: 879301 - RNA, 22 nt, Human
uaaauucagugaguaauuucug

SEQ ID NO: 879302 - RNA, 22 nt, Human
auuaggcauucugaaugagguc

SEQ ID NO: 879303 - RNA, 22 nt, Human
uuaguuaauaggucuucagcuu

SEQ ID NO: 879304 - RNA, 22 nt, Human
ccacaguuucuucaucuauaaa

SEQ ID NO: 879305 - RNA, 22 nt, Human
uuucauugccuuuggaaggucu

SEQ ID NO: 879306 - RNA, 23 nt, Human
ugacaagucucagccaaugcaga

SEQ ID NO: 879307 - RNA, 22 nt, Human
ugaucaaagugcuggaauuaca

SEQ ID NO: 879308 - RNA, 22 nt, Human
cugggccacagacucaaggcag

SEQ ID NO: 879309 - RNA, 22 nt, Human
caggaagcugugaaggagacgg

SEQ ID NO: 879310 - RNA, 22 nt, Human
caccugccucauuugucccugc

SEQ ID NO: 879311 - RNA, 22 nt, Human
ggggaaggauugaguugaccca

SEQ ID NO: 879312 - RNA, 22 nt, Human
aaauacaaaaauuagccaggca

SEQ ID NO: 879313 - RNA, 22 nt, Human
accaggccaacagcuaaguuaa

SEQ ID NO: 879314 - RNA, 22 nt, Human
uggcugagggcacuaugaagcc

SEQ ID NO: 879315 - RNA, 22 nt, Human
guuaauacaaccaugaucuucu

SEQ ID NO: 879316 - RNA, 22 nt, Human
uagcugaagggcauuuaauaaa

SEQ ID NO: 879317 - RNA, 22 nt, Human
uaacacuggcuuuugcugaggc

SEQ ID NO: 879318 - RNA, 19 nt, Human
ggaaggagagaaaugcaug

SEQ ID NO: 879319 - RNA, 22 nt, Human
uuuaaauuauaguuaaugucug

SEQ ID NO: 879320 - RNA, 22 nt, Human
guuaucuucuauuucucauacu

SEQ ID NO: 879321 - RNA, 21 nt, Human
guucccuuauuggggcaggca

SEQ ID NO: 879322 - RNA, 22 nt, Human
uagcuguguaugguuuacaaau

SEQ ID NO: 879323 - RNA, 22 nt, Human
ugcagcucgggcuuaggguggg

SEQ ID NO: 879324 - RNA, 22 nt, Human
ugcgucuggaguggaguuugaa

SEQ ID NO: 879325 - RNA, 22 nt, Human
agcccaggagguggagguugca

SEQ ID NO: 879326 - RNA, 23 nt, Human
ugguggcuugugguggccaccag

SEQ ID NO: 879327 - RNA, 22 nt, Human
uuucuuaugagcaagacucuau

SEQ ID NO: 879328 - RNA, 22 nt, Human
cacaaggcugggacaagugcug

SEQ ID NO: 879329 - RNA, 22 nt, Human
aagaguuuuagacaaacugauu

SEQ ID NO: 879330 - RNA, 22 nt, Human
uuuagcagaaacucauuaaauu

SEQ ID NO: 879331 - RNA, 19 nt, Human
ccucugugggagucaguga

SEQ ID NO: 879332 - RNA, 22 nt, Human
uagaaugagaaaguguagcagg

SEQ ID NO: 879333 - RNA, 22 nt, Human
uccuggagauaauugcagugaa

SEQ ID NO: 879334 - RNA, 22 nt, Human
ugaggccacaggaaagggcccg

SEQ ID NO: 879335 - RNA, 22 nt, Human
cuuccuugcugucugcuccagg

SEQ ID NO: 879336 - RNA, 22 nt, Human
aaaugcaugguaaaugauugcc

SEQ ID NO: 879337 - RNA, 22 nt, Human
cagauuuaagauauuuguauug

SEQ ID NO: 879338 - RNA, 22 nt, Human
uagaaaagaauuuuauuugaua

SEQ ID NO: 879339 - RNA, 22 nt, Human
agcaggcuaaucuugcugaaca

SEQ ID NO: 879340 - RNA, 22 nt, Human
agccagcuggugggucagcugg

SEQ ID NO: 879341 - RNA, 23 nt, Human
gcuaaauugaagucucaggggaa

SEQ ID NO: 879342 - RNA, 22 nt, Human
cauaacuuuaaagacagugugg

SEQ ID NO: 879343 - RNA, 22 nt, Human
cugcuguguggauucaauggcu

SEQ ID NO: 879344 - RNA, 22 nt, Human
cugauuccugauucaugcucuu

SEQ ID NO: 879345 - RNA, 22 nt, Human
uuaaggcauucuccuacuaaua

SEQ ID NO: 879346 - RNA, 22 nt, Human
cagaguccuggacacagagaca

SEQ ID NO: 879347 - RNA, 22 nt, Human
aaguaugcaaaucgucuuagaa

SEQ ID NO: 879348 - RNA, 22 nt, Human
auucaaacuguguuaggcagca

SEQ ID NO: 879349 - RNA, 22 nt, Human
gcauucauucauucauuaggua

SEQ ID NO: 879350 - RNA, 22 nt, Human
cugugggcuccugcagcucagg

SEQ ID NO: 879351 - RNA, 22 nt, Human
cucucagauggagugugaaugg

SEQ ID NO: 879352 - RNA, 22 nt, Human
aggcucagugcaaaucauucug

SEQ ID NO: 879353 - RNA, 22 nt, Human
ucagaaguugaaggcucuuuuu

SEQ ID NO: 879354 - RNA, 22 nt, Human
gcuacauaguaacccacaaauc

SEQ ID NO: 879355 - RNA, 17 nt, Human
uacuagaauagagacag

SEQ ID NO: 879356 - RNA, 22 nt, Human
uauaaaugcacuuuugaaauau

SEQ ID NO: 879357 - RNA, 22 nt, Human
aucuuugaucuuuauugcuaag

SEQ ID NO: 879358 - RNA, 22 nt, Human
guccagugacaaguagcuggcc

SEQ ID NO: 879359 - RNA, 22 nt, Human
aacuacaguauguccaaagaau

SEQ ID NO: 879360 - RNA, 22 nt, Human
ucauagaaguaguauccacauu

SEQ ID NO: 879361 - RNA, 22 nt, Human
uguaauguuagaaacaauugcu

SEQ ID NO: 879362 - RNA, 22 nt, Human
ucaaguauuuauuucugcuggc

SEQ ID NO: 879363 - RNA, 22 nt, Human
cagaggcugacccugcuguugu

SEQ ID NO: 879364 - RNA, 22 nt, Human
uugugccuuugcuuuuacaagu

SEQ ID NO: 879365 - RNA, 22 nt, Human
ucaggcugaaggaggccuaucu

SEQ ID NO: 879366 - RNA, 22 nt, Human
aucuccuuggucucguuccagg

SEQ ID NO: 879367 - RNA, 22 nt, Human
aacauuucuucugaaacugagu

SEQ ID NO: 879368 - RNA, 22 nt, Human
uaacagaauagcagaaacagaa

SEQ ID NO: 879369 - RNA, 22 nt, Human
ggaaugagcucggagcagaagg

SEQ ID NO: 879370 - RNA, 22 nt, Human
ugggagcaagcuacuuagggaa

SEQ ID NO: 879371 - RNA, 22 nt, Human
cuccaggcccacggccgcggcc

SEQ ID NO: 879372 - RNA, 21 nt, Human
agauucaggacagcagucacu

SEQ ID NO: 879373 - RNA, 23 nt, Human
uugcuuucaucaugagaugcucc

SEQ ID NO: 879374 - RNA, 22 nt, Human
acacagagggcagaagauacau

SEQ ID NO: 879375 - RNA, 22 nt, Human
gauaaaauaacuauggaauacu

SEQ ID NO: 879376 - RNA, 22 nt, Human
cuggggugucucgucugccauu

SEQ ID NO: 879377 - RNA, 22 nt, Human
ugcuaauaaacuccaggcugag

SEQ ID NO: 879378 - RNA, 22 nt, Human
ccugugccagccccuucugcug

SEQ ID NO: 879379 - RNA, 22 nt, Human
acuggacuccccaagggccagg

SEQ ID NO: 879380 - RNA, 22 nt, Human
cuaaacuucuuggcaauuuuau

SEQ ID NO: 879381 - RNA, 22 nt, Human
aucuguagaagauacucugaga

SEQ ID NO: 879382 - RNA, 22 nt, Human
uccuggggcucaugggauuugu

SEQ ID NO: 879383 - RNA, 20 nt, Human
uuauuuccaguccagguccu

SEQ ID NO: 879384 - RNA, 19 nt, Human
acugggaaaaaggcacugg

SEQ ID NO: 879385 - RNA, 22 nt, Human
ggaguccaugcagcuugagaca

SEQ ID NO: 879386 - RNA, 22 nt, Human
aaauaaucaauuuuuguagaua

SEQ ID NO: 879387 - RNA, 22 nt, Human
ugugggacagggacagcaagag

SEQ ID NO: 879388 - RNA, 22 nt, Human
aagugaguucagcauucacucg

SEQ ID NO: 879389 - RNA, 22 nt, Human
aagaugauagaucugucaaugu

SEQ ID NO: 879390 - RNA, 18 nt, Human
ccgggcuuuggugacaca

SEQ ID NO: 879391 - RNA, 22 nt, Human
auacacauauguguguauaugu

SEQ ID NO: 879392 - RNA, 22 nt, Human
acaaagugaauugcaucgaguu

SEQ ID NO: 879393 - RNA, 22 nt, Human
uugccacaguagcaaaagguuc

SEQ ID NO: 879394 - RNA, 22 nt, Human
uacaagaaugucuuaaaagcuc

SEQ ID NO: 879395 - RNA, 22 nt, Human
ucagagaggcaauacuguuuaa

SEQ ID NO: 879396 - RNA, 22 nt, Human
ggucagggggaucugugaggua

SEQ ID NO: 879397 - RNA, 22 nt, Human
uauacaaugaguacauucuggg

SEQ ID NO: 879398 - RNA, 22 nt, Human
ccaggagguggcaggacuugcc

SEQ ID NO: 879399 - RNA, 22 nt, Human
gucccagggaagaaggcagcac

SEQ ID NO: 879400 - RNA, 22 nt, Human
acuuucaugguaguuguauucu

SEQ ID NO: 879401 - RNA, 22 nt, Human
uccacagaauguaagauccaca

SEQ ID NO: 879402 - RNA, 20 nt, Human
uuuaagaaguuucugaggaa

SEQ ID NO: 879403 - RNA, 22 nt, Human
gcuggggccugaacagucagcu

SEQ ID NO: 879404 - RNA, 19 nt, Human
uugagaacaccaaguacug

SEQ ID NO: 879405 - RNA, 17 nt, Human
gccaggagguuugagcu

SEQ ID NO: 879406 - RNA, 22 nt, Human
uuuucucagcugcacuguauua

SEQ ID NO: 879407 - RNA, 22 nt, Human
aaagcaguauauugguaguugu

SEQ ID NO: 879408 - RNA, 22 nt, Human
cuaaggaaaggaaauacaguaa

SEQ ID NO: 879409 - RNA, 22 nt, Human
uguucugcaagcccugccaccu

SEQ ID NO: 879410 - RNA, 22 nt, Human
cuuuguucaugacaucugcuuc

SEQ ID NO: 879411 - RNA, 18 nt, Human
ucucuuuuccccucauug

SEQ ID NO: 879412 - RNA, 22 nt, Human
cuuuggaauauuuuauugagaa

SEQ ID NO: 879413 - RNA, 22 nt, Human
aaggcaguaggaucuuccacag

SEQ ID NO: 879414 - RNA, 20 nt, Human
cacaagaggaguucccugag

SEQ ID NO: 879415 - RNA, 22 nt, Human
agagcagacauccuugucuugu

SEQ ID NO: 879416 - RNA, 22 nt, Human
uauggcaauauguaucaagauc

SEQ ID NO: 879417 - RNA, 22 nt, Human
ugguuuuagaugccuuuacugc

SEQ ID NO: 879418 - RNA, 22 nt, Human
uacaagaaauuucugcauauau

SEQ ID NO: 879419 - RNA, 22 nt, Human
ggucuggagcuuggcuaaggga

SEQ ID NO: 879420 - RNA, 20 nt, Human
ucuucuguugccuuguucug

SEQ ID NO: 879421 - RNA, 22 nt, Human
agacauuuugauaccccuaccg

SEQ ID NO: 879422 - RNA, 22 nt, Human
ggcccagcccgagucagccuuc

SEQ ID NO: 879423 - RNA, 22 nt, Human
uggcuucagagacagaaucuau

SEQ ID NO: 879424 - RNA, 22 nt, Human
uguaaacuguagaaaauacuuu

SEQ ID NO: 879425 - RNA, 22 nt, Human
gcucugggaaggaucguaguga

SEQ ID NO: 879426 - RNA, 22 nt, Human
ccugggagcuguggaaaggcug

SEQ ID NO: 879427 - RNA, 22 nt, Human
uaugcacacauuagcacagggu

SEQ ID NO: 879428 - RNA, 22 nt, Human
ggucagccccugcucaaggccg

SEQ ID NO: 879429 - RNA, 22 nt, Human
aggcugugcgaggucucagagu

SEQ ID NO: 879430 - RNA, 22 nt, Human
agacaugccaagaaacccagug

SEQ ID NO: 879431 - RNA, 22 nt, Human
aauguggggaagccauggcuga

SEQ ID NO: 879432 - RNA, 22 nt, Human
auaacagaauaagucauuaccg

SEQ ID NO: 879433 - RNA, 22 nt, Human
uucuguguggguagcuccuguu

SEQ ID NO: 879434 - RNA, 22 nt, Human
uguagaaagaauauguuucaua

SEQ ID NO: 879435 - RNA, 22 nt, Human
uuuuauacacaugaacaugcag

SEQ ID NO: 879436 - RNA, 19 nt, Human
acacugguuguucaagggc

SEQ ID NO: 879437 - RNA, 22 nt, Human
gggagcuggaugauugaggcaa

SEQ ID NO: 879438 - RNA, 22 nt, Human
uccuuggccuaaggagaagagg

SEQ ID NO: 879439 - RNA, 22 nt, Human
agagccugaggaugucccagcu

SEQ ID NO: 879440 - RNA, 22 nt, Human
uaaagcuacacauuauuaaucc

SEQ ID NO: 879441 - RNA, 22 nt, Human
uaaagugaaggucauaaugauu

SEQ ID NO: 879442 - RNA, 22 nt, Human
uggucuuugagagaaguugauu

SEQ ID NO: 879443 - RNA, 22 nt, Human
cauguacacucauguaacuaua

SEQ ID NO: 879444 - RNA, 22 nt, Human
cugucuccuccacugcauggga

SEQ ID NO: 879445 - RNA, 22 nt, Human
ugggccaguuggaauggauacu

SEQ ID NO: 879446 - RNA, 22 nt, Human
ccugggcuucugucuagauguu

SEQ ID NO: 879447 - RNA, 22 nt, Human
accaggagaggcacuugcaaug

SEQ ID NO: 879448 - RNA, 22 nt, Human
gcacugggaaugugagcagcug

SEQ ID NO: 879449 - RNA, 22 nt, Human
ggaggagacggagugauuagug

SEQ ID NO: 879450 - RNA, 21 nt, Human
cacagagauauuggugagccu

SEQ ID NO: 879451 - RNA, 22 nt, Human
aaagagaaacuuagaagccuga

SEQ ID NO: 879452 - RNA, 22 nt, Human
ugcaguggugguaaagaugcuc

SEQ ID NO: 879453 - RNA, 22 nt, Human
cagacugagggcaucacauacg

SEQ ID NO: 879454 - RNA, 22 nt, Human
uacauacaguggaugcuuuagg

SEQ ID NO: 879455 - RNA, 22 nt, Human
agguguguauaaacauacauau

SEQ ID NO: 879456 - RNA, 22 nt, Human
aaauagauuucucuggguuugu

SEQ ID NO: 879457 - RNA, 18 nt, Human
uggagcagguaggcauga

SEQ ID NO: 879458 - RNA, 19 nt, Human
ggcugccuccugggagauu

SEQ ID NO: 879459 - RNA, 22 nt, Human
ucccaggaagaucccagggacc

SEQ ID NO: 879460 - RNA, 22 nt, Human
gugauucugcacgucauuccug

SEQ ID NO: 879461 - RNA, 22 nt, Human
uagaaauggguuacauuuagag

SEQ ID NO: 879462 - RNA, 22 nt, Human
uauugaaauccauuacguucuu

SEQ ID NO: 879463 - RNA, 22 nt, Human
acacaaaguuggaugacaaaau

SEQ ID NO: 879464 - RNA, 22 nt, Human
uuuuagaaguucaugugggauu

SEQ ID NO: 879465 - RNA, 22 nt, Human
acauacaaauagagcuguagua

SEQ ID NO: 879466 - RNA, 22 nt, Human
agccaggcagacucucuuucuu

SEQ ID NO: 879467 - RNA, 22 nt, Human
uuuaucugaggaaagcagacaa

SEQ ID NO: 879468 - RNA, 22 nt, Human
agcagcuguggaaaaguaacua

SEQ ID NO: 879469 - RNA, 20 nt, Human
ugggcagcacugcuggcugg

SEQ ID NO: 879470 - RNA, 20 nt, Human
uccuccaaccagcugcuaau

SEQ ID NO: 879471 - RNA, 22 nt, Human
ugcauuugucuugucucaugaa

SEQ ID NO: 879472 - RNA, 22 nt, Human
uacaucugucuggcuuuccauu

SEQ ID NO: 879473 - RNA, 22 nt, Human
aucuuuggaaagccaagcacag

SEQ ID NO: 879474 - RNA, 22 nt, Human
uccaggcuucacgucugcccuc

SEQ ID NO: 879475 - RNA, 22 nt, Human
ccugagcuccaguagcagccag

SEQ ID NO: 879476 - RNA, 22 nt, Human
ggaaggugcucccuggacagag

SEQ ID NO: 879477 - RNA, 22 nt, Human
aggagggagcacuauaugggga

SEQ ID NO: 879478 - RNA, 22 nt, Human
aucuagcaccaaacuagcuuuu

SEQ ID NO: 879479 - RNA, 22 nt, Human
cauacauauguggaugucauau

SEQ ID NO: 879480 - RNA, 22 nt, Human
ucucccacagucucccauggcu

SEQ ID NO: 879481 - RNA, 22 nt, Human
agaaggcuuaaaacauggaaua

SEQ ID NO: 879482 - RNA, 22 nt, Human
acuucacagauauuuauuuggu

SEQ ID NO: 879483 - RNA, 22 nt, Human
cucuggcuccauuucccuaugu

SEQ ID NO: 879484 - RNA, 22 nt, Human
gcucugugaaggguguugcuca

SEQ ID NO: 879485 - RNA, 22 nt, Human
gcagauggcucagacacugggg

SEQ ID NO: 879486 - RNA, 22 nt, Human
gagcauaggacacagaggugug

SEQ ID NO: 879487 - RNA, 22 nt, Human
ucaugcuuugguugcuguccuu

SEQ ID NO: 879488 - RNA, 22 nt, Human
aaaugguauaaugucauguauu

SEQ ID NO: 879489 - RNA, 22 nt, Human
augggaggcaaagaucgcagaa

SEQ ID NO: 879490 - RNA, 22 nt, Human
ugagcucuaagauccccucaag

SEQ ID NO: 879491 - RNA, 22 nt, Human
cagugguauuugagagaaugga

SEQ ID NO: 879492 - RNA, 21 nt, Human
cagugaggcccuccuguuccc

SEQ ID NO: 879493 - RNA, 22 nt, Human
uuuguuaauucuuauguuagag

SEQ ID NO: 879494 - RNA, 22 nt, Human
aagugcuaggauuacaggugug

SEQ ID NO: 879495 - RNA, 22 nt, Human
ugucauuuucagcuuaugcuuc

SEQ ID NO: 879496 - RNA, 22 nt, Human
augcauucagcggaaugcuuag

SEQ ID NO: 879497 - RNA, 22 nt, Human
uaacaaguucugacagcauugu

SEQ ID NO: 879498 - RNA, 22 nt, Human
gcugggagcccuggucugcucc

SEQ ID NO: 879499 - RNA, 22 nt, Human
gaaggccacggaauggagcugg

SEQ ID NO: 879500 - RNA, 22 nt, Human
agcugggaggcuccucugugac

SEQ ID NO: 879501 - RNA, 22 nt, Human
aggguggagggagucccugagc

SEQ ID NO: 879502 - RNA, 22 nt, Human
ggaggccaaggcagguggaucg

SEQ ID NO: 879503 - RNA, 22 nt, Human
guuuccagagugagggcacuug

SEQ ID NO: 879504 - RNA, 22 nt, Human
ucagugguuggaugauggucgc

SEQ ID NO: 879505 - RNA, 22 nt, Human
uacaugaacaaaauagcagaaa

SEQ ID NO: 879506 - RNA, 22 nt, Human
uauuuccagcaguaagaagaca

SEQ ID NO: 879507 - RNA, 22 nt, Human
cgugccuuggucccaaccccca

SEQ ID NO: 879508 - RNA, 22 nt, Human
ccagugagaaugaagauaaggc

SEQ ID NO: 879509 - RNA, 22 nt, Human
uguccuguuauauguuggguag

SEQ ID NO: 879510 - RNA, 22 nt, Human
uuggaaggaccaggccuugauu

SEQ ID NO: 879511 - RNA, 22 nt, Human
gggauuugugggauggccagug

SEQ ID NO: 879512 - RNA, 22 nt, Human
auucugucuuuuuaaaauaaua

SEQ ID NO: 879513 - RNA, 22 nt, Human
uugcauguccuacaucuguguc

SEQ ID NO: 879514 - RNA, 23 nt, Human
uuguuuuuagagguggcaugaga

SEQ ID NO: 879515 - RNA, 22 nt, Human
agcuggcuaugcccugugaacc

SEQ ID NO: 879516 - RNA, 22 nt, Human
ggcccugcgauuagguggcagg

SEQ ID NO: 879517 - RNA, 22 nt, Human
aggcagacugugcgggaagagu

SEQ ID NO: 879518 - RNA, 22 nt, Human
guccuauuagcauauugaauac

SEQ ID NO: 879519 - RNA, 22 nt, Human
ugcagcagcuccagguuacccu

SEQ ID NO: 879520 - RNA, 22 nt, Human
aaggugucacugggacaggaaa

SEQ ID NO: 879521 - RNA, 22 nt, Human
aggaaacuucagaguuuugguc

SEQ ID NO: 879522 - RNA, 22 nt, Human
aggcuggcugagcugcagccug

SEQ ID NO: 879523 - RNA, 22 nt, Human
gguauuuauaguggugcuuagu

SEQ ID NO: 879524 - RNA, 22 nt, Human
ggaacuuuuuaacaagcugcug

SEQ ID NO: 879525 - RNA, 18 nt, Human
gcuuccugaaagcugccc

SEQ ID NO: 879526 - RNA, 22 nt, Human
uauacagauaucuaagauguaa

SEQ ID NO: 879527 - RNA, 22 nt, Human
aggaaagaaaggaggugcauuu

SEQ ID NO: 879528 - RNA, 22 nt, Human
uuauuacacugaaagaauugcg

SEQ ID NO: 879529 - RNA, 22 nt, Human
ugucaucugauauuacuuauag

SEQ ID NO: 879530 - RNA, 22 nt, Human
cugccucagccuucugggugac

SEQ ID NO: 879531 - RNA, 22 nt, Human
auauuuuggcaaaugucuagau

SEQ ID NO: 879532 - RNA, 22 nt, Human
uauaauuuggggaaaguggugu

SEQ ID NO: 879533 - RNA, 22 nt, Human
uuaaagagucuacugcacaucc

SEQ ID NO: 879534 - RNA, 22 nt, Human
cucagugcuuaguguguuuugg

SEQ ID NO: 879535 - RNA, 22 nt, Human
acagugucuccugguacccagu

SEQ ID NO: 879536 - RNA, 22 nt, Human
uuuccuucucagggagcuucaa

SEQ ID NO: 879537 - RNA, 22 nt, Human
ugccugucucugacugccauua

SEQ ID NO: 879538 - RNA, 22 nt, Human
cucagaauuuagggcucugagg

SEQ ID NO: 879539 - RNA, 22 nt, Human
cuggaagagcauuugcauaggg

SEQ ID NO: 879540 - RNA, 22 nt, Human
uauuucacucaguauaccauag

SEQ ID NO: 879541 - RNA, 22 nt, Human
guggccagaggucccauguguc

SEQ ID NO: 879542 - RNA, 22 nt, Human
uccugcucugauggguucuccu

SEQ ID NO: 879543 - RNA, 22 nt, Human
aguggcaaagucuucagaaguu

SEQ ID NO: 879544 - RNA, 21 nt, Human
ccugggagaauuggguguggc

SEQ ID NO: 879545 - RNA, 22 nt, Human
aaaaaguauuggccaugguuga

SEQ ID NO: 879546 - RNA, 22 nt, Human
uagaaccucauaagaaucgaaa

SEQ ID NO: 879547 - RNA, 22 nt, Human
ccagcuccagcauagccaccau

SEQ ID NO: 879548 - RNA, 22 nt, Human
augcauuuguaaaauauaaucg

SEQ ID NO: 879549 - RNA, 17 nt, Human
acagggcagaaacagcu

SEQ ID NO: 879550 - RNA, 22 nt, Human
ugcuggccaagcagaggucaau

SEQ ID NO: 879551 - RNA, 22 nt, Human
gguauacaagagcaauuuaggg

SEQ ID NO: 879552 - RNA, 22 nt, Human
cucagugcuagaaguagauugc

SEQ ID NO: 879553 - RNA, 22 nt, Human
agucuugaaagcacauuagagu

SEQ ID NO: 879554 - RNA, 22 nt, Human
caucuuuggagaaacuuccguu

SEQ ID NO: 879555 - RNA, 22 nt, Human
agguggagugaaggaaaggcag

SEQ ID NO: 879556 - RNA, 22 nt, Human
augcaccugaacuccaucagcu

SEQ ID NO: 879557 - RNA, 22 nt, Human
acaagaauaaggauaagagauu

SEQ ID NO: 879558 - RNA, 22 nt, Human
cugagaauuacucugaugagua

SEQ ID NO: 879559 - RNA, 22 nt, Human
cagcagaacaguuaaagaaacc

SEQ ID NO: 879560 - RNA, 22 nt, Human
gagaaacaggaauugagucgcu

SEQ ID NO: 879561 - RNA, 19 nt, Human
ucuccaggugccccaaaca

SEQ ID NO: 879562 - RNA, 19 nt, Human
auguuugcuugaguaauaa

SEQ ID NO: 879563 - RNA, 22 nt, Human
agcccugucucucacuccaggu

SEQ ID NO: 879564 - RNA, 23 nt, Human
acugggaaguuuggagagacgca

SEQ ID NO: 879565 - RNA, 22 nt, Human
aucuguuguuuucucauauguu

SEQ ID NO: 879566 - RNA, 22 nt, Human
uacaguguauguauuuguaggu

SEQ ID NO: 879567 - RNA, 22 nt, Human
aaugaugaguucuaauagaccc

SEQ ID NO: 879568 - RNA, 22 nt, Human
uugaaauuuuaggccuugcaau

SEQ ID NO: 879569 - RNA, 22 nt, Human
gucuucuuguguugccugucuu

SEQ ID NO: 879570 - RNA, 22 nt, Human
uucccuccgaaccucagugcug

SEQ ID NO: 879571 - RNA, 22 nt, Human
gauuuguccacagagugaugaa

SEQ ID NO: 879572 - RNA, 21 nt, Human
gcagcagaggcuugacagaca

SEQ ID NO: 879573 - RNA, 18 nt, Human
uuucacaaccuccagagg

SEQ ID NO: 879574 - RNA, 22 nt, Human
agcuuuguggcuuugcaagacu

SEQ ID NO: 879575 - RNA, 19 nt, Human
ugccagcauuaggcugaag

SEQ ID NO: 879576 - RNA, 22 nt, Human
ugcuucagcagggaucgggggg

SEQ ID NO: 879577 - RNA, 22 nt, Human
gcccaagccgccuuccagagac

SEQ ID NO: 879578 - RNA, 22 nt, Human
auaaaaguucaagagaguacag

SEQ ID NO: 879579 - RNA, 20 nt, Human
cccugagaccagagagcagc

SEQ ID NO: 879580 - RNA, 22 nt, Human
gagaagaaaauuccgugaacac

SEQ ID NO: 879581 - RNA, 22 nt, Human
gaaacaauuuuuguugucuaag

SEQ ID NO: 879582 - RNA, 22 nt, Human
gagcugccugugugccaugaug

SEQ ID NO: 879583 - RNA, 22 nt, Human
acacagaugcuauuuagucucu

SEQ ID NO: 879584 - RNA, 22 nt, Human
uguuauuaaauaauucucucuu

SEQ ID NO: 879585 - RNA, 22 nt, Human
augcauaaagaaagcuaucugg

SEQ ID NO: 879586 - RNA, 22 nt, Human
ugagcuucaaaguuggaucuga

SEQ ID NO: 879587 - RNA, 22 nt, Human
aucgagggugaguacagcggac

SEQ ID NO: 879588 - RNA, 19 nt, Human
gcucaggcugugugugggg

SEQ ID NO: 879589 - RNA, 22 nt, Human
ccugagccugcagccgagcaga

SEQ ID NO: 879590 - RNA, 23 nt, Human
acugagccagggccugggucagc

SEQ ID NO: 879591 - RNA, 22 nt, Human
ucccaggauguuggcggcaggu

SEQ ID NO: 879592 - RNA, 22 nt, Human
agcugucuuucauuaccucauu

SEQ ID NO: 879593 - RNA, 22 nt, Human
aaugagauggaauucccgccua

SEQ ID NO: 879594 - RNA, 22 nt, Human
auacuucaugcuucaugucugu

SEQ ID NO: 879595 - RNA, 23 nt, Human
uugcuugagcccaggaaguggag

SEQ ID NO: 879596 - RNA, 22 nt, Human
ucuuaagcagagaagaaguuga

SEQ ID NO: 879597 - RNA, 22 nt, Human
guaauaaugguccccaaacacu

SEQ ID NO: 879598 - RNA, 22 nt, Human
uagacauuuucucaacaucucu

SEQ ID NO: 879599 - RNA, 22 nt, Human
gugcucuggcuggucucccggu

SEQ ID NO: 879600 - RNA, 22 nt, Human
agggcugacaaauggcagugac

SEQ ID NO: 879601 - RNA, 22 nt, Human
auagugaaaaugcugucagcau

SEQ ID NO: 879602 - RNA, 22 nt, Human
cagcugaggaauacuagaugua

SEQ ID NO: 879603 - RNA, 22 nt, Human
ccucagaagcucaaggacauug

SEQ ID NO: 879604 - RNA, 22 nt, Human
gcugaaaugccuuguaaauauu

SEQ ID NO: 879605 - RNA, 22 nt, Human
aaucugucccuuaacuagucau

SEQ ID NO: 879606 - RNA, 22 nt, Human
uuagagcugggauggauuuucc

SEQ ID NO: 879607 - RNA, 22 nt, Human
uccaggccuaggccaagugauu

SEQ ID NO: 879608 - RNA, 22 nt, Human
ucugaagauucuuuccacuauu

SEQ ID NO: 879609 - RNA, 22 nt, Human
gagcccugcccacuugucugag

SEQ ID NO: 879610 - RNA, 22 nt, Human
uuuaucaaacaaauuauccagc

SEQ ID NO: 879611 - RNA, 22 nt, Human
gaauucugucgcuuacuagaug

SEQ ID NO: 879612 - RNA, 22 nt, Human
ggaccugccagaacucaggcua

SEQ ID NO: 879613 - RNA, 22 nt, Human
ucccacugugccuguuguaauc

SEQ ID NO: 879614 - RNA, 22 nt, Human
aggaaaagugugaaguauggag

SEQ ID NO: 879615 - RNA, 22 nt, Human
acagagcuuaggaugacuccca

SEQ ID NO: 879616 - RNA, 22 nt, Human
auuucucuuccuccuaggguug

SEQ ID NO: 879617 - RNA, 22 nt, Human
aauuucaaugcacucaugguug

SEQ ID NO: 879618 - RNA, 22 nt, Human
ccaggcccaccuuggccacuua

SEQ ID NO: 879619 - RNA, 22 nt, Human
agcaaggaaacuauggagagau

SEQ ID NO: 879620 - RNA, 18 nt, Human
aaugcacacauuuacucc

SEQ ID NO: 879621 - RNA, 22 nt, Human
gcaguguuuuucaaugcuucca

SEQ ID NO: 879622 - RNA, 22 nt, Human
ugcucugggcucaauggcagcu

SEQ ID NO: 879623 - RNA, 22 nt, Human
ccucuggccuaggccgggagag

SEQ ID NO: 879624 - RNA, 22 nt, Human
cuauucuagucugucaugucca

SEQ ID NO: 879625 - RNA, 22 nt, Human
gacacagagcucacagucuccu

SEQ ID NO: 879626 - RNA, 21 nt, Human
aagacagaaaagccuauuuuc

SEQ ID NO: 879627 - RNA, 22 nt, Human
uuuggaaauuuucauccagaca

SEQ ID NO: 879628 - RNA, 22 nt, Human
caggggacaguaugguggauga

SEQ ID NO: 879629 - RNA, 20 nt, Human
ucuagacagggcacaggaau

SEQ ID NO: 879630 - RNA, 22 nt, Human
cccacucccuacgacacgcucc

SEQ ID NO: 879631 - RNA, 22 nt, Human
auuucucacaguggaaucucug

SEQ ID NO: 879632 - RNA, 22 nt, Human
ggucuggaauaagguccaggaa

SEQ ID NO: 879633 - RNA, 21 nt, Human
uagcuucuugaggcuuggccg

SEQ ID NO: 879634 - RNA, 22 nt, Human
ccacugagguuuugugguuaug

SEQ ID NO: 879635 - RNA, 22 nt, Human
uuucauuguccccaggcaagac

SEQ ID NO: 879636 - RNA, 22 nt, Human
gagccccagcccugcuucuaua

SEQ ID NO: 879637 - RNA, 22 nt, Human
gggaagugauggagccaggauu

SEQ ID NO: 879638 - RNA, 22 nt, Human
cagcugcccauccugggaaaug

SEQ ID NO: 879639 - RNA, 22 nt, Human
uucuacauauauuuuucucacu

SEQ ID NO: 879640 - RNA, 22 nt, Human
gggcagcaguugcccuaaucaa

SEQ ID NO: 879641 - RNA, 20 nt, Human
acuaacauuugcaaggggcu

SEQ ID NO: 879642 - RNA, 20 nt, Human
gcccaggaauuugcauuucu

SEQ ID NO: 879643 - RNA, 22 nt, Human
uuagauaacaguagaauaucaa

SEQ ID NO: 879644 - RNA, 22 nt, Human
uugucaccccuagaggaauucu

SEQ ID NO: 879645 - RNA, 22 nt, Human
acagauggagguuauuaugaac

SEQ ID NO: 879646 - RNA, 22 nt, Human
gcucucugggugugucuagaua

SEQ ID NO: 879647 - RNA, 22 nt, Human
gugaaagacagcauuaauggcu

SEQ ID NO: 879648 - RNA, 22 nt, Human
uuuccuaagguagugauaauuu

SEQ ID NO: 879649 - RNA, 22 nt, Human
aggcagccugguuugaauggaa

SEQ ID NO: 879650 - RNA, 22 nt, Human
augcaaaugucaccacuucuaa

SEQ ID NO: 879651 - RNA, 22 nt, Human
uggcugagugaacauguccauu

SEQ ID NO: 879652 - RNA, 22 nt, Human
agcagggggccacagucacagc

SEQ ID NO: 879653 - RNA, 22 nt, Human
uguaaacauauguauguaugua

SEQ ID NO: 879654 - RNA, 22 nt, Human
aaagugcugaaauuacaggugu

SEQ ID NO: 879655 - RNA, 22 nt, Human
cagcuuucuuuccauaagguuu

SEQ ID NO: 879656 - RNA, 22 nt, Human
gcaguggaagccucuuuaagca

SEQ ID NO: 879657 - RNA, 22 nt, Human
ccucccugucuaccuguugugg

SEQ ID NO: 879658 - RNA, 22 nt, Human
uauuucaacguaugaaaagcug

SEQ ID NO: 879659 - RNA, 21 nt, Human
augugugcuagaggacuacug

SEQ ID NO: 879660 - RNA, 22 nt, Human
augccuuauuccaacaaucuag

SEQ ID NO: 879661 - RNA, 20 nt, Human
ggcagcaauucacccuaucc

SEQ ID NO: 879662 - RNA, 22 nt, Human
cacucuaagaacacaaaggccc

SEQ ID NO: 879663 - RNA, 20 nt, Human
acagaugaggaaaaugaagu

SEQ ID NO: 879664 - RNA, 21 nt, Human
uaauauagguucacaacuagu

SEQ ID NO: 879665 - RNA, 22 nt, Human
ugcugccagccaggccauggag

SEQ ID NO: 879666 - RNA, 22 nt, Human
ucacuccucaggcuagcaucau

SEQ ID NO: 879667 - RNA, 22 nt, Human
gcugcccugucugcagcaggac

SEQ ID NO: 879668 - RNA, 22 nt, Human
ugaggcucaagaaagauuuguu

SEQ ID NO: 879669 - RNA, 22 nt, Human
ucccagcccagguaugaugaua

SEQ ID NO: 879670 - RNA, 22 nt, Human
uuagaaaauggaggugggaggg

SEQ ID NO: 879671 - RNA, 22 nt, Human
gacuucauaauauugagcaugu

SEQ ID NO: 879672 - RNA, 22 nt, Human
acuuaugaggagaaaauauaua

SEQ ID NO: 879673 - RNA, 22 nt, Human
cacuggcaucuaguggguugag

SEQ ID NO: 879674 - RNA, 22 nt, Human
cacauggaagagauacagugag

SEQ ID NO: 879675 - RNA, 22 nt, Human
uuaaggaaagccaaaaugaauu

SEQ ID NO: 879676 - RNA, 22 nt, Human
cuuuccaacugggugggcagcu

SEQ ID NO: 879677 - RNA, 22 nt, Human
aaugcugcucucauaauuauag

SEQ ID NO: 879678 - RNA, 22 nt, Human
uugaucccuggaaauugaaaug

SEQ ID NO: 879679 - RNA, 22 nt, Human
uccccagguccugucggcuccu

SEQ ID NO: 879680 - RNA, 22 nt, Human
gucucagauucagacaucuaca

SEQ ID NO: 879681 - RNA, 22 nt, Human
ugcuaggcauugucugggagua

SEQ ID NO: 879682 - RNA, 22 nt, Human
aaaguuuaggcuuugaaaccag

SEQ ID NO: 879683 - RNA, 22 nt, Human
aucuuugguacuauucuuauca

SEQ ID NO: 879684 - RNA, 22 nt, Human
agagucugauauuuguaccaga

SEQ ID NO: 879685 - RNA, 22 nt, Human
uucacaauuucccuucaucagg

SEQ ID NO: 879686 - RNA, 22 nt, Human
uuggcccacaguaccaugcugu

SEQ ID NO: 879687 - RNA, 22 nt, Human
auucacaguucauuagcuguaa

SEQ ID NO: 879688 - RNA, 22 nt, Human
gcuucaggaggucggucuccuu

SEQ ID NO: 879689 - RNA, 22 nt, Human
aaguccauucuuccagccagcu

SEQ ID NO: 879690 - RNA, 22 nt, Human
gcaccugaacgaccugcuccag

SEQ ID NO: 879691 - RNA, 22 nt, Human
caggacuggcucgcagugggug

SEQ ID NO: 879692 - RNA, 22 nt, Human
aaggauguucuaguuugcugag

SEQ ID NO: 879693 - RNA, 22 nt, Human
ucugggagagucacaggcauug

SEQ ID NO: 879694 - RNA, 22 nt, Human
cagugaguccaagauggcugaa

SEQ ID NO: 879695 - RNA, 22 nt, Human
auguuauucaauuugaauccaa

SEQ ID NO: 879696 - RNA, 22 nt, Human
uuguacuaucaccaugucaugu

SEQ ID NO: 879697 - RNA, 22 nt, Human
gaagagcugacagugucauccu

SEQ ID NO: 879698 - RNA, 21 nt, Human
gacagcaacuguaguccucuu

SEQ ID NO: 879699 - RNA, 22 nt, Human
gacacagagacuugcaguugua

SEQ ID NO: 879700 - RNA, 22 nt, Human
gugguuuugccauuacaaguaa

SEQ ID NO: 879701 - RNA, 22 nt, Human
ucuggccaacaaaaacuaaguc

SEQ ID NO: 879702 - RNA, 22 nt, Human
gcugcaggcagaaucucccaau

SEQ ID NO: 879703 - RNA, 18 nt, Human
uaacauguuuucauuaag

SEQ ID NO: 879704 - RNA, 22 nt, Human
aaaagacauaugugggcauucu

SEQ ID NO: 879705 - RNA, 22 nt, Human
ucuuggaaguagaacacagucu

SEQ ID NO: 879706 - RNA, 22 nt, Human
gccaggcauuuguuaggugcug

SEQ ID NO: 879707 - RNA, 22 nt, Human
auguuauaaauagagacacugg

SEQ ID NO: 879708 - RNA, 19 nt, Human
uggcugggugccaauggcc

SEQ ID NO: 879709 - RNA, 22 nt, Human
ucucagagaugucaagagucua

SEQ ID NO: 879710 - RNA, 22 nt, Human
aaacacuuccuguaacaugaca

SEQ ID NO: 879711 - RNA, 22 nt, Human
agaaacaucuuggcaacuggaa

SEQ ID NO: 879712 - RNA, 22 nt, Human
ccagugugauuguugcaagaau

SEQ ID NO: 879713 - RNA, 22 nt, Human
cuguaaagaucacagagcuggu

SEQ ID NO: 879714 - RNA, 23 nt, Human
cagugcugguucugccugugggg

SEQ ID NO: 879715 - RNA, 22 nt, Human
caguaagaguugacaauggcca

SEQ ID NO: 879716 - RNA, 22 nt, Human
cugcagcugccagugauuucag

SEQ ID NO: 879717 - RNA, 22 nt, Human
gcucugagcagggagaaacagg

SEQ ID NO: 879718 - RNA, 22 nt, Human
uccucaaauauuuacuuacuga

SEQ ID NO: 879719 - RNA, 22 nt, Human
uguaugugcuugagaagguggg

SEQ ID NO: 879720 - RNA, 22 nt, Human
aacagcauauuucauauauuga

SEQ ID NO: 879721 - RNA, 22 nt, Human
cuggugggagcagcaggcagcu

SEQ ID NO: 879722 - RNA, 22 nt, Human
ccugccaggagcuggugcugca

SEQ ID NO: 879723 - RNA, 22 nt, Human
ccagccugguucagaauuggcu

SEQ ID NO: 879724 - RNA, 22 nt, Human
uagaaaguaaacacgaagucuc

SEQ ID NO: 879725 - RNA, 22 nt, Human
caguggcacgaucucagcucac

SEQ ID NO: 879726 - RNA, 20 nt, Human
uuaugcaagcaucaauauug

SEQ ID NO: 879727 - RNA, 22 nt, Human
ggcccugugauggauguauuag

SEQ ID NO: 879728 - RNA, 22 nt, Human
uggcccagcccugcucuagggc

SEQ ID NO: 879729 - RNA, 22 nt, Human
uccagagcugggucugugcuca

SEQ ID NO: 879730 - RNA, 22 nt, Human
ugucagcaauucuggcuuacuc

SEQ ID NO: 879731 - RNA, 23 nt, Human
auaaauuacuaucucccuagagc

SEQ ID NO: 879732 - RNA, 22 nt, Human
cagcccuggugagguuggcuau

SEQ ID NO: 879733 - RNA, 23 nt, Human
acaggcaauaaagggagucucca

SEQ ID NO: 879734 - RNA, 22 nt, Human
cacagugacuggcacauaguaa

SEQ ID NO: 879735 - RNA, 22 nt, Human
uuuuucuacugcccacauugua

SEQ ID NO: 879736 - RNA, 22 nt, Human
gcccagcuggcuuccagcacau

SEQ ID NO: 879737 - RNA, 22 nt, Human
gcucaggccuggcuauccauug

SEQ ID NO: 879738 - RNA, 22 nt, Human
agcagggcagugaucagaaagg

SEQ ID NO: 879739 - RNA, 22 nt, Human
uuugugugguggauacugggua

SEQ ID NO: 879740 - RNA, 22 nt, Human
gcacugcagguggguggagagg

SEQ ID NO: 879741 - RNA, 22 nt, Human
cugaacauucuugaacaucugu

SEQ ID NO: 879742 - RNA, 19 nt, Human
guuuugcaggcagagggga

SEQ ID NO: 879743 - RNA, 22 nt, Human
acacaugaaucacugguggaag

SEQ ID NO: 879744 - RNA, 22 nt, Human
cucagugucuuauuguacacau

SEQ ID NO: 879745 - RNA, 22 nt, Human
agggcgugguggugcuggagca

SEQ ID NO: 879746 - RNA, 22 nt, Human
acucugccugaaccuccugcaa

SEQ ID NO: 879747 - RNA, 21 nt, Human
uucugcuccagcuccucuggg

SEQ ID NO: 879748 - RNA, 22 nt, Human
gcccagcugucuggcagggaug

SEQ ID NO: 879749 - RNA, 22 nt, Human
acaaggcucuggagaagcagaa

SEQ ID NO: 879750 - RNA, 22 nt, Human
ucacaaagggagggauagcugg

SEQ ID NO: 879751 - RNA, 22 nt, Human
uucauacuaaaguguaagaugu

SEQ ID NO: 879752 - RNA, 22 nt, Human
agggcagaaaccaccuugaugg

SEQ ID NO: 879753 - RNA, 22 nt, Human
ggcagaggugacagugucuuuu

SEQ ID NO: 879754 - RNA, 22 nt, Human
gaauucugguccuguccaaggu

SEQ ID NO: 879755 - RNA, 22 nt, Human
cggggcugcgcucuuccugccg

SEQ ID NO: 879756 - RNA, 22 nt, Human
uuuaggccagauuuauuugaca

SEQ ID NO: 879757 - RNA, 22 nt, Human
ucacaagauacaguuagaagca

SEQ ID NO: 879758 - RNA, 23 nt, Human
agcagcugugguuuaccuuagua

SEQ ID NO: 879759 - RNA, 22 nt, Human
gagcccagcuguccuuggcaaa

SEQ ID NO: 879760 - RNA, 22 nt, Human
uggcuggaugugagaucaagag

SEQ ID NO: 879761 - RNA, 22 nt, Human
auuccacagcuacaucaaucua

SEQ ID NO: 879762 - RNA, 22 nt, Human
aaagccagugguaugagagaaa

SEQ ID NO: 879763 - RNA, 22 nt, Human
gaacacauguccuccuuggauu

SEQ ID NO: 879764 - RNA, 22 nt, Human
uacuuucuagcucuccccaguu

SEQ ID NO: 879765 - RNA, 22 nt, Human
uccaggauugcaggugcacaac

SEQ ID NO: 879766 - RNA, 22 nt, Human
uacaauuuaguggugugugguu

SEQ ID NO: 879767 - RNA, 22 nt, Human
ucaucaucacucuggcaagcau

SEQ ID NO: 879768 - RNA, 22 nt, Human
gcuggcuguguuccuucugcca

SEQ ID NO: 879769 - RNA, 22 nt, Human
gacauucauugaugucuuccuc

SEQ ID NO: 879770 - RNA, 22 nt, Human
caugcaggccuauggagcagug

SEQ ID NO: 879771 - RNA, 22 nt, Human
ugaugaaaaccagaacucucau

SEQ ID NO: 879772 - RNA, 22 nt, Human
uacacaccugccugcagacucu

SEQ ID NO: 879773 - RNA, 22 nt, Human
aggacacagguaagccagugga

SEQ ID NO: 879774 - RNA, 22 nt, Human
ucuuuccuguaacugcuguuca

SEQ ID NO: 879775 - RNA, 22 nt, Human
guaucuuuccacaucuucagua

SEQ ID NO: 879776 - RNA, 22 nt, Human
uaacagaagaugaaacuucuuu

SEQ ID NO: 879777 - RNA, 22 nt, Human
gcucugagaggaugcugagcag

SEQ ID NO: 879778 - RNA, 22 nt, Human
ugcuccugauaucuaaugugua

SEQ ID NO: 879779 - RNA, 22 nt, Human
aacaggcaacaguugacucuga

SEQ ID NO: 879780 - RNA, 22 nt, Human
gaaggcaguaaauggcuguuuu

SEQ ID NO: 879781 - RNA, 22 nt, Human
agcuccagccucuucuggaggu

SEQ ID NO: 879782 - RNA, 22 nt, Human
aggcuggagggcaauggcaaga

SEQ ID NO: 879783 - RNA, 20 nt, Human
ugggccuguggcagaagucu

SEQ ID NO: 879784 - RNA, 22 nt, Human
gggcaccuggcuagugacagug

SEQ ID NO: 879785 - RNA, 22 nt, Human
uagcagcuccuaaacaguggug

SEQ ID NO: 879786 - RNA, 22 nt, Human
gaaguggaagccaucggcaguc

SEQ ID NO: 879787 - RNA, 22 nt, Human
gugcuaggauuacaggcauggg

SEQ ID NO: 879788 - RNA, 22 nt, Human
agcagccuuugaucaucuggga

SEQ ID NO: 879789 - RNA, 22 nt, Human
ccagggccugccacuuagcaag

SEQ ID NO: 879790 - RNA, 22 nt, Human
ccuggcucuucugugucagccc

SEQ ID NO: 879791 - RNA, 22 nt, Human
uuucccaggcccucagggcugc

SEQ ID NO: 879792 - RNA, 22 nt, Human
ugcaugcacuaucuagaugaug

SEQ ID NO: 879793 - RNA, 22 nt, Human
agcagcucacaggauuccugaa

SEQ ID NO: 879794 - RNA, 22 nt, Human
uggcagaggaggcucagauuga

SEQ ID NO: 879795 - RNA, 22 nt, Human
ugggaggcuuccagaccuugcu

SEQ ID NO: 879796 - RNA, 22 nt, Human
aacacugauggaaaguauguuu

SEQ ID NO: 879797 - RNA, 22 nt, Human
gcagcccugcaggcagcuccag

SEQ ID NO: 879798 - RNA, 22 nt, Human
acccaggcgggagugcaguguc

SEQ ID NO: 879799 - RNA, 22 nt, Human
ucacauuuauuucaaaguuacu

SEQ ID NO: 879800 - RNA, 22 nt, Human
uuuggucuuggauuuaucagug

SEQ ID NO: 879801 - RNA, 22 nt, Human
uggugggcacagugcccaggcu

SEQ ID NO: 879802 - RNA, 22 nt, Human
aaucuauaugcuuuucacauac

SEQ ID NO: 879803 - RNA, 22 nt, Human
gagagaaaaaugagcuucauug

SEQ ID NO: 879804 - RNA, 22 nt, Human
uccuguguuaaagggggugcua

SEQ ID NO: 879805 - RNA, 22 nt, Human
aagguauuggcagggcugaguu

SEQ ID NO: 879806 - RNA, 22 nt, Human
agaggcuggauugagcauagac

SEQ ID NO: 879807 - RNA, 22 nt, Human
guuauaaaaugcacaguuguuu

SEQ ID NO: 879808 - RNA, 22 nt, Human
cuccagaggaugcaggugaggg

SEQ ID NO: 879809 - RNA, 22 nt, Human
gggccccaguccucccacgugg

SEQ ID NO: 879810 - RNA, 19 nt, Human
cacuuuauuucuguuuugu

SEQ ID NO: 879811 - RNA, 22 nt, Human
ucuagucaauagaggucacacu

SEQ ID NO: 879812 - RNA, 20 nt, Human
ucccaggcugggcuccagcu

SEQ ID NO: 879813 - RNA, 21 nt, Human
cugcuuuacuucagaggaucu

SEQ ID NO: 879814 - RNA, 22 nt, Human
gagguguguuacagauugucau

SEQ ID NO: 879815 - RNA, 22 nt, Human
uuccaauggaaucaugucuuga

SEQ ID NO: 879816 - RNA, 21 nt, Human
ggcuggucgcgugcaugucuc

SEQ ID NO: 879817 - RNA, 22 nt, Human
aauugugcauuuuuaaaucacg

SEQ ID NO: 879818 - RNA, 22 nt, Human
cagucccaguuugagacucugg

SEQ ID NO: 879819 - RNA, 22 nt, Human
agugucugccaacugcaugguc

SEQ ID NO: 879820 - RNA, 23 nt, Human
agaaaguuugugccuugugacac

SEQ ID NO: 879821 - RNA, 22 nt, Human
uaaaaaguagugagaauggcgc

SEQ ID NO: 879822 - RNA, 20 nt, Human
ucugacccagagcccaggcu

SEQ ID NO: 879823 - RNA, 21 nt, Human
ucaauacaggugcaugugucu

SEQ ID NO: 879824 - RNA, 22 nt, Human
uuacuguuccucucucaaagag

SEQ ID NO: 879825 - RNA, 22 nt, Human
uguaucaaucauguaauuuggu

SEQ ID NO: 879826 - RNA, 22 nt, Human
aucauuugccucaagugaaagu

SEQ ID NO: 879827 - RNA, 22 nt, Human
uuugugugcuugguauugaaga

SEQ ID NO: 879828 - RNA, 22 nt, Human
gaggcacagagcccuaggagcu

SEQ ID NO: 879829 - RNA, 22 nt, Human
ugggugggagcacccugucugg

SEQ ID NO: 879830 - RNA, 22 nt, Human
ugguauuuccucauucugcuuu

SEQ ID NO: 879831 - RNA, 22 nt, Human
aagggcuggcccugggaagagu

SEQ ID NO: 879832 - RNA, 19 nt, Human
uucauuuguaucugcucac

SEQ ID NO: 879833 - RNA, 22 nt, Human
cugcccugucuuuuucugauga

SEQ ID NO: 879834 - RNA, 22 nt, Human
auaacagugaccucucagcacc

SEQ ID NO: 879835 - RNA, 22 nt, Human
caggcaggugcagauuccucuu

SEQ ID NO: 879836 - RNA, 22 nt, Human
ucuuacaagaaauaagccaaug

SEQ ID NO: 879837 - RNA, 22 nt, Human
aggcagguuggggaaaagcacu

SEQ ID NO: 879838 - RNA, 22 nt, Human
gcagaacauuucacaguaucuu

SEQ ID NO: 879839 - RNA, 22 nt, Human
accuuaaaggccgaaguaaaga

SEQ ID NO: 879840 - RNA, 22 nt, Human
ccaaacaaauccccauucuuag

SEQ ID NO: 879841 - RNA, 22 nt, Human
agguaaaugaauguuuagucuu

SEQ ID NO: 879842 - RNA, 22 nt, Human
ggcagguggacgugcuaaagcu

SEQ ID NO: 879843 - RNA, 22 nt, Human
cagcaguucuguacuuuagagu

SEQ ID NO: 879844 - RNA, 22 nt, Human
aaaaggcauggagguugauagu

SEQ ID NO: 879845 - RNA, 22 nt, Human
uaacacugugcccagaguccca

SEQ ID NO: 879846 - RNA, 22 nt, Human
cugucuucccgaggcccuggag

SEQ ID NO: 879847 - RNA, 22 nt, Human
uguggaaugggagugagaagac

SEQ ID NO: 879848 - RNA, 22 nt, Human
ccaguggcuacagggggguuga

SEQ ID NO: 879849 - RNA, 22 nt, Human
ucuagcaugggaaaaucacagc

SEQ ID NO: 879850 - RNA, 22 nt, Human
aggcucaguucuguggugagcc

SEQ ID NO: 879851 - RNA, 23 nt, Human
uccagggcaguggcugggucugc

SEQ ID NO: 879852 - RNA, 20 nt, Human
agccaggcucaagcuccccc

SEQ ID NO: 879853 - RNA, 22 nt, Human
uggccucaaucuguccuccagc

SEQ ID NO: 879854 - RNA, 22 nt, Human
caaugacauggauaaucauauu

SEQ ID NO: 879855 - RNA, 22 nt, Human
ccacugugcccagccucauggg

SEQ ID NO: 879856 - RNA, 22 nt, Human
cugauggagacuccacugugau

SEQ ID NO: 879857 - RNA, 22 nt, Human
ccucucuuuccuacaccuugga

SEQ ID NO: 879858 - RNA, 22 nt, Human
cagaaugaaauguaagaacacc

SEQ ID NO: 879859 - RNA, 22 nt, Human
cagagccaaaaccguaacagcc

SEQ ID NO: 879860 - RNA, 23 nt, Human
ucaguuauuggugauaaagcugg

SEQ ID NO: 879861 - RNA, 22 nt, Human
augaaggcaguuaaacgucauc

SEQ ID NO: 879862 - RNA, 22 nt, Human
ggcuucaccgcgggguugcagg

SEQ ID NO: 879863 - RNA, 22 nt, Human
augagguaucucauuuccugaa

SEQ ID NO: 879864 - RNA, 22 nt, Human
ccuggcucugccguaaccacca

SEQ ID NO: 879865 - RNA, 22 nt, Human
aagaaucauagagccacugaua

SEQ ID NO: 879866 - RNA, 22 nt, Human
uagggacaaagagcugaggccu

SEQ ID NO: 879867 - RNA, 22 nt, Human
guagucugaacaguaauuuugu

SEQ ID NO: 879868 - RNA, 20 nt, Human
gccugcagguuggaugggau

SEQ ID NO: 879869 - RNA, 22 nt, Human
gccuggggcaugcagcugauac

SEQ ID NO: 879870 - RNA, 22 nt, Human
ucucuaaagauagcugccucga

SEQ ID NO: 879871 - RNA, 22 nt, Human
agguauuuguuauuugagagug

SEQ ID NO: 879872 - RNA, 22 nt, Human
aggagccaagcagaacuaagga

SEQ ID NO: 879873 - RNA, 22 nt, Human
uucugucucccugauguagagc

SEQ ID NO: 879874 - RNA, 22 nt, Human
cuuuuccuauugauucuguuac

SEQ ID NO: 879875 - RNA, 22 nt, Human
ggcuuccagcugggccuuggag

SEQ ID NO: 879876 - RNA, 22 nt, Human
ccuuccaaaggagccacaucug

SEQ ID NO: 879877 - RNA, 22 nt, Human
uagauucaaguauucaguuugg

SEQ ID NO: 879878 - RNA, 22 nt, Human
ucuuaguuguuugcugucuaac

SEQ ID NO: 879879 - RNA, 22 nt, Human
ucuagcagagggaagaggcuuu

SEQ ID NO: 879880 - RNA, 22 nt, Human
cuugggagacacaagaagacau

SEQ ID NO: 879881 - RNA, 22 nt, Human
ugucaccaguuccaggaaauaa

SEQ ID NO: 879882 - RNA, 22 nt, Human
augagcaguagguucauggcug

SEQ ID NO: 879883 - RNA, 22 nt, Human
cccagccuuugcuuccugguuc

SEQ ID NO: 879884 - RNA, 18 nt, Human
gccuucagacugcaugcu

SEQ ID NO: 879885 - RNA, 22 nt, Human
cucaggccuugaagucuuuucu

SEQ ID NO: 879886 - RNA, 22 nt, Human
uaaaacagcagggcagagaagu

SEQ ID NO: 879887 - RNA, 22 nt, Human
gggcugaaaggccgccucagau

SEQ ID NO: 879888 - RNA, 22 nt, Human
acagauggccauauuacuauau

SEQ ID NO: 879889 - RNA, 22 nt, Human
gugagaaugagauuggaaugua

SEQ ID NO: 879890 - RNA, 21 nt, Human
gccuggcagguggaagggcuc

SEQ ID NO: 879891 - RNA, 22 nt, Human
ucccagcccagacuucuccagu

SEQ ID NO: 879892 - RNA, 21 nt, Human
ugugcaguccaaugugcuagc

SEQ ID NO: 879893 - RNA, 22 nt, Human
uacauugagaaccacugcuuag

SEQ ID NO: 879894 - RNA, 22 nt, Human
ugaaaagacugcaagagagcau

SEQ ID NO: 879895 - RNA, 22 nt, Human
uccaggaggaggaaggcugcca

SEQ ID NO: 879896 - RNA, 22 nt, Human
uguccuugugacauucuggcuu

SEQ ID NO: 879897 - RNA, 21 nt, Human
aaauuucugcaagccucaacu

SEQ ID NO: 879898 - RNA, 22 nt, Human
agggcugacaguggcguggcgu

SEQ ID NO: 879899 - RNA, 22 nt, Human
aacacuguaucagucuucaaua

SEQ ID NO: 879900 - RNA, 22 nt, Human
aaagcagucuguuuuaaccuga

SEQ ID NO: 879901 - RNA, 20 nt, Human
ccaggcuggcaaaugggggc

SEQ ID NO: 879902 - RNA, 22 nt, Human
caggaagaggacaggcuucccc

SEQ ID NO: 879903 - RNA, 22 nt, Human
aaauagagcuggguuaaacuuu

SEQ ID NO: 879904 - RNA, 20 nt, Human
ugcccacaucacucaggagu

SEQ ID NO: 879905 - RNA, 22 nt, Human
aguguauuaaaaugcuccuaag

SEQ ID NO: 879906 - RNA, 22 nt, Human
gacccuggcuagggcuuaaccu

SEQ ID NO: 879907 - RNA, 22 nt, Human
cugcuuggaguccuccagcacc

SEQ ID NO: 879908 - RNA, 22 nt, Human
gaaguguuuuaguucuucaggu

SEQ ID NO: 879909 - RNA, 22 nt, Human
ucuacuugucagucuucaaauc

SEQ ID NO: 879910 - RNA, 22 nt, Human
ucaauucagacugagaaaugau

SEQ ID NO: 879911 - RNA, 22 nt, Human
uuuuuaaugcagucugagacau

SEQ ID NO: 879912 - RNA, 22 nt, Human
caggcuccuuaucuuacaacuu

SEQ ID NO: 879913 - RNA, 22 nt, Human
cuucaguguugccagggccuag

SEQ ID NO: 879914 - RNA, 22 nt, Human
auauacaggugguauguguaaa

SEQ ID NO: 879915 - RNA, 22 nt, Human
uguguuaauuccacaaacauuc

SEQ ID NO: 879916 - RNA, 22 nt, Human
ugugggaagauguugcaggaga

SEQ ID NO: 879917 - RNA, 22 nt, Human
cuccagugcccuccuugggggc

SEQ ID NO: 879918 - RNA, 22 nt, Human
agagcuggcugugggugacuuu

SEQ ID NO: 879919 - RNA, 19 nt, Human
auucaugaaggcuugaagg

SEQ ID NO: 879920 - RNA, 22 nt, Human
auuauuguacuuucaauaaggu

SEQ ID NO: 879921 - RNA, 20 nt, Human
ugugugcuaggacuacagug

SEQ ID NO: 879922 - RNA, 22 nt, Human
cugcuuccaugcaauggcaguc

SEQ ID NO: 879923 - RNA, 22 nt, Human
gaccugguccuuguacuuugaa

SEQ ID NO: 879924 - RNA, 22 nt, Human
cagcugccuguauuguccucau

SEQ ID NO: 879925 - RNA, 22 nt, Human
acaguuuaugguguuuuauaua

SEQ ID NO: 879926 - RNA, 22 nt, Human
ccagcaccuugaucuuggaguu

SEQ ID NO: 879927 - RNA, 22 nt, Human
gagugcagaugaacagaagauu

SEQ ID NO: 879928 - RNA, 22 nt, Human
guucuucaucauuuuagauagg

SEQ ID NO: 879929 - RNA, 22 nt, Human
gcugcagagaugggugcccuuu

SEQ ID NO: 879930 - RNA, 22 nt, Human
ugacccuuggucagagugcccu

SEQ ID NO: 879931 - RNA, 22 nt, Human
guuucauaauucaaucaaauga

SEQ ID NO: 879932 - RNA, 22 nt, Human
uggggcaguggcuuuucacccu

SEQ ID NO: 879933 - RNA, 22 nt, Human
ucaaagcacacuuagugguaga

SEQ ID NO: 879934 - RNA, 22 nt, Human
augaaugcauacauuugucaag

SEQ ID NO: 879935 - RNA, 22 nt, Human
augggcaugauauuaguaccua

SEQ ID NO: 879936 - RNA, 20 nt, Human
auauuucuuaagaacuuuca

SEQ ID NO: 879937 - RNA, 22 nt, Human
acuguggcucaucaggcuggug

SEQ ID NO: 879938 - RNA, 22 nt, Human
uagauguaucuucucuuaucgu

SEQ ID NO: 879939 - RNA, 22 nt, Human
gcugagcagguuugaugcuuuu

SEQ ID NO: 879940 - RNA, 21 nt, Human
uucuucaugaugauuaauggc

SEQ ID NO: 879941 - RNA, 22 nt, Human
aaaguaaccuaguaauaguguc

SEQ ID NO: 879942 - RNA, 22 nt, Human
aaggccaccaccagcgaggggg

SEQ ID NO: 879943 - RNA, 22 nt, Human
gcugccuuugugagccaagggg

SEQ ID NO: 879944 - RNA, 22 nt, Human
ugucagugguaagguugggagu

SEQ ID NO: 879945 - RNA, 22 nt, Human
cuuuguauucaguugggcugug

SEQ ID NO: 879946 - RNA, 22 nt, Human
cugggguggagauuggcaaucu

SEQ ID NO: 879947 - RNA, 22 nt, Human
ucacuccaucuuugcuacuggu

SEQ ID NO: 879948 - RNA, 22 nt, Human
acacauaucuaagauagaugac

SEQ ID NO: 879949 - RNA, 22 nt, Human
augacaaaagaagacaugaggu

SEQ ID NO: 879950 - RNA, 22 nt, Human
acacagauggguagaaaacaga

SEQ ID NO: 879951 - RNA, 22 nt, Human
ccacugaguacccgauggcugc

SEQ ID NO: 879952 - RNA, 22 nt, Human
aggugcaggagcugugcaggga

SEQ ID NO: 879953 - RNA, 22 nt, Human
auacauacauguacacauaaau

SEQ ID NO: 879954 - RNA, 19 nt, Human
ugaagcaggcagagaagau

SEQ ID NO: 879955 - RNA, 22 nt, Human
gcugugugcuaggauauguuuu

SEQ ID NO: 879956 - RNA, 22 nt, Human
agaauaugccuuagcaagccca

SEQ ID NO: 879957 - RNA, 22 nt, Human
augcagaaugaguucacgaucu

SEQ ID NO: 879958 - RNA, 22 nt, Human
aggcaacucaucaugaaagacu

SEQ ID NO: 879959 - RNA, 22 nt, Human
aguacaguuauaaguggucuug

SEQ ID NO: 879960 - RNA, 22 nt, Human
acucccacuccagaguagaagc

SEQ ID NO: 879961 - RNA, 22 nt, Human
ugugugugacaaccuaguucag

SEQ ID NO: 879962 - RNA, 22 nt, Human
uuccacagcccaagcugguggc

SEQ ID NO: 879963 - RNA, 22 nt, Human
cuucacuaaucacugaacucca

SEQ ID NO: 879964 - RNA, 20 nt, Human
ccagagaguagguuagugau

SEQ ID NO: 879965 - RNA, 22 nt, Human
acugggaaggagcaggaucugu

SEQ ID NO: 879966 - RNA, 22 nt, Human
uauaggaauaaagugggguaua

SEQ ID NO: 879967 - RNA, 21 nt, Human
auuagaagguauuuagggccu

SEQ ID NO: 879968 - RNA, 22 nt, Human
ccuggcagcuguuuggcuuggc

SEQ ID NO: 879969 - RNA, 22 nt, Human
gcacccaggccggcgacugcag

SEQ ID NO: 879970 - RNA, 22 nt, Human
uuuuuaagagauucuccagucu

SEQ ID NO: 879971 - RNA, 22 nt, Human
agagcuuuagcugcuggucugg

SEQ ID NO: 879972 - RNA, 22 nt, Human
uccugcuggaauggaaaaugaa

SEQ ID NO: 879973 - RNA, 22 nt, Human
cucugggacaucccuuggccua

SEQ ID NO: 879974 - RNA, 22 nt, Human
cgcccagggcaggaggccgcuc

SEQ ID NO: 879975 - RNA, 22 nt, Human
aagguguggaguggugcgacug

SEQ ID NO: 879976 - RNA, 22 nt, Human
agcuucucucuuugcacucaca

SEQ ID NO: 879977 - RNA, 22 nt, Human
auguuacagaaagcaaagauga

SEQ ID NO: 879978 - RNA, 22 nt, Human
ucccugcugcacucacaccuac

SEQ ID NO: 879979 - RNA, 22 nt, Human
cugaggagaacaaugagaucaa

SEQ ID NO: 879980 - RNA, 22 nt, Human
ccagagaguaggaggcauuauu

SEQ ID NO: 879981 - RNA, 22 nt, Human
cuggacuucucuucaaagacag

SEQ ID NO: 879982 - RNA, 21 nt, Human
cagugccagccacaggacgcc

SEQ ID NO: 879983 - RNA, 20 nt, Human
uuuccuaagugguuugcuga

SEQ ID NO: 879984 - RNA, 22 nt, Human
uacaagacgagggaaguucuuu

SEQ ID NO: 879985 - RNA, 22 nt, Human
cuuggaacaaauuaaacaauac

SEQ ID NO: 879986 - RNA, 22 nt, Human
ggcugccuccugcugggcugga

SEQ ID NO: 879987 - RNA, 22 nt, Human
agggaaugugaaaacaccucuc

SEQ ID NO: 879988 - RNA, 22 nt, Human
gcugaagcugcagcaggaggaa

SEQ ID NO: 879989 - RNA, 22 nt, Human
agggcacaucugcugggaaugg

SEQ ID NO: 879990 - RNA, 22 nt, Human
uaaagcuuguauugcaauauuu

SEQ ID NO: 879991 - RNA, 22 nt, Human
ucagggcacauucugcaguggc

SEQ ID NO: 879992 - RNA, 22 nt, Human
ucaguagucuaggauuucaccu

SEQ ID NO: 879993 - RNA, 22 nt, Human
ucuagagcuggaguagaaugug

SEQ ID NO: 879994 - RNA, 23 nt, Human
uuucaguugagaaugcacggacc

SEQ ID NO: 879995 - RNA, 22 nt, Human
auaugcaagcacauagaauacu

SEQ ID NO: 879996 - RNA, 22 nt, Human
ucacuaaugagcuaaggaaaag

SEQ ID NO: 879997 - RNA, 19 nt, Human
aggcuugguugcagcaagc

SEQ ID NO: 879998 - RNA, 22 nt, Human
auggcagugauaggcuagugau

SEQ ID NO: 879999 - RNA, 22 nt, Human
agaugugauguuaggcccuugg

SEQ ID NO: 880000 - RNA, 22 nt, Human
cucagcaccccgacaggacauu

SEQ ID NO: 880001 - RNA, 20 nt, Human
ucaguguauccucaguggcu

SEQ ID NO: 880002 - RNA, 22 nt, Human
cacagcuggggaagcugaggcc

SEQ ID NO: 880003 - RNA, 22 nt, Human
aggacuucaucaccuguauaaa

SEQ ID NO: 880004 - RNA, 21 nt, Human
cagagcuguccaaacccugac

SEQ ID NO: 880005 - RNA, 22 nt, Human
agcugguucaguuucugggccu

SEQ ID NO: 880006 - RNA, 22 nt, Human
cuacauucugggaaaucagaug

SEQ ID NO: 880007 - RNA, 22 nt, Human
aggcagcugcccucuccuuccu

SEQ ID NO: 880008 - RNA, 19 nt, Human
ucaacccucuuugccuagc

SEQ ID NO: 880009 - RNA, 22 nt, Human
ucugagaacaugcuuugaucau

SEQ ID NO: 880010 - RNA, 22 nt, Human
caaauccucaccucaucaugaa

SEQ ID NO: 880011 - RNA, 22 nt, Human
acacaguauuacaauaggugcu

SEQ ID NO: 880012 - RNA, 22 nt, Human
ucugcauauuguuaauggaaug

SEQ ID NO: 880013 - RNA, 22 nt, Human
cacacaccaaucaaaugucaga

SEQ ID NO: 880014 - RNA, 20 nt, Human
gcccaggaucucugaggcau

SEQ ID NO: 880015 - RNA, 22 nt, Human
agugugacaaaucuauggcuca

SEQ ID NO: 880016 - RNA, 22 nt, Human
cgcaggugaaagaggcugggca

SEQ ID NO: 880017 - RNA, 22 nt, Human
aaggcugaccaguuuacacuuu

SEQ ID NO: 880018 - RNA, 22 nt, Human
uggaaagguaggauuucaagac

SEQ ID NO: 880019 - RNA, 22 nt, Human
aaauucuuucauggcuaauaag

SEQ ID NO: 880020 - RNA, 22 nt, Human
ccuggccgguaucccaccuccu

SEQ ID NO: 880021 - RNA, 22 nt, Human
uacuuguuuuguguuccuaaac

SEQ ID NO: 880022 - RNA, 23 nt, Human
agugagcagcuguagggcaagga

SEQ ID NO: 880023 - RNA, 22 nt, Human
ucugagaauggagcuaaaaauc

SEQ ID NO: 880024 - RNA, 22 nt, Human
ugaaauuccaggagaguuaaaa

SEQ ID NO: 880025 - RNA, 22 nt, Human
uccuuagagauacugucuugaa

SEQ ID NO: 880026 - RNA, 22 nt, Human
ugucccagcagcuggguucucu

SEQ ID NO: 880027 - RNA, 22 nt, Human
agggagaagguuuagcugugag

SEQ ID NO: 880028 - RNA, 22 nt, Human
uccaauguuauuaucuagaggc

SEQ ID NO: 880029 - RNA, 22 nt, Human
aggcugcucaguagauggagcu

SEQ ID NO: 880030 - RNA, 22 nt, Human
auugauucuguaagucaacaau

SEQ ID NO: 880031 - RNA, 22 nt, Human
cagagguagaaggcaugcagug

SEQ ID NO: 880032 - RNA, 22 nt, Human
uuagaaucuaacauucuuaucu

SEQ ID NO: 880033 - RNA, 18 nt, Human
aggauauuaagaguacag

SEQ ID NO: 880034 - RNA, 22 nt, Human
ugggaccugcccuggccccauc

SEQ ID NO: 880035 - RNA, 22 nt, Human
aucuguauauuuuucaaugcaa

SEQ ID NO: 880036 - RNA, 22 nt, Human
accagagacugcauuucucuga

SEQ ID NO: 880037 - RNA, 22 nt, Human
cucuggcucccgcagcccccau

SEQ ID NO: 880038 - RNA, 22 nt, Human
uacaaagauggaagguuauguu

SEQ ID NO: 880039 - RNA, 22 nt, Human
gccucugggcucugccccuggc

SEQ ID NO: 880040 - RNA, 22 nt, Human
uuccugggcuuuccccucuggu

SEQ ID NO: 880041 - RNA, 22 nt, Human
gggacacagguaucucaaauga

SEQ ID NO: 880042 - RNA, 22 nt, Human
uaguguaaacuuaugcugagcc

SEQ ID NO: 880043 - RNA, 22 nt, Human
gcagggaaguuugaucuuuuuc

SEQ ID NO: 880044 - RNA, 22 nt, Human
ugcuggcuggaucagagauugg

SEQ ID NO: 880045 - RNA, 22 nt, Human
gguaacuuacagggccccuuua

SEQ ID NO: 880046 - RNA, 22 nt, Human
uuuauacuccacucugcaagcg

SEQ ID NO: 880047 - RNA, 22 nt, Human
ucuucaaagaauuuuaguaauu

SEQ ID NO: 880048 - RNA, 22 nt, Human
aagaagcuauacauaauuuggg

SEQ ID NO: 880049 - RNA, 22 nt, Human
auaaaagucugcuuauuugggc

SEQ ID NO: 880050 - RNA, 23 nt, Human
gcucuggagcugggccuggcagg

SEQ ID NO: 880051 - RNA, 22 nt, Human
ugagcuggagucuguggcuccu

SEQ ID NO: 880052 - RNA, 21 nt, Human
ucuccaguauccuucucugag

SEQ ID NO: 880053 - RNA, 22 nt, Human
augggaucuugcccugagggcu

SEQ ID NO: 880054 - RNA, 22 nt, Human
ugaaaagugaucauggauuagg

SEQ ID NO: 880055 - RNA, 23 nt, Human
agaaguucaagaccagccugccc

SEQ ID NO: 880056 - RNA, 22 nt, Human
ggcagcaaaaagccugguugaa

SEQ ID NO: 880057 - RNA, 22 nt, Human
gcuccuggugcaaaguuucuuc

SEQ ID NO: 880058 - RNA, 22 nt, Human
auggcucugcugggcaaagcaa

SEQ ID NO: 880059 - RNA, 22 nt, Human
agagaagggccuguauguaauc

SEQ ID NO: 880060 - RNA, 22 nt, Human
aaagccaguuucuggaaguacc

SEQ ID NO: 880061 - RNA, 22 nt, Human
gcucuccacugaccacggggca

SEQ ID NO: 880062 - RNA, 18 nt, Human
gccugggaggaggaaaug

SEQ ID NO: 880063 - RNA, 22 nt, Human
ucaaguaugacaucaaguuucu

SEQ ID NO: 880064 - RNA, 22 nt, Human
guggcagagggugagcuggacu

SEQ ID NO: 880065 - RNA, 22 nt, Human
cuucagaaugggacuguguuug

SEQ ID NO: 880066 - RNA, 18 nt, Human
uggcuucuauuuuacuca

SEQ ID NO: 880067 - RNA, 22 nt, Human
gaagaaucugaggacagucauu

SEQ ID NO: 880068 - RNA, 22 nt, Human
uggggaggaagucagauuucag

SEQ ID NO: 880069 - RNA, 22 nt, Human
auaagagucuuguuuucuuauu

SEQ ID NO: 880070 - RNA, 22 nt, Human
guacaucuuuaaauuguucagu

SEQ ID NO: 880071 - RNA, 22 nt, Human
aaagauguuuuauaaguuaugg

SEQ ID NO: 880072 - RNA, 22 nt, Human
auuuaugacagaagauaugcug

SEQ ID NO: 880073 - RNA, 21 nt, Human
agagagggagaugaaacaucc

SEQ ID NO: 880074 - RNA, 22 nt, Human
cccucacagucuaggagcagcu

SEQ ID NO: 880075 - RNA, 22 nt, Human
ugcuuuauuaagagagaaauuu

SEQ ID NO: 880076 - RNA, 22 nt, Human
cagaugagggcuggaggugagc

SEQ ID NO: 880077 - RNA, 22 nt, Human
augguugaaucaagguagacaa

SEQ ID NO: 880078 - RNA, 22 nt, Human
cacagcugcccccucucuaacu

SEQ ID NO: 880079 - RNA, 22 nt, Human
gacaguuuugcugaaauugagc

SEQ ID NO: 880080 - RNA, 21 nt, Human
cugggcucaagcaauccuuuc

SEQ ID NO: 880081 - RNA, 22 nt, Human
agcccuguuaacuguuuugaag

SEQ ID NO: 880082 - RNA, 22 nt, Human
aggcacugacagauucuguguc

SEQ ID NO: 880083 - RNA, 22 nt, Human
aggccaaagcacagagcuggaa

SEQ ID NO: 880084 - RNA, 22 nt, Human
cgugucuguguaugcaggccgu

SEQ ID NO: 880085 - RNA, 18 nt, Human
uccaggccugaagugucc

SEQ ID NO: 880086 - RNA, 21 nt, Human
aauauccaaaugauuagaucu

SEQ ID NO: 880087 - RNA, 22 nt, Human
acacugugcuuagaugcugaac

SEQ ID NO: 880088 - RNA, 22 nt, Human
uggaagaauagaagaugguuga

SEQ ID NO: 880089 - RNA, 22 nt, Human
gcucaggccuccagaggggcaa

SEQ ID NO: 880090 - RNA, 22 nt, Human
caagcacuguggcacucgcagg

SEQ ID NO: 880091 - RNA, 22 nt, Human
aucaacugccccaaauguauuu

SEQ ID NO: 880092 - RNA, 22 nt, Human
cugcagcugggccagggccacc

SEQ ID NO: 880093 - RNA, 22 nt, Human
ggcaguggguuccccaaggcac

SEQ ID NO: 880094 - RNA, 22 nt, Human
guguccagggcuggaagugagg

SEQ ID NO: 880095 - RNA, 21 nt, Human
gagaaucaggaaggauugaug

SEQ ID NO: 880096 - RNA, 22 nt, Human
ugucuucaugccugaaagaaga

SEQ ID NO: 880097 - RNA, 22 nt, Human
auucucuagucucuuccauaaa

SEQ ID NO: 880098 - RNA, 17 nt, Human
ugggggcgccagggucu

SEQ ID NO: 880099 - RNA, 22 nt, Human
aaaauggucucagcuggcacca

SEQ ID NO: 880100 - RNA, 22 nt, Human
auccauuuaauugaggggaagg

SEQ ID NO: 880101 - RNA, 22 nt, Human
aagcagcagccugaaguacguc

SEQ ID NO: 880102 - RNA, 22 nt, Human
gugaacugcugaguuuuaucau

SEQ ID NO: 880103 - RNA, 22 nt, Human
uguucucacuggaugcuucaca

SEQ ID NO: 880104 - RNA, 22 nt, Human
ucauggauaaaauauugguuaa

SEQ ID NO: 880105 - RNA, 22 nt, Human
aaggaggguucccagguccugg

SEQ ID NO: 880106 - RNA, 22 nt, Human
gcuguccagcuccagccagcca

SEQ ID NO: 880107 - RNA, 22 nt, Human
uuucuaaguguguuucauagga

SEQ ID NO: 880108 - RNA, 22 nt, Human
uguuuccuaagugucucugaag

SEQ ID NO: 880109 - RNA, 20 nt, Human
gggcuccagcugugauucuu

SEQ ID NO: 880110 - RNA, 22 nt, Human
cugagcaggauauucacagcag

SEQ ID NO: 880111 - RNA, 22 nt, Human
acagugugcaagaaauggggga

SEQ ID NO: 880112 - RNA, 22 nt, Human
uacaguaaucuggacaugauuu

SEQ ID NO: 880113 - RNA, 22 nt, Human
caggaacauguuggaaagaaau

SEQ ID NO: 880114 - RNA, 22 nt, Human
ugcagcuggauuuaucuuuucc

SEQ ID NO: 880115 - RNA, 22 nt, Human
ucaggaaggagcuggccugcca

SEQ ID NO: 880116 - RNA, 22 nt, Human
cccaggucugccagccuguggg

SEQ ID NO: 880117 - RNA, 22 nt, Human
auuccaaaggcuggccuggagg

SEQ ID NO: 880118 - RNA, 22 nt, Human
cucuucaguaaaugacacuguu

SEQ ID NO: 880119 - RNA, 22 nt, Human
uggcuccauucuuuaugaguug

SEQ ID NO: 880120 - RNA, 22 nt, Human
ucccugagggcagcucaagucc

SEQ ID NO: 880121 - RNA, 22 nt, Human
ugaaugagucaaucauuuagcu

SEQ ID NO: 880122 - RNA, 22 nt, Human
aaauggcaaucagcagaagcua

SEQ ID NO: 880123 - RNA, 22 nt, Human
aaucacauugaaucugcuaccu

SEQ ID NO: 880124 - RNA, 22 nt, Human
uguacuguaugccaggcacuau

SEQ ID NO: 880125 - RNA, 22 nt, Human
acugucaccuaaauuuucauug

SEQ ID NO: 880126 - RNA, 22 nt, Human
auaaagcaaauaggacuauugc

SEQ ID NO: 880127 - RNA, 19 nt, Human
ucagaauucugucucuuga

SEQ ID NO: 880128 - RNA, 22 nt, Human
aaagcagcaacgugcauauaac

SEQ ID NO: 880129 - RNA, 22 nt, Human
gugcuguaucagaaucugcucu

SEQ ID NO: 880130 - RNA, 22 nt, Human
auuugcuuguaaauguaugccu

SEQ ID NO: 880131 - RNA, 22 nt, Human
gucucugggugugugaugccaa

SEQ ID NO: 880132 - RNA, 23 nt, Human
augugcaaagugcuacaguauag

SEQ ID NO: 880133 - RNA, 22 nt, Human
aagcuaaguggaagucuuauca

SEQ ID NO: 880134 - RNA, 22 nt, Human
acaguuaucuuugaaauagaga

SEQ ID NO: 880135 - RNA, 23 nt, Human
agcaaugcugggagacucuguaa

SEQ ID NO: 880136 - RNA, 22 nt, Human
uauauaauuuucugccauaucc

SEQ ID NO: 880137 - RNA, 22 nt, Human
uuuucuuauggugaagcacaaa

SEQ ID NO: 880138 - RNA, 22 nt, Human
uuaucguacgcuucagaaauuu

SEQ ID NO: 880139 - RNA, 22 nt, Human
gaaaaguauguuuauuuugacu

SEQ ID NO: 880140 - RNA, 22 nt, Human
acagaauagagacugccugcuc

SEQ ID NO: 880141 - RNA, 22 nt, Human
uaaguucugaagaggcgaggua

SEQ ID NO: 880142 - RNA, 22 nt, Human
ccccuucuggucuucaauggug

SEQ ID NO: 880143 - RNA, 22 nt, Human
aagaguaaauucaggacuuuaa

SEQ ID NO: 880144 - RNA, 22 nt, Human
gucugccucuauugccuaccug

SEQ ID NO: 880145 - RNA, 22 nt, Human
agugaaaugauaguguaaauac

SEQ ID NO: 880146 - RNA, 22 nt, Human
ccaaggcauauggcugaaacca

SEQ ID NO: 880147 - RNA, 22 nt, Human
ccuggagagcucgggccaggca

SEQ ID NO: 880148 - RNA, 23 nt, Human
ccagugugguagguccacaggug

SEQ ID NO: 880149 - RNA, 22 nt, Human
ucagggaagacuucuuagagga

SEQ ID NO: 880150 - RNA, 22 nt, Human
uguggggaucuucuagcuuuuc

SEQ ID NO: 880151 - RNA, 22 nt, Human
agcagaaccacagcacuguuga

SEQ ID NO: 880152 - RNA, 22 nt, Human
ugguauuucugugcccagcuca

SEQ ID NO: 880153 - RNA, 22 nt, Human
gcagagguggaugcaauugggg

SEQ ID NO: 880154 - RNA, 22 nt, Human
uccaggagagguguggggacug

SEQ ID NO: 880155 - RNA, 20 nt, Human
ccugcuguuuccauggggcc

SEQ ID NO: 880156 - RNA, 22 nt, Human
uucauugagcuguacacuuagg

SEQ ID NO: 880157 - RNA, 22 nt, Human
ugcuuaaacacauacauacaua

SEQ ID NO: 880158 - RNA, 22 nt, Human
aaggaagaagggaaguuacuua

SEQ ID NO: 880159 - RNA, 18 nt, Human
gcaggcccuguuucuggg

SEQ ID NO: 880160 - RNA, 22 nt, Human
ggagcuggcagcgcaacccaga

SEQ ID NO: 880161 - RNA, 22 nt, Human
cagaggaggccaccgcauaggc

SEQ ID NO: 880162 - RNA, 22 nt, Human
cuugcuguugugggagacuggg

SEQ ID NO: 880163 - RNA, 22 nt, Human
gggcugcaaugcuucaguuguu

SEQ ID NO: 880164 - RNA, 22 nt, Human
agcagcagccguagccuuauua

SEQ ID NO: 880165 - RNA, 22 nt, Human
aguuucuagccucacuguuuag

SEQ ID NO: 880166 - RNA, 19 nt, Human
uuuuccuucuauauguuuc

SEQ ID NO: 880167 - RNA, 22 nt, Human
uaguaguaauuguuaucuuauu

SEQ ID NO: 880168 - RNA, 22 nt, Human
acacacagaaggaagccccacu

SEQ ID NO: 880169 - RNA, 22 nt, Human
aaguugauuuaaacuacuaguc

SEQ ID NO: 880170 - RNA, 17 nt, Human
ucucaggggcuagcccu

SEQ ID NO: 880171 - RNA, 22 nt, Human
cagaggcgaggcagcugaaccu

SEQ ID NO: 880172 - RNA, 22 nt, Human
augggaggcagacacuaaguuc

SEQ ID NO: 880173 - RNA, 22 nt, Human
cuaucaaacagccauuaauaua

SEQ ID NO: 880174 - RNA, 22 nt, Human
aaaagagcaaacauguaauagu

SEQ ID NO: 880175 - RNA, 22 nt, Human
ugucugaaggcagguggagaac

SEQ ID NO: 880176 - RNA, 20 nt, Human
ccucacagggcagagagggg

SEQ ID NO: 880177 - RNA, 22 nt, Human
augcaucaauuaggggcagaca

SEQ ID NO: 880178 - RNA, 22 nt, Human
uccuggugucgccuggucaguu

SEQ ID NO: 880179 - RNA, 22 nt, Human
cuagcaucagaugagaagcugu

SEQ ID NO: 880180 - RNA, 22 nt, Human
gcacagagagcagugggggaca

SEQ ID NO: 880181 - RNA, 22 nt, Human
gaaguuuuagucaaaauguaga

SEQ ID NO: 880182 - RNA, 22 nt, Human
ugucuucacaaagcagaaggga

SEQ ID NO: 880183 - RNA, 22 nt, Human
aaugcuuauaacguuagaaugu

SEQ ID NO: 880184 - RNA, 22 nt, Human
aaugacaagacauagucucuga

SEQ ID NO: 880185 - RNA, 22 nt, Human
uucagcaguuucugagaagcaa

SEQ ID NO: 880186 - RNA, 22 nt, Human
cauggcagccugcccugcuugc

SEQ ID NO: 880187 - RNA, 21 nt, Human
ugccuggccuuugcuuuuccu

SEQ ID NO: 880188 - RNA, 22 nt, Human
acucauuugcaugaugugcuau

SEQ ID NO: 880189 - RNA, 22 nt, Human
caggaaaugggucguuuuauaa

SEQ ID NO: 880190 - RNA, 19 nt, Human
agccuggagggcuggucac

SEQ ID NO: 880191 - RNA, 22 nt, Human
acaaaacaguguuccugccccu

SEQ ID NO: 880192 - RNA, 22 nt, Human
cacugagggcggagcccaggga

SEQ ID NO: 880193 - RNA, 22 nt, Human
auguguuuugguggaucauuca

SEQ ID NO: 880194 - RNA, 22 nt, Human
aagauucccagagaaguuccac

SEQ ID NO: 880195 - RNA, 22 nt, Human
gcccagccuccaagcuccaagg

SEQ ID NO: 880196 - RNA, 22 nt, Human
uggcacugagcagccgcggcag

SEQ ID NO: 880197 - RNA, 22 nt, Human
cuagucucuggaggucagggcu

SEQ ID NO: 880198 - RNA, 23 nt, Human
agaguggccuacucacacucauu

SEQ ID NO: 880199 - RNA, 22 nt, Human
acccagaggcggagguugcagu

SEQ ID NO: 880200 - RNA, 22 nt, Human
acagauuuuucagcuccugugu

SEQ ID NO: 880201 - RNA, 22 nt, Human
gaaacugugaggaucuuaacuu

SEQ ID NO: 880202 - RNA, 22 nt, Human
aaggaaagacauauaaaugacu

SEQ ID NO: 880203 - RNA, 22 nt, Human
ugggacaggaugaccagaaggu

SEQ ID NO: 880204 - RNA, 22 nt, Human
guccugagaugucacaagguuu

SEQ ID NO: 880205 - RNA, 22 nt, Human
cacagaacauccuuagcucaug

SEQ ID NO: 880206 - RNA, 22 nt, Human
acaggcacuuugacaugccauc

SEQ ID NO: 880207 - RNA, 17 nt, Human
agagcauguguaggagc

SEQ ID NO: 880208 - RNA, 22 nt, Human
aguuugauggcuuaauaguaga

SEQ ID NO: 880209 - RNA, 22 nt, Human
acagagacaaauguuaguaguu

SEQ ID NO: 880210 - RNA, 22 nt, Human
ggcagcaucucuggcagcagcu

SEQ ID NO: 880211 - RNA, 22 nt, Human
uuauuuugccacaggugaccuu

SEQ ID NO: 880212 - RNA, 22 nt, Human
aguuauaaaaggagcacugauu

SEQ ID NO: 880213 - RNA, 22 nt, Human
agggcucaguaaacgguggauu

SEQ ID NO: 880214 - RNA, 22 nt, Human
ccagcagcagcguccaaggaga

SEQ ID NO: 880215 - RNA, 22 nt, Human
aggugggcaaugaggccugagu

SEQ ID NO: 880216 - RNA, 20 nt, Human
aguagcagugugacauugac

SEQ ID NO: 880217 - RNA, 22 nt, Human
aaagcaaucuaguuccaauucu

SEQ ID NO: 880218 - RNA, 22 nt, Human
ugcuucugcuuuacuugguuca

SEQ ID NO: 880219 - RNA, 22 nt, Human
ugcuucuccauugaugcuaagu

SEQ ID NO: 880220 - RNA, 22 nt, Human
aagaagagaaaugugcugcugg

SEQ ID NO: 880221 - RNA, 22 nt, Human
uagcuaauggugaagauucaga

SEQ ID NO: 880222 - RNA, 22 nt, Human
ccacugcccccugaagaccagg

SEQ ID NO: 880223 - RNA, 22 nt, Human
aagaagucuggagcaaugcaau

SEQ ID NO: 880224 - RNA, 22 nt, Human
uauuugucacuagaaaggguaa

SEQ ID NO: 880225 - RNA, 22 nt, Human
uagggcuguuuaaaagugaggu

SEQ ID NO: 880226 - RNA, 17 nt, Human
acauuuccuaacugaag

SEQ ID NO: 880227 - RNA, 22 nt, Human
aaaguguagagacuuuggaacc

SEQ ID NO: 880228 - RNA, 19 nt, Human
gugguuuucugaggagucu

SEQ ID NO: 880229 - RNA, 22 nt, Human
auuaggaaauguguugcaagca

SEQ ID NO: 880230 - RNA, 19 nt, Human
uggcccagaugguccuggg

SEQ ID NO: 880231 - RNA, 22 nt, Human
auguucaacaguuugcacacau

SEQ ID NO: 880232 - RNA, 23 nt, Human
ucacagggcacuggcugggguug

SEQ ID NO: 880233 - RNA, 22 nt, Human
aguuuacauaaaaaggcagagg

SEQ ID NO: 880234 - RNA, 22 nt, Human
gggcuggagccagcuguggcug

SEQ ID NO: 880235 - RNA, 19 nt, Human
ccucugccagcccgccucu

SEQ ID NO: 880236 - RNA, 22 nt, Human
caggccagaguccaacuccaga

SEQ ID NO: 880237 - RNA, 22 nt, Human
caucuauuuucugugagguauc

SEQ ID NO: 880238 - RNA, 22 nt, Human
gaacuucacgauagccaaagcu

SEQ ID NO: 880239 - RNA, 22 nt, Human
ccagggaggguccuguggcuuc

SEQ ID NO: 880240 - RNA, 22 nt, Human
uguaaauugaaggaaauuugug

SEQ ID NO: 880241 - RNA, 22 nt, Human
auggguaaagcaggaagagagu

SEQ ID NO: 880242 - RNA, 22 nt, Human
ggcugugaaguagcaggggcag

SEQ ID NO: 880243 - RNA, 22 nt, Human
uaggaaauugccaauauaugac

SEQ ID NO: 880244 - RNA, 22 nt, Human
augaaacagugaauuagucaag

SEQ ID NO: 880245 - RNA, 22 nt, Human
ucaauucugcauacauuucacu

SEQ ID NO: 880246 - RNA, 22 nt, Human
uagcauuauuuccucuuuuugu

SEQ ID NO: 880247 - RNA, 22 nt, Human
auuuuacuucauuugaaaugcc

SEQ ID NO: 880248 - RNA, 22 nt, Human
uguauacauguguucaugcaug

SEQ ID NO: 880249 - RNA, 22 nt, Human
cauucaguggaguauuauucag

SEQ ID NO: 880250 - RNA, 22 nt, Human
ggagagaaauugagguagcaag

SEQ ID NO: 880251 - RNA, 22 nt, Human
uacauugacugugugcaucaca

SEQ ID NO: 880252 - RNA, 22 nt, Human
guuuaaguuucagaagcuaaga

SEQ ID NO: 880253 - RNA, 22 nt, Human
uucuuucucaacaugaauguuu

SEQ ID NO: 880254 - RNA, 22 nt, Human
ucucaguccaaaugagagguug

SEQ ID NO: 880255 - RNA, 22 nt, Human
cuaagacucugcaaaucagcuu

SEQ ID NO: 880256 - RNA, 22 nt, Human
ccagucuggcaggagggggaac

SEQ ID NO: 880257 - RNA, 22 nt, Human
uuacagaaguauugagagaucc

SEQ ID NO: 880258 - RNA, 22 nt, Human
uggcugcagaucaagggcaggc

SEQ ID NO: 880259 - RNA, 22 nt, Human
ugagggagcacacacugaagug

SEQ ID NO: 880260 - RNA, 22 nt, Human
auaauccauuaauuaaugacca

SEQ ID NO: 880261 - RNA, 22 nt, Human
ugucugaaagaggacgagcugg

SEQ ID NO: 880262 - RNA, 22 nt, Human
guggggugggcugaguuaggcc

SEQ ID NO: 880263 - RNA, 22 nt, Human
cagcagaaacccagcaaagcca

SEQ ID NO: 880264 - RNA, 18 nt, Human
gagagggaucccucagga

SEQ ID NO: 880265 - RNA, 22 nt, Human
auacaucauuucccaucaaucg

SEQ ID NO: 880266 - RNA, 22 nt, Human
gacaccauuaccuuucuauauu

SEQ ID NO: 880267 - RNA, 22 nt, Human
aagcuguuguucauccugaauu

SEQ ID NO: 880268 - RNA, 22 nt, Human
cauaauuacugauaugcugauu

SEQ ID NO: 880269 - RNA, 22 nt, Human
auggcacagugggaaaugaccu

SEQ ID NO: 880270 - RNA, 17 nt, Human
gcacagugauauuauuu

SEQ ID NO: 880271 - RNA, 22 nt, Human
uacaauguucauagcuuuggca

SEQ ID NO: 880272 - RNA, 22 nt, Human
cugugugcaggugcuggguacc

SEQ ID NO: 880273 - RNA, 22 nt, Human
ggccugucucacccccgggugc

SEQ ID NO: 880274 - RNA, 22 nt, Human
uuucucaaggugucauguauuu

SEQ ID NO: 880275 - RNA, 22 nt, Human
gguggcagaauaauugaagguc

SEQ ID NO: 880276 - RNA, 22 nt, Human
augcauucuguagagcauuuau

SEQ ID NO: 880277 - RNA, 22 nt, Human
ugauguuuaauacuaugcuuuu

SEQ ID NO: 880278 - RNA, 22 nt, Human
aggcuacaaauaagcauguaau

SEQ ID NO: 880279 - RNA, 22 nt, Human
aucuucaaagcacaucguuugu

SEQ ID NO: 880280 - RNA, 22 nt, Human
auuaugaaguugagggacccug

SEQ ID NO: 880281 - RNA, 22 nt, Human
acagcacagagugguauggcug

SEQ ID NO: 880282 - RNA, 22 nt, Human
uucuguacuucaggggcucugu

SEQ ID NO: 880283 - RNA, 22 nt, Human
aauaacagagucuucaagauag

SEQ ID NO: 880284 - RNA, 22 nt, Human
gagaggccauggggugggaugc

SEQ ID NO: 880285 - RNA, 22 nt, Human
uuuuacuuuggauacaguacuu

SEQ ID NO: 880286 - RNA, 22 nt, Human
agcugguggaagggagcccaaa

SEQ ID NO: 880287 - RNA, 22 nt, Human
agacaaaugaacaaauauguga

SEQ ID NO: 880288 - RNA, 22 nt, Human
uccugagauaggaguugaaggc

SEQ ID NO: 880289 - RNA, 22 nt, Human
gagauggagucuuuuucuguca

SEQ ID NO: 880290 - RNA, 22 nt, Human
ccugguguugccaaucugugcc

SEQ ID NO: 880291 - RNA, 22 nt, Human
aggaauugagauccuagguuuu

SEQ ID NO: 880292 - RNA, 22 nt, Human
cugaagccaguuugcugcccuu

SEQ ID NO: 880293 - RNA, 22 nt, Human
augcccuuaugccagaggcaau

SEQ ID NO: 880294 - RNA, 22 nt, Human
ccacagugaguuagauugacca

SEQ ID NO: 880295 - RNA, 22 nt, Human
agggugcguucuaugagaaucu

SEQ ID NO: 880296 - RNA, 22 nt, Human
cuggcuuucucugugguguuca

SEQ ID NO: 880297 - RNA, 22 nt, Human
uuucccaguuagugaagacaug

SEQ ID NO: 880298 - RNA, 22 nt, Human
ucuagaagggugccgaucuuag

SEQ ID NO: 880299 - RNA, 22 nt, Human
aaugaagaaauggacaucuuua

SEQ ID NO: 880300 - RNA, 22 nt, Human
ugaaugcuuuggagccuucuaa

SEQ ID NO: 880301 - RNA, 22 nt, Human
gccagguggagguugcagugag

SEQ ID NO: 880302 - RNA, 22 nt, Human
uaagaaauuuaguuauagaaug

SEQ ID NO: 880303 - RNA, 20 nt, Human
uauuacacacaaugagcagu

SEQ ID NO: 880304 - RNA, 22 nt, Human
ucuuuggauuaaaauauuugua

SEQ ID NO: 880305 - RNA, 19 nt, Human
uaguguuuuucuggagcag

SEQ ID NO: 880306 - RNA, 23 nt, Human
uuauuuggauuuuaguggaaaga

SEQ ID NO: 880307 - RNA, 22 nt, Human
aaaauuauggaguaucccaaag

SEQ ID NO: 880308 - RNA, 22 nt, Human
uucaacuuuaugcauauguauu

SEQ ID NO: 880309 - RNA, 22 nt, Human
gcccaggaguugguggcugcag

SEQ ID NO: 880310 - RNA, 22 nt, Human
caccucuuugauuugaggcaag

SEQ ID NO: 880311 - RNA, 22 nt, Human
augcucucuguccugcucagag

SEQ ID NO: 880312 - RNA, 22 nt, Human
aggcagcuggaaaacuccaggc

SEQ ID NO: 880313 - RNA, 22 nt, Human
augcuacauuuugguuuauaaa

SEQ ID NO: 880314 - RNA, 22 nt, Human
uauucucugcagcugaauguuu

SEQ ID NO: 880315 - RNA, 22 nt, Human
uccucccuucucacugggaagg

SEQ ID NO: 880316 - RNA, 22 nt, Human
gaaagugcuuuugagugugugc

SEQ ID NO: 880317 - RNA, 22 nt, Human
aagacacagcgaaauguuccug

SEQ ID NO: 880318 - RNA, 22 nt, Human
uauuacagggcuaguuaugagu

SEQ ID NO: 880319 - RNA, 22 nt, Human
aagauaaacucuugauuucuga

SEQ ID NO: 880320 - RNA, 19 nt, Human
aaagauguccuuuugggcu

SEQ ID NO: 880321 - RNA, 22 nt, Human
cagcuucaacugcacagucaac

SEQ ID NO: 880322 - RNA, 22 nt, Human
cuguggcucaauugccuacuga

SEQ ID NO: 880323 - RNA, 17 nt, Human
ugguccagguggagcca

SEQ ID NO: 880324 - RNA, 17 nt, Human
cuuggcaccucugccau

SEQ ID NO: 880325 - RNA, 22 nt, Human
gagggccucugcugcuccacau

SEQ ID NO: 880326 - RNA, 22 nt, Human
aaagaaucagaagucucaaaca

SEQ ID NO: 880327 - RNA, 22 nt, Human
ggcauuuuugacaaagagcaau

SEQ ID NO: 880328 - RNA, 22 nt, Human
ucccuggguccugcuugcucuc

SEQ ID NO: 880329 - RNA, 22 nt, Human
ccuuugcauucuagauguuuag

SEQ ID NO: 880330 - RNA, 22 nt, Human
aaguaacagaggggguguugcu

SEQ ID NO: 880331 - RNA, 22 nt, Human
cagcaagugauggaaaucagag

SEQ ID NO: 880332 - RNA, 22 nt, Human
uccagggccccccaguugcacg

SEQ ID NO: 880333 - RNA, 22 nt, Human
uuucauugugaugcuuuuauca

SEQ ID NO: 880334 - RNA, 23 nt, Human
uuuauuuauuuaggcugagggau

SEQ ID NO: 880335 - RNA, 22 nt, Human
uccuagaggaugguaggaagcu

SEQ ID NO: 880336 - RNA, 22 nt, Human
uuagcaaaguuugccaucuagu

SEQ ID NO: 880337 - RNA, 22 nt, Human
agcaggaaguagucuguaagca

SEQ ID NO: 880338 - RNA, 22 nt, Human
ucugcagacaggaagcugaggc

SEQ ID NO: 880339 - RNA, 22 nt, Human
cagagcagggugcaccuugggc

SEQ ID NO: 880340 - RNA, 22 nt, Human
agagcuggaaucagaccucagg

SEQ ID NO: 880341 - RNA, 22 nt, Human
uaaacacucacuucauagccau

SEQ ID NO: 880342 - RNA, 22 nt, Human
gcucccugguauugcugccacu

SEQ ID NO: 880343 - RNA, 22 nt, Human
caaguugcucugccucuguagg

SEQ ID NO: 880344 - RNA, 22 nt, Human
cuggggaggaugcuacgaccug

SEQ ID NO: 880345 - RNA, 22 nt, Human
auggcuggauuugauccauggg

SEQ ID NO: 880346 - RNA, 22 nt, Human
agugucugagccagaauuagaa

SEQ ID NO: 880347 - RNA, 22 nt, Human
agcuucaugccuaaagacagcg

SEQ ID NO: 880348 - RNA, 22 nt, Human
ggggcucaguucggacagccug

SEQ ID NO: 880349 - RNA, 22 nt, Human
cugagguaauuuuccagauaau

SEQ ID NO: 880350 - RNA, 22 nt, Human
guuccuuguauuucagacauga

SEQ ID NO: 880351 - RNA, 22 nt, Human
gaaauucacuguauuucuuggg

SEQ ID NO: 880352 - RNA, 22 nt, Human
agccacagggggugagggacaa

SEQ ID NO: 880353 - RNA, 20 nt, Human
aucaaaauccuauugagguu

SEQ ID NO: 880354 - RNA, 22 nt, Human
agaaaguucacugguauauuuu

SEQ ID NO: 880355 - RNA, 22 nt, Human
agguaaaauagauaguauuucu

SEQ ID NO: 880356 - RNA, 20 nt, Human
ccagagcugauggcugcccg

SEQ ID NO: 880357 - RNA, 22 nt, Human
cagucaccuugaggacucagac

SEQ ID NO: 880358 - RNA, 22 nt, Human
uagaaaagcucuaaggccucuc

SEQ ID NO: 880359 - RNA, 22 nt, Human
ccacagugggcacagcaggacu

SEQ ID NO: 880360 - RNA, 22 nt, Human
guucuucaucauuaacacucug

SEQ ID NO: 880361 - RNA, 22 nt, Human
uacaguuuguuacauuguuagu

SEQ ID NO: 880362 - RNA, 22 nt, Human
ugccugugaucagcugaguuca

SEQ ID NO: 880363 - RNA, 22 nt, Human
uaaagcauguuucaguaagguu

SEQ ID NO: 880364 - RNA, 22 nt, Human
uccagggcuccccaacauccag

SEQ ID NO: 880365 - RNA, 22 nt, Human
aagcugcagcacagagaggugg

SEQ ID NO: 880366 - RNA, 22 nt, Human
ucaucuguugauuuuaagucuu

SEQ ID NO: 880367 - RNA, 22 nt, Human
gaagaauauucuugaucuuaga

SEQ ID NO: 880368 - RNA, 22 nt, Human
ucucacagcaucauugcucaug

SEQ ID NO: 880369 - RNA, 21 nt, Human
gcugcagggcccagggcaccc

SEQ ID NO: 880370 - RNA, 22 nt, Human
uacaggagcacaaaagaguuga

SEQ ID NO: 880371 - RNA, 22 nt, Human
uaagacacgggcugaucuaaag

SEQ ID NO: 880372 - RNA, 22 nt, Human
cagcugcaaucagaagcuaagg

SEQ ID NO: 880373 - RNA, 22 nt, Human
gcugaauaauguguaaugucuc

SEQ ID NO: 880374 - RNA, 22 nt, Human
acauauguguuguacaugcaug

SEQ ID NO: 880375 - RNA, 22 nt, Human
aaaacauuuuacugccaucuca

SEQ ID NO: 880376 - RNA, 22 nt, Human
agggcaguguggugggacugac

SEQ ID NO: 880377 - RNA, 22 nt, Human
uucaagucugaagaggacuaau

SEQ ID NO: 880378 - RNA, 14 nt, Human
gcagguggaucacc

SEQ ID NO: 880379 - RNA, 14 nt, Human
gcaggcggaucacu

SEQ ID NO: 880380 - RNA, 21 nt, Human
agacaggucagggagagguga

SEQ ID NO: 880381 - RNA, 22 nt, Human
augcuguguuugagaaccuagg

SEQ ID NO: 880382 - RNA, 19 nt, Human
uuccaguucuaaucucuuc

SEQ ID NO: 880383 - RNA, 22 nt, Human
agggaagcagcagccgccuguc

SEQ ID NO: 880384 - RNA, 22 nt, Human
cagacuguggcuucuuggaggg

SEQ ID NO: 880385 - RNA, 22 nt, Human
gaggcagcaugguaccuuggag

SEQ ID NO: 880386 - RNA, 22 nt, Human
cuggccccagaguuucacuugg

SEQ ID NO: 880387 - RNA, 22 nt, Human
cuuguuauuggaaaugucaugc

SEQ ID NO: 880388 - RNA, 22 nt, Human
gcugagccacaggcagugcacu

SEQ ID NO: 880389 - RNA, 22 nt, Human
cacaggacucgacugcagacag

SEQ ID NO: 880390 - RNA, 22 nt, Human
gucagcaagaugaaucagcagg

SEQ ID NO: 880391 - RNA, 20 nt, Human
uguaggaaggacccugucug

SEQ ID NO: 880392 - RNA, 22 nt, Human
gugaaggcagccaucgacaguu

SEQ ID NO: 880393 - RNA, 22 nt, Human
ggagccugguuacuagagccug

SEQ ID NO: 880394 - RNA, 22 nt, Human
caccaggguacaauuucgcaga

SEQ ID NO: 880395 - RNA, 22 nt, Human
uaagugaguucuugcuagauuu

SEQ ID NO: 880396 - RNA, 22 nt, Human
cucagcuucuaccuccugagug

SEQ ID NO: 880397 - RNA, 22 nt, Human
gagggcaguagccucguacccu

SEQ ID NO: 880398 - RNA, 22 nt, Human
ucagcuguaucagaaauacaau

SEQ ID NO: 880399 - RNA, 22 nt, Human
aaagagcuugcuugcuuuauau

SEQ ID NO: 880400 - RNA, 22 nt, Human
gcuggagaguaguaagcaguua

SEQ ID NO: 880401 - RNA, 22 nt, Human
uugggaaguuuaaugacagacu

SEQ ID NO: 880402 - RNA, 22 nt, Human
ccaggccugugcaaggagggag

SEQ ID NO: 880403 - RNA, 22 nt, Human
gcuuuucuagcuagaacauccg

SEQ ID NO: 880404 - RNA, 22 nt, Human
uaguauuuccuguaagcuauag

SEQ ID NO: 880405 - RNA, 19 nt, Human
cugcagcugcaccauccca

SEQ ID NO: 880406 - RNA, 22 nt, Human
ugacagcagcauagugagcaau

SEQ ID NO: 880407 - RNA, 22 nt, Human
aacaugucuuuagagaaacauu

SEQ ID NO: 880408 - RNA, 22 nt, Human
acuuuucugcagaugaucucuu

SEQ ID NO: 880409 - RNA, 22 nt, Human
gcugagggccgcauagggucau

SEQ ID NO: 880410 - RNA, 22 nt, Human
aucauugaaauguaguuucauc

SEQ ID NO: 880411 - RNA, 22 nt, Human
cagcauccuuugcugguuuccc

SEQ ID NO: 880412 - RNA, 22 nt, Human
uggcuuuacuuaaacugaauca

SEQ ID NO: 880413 - RNA, 22 nt, Human
aaacaaagcaucuugcuaugca

SEQ ID NO: 880414 - RNA, 20 nt, Human
ugggugagaguguuugcucu

SEQ ID NO: 880415 - RNA, 22 nt, Human
cauuuguugguugcugucuuau

SEQ ID NO: 880416 - RNA, 22 nt, Human
uccugagggcauuuuggugacu

SEQ ID NO: 880417 - RNA, 22 nt, Human
uguaagaaucagucuuuaaugu

SEQ ID NO: 880418 - RNA, 22 nt, Human
caguuucuucaauucagacacu

SEQ ID NO: 880419 - RNA, 22 nt, Human
aucucuuagcagucuagugacc

SEQ ID NO: 880420 - RNA, 22 nt, Human
uucuuugcccuuaaugaaauaa

SEQ ID NO: 880421 - RNA, 22 nt, Human
auucagaauugugggcaguaca

SEQ ID NO: 880422 - RNA, 22 nt, Human
gaggagaaauuauccuuggugu

SEQ ID NO: 880423 - RNA, 22 nt, Human
cacaugaaggcuggggucguga

SEQ ID NO: 880424 - RNA, 22 nt, Human
gcuucuaugcuucaagagagag

SEQ ID NO: 880425 - RNA, 22 nt, Human
ugcauauacccgcauuuacaua

SEQ ID NO: 880426 - RNA, 21 nt, Human
uccugccuuaguccagagcag

SEQ ID NO: 880427 - RNA, 22 nt, Human
ccuacaggaaauuguaucaaaa

SEQ ID NO: 880428 - RNA, 22 nt, Human
aggguggccaccaaguauguca

SEQ ID NO: 880429 - RNA, 22 nt, Human
ucaaaaauuuucugaggaugag

SEQ ID NO: 880430 - RNA, 21 nt, Human
ugggccaguagaaaggaaggc

SEQ ID NO: 880431 - RNA, 22 nt, Human
gaggagguggagucaugcagag

SEQ ID NO: 880432 - RNA, 22 nt, Human
gugaaacuucacauuuugauag

SEQ ID NO: 880433 - RNA, 22 nt, Human
aguuguauuagagaacacaaac

SEQ ID NO: 880434 - RNA, 22 nt, Human
uuugcucugacagugccagaga

SEQ ID NO: 880435 - RNA, 22 nt, Human
ugccuuaauuucccuguuuugu

SEQ ID NO: 880436 - RNA, 22 nt, Human
guuauaaaggugauaaugguca

SEQ ID NO: 880437 - RNA, 21 nt, Human
cagcuccacuaaagcagcugu

SEQ ID NO: 880438 - RNA, 22 nt, Human
cacacaggaaaauuggaauuaa

SEQ ID NO: 880439 - RNA, 22 nt, Human
ggcccagagucugcaauggagu

SEQ ID NO: 880440 - RNA, 22 nt, Human
cuccagcuuuagcucuccaggg

SEQ ID NO: 880441 - RNA, 22 nt, Human
uagagaugcccuagcugaagua

SEQ ID NO: 880442 - RNA, 22 nt, Human
ggccagugugggaguaguucuu

SEQ ID NO: 880443 - RNA, 18 nt, Human
cugagggcagccccuggg

SEQ ID NO: 880444 - RNA, 21 nt, Human
uggcucuggguaggagagugc

SEQ ID NO: 880445 - RNA, 22 nt, Human
cugacuuuuccaaauaauacuu

SEQ ID NO: 880446 - RNA, 22 nt, Human
uguacagacuuugcagugugca

SEQ ID NO: 880447 - RNA, 22 nt, Human
guuuuucuuugugugaagacaa

SEQ ID NO: 880448 - RNA, 22 nt, Human
ucauucauucuuucugaauaua

SEQ ID NO: 880449 - RNA, 22 nt, Human
gacuauuuauuuacagaaagcu

SEQ ID NO: 880450 - RNA, 22 nt, Human
ugauucugccccuuggcucugg

SEQ ID NO: 880451 - RNA, 22 nt, Human
aguccuagcccuggauccauca

SEQ ID NO: 880452 - RNA, 22 nt, Human
ccaggagcaaagaucacuggga

SEQ ID NO: 880453 - RNA, 22 nt, Human
gaggaaaugguuguucaggugg

SEQ ID NO: 880454 - RNA, 22 nt, Human
aaagccagggacagugugcaug

SEQ ID NO: 880455 - RNA, 22 nt, Human
uacccagggcuuuucugaugca

SEQ ID NO: 880456 - RNA, 22 nt, Human
auuuuguugaugguggaguagc

SEQ ID NO: 880457 - RNA, 22 nt, Human
aucacugaaugcaaagcuggga

SEQ ID NO: 880458 - RNA, 22 nt, Human
uccucagggguuucagguguac

SEQ ID NO: 880459 - RNA, 22 nt, Human
aaagaagcauaggcuagacuuc

SEQ ID NO: 880460 - RNA, 22 nt, Human
caagacuuuggaaggcugaggc

SEQ ID NO: 880461 - RNA, 22 nt, Human
aaacacugguaugauguauagu

SEQ ID NO: 880462 - RNA, 22 nt, Human
caauucaauggcaaaguauugu

SEQ ID NO: 880463 - RNA, 22 nt, Human
agauucuaccagagcuaguuug

SEQ ID NO: 880464 - RNA, 22 nt, Human
gucaggagauagggcaagcuuc

SEQ ID NO: 880465 - RNA, 22 nt, Human
cugaauauuagucaugucugau

SEQ ID NO: 880466 - RNA, 22 nt, Human
aggaagcuuguguguauugguc

SEQ ID NO: 880467 - RNA, 22 nt, Human
aaaccuucacaucuacucuaca

SEQ ID NO: 880468 - RNA, 22 nt, Human
cuucccuuuagcauauaguagu

SEQ ID NO: 880469 - RNA, 22 nt, Human
guuucaaaggugucaggcaguu

SEQ ID NO: 880470 - RNA, 19 nt, Human
ucagccaccagaagagaua

SEQ ID NO: 880471 - RNA, 22 nt, Human
ggagaagcaggugcuuuggguc

SEQ ID NO: 880472 - RNA, 22 nt, Human
ugcuggggguucagaugaguaa

SEQ ID NO: 880473 - RNA, 22 nt, Human
ugugcugcucucagugacagcc

SEQ ID NO: 880474 - RNA, 22 nt, Human
aaauuaagggugagaagaguug

SEQ ID NO: 880475 - RNA, 22 nt, Human
cagaugaaguauuacagacauu

SEQ ID NO: 880476 - RNA, 22 nt, Human
cugugggagaaguugcuggagu

SEQ ID NO: 880477 - RNA, 22 nt, Human
guucaagguuuuacagagugua

SEQ ID NO: 880478 - RNA, 22 nt, Human
ucaggacagaaggcugccaggg

SEQ ID NO: 880479 - RNA, 22 nt, Human
gccuggcugucuggcaagguuc

SEQ ID NO: 880480 - RNA, 22 nt, Human
uaacguuugauaacuucuguuc

SEQ ID NO: 880481 - RNA, 22 nt, Human
cauuguugugagaucaagcagu

SEQ ID NO: 880482 - RNA, 17 nt, Human
ugcucuguggucuuuua

SEQ ID NO: 880483 - RNA, 22 nt, Human
ucaaaguauuuuaacuguaucc

SEQ ID NO: 880484 - RNA, 22 nt, Human
ucacugaacucucauagagaaa

SEQ ID NO: 880485 - RNA, 23 nt, Human
cccugcacuaagaggagaaggug

SEQ ID NO: 880486 - RNA, 22 nt, Human
cuagaaccuaggaguacuaaag

SEQ ID NO: 880487 - RNA, 22 nt, Human
ccagcucugauuuugaccucca

SEQ ID NO: 880488 - RNA, 22 nt, Human
gcugcucuggcucugcaguguc

SEQ ID NO: 880489 - RNA, 22 nt, Human
gccuggggggcaugucauaaua

SEQ ID NO: 880490 - RNA, 20 nt, Human
acugagaccaauaaguagaa

SEQ ID NO: 880491 - RNA, 22 nt, Human
uugaaucucuugaaucucuguu

SEQ ID NO: 880492 - RNA, 22 nt, Human
aagggcuggccacauucugggu

SEQ ID NO: 880493 - RNA, 22 nt, Human
agugucauaugccacugcaucc

SEQ ID NO: 880494 - RNA, 22 nt, Human
uguauguauacacauagauacg

SEQ ID NO: 880495 - RNA, 22 nt, Human
ucagcuuuccugcagcuaaggg

SEQ ID NO: 880496 - RNA, 22 nt, Human
ugaaauucauuguuuuaugugu

SEQ ID NO: 880497 - RNA, 22 nt, Human
uucuguuuauuccuaggagcuc

SEQ ID NO: 880498 - RNA, 22 nt, Human
aaaguugcuggcuuugguucau

SEQ ID NO: 880499 - RNA, 20 nt, Human
cuccagacuacagaagagcc

SEQ ID NO: 880500 - RNA, 21 nt, Human
ugauacaggaaugguucuaug

SEQ ID NO: 880501 - RNA, 22 nt, Human
acuguggccaaagccucuggga

SEQ ID NO: 880502 - RNA, 20 nt, Human
agcuaggagaaagcauggag

SEQ ID NO: 880503 - RNA, 22 nt, Human
uaaacaaggguuacugagcaug

SEQ ID NO: 880504 - RNA, 22 nt, Human
cauguaaaaagaagaaucugga

SEQ ID NO: 880505 - RNA, 22 nt, Human
ggcuggcaccugcccuccgcug

SEQ ID NO: 880506 - RNA, 22 nt, Human
aagcccuguuaggcacugggga

SEQ ID NO: 880507 - RNA, 22 nt, Human
agugaaaacacuaguucuugcc

SEQ ID NO: 880508 - RNA, 22 nt, Human
cauaucauaggucuuggauaau

SEQ ID NO: 880509 - RNA, 22 nt, Human
uuuugguuuggcuccaaauagg

SEQ ID NO: 880510 - RNA, 22 nt, Human
acucuaaauagccucuuaaaca

SEQ ID NO: 880511 - RNA, 22 nt, Human
acucacugggucccggaagccc

SEQ ID NO: 880512 - RNA, 21 nt, Human
aguuugaugcaauuucugaga

SEQ ID NO: 880513 - RNA, 22 nt, Human
aucagaagcuuguagucucucu

SEQ ID NO: 880514 - RNA, 22 nt, Human
aggcagugagugugacuucaca

SEQ ID NO: 880515 - RNA, 22 nt, Human
cauuuacagcagacugaugaaa

SEQ ID NO: 880516 - RNA, 22 nt, Human
agugcagagagcaauacucuac

SEQ ID NO: 880517 - RNA, 22 nt, Human
uuuaaaugcuuuaagcaagggu

SEQ ID NO: 880518 - RNA, 22 nt, Human
caguuucuuaucuucaaaauug

SEQ ID NO: 880519 - RNA, 22 nt, Human
aaggcagccucugccagccggg

SEQ ID NO: 880520 - RNA, 22 nt, Human
gcagcagcagggagucugacuu

SEQ ID NO: 880521 - RNA, 22 nt, Human
uacuagaaauuaccuucucacu

SEQ ID NO: 880522 - RNA, 19 nt, Human
gcagcagcauuugguaaua

SEQ ID NO: 880523 - RNA, 22 nt, Human
ucagcugccucucccuggaaga

SEQ ID NO: 880524 - RNA, 20 nt, Human
uaagaacaagacuaggaagc

SEQ ID NO: 880525 - RNA, 22 nt, Human
acacagaaccucauagccucuc

SEQ ID NO: 880526 - RNA, 22 nt, Human
guuuaugaaauuucaggcauuu

SEQ ID NO: 880527 - RNA, 22 nt, Human
uuagcauuucuggaaucacaag

SEQ ID NO: 880528 - RNA, 22 nt, Human
gggcugaacucaagucagcucc

SEQ ID NO: 880529 - RNA, 21 nt, Human
auggagucaggggaaugggcc

SEQ ID NO: 880530 - RNA, 22 nt, Human
uaguuucugccucggaagcuga

SEQ ID NO: 880531 - RNA, 22 nt, Human
uucuacacuuuucauuagcuag

SEQ ID NO: 880532 - RNA, 22 nt, Human
cagagcacccaaggagcauuug

SEQ ID NO: 880533 - RNA, 22 nt, Human
agugucugggcucccuuggagc

SEQ ID NO: 880534 - RNA, 22 nt, Human
uucagaggugggcugagaggau

SEQ ID NO: 880535 - RNA, 22 nt, Human
ucagggcaaaagggaaaccauu

SEQ ID NO: 880536 - RNA, 22 nt, Human
ggcaggugcuaagagagguaaa

SEQ ID NO: 880537 - RNA, 22 nt, Human
cugcugugcagacagacucucu

SEQ ID NO: 880538 - RNA, 22 nt, Human
uggcagcauuuuuuccagaaca

SEQ ID NO: 880539 - RNA, 22 nt, Human
ucuugcagaagaagcugccaag

SEQ ID NO: 880540 - RNA, 22 nt, Human
gguguugcaguugaagacuggu

SEQ ID NO: 880541 - RNA, 22 nt, Human
ucagcaaaggaccagcacaggc

SEQ ID NO: 880542 - RNA, 22 nt, Human
auuccaggcaaagcagagaaga

SEQ ID NO: 880543 - RNA, 22 nt, Human
uagcuguuuuuugugaggaaau

SEQ ID NO: 880544 - RNA, 22 nt, Human
aauugagugcuagacaucauga

SEQ ID NO: 880545 - RNA, 22 nt, Human
ggugucagauacauaggaagua

SEQ ID NO: 880546 - RNA, 22 nt, Human
aaaguuuccugcuaagugcuau

SEQ ID NO: 880547 - RNA, 22 nt, Human
agaggcugugcagagggagugc

SEQ ID NO: 880548 - RNA, 22 nt, Human
aggcagcguagcaaggcuagua

SEQ ID NO: 880549 - RNA, 22 nt, Human
gcucugcuguguuuguucagca

SEQ ID NO: 880550 - RNA, 22 nt, Human
acugcuuacccggccugacuuc

SEQ ID NO: 880551 - RNA, 22 nt, Human
uguuuuaagagcgcacuuuaua

SEQ ID NO: 880552 - RNA, 22 nt, Human
cggcuucagcucaggccccucg

SEQ ID NO: 880553 - RNA, 22 nt, Human
gcagggugacguugcccaccuc

SEQ ID NO: 880554 - RNA, 22 nt, Human
ugagguggguggcuucuguuau

SEQ ID NO: 880555 - RNA, 22 nt, Human
gaagcaagugcaaggaagaggc

SEQ ID NO: 880556 - RNA, 22 nt, Human
cucuccccacacccucugcaug

SEQ ID NO: 880557 - RNA, 19 nt, Human
uuucuaagcuaaaugcuuc

SEQ ID NO: 880558 - RNA, 22 nt, Human
uuuguacaauuagcagaggcua

SEQ ID NO: 880559 - RNA, 22 nt, Human
auuauucuugagguguuuauug

SEQ ID NO: 880560 - RNA, 22 nt, Human
cuggcagguggagguugcagug

SEQ ID NO: 880561 - RNA, 22 nt, Human
uuuugguucugggauacagaga

SEQ ID NO: 880562 - RNA, 22 nt, Human
uuauguagucacuguggucuug

SEQ ID NO: 880563 - RNA, 22 nt, Human
ugggccacgugacccuuacccu

SEQ ID NO: 880564 - RNA, 22 nt, Human
ccucccuggccagagcagcagc

SEQ ID NO: 880565 - RNA, 22 nt, Human
gugucaugggagucagaaguga

SEQ ID NO: 880566 - RNA, 22 nt, Human
uuuucaguuugcacugcagugc

SEQ ID NO: 880567 - RNA, 22 nt, Human
cagagcaguggagaguaggucu

SEQ ID NO: 880568 - RNA, 22 nt, Human
ucugucuuugucaggaccagag

SEQ ID NO: 880569 - RNA, 22 nt, Human
agaggggugggcacagcgccca

SEQ ID NO: 880570 - RNA, 22 nt, Human
uuugucuuauccaaucucucag

SEQ ID NO: 880571 - RNA, 22 nt, Human
gcucccagcauugcuucccagg

SEQ ID NO: 880572 - RNA, 22 nt, Human
gaacuuuaaaacaaaguacagu

SEQ ID NO: 880573 - RNA, 22 nt, Human
aauaagaauugccagauuugaa

SEQ ID NO: 880574 - RNA, 22 nt, Human
uuccuuguggaaacuauggacg

SEQ ID NO: 880575 - RNA, 22 nt, Human
uaaauuacucaaugcacauaaa

SEQ ID NO: 880576 - RNA, 19 nt, Human
aguccaugaauggaggaug

SEQ ID NO: 880577 - RNA, 22 nt, Human
gaaguuauuuuaccuguuaaag

SEQ ID NO: 880578 - RNA, 22 nt, Human
aucucuuaugucacauaaacca

SEQ ID NO: 880579 - RNA, 22 nt, Human
ccaggggcuggugcugagcugg

SEQ ID NO: 880580 - RNA, 22 nt, Human
auuccacagccgauaccaugac

SEQ ID NO: 880581 - RNA, 22 nt, Human
uccugccuaccuugcggaggug

SEQ ID NO: 880582 - RNA, 22 nt, Human
ccuuucuugcuaagaguuuaug

SEQ ID NO: 880583 - RNA, 22 nt, Human
gaaguuuauuuuacacauccau

SEQ ID NO: 880584 - RNA, 22 nt, Human
gcugcaggcauuuuccugggca

SEQ ID NO: 880585 - RNA, 17 nt, Human
ugcaagaagauuaggaa

SEQ ID NO: 880586 - RNA, 22 nt, Human
ucauaacaaccuggaaggccag

SEQ ID NO: 880587 - RNA, 22 nt, Human
cugagcuguggccaccaauuua

SEQ ID NO: 880588 - RNA, 22 nt, Human
agugcaaagggcuguugagaag

SEQ ID NO: 880589 - RNA, 22 nt, Human
ucuggcuccaccuccuuuacua

SEQ ID NO: 880590 - RNA, 22 nt, Human
uguuuauucauggcuaaugaaa

SEQ ID NO: 880591 - RNA, 22 nt, Human
uccugagcaccuaugccauggc

SEQ ID NO: 880592 - RNA, 22 nt, Human
cucucugagugagggacaagcu

SEQ ID NO: 880593 - RNA, 22 nt, Human
uuucuaguccucaugcaucauu

SEQ ID NO: 880594 - RNA, 22 nt, Human
augcuugcccauguuucugaag

SEQ ID NO: 880595 - RNA, 22 nt, Human
acccugugucacaguggccugu

SEQ ID NO: 880596 - RNA, 22 nt, Human
aucacauuauguagugaaaagg

SEQ ID NO: 880597 - RNA, 22 nt, Human
gcugccccgagccauccuucag

SEQ ID NO: 880598 - RNA, 22 nt, Human
caugcagguuauaugugcuucu

SEQ ID NO: 880599 - RNA, 22 nt, Human
gagcuuccugcaggucacugug

SEQ ID NO: 880600 - RNA, 20 nt, Human
auggaggaagggcaagagaa

SEQ ID NO: 880601 - RNA, 22 nt, Human
accucucuuguagcugcuggug

SEQ ID NO: 880602 - RNA, 22 nt, Human
uaccauuucaguaaaaacuuag

SEQ ID NO: 880603 - RNA, 22 nt, Human
uagaacuugaaugugaaaucag

SEQ ID NO: 880604 - RNA, 22 nt, Human
cuucucuuccuuugucaacuga

SEQ ID NO: 880605 - RNA, 22 nt, Human
cagcagccuaggguuccaucau

SEQ ID NO: 880606 - RNA, 23 nt, Human
uugaauuucucuugcaauauuua

SEQ ID NO: 880607 - RNA, 22 nt, Human
uccugaccucuugcucugaccu

SEQ ID NO: 880608 - RNA, 16 nt, Human
gugacagacaauaggc

SEQ ID NO: 880609 - RNA, 22 nt, Human
cagucuuugaugcauccuagcc

SEQ ID NO: 880610 - RNA, 22 nt, Human
agauuugggggcuagggcuggu

SEQ ID NO: 880611 - RNA, 22 nt, Human
gagagcugggcuuugggugaag

SEQ ID NO: 880612 - RNA, 23 nt, Human
caguggagacucaugcuuccuua

SEQ ID NO: 880613 - RNA, 22 nt, Human
cagcccugcacgcugccuccgc

SEQ ID NO: 880614 - RNA, 22 nt, Human
agggcugagugggagagaguug

SEQ ID NO: 880615 - RNA, 22 nt, Human
cagccuggccugggacugcuga

SEQ ID NO: 880616 - RNA, 22 nt, Human
gaaaggagugcuuuccaggucu

SEQ ID NO: 880617 - RNA, 20 nt, Human
agugaggcaguucagugggc

SEQ ID NO: 880618 - RNA, 22 nt, Human
aggggagcuugccuggucaccc

SEQ ID NO: 880619 - RNA, 22 nt, Human
agagaugaaucuugagacucug

SEQ ID NO: 880620 - RNA, 22 nt, Human
uaggaaacaaaguaaugcaacu

SEQ ID NO: 880621 - RNA, 22 nt, Human
gccugcccacggggcuggcaua

SEQ ID NO: 880622 - RNA, 22 nt, Human
aauguuaauucacagccaaaua

SEQ ID NO: 880623 - RNA, 22 nt, Human
ucacacaggguucuggucucau

SEQ ID NO: 880624 - RNA, 22 nt, Human
cagcagcaacaacggaagccuu

SEQ ID NO: 880625 - RNA, 22 nt, Human
ucauggcuuuuucacuguucgc

SEQ ID NO: 880626 - RNA, 22 nt, Human
gaagaagacauggaacaauagu

SEQ ID NO: 880627 - RNA, 22 nt, Human
augugcacacagugucaugcaa

SEQ ID NO: 880628 - RNA, 22 nt, Human
gcuccaggagcucacagcucgc

SEQ ID NO: 880629 - RNA, 22 nt, Human
ggacgcagcgagggaagcagcc

SEQ ID NO: 880630 - RNA, 23 nt, Human
aagaguuuagagucuugcagagu

SEQ ID NO: 880631 - RNA, 22 nt, Human
ucucuguauucugauauucacu

SEQ ID NO: 880632 - RNA, 22 nt, Human
gcugucacaagcaucuggggca

SEQ ID NO: 880633 - RNA, 22 nt, Human
agaguuuggugaagcaauuuga

SEQ ID NO: 880634 - RNA, 22 nt, Human
auucuauuaauauuucuaggaa

SEQ ID NO: 880635 - RNA, 22 nt, Human
gugcugaagugaaauucaucaa

SEQ ID NO: 880636 - RNA, 22 nt, Human
ucugucacuuauuaagauggau

SEQ ID NO: 880637 - RNA, 22 nt, Human
ucuggaagguuggcucccaguu

SEQ ID NO: 880638 - RNA, 22 nt, Human
aguaaaacagagaaaucacuca

SEQ ID NO: 880639 - RNA, 22 nt, Human
uacaauguugguaaaguaucau

SEQ ID NO: 880640 - RNA, 22 nt, Human
gagcuuccauccuuacugugug

SEQ ID NO: 880641 - RNA, 22 nt, Human
agccuagcugugugaggccauc

SEQ ID NO: 880642 - RNA, 22 nt, Human
uuggaccucaguuauucuauca

SEQ ID NO: 880643 - RNA, 22 nt, Human
gaaggagggugcggaucugagc

SEQ ID NO: 880644 - RNA, 22 nt, Human
auauguguaaaugcauuuguuu

SEQ ID NO: 880645 - RNA, 22 nt, Human
ugccuggcaacuguggugggcu

SEQ ID NO: 880646 - RNA, 21 nt, Human
gcagagccugagguucuugag

SEQ ID NO: 880647 - RNA, 22 nt, Human
caucuguuuccuaaucuguagc

SEQ ID NO: 880648 - RNA, 22 nt, Human
uacugcauaacuggcauguggg

SEQ ID NO: 880649 - RNA, 22 nt, Human
aggcuucugcuguauuaacacu

SEQ ID NO: 880650 - RNA, 21 nt, Human
aggcagcaggauccagggaca

SEQ ID NO: 880651 - RNA, 22 nt, Human
cucugguuuuucuuccauuaag

SEQ ID NO: 880652 - RNA, 21 nt, Human
cagagcagcguucugcugugg

SEQ ID NO: 880653 - RNA, 20 nt, Human
aaguuuaggggaaagugaca

SEQ ID NO: 880654 - RNA, 22 nt, Human
ggcacagagcccagcuuccuag

SEQ ID NO: 880655 - RNA, 22 nt, Human
uggcaggggaggugcuugcuua

SEQ ID NO: 880656 - RNA, 22 nt, Human
uaaggacauuagaaaugaugcu

SEQ ID NO: 880657 - RNA, 17 nt, Human
ugguacaggcugaggga

SEQ ID NO: 880658 - RNA, 22 nt, Human
gcacagaaguaaaauacaaguc

SEQ ID NO: 880659 - RNA, 22 nt, Human
ccagagccucaacacagguccu

SEQ ID NO: 880660 - RNA, 22 nt, Human
uugggaaauuacucugcuagga

SEQ ID NO: 880661 - RNA, 22 nt, Human
ggcuccaggagggccuuggcca

SEQ ID NO: 880662 - RNA, 23 nt, Human
cagggcugguagggaagagcgug

SEQ ID NO: 880663 - RNA, 22 nt, Human
agccccagccccucucucacaa

SEQ ID NO: 880664 - RNA, 17 nt, Human
ggcuuacaggugccagc

SEQ ID NO: 880665 - RNA, 22 nt, Human
gguucagggaugugggugaugc

SEQ ID NO: 880666 - RNA, 22 nt, Human
agcuuuagaauuguucagcaag

SEQ ID NO: 880667 - RNA, 22 nt, Human
uaaagacaauaggaaaguuguu

SEQ ID NO: 880668 - RNA, 22 nt, Human
agagcugauuugauuacagugc

SEQ ID NO: 880669 - RNA, 22 nt, Human
ugggguucuuuguuuccugccu

SEQ ID NO: 880670 - RNA, 22 nt, Human
aggagaggucucccuuccccag

SEQ ID NO: 880671 - RNA, 22 nt, Human
ccuggcugccgagugugcagcg

SEQ ID NO: 880672 - RNA, 22 nt, Human
ugcgcccagccaagucuggcac

SEQ ID NO: 880673 - RNA, 22 nt, Human
guggacugcgcuugagggggcc

SEQ ID NO: 880674 - RNA, 22 nt, Human
uagaugaaugacuuauauguca

SEQ ID NO: 880675 - RNA, 22 nt, Human
cagcuggaggagcagcuuccag

SEQ ID NO: 880676 - RNA, 22 nt, Human
uuucaucuugauucuauauggc

SEQ ID NO: 880677 - RNA, 22 nt, Human
uauguacuuuccugggaauguu

SEQ ID NO: 880678 - RNA, 22 nt, Human
ccccucauucucugagcuaguu

SEQ ID NO: 880679 - RNA, 22 nt, Human
ugagauaacaaaauuaucuuca

SEQ ID NO: 880680 - RNA, 22 nt, Human
agucacaguucugcugucugag

SEQ ID NO: 880681 - RNA, 22 nt, Human
gcauuucagaaagguuaccaac

SEQ ID NO: 880682 - RNA, 22 nt, Human
ggagggcagaguccccugcuga

SEQ ID NO: 880683 - RNA, 22 nt, Human
aaggccaggccuagcacggagg

SEQ ID NO: 880684 - RNA, 22 nt, Human
acaugggagagaaauaaaugua

SEQ ID NO: 880685 - RNA, 22 nt, Human
uaagaacauuuucggaaagaua

SEQ ID NO: 880686 - RNA, 20 nt, Human
auaguaaugaagucuuguuc

SEQ ID NO: 880687 - RNA, 22 nt, Human
aacuuuaaagaggaggcuuggg

SEQ ID NO: 880688 - RNA, 22 nt, Human
ucuguuccucaaggucugugug

SEQ ID NO: 880689 - RNA, 22 nt, Human
ugaggccucauuuagggagagg

SEQ ID NO: 880690 - RNA, 22 nt, Human
cagacaggagacuggaucaugg

SEQ ID NO: 880691 - RNA, 22 nt, Human
agucuuugaaguucugacagag

SEQ ID NO: 880692 - RNA, 22 nt, Human
gguugaaucauucuuugcaccg

SEQ ID NO: 880693 - RNA, 22 nt, Human
gugauacaggauggugauaaau

SEQ ID NO: 880694 - RNA, 19 nt, Human
aucaccugguguuuccuug

SEQ ID NO: 880695 - RNA, 22 nt, Human
ggagggugcauuuuacccugug

SEQ ID NO: 880696 - RNA, 22 nt, Human
cucuuuguauuucuuugggcca

SEQ ID NO: 880697 - RNA, 22 nt, Human
ugguauaaaagaguaaacuaug

SEQ ID NO: 880698 - RNA, 22 nt, Human
aguguuggaccgagguggagcc

SEQ ID NO: 880699 - RNA, 22 nt, Human
auuccuugggaauuauugaaug

SEQ ID NO: 880700 - RNA, 22 nt, Human
gcuuucugguucucaaagcacu

SEQ ID NO: 880701 - RNA, 22 nt, Human
guuucuguguuagaugagucuu

SEQ ID NO: 880702 - RNA, 22 nt, Human
uccuuuggagcuugacugguag

SEQ ID NO: 880703 - RNA, 22 nt, Human
uuuacgaaaagugacuaauagg

SEQ ID NO: 880704 - RNA, 22 nt, Human
ucucacacaacauguuacuuug

SEQ ID NO: 880705 - RNA, 22 nt, Human
acaaugaugcagaugaguaaga

SEQ ID NO: 880706 - RNA, 21 nt, Human
agcugagguaaggcaagagag

SEQ ID NO: 880707 - RNA, 22 nt, Human
ugaggcaggacugagcgggaug

SEQ ID NO: 880708 - RNA, 22 nt, Human
uauuccaauugguuguaaagaa

SEQ ID NO: 880709 - RNA, 22 nt, Human
uaaguagucagacauaccccau

SEQ ID NO: 880710 - RNA, 22 nt, Human
ggguuggauuacuuagggagaa

SEQ ID NO: 880711 - RNA, 16 nt, Human
aaggcugauuuucccu

SEQ ID NO: 880712 - RNA, 22 nt, Human
ucccucagcucauauuuaugcc

SEQ ID NO: 880713 - RNA, 22 nt, Human
auaagguuaacaucaucaguga

SEQ ID NO: 880714 - RNA, 22 nt, Human
uucauucuuuuacaugugaaua

SEQ ID NO: 880715 - RNA, 22 nt, Human
cuuuuucauuggcuuuaggaca

SEQ ID NO: 880716 - RNA, 22 nt, Human
acagggccaggugagaggugcu

SEQ ID NO: 880717 - RNA, 21 nt, Human
uucaucagccagaaaucaagc

SEQ ID NO: 880718 - RNA, 22 nt, Human
ugauuauauucuaacuucauaa

SEQ ID NO: 880719 - RNA, 22 nt, Human
cuuuugauugagcaguuucaaa

SEQ ID NO: 880720 - RNA, 22 nt, Human
cuuguacaggauauuauaggcu

SEQ ID NO: 880721 - RNA, 22 nt, Human
aaacacacagaaaugaaugagg

SEQ ID NO: 880722 - RNA, 19 nt, Human
ggaagagaggaaaggugga

SEQ ID NO: 880723 - RNA, 22 nt, Human
cacaggaauuagcagccuaaaa

SEQ ID NO: 880724 - RNA, 22 nt, Human
agggcuccuaugaugcucugcc

SEQ ID NO: 880725 - RNA, 22 nt, Human
ugagguggccgaggagcaggac

SEQ ID NO: 880726 - RNA, 22 nt, Human
uagaaagucaaaacacuguguu

SEQ ID NO: 880727 - RNA, 22 nt, Human
ggcuagaguggaacuggagcgg

SEQ ID NO: 880728 - RNA, 22 nt, Human
auguagaauuccuucuacuuug

SEQ ID NO: 880729 - RNA, 22 nt, Human
auguauuugcuuguuauggauu

SEQ ID NO: 880730 - RNA, 22 nt, Human
uuuaucaguagcaaaguuuuaa

SEQ ID NO: 880731 - RNA, 19 nt, Human
ugcuggagugacauucuga

SEQ ID NO: 880732 - RNA, 22 nt, Human
acugcuuuuagaaaucuauaga

SEQ ID NO: 880733 - RNA, 22 nt, Human
cacaaggcacauuccuugucca

SEQ ID NO: 880734 - RNA, 22 nt, Human
cccagcucugcagaccugcccu

SEQ ID NO: 880735 - RNA, 21 nt, Human
aagagcuggaucaaggauaag

SEQ ID NO: 880736 - RNA, 22 nt, Human
agcuggaauccuacuucuaaca

SEQ ID NO: 880737 - RNA, 22 nt, Human
ucaggaggcggugcugccuuug

SEQ ID NO: 880738 - RNA, 22 nt, Human
uggccagccuggugcuugcucc

SEQ ID NO: 880739 - RNA, 22 nt, Human
cagguguugauacuaaucgugg

SEQ ID NO: 880740 - RNA, 22 nt, Human
aaaaguauaggguuuggaguca

SEQ ID NO: 880741 - RNA, 22 nt, Human
uccuugcacauuaucugggaaa

SEQ ID NO: 880742 - RNA, 22 nt, Human
aggcaguggaugucaggaaugg

SEQ ID NO: 880743 - RNA, 22 nt, Human
caucuuuaacaauuuacaaugu

SEQ ID NO: 880744 - RNA, 22 nt, Human
uaauccaauggcacaauguaug

SEQ ID NO: 880745 - RNA, 22 nt, Human
ugugugcagcggcaggugaagu

SEQ ID NO: 880746 - RNA, 22 nt, Human
aacaucuuuguaguguucuccu

SEQ ID NO: 880747 - RNA, 22 nt, Human
augauguaccacuuucucaguu

SEQ ID NO: 880748 - RNA, 22 nt, Human
cugccuggcccagggaugggcc

SEQ ID NO: 880749 - RNA, 22 nt, Human
agagucuuccaggcagccugag

SEQ ID NO: 880750 - RNA, 18 nt, Human
gcagugaagaaagagcuu

SEQ ID NO: 880751 - RNA, 17 nt, Human
agcuucaguugcaaaac

SEQ ID NO: 880752 - RNA, 21 nt, Human
ccagacuggccuaugugguag

SEQ ID NO: 880753 - RNA, 22 nt, Human
aaccacuggucugagguacaag

SEQ ID NO: 880754 - RNA, 22 nt, Human
gaaguauuauagcauauuagcc

SEQ ID NO: 880755 - RNA, 21 nt, Human
uuuauuaacaacuguggacgu

SEQ ID NO: 880756 - RNA, 22 nt, Human
uaaucucuagcccaugcaaaga

SEQ ID NO: 880757 - RNA, 22 nt, Human
ccagcucucaaggcucccuggg

SEQ ID NO: 880758 - RNA, 19 nt, Human
aggcugugagggaggacuc

SEQ ID NO: 880759 - RNA, 22 nt, Human
gacuccagcauauacuuuuagu

SEQ ID NO: 880760 - RNA, 22 nt, Human
cgccccagucuguaggugcccc

SEQ ID NO: 880761 - RNA, 22 nt, Human
uccuggcccaaucugcccauga

SEQ ID NO: 880762 - RNA, 22 nt, Human
cagaaaggacagagugagggug

SEQ ID NO: 880763 - RNA, 22 nt, Human
uggaggcauuugauguucauaa

SEQ ID NO: 880764 - RNA, 22 nt, Human
uggccugucuuguugugcuaga

SEQ ID NO: 880765 - RNA, 23 nt, Human
uccuccugacacagccugaguga

SEQ ID NO: 880766 - RNA, 22 nt, Human
acagagguuaggauggguugua

SEQ ID NO: 880767 - RNA, 22 nt, Human
uccuuuaugugaguuguuuccc

SEQ ID NO: 880768 - RNA, 22 nt, Human
ucauauaacuggauauuuucaa

SEQ ID NO: 880769 - RNA, 22 nt, Human
caggcuauauuuaaagaagaac

SEQ ID NO: 880770 - RNA, 22 nt, Human
agcccagcccgggcugcgcuuu

SEQ ID NO: 880771 - RNA, 22 nt, Human
uugcaucagcaggcauaauugg

SEQ ID NO: 880772 - RNA, 22 nt, Human
cauacaagcgugcaugugcuug

SEQ ID NO: 880773 - RNA, 22 nt, Human
cacagcugccaugcagucagug

SEQ ID NO: 880774 - RNA, 22 nt, Human
ccugaggggcugcaggccagcu

SEQ ID NO: 880775 - RNA, 22 nt, Human
gcacggcuaauuuuuguauuuu

SEQ ID NO: 880776 - RNA, 22 nt, Human
uucaauucuaaacuaauauucu

SEQ ID NO: 880777 - RNA, 22 nt, Human
uuucuuuugaauaguguguggu

SEQ ID NO: 880778 - RNA, 22 nt, Human
ucaagccacuggcagaagauua

SEQ ID NO: 880779 - RNA, 22 nt, Human
augccagguacagggguagggu

SEQ ID NO: 880780 - RNA, 22 nt, Human
cuacagaggacacaaagaucuu

SEQ ID NO: 880781 - RNA, 22 nt, Human
uugauucuggugacugauggaa

SEQ ID NO: 880782 - RNA, 22 nt, Human
ucugagacaacuuagcccucga

SEQ ID NO: 880783 - RNA, 22 nt, Human
uagggguguuucgagagagguu

SEQ ID NO: 880784 - RNA, 22 nt, Human
gaggccugggagccuguccucc

SEQ ID NO: 880785 - RNA, 22 nt, Human
uauaugcagugugucauucaag

SEQ ID NO: 880786 - RNA, 21 nt, Human
gccugcugccuguggccgguc

SEQ ID NO: 880787 - RNA, 20 nt, Human
cguguguggcuauuuugggu

SEQ ID NO: 880788 - RNA, 22 nt, Human
uggcuggcccugggagugcaga

SEQ ID NO: 880789 - RNA, 22 nt, Human
gaagcuguguugauggcaugga

SEQ ID NO: 880790 - RNA, 22 nt, Human
uaauuggcuuuacuuaaagucc

SEQ ID NO: 880791 - RNA, 22 nt, Human
gucaaugcuuuaguuucuggua

SEQ ID NO: 880792 - RNA, 22 nt, Human
agagguaaagagaggggaaauu

SEQ ID NO: 880793 - RNA, 22 nt, Human
ugccuggcaaugccagaagcca

SEQ ID NO: 880794 - RNA, 22 nt, Human
ggagcugugcagugacuacaga

SEQ ID NO: 880795 - RNA, 22 nt, Human
uggcucuggggacaguaagucc

SEQ ID NO: 880796 - RNA, 22 nt, Human
uucaacaauuaaguaucagccu

SEQ ID NO: 880797 - RNA, 22 nt, Human
ggugagucauuuggcucaagag

SEQ ID NO: 880798 - RNA, 22 nt, Human
auuuggauucuuauuuagcacu

SEQ ID NO: 880799 - RNA, 22 nt, Human
ugagaaugugcaauauccuucc

SEQ ID NO: 880800 - RNA, 22 nt, Human
caggcagcgcucguggccuggc

SEQ ID NO: 880801 - RNA, 22 nt, Human
caucagugcccuuggggaugcc

SEQ ID NO: 880802 - RNA, 22 nt, Human
gugugggaauggcggucgugca

SEQ ID NO: 880803 - RNA, 22 nt, Human
caaagccaggcuuucuaaugua

SEQ ID NO: 880804 - RNA, 22 nt, Human
uugcaaagagauaauccuaggc

SEQ ID NO: 880805 - RNA, 22 nt, Human
cagccacuguggucuagcugca

SEQ ID NO: 880806 - RNA, 22 nt, Human
agacagugauggacaggcagac

SEQ ID NO: 880807 - RNA, 22 nt, Human
gagguggcugucagcuucacuu

SEQ ID NO: 880808 - RNA, 19 nt, Human
uguguguuuauauauguau

SEQ ID NO: 880809 - RNA, 22 nt, Human
ggaacuggagaaugcccucuuu

SEQ ID NO: 880810 - RNA, 22 nt, Human
uuauuccaguaaucucuguaau

SEQ ID NO: 880811 - RNA, 22 nt, Human
ggaagauuuuccauuccucuuu

SEQ ID NO: 880812 - RNA, 22 nt, Human
ucuguguuugccauccuugcuc

SEQ ID NO: 880813 - RNA, 22 nt, Human
uuagaaguaaggucagauuucu

SEQ ID NO: 880814 - RNA, 22 nt, Human
gugcaguugaagcauggggaga

SEQ ID NO: 880815 - RNA, 22 nt, Human
aaggcaugaaagcgaaaugaga

SEQ ID NO: 880816 - RNA, 22 nt, Human
ugcagaauguggacaguggguu

SEQ ID NO: 880817 - RNA, 22 nt, Human
auucaacauauucugaguaaaa

SEQ ID NO: 880818 - RNA, 22 nt, Human
agcucacaguguccuuccucaa

SEQ ID NO: 880819 - RNA, 22 nt, Human
aaacuuuguucguccagacuca

SEQ ID NO: 880820 - RNA, 19 nt, Human
ugggugugaccaucucugc

SEQ ID NO: 880821 - RNA, 22 nt, Human
cccaggcuggagggcaguguca

SEQ ID NO: 880822 - RNA, 22 nt, Human
uaagugauuuguaguauacuau

SEQ ID NO: 880823 - RNA, 22 nt, Human
ggucuggaugcugagguuccca

SEQ ID NO: 880824 - RNA, 22 nt, Human
ggaaacauauucugaugugcau

SEQ ID NO: 880825 - RNA, 21 nt, Human
ucugggcccaugcugccucac

SEQ ID NO: 880826 - RNA, 22 nt, Human
agcccagcaaagggguuugaga

SEQ ID NO: 880827 - RNA, 22 nt, Human
cauggcugaacacucagugacu

SEQ ID NO: 880828 - RNA, 22 nt, Human
aaagccaggguccaggccugcc

SEQ ID NO: 880829 - RNA, 21 nt, Human
uggacuggugaguuuaggcug

SEQ ID NO: 880830 - RNA, 22 nt, Human
cacccugcucugcugugcggcc

SEQ ID NO: 880831 - RNA, 22 nt, Human
aaaagucuuggggaaggccagg

SEQ ID NO: 880832 - RNA, 22 nt, Human
guuuggcucugggugccugugc

SEQ ID NO: 880833 - RNA, 22 nt, Human
gcuguggccuggcgcagagcug

SEQ ID NO: 880834 - RNA, 22 nt, Human
cugagguaaaauuucuauuuug

SEQ ID NO: 880835 - RNA, 22 nt, Human
uuccuaaaagaauacacuggau

SEQ ID NO: 880836 - RNA, 22 nt, Human
uuggcagaugagaccagggguu

SEQ ID NO: 880837 - RNA, 21 nt, Human
uagcuuuaauauucccacauu

SEQ ID NO: 880838 - RNA, 22 nt, Human
gaggagggcaguuccucuuuua

SEQ ID NO: 880839 - RNA, 22 nt, Human
uuaacaaaguaacgggaaaaga

SEQ ID NO: 880840 - RNA, 22 nt, Human
aauuuggaagauguuguuuauc

SEQ ID NO: 880841 - RNA, 22 nt, Human
caucaaauacuacauggguugg

SEQ ID NO: 880842 - RNA, 22 nt, Human
gcagaugauguagacagacagu

SEQ ID NO: 880843 - RNA, 22 nt, Human
aggaucuugcuguagaggauag

SEQ ID NO: 880844 - RNA, 22 nt, Human
ggggaggaccuuuccaaggcuu

SEQ ID NO: 880845 - RNA, 22 nt, Human
uccuuagacaaagagugggcuu

SEQ ID NO: 880846 - RNA, 22 nt, Human
ggcugcaggaugcccagccgug

SEQ ID NO: 880847 - RNA, 22 nt, Human
aauucaaggaucuguuaaaucu

SEQ ID NO: 880848 - RNA, 22 nt, Human
acucuaaaagugaagugugguc

SEQ ID NO: 880849 - RNA, 22 nt, Human
cuuagaaauuguuacucauuca

SEQ ID NO: 880850 - RNA, 20 nt, Human
acuggcagccugccugcugu

SEQ ID NO: 880851 - RNA, 22 nt, Human
uccagaggcaaaaagguaugga

SEQ ID NO: 880852 - RNA, 22 nt, Human
gggcagguguuuccaaggugag

SEQ ID NO: 880853 - RNA, 22 nt, Human
uguucacacagucuauacggau

SEQ ID NO: 880854 - RNA, 22 nt, Human
cacuauaugccuuugaaauaca

SEQ ID NO: 880855 - RNA, 21 nt, Human
uauacagaggggaacaggaga

SEQ ID NO: 880856 - RNA, 22 nt, Human
agugcagagaccuggucaggca

SEQ ID NO: 880857 - RNA, 22 nt, Human
aguaaacauaauuuaccuguag

SEQ ID NO: 880858 - RNA, 22 nt, Human
cuaaggaauuggagcauguguu

SEQ ID NO: 880859 - RNA, 22 nt, Human
acccagagauggaccuggcugc

SEQ ID NO: 880860 - RNA, 22 nt, Human
auuagcauugcuacucucaaga

SEQ ID NO: 880861 - RNA, 22 nt, Human
augugggaaauacaagcuaaaa

SEQ ID NO: 880862 - RNA, 22 nt, Human
aguucugaaugaggaaucuggg

SEQ ID NO: 880863 - RNA, 22 nt, Human
auggccagcuuauaggggcuca

SEQ ID NO: 880864 - RNA, 22 nt, Human
ccccuccuggccacacugucag

SEQ ID NO: 880865 - RNA, 22 nt, Human
uuguuauuuacaacaauccuau

SEQ ID NO: 880866 - RNA, 22 nt, Human
uggaagagguggaaguggcuuc

SEQ ID NO: 880867 - RNA, 22 nt, Human
ugcauagggaaccucaugcauu

SEQ ID NO: 880868 - RNA, 22 nt, Human
ccugggugguuccggcaaggag

SEQ ID NO: 880869 - RNA, 22 nt, Human
uaggaaauuugaaauauguggg

SEQ ID NO: 880870 - RNA, 22 nt, Human
uugcagggcuggaacauggaau

SEQ ID NO: 880871 - RNA, 19 nt, Human
ugucuccucaugcaagugu

SEQ ID NO: 880872 - RNA, 22 nt, Human
agcuuuuucacuuuggauggga

SEQ ID NO: 880873 - RNA, 22 nt, Human
auucaggagugugccaggaagg

SEQ ID NO: 880874 - RNA, 22 nt, Human
acagugauauuuuuacucaaau

SEQ ID NO: 880875 - RNA, 22 nt, Human
gcccugagacugagcauggguu

SEQ ID NO: 880876 - RNA, 22 nt, Human
uauuuucuguggaggaccagau

SEQ ID NO: 880877 - RNA, 22 nt, Human
aggccaggaccauuagcccaga

SEQ ID NO: 880878 - RNA, 22 nt, Human
aggaaggguggauaguaacgug

SEQ ID NO: 880879 - RNA, 22 nt, Human
auuuugugaacccucaagcaau

SEQ ID NO: 880880 - RNA, 22 nt, Human
uaugauaugcacuuuaucagaa

SEQ ID NO: 880881 - RNA, 22 nt, Human
ugccugaugcaggaguaucaga

SEQ ID NO: 880882 - RNA, 22 nt, Human
cugcugucucacuggugugguu

SEQ ID NO: 880883 - RNA, 22 nt, Human
ucaggcuguaaauggugugggu

SEQ ID NO: 880884 - RNA, 22 nt, Human
caucuucacauauuuccaauga

SEQ ID NO: 880885 - RNA, 22 nt, Human
acagaauugaaaguauaaucug

SEQ ID NO: 880886 - RNA, 22 nt, Human
aacauaucauuuaacccucacc

SEQ ID NO: 880887 - RNA, 22 nt, Human
ucugcauaccccuuuagcagag

SEQ ID NO: 880888 - RNA, 22 nt, Human
guacaacaggauugauguacca

SEQ ID NO: 880889 - RNA, 22 nt, Human
guccuuggcacccaugugauuc

SEQ ID NO: 880890 - RNA, 22 nt, Human
gaugcaaacugugacauagagu

SEQ ID NO: 880891 - RNA, 22 nt, Human
uacuauacucuccauuuuauag

SEQ ID NO: 880892 - RNA, 18 nt, Human
ucuuuuccuuccacuucc

SEQ ID NO: 880893 - RNA, 22 nt, Human
uguggaaaagccccacaggacu

SEQ ID NO: 880894 - RNA, 22 nt, Human
acacaguguccuucuacuugcc

SEQ ID NO: 880895 - RNA, 22 nt, Human
aagcuguguccuagagguguaa

SEQ ID NO: 880896 - RNA, 22 nt, Human
uugaaagauagugaagccagcc

SEQ ID NO: 880897 - RNA, 22 nt, Human
ugaggcuuccaacaugugagaa

SEQ ID NO: 880898 - RNA, 22 nt, Human
ucauuuaauaauuuuugaguag

SEQ ID NO: 880899 - RNA, 22 nt, Human
ugucagugacagauuuaugauc

SEQ ID NO: 880900 - RNA, 22 nt, Human
aaugacauaagugcagaugcua

SEQ ID NO: 880901 - RNA, 22 nt, Human
ugagccagguuuuccaucauuc

SEQ ID NO: 880902 - RNA, 22 nt, Human
ccaggugugcucugcaguggau

SEQ ID NO: 880903 - RNA, 22 nt, Human
guucuucccuuuggggauugug

SEQ ID NO: 880904 - RNA, 22 nt, Human
ucauucuugcguaugccauggu

SEQ ID NO: 880905 - RNA, 22 nt, Human
auggaagaaagagacaauuuga

SEQ ID NO: 880906 - RNA, 20 nt, Human
gcaacucacccacagcagcu

SEQ ID NO: 880907 - RNA, 22 nt, Human
ugaguauuuuaaguucucaauc

SEQ ID NO: 880908 - RNA, 22 nt, Human
ugcuauaagcuccacgcuguag

SEQ ID NO: 880909 - RNA, 22 nt, Human
cuggaagggaaaucucuuggca

SEQ ID NO: 880910 - RNA, 22 nt, Human
cagcgguggcaaggugacugug

SEQ ID NO: 880911 - RNA, 22 nt, Human
uggccagacagagaggcuuugu

SEQ ID NO: 880912 - RNA, 22 nt, Human
ugagguaugagguucuaugauc

SEQ ID NO: 880913 - RNA, 22 nt, Human
cagacugggagucaggaagaag

SEQ ID NO: 880914 - RNA, 22 nt, Human
acuggacagaggaaauauggag

SEQ ID NO: 880915 - RNA, 22 nt, Human
acagauuuguucuuuugggcua

SEQ ID NO: 880916 - RNA, 22 nt, Human
aggucuagauuuauagacagca

SEQ ID NO: 880917 - RNA, 22 nt, Human
gaggcagcugaaggagugacag

SEQ ID NO: 880918 - RNA, 22 nt, Human
ugcagggugguuugaagggucu

SEQ ID NO: 880919 - RNA, 22 nt, Human
aaggcccuggaugguuuugaga

SEQ ID NO: 880920 - RNA, 22 nt, Human
uuauucauuaacagggaccaaa

SEQ ID NO: 880921 - RNA, 20 nt, Human
gggcucugcauccaucagcc

SEQ ID NO: 880922 - RNA, 22 nt, Human
cacaugcaguuuacgucacuga

SEQ ID NO: 880923 - RNA, 22 nt, Human
uaggcaaggcauuuggcucuug

SEQ ID NO: 880924 - RNA, 22 nt, Human
aaagaccauguuuacagcuagg

SEQ ID NO: 880925 - RNA, 22 nt, Human
caggcuucgcucugugggcagg

SEQ ID NO: 880926 - RNA, 22 nt, Human
uuggcagcuacuuccccagugc

SEQ ID NO: 880927 - RNA, 22 nt, Human
gacauugugguuauuaaauguu

SEQ ID NO: 880928 - RNA, 22 nt, Human
ugcccucccuguacugucagga

SEQ ID NO: 880929 - RNA, 22 nt, Human
agcaccuccuuagcuaugacca

SEQ ID NO: 880930 - RNA, 22 nt, Human
uuauucaucagugcauuaauuu

SEQ ID NO: 880931 - RNA, 22 nt, Human
aaugcuuauuauuaauagaaug

SEQ ID NO: 880932 - RNA, 22 nt, Human
ucccugggccuaucuuagcucc

SEQ ID NO: 880933 - RNA, 22 nt, Human
ugaaagacaagguuuuuucaga

SEQ ID NO: 880934 - RNA, 22 nt, Human
acuuucauguuggugaaggguu

SEQ ID NO: 880935 - RNA, 22 nt, Human
caucaucaacuggcagguaagu

SEQ ID NO: 880936 - RNA, 22 nt, Human
uagaaacauucaguugcagucc

SEQ ID NO: 880937 - RNA, 22 nt, Human
auguccuugagacccuccucgg

SEQ ID NO: 880938 - RNA, 22 nt, Human
acagcagccagccacugugagc

SEQ ID NO: 880939 - RNA, 22 nt, Human
uccugggcuucacagacucugu

SEQ ID NO: 880940 - RNA, 22 nt, Human
caggacacaggguguggcugau

SEQ ID NO: 880941 - RNA, 22 nt, Human
uaaaggcacggaguuguuaugg

SEQ ID NO: 880942 - RNA, 21 nt, Human
cagaggccuaucacagacucc

SEQ ID NO: 880943 - RNA, 22 nt, Human
accagaggaagggaaucucaag

SEQ ID NO: 880944 - RNA, 20 nt, Human
ucuguguuucagcugcuuga

SEQ ID NO: 880945 - RNA, 22 nt, Human
cagauaaauagauagauaaacu

SEQ ID NO: 880946 - RNA, 22 nt, Human
acagcuucacccauuaucccug

SEQ ID NO: 880947 - RNA, 22 nt, Human
cuuccccaggaccucugcuaaa

SEQ ID NO: 880948 - RNA, 22 nt, Human
uggcuuccuguuucccagaaag

SEQ ID NO: 880949 - RNA, 22 nt, Human
uagcagcuccauuucucuggca

SEQ ID NO: 880950 - RNA, 22 nt, Human
uuuggucucugugcauccuccu

SEQ ID NO: 880951 - RNA, 22 nt, Human
auuugcuuccuaauacucauau

SEQ ID NO: 880952 - RNA, 22 nt, Human
ccuggguuggagagcaauggug

SEQ ID NO: 880953 - RNA, 22 nt, Human
uaaguccuagaugauucacaga

SEQ ID NO: 880954 - RNA, 22 nt, Human
uccaggcaugguguaauuuugc

SEQ ID NO: 880955 - RNA, 22 nt, Human
ccagcucucuguccuccccaca

SEQ ID NO: 880956 - RNA, 22 nt, Human
cccaggagguggagguugcggu

SEQ ID NO: 880957 - RNA, 22 nt, Human
ccuggccauagggcccaggaaa

SEQ ID NO: 880958 - RNA, 22 nt, Human
ucugagaauagugccacugugg

SEQ ID NO: 880959 - RNA, 21 nt, Human
caauuucaugggaagauggga

SEQ ID NO: 880960 - RNA, 22 nt, Human
aucccugcccucauggagcuua

SEQ ID NO: 880961 - RNA, 22 nt, Human
augggcagaguggggacaggaa

SEQ ID NO: 880962 - RNA, 22 nt, Human
aacaucucagaagugacccuga

SEQ ID NO: 880963 - RNA, 22 nt, Human
uucagugcuaaaaagucucaag

SEQ ID NO: 880964 - RNA, 21 nt, Human
gaggccacuaauaggggcaga

SEQ ID NO: 880965 - RNA, 22 nt, Human
uuuugaaagggugauuuggcuu

SEQ ID NO: 880966 - RNA, 22 nt, Human
caggaggaagaacucugcaaca

SEQ ID NO: 880967 - RNA, 22 nt, Human
ucugcaaguagaugacagugag

SEQ ID NO: 880968 - RNA, 22 nt, Human
auguuuccagcucagcugcagg

SEQ ID NO: 880969 - RNA, 22 nt, Human
ucaguaaaugagcaaaaauuuc

SEQ ID NO: 880970 - RNA, 22 nt, Human
cuagaggggaaaaaggucuugu

SEQ ID NO: 880971 - RNA, 22 nt, Human
ugaugugaacucuugauaugau

SEQ ID NO: 880972 - RNA, 22 nt, Human
ggugggcaggucacucugccuc

SEQ ID NO: 880973 - RNA, 22 nt, Human
ugcuggaauaauuucauguuaa

SEQ ID NO: 880974 - RNA, 22 nt, Human
uucuaacuaaagucuuuguuuu

SEQ ID NO: 880975 - RNA, 22 nt, Human
auggccagauuauaugguuuuu

SEQ ID NO: 880976 - RNA, 22 nt, Human
uggugcugccaccuccucugcu

SEQ ID NO: 880977 - RNA, 22 nt, Human
ugcacagcuggcucuccuuuuc

SEQ ID NO: 880978 - RNA, 20 nt, Human
ucugggagggacaagucucc

SEQ ID NO: 880979 - RNA, 22 nt, Human
cagauuucaugcgaaauggggu

SEQ ID NO: 880980 - RNA, 22 nt, Human
auaguacacauccuacaauguu

SEQ ID NO: 880981 - RNA, 22 nt, Human
auguguauuacccuuucauucc

SEQ ID NO: 880982 - RNA, 22 nt, Human
aggcuucauuacagugguucaa

SEQ ID NO: 880983 - RNA, 22 nt, Human
agugugacauaagagcccugga

SEQ ID NO: 880984 - RNA, 22 nt, Human
gggcugagugaccucaggccaa

SEQ ID NO: 880985 - RNA, 22 nt, Human
auaugagagaggaaagauuuua

SEQ ID NO: 880986 - RNA, 22 nt, Human
aagggagaaaacuuguggcuua

SEQ ID NO: 880987 - RNA, 22 nt, Human
cuucucaaaguugugaaucagg

SEQ ID NO: 880988 - RNA, 22 nt, Human
uguggcucggccagcugcugaa

SEQ ID NO: 880989 - RNA, 22 nt, Human
cauuuguaguaucuguuuauau

SEQ ID NO: 880990 - RNA, 22 nt, Human
uguaucaagaucagcagcuguu

SEQ ID NO: 880991 - RNA, 22 nt, Human
uggcucugggcaccguguccac

SEQ ID NO: 880992 - RNA, 22 nt, Human
uuuuccucuguuauuaguguga

SEQ ID NO: 880993 - RNA, 22 nt, Human
cuguucuucuaguccacugaca

SEQ ID NO: 880994 - RNA, 22 nt, Human
gcaggcagccacgauucccuug

SEQ ID NO: 880995 - RNA, 22 nt, Human
ggccgugcuccaaagucaucgu

SEQ ID NO: 880996 - RNA, 22 nt, Human
guucaucucacagauaggcagu

SEQ ID NO: 880997 - RNA, 22 nt, Human
uucucuuauucuggauaugcag

SEQ ID NO: 880998 - RNA, 22 nt, Human
uacauugaccuuuguuagguug

SEQ ID NO: 880999 - RNA, 22 nt, Human
cuuugcagaaauaaacuugaug

SEQ ID NO: 881000 - RNA, 22 nt, Human
aguucugauaaaggaggaagau

SEQ ID NO: 881001 - RNA, 22 nt, Human
ugcuggaaaguuaaauuuugga

SEQ ID NO: 881002 - RNA, 22 nt, Human
caguauguacucuuaucaugua

SEQ ID NO: 881003 - RNA, 19 nt, Human
ugugugcugacugccagag

SEQ ID NO: 881004 - RNA, 22 nt, Human
gaacuccagaugacucaggaac

SEQ ID NO: 881005 - RNA, 22 nt, Human
ggcccuguccuggcugucuccg

SEQ ID NO: 881006 - RNA, 22 nt, Human
uagcagcauuuuuguagaguau

SEQ ID NO: 881007 - RNA, 21 nt, Human
auauuguagguaaagugcagg

SEQ ID NO: 881008 - RNA, 22 nt, Human
cuuuccuaguaguuacagaaug

SEQ ID NO: 881009 - RNA, 20 nt, Human
ugaauaugaccuuauuugga

SEQ ID NO: 881010 - RNA, 22 nt, Human
auacuucucaugggcucugagc

SEQ ID NO: 881011 - RNA, 22 nt, Human
ucacaaauguuugcaugugucu

SEQ ID NO: 881012 - RNA, 22 nt, Human
acaucacagagcccagauaaag

SEQ ID NO: 881013 - RNA, 22 nt, Human
aaugaaacuauauuuagagagg

SEQ ID NO: 881014 - RNA, 22 nt, Human
uuaaaauguacaggggaaagug

SEQ ID NO: 881015 - RNA, 22 nt, Human
gcagagguccuagccaggaguc

SEQ ID NO: 881016 - RNA, 22 nt, Human
uuucagaucacuuucaggaaag

SEQ ID NO: 881017 - RNA, 22 nt, Human
ccucaagaugcacugaacauau

SEQ ID NO: 881018 - RNA, 22 nt, Human
gccugcugaaccucaugcaguc

SEQ ID NO: 881019 - RNA, 22 nt, Human
aaguaacaucugaacaugaugu

SEQ ID NO: 881020 - RNA, 19 nt, Human
agcacagacaagaccagca

SEQ ID NO: 881021 - RNA, 22 nt, Human
gccaggcucaguagcgauuccu

SEQ ID NO: 881022 - RNA, 22 nt, Human
guugggagcagcagaccaagag

SEQ ID NO: 881023 - RNA, 22 nt, Human
cuggagcauccaugcccagggu

SEQ ID NO: 881024 - RNA, 18 nt, Human
ugacccuuucucccugug

SEQ ID NO: 881025 - RNA, 22 nt, Human
ucugccacugugaugcaugaua

SEQ ID NO: 881026 - RNA, 22 nt, Human
uagggcaggugaagaaaagcua

SEQ ID NO: 881027 - RNA, 22 nt, Human
uuauguacucugcaauguuuga

SEQ ID NO: 881028 - RNA, 22 nt, Human
uaaaguccuugaaccggaugua

SEQ ID NO: 881029 - RNA, 22 nt, Human
aagcaacuccuaggaggaaagg

SEQ ID NO: 881030 - RNA, 22 nt, Human
ggaaaagaauugcagugaagua

SEQ ID NO: 881031 - RNA, 22 nt, Human
uguccuguucauggcucuggac

SEQ ID NO: 881032 - RNA, 22 nt, Human
cucagggcggcgggcagcccag

SEQ ID NO: 881033 - RNA, 22 nt, Human
gcaaaggcuucuuuuauucucc

SEQ ID NO: 881034 - RNA, 22 nt, Human
ucuggagauaagacagacagau

SEQ ID NO: 881035 - RNA, 22 nt, Human
uugaagagacaauuuggaaagc

SEQ ID NO: 881036 - RNA, 22 nt, Human
gauuucuuugcaagcuguguuc

SEQ ID NO: 881037 - RNA, 22 nt, Human
uucugaggcauagaggaugaga

SEQ ID NO: 881038 - RNA, 22 nt, Human
gaguccuuaauacacuggugga

SEQ ID NO: 881039 - RNA, 22 nt, Human
cccaggucccggggccagcugc

SEQ ID NO: 881040 - RNA, 22 nt, Human
augucagauccucagaaagucu

SEQ ID NO: 881041 - RNA, 22 nt, Human
cuucuguagccaguaacauaua

SEQ ID NO: 881042 - RNA, 22 nt, Human
aagaguaugcaugcauguuugu

SEQ ID NO: 881043 - RNA, 22 nt, Human
ugccugugacccaaggaugcga

SEQ ID NO: 881044 - RNA, 22 nt, Human
uuggcagagccccagccuugga

SEQ ID NO: 881045 - RNA, 22 nt, Human
gacagggaaacauugaaguguc

SEQ ID NO: 881046 - RNA, 22 nt, Human
uacaguaguaagaaugccuuau

SEQ ID NO: 881047 - RNA, 18 nt, Human
ggggaaaagccagguguc

SEQ ID NO: 881048 - RNA, 22 nt, Human
cucugucccagacccaccucuc

SEQ ID NO: 881049 - RNA, 22 nt, Human
acaaacuucccagacaagcucc

SEQ ID NO: 881050 - RNA, 22 nt, Human
aaaauucuaacaugcagccaag

SEQ ID NO: 881051 - RNA, 22 nt, Human
uaacacauauuucaagaguagu

SEQ ID NO: 881052 - RNA, 22 nt, Human
cagcccucaucucagcuucuuu

SEQ ID NO: 881053 - RNA, 22 nt, Human
caggcuucagcauccacuuagu

SEQ ID NO: 881054 - RNA, 22 nt, Human
agauggaaaauauagacagaga

SEQ ID NO: 881055 - RNA, 20 nt, Human
ggcaaugccagaugacagga

SEQ ID NO: 881056 - RNA, 22 nt, Human
uuuccuaagauagauacuucag

SEQ ID NO: 881057 - RNA, 22 nt, Human
caguaacuaggacaaggaggaa

SEQ ID NO: 881058 - RNA, 22 nt, Human
aggcugaggcuuuccuuggaga

SEQ ID NO: 881059 - RNA, 22 nt, Human
ugcuucugucucuuaugccuug

SEQ ID NO: 881060 - RNA, 22 nt, Human
ucugcacaauugaucauggcaa

SEQ ID NO: 881061 - RNA, 22 nt, Human
aaagacauauuucuaaguuuau

SEQ ID NO: 881062 - RNA, 22 nt, Human
aaugggaagccagaagacaagg

SEQ ID NO: 881063 - RNA, 22 nt, Human
ggguggaguagaaagaugaauu

SEQ ID NO: 881064 - RNA, 22 nt, Human
ucacugaaggaagacacuguca

SEQ ID NO: 881065 - RNA, 22 nt, Human
gagcccagcuugcacauggagc

SEQ ID NO: 881066 - RNA, 22 nt, Human
cuggcagcccaaccuagagucu

SEQ ID NO: 881067 - RNA, 22 nt, Human
ccaaagugugggagaagaggua

SEQ ID NO: 881068 - RNA, 22 nt, Human
uuccuucuggaagcuucagggg

SEQ ID NO: 881069 - RNA, 22 nt, Human
aaacacucauguguuacucucc

SEQ ID NO: 881070 - RNA, 22 nt, Human
ugggggacugcacuggcgucag

SEQ ID NO: 881071 - RNA, 22 nt, Human
aggcccugggagcagagaugca

SEQ ID NO: 881072 - RNA, 22 nt, Human
uuuguuaaggaguauugcuucu

SEQ ID NO: 881073 - RNA, 22 nt, Human
gggcagcagaauuggacagaaa

SEQ ID NO: 881074 - RNA, 22 nt, Human
cagaaccaggaacugauggaga

SEQ ID NO: 881075 - RNA, 22 nt, Human
auguagaaauaauuucaguucc

SEQ ID NO: 881076 - RNA, 22 nt, Human
acuugggucacaugaccuaccu

SEQ ID NO: 881077 - RNA, 22 nt, Human
cccagacugcagagcgggcaga

SEQ ID NO: 881078 - RNA, 22 nt, Human
auuuggucagaacucucuuuag

SEQ ID NO: 881079 - RNA, 22 nt, Human
cggcccugcugagcuugucugg

SEQ ID NO: 881080 - RNA, 22 nt, Human
aggccagcaugcaguucuaagg

SEQ ID NO: 881081 - RNA, 22 nt, Human
gaucaguaagugaauaaugagu

SEQ ID NO: 881082 - RNA, 22 nt, Human
acccagccuacaaagcucaccu

SEQ ID NO: 881083 - RNA, 22 nt, Human
uugggagguaauggagccaagu

SEQ ID NO: 881084 - RNA, 22 nt, Human
uuuuugcugauaagcagaauuc

SEQ ID NO: 881085 - RNA, 22 nt, Human
uguuuuuuccuuaugcaaucug

SEQ ID NO: 881086 - RNA, 22 nt, Human
uucuuuggcugccagucuggag

SEQ ID NO: 881087 - RNA, 22 nt, Human
uacaguuacccuggaaagaaau

SEQ ID NO: 881088 - RNA, 22 nt, Human
aagggcggacagggcacauuuc

SEQ ID NO: 881089 - RNA, 22 nt, Human
uggccuggccacauccagcagg

SEQ ID NO: 881090 - RNA, 21 nt, Human
ccucuggcuugugcugugccc

SEQ ID NO: 881091 - RNA, 22 nt, Human
agcccacuguuuucauuucucu

SEQ ID NO: 881092 - RNA, 22 nt, Human
guuucuaaauguucugaguuuu

SEQ ID NO: 881093 - RNA, 23 nt, Human
augcaucaugaaaacuagagagc

SEQ ID NO: 881094 - RNA, 22 nt, Human
aagucauuaucucuucuaaucu

SEQ ID NO: 881095 - RNA, 18 nt, Human
auguguggcuuggggucc

SEQ ID NO: 881096 - RNA, 20 nt, Human
cagagaccugucuucacaga

SEQ ID NO: 881097 - RNA, 22 nt, Human
cagguccacggcgcccaggggu

SEQ ID NO: 881098 - RNA, 22 nt, Human
uccccaccuaagauacccaucu

SEQ ID NO: 881099 - RNA, 22 nt, Human
gaaagauaaucaauuacuccuu

SEQ ID NO: 881100 - RNA, 22 nt, Human
gugagguaaagcacagaaauag

SEQ ID NO: 881101 - RNA, 22 nt, Human
ccagaacugagaaaauaaauuu

SEQ ID NO: 881102 - RNA, 22 nt, Human
augcuguguccuagugaaagaa

SEQ ID NO: 881103 - RNA, 22 nt, Human
aauucacaggaucacaggagag

SEQ ID NO: 881104 - RNA, 22 nt, Human
caucucugagaccucagcuggg

SEQ ID NO: 881105 - RNA, 22 nt, Human
uacaauauguggccuuuuguga

SEQ ID NO: 881106 - RNA, 22 nt, Human
gcucuugauacaucaagaacuu

SEQ ID NO: 881107 - RNA, 22 nt, Human
cccauuuugcuuaugcugcugu

SEQ ID NO: 881108 - RNA, 22 nt, Human
uucucuggacagugaagagagg

SEQ ID NO: 881109 - RNA, 22 nt, Human
agcugcccagauaggaggaggc

SEQ ID NO: 881110 - RNA, 22 nt, Human
caauuacuuuugcaccaauaua

SEQ ID NO: 881111 - RNA, 22 nt, Human
cugccagguaaacugcaggaau

SEQ ID NO: 881112 - RNA, 22 nt, Human
cagaacagaaguaaaauuuacc

SEQ ID NO: 881113 - RNA, 22 nt, Human
cuucacaacgacaucugguuag

SEQ ID NO: 881114 - RNA, 22 nt, Human
ucugggucuuuacccauggaau

SEQ ID NO: 881115 - RNA, 20 nt, Human
agcugaagaucuggaugggg

SEQ ID NO: 881116 - RNA, 22 nt, Human
acaaaguaggcagugggcugga

SEQ ID NO: 881117 - RNA, 22 nt, Human
uuagagaugucccaaaaugaag

SEQ ID NO: 881118 - RNA, 22 nt, Human
aaugacuuugaaauauuugagu

SEQ ID NO: 881119 - RNA, 22 nt, Human
agcagccuauucuucucuugga

SEQ ID NO: 881120 - RNA, 22 nt, Human
ggcucaggagaggggcuaaaag

SEQ ID NO: 881121 - RNA, 22 nt, Human
ccauugaauuagaaggggaagg

SEQ ID NO: 881122 - RNA, 22 nt, Human
gaccagcucucugaagaaagag

SEQ ID NO: 881123 - RNA, 22 nt, Human
guuguaaauacaguacugaaac

SEQ ID NO: 881124 - RNA, 22 nt, Human
gaagugugcacaucuuacaagu

SEQ ID NO: 881125 - RNA, 22 nt, Human
agaggcccuggcuagagcagcu

SEQ ID NO: 881126 - RNA, 22 nt, Human
guauucaagcgagcagaugucu

SEQ ID NO: 881127 - RNA, 22 nt, Human
ugcucugggcaacagccucccu

SEQ ID NO: 881128 - RNA, 22 nt, Human
caguggaaauauuggcagcauc

SEQ ID NO: 881129 - RNA, 22 nt, Human
agcagccauagauagcaugcaa

SEQ ID NO: 881130 - RNA, 22 nt, Human
gaaguucucaaggaucacagaa

SEQ ID NO: 881131 - RNA, 22 nt, Human
ugagaauacugcauuguuagga

SEQ ID NO: 881132 - RNA, 22 nt, Human
uagcuguuaaguuguuuggaaa

SEQ ID NO: 881133 - RNA, 22 nt, Human
acucugacauuuaaaaagcaau

SEQ ID NO: 881134 - RNA, 22 nt, Human
aauuuuauuagaaggcaagggg

SEQ ID NO: 881135 - RNA, 22 nt, Human
uccaggccucuagcccucucuu

SEQ ID NO: 881136 - RNA, 21 nt, Human
cccagagccuagggagggcac

SEQ ID NO: 881137 - RNA, 22 nt, Human
cugcuccugugggccaguggcc

SEQ ID NO: 881138 - RNA, 22 nt, Human
ccagugcaggugagcaccaggu

SEQ ID NO: 881139 - RNA, 19 nt, Human
uggcucuguuucucuggag

SEQ ID NO: 881140 - RNA, 22 nt, Human
guccuugggauagaaagaugaa

SEQ ID NO: 881141 - RNA, 22 nt, Human
uuuacacuugaggaaacugagg

SEQ ID NO: 881142 - RNA, 22 nt, Human
aaagguuuauuuaaucagggag

SEQ ID NO: 881143 - RNA, 22 nt, Human
ucacaguugagcagguugugca

SEQ ID NO: 881144 - RNA, 22 nt, Human
gcuguuucugaguagcuaggcu

SEQ ID NO: 881145 - RNA, 22 nt, Human
acacagcaaggucugacuuugg

SEQ ID NO: 881146 - RNA, 18 nt, Human
ucccuucucccuugccuc

SEQ ID NO: 881147 - RNA, 21 nt, Human
acugagggccagagaggaccu

SEQ ID NO: 881148 - RNA, 22 nt, Human
cauguguguggacgagcguggc

SEQ ID NO: 881149 - RNA, 22 nt, Human
augauacaucuucaugucagug

SEQ ID NO: 881150 - RNA, 22 nt, Human
cagugugugacucuggggguac

SEQ ID NO: 881151 - RNA, 18 nt, Human
auacaagaucaaguguuc

SEQ ID NO: 881152 - RNA, 22 nt, Human
gguugaauaucuuuauguuggu

SEQ ID NO: 881153 - RNA, 22 nt, Human
gaaggggguugcagucuagggu

SEQ ID NO: 881154 - RNA, 22 nt, Human
gagagcuguguucauucuacca

SEQ ID NO: 881155 - RNA, 18 nt, Human
uuuuaauuucaggggugg

SEQ ID NO: 881156 - RNA, 22 nt, Human
uugugaauggugccgcaauaaa

SEQ ID NO: 881157 - RNA, 22 nt, Human
auguacauguuuaagugaagga

SEQ ID NO: 881158 - RNA, 22 nt, Human
ucaggaagccacuccacagaga

SEQ ID NO: 881159 - RNA, 21 nt, Human
gggcagaggggccuccugggu

SEQ ID NO: 881160 - RNA, 22 nt, Human
ugggcuagcagggaagagagac

SEQ ID NO: 881161 - RNA, 22 nt, Human
uggcccugagggcucggagcca

SEQ ID NO: 881162 - RNA, 21 nt, Human
aacugagaccagcuaaagugg

SEQ ID NO: 881163 - RNA, 22 nt, Human
cacaaaugacugaaacgacugu

SEQ ID NO: 881164 - RNA, 22 nt, Human
acugaagcacauuugccaugaa

SEQ ID NO: 881165 - RNA, 22 nt, Human
cagagcccucaaggccgaugca

SEQ ID NO: 881166 - RNA, 22 nt, Human
cucaggccagguuucucccaca

SEQ ID NO: 881167 - RNA, 22 nt, Human
gugcucagggccuggcugggga

SEQ ID NO: 881168 - RNA, 18 nt, Human
cccucuccugcuaguggg

SEQ ID NO: 881169 - RNA, 22 nt, Human
uaccuucucuagaucuuuauuc

SEQ ID NO: 881170 - RNA, 22 nt, Human
acccugagggguauagcagaag

SEQ ID NO: 881171 - RNA, 22 nt, Human
acauugugauccgacugauuaa

SEQ ID NO: 881172 - RNA, 22 nt, Human
agucaggacagauuuucugggg

SEQ ID NO: 881173 - RNA, 22 nt, Human
acucugaacuccaggaggcuca

SEQ ID NO: 881174 - RNA, 22 nt, Human
cuggagauuaaguucucagcca

SEQ ID NO: 881175 - RNA, 22 nt, Human
ugauacauaaaccaucauuuug

SEQ ID NO: 881176 - RNA, 22 nt, Human
agugugcuagcaagaacugggg

SEQ ID NO: 881177 - RNA, 22 nt, Human
gagcccaggcugggguucagag

SEQ ID NO: 881178 - RNA, 19 nt, Human
uuucacaaagagagcguga

SEQ ID NO: 881179 - RNA, 22 nt, Human
guggcagagaacaaggagaggu

SEQ ID NO: 881180 - RNA, 22 nt, Human
ugcuggggguagcucugcguag

SEQ ID NO: 881181 - RNA, 22 nt, Human
aaacaauguuccuauauuagag

SEQ ID NO: 881182 - RNA, 22 nt, Human
acagccagguaaaggcauggca

SEQ ID NO: 881183 - RNA, 22 nt, Human
ugugggcucccccucacucugu

SEQ ID NO: 881184 - RNA, 22 nt, Human
uaauacuuaccuugcagagucu

SEQ ID NO: 881185 - RNA, 22 nt, Human
gaaagucauggaugaacacuac

SEQ ID NO: 881186 - RNA, 22 nt, Human
ugccaggcccagcagggcggcc

SEQ ID NO: 881187 - RNA, 22 nt, Human
aagcaucuuaaaaaguaucaga

SEQ ID NO: 881188 - RNA, 21 nt, Human
agauuugucccuucccauuua

SEQ ID NO: 881189 - RNA, 22 nt, Human
augcucugggcuuuugaagugg

SEQ ID NO: 881190 - RNA, 20 nt, Human
uucuaacuacucucccuuug

SEQ ID NO: 881191 - RNA, 22 nt, Human
ggcuauuucauuuaguacuagg

SEQ ID NO: 881192 - RNA, 22 nt, Human
ccuguguguaggccaggggagu

SEQ ID NO: 881193 - RNA, 22 nt, Human
gcaccagccugagccucuugca

SEQ ID NO: 881194 - RNA, 22 nt, Human
uuaucuuggguaacuuugugca

SEQ ID NO: 881195 - RNA, 18 nt, Human
acaaaggucugcaagacc

SEQ ID NO: 881196 - RNA, 22 nt, Human
uggaucuaucuccagggguccu

SEQ ID NO: 881197 - RNA, 21 nt, Human
aggguccuacagggcucagga

SEQ ID NO: 881198 - RNA, 22 nt, Human
uguauauacauacacacaugaa

SEQ ID NO: 881199 - RNA, 22 nt, Human
gaauuacauaguuucuagguuc

SEQ ID NO: 881200 - RNA, 22 nt, Human
uagcaagaggugaagguuucau

SEQ ID NO: 881201 - RNA, 22 nt, Human
cagguggguguaugaaugcaaa

SEQ ID NO: 881202 - RNA, 22 nt, Human
aauacagauggcaugugaagau

SEQ ID NO: 881203 - RNA, 22 nt, Human
agcucccagucuccucuccaug

SEQ ID NO: 881204 - RNA, 22 nt, Human
uucacaucucagcacugccucu

SEQ ID NO: 881205 - RNA, 22 nt, Human
uugcuguaaguaucuuucuacc

SEQ ID NO: 881206 - RNA, 22 nt, Human
ugagaaacauaugagagauuug

SEQ ID NO: 881207 - RNA, 22 nt, Human
gcugagggcagccuccuagguc

SEQ ID NO: 881208 - RNA, 22 nt, Human
uaguggaggggaugcaaagcuu

SEQ ID NO: 881209 - RNA, 22 nt, Human
aaacaaugagcuuuuacacacu

SEQ ID NO: 881210 - RNA, 22 nt, Human
guggcaaguguuccaagaggcg

SEQ ID NO: 881211 - RNA, 22 nt, Human
uuagagcuagaugaggucauga

SEQ ID NO: 881212 - RNA, 22 nt, Human
ccagaggugcucuuuggaagug

SEQ ID NO: 881213 - RNA, 22 nt, Human
ugggagcagcuuugcgagggag

SEQ ID NO: 881214 - RNA, 22 nt, Human
cuccuagaugucuucagagaaa

SEQ ID NO: 881215 - RNA, 22 nt, Human
acaaaugaaccugaaaucucag

SEQ ID NO: 881216 - RNA, 22 nt, Human
caucaguguggcaguucacugu

SEQ ID NO: 881217 - RNA, 22 nt, Human
cucucuggcacuucauugcugu

SEQ ID NO: 881218 - RNA, 22 nt, Human
ugcuucugacauguucuugguu

SEQ ID NO: 881219 - RNA, 20 nt, Human
cuguccccgaggucaccagg

SEQ ID NO: 881220 - RNA, 22 nt, Human
ccugcccauacugaccucuaau

SEQ ID NO: 881221 - RNA, 20 nt, Human
acaguguaauauucacauuc

SEQ ID NO: 881222 - RNA, 22 nt, Human
ucagcaguggcucucaugcagu

SEQ ID NO: 881223 - RNA, 22 nt, Human
gauuucucaauccuaguacuau

SEQ ID NO: 881224 - RNA, 22 nt, Human
ggcuucaccaggugcaugcaug

SEQ ID NO: 881225 - RNA, 22 nt, Human
aagacaucagugaugacauuug

SEQ ID NO: 881226 - RNA, 22 nt, Human
auguauacuaacacaugcaguu

SEQ ID NO: 881227 - RNA, 20 nt, Human
cugggcucgguggcccuggc

SEQ ID NO: 881228 - RNA, 22 nt, Human
acuuuuuacaggguguauacca

SEQ ID NO: 881229 - RNA, 22 nt, Human
augugcaguugguggccaggag

SEQ ID NO: 881230 - RNA, 22 nt, Human
aaacuccagugaauacuagaau

SEQ ID NO: 881231 - RNA, 21 nt, Human
uucacaaccugcuuuaguggg

SEQ ID NO: 881232 - RNA, 22 nt, Human
uuucucuuaaugucucugugcu

SEQ ID NO: 881233 - RNA, 22 nt, Human
agccacagcaacaagugcaauu

SEQ ID NO: 881234 - RNA, 21 nt, Human
cggaaaggacuagggcucaga

SEQ ID NO: 881235 - RNA, 22 nt, Human
cuguggagcagggcagggucac

SEQ ID NO: 881236 - RNA, 22 nt, Human
ccaggagcaacuugaaggcaag

SEQ ID NO: 881237 - RNA, 23 nt, Human
agacaaaagccucagucuuaggc

SEQ ID NO: 881238 - RNA, 22 nt, Human
cacaugcauaccuauguguaua

SEQ ID NO: 881239 - RNA, 19 nt, Human
ucucacaagcaacauuguu

SEQ ID NO: 881240 - RNA, 22 nt, Human
ucugucacucuagagauggcag

SEQ ID NO: 881241 - RNA, 22 nt, Human
agucacaugcauuuucuucaau

SEQ ID NO: 881242 - RNA, 22 nt, Human
cugugcaaauaaagagcaacau

SEQ ID NO: 881243 - RNA, 23 nt, Human
agacuucuccaacaagcuuggcu

SEQ ID NO: 881244 - RNA, 22 nt, Human
ggugugcaggcuaucacagaca

SEQ ID NO: 881245 - RNA, 22 nt, Human
aggacagcaaccguuauucaca

SEQ ID NO: 881246 - RNA, 22 nt, Human
ugucuccaacucacuguauacu

SEQ ID NO: 881247 - RNA, 21 nt, Human
ugucacagauucucagcuugc

SEQ ID NO: 881248 - RNA, 22 nt, Human
guuucagauuugguuucagaag

SEQ ID NO: 881249 - RNA, 22 nt, Human
aggcagguguugggagacacca

SEQ ID NO: 881250 - RNA, 16 nt, Human
uccuaacuggcaguuc

SEQ ID NO: 881251 - RNA, 22 nt, Human
uauauuaucauaaaaccauuca

SEQ ID NO: 881252 - RNA, 22 nt, Human
cuguccagaaagggggcaacaa

SEQ ID NO: 881253 - RNA, 21 nt, Human
uccuccuggccaggcggcccc

SEQ ID NO: 881254 - RNA, 22 nt, Human
ugggcaucucugcugccggccu

SEQ ID NO: 881255 - RNA, 22 nt, Human
acaguuaauuaacauuaagggg

SEQ ID NO: 881256 - RNA, 22 nt, Human
agaaucuucagaugauuuguca

SEQ ID NO: 881257 - RNA, 21 nt, Human
aaacugaggcuucaagcagug

SEQ ID NO: 881258 - RNA, 22 nt, Human
acagcuggacaggggagaguuu

SEQ ID NO: 881259 - RNA, 22 nt, Human
cagcaggaggugaguagcaggu

SEQ ID NO: 881260 - RNA, 22 nt, Human
uaaaacuagaccgugagucuaa

SEQ ID NO: 881261 - RNA, 22 nt, Human
ucauaaauauuugugggggcuu

SEQ ID NO: 881262 - RNA, 22 nt, Human
accagcaguuaugaggccagga

SEQ ID NO: 881263 - RNA, 22 nt, Human
aggcugucugaccccagagccc

SEQ ID NO: 881264 - RNA, 22 nt, Human
aagauauucaaagauuuauuag

SEQ ID NO: 881265 - RNA, 22 nt, Human
uucucuggguuaggggaacuau

SEQ ID NO: 881266 - RNA, 22 nt, Human
caucagaagaaagacaaaugau

SEQ ID NO: 881267 - RNA, 22 nt, Human
caaaacuaucaggcucaaagcu

SEQ ID NO: 881268 - RNA, 22 nt, Human
uggcuucaaggugauaauuuac

SEQ ID NO: 881269 - RNA, 22 nt, Human
acauuuggcaucuuguaacacu

SEQ ID NO: 881270 - RNA, 22 nt, Human
caguggcugagaguggacacug

SEQ ID NO: 881271 - RNA, 22 nt, Human
uuucuauuuacagugcuaggua

SEQ ID NO: 881272 - RNA, 22 nt, Human
gagcaagauuuuauaaguugug

SEQ ID NO: 881273 - RNA, 22 nt, Human
aagaagaugguuaacuuucagu

SEQ ID NO: 881274 - RNA, 22 nt, Human
auguuuuauauuuugcagcagu

SEQ ID NO: 881275 - RNA, 18 nt, Human
ugucucuccuuucugugu

SEQ ID NO: 881276 - RNA, 17 nt, Human
agaaagaggauccacag

SEQ ID NO: 881277 - RNA, 22 nt, Human
caggagacaauggcuguggggc

SEQ ID NO: 881278 - RNA, 22 nt, Human
caggguuucaccauguuagcag

SEQ ID NO: 881279 - RNA, 22 nt, Human
cacuuaaagucuuagcuuacag

SEQ ID NO: 881280 - RNA, 22 nt, Human
auggccagcucagagcacucag

SEQ ID NO: 881281 - RNA, 22 nt, Human
augaaaugagucaaugcgacua

SEQ ID NO: 881282 - RNA, 22 nt, Human
gaggguggaagagcugcugaga

SEQ ID NO: 881283 - RNA, 23 nt, Human
ugaguucuaggcuuaaaacuagc

SEQ ID NO: 881284 - RNA, 22 nt, Human
ccucucccgggugccgcugggc

SEQ ID NO: 881285 - RNA, 22 nt, Human
cugcagcugcucauguuacuug

SEQ ID NO: 881286 - RNA, 22 nt, Human
auagaauaaugguugucaggag

SEQ ID NO: 881287 - RNA, 22 nt, Human
uaaggccaccguuauagaacca

SEQ ID NO: 881288 - RNA, 22 nt, Human
ucacaguaaaagcauggaagag

SEQ ID NO: 881289 - RNA, 22 nt, Human
uggggaagaauaauguauguac

SEQ ID NO: 881290 - RNA, 22 nt, Human
ugguggagccuaggcuaagucu

SEQ ID NO: 881291 - RNA, 21 nt, Human
aaugcugcccaguaagauggc

SEQ ID NO: 881292 - RNA, 22 nt, Human
agccaaaucuaaagugaauauu

SEQ ID NO: 881293 - RNA, 22 nt, Human
gaacagggaguacggcacauuu

SEQ ID NO: 881294 - RNA, 22 nt, Human
cuauauuuggugagggaugucu

SEQ ID NO: 881295 - RNA, 22 nt, Human
gaaggagcuaaagggagcccug

SEQ ID NO: 881296 - RNA, 22 nt, Human
uuuggaauucugcagcucaugu

SEQ ID NO: 881297 - RNA, 18 nt, Human
aaagcuguuauuccagaa

SEQ ID NO: 881298 - RNA, 22 nt, Human
aaauacugggcucaaaaggguu

SEQ ID NO: 881299 - RNA, 22 nt, Human
ugugaggaggcggccagaagag

SEQ ID NO: 881300 - RNA, 22 nt, Human
uacaggcccauagucccugcuu

SEQ ID NO: 881301 - RNA, 22 nt, Human
uguuacaaacuguuguuucuau

SEQ ID NO: 881302 - RNA, 22 nt, Human
gagacccccugaguuauggccu

SEQ ID NO: 881303 - RNA, 22 nt, Human
auugcaggauacccagguagag

SEQ ID NO: 881304 - RNA, 22 nt, Human
agugcuguccaguuucacaggu

SEQ ID NO: 881305 - RNA, 22 nt, Human
ggaugcugacuuuggagcaugg

SEQ ID NO: 881306 - RNA, 22 nt, Human
acuguacacauucgucaagacu

SEQ ID NO: 881307 - RNA, 22 nt, Human
ucuuguuaucaggaaaacagua

SEQ ID NO: 881308 - RNA, 22 nt, Human
uuaaauuccagccucauaauag

SEQ ID NO: 881309 - RNA, 22 nt, Human
caggguugcaugcaucuguggg

SEQ ID NO: 881310 - RNA, 22 nt, Human
ccaaugcagauaagacaaacac

SEQ ID NO: 881311 - RNA, 18 nt, Human
cugaggcuuagagagguu

SEQ ID NO: 881312 - RNA, 22 nt, Human
cuaaacauguagcuuuuguggu

SEQ ID NO: 881313 - RNA, 22 nt, Human
acuagcagggauguuauuacuu

SEQ ID NO: 881314 - RNA, 18 nt, Human
cuccugggcugcagaugc

SEQ ID NO: 881315 - RNA, 22 nt, Human
ugccuuaaaaaauucuaaacau

SEQ ID NO: 881316 - RNA, 22 nt, Human
agugaaauugcuguaagaggaa

SEQ ID NO: 881317 - RNA, 22 nt, Human
aagccaagguuuuggucacagc

SEQ ID NO: 881318 - RNA, 22 nt, Human
ugggagaaucuugcucugcuac

SEQ ID NO: 881319 - RNA, 22 nt, Human
agggcuuguaggguggcuguag

SEQ ID NO: 881320 - RNA, 22 nt, Human
acagggcagcaacuuugugccu

SEQ ID NO: 881321 - RNA, 22 nt, Human
uggcuccagcguccacguccug

SEQ ID NO: 881322 - RNA, 22 nt, Human
acauauuccauuguugggaucc

SEQ ID NO: 881323 - RNA, 22 nt, Human
cagguuucuaguucuaagaaua

SEQ ID NO: 881324 - RNA, 20 nt, Human
guccugggagccacagcaca

SEQ ID NO: 881325 - RNA, 22 nt, Human
cuuaagaauauugaaguugugg

SEQ ID NO: 881326 - RNA, 22 nt, Human
ugaaagugucauagaaacccau

SEQ ID NO: 881327 - RNA, 22 nt, Human
auuaaugucuaccaguugugug

SEQ ID NO: 881328 - RNA, 22 nt, Human
acuugaaagaaguuuccuuaaa

SEQ ID NO: 881329 - RNA, 22 nt, Human
cagagggcuguguaaggauguu

SEQ ID NO: 881330 - RNA, 21 nt, Human
agggagucuggaggaagcguu

SEQ ID NO: 881331 - RNA, 22 nt, Human
ucugaggcugcaucuaugugac

SEQ ID NO: 881332 - RNA, 20 nt, Human
aguuagugaguaauugagcu

SEQ ID NO: 881333 - RNA, 22 nt, Human
aaauagauugcugaggcauuac

SEQ ID NO: 881334 - RNA, 22 nt, Human
gccugcuguugagggaagagcu

SEQ ID NO: 881335 - RNA, 22 nt, Human
agaggcuugacaauaugauugg

SEQ ID NO: 881336 - RNA, 22 nt, Human
cauucuuauauuuacucauuca

SEQ ID NO: 881337 - RNA, 22 nt, Human
agggugcagucacaggaaaugu

SEQ ID NO: 881338 - RNA, 22 nt, Human
auuuggaaggagcugcacagca

SEQ ID NO: 881339 - RNA, 17 nt, Human
uauacacagacagacug

SEQ ID NO: 881340 - RNA, 22 nt, Human
guguguggaaugcucauuuauu

SEQ ID NO: 881341 - RNA, 23 nt, Human
cuuuaaugaaauucucugugaag

SEQ ID NO: 881342 - RNA, 22 nt, Human
ucccagaaguccagccaugggc

SEQ ID NO: 881343 - RNA, 22 nt, Human
cccucagagccugaagcaagca

SEQ ID NO: 881344 - RNA, 22 nt, Human
gaauuccacuuuggcuuuuggg

SEQ ID NO: 881345 - RNA, 21 nt, Human
ccugugugucugacugggcua

SEQ ID NO: 881346 - RNA, 21 nt, Human
guccagagagccggcuccuga

SEQ ID NO: 881347 - RNA, 22 nt, Human
acguguguuuaacaaaccugca

SEQ ID NO: 881348 - RNA, 18 nt, Human
agcagcugucagaaugcc

SEQ ID NO: 881349 - RNA, 22 nt, Human
acaaaugacucaaacaccacuu

SEQ ID NO: 881350 - RNA, 22 nt, Human
guccauccgugguagcauggau

SEQ ID NO: 881351 - RNA, 20 nt, Human
ggugcugauaagaaagaagu

SEQ ID NO: 881352 - RNA, 22 nt, Human
gcacagagugggugagaugugg

SEQ ID NO: 881353 - RNA, 22 nt, Human
ggcgaggccgggacaggcugga

SEQ ID NO: 881354 - RNA, 18 nt, Human
uucugcggugacagauau

SEQ ID NO: 881355 - RNA, 22 nt, Human
ucacacauuguugcuuaaguug

SEQ ID NO: 881356 - RNA, 22 nt, Human
cagaggucccuguucuuaagga

SEQ ID NO: 881357 - RNA, 22 nt, Human
cugugucuccuuggugggauau

SEQ ID NO: 881358 - RNA, 22 nt, Human
acaaggcaguuaaaaugguuaa

SEQ ID NO: 881359 - RNA, 22 nt, Human
gccucaaaaguguuguagaggg

SEQ ID NO: 881360 - RNA, 22 nt, Human
gacacagagauaggccuguguu

SEQ ID NO: 881361 - RNA, 22 nt, Human
uauuccaacuucacuauugucu

SEQ ID NO: 881362 - RNA, 22 nt, Human
gagcuuccauggacgccaucug

SEQ ID NO: 881363 - RNA, 22 nt, Human
uccccucugguugacccaggag

SEQ ID NO: 881364 - RNA, 22 nt, Human
agcaauuuuugauuuucagugu

SEQ ID NO: 881365 - RNA, 22 nt, Human
cagacaggaaguucagaagaaa

SEQ ID NO: 881366 - RNA, 22 nt, Human
ugaagccacacuagcuuguccu

SEQ ID NO: 881367 - RNA, 22 nt, Human
aggccagcaccagagucaagaa

SEQ ID NO: 881368 - RNA, 22 nt, Human
uuugagaacccuguauuuuaag

SEQ ID NO: 881369 - RNA, 22 nt, Human
gcaggacauucagugaaugggc

SEQ ID NO: 881370 - RNA, 22 nt, Human
ccugagcaacuucaagggccug

SEQ ID NO: 881371 - RNA, 19 nt, Human
cacagggagaccacauguc

SEQ ID NO: 881372 - RNA, 22 nt, Human
aagaacuuuaaagcacuuauga

SEQ ID NO: 881373 - RNA, 18 nt, Human
aucuguccuuucucugcc

SEQ ID NO: 881374 - RNA, 22 nt, Human
aaacucuagcuacuaggauaac

SEQ ID NO: 881375 - RNA, 22 nt, Human
acuauacaguauguacgugcac

SEQ ID NO: 881376 - RNA, 22 nt, Human
guucauuuuuagaaugcuagua

SEQ ID NO: 881377 - RNA, 22 nt, Human
cagcaggucuuguugcugcuga

SEQ ID NO: 881378 - RNA, 22 nt, Human
ucccauuucuugcauccuugcu

SEQ ID NO: 881379 - RNA, 22 nt, Human
ggcaguucuggaugcauuguca

SEQ ID NO: 881380 - RNA, 22 nt, Human
ccaaaguuuuuauaguuagcau

SEQ ID NO: 881381 - RNA, 22 nt, Human
ucuagaauggcugggcacagcu

SEQ ID NO: 881382 - RNA, 22 nt, Human
auaaacuugagucucagaguau

SEQ ID NO: 881383 - RNA, 22 nt, Human
aagagcuggaagugaagauaac

SEQ ID NO: 881384 - RNA, 22 nt, Human
uauaagucuggcauauguaugc

SEQ ID NO: 881385 - RNA, 22 nt, Human
agugugagccuacaggccaaag

SEQ ID NO: 881386 - RNA, 22 nt, Human
agcuuacugggcaguaaagauu

SEQ ID NO: 881387 - RNA, 21 nt, Human
uccagggaauuucaacuuuua

SEQ ID NO: 881388 - RNA, 23 nt, Human
ugaagguauuaccugagaugcuc

SEQ ID NO: 881389 - RNA, 19 nt, Human
ccaggucuggggccagauu

SEQ ID NO: 881390 - RNA, 22 nt, Human
ucuucacauauuccuugagcua

SEQ ID NO: 881391 - RNA, 22 nt, Human
uccccacacuuucacuccuggc

SEQ ID NO: 881392 - RNA, 22 nt, Human
agguuuucacaggaaguauguu

SEQ ID NO: 881393 - RNA, 22 nt, Human
ggugguggagccagcugggagu

SEQ ID NO: 881394 - RNA, 22 nt, Human
uaguuucauaugcaaaauagua

SEQ ID NO: 881395 - RNA, 22 nt, Human
gccuguuggguaacagaguuca

SEQ ID NO: 881396 - RNA, 21 nt, Human
uagggggcagugggaugcuua

SEQ ID NO: 881397 - RNA, 22 nt, Human
gccucuguaggagugagagcau

SEQ ID NO: 881398 - RNA, 22 nt, Human
cuuuuucaagucaaagagggua

SEQ ID NO: 881399 - RNA, 22 nt, Human
uguucuaugcucuuuaagguga

SEQ ID NO: 881400 - RNA, 22 nt, Human
augcuuuauguucuggcauuuu

SEQ ID NO: 881401 - RNA, 22 nt, Human
uuucuuuguuguuaucacauca

SEQ ID NO: 881402 - RNA, 21 nt, Human
agaggcaggcauuaaguacac

SEQ ID NO: 881403 - RNA, 18 nt, Human
aagcagacagcagacagu

SEQ ID NO: 881404 - RNA, 22 nt, Human
aauguugcagagugauugucca

SEQ ID NO: 881405 - RNA, 20 nt, Human
ggcaggaccccaguggcauc

SEQ ID NO: 881406 - RNA, 22 nt, Human
cagagugauuugaugaguugca

SEQ ID NO: 881407 - RNA, 22 nt, Human
augcuuugaaguuuuuccucau

SEQ ID NO: 881408 - RNA, 22 nt, Human
caggugcccagcuccugcugug

SEQ ID NO: 881409 - RNA, 22 nt, Human
aggggcugcuggguccgccccu

SEQ ID NO: 881410 - RNA, 22 nt, Human
acaguguuucacuuaaccguuu

SEQ ID NO: 881411 - RNA, 22 nt, Human
gguuggggcgagcuggaggccc

SEQ ID NO: 881412 - RNA, 22 nt, Human
agcuucuuaguucacuuuuaau

SEQ ID NO: 881413 - RNA, 19 nt, Human
gggcucuggccucaguggg

SEQ ID NO: 881414 - RNA, 22 nt, Human
ucucuggguaaaguucucucau

SEQ ID NO: 881415 - RNA, 22 nt, Human
cagcaacuccuguagcuuaugc

SEQ ID NO: 881416 - RNA, 22 nt, Human
agggaagcaaugauuauuauuc

SEQ ID NO: 881417 - RNA, 22 nt, Human
aucucuagcuaacccucuggca

SEQ ID NO: 881418 - RNA, 22 nt, Human
gcucugagaaccaggaacacag

SEQ ID NO: 881419 - RNA, 22 nt, Human
gucauauacacugcauguaauc

SEQ ID NO: 881420 - RNA, 22 nt, Human
acucuaaauagauaaccaugca

SEQ ID NO: 881421 - RNA, 22 nt, Human
uagggcaauauuucccagaaaa

SEQ ID NO: 881422 - RNA, 22 nt, Human
gagccagggcugugagcugagc

SEQ ID NO: 881423 - RNA, 22 nt, Human
auugagcacaugcuaugugcca

SEQ ID NO: 881424 - RNA, 22 nt, Human
uacucacuauucuaucagauag

SEQ ID NO: 881425 - RNA, 22 nt, Human
uuaaaaugcagauucugauuca

SEQ ID NO: 881426 - RNA, 22 nt, Human
ggacuggguaggagcccagggc

SEQ ID NO: 881427 - RNA, 22 nt, Human
ugagcuuuguuguuaguauauu

SEQ ID NO: 881428 - RNA, 22 nt, Human
acaugacuuuucucuuccagag

SEQ ID NO: 881429 - RNA, 22 nt, Human
aaaagucuacaagcuucaacaa

SEQ ID NO: 881430 - RNA, 22 nt, Human
gaaauguugucucugcagcaau

SEQ ID NO: 881431 - RNA, 23 nt, Human
agaaagucauggccagguuugau

SEQ ID NO: 881432 - RNA, 22 nt, Human
aauugaaauucuuuguggucca

SEQ ID NO: 881433 - RNA, 22 nt, Human
gagcuguguugucuaguaccga

SEQ ID NO: 881434 - RNA, 22 nt, Human
ucugggaggucacauuggucuu

SEQ ID NO: 881435 - RNA, 22 nt, Human
agaaauacugccuaagacugua

SEQ ID NO: 881436 - RNA, 22 nt, Human
gaacuauaucuucaagaaaaug

SEQ ID NO: 881437 - RNA, 23 nt, Human
gaauaguuuuagaaauuggagaa

SEQ ID NO: 881438 - RNA, 22 nt, Human
ucaugacaaugguagccuguua

SEQ ID NO: 881439 - RNA, 22 nt, Human
ugauuuccuggcuuuggaguuc

SEQ ID NO: 881440 - RNA, 22 nt, Human
agggaggcauuagcuacugcga

SEQ ID NO: 881441 - RNA, 22 nt, Human
uuaggaagaauauauuuagagc

SEQ ID NO: 881442 - RNA, 22 nt, Human
aaagauuauggcauugaaauac

SEQ ID NO: 881443 - RNA, 22 nt, Human
uuuaugacaagcauuacugauu

SEQ ID NO: 881444 - RNA, 22 nt, Human
ccuguggcugccacuuggguga

SEQ ID NO: 881445 - RNA, 22 nt, Human
ucugccagaagccagggucugg

SEQ ID NO: 881446 - RNA, 22 nt, Human
uacaaugugugcuucuugucac

SEQ ID NO: 881447 - RNA, 22 nt, Human
augcacagcagugaguucagug

SEQ ID NO: 881448 - RNA, 22 nt, Human
ggccuggcucuugcccagccug

SEQ ID NO: 881449 - RNA, 22 nt, Human
uuggaaggauuuagagaugucu

SEQ ID NO: 881450 - RNA, 19 nt, Human
gucucuggauuucaggucc

SEQ ID NO: 881451 - RNA, 22 nt, Human
aauagcauaagaugucaaauag

SEQ ID NO: 881452 - RNA, 22 nt, Human
agccaguagaucgggaggaugu

SEQ ID NO: 881453 - RNA, 22 nt, Human
cugugcugggugugcuuaugau

SEQ ID NO: 881454 - RNA, 21 nt, Human
uguguaauuuuuuaaauggcc

SEQ ID NO: 881455 - RNA, 22 nt, Human
gcccuggccuucaucucagaca

SEQ ID NO: 881456 - RNA, 22 nt, Human
uuguagcaucaaucaguacuuu

SEQ ID NO: 881457 - RNA, 22 nt, Human
aguuucuaugugaaaugcacau

SEQ ID NO: 881458 - RNA, 22 nt, Human
cagauggcugccuucuugcugu

SEQ ID NO: 881459 - RNA, 22 nt, Human
uggaggccagugaaaguagauu

SEQ ID NO: 881460 - RNA, 22 nt, Human
gagcaggaaggccagaaggguc

SEQ ID NO: 881461 - RNA, 22 nt, Human
uuugcuauugugaauagugcca

SEQ ID NO: 881462 - RNA, 22 nt, Human
aacccgggaggcagagguugug

SEQ ID NO: 881463 - RNA, 22 nt, Human
gggcaguagcuucguaggcauc

SEQ ID NO: 881464 - RNA, 21 nt, Human
ugucuccuguuggcacauggc

SEQ ID NO: 881465 - RNA, 22 nt, Human
uggcagcucauuuggaaaugga

SEQ ID NO: 881466 - RNA, 22 nt, Human
gcaguuagcuugucacaguccu

SEQ ID NO: 881467 - RNA, 22 nt, Human
ucaagaauuuuuaaugugacug

SEQ ID NO: 881468 - RNA, 22 nt, Human
cugaagcuuuacuucaaauaca

SEQ ID NO: 881469 - RNA, 22 nt, Human
guucccauacaguaucagugcu

SEQ ID NO: 881470 - RNA, 22 nt, Human
agauguggaaagaaguuagaag

SEQ ID NO: 881471 - RNA, 22 nt, Human
aaggaggacacccaggacuggg

SEQ ID NO: 881472 - RNA, 21 nt, Human
gccuggcuucacaggcacuga

SEQ ID NO: 881473 - RNA, 22 nt, Human
uaaaguauauuuuuucucaaua

SEQ ID NO: 881474 - RNA, 22 nt, Human
ccaggccuguguuguguggagg

SEQ ID NO: 881475 - RNA, 22 nt, Human
gaaauuaagcaggggucugugg

SEQ ID NO: 881476 - RNA, 21 nt, Human
ucagggcagcugcucuucaga

SEQ ID NO: 881477 - RNA, 22 nt, Human
guuugccuuuuagauaggaaug

SEQ ID NO: 881478 - RNA, 18 nt, Human
aaaaugcaggcgacaugg

SEQ ID NO: 881479 - RNA, 17 nt, Human
agcugagcuggccaggg

SEQ ID NO: 881480 - RNA, 22 nt, Human
ugaagcuauauaaguuacagca

SEQ ID NO: 881481 - RNA, 22 nt, Human
cucauaaagugagaauaugacc

SEQ ID NO: 881482 - RNA, 22 nt, Human
agcagcaacuuauuuuucuuau

SEQ ID NO: 881483 - RNA, 22 nt, Human
ugcagcaaacaggccuucaggg

SEQ ID NO: 881484 - RNA, 22 nt, Human
cuucugggccauggccuuccuc

SEQ ID NO: 881485 - RNA, 19 nt, Human
ugaacagagaggacucugg

SEQ ID NO: 881486 - RNA, 22 nt, Human
uuaacuucaacacucucuugua

SEQ ID NO: 881487 - RNA, 18 nt, Human
uggugaaggguggaggag

SEQ ID NO: 881488 - RNA, 17 nt, Human
augugucuagugcaacc

SEQ ID NO: 881489 - RNA, 22 nt, Human
uuguaaacuguuaaaagccaga

SEQ ID NO: 881490 - RNA, 18 nt, Human
ucagagagcagcuuuauu

SEQ ID NO: 881491 - RNA, 22 nt, Human
ugcuccagcuggagaugggggc

SEQ ID NO: 881492 - RNA, 22 nt, Human
gugugucagagcucagagaagu

SEQ ID NO: 881493 - RNA, 22 nt, Human
uggcccaggugcaagagacaga

SEQ ID NO: 881494 - RNA, 22 nt, Human
auacagaauacuaauuccugag

SEQ ID NO: 881495 - RNA, 22 nt, Human
uuucuacauuuguaaccagauu

SEQ ID NO: 881496 - RNA, 22 nt, Human
aggcccauguucacuugcucag

SEQ ID NO: 881497 - RNA, 22 nt, Human
cagaagugauguugagcuaguc

SEQ ID NO: 881498 - RNA, 21 nt, Human
uaagccaccaugugaaaccag

SEQ ID NO: 881499 - RNA, 22 nt, Human
acaugccagcccauuuaaaugg

SEQ ID NO: 881500 - RNA, 22 nt, Human
ucuguccaggcuuacuauauau

SEQ ID NO: 881501 - RNA, 22 nt, Human
aaagacacacagugcuucaguu

SEQ ID NO: 881502 - RNA, 21 nt, Human
gcaaagugugggcauaaacag

SEQ ID NO: 881503 - RNA, 22 nt, Human
gggagguguuccaguguuggua

SEQ ID NO: 881504 - RNA, 22 nt, Human
uuccuugagaaaggcacaaguu

SEQ ID NO: 881505 - RNA, 22 nt, Human
ccugggccucacccagcucuug

SEQ ID NO: 881506 - RNA, 18 nt, Human
gagcccugagucugcaca

SEQ ID NO: 881507 - RNA, 22 nt, Human
aaaggcaugugcaacuacaaau

SEQ ID NO: 881508 - RNA, 22 nt, Human
uuaugugcuucaacugagccua

SEQ ID NO: 881509 - RNA, 22 nt, Human
aagcagcaacaaacuggauaaa

SEQ ID NO: 881510 - RNA, 22 nt, Human
ccagcccugccagagagagcug

SEQ ID NO: 881511 - RNA, 22 nt, Human
aguaagcaauagagugagaauu

SEQ ID NO: 881512 - RNA, 22 nt, Human
aauucacaaaaguuagauccau

SEQ ID NO: 881513 - RNA, 22 nt, Human
ggacagacuuuacagccccggg

SEQ ID NO: 881514 - RNA, 22 nt, Human
ucucaucugcgagcucugccag

SEQ ID NO: 881515 - RNA, 21 nt, Human
gcccaugugggagggguagaa

SEQ ID NO: 881516 - RNA, 22 nt, Human
agauacauauagaaaacaucaa

SEQ ID NO: 881517 - RNA, 22 nt, Human
acccagggcagccagcggggag

SEQ ID NO: 881518 - RNA, 22 nt, Human
uguuucauuaguacugacaaua

SEQ ID NO: 881519 - RNA, 17 nt, Human
ucugaggugaggaugca

SEQ ID NO: 881520 - RNA, 20 nt, Human
agggcagcuugaggagccgg

SEQ ID NO: 881521 - RNA, 22 nt, Human
cuuaggaagcgggaccugugca

SEQ ID NO: 881522 - RNA, 18 nt, Human
cuccuuucccuacaccuc

SEQ ID NO: 881523 - RNA, 22 nt, Human
uuuccaaagguggcaggaacaa

SEQ ID NO: 881524 - RNA, 22 nt, Human
ugccucugugugcaggugagca

SEQ ID NO: 881525 - RNA, 22 nt, Human
cuuguuuucuaaaacaucauuu

SEQ ID NO: 881526 - RNA, 22 nt, Human
uuuugucuaagaacuuugcaaa

SEQ ID NO: 881527 - RNA, 22 nt, Human
gaaauugucagcuucuuucagu

SEQ ID NO: 881528 - RNA, 22 nt, Human
gaauagauaagugacuauuugg

SEQ ID NO: 881529 - RNA, 22 nt, Human
ucaacaguucuguccaauuaau

SEQ ID NO: 881530 - RNA, 22 nt, Human
gaauucugguuuugaaaugaau

SEQ ID NO: 881531 - RNA, 23 nt, Human
augaacauuaguuucagauauug

SEQ ID NO: 881532 - RNA, 22 nt, Human
aacaguguguacacaucauagg

SEQ ID NO: 881533 - RNA, 22 nt, Human
gacagguaaagaugguggcagg

SEQ ID NO: 881534 - RNA, 22 nt, Human
gggccagguggaccccagccuc

SEQ ID NO: 881535 - RNA, 22 nt, Human
agucucagaaaauaugcuuuuu

SEQ ID NO: 881536 - RNA, 22 nt, Human
uuacuguagcuugacauauguc

SEQ ID NO: 881537 - RNA, 22 nt, Human
caaguuauuucauuggaacaau

SEQ ID NO: 881538 - RNA, 22 nt, Human
uaucuacauguagguauguaug

SEQ ID NO: 881539 - RNA, 22 nt, Human
cagggucaccagagaucugcau

SEQ ID NO: 881540 - RNA, 22 nt, Human
ggccaaggaugguggcucuggu

SEQ ID NO: 881541 - RNA, 18 nt, Human
gccugccuagagcuugcc

SEQ ID NO: 881542 - RNA, 22 nt, Human
aacuccaggcagggaggccacu

SEQ ID NO: 881543 - RNA, 22 nt, Human
aggacaauuagacucuuuguuu

SEQ ID NO: 881544 - RNA, 22 nt, Human
cauuucauaguugucacaauaa

SEQ ID NO: 881545 - RNA, 22 nt, Human
aaaguuagcauucucucuugcu

SEQ ID NO: 881546 - RNA, 22 nt, Human
ucacagugaggaguuacaguuu

SEQ ID NO: 881547 - RNA, 22 nt, Human
gcacauuugccacugagcuccu

SEQ ID NO: 881548 - RNA, 22 nt, Human
uugaaaacagcguagauucaca

SEQ ID NO: 881549 - RNA, 22 nt, Human
uguaguaaacacuauucugauc

SEQ ID NO: 881550 - RNA, 16 nt, Human
aggcagcauguuagug

SEQ ID NO: 881551 - RNA, 22 nt, Human
ugagauggguguccagggagga

SEQ ID NO: 881552 - RNA, 22 nt, Human
auaugugaaguggguuauuuug

SEQ ID NO: 881553 - RNA, 22 nt, Human
gguccagaagcugguaggguag

SEQ ID NO: 881554 - RNA, 22 nt, Human
agagggcccauguugggcugcu

SEQ ID NO: 881555 - RNA, 21 nt, Human
accaaaaccuauacuuucugu

SEQ ID NO: 881556 - RNA, 22 nt, Human
ugacagcaugaccacagggucu

SEQ ID NO: 881557 - RNA, 22 nt, Human
agccaugcaccuuacucuugcu

SEQ ID NO: 881558 - RNA, 22 nt, Human
gcauggagaagugggaacaggu

SEQ ID NO: 881559 - RNA, 22 nt, Human
ucaaaugcuguauuguaguaau

SEQ ID NO: 881560 - RNA, 22 nt, Human
cugaugagcccaggugaccaug

SEQ ID NO: 881561 - RNA, 22 nt, Human
cuacauuuguucuauagcuuuu

SEQ ID NO: 881562 - RNA, 22 nt, Human
acaaacugggauaggauccugu

SEQ ID NO: 881563 - RNA, 22 nt, Human
uggcacuggaaucguagccuug

SEQ ID NO: 881564 - RNA, 22 nt, Human
uccauuuuagagaugaagaaac

SEQ ID NO: 881565 - RNA, 22 nt, Human
gcugucccaugguugcaagaug

SEQ ID NO: 881566 - RNA, 22 nt, Human
uuguccaucuguauuucccaug

SEQ ID NO: 881567 - RNA, 22 nt, Human
gcccugaauaauagagugggga

SEQ ID NO: 881568 - RNA, 22 nt, Human
ugugagaggagaaaugcauuaa

SEQ ID NO: 881569 - RNA, 22 nt, Human
auggaagaguccccauggauga

SEQ ID NO: 881570 - RNA, 23 nt, Human
gcccugacugcggccucccacuc

SEQ ID NO: 881571 - RNA, 22 nt, Human
guggguggagacugggugcaag

SEQ ID NO: 881572 - RNA, 22 nt, Human
guggccuggcgagcuggcgcgg

SEQ ID NO: 881573 - RNA, 22 nt, Human
gcaggcccuuagccuugguggg

SEQ ID NO: 881574 - RNA, 22 nt, Human
gaggaagaaucaggguggugag

SEQ ID NO: 881575 - RNA, 22 nt, Human
uuucaagacguuaagucagcuu

SEQ ID NO: 881576 - RNA, 22 nt, Human
ugcaauguguuagaugguuuua

SEQ ID NO: 881577 - RNA, 22 nt, Human
cucugagcccgcugcagcccca

SEQ ID NO: 881578 - RNA, 22 nt, Human
gagacugcauagauggccacaa

SEQ ID NO: 881579 - RNA, 22 nt, Human
gcuaucuuucugcaccauaauu

SEQ ID NO: 881580 - RNA, 22 nt, Human
uccugugggcucucggccucca

SEQ ID NO: 881581 - RNA, 23 nt, Human
agggaagggggcuuauuccacag

SEQ ID NO: 881582 - RNA, 22 nt, Human
gccaggcuggugcaaggauauu

SEQ ID NO: 881583 - RNA, 22 nt, Human
ugugaaaucugaugaauugacc

SEQ ID NO: 881584 - RNA, 22 nt, Human
cagguccuggcagcugacucag

SEQ ID NO: 881585 - RNA, 22 nt, Human
ccagaaagauaggaaaucaagu

SEQ ID NO: 881586 - RNA, 22 nt, Human
gaggugaguggaucacgagguc

SEQ ID NO: 881587 - RNA, 22 nt, Human
acccuggagguggaggugcagu

SEQ ID NO: 881588 - RNA, 21 nt, Human
acugcacacuaugugaauuga

SEQ ID NO: 881589 - RNA, 22 nt, Human
ugggccugcuggggcauuuuca

SEQ ID NO: 881590 - RNA, 22 nt, Human
ugaaggaggaauguggccucca

SEQ ID NO: 881591 - RNA, 22 nt, Human
ucuucagaagaucacaucagug

SEQ ID NO: 881592 - RNA, 22 nt, Human
gcugucuuggguagaaagaggu

SEQ ID NO: 881593 - RNA, 22 nt, Human
agucccagaucuacaggaggga

SEQ ID NO: 881594 - RNA, 22 nt, Human
cuacagugacagaauuaaacag

SEQ ID NO: 881595 - RNA, 22 nt, Human
acaugcuuucuagguccuucug

SEQ ID NO: 881596 - RNA, 22 nt, Human
uauuucuuguucccuccaaguu

SEQ ID NO: 881597 - RNA, 22 nt, Human
ccucccagugccggggccggcu

SEQ ID NO: 881598 - RNA, 22 nt, Human
agacagaauuugucagauaaau

SEQ ID NO: 881599 - RNA, 22 nt, Human
gaaggcaggcuucugauuaggu

SEQ ID NO: 881600 - RNA, 23 nt, Human
auuuuuugucuuuguaacuagau

SEQ ID NO: 881601 - RNA, 22 nt, Human
caagauauguccuguuacuaag

SEQ ID NO: 881602 - RNA, 22 nt, Human
agcugccauccgaggugucaga

SEQ ID NO: 881603 - RNA, 22 nt, Human
cagugauuaaaacaugacagcc

SEQ ID NO: 881604 - RNA, 22 nt, Human
cagacagggcccugugauggua

SEQ ID NO: 881605 - RNA, 22 nt, Human
aaacaugaugccuguacuaaga

SEQ ID NO: 881606 - RNA, 22 nt, Human
uaggggcucagaacauguccuu

SEQ ID NO: 881607 - RNA, 22 nt, Human
cauuuaguuuugcaguagcagg

SEQ ID NO: 881608 - RNA, 23 nt, Human
gccaauuuuugacugucaguagg

SEQ ID NO: 881609 - RNA, 22 nt, Human
cuugggcuauaaauauaaccau

SEQ ID NO: 881610 - RNA, 22 nt, Human
cagaagcaaguagugauucuuu

SEQ ID NO: 881611 - RNA, 22 nt, Human
gcccucuguuauugcauccuua

SEQ ID NO: 881612 - RNA, 22 nt, Human
acuuccaaagaagugauuacag

SEQ ID NO: 881613 - RNA, 22 nt, Human
gcccagagugaguccugggccc

SEQ ID NO: 881614 - RNA, 22 nt, Human
cugcuucacccaacuuugggau

SEQ ID NO: 881615 - RNA, 21 nt, Human
gggaagacugucaggauuccu

SEQ ID NO: 881616 - RNA, 22 nt, Human
uaaauugaaaaucuacagaaca

SEQ ID NO: 881617 - RNA, 21 nt, Human
uagcugugcaacuuugggcaa

SEQ ID NO: 881618 - RNA, 22 nt, Human
cugugggccugauguucuucuc

SEQ ID NO: 881619 - RNA, 22 nt, Human
cugucuguagacauuuuugguu

SEQ ID NO: 881620 - RNA, 22 nt, Human
cagcaaggucugucaauagugg

SEQ ID NO: 881621 - RNA, 22 nt, Human
acugaggcgcaguccggcuguc

SEQ ID NO: 881622 - RNA, 22 nt, Human
ugcuuuguguacacaagaauca

SEQ ID NO: 881623 - RNA, 17 nt, Human
agauggcaggaggcaga

SEQ ID NO: 881624 - RNA, 22 nt, Human
auugaaaauaaggccagaaaca

SEQ ID NO: 881625 - RNA, 22 nt, Human
gggaagcugcguggucuagggc

SEQ ID NO: 881626 - RNA, 22 nt, Human
gcagccaggaagccuuucccuc

SEQ ID NO: 881627 - RNA, 22 nt, Human
ucaagaaaugugcuuggauaua

SEQ ID NO: 881628 - RNA, 22 nt, Human
cuggcuccagugacaagucgau

SEQ ID NO: 881629 - RNA, 22 nt, Human
gucuagcacaucaucucacugc

SEQ ID NO: 881630 - RNA, 22 nt, Human
ugcugcagcagugcgggcagcu

SEQ ID NO: 881631 - RNA, 22 nt, Human
aggagcuaauucauaagccacu

SEQ ID NO: 881632 - RNA, 22 nt, Human
uuuccccagguagauagauaau

SEQ ID NO: 881633 - RNA, 22 nt, Human
ggaggccaggaugggaacucaa

SEQ ID NO: 881634 - RNA, 22 nt, Human
gcugugaguggaggaggcugag

SEQ ID NO: 881635 - RNA, 22 nt, Human
gcuggcuggaacuagcaguugg

SEQ ID NO: 881636 - RNA, 22 nt, Human
auaugugaaugauaucacuuug

SEQ ID NO: 881637 - RNA, 23 nt, Human
ucuguucuuuuagcugaucauuu

SEQ ID NO: 881638 - RNA, 22 nt, Human
acaggccagagguggggcagcc

SEQ ID NO: 881639 - RNA, 22 nt, Human
gcaguggggcgcugggaguugg

SEQ ID NO: 881640 - RNA, 22 nt, Human
ugggcagagaucuggaucaaac

SEQ ID NO: 881641 - RNA, 22 nt, Human
ccaggaggaucauccuguuuuc

SEQ ID NO: 881642 - RNA, 22 nt, Human
ccagggcugcugggggaguuga

SEQ ID NO: 881643 - RNA, 22 nt, Human
auaguacaaucaguuaauuagu

SEQ ID NO: 881644 - RNA, 22 nt, Human
uaaaauguuugcaagagaccag

SEQ ID NO: 881645 - RNA, 22 nt, Human
aaacccagagacuagaaagacc

SEQ ID NO: 881646 - RNA, 23 nt, Human
ucugagaagguuucagccagacu

SEQ ID NO: 881647 - RNA, 22 nt, Human
ccagauaucacugccguguugu

SEQ ID NO: 881648 - RNA, 22 nt, Human
auguucauuuucuuaaugugcc

SEQ ID NO: 881649 - RNA, 22 nt, Human
augggcugacccagucguggca

SEQ ID NO: 881650 - RNA, 22 nt, Human
uuguucauuagcgcuugggcac

SEQ ID NO: 881651 - RNA, 22 nt, Human
uucugucuucccacugaggagc

SEQ ID NO: 881652 - RNA, 22 nt, Human
acaaacuaaaauucuuuauuga

SEQ ID NO: 881653 - RNA, 22 nt, Human
uauguacuacacuagaacauuu

SEQ ID NO: 881654 - RNA, 22 nt, Human
auaguuuucuaugcacuguuau

SEQ ID NO: 881655 - RNA, 18 nt, Human
augucugugcacuggaua

SEQ ID NO: 881656 - RNA, 22 nt, Human
ugucuuaauuuggaugauguuu

SEQ ID NO: 881657 - RNA, 22 nt, Human
uccugcaggcuugaguccucag

SEQ ID NO: 881658 - RNA, 22 nt, Human
auucaguucugcugguucugcu

SEQ ID NO: 881659 - RNA, 22 nt, Human
uuccauuuauucuuguccagau

SEQ ID NO: 881660 - RNA, 22 nt, Human
ggugcugacuucacagucuuac

SEQ ID NO: 881661 - RNA, 22 nt, Human
uucuaauuaaaucuacgcuagg

SEQ ID NO: 881662 - RNA, 22 nt, Human
augcuuuaaaugucuuuugcuu

SEQ ID NO: 881663 - RNA, 22 nt, Human
aaguuaagcauggccaugugac

SEQ ID NO: 881664 - RNA, 22 nt, Human
aggccaguguggcuggagcaca

SEQ ID NO: 881665 - RNA, 22 nt, Human
ugguugaauguagcauuuaugg

SEQ ID NO: 881666 - RNA, 22 nt, Human
cugagcagucuagccagguguu

SEQ ID NO: 881667 - RNA, 22 nt, Human
aaaguucugaugcugaucaaag

SEQ ID NO: 881668 - RNA, 22 nt, Human
agaaaacauaggagacaggaaa

SEQ ID NO: 881669 - RNA, 22 nt, Human
uggcagauaaacaugugauaaa

SEQ ID NO: 881670 - RNA, 22 nt, Human
auggcagaccugggcuggagaa

SEQ ID NO: 881671 - RNA, 20 nt, Human
ugcucuggaaauggucugag

SEQ ID NO: 881672 - RNA, 22 nt, Human
uguucucuaagccacccauuuu

SEQ ID NO: 881673 - RNA, 22 nt, Human
auggaagacagauaaggcagaa

SEQ ID NO: 881674 - RNA, 23 nt, Human
cccaggagccugaguccucucug

SEQ ID NO: 881675 - RNA, 20 nt, Human
cuagaacugagaaauuuaaa

SEQ ID NO: 881676 - RNA, 22 nt, Human
ugggccugugaugcugggcuau

SEQ ID NO: 881677 - RNA, 22 nt, Human
uugagaauaaauuagcagacau

SEQ ID NO: 881678 - RNA, 22 nt, Human
gagggccaacuagcaccacuuu

SEQ ID NO: 881679 - RNA, 22 nt, Human
aaauaugaaugauaagaguuau

SEQ ID NO: 881680 - RNA, 21 nt, Human
ucuaagaacaugauucucccu

SEQ ID NO: 881681 - RNA, 22 nt, Human
gaaggcucuugaggccagguaa

SEQ ID NO: 881682 - RNA, 18 nt, Human
agaggcuggacaggggau

SEQ ID NO: 881683 - RNA, 22 nt, Human
gcagaaguuaaucgaaggccau

SEQ ID NO: 881684 - RNA, 22 nt, Human
uccuucaccuuagcccuccuag

SEQ ID NO: 881685 - RNA, 22 nt, Human
uuuccagugauggggucuggcu

SEQ ID NO: 881686 - RNA, 22 nt, Human
aagcacagagaugggcacgccu

SEQ ID NO: 881687 - RNA, 22 nt, Human
guuuacaugcaugcaagaauga

SEQ ID NO: 881688 - RNA, 22 nt, Human
gggagcuguaagggacagguag

SEQ ID NO: 881689 - RNA, 22 nt, Human
acguguguaugaguguacauau

SEQ ID NO: 881690 - RNA, 22 nt, Human
ucuggagaucauguggggugga

SEQ ID NO: 881691 - RNA, 22 nt, Human
auguuuucuccauguuaugcuu

SEQ ID NO: 881692 - RNA, 22 nt, Human
guguucauggaugucaauuuga

SEQ ID NO: 881693 - RNA, 22 nt, Human
augccuggacugacaugcacug

SEQ ID NO: 881694 - RNA, 22 nt, Human
ucugggcagcagcagcuaguag

SEQ ID NO: 881695 - RNA, 22 nt, Human
uaaugugauauuccuguccuuu

SEQ ID NO: 881696 - RNA, 22 nt, Human
acaaggcuggcugggaaaaacu

SEQ ID NO: 881697 - RNA, 22 nt, Human
ccugucugagccagggugggca

SEQ ID NO: 881698 - RNA, 22 nt, Human
ucacaguuuuagaaaauagaua

SEQ ID NO: 881699 - RNA, 22 nt, Human
ucucuuguaauuuaaaaaaucu

SEQ ID NO: 881700 - RNA, 22 nt, Human
aaggaagacuugagaagguucc

SEQ ID NO: 881701 - RNA, 22 nt, Human
gaaguuugauuuuucuccuaga

SEQ ID NO: 881702 - RNA, 22 nt, Human
agaaacaacuuguuucucuugc

SEQ ID NO: 881703 - RNA, 22 nt, Human
ucccaggugaugcugaggccac

SEQ ID NO: 881704 - RNA, 22 nt, Human
ggcgagcagcgcugugucaggu

SEQ ID NO: 881705 - RNA, 22 nt, Human
ucagaacauugacauucuuauu

SEQ ID NO: 881706 - RNA, 22 nt, Human
gauaacaauaugaaguagauau

SEQ ID NO: 881707 - RNA, 22 nt, Human
agccuuagauaaaugcuagcuc

SEQ ID NO: 881708 - RNA, 22 nt, Human
aagugaaauugccauucuuaua

SEQ ID NO: 881709 - RNA, 22 nt, Human
ucuguucuaagcauucuaugug

SEQ ID NO: 881710 - RNA, 22 nt, Human
uuuggcaagaaaaugugauuga

SEQ ID NO: 881711 - RNA, 22 nt, Human
gagguggcgcgccaucccugcc

SEQ ID NO: 881712 - RNA, 22 nt, Human
aacagacagaaaaaugugaucu

SEQ ID NO: 881713 - RNA, 23 nt, Human
cacugccuucaguugcuucaccu

SEQ ID NO: 881714 - RNA, 22 nt, Human
aggugugaagaguugacacauu

SEQ ID NO: 881715 - RNA, 23 nt, Human
ccugucugugcuggguggacaca

SEQ ID NO: 881716 - RNA, 22 nt, Human
acccagagucauggcacuuagc

SEQ ID NO: 881717 - RNA, 22 nt, Human
uaguuugagaauugaaauagaa

SEQ ID NO: 881718 - RNA, 20 nt, Human
caggccuucaggauggcugg

SEQ ID NO: 881719 - RNA, 22 nt, Human
auuugaaaucuggguuacucug

SEQ ID NO: 881720 - RNA, 22 nt, Human
aggcuggcuggcaggggacaca

SEQ ID NO: 881721 - RNA, 22 nt, Human
ucugcaaacuuaaguugaaaua

SEQ ID NO: 881722 - RNA, 22 nt, Human
ccacagagacaggguccuugcu

SEQ ID NO: 881723 - RNA, 22 nt, Human
uccagccaagccuugguagcug

SEQ ID NO: 881724 - RNA, 22 nt, Human
ugaccugcagucaagaggggaa

SEQ ID NO: 881725 - RNA, 22 nt, Human
uccugaggaaugugaagagaac

SEQ ID NO: 881726 - RNA, 22 nt, Human
uguaaagagaaugguauaugga

SEQ ID NO: 881727 - RNA, 22 nt, Human
ugaaccuucauaaaauuaagug

SEQ ID NO: 881728 - RNA, 22 nt, Human
cagagcaugaauaaaaguuaca

SEQ ID NO: 881729 - RNA, 20 nt, Human
gggcuggcgcauggggaaag

SEQ ID NO: 881730 - RNA, 22 nt, Human
aguugggauucuugguucuggg

SEQ ID NO: 881731 - RNA, 22 nt, Human
ugugcacaggaagcuauucucu

SEQ ID NO: 881732 - RNA, 22 nt, Human
ugagcccaggaguaugaggcug

SEQ ID NO: 881733 - RNA, 22 nt, Human
ucagugcugaguagcgugcacc

SEQ ID NO: 881734 - RNA, 22 nt, Human
uccuggcuuccacuccucuguu

SEQ ID NO: 881735 - RNA, 23 nt, Human
aaaugcugaaucuuuacuguuua

SEQ ID NO: 881736 - RNA, 22 nt, Human
aggugugagaaacgugaccagu

SEQ ID NO: 881737 - RNA, 22 nt, Human
uccuuagggauuuuuccaguca

SEQ ID NO: 881738 - RNA, 22 nt, Human
gcaugggcaagaggacuggggg

SEQ ID NO: 881739 - RNA, 22 nt, Human
gggugcagggucuccagcagcu

SEQ ID NO: 881740 - RNA, 22 nt, Human
guggcagggcuuugcuguucuu

SEQ ID NO: 881741 - RNA, 19 nt, Human
acccagcccaggaguggca

SEQ ID NO: 881742 - RNA, 21 nt, Human
accuuagagagaaagccauca

SEQ ID NO: 881743 - RNA, 22 nt, Human
cugggugguucuaacuguugau

SEQ ID NO: 881744 - RNA, 22 nt, Human
uggcaggaagacguggggcacc

SEQ ID NO: 881745 - RNA, 22 nt, Human
ccugggaccucgcgggaagcgg

SEQ ID NO: 881746 - RNA, 22 nt, Human
cacuagaaagguacagauuaug

SEQ ID NO: 881747 - RNA, 22 nt, Human
gggagagagagcucauguugaa

SEQ ID NO: 881748 - RNA, 22 nt, Human
aaaagagguuaaccaggugugu

SEQ ID NO: 881749 - RNA, 22 nt, Human
uucuuuguagcaaaacguguau

SEQ ID NO: 881750 - RNA, 22 nt, Human
gugggaagaacuucaaguggcu

SEQ ID NO: 881751 - RNA, 22 nt, Human
agcacaggugaaacagucaggu

SEQ ID NO: 881752 - RNA, 22 nt, Human
ucuugagaaauaauuaaacaug

SEQ ID NO: 881753 - RNA, 22 nt, Human
ggaaagagaaguugggaggaau

SEQ ID NO: 881754 - RNA, 22 nt, Human
guuucacacauccugcacauag

SEQ ID NO: 881755 - RNA, 22 nt, Human
cucaaguuucauauuugucuag

SEQ ID NO: 881756 - RNA, 22 nt, Human
acacauuuucuaacagggauca

SEQ ID NO: 881757 - RNA, 22 nt, Human
auauucuugugauuauaaagua

SEQ ID NO: 881758 - RNA, 22 nt, Human
uaggcaauguucuaaggaauga

SEQ ID NO: 881759 - RNA, 22 nt, Human
agcauuuauuucuuagaaauug

SEQ ID NO: 881760 - RNA, 22 nt, Human
uugcauuugcucauuugauaug

SEQ ID NO: 881761 - RNA, 22 nt, Human
uguggcugcaggcgauggagga

SEQ ID NO: 881762 - RNA, 22 nt, Human
cugccucucaggucccugagau

SEQ ID NO: 881763 - RNA, 22 nt, Human
cagugauucaggugccuguugg

SEQ ID NO: 881764 - RNA, 22 nt, Human
augaaauguaaguagagaguuu

SEQ ID NO: 881765 - RNA, 22 nt, Human
cuggcagcauuaacagagagca

SEQ ID NO: 881766 - RNA, 21 nt, Human
aggcccaggaauaugcauuuu

SEQ ID NO: 881767 - RNA, 22 nt, Human
ugguaagguucuacaguguuga

SEQ ID NO: 881768 - RNA, 22 nt, Human
cuuggugagacucccacccacc

SEQ ID NO: 881769 - RNA, 22 nt, Human
aacuuuucauaagggcaaauuu

SEQ ID NO: 881770 - RNA, 17 nt, Human
ggcuggaggggacccgg

SEQ ID NO: 881771 - RNA, 22 nt, Human
gcucugagugauuaaggagcuu

SEQ ID NO: 881772 - RNA, 22 nt, Human
uuggaaagggaggaauguagac

SEQ ID NO: 881773 - RNA, 22 nt, Human
cagauucucacuguauucaggu

SEQ ID NO: 881774 - RNA, 22 nt, Human
aacuacauuguccuuucugaag

SEQ ID NO: 881775 - RNA, 22 nt, Human
uucuuuucugcagcugguauuu

SEQ ID NO: 881776 - RNA, 22 nt, Human
cugcuucacuucgguugcauag

SEQ ID NO: 881777 - RNA, 22 nt, Human
acuugggucaaguagcucacag

SEQ ID NO: 881778 - RNA, 17 nt, Human
aaguccagccugcagcu

SEQ ID NO: 881779 - RNA, 22 nt, Human
uggagguguauaagguagcuuc

SEQ ID NO: 881780 - RNA, 22 nt, Human
agauuucucuuucccuggcuga

SEQ ID NO: 881781 - RNA, 22 nt, Human
uguauuaucaaguaaauacaug

SEQ ID NO: 881782 - RNA, 22 nt, Human
aucauggaagccuaucuugaga

SEQ ID NO: 881783 - RNA, 22 nt, Human
uaauaagucuguuguuuaauug

SEQ ID NO: 881784 - RNA, 22 nt, Human
ccagagcccagcacacggugcu

SEQ ID NO: 881785 - RNA, 22 nt, Human
uggccacaugcgucugugaggc

SEQ ID NO: 881786 - RNA, 22 nt, Human
acaggagaauuaucuggaacaa

SEQ ID NO: 881787 - RNA, 22 nt, Human
auuuccuuugcaaagacugugc

SEQ ID NO: 881788 - RNA, 22 nt, Human
aaggcagcaacuaauggaucuc

SEQ ID NO: 881789 - RNA, 22 nt, Human
guguggggccaggaucagggcu

SEQ ID NO: 881790 - RNA, 22 nt, Human
aguaaacauuucagauuuauuu

SEQ ID NO: 881791 - RNA, 22 nt, Human
ggcaaacagacuugaccaucuu

SEQ ID NO: 881792 - RNA, 22 nt, Human
aaacuugacagugagacaguuu

SEQ ID NO: 881793 - RNA, 22 nt, Human
uggcaaugaggucagaugucuu

SEQ ID NO: 881794 - RNA, 22 nt, Human
uuauguucccuuaagagaacag

SEQ ID NO: 881795 - RNA, 22 nt, Human
agugauuugcaguauuuacuaa

SEQ ID NO: 881796 - RNA, 22 nt, Human
aaaggacuagucuuucuaccau

SEQ ID NO: 881797 - RNA, 22 nt, Human
uucugucacagugcugguauca

SEQ ID NO: 881798 - RNA, 22 nt, Human
ugcuccacuaagccaucccauu

SEQ ID NO: 881799 - RNA, 22 nt, Human
cacaugcaucacgacuuccuuu

SEQ ID NO: 881800 - RNA, 22 nt, Human
gcuccugcagagauguuccaug

SEQ ID NO: 881801 - RNA, 22 nt, Human
uucuuaauggcaaaggauuuua

SEQ ID NO: 881802 - RNA, 22 nt, Human
aacauuuaugauugagguaaau

SEQ ID NO: 881803 - RNA, 22 nt, Human
aaaggcauuuuaauucuaaaga

SEQ ID NO: 881804 - RNA, 22 nt, Human
auuugcuuguucaccaguacuu

SEQ ID NO: 881805 - RNA, 22 nt, Human
cuuccuuggcuucuggggugug

SEQ ID NO: 881806 - RNA, 20 nt, Human
caggcaguuugugguuaggg

SEQ ID NO: 881807 - RNA, 22 nt, Human
auaaaaaggacagauguggucu

SEQ ID NO: 881808 - RNA, 22 nt, Human
accuggcuuuggggauaggcuu

SEQ ID NO: 881809 - RNA, 22 nt, Human
aaauugcuauaugugaauguga

SEQ ID NO: 881810 - RNA, 22 nt, Human
agaguggcuugcucagcuagca

SEQ ID NO: 881811 - RNA, 22 nt, Human
acuggggaguugaagcacuuuc

SEQ ID NO: 881812 - RNA, 22 nt, Human
uguguguguuuauaaaucuaaa

SEQ ID NO: 881813 - RNA, 22 nt, Human
ugcucccagggacucuggcugg

SEQ ID NO: 881814 - RNA, 22 nt, Human
uugagguagagaaaggaaauga

SEQ ID NO: 881815 - RNA, 22 nt, Human
ugauggaggacccagcguggga

SEQ ID NO: 881816 - RNA, 22 nt, Human
caagucaaagacuagaacuagu

SEQ ID NO: 881817 - RNA, 22 nt, Human
auuuauuaagcaucugcuaugu

SEQ ID NO: 881818 - RNA, 22 nt, Human
caguuuuauugguugaaaucug

SEQ ID NO: 881819 - RNA, 22 nt, Human
aaacuuugguauguagcaaaac

SEQ ID NO: 881820 - RNA, 22 nt, Human
gccuggcuaguuagugucaggu

SEQ ID NO: 881821 - RNA, 22 nt, Human
aggagggaccuaggaauauugc

SEQ ID NO: 881822 - RNA, 22 nt, Human
ggucccaggcucccucuugucc

SEQ ID NO: 881823 - RNA, 22 nt, Human
uauuuugcuuuagcugacuguu

SEQ ID NO: 881824 - RNA, 22 nt, Human
uuaacaaauauuucccaugccc

SEQ ID NO: 881825 - RNA, 20 nt, Human
gaaggcaaugguuuggcaca

SEQ ID NO: 881826 - RNA, 23 nt, Human
gggcaccaggagcaccggacagg

SEQ ID NO: 881827 - RNA, 22 nt, Human
gcagacagacugcagugauuuu

SEQ ID NO: 881828 - RNA, 22 nt, Human
augaaaguguuuaaguuuaugu

SEQ ID NO: 881829 - RNA, 22 nt, Human
aaggccauacaaugaaaggggc

SEQ ID NO: 881830 - RNA, 22 nt, Human
acaauguuuuuguucaaagagu

SEQ ID NO: 881831 - RNA, 22 nt, Human
ccuaauuaucucccaaagaucc

SEQ ID NO: 881832 - RNA, 22 nt, Human
gcagagcagagccugcauuggc

SEQ ID NO: 881833 - RNA, 22 nt, Human
cuaauucucagcaugaacuggu

SEQ ID NO: 881834 - RNA, 22 nt, Human
ggcagggcagcgcugauuaggg

SEQ ID NO: 881835 - RNA, 22 nt, Human
uguuuacaaggagaauuugagg

SEQ ID NO: 881836 - RNA, 22 nt, Human
auggacagcaacuggaagcuuc

SEQ ID NO: 881837 - RNA, 22 nt, Human
caggcagaaggaaguaccaggc

SEQ ID NO: 881838 - RNA, 22 nt, Human
gcucuccaggggcucccaggau

SEQ ID NO: 881839 - RNA, 22 nt, Human
ugaaggaaaugacggcagaaga

SEQ ID NO: 881840 - RNA, 22 nt, Human
uccuaacugcccugggcaaggu

SEQ ID NO: 881841 - RNA, 22 nt, Human
ccuaagaauuaaugaauacacc

SEQ ID NO: 881842 - RNA, 22 nt, Human
uuucuaaguaaacacagcauac

SEQ ID NO: 881843 - RNA, 22 nt, Human
gcucugggugaacuuggagcaa

SEQ ID NO: 881844 - RNA, 22 nt, Human
aggugccagaugcacagcugaa

SEQ ID NO: 881845 - RNA, 22 nt, Human
gaagauuugaaacacauagaca

SEQ ID NO: 881846 - RNA, 22 nt, Human
ggcugccuuuagaacggaugcu

SEQ ID NO: 881847 - RNA, 22 nt, Human
ugggccacaagccaugggacca

SEQ ID NO: 881848 - RNA, 22 nt, Human
uugcuauacucauuaguuauuu

SEQ ID NO: 881849 - RNA, 22 nt, Human
agaagccaauccuugucucucu

SEQ ID NO: 881850 - RNA, 22 nt, Human
agcuggaagugcauuucucacu

SEQ ID NO: 881851 - RNA, 22 nt, Human
uuguaucaguuagcuauugcug

SEQ ID NO: 881852 - RNA, 23 nt, Human
guucauuuuauugucugauugcu

SEQ ID NO: 881853 - RNA, 22 nt, Human
guacauauggcacaugcuauuu

SEQ ID NO: 881854 - RNA, 20 nt, Human
cagaaagaagguagauuuuu

SEQ ID NO: 881855 - RNA, 22 nt, Human
uuuggcggggcaauucugaagc

SEQ ID NO: 881856 - RNA, 23 nt, Human
ucaaaguaguuuuauccaauaaa

SEQ ID NO: 881857 - RNA, 22 nt, Human
uuguuaaaauauuggagaaagg

SEQ ID NO: 881858 - RNA, 22 nt, Human
ugcaaaugcccauuuauuuucu

SEQ ID NO: 881859 - RNA, 22 nt, Human
uuauuuaauuuucucacucaga

SEQ ID NO: 881860 - RNA, 22 nt, Human
uacaugcauguguguaaauaua

SEQ ID NO: 881861 - RNA, 22 nt, Human
ucagcauucuuuacaaggauga

SEQ ID NO: 881862 - RNA, 22 nt, Human
uugacaaaggaauugaaucucu

SEQ ID NO: 881863 - RNA, 22 nt, Human
cagugcaggcugggggcccugc

SEQ ID NO: 881864 - RNA, 22 nt, Human
auguuucauccacuggccuuuc

SEQ ID NO: 881865 - RNA, 16 nt, Human
uaacauuuuuaaaagg

SEQ ID NO: 881866 - RNA, 22 nt, Human
ucugaugauaaagcauccuuua

SEQ ID NO: 881867 - RNA, 22 nt, Human
cugcugucaaaaaucacuccau

SEQ ID NO: 881868 - RNA, 22 nt, Human
uauggauggaaagggccaagcu

SEQ ID NO: 881869 - RNA, 22 nt, Human
gaacuuuguggggcugagagga

SEQ ID NO: 881870 - RNA, 22 nt, Human
uccugaaaugugcacaugacau

SEQ ID NO: 881871 - RNA, 22 nt, Human
gcagaccugaccuugggcagca

SEQ ID NO: 881872 - RNA, 22 nt, Human
uggaauguuaugaugaugguaa

SEQ ID NO: 881873 - RNA, 22 nt, Human
auuuuccuuguggguuagcgaa

SEQ ID NO: 881874 - RNA, 22 nt, Human
uagcuuuuaagucauaaccuca

SEQ ID NO: 881875 - RNA, 22 nt, Human
agcaacaguguauaucauaggc

SEQ ID NO: 881876 - RNA, 22 nt, Human
guaacauuauucaugagauaca

SEQ ID NO: 881877 - RNA, 22 nt, Human
ugaaggagaauuaauaggcauu

SEQ ID NO: 881878 - RNA, 22 nt, Human
aagaaagcugaauauucugugu

SEQ ID NO: 881879 - RNA, 22 nt, Human
caaaagcaguucuaucugaguu

SEQ ID NO: 881880 - RNA, 21 nt, Human
gcucaaguuucucuggcaaca

SEQ ID NO: 881881 - RNA, 22 nt, Human
cuggccaggcucucacgugguc

SEQ ID NO: 881882 - RNA, 21 nt, Human
ugugaccugauguaguacauu

SEQ ID NO: 881883 - RNA, 22 nt, Human
acuacaguaagggaggcagcau

SEQ ID NO: 881884 - RNA, 22 nt, Human
cugagaguauuggcaggcuugg

SEQ ID NO: 881885 - RNA, 22 nt, Human
cagaagacugcagggaagggac

SEQ ID NO: 881886 - RNA, 23 nt, Human
guguguggaaagugcaugggccu

SEQ ID NO: 881887 - RNA, 22 nt, Human
ggugucugauuccaaggccaca

SEQ ID NO: 881888 - RNA, 22 nt, Human
uuccaaagaaauugaccaagac

SEQ ID NO: 881889 - RNA, 22 nt, Human
gcuuuucuccuuagugucccug

SEQ ID NO: 881890 - RNA, 22 nt, Human
uaaucuaccacuauugcaauau

SEQ ID NO: 881891 - RNA, 22 nt, Human
caaagugccuguaccacuuugc

SEQ ID NO: 881892 - RNA, 18 nt, Human
ccuguuacacacuggggu

SEQ ID NO: 881893 - RNA, 22 nt, Human
agcuugcuguauuuucuggagg

SEQ ID NO: 881894 - RNA, 22 nt, Human
acugagcauaaauaugugucca

SEQ ID NO: 881895 - RNA, 22 nt, Human
ucucuggaguauaaccagggau

SEQ ID NO: 881896 - RNA, 22 nt, Human
auuacaacuggaauggugcugg

SEQ ID NO: 881897 - RNA, 22 nt, Human
aaucagaauuuauugaaucuuu

SEQ ID NO: 881898 - RNA, 22 nt, Human
uacauacaagauguguuuaaaa

SEQ ID NO: 881899 - RNA, 22 nt, Human
cuucauguacaguuauuggaga

SEQ ID NO: 881900 - RNA, 22 nt, Human
gcuauacaaguguagaauagag

SEQ ID NO: 881901 - RNA, 22 nt, Human
auguagcuugucccacaucaua

SEQ ID NO: 881902 - RNA, 22 nt, Human
caucuacuuuaaggauucuggg

SEQ ID NO: 881903 - RNA, 20 nt, Human
cagguauuacuuccuuuaug

SEQ ID NO: 881904 - RNA, 21 nt, Human
uucugcauuaagguggagaua

SEQ ID NO: 881905 - RNA, 22 nt, Human
cagucaacagagagcccgucag

SEQ ID NO: 881906 - RNA, 22 nt, Human
auuggugcucuggcacauuccu

SEQ ID NO: 881907 - RNA, 22 nt, Human
uguaguccaggaauugugucug

SEQ ID NO: 881908 - RNA, 22 nt, Human
ggaagcugugcucucaggccuc

SEQ ID NO: 881909 - RNA, 22 nt, Human
ucaguaaacagguuuaaguccu

SEQ ID NO: 881910 - RNA, 18 nt, Human
gcuuggcugcagagagag

SEQ ID NO: 881911 - RNA, 22 nt, Human
uuguuuuggagaugagcuaaaa

SEQ ID NO: 881912 - RNA, 22 nt, Human
cagggcugguuugucgaagaaa

SEQ ID NO: 881913 - RNA, 22 nt, Human
ggcaggugacggggaugaguau

SEQ ID NO: 881914 - RNA, 22 nt, Human
gcauuaauguaagacccacucc

SEQ ID NO: 881915 - RNA, 22 nt, Human
uuucaucaucaaaauagugagg

SEQ ID NO: 881916 - RNA, 22 nt, Human
uaggcaggcugaauguagauuu

SEQ ID NO: 881917 - RNA, 22 nt, Human
guccuuggcuugaggcaccuca

SEQ ID NO: 881918 - RNA, 22 nt, Human
uacuuaaaaauuaucaaagugg

SEQ ID NO: 881919 - RNA, 22 nt, Human
acugccagaagacagcuuuuca

SEQ ID NO: 881920 - RNA, 22 nt, Human
caugggagguuggcuuggcaug

SEQ ID NO: 881921 - RNA, 22 nt, Human
cucaaagaagggagguauuugg

SEQ ID NO: 881922 - RNA, 22 nt, Human
gccugugcauagcagcggacuc

SEQ ID NO: 881923 - RNA, 22 nt, Human
gugcuguauaugcaagaggaag

SEQ ID NO: 881924 - RNA, 22 nt, Human
caguacagaaucuauuccugca

SEQ ID NO: 881925 - RNA, 22 nt, Human
uagaacagaaggcaccuucucu

SEQ ID NO: 881926 - RNA, 22 nt, Human
guaaaguaaacccacuuuguag

SEQ ID NO: 881927 - RNA, 20 nt, Human
auccucacccucaguccuag

SEQ ID NO: 881928 - RNA, 22 nt, Human
gccuacauuucccaguugaaug

SEQ ID NO: 881929 - RNA, 22 nt, Human
aggcugccucuuuugagagggu

SEQ ID NO: 881930 - RNA, 22 nt, Human
auauuuacugcuguggugaagg

SEQ ID NO: 881931 - RNA, 20 nt, Human
uggcccuguuuucuccaggc

SEQ ID NO: 881932 - RNA, 22 nt, Human
uguaucugugauguagggguuu

SEQ ID NO: 881933 - RNA, 19 nt, Human
uguguggguuuagaguagu

SEQ ID NO: 881934 - RNA, 22 nt, Human
aacagugaggugaauaugcucc

SEQ ID NO: 881935 - RNA, 22 nt, Human
ugggacacccucacgccugcac

SEQ ID NO: 881936 - RNA, 22 nt, Human
ggagccuggcccggcccuuggc

SEQ ID NO: 881937 - RNA, 22 nt, Human
gcugcaacuguugcucucugca

SEQ ID NO: 881938 - RNA, 22 nt, Human
caggccuugggacccagacugg

SEQ ID NO: 881939 - RNA, 22 nt, Human
augcaauaccuucugaaaauaa

SEQ ID NO: 881940 - RNA, 22 nt, Human
uaggcagugcucugugcuucag

SEQ ID NO: 881941 - RNA, 20 nt, Human
cuccugggacugcugguuau

SEQ ID NO: 881942 - RNA, 22 nt, Human
acucacagggccucaguuuucc

SEQ ID NO: 881943 - RNA, 22 nt, Human
acuaguuuuccauaauauagga

SEQ ID NO: 881944 - RNA, 22 nt, Human
ggcagaaggccucccagcuccu

SEQ ID NO: 881945 - RNA, 22 nt, Human
aacuuagacuuguuucuuggua

SEQ ID NO: 881946 - RNA, 22 nt, Human
gcccugcucuguuggucaccug

SEQ ID NO: 881947 - RNA, 22 nt, Human
guucacaagaguuacagacaga

SEQ ID NO: 881948 - RNA, 22 nt, Human
augaaucaaacuguacacugag

SEQ ID NO: 881949 - RNA, 23 nt, Human
uugcaaaaugcaauugaguuaga

SEQ ID NO: 881950 - RNA, 22 nt, Human
ggucagagccguuagcauucag

SEQ ID NO: 881951 - RNA, 22 nt, Human
ucaaggcaaaguaaauauucaa

SEQ ID NO: 881952 - RNA, 22 nt, Human
gucagcaaaaaauuuaugugag

SEQ ID NO: 881953 - RNA, 22 nt, Human
aaggugugcugugagaccuggu

SEQ ID NO: 881954 - RNA, 22 nt, Human
cccaggaguuggaggcuacggu

SEQ ID NO: 881955 - RNA, 22 nt, Human
cuaauaacaugaacuacuuucu

SEQ ID NO: 881956 - RNA, 22 nt, Human
uuaaaaugaauauugauuagca

SEQ ID NO: 881957 - RNA, 22 nt, Human
uuacaguaugaucaacuuuuca

SEQ ID NO: 881958 - RNA, 22 nt, Human
uguacacacacguguguaucua

SEQ ID NO: 881959 - RNA, 22 nt, Human
uggcugcaggggugucugacau

SEQ ID NO: 881960 - RNA, 22 nt, Human
gucaaauauacuaagagguaaa

SEQ ID NO: 881961 - RNA, 22 nt, Human
acauacuuaugcuaaaaauaua

SEQ ID NO: 881962 - RNA, 22 nt, Human
auaucacagaugcagaaagaga

SEQ ID NO: 881963 - RNA, 22 nt, Human
auagaauguauuauaguacaga

SEQ ID NO: 881964 - RNA, 22 nt, Human
uucuauugcacacaaauaauua

SEQ ID NO: 881965 - RNA, 22 nt, Human
aaauucuaaggucacaauguug

SEQ ID NO: 881966 - RNA, 22 nt, Human
ccagugcuaagguagccucugc

SEQ ID NO: 881967 - RNA, 22 nt, Human
gcugagugauugauauuuuagu

SEQ ID NO: 881968 - RNA, 22 nt, Human
ugaggcucagaagugccaagug

SEQ ID NO: 881969 - RNA, 21 nt, Human
ugcuccaggagggggcagucc

SEQ ID NO: 881970 - RNA, 22 nt, Human
gccuggagcucaugugggcauu

SEQ ID NO: 881971 - RNA, 22 nt, Human
agagaugaaaaggguacugagg

SEQ ID NO: 881972 - RNA, 22 nt, Human
gcucugagcccccagaagcaga

SEQ ID NO: 881973 - RNA, 22 nt, Human
gucuuuuugucuggcagagguc

SEQ ID NO: 881974 - RNA, 22 nt, Human
cuauuuucauucuuacauuguc

SEQ ID NO: 881975 - RNA, 22 nt, Human
ugaggcuuggaggcuccagugg

SEQ ID NO: 881976 - RNA, 22 nt, Human
ugcagcagucagucaggccugg

SEQ ID NO: 881977 - RNA, 22 nt, Human
agguaaggggcucccaaguccc

SEQ ID NO: 881978 - RNA, 19 nt, Human
ggggccugugauggucaca

SEQ ID NO: 881979 - RNA, 18 nt, Human
gcucuggcucaccuccag

SEQ ID NO: 881980 - RNA, 22 nt, Human
ugugugcauacacacgguaaca

SEQ ID NO: 881981 - RNA, 22 nt, Human
gggugggaacaggaugccagga

SEQ ID NO: 881982 - RNA, 22 nt, Human
auuguaaaguacuguguacaau

SEQ ID NO: 881983 - RNA, 22 nt, Human
gguggcugggauuaguagccca

SEQ ID NO: 881984 - RNA, 22 nt, Human
uguguucaugucacuggaaucc

SEQ ID NO: 881985 - RNA, 22 nt, Human
ggcuucauuucuguccuugauu

SEQ ID NO: 881986 - RNA, 22 nt, Human
ucagaaagcuuagugucuugca

SEQ ID NO: 881987 - RNA, 22 nt, Human
aacaucugggcccugauuuugg

SEQ ID NO: 881988 - RNA, 22 nt, Human
ccuuguccucugguuuccuguu

SEQ ID NO: 881989 - RNA, 22 nt, Human
caggcugcugccuagaaugaca

SEQ ID NO: 881990 - RNA, 22 nt, Human
uuauagaaugguggauuuucug

SEQ ID NO: 881991 - RNA, 22 nt, Human
ugacaggugcugggggcagugu

SEQ ID NO: 881992 - RNA, 22 nt, Human
uagggcagccacccaggcugcu

SEQ ID NO: 881993 - RNA, 22 nt, Human
uauugucuaggaauuguuuaaa

SEQ ID NO: 881994 - RNA, 22 nt, Human
ggcuggcucaugcaaaggguga

SEQ ID NO: 881995 - RNA, 22 nt, Human
gacacaguucuguucuaguagg

SEQ ID NO: 881996 - RNA, 22 nt, Human
uuuuccucaggaaugcuaagcu

SEQ ID NO: 881997 - RNA, 16 nt, Human
uccaguguuccuggau

SEQ ID NO: 881998 - RNA, 22 nt, Human
agguauguacacacagcucuaa

SEQ ID NO: 881999 - RNA, 22 nt, Human
aucauacauguaacuaaguaaa

SEQ ID NO: 882000 - RNA, 20 nt, Human
cugcugugauucccuccucc

SEQ ID NO: 882001 - RNA, 22 nt, Human
ucuaggagcuuaaaggaggcca

SEQ ID NO: 882002 - RNA, 22 nt, Human
caaaugcauaguuuauaagaag

SEQ ID NO: 882003 - RNA, 22 nt, Human
acaauauuguacccagaaguuu

SEQ ID NO: 882004 - RNA, 22 nt, Human
ggcaggguaaaccgagguaagu

SEQ ID NO: 882005 - RNA, 22 nt, Human
uccugagcccuggggucagugu

SEQ ID NO: 882006 - RNA, 22 nt, Human
acugaaaaugaauuagaaacag

SEQ ID NO: 882007 - RNA, 22 nt, Human
uaaggaaggggaaagacauguc

SEQ ID NO: 882008 - RNA, 22 nt, Human
ugcagaagugagucaugaggaa

SEQ ID NO: 882009 - RNA, 22 nt, Human
caggagcuucugcccauggcca

SEQ ID NO: 882010 - RNA, 22 nt, Human
uuacacaugcuuuguguguaug

SEQ ID NO: 882011 - RNA, 22 nt, Human
cuuauugugucuuugaauaagu

SEQ ID NO: 882012 - RNA, 22 nt, Human
uccaggcccacucgguggggcu

SEQ ID NO: 882013 - RNA, 22 nt, Human
gagugaguggccaggaggcaga

SEQ ID NO: 882014 - RNA, 22 nt, Human
uuuucucuauauugucugugaa

SEQ ID NO: 882015 - RNA, 22 nt, Human
agugcaaacuuuauugugaccu

SEQ ID NO: 882016 - RNA, 22 nt, Human
auuuagaaguuggagggcaaga

SEQ ID NO: 882017 - RNA, 22 nt, Human
aaacacuguacaaucugcaggg

SEQ ID NO: 882018 - RNA, 22 nt, Human
aaccugaagaaaauauuugcug

SEQ ID NO: 882019 - RNA, 22 nt, Human
auagcaauuugcccaauuaccu

SEQ ID NO: 882020 - RNA, 22 nt, Human
auuauucaaucauauuaaaagu

SEQ ID NO: 882021 - RNA, 22 nt, Human
uguacaggaggccacauuggaa

SEQ ID NO: 882022 - RNA, 22 nt, Human
cuggcuuccaugcuguaguggc

SEQ ID NO: 882023 - RNA, 22 nt, Human
cuguggcauugugaggacugca

SEQ ID NO: 882024 - RNA, 17 nt, Human
agcaggcugcagaggcc

SEQ ID NO: 882025 - RNA, 22 nt, Human
accucccagcucugagcuuggg

SEQ ID NO: 882026 - RNA, 22 nt, Human
cucugggcaccaaagagcagcu

SEQ ID NO: 882027 - RNA, 21 nt, Human
acccaggggaagcagaaacug

SEQ ID NO: 882028 - RNA, 22 nt, Human
cuguccauauucaagggguagg

SEQ ID NO: 882029 - RNA, 22 nt, Human
ugcauuaagguaauuguauaau

SEQ ID NO: 882030 - RNA, 21 nt, Human
ugcagcagauuugggggaaga

SEQ ID NO: 882031 - RNA, 22 nt, Human
gccugggugucgaucacuagug

SEQ ID NO: 882032 - RNA, 22 nt, Human
gcucugugggggaaauccuggg

SEQ ID NO: 882033 - RNA, 22 nt, Human
gcagagcuaucuucuggauuug

SEQ ID NO: 882034 - RNA, 22 nt, Human
aagaauuuuccagcaugucagu

SEQ ID NO: 882035 - RNA, 22 nt, Human
uacagcauguccuuagcaaggc

SEQ ID NO: 882036 - RNA, 22 nt, Human
ucaaacuggcagacuucuacuu

SEQ ID NO: 882037 - RNA, 20 nt, Human
uuucaaacugcaccuuugcu

SEQ ID NO: 882038 - RNA, 20 nt, Human
gggugaggauggagaauuug

SEQ ID NO: 882039 - RNA, 22 nt, Human
accugagaccuaaucugacugu

SEQ ID NO: 882040 - RNA, 22 nt, Human
auuagcaauuguuucauugauc

SEQ ID NO: 882041 - RNA, 22 nt, Human
agagaaacugauguccuuugaa

SEQ ID NO: 882042 - RNA, 22 nt, Human
gggugggguucaggaaucuuca

SEQ ID NO: 882043 - RNA, 22 nt, Human
gcgccuggcacacagcaagggc

SEQ ID NO: 882044 - RNA, 22 nt, Human
agcuggcaccaaauauaguaaa

SEQ ID NO: 882045 - RNA, 22 nt, Human
aaggagcacacaaucuagaacc

SEQ ID NO: 882046 - RNA, 22 nt, Human
uagaaaucauuuagaaguauug

SEQ ID NO: 882047 - RNA, 22 nt, Human
ucagaggugagcuucuugcuaa

SEQ ID NO: 882048 - RNA, 22 nt, Human
uacagaagcuuuugaaaagaug

SEQ ID NO: 882049 - RNA, 22 nt, Human
aacagcuaguaccaauccacua

SEQ ID NO: 882050 - RNA, 17 nt, Human
cugggauguggacucuu

SEQ ID NO: 882051 - RNA, 18 nt, Human
cugggcucgagagauccu

SEQ ID NO: 882052 - RNA, 22 nt, Human
ugaaaccuuggcuagagauuga

SEQ ID NO: 882053 - RNA, 22 nt, Human
acugcagccuagggaccacagu

SEQ ID NO: 882054 - RNA, 22 nt, Human
gugggcaguucaauucugggag

SEQ ID NO: 882055 - RNA, 23 nt, Human
agccucuuguggauggucagcga

SEQ ID NO: 882056 - RNA, 20 nt, Human
aacaaacuacaaaauuaugu

SEQ ID NO: 882057 - RNA, 22 nt, Human
ugacaguuuaguguaauaguua

SEQ ID NO: 882058 - RNA, 22 nt, Human
guuuccuuuaauagugauauug

SEQ ID NO: 882059 - RNA, 20 nt, Human
uggaaggcaucugcauuauu

SEQ ID NO: 882060 - RNA, 21 nt, Human
ugcaauauauauuugccugaa

SEQ ID NO: 882061 - RNA, 22 nt, Human
gccaaauaaguggaaucacaca

SEQ ID NO: 882062 - RNA, 22 nt, Human
uuuaccaaauagauuaugucag

SEQ ID NO: 882063 - RNA, 22 nt, Human
uuucaggcagguggaaugagua

SEQ ID NO: 882064 - RNA, 22 nt, Human
uaacaagucauuuuaucagcag

SEQ ID NO: 882065 - RNA, 22 nt, Human
agagggcuggacgcagguugga

SEQ ID NO: 882066 - RNA, 22 nt, Human
gauguaaauggucuuuggcaga

SEQ ID NO: 882067 - RNA, 22 nt, Human
cuuuggaggucauagccaagag

SEQ ID NO: 882068 - RNA, 22 nt, Human
ccuggcacgaagggcugagguu

SEQ ID NO: 882069 - RNA, 22 nt, Human
ucuggcucagggcucugaggga

SEQ ID NO: 882070 - RNA, 22 nt, Human
auucaaagaaccuuuagcauug

SEQ ID NO: 882071 - RNA, 22 nt, Human
gcuggcagucccaucagcuggg

SEQ ID NO: 882072 - RNA, 22 nt, Human
ggaagcugaggcccagugaagg

SEQ ID NO: 882073 - RNA, 22 nt, Human
uucacccuggaccagaaauugg

SEQ ID NO: 882074 - RNA, 21 nt, Human
uuucauugaaugagauaaggu

SEQ ID NO: 882075 - RNA, 20 nt, Human
cucucuggaaggugggagcc

SEQ ID NO: 882076 - RNA, 22 nt, Human
uucaguguuaaucuugggagaa

SEQ ID NO: 882077 - RNA, 22 nt, Human
ucuucaugucucugcuugaguc

SEQ ID NO: 882078 - RNA, 23 nt, Human
cuagaugcaagcuccaugaggga

SEQ ID NO: 882079 - RNA, 22 nt, Human
caacagaaggaagcagggucag

SEQ ID NO: 882080 - RNA, 23 nt, Human
cuucaucaaaaguuaacacuagu

SEQ ID NO: 882081 - RNA, 22 nt, Human
agggggcucagugacugaagug

SEQ ID NO: 882082 - RNA, 22 nt, Human
ucagcacuggcgcugggcaggu

SEQ ID NO: 882083 - RNA, 22 nt, Human
ugugugucagcccaagggccuu

SEQ ID NO: 882084 - RNA, 22 nt, Human
aagccuuggcccuucauuauaa

SEQ ID NO: 882085 - RNA, 22 nt, Human
ccucuccaguuuuaacgugacc

SEQ ID NO: 882086 - RNA, 22 nt, Human
aagaguggagaauaaaauagga

SEQ ID NO: 882087 - RNA, 22 nt, Human
gaugggcaucaaacaugacgug

SEQ ID NO: 882088 - RNA, 22 nt, Human
agaaggcucacuaagagugacu

SEQ ID NO: 882089 - RNA, 22 nt, Human
uagaaaugcccagauucugcua

SEQ ID NO: 882090 - RNA, 22 nt, Human
aggaacuggauauaaugugaga

SEQ ID NO: 882091 - RNA, 22 nt, Human
gugagguccaguaacuugucca

SEQ ID NO: 882092 - RNA, 22 nt, Human
aggacauguaaauggagaggga

SEQ ID NO: 882093 - RNA, 21 nt, Human
guauucuuuaugaagugaaaa

SEQ ID NO: 882094 - RNA, 22 nt, Human
ucacaggcucuccaccaugagg

SEQ ID NO: 882095 - RNA, 22 nt, Human
aggaagaacagauaauggacgc

SEQ ID NO: 882096 - RNA, 19 nt, Human
uugaagaauaaaaacacau

SEQ ID NO: 882097 - RNA, 22 nt, Human
gaagcccaagcuucacagcuau

SEQ ID NO: 882098 - RNA, 22 nt, Human
auguuguugaacucuuugcaug

SEQ ID NO: 882099 - RNA, 22 nt, Human
cugcaagggaucuucagguagc

SEQ ID NO: 882100 - RNA, 18 nt, Human
cauuuguuauugugugug

SEQ ID NO: 882101 - RNA, 22 nt, Human
gcuccaggaggcucccgcgucu

SEQ ID NO: 882102 - RNA, 22 nt, Human
auuaaacugagcaaauuaacau

SEQ ID NO: 882103 - RNA, 22 nt, Human
ucaugcucugguuuagcuguuu

SEQ ID NO: 882104 - RNA, 22 nt, Human
aagcagcauaugacagcaucca

SEQ ID NO: 882105 - RNA, 22 nt, Human
gcuggggaccagcugucucuga

SEQ ID NO: 882106 - RNA, 22 nt, Human
gacagacaggaggcauucaggg

SEQ ID NO: 882107 - RNA, 19 nt, Human
ugugggcaagggauggcag

SEQ ID NO: 882108 - RNA, 22 nt, Human
cucccugggccucaguuucucu

SEQ ID NO: 882109 - RNA, 22 nt, Human
aagguacaggcauugcugcagc

SEQ ID NO: 882110 - RNA, 22 nt, Human
guggcagccaugagaauauaac

SEQ ID NO: 882111 - RNA, 22 nt, Human
ggagacugaucugagugauaac

SEQ ID NO: 882112 - RNA, 22 nt, Human
auguuuugauugguuaggucug

SEQ ID NO: 882113 - RNA, 22 nt, Human
acacugcagaugaaagcauaag

SEQ ID NO: 882114 - RNA, 22 nt, Human
cuggcauugagggucacaaggc

SEQ ID NO: 882115 - RNA, 22 nt, Human
acaucuguuugagaaaaagaag

SEQ ID NO: 882116 - RNA, 22 nt, Human
uuuucccagagcuguccucaag

SEQ ID NO: 882117 - RNA, 22 nt, Human
acugaaacacugagugaauugu

SEQ ID NO: 882118 - RNA, 22 nt, Human
aaaccugaauguaugucagaag

SEQ ID NO: 882119 - RNA, 22 nt, Human
cagaguacugggagaacagaag

SEQ ID NO: 882120 - RNA, 22 nt, Human
aggcugugaguaguucuuguug

SEQ ID NO: 882121 - RNA, 19 nt, Human
gagcugccuuuugaagacc

SEQ ID NO: 882122 - RNA, 17 nt, Human
uguuuuuucccuguucu

SEQ ID NO: 882123 - RNA, 22 nt, Human
uacaaagucagaauaacaggug

SEQ ID NO: 882124 - RNA, 23 nt, Human
auguaaacuucagagucauugcc

SEQ ID NO: 882125 - RNA, 22 nt, Human
ucaggagggauuguugccuauu

SEQ ID NO: 882126 - RNA, 22 nt, Human
aggcugcagaacagucaggugc

SEQ ID NO: 882127 - RNA, 22 nt, Human
uugcugauucuguauuuaaggu

SEQ ID NO: 882128 - RNA, 22 nt, Human
aaggcauauauucuaaacagga

SEQ ID NO: 882129 - RNA, 22 nt, Human
cugaugccucucuucuuggcuu

SEQ ID NO: 882130 - RNA, 23 nt, Human
ucuguggccccuucgccccacuc

SEQ ID NO: 882131 - RNA, 22 nt, Human
uggcugcaguugggcccucaga

SEQ ID NO: 882132 - RNA, 22 nt, Human
uacaaagagguaauugcauaua

SEQ ID NO: 882133 - RNA, 22 nt, Human
ucaaaguaccauuaucagugga

SEQ ID NO: 882134 - RNA, 22 nt, Human
ucacagugagccaugucagaga

SEQ ID NO: 882135 - RNA, 22 nt, Human
cagagggaaaaggggaguaaua

SEQ ID NO: 882136 - RNA, 22 nt, Human
gcuacugauugaccuuggagag

SEQ ID NO: 882137 - RNA, 22 nt, Human
cugagaagaggguauguggcgc

SEQ ID NO: 882138 - RNA, 22 nt, Human
acucuugucucaacuuuuguau

SEQ ID NO: 882139 - RNA, 22 nt, Human
gagccaggagauaccuaagggg

SEQ ID NO: 882140 - RNA, 22 nt, Human
aaaauuuugcccuauccuucau

SEQ ID NO: 882141 - RNA, 22 nt, Human
gcagcuggacccacacggcuua

SEQ ID NO: 882142 - RNA, 22 nt, Human
uauugaauuagacccuaaaaug

SEQ ID NO: 882143 - RNA, 22 nt, Human
gcaagcuguccuuuugcauggc

SEQ ID NO: 882144 - RNA, 22 nt, Human
uuaggaaguuucagaaaaugca

SEQ ID NO: 882145 - RNA, 22 nt, Human
uuggcagcccugacccaauggg

SEQ ID NO: 882146 - RNA, 22 nt, Human
ucagagagccucaggcacugcc

SEQ ID NO: 882147 - RNA, 22 nt, Human
uguucuguaccuguccuggggc

SEQ ID NO: 882148 - RNA, 22 nt, Human
gcugggcaccucucccagauug

SEQ ID NO: 882149 - RNA, 19 nt, Human
gagcagcuuccuaucuggu

SEQ ID NO: 882150 - RNA, 22 nt, Human
agcagcugcuuuucuucauugg

SEQ ID NO: 882151 - RNA, 22 nt, Human
aaggccacugaagaaaucacaa

SEQ ID NO: 882152 - RNA, 22 nt, Human
cugaagcucuccaguuuguuuc

SEQ ID NO: 882153 - RNA, 22 nt, Human
acacaggaagucagcacugaug

SEQ ID NO: 882154 - RNA, 22 nt, Human
caacaucaguccucaugagaca

SEQ ID NO: 882155 - RNA, 22 nt, Human
aguuuggaagaauuuggucugu

SEQ ID NO: 882156 - RNA, 22 nt, Human
agggcagcuaaggugcugacug

SEQ ID NO: 882157 - RNA, 22 nt, Human
gaaacuugccugaagucaacca

SEQ ID NO: 882158 - RNA, 21 nt, Human
ccacucaugacuccacucacc

SEQ ID NO: 882159 - RNA, 22 nt, Human
ccucugggccuggaagggcagu

SEQ ID NO: 882160 - RNA, 22 nt, Human
gcagugugaugcuuccagccac

SEQ ID NO: 882161 - RNA, 22 nt, Human
gcucucuuucacagagguagga

SEQ ID NO: 882162 - RNA, 22 nt, Human
ugagaguuccuccucuuuccac

SEQ ID NO: 882163 - RNA, 22 nt, Human
auucuggggcugguuauuuuga

SEQ ID NO: 882164 - RNA, 22 nt, Human
cagggcuuuccugagaagugau

SEQ ID NO: 882165 - RNA, 22 nt, Human
cagucccagcugcucagaaggc

SEQ ID NO: 882166 - RNA, 22 nt, Human
ugugcucagccaggggcaggcc

SEQ ID NO: 882167 - RNA, 20 nt, Human
aggcagcuggccaggcaggu

SEQ ID NO: 882168 - RNA, 22 nt, Human
acuaaauuugucaaugacacuu

SEQ ID NO: 882169 - RNA, 22 nt, Human
aaucaaagaaugggcuaguugg

SEQ ID NO: 882170 - RNA, 22 nt, Human
cucuguuucucagccuauuucc

SEQ ID NO: 882171 - RNA, 22 nt, Human
cucugaggucuaggaccauggc

SEQ ID NO: 882172 - RNA, 19 nt, Human
agcaggcagguggcccagg

SEQ ID NO: 882173 - RNA, 17 nt, Human
ggagcagauccaccauu

SEQ ID NO: 882174 - RNA, 22 nt, Human
aaaauauguauaacucuucugc

SEQ ID NO: 882175 - RNA, 22 nt, Human
ugacccuugccaaguuccuuuu

SEQ ID NO: 882176 - RNA, 21 nt, Human
acuuggccaggcccccaccug

SEQ ID NO: 882177 - RNA, 22 nt, Human
gggccuguguguucaggagccu

SEQ ID NO: 882178 - RNA, 22 nt, Human
gaagugcaaccugaaauacuag

SEQ ID NO: 882179 - RNA, 22 nt, Human
uaacaguaccauuaacuuugau

SEQ ID NO: 882180 - RNA, 22 nt, Human
uuaggcaaugcucucaaauuug

SEQ ID NO: 882181 - RNA, 22 nt, Human
gcaccaggcuuagagccccagg

SEQ ID NO: 882182 - RNA, 22 nt, Human
caccucugccucaagcuuccca

SEQ ID NO: 882183 - RNA, 22 nt, Human
uuuccacacucacugcacucau

SEQ ID NO: 882184 - RNA, 22 nt, Human
aguauuuguggauuuguauugg

SEQ ID NO: 882185 - RNA, 22 nt, Human
agccagugggauuagagccucu

SEQ ID NO: 882186 - RNA, 22 nt, Human
uccuaagaagcaugggucccaa

SEQ ID NO: 882187 - RNA, 22 nt, Human
gugcagugagcagugcagcacc

SEQ ID NO: 882188 - RNA, 22 nt, Human
agcagggcucugccaugggccc

SEQ ID NO: 882189 - RNA, 23 nt, Human
agaggcugcaggguauugagaau

SEQ ID NO: 882190 - RNA, 19 nt, Human
ugcugaaguugucagucug

SEQ ID NO: 882191 - RNA, 22 nt, Human
gcaaauguuuuugaguguuuac

SEQ ID NO: 882192 - RNA, 22 nt, Human
cuggagagaauguggaaugauu

SEQ ID NO: 882193 - RNA, 22 nt, Human
cagcagccuacaaugcacagaa

SEQ ID NO: 882194 - RNA, 22 nt, Human
agcaggcuccuuccuucucugg

SEQ ID NO: 882195 - RNA, 22 nt, Human
cugaggcugggcugaggguaua

SEQ ID NO: 882196 - RNA, 22 nt, Human
ugagacaaaauugacagacaaa

SEQ ID NO: 882197 - RNA, 22 nt, Human
ucuuccagauacuuccugacuu

SEQ ID NO: 882198 - RNA, 22 nt, Human
gccuucugcgcucgugucuccg

SEQ ID NO: 882199 - RNA, 22 nt, Human
cuagagaaucuuuuaagaagug

SEQ ID NO: 882200 - RNA, 22 nt, Human
uggcuggucacaugguaggucu

SEQ ID NO: 882201 - RNA, 22 nt, Human
ggcaggagauaaaauauuaguu

SEQ ID NO: 882202 - RNA, 22 nt, Human
gggaggugaaaggucaugugug

SEQ ID NO: 882203 - RNA, 22 nt, Human
gggaugcagucagagccccugu

SEQ ID NO: 882204 - RNA, 22 nt, Human
ugacacacugccaggcgcucgg

SEQ ID NO: 882205 - RNA, 22 nt, Human
uccuggcucugcugccuccuag

SEQ ID NO: 882206 - RNA, 22 nt, Human
ucucccaagccuggcaggggca

SEQ ID NO: 882207 - RNA, 22 nt, Human
ucuguacaccaggggccauucu

SEQ ID NO: 882208 - RNA, 20 nt, Human
gggcagccucgggagugggu

SEQ ID NO: 882209 - RNA, 19 nt, Human
gaguuuaucuccuagcccu

SEQ ID NO: 882210 - RNA, 22 nt, Human
augcuagaagggagcacuaugu

SEQ ID NO: 882211 - RNA, 22 nt, Human
gacuuugccacuugcuccagcu

SEQ ID NO: 882212 - RNA, 22 nt, Human
agacaucagcuugugugcaggg

SEQ ID NO: 882213 - RNA, 20 nt, Human
gagagcuggggaugaggcug

SEQ ID NO: 882214 - RNA, 22 nt, Human
uguuuugucuaauagggcaggu

SEQ ID NO: 882215 - RNA, 22 nt, Human
ucuagaaaaaaacugcugugga

SEQ ID NO: 882216 - RNA, 22 nt, Human
auguuauuuauuauccucgguu

SEQ ID NO: 882217 - RNA, 22 nt, Human
aguucaaacucuauaagaacuu

SEQ ID NO: 882218 - RNA, 22 nt, Human
aaaaucugcuuccuuuuacaga

SEQ ID NO: 882219 - RNA, 19 nt, Human
cuugcugggugguuucugc

SEQ ID NO: 882220 - RNA, 22 nt, Human
augaguuuugggggauguuaga

SEQ ID NO: 882221 - RNA, 22 nt, Human
ugcuggcacgugacugggaagu

SEQ ID NO: 882222 - RNA, 17 nt, Human
auccccagcaucuagaa

SEQ ID NO: 882223 - RNA, 22 nt, Human
gccagagguucaacaacugucu

SEQ ID NO: 882224 - RNA, 22 nt, Human
gacuggccuggagaugcagcug

SEQ ID NO: 882225 - RNA, 22 nt, Human
agccaggccagcugucuugagu

SEQ ID NO: 882226 - RNA, 22 nt, Human
ugccuggguguaaagggccaac

SEQ ID NO: 882227 - RNA, 22 nt, Human
uccuuggcacacucggaucuga

SEQ ID NO: 882228 - RNA, 22 nt, Human
gaccuuagaacgugacacaaga

SEQ ID NO: 882229 - RNA, 22 nt, Human
aaaguaucuuacugcagccgag

SEQ ID NO: 882230 - RNA, 22 nt, Human
cuggcugugucuuggaggagcu

SEQ ID NO: 882231 - RNA, 22 nt, Human
aagggcugggucugguuaaccc

SEQ ID NO: 882232 - RNA, 22 nt, Human
gcaggggaguggcaggcccgga

SEQ ID NO: 882233 - RNA, 22 nt, Human
agcucucccauagggcaagauc

SEQ ID NO: 882234 - RNA, 22 nt, Human
gccugccacgcaugcagaguca

SEQ ID NO: 882235 - RNA, 22 nt, Human
agcagagucugugugcacuuua

SEQ ID NO: 882236 - RNA, 22 nt, Human
agcagggggaguuagacuagau

SEQ ID NO: 882237 - RNA, 20 nt, Human
ggcagcucuagucgaggccc

SEQ ID NO: 882238 - RNA, 23 nt, Human
agugaagcugguuagugaugacc

SEQ ID NO: 882239 - RNA, 22 nt, Human
cagcucugugcaggccugggga

SEQ ID NO: 882240 - RNA, 22 nt, Human
aauaagauccugaagauauguu

SEQ ID NO: 882241 - RNA, 22 nt, Human
aagcugccauagaacgagaggu

SEQ ID NO: 882242 - RNA, 22 nt, Human
aauaacuuaagaaauuucccca

SEQ ID NO: 882243 - RNA, 22 nt, Human
ccagagagucgaugggggacac

SEQ ID NO: 882244 - RNA, 21 nt, Human
agugacagaggaaggugcaua

SEQ ID NO: 882245 - RNA, 22 nt, Human
guauguguaaguaugccaccuu

SEQ ID NO: 882246 - RNA, 22 nt, Human
uacauucauggugacuuguaug

SEQ ID NO: 882247 - RNA, 22 nt, Human
ccuaggcaagaguuggugugga

SEQ ID NO: 882248 - RNA, 22 nt, Human
ucacugcucucuaagcaucgcc

SEQ ID NO: 882249 - RNA, 22 nt, Human
uggcaaaacccacaauuauauc

SEQ ID NO: 882250 - RNA, 22 nt, Human
gcagccagugggaugagaaaga

SEQ ID NO: 882251 - RNA, 22 nt, Human
cugaaaaauauguuuuggagaa

SEQ ID NO: 882252 - RNA, 22 nt, Human
uggcacugggaugcuacuguua

SEQ ID NO: 882253 - RNA, 22 nt, Human
ugcacgaaaucuuucuagucuu

SEQ ID NO: 882254 - RNA, 22 nt, Human
gggcagugucugcaaaugaaca

SEQ ID NO: 882255 - RNA, 22 nt, Human
cucagccagugaucuuuccuuu

SEQ ID NO: 882256 - RNA, 22 nt, Human
aguuauauaacuaucuagaugc

SEQ ID NO: 882257 - RNA, 22 nt, Human
augugugcaaugcuauuuuggc

SEQ ID NO: 882258 - RNA, 17 nt, Human
gucaauauuguugacag

SEQ ID NO: 882259 - RNA, 22 nt, Human
agacacagcuaccauaauacca

SEQ ID NO: 882260 - RNA, 22 nt, Human
gcugugcaguaguagguacagu

SEQ ID NO: 882261 - RNA, 22 nt, Human
uucucagggucuggauggccug

SEQ ID NO: 882262 - RNA, 22 nt, Human
aucucagaaaguuuaauuuuuc

SEQ ID NO: 882263 - RNA, 22 nt, Human
aguggcuguaggcuaugagaga

SEQ ID NO: 882264 - RNA, 22 nt, Human
cugcagggaugugaggcccguu

SEQ ID NO: 882265 - RNA, 22 nt, Human
uuuuuccuagugcuuucuggua

SEQ ID NO: 882266 - RNA, 22 nt, Human
uggcccugccgccacgacgucu

SEQ ID NO: 882267 - RNA, 22 nt, Human
gcacucaggacucucaucagua

SEQ ID NO: 882268 - RNA, 22 nt, Human
ugugaggauggaguucuacagg

SEQ ID NO: 882269 - RNA, 22 nt, Human
gcuaaauuuaagccuuucuccu

SEQ ID NO: 882270 - RNA, 22 nt, Human
aaaaaggcuaagcaucuugugc

SEQ ID NO: 882271 - RNA, 22 nt, Human
ccugggcaacauagugagaccc

SEQ ID NO: 882272 - RNA, 22 nt, Human
ucagugccaauucugccauggg

SEQ ID NO: 882273 - RNA, 20 nt, Human
uauugccuaaauaccagaau

SEQ ID NO: 882274 - RNA, 22 nt, Human
gggggcuagagagaugaaauau

SEQ ID NO: 882275 - RNA, 19 nt, Human
uguuaugacuuugccuuuu

SEQ ID NO: 882276 - RNA, 22 nt, Human
gucaucuuaucauuguugcugu

SEQ ID NO: 882277 - RNA, 22 nt, Human
auuuccaccaucucucugggcc

SEQ ID NO: 882278 - RNA, 22 nt, Human
ccuaggcuggcugucuucaggu

SEQ ID NO: 882279 - RNA, 22 nt, Human
uugugaauagugccgcuauaaa

SEQ ID NO: 882280 - RNA, 22 nt, Human
cccugcagagaccacugaccuu

SEQ ID NO: 882281 - RNA, 22 nt, Human
agcuccugauucucagagauag

SEQ ID NO: 882282 - RNA, 19 nt, Human
uuugacagaguuugagcau

SEQ ID NO: 882283 - RNA, 22 nt, Human
cucagaggcaagcaaggagcug

SEQ ID NO: 882284 - RNA, 22 nt, Human
uacaucaugaaagcauacauca

SEQ ID NO: 882285 - RNA, 22 nt, Human
uagagguagaguuacauuaguc

SEQ ID NO: 882286 - RNA, 22 nt, Human
aaaacagaggugccugggccca

SEQ ID NO: 882287 - RNA, 22 nt, Human
uauuccaacugucauagucaua

SEQ ID NO: 882288 - RNA, 17 nt, Human
ggcaguggaggaagaga

SEQ ID NO: 882289 - RNA, 22 nt, Human
aggccaaguuacuugggaaagc

SEQ ID NO: 882290 - RNA, 22 nt, Human
cucugugagggucuguacagaa

SEQ ID NO: 882291 - RNA, 22 nt, Human
uggcacauagcagguacucagu

SEQ ID NO: 882292 - RNA, 22 nt, Human
ucaugacagccagagcucugac

SEQ ID NO: 882293 - RNA, 22 nt, Human
gugggcagugugucaguaucuu

SEQ ID NO: 882294 - RNA, 22 nt, Human
gauuuuauuagcccaaacuuug

SEQ ID NO: 882295 - RNA, 22 nt, Human
aaaguucauugaugacugaggu

SEQ ID NO: 882296 - RNA, 22 nt, Human
agagggcaaguguaguccagua

SEQ ID NO: 882297 - RNA, 22 nt, Human
aggcagugcagaguccucuucu

SEQ ID NO: 882298 - RNA, 22 nt, Human
gcccaggaagugacucagaugu

SEQ ID NO: 882299 - RNA, 22 nt, Human
guucauuuuacuguaaauagca

SEQ ID NO: 882300 - RNA, 22 nt, Human
aauggcagagacuguugaaaua

SEQ ID NO: 882301 - RNA, 22 nt, Human
aggcugagggcuccugagggca

SEQ ID NO: 882302 - RNA, 22 nt, Human
uggaccagggucccagaguaug

SEQ ID NO: 882303 - RNA, 22 nt, Human
ucacaggguuuggaagccuccu

SEQ ID NO: 882304 - RNA, 22 nt, Human
ggguauuugacaaacugacacu

SEQ ID NO: 882305 - RNA, 22 nt, Human
ugagcagaugucuaacuuuuac

SEQ ID NO: 882306 - RNA, 18 nt, Human
caagagcugcuccuggcc

SEQ ID NO: 882307 - RNA, 23 nt, Human
gauguauauaugagccgucacau

SEQ ID NO: 882308 - RNA, 20 nt, Human
uucugggaauuggguagcug

SEQ ID NO: 882309 - RNA, 22 nt, Human
ucugugccagcagccuccugga

SEQ ID NO: 882310 - RNA, 18 nt, Human
cugcacuguggguagcuc

SEQ ID NO: 882311 - RNA, 22 nt, Human
aaggugugaagagaugggaaga

SEQ ID NO: 882312 - RNA, 22 nt, Human
agcauaggcggugguaggaccc

SEQ ID NO: 882313 - RNA, 22 nt, Human
aacacagcaucccuuaggucgu

SEQ ID NO: 882314 - RNA, 22 nt, Human
gccaggcaggugucggagcccu

SEQ ID NO: 882315 - RNA, 22 nt, Human
auuagguaaucuuuagauacac

SEQ ID NO: 882316 - RNA, 22 nt, Human
agugcaggccccaggccaggcc

SEQ ID NO: 882317 - RNA, 22 nt, Human
acacugaaugcuguuuagaaau

SEQ ID NO: 882318 - RNA, 22 nt, Human
uggaaugaugacuaggaauugu

SEQ ID NO: 882319 - RNA, 20 nt, Human
gcugggaacaggauugaauc

SEQ ID NO: 882320 - RNA, 22 nt, Human
cuauuauuagauaaucuacuug

SEQ ID NO: 882321 - RNA, 19 nt, Human
aguacagaaaagagcccug

SEQ ID NO: 882322 - RNA, 22 nt, Human
gcaaugcagggcaacauggggu

SEQ ID NO: 882323 - RNA, 22 nt, Human
aaggcagguauugaugccacag

SEQ ID NO: 882324 - RNA, 22 nt, Human
uugucauugggguuauuuguua

SEQ ID NO: 882325 - RNA, 22 nt, Human
acaggcugcccgcuccccaccu

SEQ ID NO: 882326 - RNA, 22 nt, Human
uuugcuuaacugguagaaugcg

SEQ ID NO: 882327 - RNA, 22 nt, Human
auguggauagcacaggaauggu

SEQ ID NO: 882328 - RNA, 22 nt, Human
aaacuacacuuugggaccagca

SEQ ID NO: 882329 - RNA, 22 nt, Human
uaugucuggcauguuguaauua

SEQ ID NO: 882330 - RNA, 22 nt, Human
ggccaaaugaaaucugagcaau

SEQ ID NO: 882331 - RNA, 22 nt, Human
acaguggaaaugugggagggga

SEQ ID NO: 882332 - RNA, 22 nt, Human
aauacauauggaauuccauguu

SEQ ID NO: 882333 - RNA, 22 nt, Human
acaaagacgggauaagguuugg

SEQ ID NO: 882334 - RNA, 22 nt, Human
uuugacucauugauuuucucug

SEQ ID NO: 882335 - RNA, 22 nt, Human
guggagcauaacacacuagccu

SEQ ID NO: 882336 - RNA, 22 nt, Human
aaucuaagggaaauuggagaug

SEQ ID NO: 882337 - RNA, 17 nt, Human
uccuuggcaaccaguuc

SEQ ID NO: 882338 - RNA, 22 nt, Human
uaagauuuuuaaaauguccuca

SEQ ID NO: 882339 - RNA, 22 nt, Human
agcaccugggcuggaagacccc

SEQ ID NO: 882340 - RNA, 22 nt, Human
aggagcucuugaugcuugaggg

SEQ ID NO: 882341 - RNA, 22 nt, Human
aaggucugugaggcuguuuguc

SEQ ID NO: 882342 - RNA, 22 nt, Human
agccaguggaauucccaggggu

SEQ ID NO: 882343 - RNA, 22 nt, Human
aauaguugugaaucaggacuag

SEQ ID NO: 882344 - RNA, 22 nt, Human
auuuggucacuaggaaaaucaa

SEQ ID NO: 882345 - RNA, 22 nt, Human
aguuaaacuugccuuuauuccu

SEQ ID NO: 882346 - RNA, 22 nt, Human
gauguggcugccauggagccug

SEQ ID NO: 882347 - RNA, 22 nt, Human
gaagagagccgcgggacaucag

SEQ ID NO: 882348 - RNA, 22 nt, Human
uggcccugggcagaggcaacau

SEQ ID NO: 882349 - RNA, 20 nt, Human
gggaggccccagaguccagg

SEQ ID NO: 882350 - RNA, 22 nt, Human
ucucagucccauugaagaggug

SEQ ID NO: 882351 - RNA, 22 nt, Human
guuauuucagccacagagugca

SEQ ID NO: 882352 - RNA, 22 nt, Human
aauaaaaugaacugguagaguu

SEQ ID NO: 882353 - RNA, 22 nt, Human
acccaggccugagagacaggag

SEQ ID NO: 882354 - RNA, 22 nt, Human
acacuguguggucucucucgga

SEQ ID NO: 882355 - RNA, 22 nt, Human
cacagcugcuuguuagaauagc

SEQ ID NO: 882356 - RNA, 19 nt, Human
uauauuuguugaauaaaaa

SEQ ID NO: 882357 - RNA, 22 nt, Human
ucuaggggcaaugugcaaggac

SEQ ID NO: 882358 - RNA, 22 nt, Human
gaaucagccugaguuugcagcu

SEQ ID NO: 882359 - RNA, 22 nt, Human
ucaaugauaucagcaggaugug

SEQ ID NO: 882360 - RNA, 22 nt, Human
cucucuuuuucgugugccgaag

SEQ ID NO: 882361 - RNA, 22 nt, Human
uggcagcugucagaaugcaaau

SEQ ID NO: 882362 - RNA, 22 nt, Human
cauggcggucaggauguaggug

SEQ ID NO: 882363 - RNA, 22 nt, Human
gggcaggugccagcucccuguc

SEQ ID NO: 882364 - RNA, 22 nt, Human
cagcuucagaagaagccgugag

SEQ ID NO: 882365 - RNA, 22 nt, Human
guucugaaugugccuguacucu

SEQ ID NO: 882366 - RNA, 22 nt, Human
aguggcuggcauaggaacagac

SEQ ID NO: 882367 - RNA, 22 nt, Human
ucacucagguucaugucuuugu

SEQ ID NO: 882368 - RNA, 22 nt, Human
cucaaauagaacugaucuauaa

SEQ ID NO: 882369 - RNA, 22 nt, Human
ggacugaaggacaaucugguuc

SEQ ID NO: 882370 - RNA, 22 nt, Human
ugccuguccugaggaugagggu

SEQ ID NO: 882371 - RNA, 22 nt, Human
gccucaggugcaucucucauuc

SEQ ID NO: 882372 - RNA, 22 nt, Human
ggccagagaagucagacccuug

SEQ ID NO: 882373 - RNA, 22 nt, Human
cagucuccaaaucaaucugaau

SEQ ID NO: 882374 - RNA, 22 nt, Human
uggcuggcguuggggccaguga

SEQ ID NO: 882375 - RNA, 22 nt, Human
aaaggcacacacuccuuguuau

SEQ ID NO: 882376 - RNA, 22 nt, Human
uaucugggaaggggagaauaga

SEQ ID NO: 882377 - RNA, 22 nt, Human
cagcccuggcccaggugccuua

SEQ ID NO: 882378 - RNA, 19 nt, Human
auaaauaaaaagugggaga

SEQ ID NO: 882379 - RNA, 22 nt, Human
cuggccagcauuuuugcuuuag

SEQ ID NO: 882380 - RNA, 22 nt, Human
cagagcaggcccacugcccucc

SEQ ID NO: 882381 - RNA, 20 nt, Human
aacaguaccauuuaucucag

SEQ ID NO: 882382 - RNA, 22 nt, Human
cugagccauaagggaggcuggg

SEQ ID NO: 882383 - RNA, 22 nt, Human
ggaggugggcuaaggacucucu

SEQ ID NO: 882384 - RNA, 22 nt, Human
gaugcaaaaguaucauuuuaau

SEQ ID NO: 882385 - RNA, 18 nt, Human
guuuccugaggugaaggg

SEQ ID NO: 882386 - RNA, 22 nt, Human
uucugagggcuaauguacugua

SEQ ID NO: 882387 - RNA, 22 nt, Human
uugggaggucauaaaucuguuc

SEQ ID NO: 882388 - RNA, 22 nt, Human
gcagggcagugugucugugggg

SEQ ID NO: 882389 - RNA, 22 nt, Human
ucccaggccauaaaacucagag

SEQ ID NO: 882390 - RNA, 22 nt, Human
ucucuguaagagaggcuuucau

SEQ ID NO: 882391 - RNA, 22 nt, Human
gaguacauguauagagauuaac

SEQ ID NO: 882392 - RNA, 22 nt, Human
aaacagcugggagguagaggcg

SEQ ID NO: 882393 - RNA, 22 nt, Human
gaaacagguggcaggcuagauu

SEQ ID NO: 882394 - RNA, 20 nt, Human
gaggcucugggcauggcgcc

SEQ ID NO: 882395 - RNA, 22 nt, Human
auguaaacuuagauaagcagua

SEQ ID NO: 882396 - RNA, 22 nt, Human
ugcagggacaggcucuggggau

SEQ ID NO: 882397 - RNA, 22 nt, Human
cagcagccuagaagcucuacca

SEQ ID NO: 882398 - RNA, 22 nt, Human
cuggcugugcugacugagaggg

SEQ ID NO: 882399 - RNA, 22 nt, Human
aaauucauuuuucuuagugugc

SEQ ID NO: 882400 - RNA, 22 nt, Human
cacauuuaucuguucuuucuag

SEQ ID NO: 882401 - RNA, 22 nt, Human
ucacauguguggcagugcaagu

SEQ ID NO: 882402 - RNA, 22 nt, Human
cagaccuggaaaacaggcuugc

SEQ ID NO: 882403 - RNA, 22 nt, Human
uugagguauugauauuuuauga

SEQ ID NO: 882404 - RNA, 22 nt, Human
guauuauuggguaguaugguaa

SEQ ID NO: 882405 - RNA, 23 nt, Human
ccauucaucucagucauugcuuu

SEQ ID NO: 882406 - RNA, 21 nt, Human
uggagcugccacuuguccucc

SEQ ID NO: 882407 - RNA, 22 nt, Human
gggcagguacaagaugcuucuu

SEQ ID NO: 882408 - RNA, 22 nt, Human
caagagcuagacuuugucagga

SEQ ID NO: 882409 - RNA, 22 nt, Human
cuggaggugccuagaugagcuc

SEQ ID NO: 882410 - RNA, 22 nt, Human
gcaggccauucaggagaugugc

SEQ ID NO: 882411 - RNA, 22 nt, Human
cuggccucacagaggcuaagcc

SEQ ID NO: 882412 - RNA, 22 nt, Human
ucugagggugggagaaggagcu

SEQ ID NO: 882413 - RNA, 22 nt, Human
gaggcccaguccugcaagcacg

SEQ ID NO: 882414 - RNA, 22 nt, Human
gugguauuuaugacagugcccg

SEQ ID NO: 882415 - RNA, 22 nt, Human
ugaaauaucauuuucaucuccc

SEQ ID NO: 882416 - RNA, 22 nt, Human
uccaaugugacuaucagggagc

SEQ ID NO: 882417 - RNA, 22 nt, Human
gacaaugugacagaccaaugau

SEQ ID NO: 882418 - RNA, 22 nt, Human
gcuugggcuuaacuguagguuc

SEQ ID NO: 882419 - RNA, 22 nt, Human
aacaguacuggacaaggaguca

SEQ ID NO: 882420 - RNA, 19 nt, Human
cuggugcuugagugaguca

SEQ ID NO: 882421 - RNA, 20 nt, Human
uaacagaaguagaagugggu

SEQ ID NO: 882422 - RNA, 22 nt, Human
cagcuuugaaacauggcucuag

SEQ ID NO: 882423 - RNA, 22 nt, Human
augugugguacagucccguuua

SEQ ID NO: 882424 - RNA, 23 nt, Human
gaaguucuguucagccagacaag

SEQ ID NO: 882425 - RNA, 22 nt, Human
ccuguagaaucuguagacccau

SEQ ID NO: 882426 - RNA, 22 nt, Human
gcuucucuuaaugccuggcuuu

SEQ ID NO: 882427 - RNA, 22 nt, Human
cugccugcucaccagggcucug

SEQ ID NO: 882428 - RNA, 22 nt, Human
uggaauguuuuccuaaaucaga

SEQ ID NO: 882429 - RNA, 21 nt, Human
acaaaggaagucucuuuuaag

SEQ ID NO: 882430 - RNA, 22 nt, Human
uauguucuagacuuuugcugug

SEQ ID NO: 882431 - RNA, 16 nt, Human
gagaagagcccggcag

SEQ ID NO: 882432 - RNA, 22 nt, Human
gaagguuuuguuugcaaaucau

SEQ ID NO: 882433 - RNA, 22 nt, Human
uguauauaagcauuuacuuguu

SEQ ID NO: 882434 - RNA, 22 nt, Human
ucugaaaugaacucuugaacuu

SEQ ID NO: 882435 - RNA, 18 nt, Human
gcagacacucguggaggg

SEQ ID NO: 882436 - RNA, 21 nt, Human
uccugcagggcagcagagugg

SEQ ID NO: 882437 - RNA, 22 nt, Human
aagacugaguucaaaucacagc

SEQ ID NO: 882438 - RNA, 22 nt, Human
uccugucagugaggcagaugaa

SEQ ID NO: 882439 - RNA, 22 nt, Human
aggaagagcauucacaugguag

SEQ ID NO: 882440 - RNA, 22 nt, Human
ucuuccuaugccaacauucugu

SEQ ID NO: 882441 - RNA, 17 nt, Human
ugucuucugaagagagc

SEQ ID NO: 882442 - RNA, 22 nt, Human
cuguuuccuaccguuuuucauu

SEQ ID NO: 882443 - RNA, 22 nt, Human
gagacagcagggccagggccug

SEQ ID NO: 882444 - RNA, 22 nt, Human
uaguuaaaauaauggagauguu

SEQ ID NO: 882445 - RNA, 22 nt, Human
aaacauucccuaauguguccgu

SEQ ID NO: 882446 - RNA, 22 nt, Human
cugaggcugcccagggccaggu

SEQ ID NO: 882447 - RNA, 22 nt, Human
ucaggcagagggagaagccaag

SEQ ID NO: 882448 - RNA, 22 nt, Human
uucuauguuaguaugggucucc

SEQ ID NO: 882449 - RNA, 22 nt, Human
ugaaaggugacauuucuuggau

SEQ ID NO: 882450 - RNA, 22 nt, Human
uaaugcuugcaaauuaugggac

SEQ ID NO: 882451 - RNA, 17 nt, Human
uuuacauugcucgcagu

SEQ ID NO: 882452 - RNA, 22 nt, Human
agacacagugaguuucuuuccc

SEQ ID NO: 882453 - RNA, 22 nt, Human
ggaguggcagcuaggcugucag

SEQ ID NO: 882454 - RNA, 22 nt, Human
aacauucuauuuugcuaaaaca

SEQ ID NO: 882455 - RNA, 22 nt, Human
uccagagcuguccuacugugag

SEQ ID NO: 882456 - RNA, 22 nt, Human
uccagagaucucucuucccugu

SEQ ID NO: 882457 - RNA, 22 nt, Human
auugcuuuugagcuagaauuuu

SEQ ID NO: 882458 - RNA, 22 nt, Human
ggcugccuuggggguugucauu

SEQ ID NO: 882459 - RNA, 22 nt, Human
ugccugcgaggcaugggugaga

SEQ ID NO: 882460 - RNA, 22 nt, Human
aaggagagagcuuugcuggaac

SEQ ID NO: 882461 - RNA, 22 nt, Human
ccagcagcauccugcagcacuu

SEQ ID NO: 882462 - RNA, 22 nt, Human
aauguaaaauaucuuguacuug

SEQ ID NO: 882463 - RNA, 22 nt, Human
agucccagcucagaaccacuag

SEQ ID NO: 882464 - RNA, 22 nt, Human
acagggcagguggcuacugguc

SEQ ID NO: 882465 - RNA, 22 nt, Human
caggcccagugaucagggcucu

SEQ ID NO: 882466 - RNA, 22 nt, Human
cacaugaauaaggcuuuauugu

SEQ ID NO: 882467 - RNA, 20 nt, Human
aaauggcacaugggaagucc

SEQ ID NO: 882468 - RNA, 22 nt, Human
agcaaggcugggucuaaugggg

SEQ ID NO: 882469 - RNA, 22 nt, Human
ggcugaaaccguuauccacuga

SEQ ID NO: 882470 - RNA, 22 nt, Human
aagguucccucucuggaagccu

SEQ ID NO: 882471 - RNA, 22 nt, Human
ugcauucugaacguaaauguga

SEQ ID NO: 882472 - RNA, 22 nt, Human
gauucaauguugcagauggaau

SEQ ID NO: 882473 - RNA, 22 nt, Human
agccuggcacugaggcagggcg

SEQ ID NO: 882474 - RNA, 22 nt, Human
agcaagguggagaaggaugggu

SEQ ID NO: 882475 - RNA, 22 nt, Human
ugcacuuugcaggcauggaaac

SEQ ID NO: 882476 - RNA, 22 nt, Human
ggcucugggccagaguuggcuu

SEQ ID NO: 882477 - RNA, 20 nt, Human
cccagaagcuuaacagagca

SEQ ID NO: 882478 - RNA, 22 nt, Human
ggccagcccuccucccuggguu

SEQ ID NO: 882479 - RNA, 22 nt, Human
uaggaaacuaauacagucugga

SEQ ID NO: 882480 - RNA, 22 nt, Human
auuuuuuguuaacucaggauag

SEQ ID NO: 882481 - RNA, 22 nt, Human
cccaacaacaugaaacuaccua

SEQ ID NO: 882482 - RNA, 22 nt, Human
agcagggaggcccagggcacug

SEQ ID NO: 882483 - RNA, 22 nt, Human
uagcaguauauuuuaaggaagc

SEQ ID NO: 882484 - RNA, 22 nt, Human
ggaggccaaggcaggcggauca

SEQ ID NO: 882485 - RNA, 22 nt, Human
uagcaaaagcucaacaggaagg

SEQ ID NO: 882486 - RNA, 22 nt, Human
agagcacaggguuuugugccgg

SEQ ID NO: 882487 - RNA, 22 nt, Human
cuggccagccucccagguaccc

SEQ ID NO: 882488 - RNA, 19 nt, Human
cucuggagaacaauagugc

SEQ ID NO: 882489 - RNA, 22 nt, Human
ugggagaagcagugggacagua

SEQ ID NO: 882490 - RNA, 22 nt, Human
ccaggcugagcaugauuggagc

SEQ ID NO: 882491 - RNA, 22 nt, Human
ggcucugggucuguggggagcg

SEQ ID NO: 882492 - RNA, 20 nt, Human
caguugaaauaauuuguuug

SEQ ID NO: 882493 - RNA, 22 nt, Human
ccagaggugcugggagaggucu

SEQ ID NO: 882494 - RNA, 22 nt, Human
gaagaggaugacaggagccggu

SEQ ID NO: 882495 - RNA, 22 nt, Human
gccaccuggacagcugugcccu

SEQ ID NO: 882496 - RNA, 22 nt, Human
uaguuaaagcccuaaauugaua

SEQ ID NO: 882497 - RNA, 20 nt, Human
auagaucagugagacuaaag

SEQ ID NO: 882498 - RNA, 22 nt, Human
aacuuagagcucuccuaaauga

SEQ ID NO: 882499 - RNA, 22 nt, Human
ucaggaagacaaucuuuggcuc

SEQ ID NO: 882500 - RNA, 22 nt, Human
cucuugaguggcaugcucuaac

SEQ ID NO: 882501 - RNA, 22 nt, Human
caggccgggcacugcgcuaggu

SEQ ID NO: 882502 - RNA, 22 nt, Human
auaaucaaaguccuaugacauc

SEQ ID NO: 882503 - RNA, 22 nt, Human
ugucucuucccacucagacccc

SEQ ID NO: 882504 - RNA, 22 nt, Human
aaugcaaagugaggugaguggc

SEQ ID NO: 882505 - RNA, 22 nt, Human
aguggcaggcggagauguagga

SEQ ID NO: 882506 - RNA, 23 nt, Human
gugucauuacuguaauuauugug

SEQ ID NO: 882507 - RNA, 22 nt, Human
aucaucuggguuaaugugcuca

SEQ ID NO: 882508 - RNA, 20 nt, Human
acaucaacuagucacagaca

SEQ ID NO: 882509 - RNA, 23 nt, Human
cacaugcaggcaguggccuucaa

SEQ ID NO: 882510 - RNA, 22 nt, Human
uagcauuuauuccagauuugga

SEQ ID NO: 882511 - RNA, 22 nt, Human
cuuaaaagagaugacggcaggg

SEQ ID NO: 882512 - RNA, 22 nt, Human
caaaugcuaacuucuuuccaaa

SEQ ID NO: 882513 - RNA, 22 nt, Human
cagacccaggauccaaauguug

SEQ ID NO: 882514 - RNA, 22 nt, Human
cugccugcugcccuccagagcc

SEQ ID NO: 882515 - RNA, 22 nt, Human
acugauuucagggaugagaaga

SEQ ID NO: 882516 - RNA, 22 nt, Human
ccugugugcacacgaggccaug

SEQ ID NO: 882517 - RNA, 22 nt, Human
gaucaaaagcuggguucuaaaa

SEQ ID NO: 882518 - RNA, 22 nt, Human
ugcucugaaggggaagggaugg

SEQ ID NO: 882519 - RNA, 22 nt, Human
caggcuuucaggacagcgagcc

SEQ ID NO: 882520 - RNA, 22 nt, Human
caugacauccugaagcugcaca

SEQ ID NO: 882521 - RNA, 22 nt, Human
uggccugguuguugcugccguu

SEQ ID NO: 882522 - RNA, 22 nt, Human
cugccugugugugccugcagaa

SEQ ID NO: 882523 - RNA, 22 nt, Human
gcagugaaacaauaggaucaaa

SEQ ID NO: 882524 - RNA, 22 nt, Human
auccucagaccucagcaaagcc

SEQ ID NO: 882525 - RNA, 22 nt, Human
ucuccugauaucugcagaccua

SEQ ID NO: 882526 - RNA, 21 nt, Human
aggagcuguguuagcuggucg

SEQ ID NO: 882527 - RNA, 22 nt, Human
aauuucaagucuugaagaagua

SEQ ID NO: 882528 - RNA, 22 nt, Human
ucccuucaagauuuggggaaau

SEQ ID NO: 882529 - RNA, 22 nt, Human
ucacauuucaagugcucaaaag

SEQ ID NO: 882530 - RNA, 22 nt, Human
agcuggcucagccggguggucu

SEQ ID NO: 882531 - RNA, 22 nt, Human
uggcuucagagucugaguucuu

SEQ ID NO: 882532 - RNA, 21 nt, Human
cauuucaguaaggaagccugu

SEQ ID NO: 882533 - RNA, 22 nt, Human
gguauggaucagaugggcucaa

SEQ ID NO: 882534 - RNA, 22 nt, Human
ccugaguguaauaaugaaggca

SEQ ID NO: 882535 - RNA, 22 nt, Human
gggcacagaagucuaagacauc

SEQ ID NO: 882536 - RNA, 22 nt, Human
cuguucuuuaguuccacugcaa

SEQ ID NO: 882537 - RNA, 22 nt, Human
ggacagagcagacgagcagcgg

SEQ ID NO: 882538 - RNA, 22 nt, Human
ucuaacuaacuacaguaagagg

SEQ ID NO: 882539 - RNA, 22 nt, Human
cacauuaagaauaaugagacua

SEQ ID NO: 882540 - RNA, 20 nt, Human
gccagcccugacacaggagc

SEQ ID NO: 882541 - RNA, 22 nt, Human
ucagcuucucaaaauggcuuag

SEQ ID NO: 882542 - RNA, 22 nt, Human
ccuggcugaacaaagucccucc

SEQ ID NO: 882543 - RNA, 22 nt, Human
ccugugugcugaugacgacaga

SEQ ID NO: 882544 - RNA, 22 nt, Human
ugaaaugaaugugauucgauag

SEQ ID NO: 882545 - RNA, 22 nt, Human
ggagugaauaaguagggggaaa

SEQ ID NO: 882546 - RNA, 22 nt, Human
auccucucugugacagggaacg

SEQ ID NO: 882547 - RNA, 22 nt, Human
uaugcuuuacuuuucauuguga

SEQ ID NO: 882548 - RNA, 22 nt, Human
cuccagagacacuucucaugau

SEQ ID NO: 882549 - RNA, 22 nt, Human
guaaaauagaauaacguggcua

SEQ ID NO: 882550 - RNA, 22 nt, Human
ggaaagccaggugcucuggugu

SEQ ID NO: 882551 - RNA, 22 nt, Human
cugggcugcggugguagguugu

SEQ ID NO: 882552 - RNA, 22 nt, Human
aggcuagaggcuucuggcuuca

SEQ ID NO: 882553 - RNA, 22 nt, Human
cuggaaggggcagucuuugggc

SEQ ID NO: 882554 - RNA, 23 nt, Human
cagcaagugaauuccaagagaga

SEQ ID NO: 882555 - RNA, 22 nt, Human
caagagcuggagaggcagucua

SEQ ID NO: 882556 - RNA, 21 nt, Human
cauuucuauugaugagaaaag

SEQ ID NO: 882557 - RNA, 19 nt, Human
ucaaugucuggccaauggu

SEQ ID NO: 882558 - RNA, 22 nt, Human
uaucagcaccgcggacagcauc

SEQ ID NO: 882559 - RNA, 22 nt, Human
agcacagguaauacagaguaac

SEQ ID NO: 882560 - RNA, 22 nt, Human
aaucuucaaaauguucugcuug

SEQ ID NO: 882561 - RNA, 22 nt, Human
aaugagucaaaacagcauauag

SEQ ID NO: 882562 - RNA, 22 nt, Human
uccugggaggcaggaccccuuu

SEQ ID NO: 882563 - RNA, 20 nt, Human
uaacaguugaagaacaagga

SEQ ID NO: 882564 - RNA, 22 nt, Human
gccuucccacccugcgaggcug

SEQ ID NO: 882565 - RNA, 22 nt, Human
gccuggcaggccuguuggggcu

SEQ ID NO: 882566 - RNA, 22 nt, Human
ccagccuggacugggucuugug

SEQ ID NO: 882567 - RNA, 22 nt, Human
gaggcggcggccgagccuggcu

SEQ ID NO: 882568 - RNA, 22 nt, Human
augucacaugguucuggggccu

SEQ ID NO: 882569 - RNA, 22 nt, Human
uuccugggugguccugguagag

SEQ ID NO: 882570 - RNA, 22 nt, Human
uagcaggauuugaagaagaucu

SEQ ID NO: 882571 - RNA, 22 nt, Human
gagucccaggauaugugcuguu

SEQ ID NO: 882572 - RNA, 22 nt, Human
gggugggaaggcuaagggauug

SEQ ID NO: 882573 - RNA, 22 nt, Human
uacuguaggugggucacuagua

SEQ ID NO: 882574 - RNA, 22 nt, Human
caggcagcccugcaccaagugu

SEQ ID NO: 882575 - RNA, 22 nt, Human
ugcuggcucugggccaagcagg

SEQ ID NO: 882576 - RNA, 22 nt, Human
ucuucuguuaccacagcgauga

SEQ ID NO: 882577 - RNA, 22 nt, Human
augcuuaacucuguacauaguu

SEQ ID NO: 882578 - RNA, 22 nt, Human
gaagauuuuucuuaaugcuccg

SEQ ID NO: 882579 - RNA, 19 nt, Human
uucuuacaacacccuggga

SEQ ID NO: 882580 - RNA, 22 nt, Human
aggcagcugaccacaguaugau

SEQ ID NO: 882581 - RNA, 22 nt, Human
acucugggcccacccucagagu

SEQ ID NO: 882582 - RNA, 22 nt, Human
caguuacauuaauaaugcacau

SEQ ID NO: 882583 - RNA, 22 nt, Human
acagcccaggacuccagugggc

SEQ ID NO: 882584 - RNA, 19 nt, Human
gcucucccucucaguugag

SEQ ID NO: 882585 - RNA, 22 nt, Human
aaccuggaggcuguguagucuu

SEQ ID NO: 882586 - RNA, 22 nt, Human
ucccaggcaggugacaggggga

SEQ ID NO: 882587 - RNA, 22 nt, Human
cucugcuuuuaugugccggcgc

SEQ ID NO: 882588 - RNA, 22 nt, Human
gaggaaguucuaugauuacauc

SEQ ID NO: 882589 - RNA, 18 nt, Human
cagaggagagacauucag

SEQ ID NO: 882590 - RNA, 22 nt, Human
uccugggaguaauugagucaug

SEQ ID NO: 882591 - RNA, 22 nt, Human
gggcucagucggcaagccccuu

SEQ ID NO: 882592 - RNA, 22 nt, Human
aaagccauaagccuaauacuaa

SEQ ID NO: 882593 - RNA, 22 nt, Human
aacaguuugagcuuugaauuuc

SEQ ID NO: 882594 - RNA, 22 nt, Human
acuagccaaguuuuacgacuaa

SEQ ID NO: 882595 - RNA, 22 nt, Human
aggcuuguggggaaucugugug

SEQ ID NO: 882596 - RNA, 22 nt, Human
uccaugagggacacuggaugcu

SEQ ID NO: 882597 - RNA, 22 nt, Human
gucacaggaaaggguguaaggg

SEQ ID NO: 882598 - RNA, 22 nt, Human
ggcugcaguugugugaaggccg

SEQ ID NO: 882599 - RNA, 22 nt, Human
ugcagcaaaaggucagagggag

SEQ ID NO: 882600 - RNA, 22 nt, Human
aggcuguguuuccccuggagcu

SEQ ID NO: 882601 - RNA, 22 nt, Human
uugagaagguggucauuugcaa

SEQ ID NO: 882602 - RNA, 18 nt, Human
agcaagacagugguguga

SEQ ID NO: 882603 - RNA, 15 nt, Human
cccaggaguucgaga

SEQ ID NO: 882604 - RNA, 17 nt, Human
uccaagccagcuugccu

SEQ ID NO: 882605 - RNA, 21 nt, Human
gucaggagccgucuuacauuc

SEQ ID NO: 882606 - RNA, 22 nt, Human
caaaucuauauguugauauucu

SEQ ID NO: 882607 - RNA, 22 nt, Human
aguagcagaguuggacuaugca

SEQ ID NO: 882608 - RNA, 21 nt, Human
agcuuacauuaccauuguugc

SEQ ID NO: 882609 - RNA, 22 nt, Human
guccucuguguaggcugcagac

SEQ ID NO: 882610 - RNA, 22 nt, Human
agccagcaggaacgucuagguu

SEQ ID NO: 882611 - RNA, 22 nt, Human
ggcugaaguucuuuuuguucag

SEQ ID NO: 882612 - RNA, 22 nt, Human
auguucaaagaucgugcuaucc

SEQ ID NO: 882613 - RNA, 22 nt, Human
uauguacauggagagcaauuga

SEQ ID NO: 882614 - RNA, 17 nt, Human
gcucugccccagccucu

SEQ ID NO: 882615 - RNA, 20 nt, Human
gugcaauggcgcaaucucgg

SEQ ID NO: 882616 - RNA, 22 nt, Human
uucucuccuccuagaggcuuuu

SEQ ID NO: 882617 - RNA, 22 nt, Human
auucaguuucauggcacagcua

SEQ ID NO: 882618 - RNA, 22 nt, Human
ugcucccaggcauucucuguug

SEQ ID NO: 882619 - RNA, 22 nt, Human
uuuauuccaaagcuugcacuuu

SEQ ID NO: 882620 - RNA, 22 nt, Human
cuuuucuuguauuggaugcccc

SEQ ID NO: 882621 - RNA, 22 nt, Human
uugcagaauacuuauucuguau

SEQ ID NO: 882622 - RNA, 22 nt, Human
ucucuacagauccuauauagaa

SEQ ID NO: 882623 - RNA, 22 nt, Human
ugaggcugccuugggaagaggg

SEQ ID NO: 882624 - RNA, 17 nt, Human
ugaagaugcauggcagc

SEQ ID NO: 882625 - RNA, 22 nt, Human
ggccugugcacaugugcaggaa

SEQ ID NO: 882626 - RNA, 22 nt, Human
aagaaaacaaugacuugccagc

SEQ ID NO: 882627 - RNA, 22 nt, Human
aggcugugagcaagaacaccua

SEQ ID NO: 882628 - RNA, 22 nt, Human
uggggcugucccgguuuggcga

SEQ ID NO: 882629 - RNA, 22 nt, Human
ugaaaucauugggguugaauaa

SEQ ID NO: 882630 - RNA, 22 nt, Human
acaaaguaagggcuaaugagca

SEQ ID NO: 882631 - RNA, 22 nt, Human
aaggcugguuccaucccuggug

SEQ ID NO: 882632 - RNA, 22 nt, Human
acccugagucagacagccugac

SEQ ID NO: 882633 - RNA, 22 nt, Human
ucccacucccaggcaggccucu

SEQ ID NO: 882634 - RNA, 22 nt, Human
uuaugaaaacaaucaguaggca

SEQ ID NO: 882635 - RNA, 21 nt, Human
gcauuaaaagcaguuguuggu

SEQ ID NO: 882636 - RNA, 22 nt, Human
ugucccauggcuuuucuggugg

SEQ ID NO: 882637 - RNA, 22 nt, Human
caggcccugccuugagggaccu

SEQ ID NO: 882638 - RNA, 22 nt, Human
ggauaguucuggauauuuuaag

SEQ ID NO: 882639 - RNA, 20 nt, Human
uguggacucaguuucuugcu

SEQ ID NO: 882640 - RNA, 22 nt, Human
uggccaggcuggucuggaacgc

SEQ ID NO: 882641 - RNA, 22 nt, Human
cugggcuaauuaagcacagcug

SEQ ID NO: 882642 - RNA, 22 nt, Human
cccugaggggaguggugaggug

SEQ ID NO: 882643 - RNA, 22 nt, Human
aucacaaaggucucagagcaca

SEQ ID NO: 882644 - RNA, 22 nt, Human
agucugguauuggucuuuaauc

SEQ ID NO: 882645 - RNA, 22 nt, Human
acugucuuguuccaagacuaaa

SEQ ID NO: 882646 - RNA, 22 nt, Human
caugucacuuuaacaaauuagu

SEQ ID NO: 882647 - RNA, 22 nt, Human
ugcuccuguuucaucagcuaua

SEQ ID NO: 882648 - RNA, 22 nt, Human
guguaguauaagguuaaaaccu

SEQ ID NO: 882649 - RNA, 22 nt, Human
agaggucuuuuggucugcagaa

SEQ ID NO: 882650 - RNA, 22 nt, Human
ucuucagaggagcugaauauau

SEQ ID NO: 882651 - RNA, 22 nt, Human
ccugccagggccuuggaagaaa

SEQ ID NO: 882652 - RNA, 22 nt, Human
uucucagggcccuguguuagcu

SEQ ID NO: 882653 - RNA, 22 nt, Human
uagaagcaguaauagaaauagg

SEQ ID NO: 882654 - RNA, 19 nt, Human
aauaauguucaugagauug

SEQ ID NO: 882655 - RNA, 22 nt, Human
gugaguuacucugguucucauu

SEQ ID NO: 882656 - RNA, 22 nt, Human
cccaguaccucuguucccugcu

SEQ ID NO: 882657 - RNA, 22 nt, Human
auuucugauaaacguaagcugc

SEQ ID NO: 882658 - RNA, 22 nt, Human
cuuguuuaaauaagauagcagu

SEQ ID NO: 882659 - RNA, 22 nt, Human
agcaagcacacuucaugugaac

SEQ ID NO: 882660 - RNA, 21 nt, Human
ugggcacugagggugcugcuc

SEQ ID NO: 882661 - RNA, 22 nt, Human
ucauuaaauguuuguugugcca

SEQ ID NO: 882662 - RNA, 21 nt, Human
agugugugauaggcaggaaga

SEQ ID NO: 882663 - RNA, 22 nt, Human
cagaguggcacucugcuggaug

SEQ ID NO: 882664 - RNA, 22 nt, Human
cugggcagcuccauaccaccca

SEQ ID NO: 882665 - RNA, 22 nt, Human
uuucaguuuccagcuuugucau

SEQ ID NO: 882666 - RNA, 22 nt, Human
cugggaagggacgccagugccu

SEQ ID NO: 882667 - RNA, 22 nt, Human
agagugggccucugagucccag

SEQ ID NO: 882668 - RNA, 22 nt, Human
gcugcucagugggccugagccu

SEQ ID NO: 882669 - RNA, 22 nt, Human
auauuucuccaaauguuuucaa

SEQ ID NO: 882670 - RNA, 22 nt, Human
cuggcacagagacagaaggauu

SEQ ID NO: 882671 - RNA, 22 nt, Human
gcuuuagaaauguaggagauac

SEQ ID NO: 882672 - RNA, 22 nt, Human
ugcugaggcuagaccuggaagu

SEQ ID NO: 882673 - RNA, 22 nt, Human
uugagaaaagcuguguaaggau

SEQ ID NO: 882674 - RNA, 22 nt, Human
gcaggagcagucaggggcagcu

SEQ ID NO: 882675 - RNA, 22 nt, Human
auuuugacugcauuacagaaca

SEQ ID NO: 882676 - RNA, 22 nt, Human
uuugagaaacugauuauuaugg

SEQ ID NO: 882677 - RNA, 22 nt, Human
aucuuuggugcuuggugcuccc

SEQ ID NO: 882678 - RNA, 22 nt, Human
uaggggaggggaucaugugcug

SEQ ID NO: 882679 - RNA, 22 nt, Human
uccaggagggggagccgugccg

SEQ ID NO: 882680 - RNA, 22 nt, Human
ucagacagugugaucagucucu

SEQ ID NO: 882681 - RNA, 22 nt, Human
ccugcagggugcugccacagau

SEQ ID NO: 882682 - RNA, 22 nt, Human
gcccagcacagcuggaagaguc

SEQ ID NO: 882683 - RNA, 22 nt, Human
uauuacaauuuacauugcacuu

SEQ ID NO: 882684 - RNA, 22 nt, Human
ucauugaaagugccuccucgga

SEQ ID NO: 882685 - RNA, 22 nt, Human
auaaacaagacuggccaacuuu

SEQ ID NO: 882686 - RNA, 22 nt, Human
ucuuccugcuuuggugaggcuu

SEQ ID NO: 882687 - RNA, 22 nt, Human
cuuuuguugcccuugucgcagg

SEQ ID NO: 882688 - RNA, 22 nt, Human
aagccaaguuggaagacugaau

SEQ ID NO: 882689 - RNA, 22 nt, Human
uaagaauuccaucgcagaguau

SEQ ID NO: 882690 - RNA, 22 nt, Human
uaguaaagugucuuaacacaua

SEQ ID NO: 882691 - RNA, 22 nt, Human
cccugcugaaucccauggaguc

SEQ ID NO: 882692 - RNA, 22 nt, Human
auuguuuuccaaagaugcugcu

SEQ ID NO: 882693 - RNA, 22 nt, Human
ccuggaagauucaccacuacca

SEQ ID NO: 882694 - RNA, 22 nt, Human
ugcucuucggggccacugcuug

SEQ ID NO: 882695 - RNA, 22 nt, Human
agaggcuccucggugccucgug

SEQ ID NO: 882696 - RNA, 22 nt, Human
ggagccugcgggagcucccauu

SEQ ID NO: 882697 - RNA, 22 nt, Human
ugaagaaacagaccaagaggau

SEQ ID NO: 882698 - RNA, 22 nt, Human
aaaucuuccugaaauuuguuca

SEQ ID NO: 882699 - RNA, 22 nt, Human
cuggcagcucuacucagagccu

SEQ ID NO: 882700 - RNA, 22 nt, Human
gaggcccagagagguugcauga

SEQ ID NO: 882701 - RNA, 22 nt, Human
caguuaaagugcuuaucacaga

SEQ ID NO: 882702 - RNA, 23 nt, Human
ugucauugugacuacagaaccag

SEQ ID NO: 882703 - RNA, 22 nt, Human
uucuucuuuaucucaguauccu

SEQ ID NO: 882704 - RNA, 22 nt, Human
ugaguguguauuauguaucagg

SEQ ID NO: 882705 - RNA, 22 nt, Human
ugccauagcaaugguaagcuga

SEQ ID NO: 882706 - RNA, 22 nt, Human
agcaagaaaucuucaguguucu

SEQ ID NO: 882707 - RNA, 22 nt, Human
cacagaggacuguagcggggag

SEQ ID NO: 882708 - RNA, 22 nt, Human
auccagggauaaaaguaagguu

SEQ ID NO: 882709 - RNA, 22 nt, Human
cuucaaagauuauugaaaacaa

SEQ ID NO: 882710 - RNA, 22 nt, Human
gcaagaacgaauccuacuugcu

SEQ ID NO: 882711 - RNA, 22 nt, Human
ucuggccccgcaugcacuuuau

SEQ ID NO: 882712 - RNA, 22 nt, Human
aauaauguuuauuuguauucuc

SEQ ID NO: 882713 - RNA, 22 nt, Human
ggagaggugagagguacaaguu

SEQ ID NO: 882714 - RNA, 22 nt, Human
ggcagcaguaggagcuaaucuu

SEQ ID NO: 882715 - RNA, 22 nt, Human
agcacagcagcgucuaaccgau

SEQ ID NO: 882716 - RNA, 22 nt, Human
ccuguugucucuuccuguugac

SEQ ID NO: 882717 - RNA, 22 nt, Human
caugcccuccuugccuucacug

SEQ ID NO: 882718 - RNA, 21 nt, Human
uuagaacaauauuugguauag

SEQ ID NO: 882719 - RNA, 22 nt, Human
cauaaaguaaagaugucuucca

SEQ ID NO: 882720 - RNA, 22 nt, Human
uuaccaaaugaaauagagauuu

SEQ ID NO: 882721 - RNA, 19 nt, Human
aaauacugaaguuguucau

SEQ ID NO: 882722 - RNA, 21 nt, Human
cugugggaccaagcacuggga

SEQ ID NO: 882723 - RNA, 22 nt, Human
aggcauggcacugagcagcuuc

SEQ ID NO: 882724 - RNA, 22 nt, Human
gcagguccagucaccagagaga

SEQ ID NO: 882725 - RNA, 22 nt, Human
caguggauuaaggagggcagcu

SEQ ID NO: 882726 - RNA, 22 nt, Human
cagcagucccugcaguggggaa

SEQ ID NO: 882727 - RNA, 22 nt, Human
aaugugaaaccgcacagaauaa

SEQ ID NO: 882728 - RNA, 22 nt, Human
aucucuggccuuccuuuuccaa

SEQ ID NO: 882729 - RNA, 22 nt, Human
aggcaguugaguggcuuuuuca

SEQ ID NO: 882730 - RNA, 22 nt, Human
ccugugcuggacagggcugggc

SEQ ID NO: 882731 - RNA, 22 nt, Human
aaagguuuuuauuuauccugga

SEQ ID NO: 882732 - RNA, 22 nt, Human
cuguacaaauggcaguugaguu

SEQ ID NO: 882733 - RNA, 22 nt, Human
ucuggggaugaggaccuagaug

SEQ ID NO: 882734 - RNA, 22 nt, Human
caggccagggagaauaugaagc

SEQ ID NO: 882735 - RNA, 22 nt, Human
uaggccagauuacuagaguagg

SEQ ID NO: 882736 - RNA, 22 nt, Human
ugcuuaauauugugauguaaua

SEQ ID NO: 882737 - RNA, 22 nt, Human
uagcauuagucagauauguuuu

SEQ ID NO: 882738 - RNA, 22 nt, Human
agucugaaguagucuuuagugu

SEQ ID NO: 882739 - RNA, 22 nt, Human
caggcccucgcccgcagcgacc

SEQ ID NO: 882740 - RNA, 22 nt, Human
ugggggaagagcuuguuaaagu

SEQ ID NO: 882741 - RNA, 19 nt, Human
acccuaggaggucugguga

SEQ ID NO: 882742 - RNA, 22 nt, Human
ugaggggcggccugcagaggcc

SEQ ID NO: 882743 - RNA, 17 nt, Human
agcuacaaggcaguuca

SEQ ID NO: 882744 - RNA, 22 nt, Human
gaggagcugaggcugaggccuc

SEQ ID NO: 882745 - RNA, 22 nt, Human
agguagaggccuccaggcagca

SEQ ID NO: 882746 - RNA, 22 nt, Human
augcuuuacaguuuuccaaaca

SEQ ID NO: 882747 - RNA, 22 nt, Human
uaacaacuggacaauguugcuc

SEQ ID NO: 882748 - RNA, 22 nt, Human
ggcugcagcggauuggggauug

SEQ ID NO: 882749 - RNA, 22 nt, Human
ggaagggcaaaagagaugaacu

SEQ ID NO: 882750 - RNA, 22 nt, Human
ccucaaaguagagggagaugag

SEQ ID NO: 882751 - RNA, 22 nt, Human
uaaacagugauacguuccagcu

SEQ ID NO: 882752 - RNA, 22 nt, Human
ugugacuugauguuugcaccag

SEQ ID NO: 882753 - RNA, 22 nt, Human
gcugcaggcuguggcaggggag

SEQ ID NO: 882754 - RNA, 22 nt, Human
gcccaauagagaaauagugaaa

SEQ ID NO: 882755 - RNA, 21 nt, Human
aaguccaauaccuaaggcucc

SEQ ID NO: 882756 - RNA, 22 nt, Human
cccagagguuccuuagggacca

SEQ ID NO: 882757 - RNA, 22 nt, Human
uuugcauugcauacaaggaacu

SEQ ID NO: 882758 - RNA, 22 nt, Human
accugaaaccaacuuguguacu

SEQ ID NO: 882759 - RNA, 22 nt, Human
caacacagggguuaugccaugg

SEQ ID NO: 882760 - RNA, 22 nt, Human
ucuagaagauaccugcugccaa

SEQ ID NO: 882761 - RNA, 22 nt, Human
ggucccagcugcucaagaggcu

SEQ ID NO: 882762 - RNA, 22 nt, Human
cauucccacguguucuuugcuu

SEQ ID NO: 882763 - RNA, 22 nt, Human
ggcuuuagggcaggcaguguua

SEQ ID NO: 882764 - RNA, 22 nt, Human
ucuguggcuuucuuauguugua

SEQ ID NO: 882765 - RNA, 22 nt, Human
uaagugaaauggugcaucaaau

SEQ ID NO: 882766 - RNA, 22 nt, Human
ucccucagucccuggacaggca

SEQ ID NO: 882767 - RNA, 22 nt, Human
augaaaugcugagaggugcuuc

SEQ ID NO: 882768 - RNA, 22 nt, Human
ucacaucugugugauugucauu

SEQ ID NO: 882769 - RNA, 22 nt, Human
gacuggaaagccuguccucaga

SEQ ID NO: 882770 - RNA, 22 nt, Human
uuuggaaaaagccugaacauag

SEQ ID NO: 882771 - RNA, 22 nt, Human
cugacacccagcagaacuggga

SEQ ID NO: 882772 - RNA, 22 nt, Human
gucccuggaucugggacagcug

SEQ ID NO: 882773 - RNA, 22 nt, Human
cuagugaaauuugcaaguaauu

SEQ ID NO: 882774 - RNA, 22 nt, Human
aauaguucuagcucagaagcuc

SEQ ID NO: 882775 - RNA, 22 nt, Human
uauggaaauaauuagacaagug

SEQ ID NO: 882776 - RNA, 21 nt, Human
cacaggcuucuauacacaaug

SEQ ID NO: 882777 - RNA, 16 nt, Human
uacaauguagaaaaca

SEQ ID NO: 882778 - RNA, 22 nt, Human
gaggcucagagugguuaaauaa

SEQ ID NO: 882779 - RNA, 22 nt, Human
augucagauguuuaucugauuu

SEQ ID NO: 882780 - RNA, 22 nt, Human
aguggggaagauuuugcaguca

SEQ ID NO: 882781 - RNA, 22 nt, Human
uucucaaaacucaggguaucug

SEQ ID NO: 882782 - RNA, 22 nt, Human
auagaaauguauuuuggacuag

SEQ ID NO: 882783 - RNA, 22 nt, Human
uggccugaguugucugcaggcc

SEQ ID NO: 882784 - RNA, 22 nt, Human
ugcuggcacguggaccaggaga

SEQ ID NO: 882785 - RNA, 22 nt, Human
agcaugaaaggcgugccaacuu

SEQ ID NO: 882786 - RNA, 22 nt, Human
agagaacauuagcaaaaacagc

SEQ ID NO: 882787 - RNA, 22 nt, Human
uucuuagaugauuaaugauggg

SEQ ID NO: 882788 - RNA, 22 nt, Human
acagcuguauccccagagcuca

SEQ ID NO: 882789 - RNA, 22 nt, Human
cuaaggguugaaacagcaagaa

SEQ ID NO: 882790 - RNA, 22 nt, Human
uccuggguagccuguccaagau

SEQ ID NO: 882791 - RNA, 22 nt, Human
gaauaauugugaugcuugaagu

SEQ ID NO: 882792 - RNA, 22 nt, Human
aggcuacuucuagagggacaau

SEQ ID NO: 882793 - RNA, 21 nt, Human
ccugagaucuggaguggcuuu

SEQ ID NO: 882794 - RNA, 22 nt, Human
aaugucuuacauuuacugagca

SEQ ID NO: 882795 - RNA, 22 nt, Human
ccacagggucagccacucugca

SEQ ID NO: 882796 - RNA, 22 nt, Human
aauaaagcaggguccuugcacu

SEQ ID NO: 882797 - RNA, 22 nt, Human
guuauaaaugacugcaaaaguu

SEQ ID NO: 882798 - RNA, 22 nt, Human
ucucugggaucguuuugggcuc

SEQ ID NO: 882799 - RNA, 22 nt, Human
acagguuuuuggauaauccuuu

SEQ ID NO: 882800 - RNA, 22 nt, Human
aggccacagccugggaggugac

SEQ ID NO: 882801 - RNA, 22 nt, Human
ucuccaggcacuuggcugcuac

SEQ ID NO: 882802 - RNA, 22 nt, Human
gacaagacuauguagaaaguau

SEQ ID NO: 882803 - RNA, 22 nt, Human
ucagugauugguggacugccua

SEQ ID NO: 882804 - RNA, 22 nt, Human
uucuucagucccacuagccaca

SEQ ID NO: 882805 - RNA, 18 nt, Human
agaaauaccaguauugga

SEQ ID NO: 882806 - RNA, 22 nt, Human
gacaaacugaaguauauuuaga

SEQ ID NO: 882807 - RNA, 22 nt, Human
auuuucuguaacuauuucuaua

SEQ ID NO: 882808 - RNA, 22 nt, Human
ucauaaagagugcuguuguuuu

SEQ ID NO: 882809 - RNA, 22 nt, Human
aggcuaggggcagugccagcau

SEQ ID NO: 882810 - RNA, 22 nt, Human
uuuuccuuaacagagggagaaa

SEQ ID NO: 882811 - RNA, 18 nt, Human
cugcuucugucugccagu

SEQ ID NO: 882812 - RNA, 22 nt, Human
ugcaaggcccagacaagagcuc

SEQ ID NO: 882813 - RNA, 22 nt, Human
uugagaaaaccaucguaagaau

SEQ ID NO: 882814 - RNA, 22 nt, Human
agguggggaguauauguaauug

SEQ ID NO: 882815 - RNA, 22 nt, Human
uccuuuuucucacacaacgaac

SEQ ID NO: 882816 - RNA, 22 nt, Human
uuuggaagacagggcaggaaag

SEQ ID NO: 882817 - RNA, 22 nt, Human
ucagaggaaaggucagauggcu

SEQ ID NO: 882818 - RNA, 22 nt, Human
aaguccuaauuuuaggaggaga

SEQ ID NO: 882819 - RNA, 22 nt, Human
cuuccugggcaauguucugcuu

SEQ ID NO: 882820 - RNA, 22 nt, Human
cuuuguugugccugagugcacc

SEQ ID NO: 882821 - RNA, 19 nt, Human
ugccucagggcuuugagga

SEQ ID NO: 882822 - RNA, 22 nt, Human
gaguggcuuuuuuaugguaaug

SEQ ID NO: 882823 - RNA, 22 nt, Human
gcauuuauuucuuuacugcauc

SEQ ID NO: 882824 - RNA, 22 nt, Human
gcagggcggcccagagcaggcc

SEQ ID NO: 882825 - RNA, 22 nt, Human
ugacauuucagauaugguauuu

SEQ ID NO: 882826 - RNA, 22 nt, Human
agaacucuuuaucuguggaaug

SEQ ID NO: 882827 - RNA, 22 nt, Human
uuuucauuagaaugacugagaa

SEQ ID NO: 882828 - RNA, 23 nt, Human
cccugcucaggggucugauucuc

SEQ ID NO: 882829 - RNA, 23 nt, Human
ugcagcaggguggucuacuucuc

SEQ ID NO: 882830 - RNA, 22 nt, Human
uguuuaauuucacaaaguugac

SEQ ID NO: 882831 - RNA, 22 nt, Human
uggcaagagggaugcaagguuu

SEQ ID NO: 882832 - RNA, 22 nt, Human
agcccaggcagagggaugcuug

SEQ ID NO: 882833 - RNA, 22 nt, Human
caucuuucaguuuauaagucug

SEQ ID NO: 882834 - RNA, 22 nt, Human
gcagaagggaauaaggagcuuu

SEQ ID NO: 882835 - RNA, 22 nt, Human
uauguauauguguguugacaac

SEQ ID NO: 882836 - RNA, 18 nt, Human
gcuucauggaaggguugu

SEQ ID NO: 882837 - RNA, 22 nt, Human
gcacaggaggccgaugcucaug

SEQ ID NO: 882838 - RNA, 22 nt, Human
ggugaagcguauuuguggagcu

SEQ ID NO: 882839 - RNA, 22 nt, Human
cucugggauagagccucggucu

SEQ ID NO: 882840 - RNA, 18 nt, Human
agagggaaucaguuggau

SEQ ID NO: 882841 - RNA, 22 nt, Human
ugcuggggucauggggcgcccg

SEQ ID NO: 882842 - RNA, 22 nt, Human
gugauaauugcagagaaaggag

SEQ ID NO: 882843 - RNA, 21 nt, Human
agaaaaguauuugaaucaaga

SEQ ID NO: 882844 - RNA, 22 nt, Human
uaugaaguagagcagagaugcc

SEQ ID NO: 882845 - RNA, 22 nt, Human
acacuguuccugaaauuguuau

SEQ ID NO: 882846 - RNA, 22 nt, Human
augcuauuuuacauaggaaugg

SEQ ID NO: 882847 - RNA, 22 nt, Human
aggcucagugauguaaaauaua

SEQ ID NO: 882848 - RNA, 22 nt, Human
gcugcccugacuccagcagccu

SEQ ID NO: 882849 - RNA, 22 nt, Human
aaugaguuuguucuauuauuug

SEQ ID NO: 882850 - RNA, 22 nt, Human
acaugcuuuaucggauugacac

SEQ ID NO: 882851 - RNA, 22 nt, Human
gcugccaucagaguucaggaau

SEQ ID NO: 882852 - RNA, 22 nt, Human
agggugagggucuggccuugag

SEQ ID NO: 882853 - RNA, 22 nt, Human
auuccugaagaagguauguugc

SEQ ID NO: 882854 - RNA, 22 nt, Human
uaucagauauagcauucacugg

SEQ ID NO: 882855 - RNA, 22 nt, Human
acagcuacucugcagauaaauc

SEQ ID NO: 882856 - RNA, 22 nt, Human
gaaguuauuugcuaucuacuga

SEQ ID NO: 882857 - RNA, 22 nt, Human
ggccugcugcagugugacaguu

SEQ ID NO: 882858 - RNA, 18 nt, Human
ucaagacaucaugaaaua

SEQ ID NO: 882859 - RNA, 22 nt, Human
ugaggcaaagacaaagcagcau

SEQ ID NO: 882860 - RNA, 22 nt, Human
uaaggucuuuaacaggucuuuu

SEQ ID NO: 882861 - RNA, 22 nt, Human
guggaaauaguuugguuauaga

SEQ ID NO: 882862 - RNA, 19 nt, Human
agaaucuaaauuauuucug

SEQ ID NO: 882863 - RNA, 22 nt, Human
auguaacauaugugaucgcauu

SEQ ID NO: 882864 - RNA, 22 nt, Human
agcucccaauugacuugaacua

SEQ ID NO: 882865 - RNA, 18 nt, Human
agugugugcccuuucagg

SEQ ID NO: 882866 - RNA, 22 nt, Human
ugcaucauuuauaaugucuuug

SEQ ID NO: 882867 - RNA, 22 nt, Human
gcagugaaaaagugcacccugu

SEQ ID NO: 882868 - RNA, 23 nt, Human
cagaggugucagugcccaguguc

SEQ ID NO: 882869 - RNA, 22 nt, Human
aauucugcauaagguggcucug

SEQ ID NO: 882870 - RNA, 22 nt, Human
ugggcagcauccuccacaguca

SEQ ID NO: 882871 - RNA, 22 nt, Human
aggaccugacuggcuccugcuu

SEQ ID NO: 882872 - RNA, 22 nt, Human
aggagugggggcgagaaguuaa

SEQ ID NO: 882873 - RNA, 22 nt, Human
caggccuuaucuccacccugca

SEQ ID NO: 882874 - RNA, 22 nt, Human
uguucacauguacaugaauauu

SEQ ID NO: 882875 - RNA, 21 nt, Human
cacugaggucagggguagggu

SEQ ID NO: 882876 - RNA, 22 nt, Human
aucuggaauccuuguggacaau

SEQ ID NO: 882877 - RNA, 22 nt, Human
gcagcugggacacugaggccag

SEQ ID NO: 882878 - RNA, 22 nt, Human
uauuguacauuucaaaguagcu

SEQ ID NO: 882879 - RNA, 22 nt, Human
acuucaaauuuucagaagaaau

SEQ ID NO: 882880 - RNA, 22 nt, Human
aggaaauugucuuuuuccuugu

SEQ ID NO: 882881 - RNA, 22 nt, Human
cuggaaggagcccgggcggauc

SEQ ID NO: 882882 - RNA, 22 nt, Human
acagugaaaauaauaucuucaa

SEQ ID NO: 882883 - RNA, 22 nt, Human
uagaacagaguuccagugauca

SEQ ID NO: 882884 - RNA, 22 nt, Human
ucagcaaguggaccauccuggg

SEQ ID NO: 882885 - RNA, 23 nt, Human
uagaacaucggugucuuggagca

SEQ ID NO: 882886 - RNA, 22 nt, Human
aggaggccgcugaugggcuccc

SEQ ID NO: 882887 - RNA, 22 nt, Human
uugguaaauaacaaucacagug

SEQ ID NO: 882888 - RNA, 22 nt, Human
ugggaauagaacaagauagaga

SEQ ID NO: 882889 - RNA, 22 nt, Human
uggcagugcugcagugcccuua

SEQ ID NO: 882890 - RNA, 22 nt, Human
acacaucuaucucuacacaagg

SEQ ID NO: 882891 - RNA, 22 nt, Human
ucagaaagcuauaugguguguc

SEQ ID NO: 882892 - RNA, 22 nt, Human
uagacauuagguagguucaugg

SEQ ID NO: 882893 - RNA, 22 nt, Human
uagggcagcugcaucaggcacu

SEQ ID NO: 882894 - RNA, 22 nt, Human
agucaacagcauuauggaugaa

SEQ ID NO: 882895 - RNA, 22 nt, Human
acccucagcuggagauugaauu

SEQ ID NO: 882896 - RNA, 22 nt, Human
ggcacugaucugauuucccucc

SEQ ID NO: 882897 - RNA, 22 nt, Human
ucccagcauuaaugccugucag

SEQ ID NO: 882898 - RNA, 23 nt, Human
augggccaagcaagacccaugac

SEQ ID NO: 882899 - RNA, 22 nt, Human
agcaauaaauguaaagguuaag

SEQ ID NO: 882900 - RNA, 22 nt, Human
uggaauguugcauaagaucuga

SEQ ID NO: 882901 - RNA, 22 nt, Human
uguugagacugagggagucagc

SEQ ID NO: 882902 - RNA, 22 nt, Human
cuuagaaugucuacucuuacca

SEQ ID NO: 882903 - RNA, 22 nt, Human
cccagcaguuguuggugcacau

SEQ ID NO: 882904 - RNA, 22 nt, Human
uuugcuaaaauguauugggauu

SEQ ID NO: 882905 - RNA, 22 nt, Human
auguuuacaauucaguauuaca

SEQ ID NO: 882906 - RNA, 22 nt, Human
agcaaguaguaccaaguagcuc

SEQ ID NO: 882907 - RNA, 22 nt, Human
augucucucagguuuaacuuua

SEQ ID NO: 882908 - RNA, 22 nt, Human
auuucuguuauaccuuucucag

SEQ ID NO: 882909 - RNA, 22 nt, Human
agcaggcuuguuaugucugaga

SEQ ID NO: 882910 - RNA, 22 nt, Human
aagauaaguaacgagccucagu

SEQ ID NO: 882911 - RNA, 21 nt, Human
gaagagaguccucauccugag

SEQ ID NO: 882912 - RNA, 22 nt, Human
uauaaagaaggcacagcaagac

SEQ ID NO: 882913 - RNA, 22 nt, Human
cucaccaggaacagcugcggag

SEQ ID NO: 882914 - RNA, 22 nt, Human
auacaaguugcccaaaugauua

SEQ ID NO: 882915 - RNA, 22 nt, Human
agcugggacucaacugucuggg

SEQ ID NO: 882916 - RNA, 22 nt, Human
cagguguuauacaugaaauuua

SEQ ID NO: 882917 - RNA, 22 nt, Human
uggccucuuaggacauccucua

SEQ ID NO: 882918 - RNA, 21 nt, Human
uaauuuauucagcacaguguu

SEQ ID NO: 882919 - RNA, 22 nt, Human
ccauaggagcccuggucccuga

SEQ ID NO: 882920 - RNA, 22 nt, Human
gagaggcagaggccugaaaccg

SEQ ID NO: 882921 - RNA, 19 nt, Human
gcaggcagcugggguaucc

SEQ ID NO: 882922 - RNA, 19 nt, Human
ugagauuucuuaggugauu

SEQ ID NO: 882923 - RNA, 22 nt, Human
gagggagagugauggaccauug

SEQ ID NO: 882924 - RNA, 22 nt, Human
acagagcacauagauuggaguu

SEQ ID NO: 882925 - RNA, 22 nt, Human
ucugaggcugaauggacuccgu

SEQ ID NO: 882926 - RNA, 22 nt, Human
uuccuacauuugccucacuccc

SEQ ID NO: 882927 - RNA, 22 nt, Human
ucccaaagaacugaauaguaau

SEQ ID NO: 882928 - RNA, 22 nt, Human
ggucagaggggauuccuuggga

SEQ ID NO: 882929 - RNA, 22 nt, Human
uuuuauuaguggcuagaugggg

SEQ ID NO: 882930 - RNA, 22 nt, Human
cacauucagguggcauguuaga

SEQ ID NO: 882931 - RNA, 22 nt, Human
ugggcuggcccaccacaccucg

SEQ ID NO: 882932 - RNA, 22 nt, Human
acaguuuacuggccuugccguu

SEQ ID NO: 882933 - RNA, 22 nt, Human
cugccagcucucuggaggcucu

SEQ ID NO: 882934 - RNA, 22 nt, Human
cagcuuuugcagacuucuugcc

SEQ ID NO: 882935 - RNA, 22 nt, Human
agcuggagaaaccugggagggu

SEQ ID NO: 882936 - RNA, 22 nt, Human
gauugaaaggucuuuaaauugg

SEQ ID NO: 882937 - RNA, 22 nt, Human
aucugggagcggagguugcagu

SEQ ID NO: 882938 - RNA, 22 nt, Human
cacucuaaccuccaucuuccau

SEQ ID NO: 882939 - RNA, 22 nt, Human
acuuuggaaauugucuauaaga

SEQ ID NO: 882940 - RNA, 23 nt, Human
caccccacccugaggaggaggga

SEQ ID NO: 882941 - RNA, 22 nt, Human
agcuuagaagugugcugagagg

SEQ ID NO: 882942 - RNA, 22 nt, Human
ucaggccacuucacaggugauu

SEQ ID NO: 882943 - RNA, 22 nt, Human
ucccugugagaaaugaagcagg

SEQ ID NO: 882944 - RNA, 22 nt, Human
ggcugcucggagccuccuguga

SEQ ID NO: 882945 - RNA, 22 nt, Human
ggagugaggcauuuguagcuga

SEQ ID NO: 882946 - RNA, 22 nt, Human
ucuggcucuguguccccaccca

SEQ ID NO: 882947 - RNA, 22 nt, Human
caggcugccgaggcugcagaau

SEQ ID NO: 882948 - RNA, 23 nt, Human
ccuccccuucccacagcugggug

SEQ ID NO: 882949 - RNA, 22 nt, Human
ccugguggagaggggcggagcg

SEQ ID NO: 882950 - RNA, 22 nt, Human
gcugugcagauguagggagugg

SEQ ID NO: 882951 - RNA, 22 nt, Human
auguucuuugaaauauuuuaga

SEQ ID NO: 882952 - RNA, 17 nt, Human
uuagagcuacauguuga

SEQ ID NO: 882953 - RNA, 22 nt, Human
ugcuagaauuugcagaagcaua

SEQ ID NO: 882954 - RNA, 22 nt, Human
agacagcuguuccuucauguuu

SEQ ID NO: 882955 - RNA, 22 nt, Human
aaguuucaugauguaauuauug

SEQ ID NO: 882956 - RNA, 22 nt, Human
aauggcuucaugucuguggaaa

SEQ ID NO: 882957 - RNA, 22 nt, Human
cagagccaucaugauauggagu

SEQ ID NO: 882958 - RNA, 22 nt, Human
aaaguucaugguguuauagaaa

SEQ ID NO: 882959 - RNA, 22 nt, Human
uauuagauuaacuuuaaugucu

SEQ ID NO: 882960 - RNA, 22 nt, Human
aagucaaguacuacaggaaaca

SEQ ID NO: 882961 - RNA, 22 nt, Human
ccaagaggggcagagggcugca

SEQ ID NO: 882962 - RNA, 22 nt, Human
gcauuucaaaauuccaggcaag

SEQ ID NO: 882963 - RNA, 22 nt, Human
ccauuucacccacugcuuuagg

SEQ ID NO: 882964 - RNA, 22 nt, Human
gcagggcagcuuagucccuguc

SEQ ID NO: 882965 - RNA, 22 nt, Human
uuuuagaaauacugauuuagug

SEQ ID NO: 882966 - RNA, 22 nt, Human
agccagcaggugagugcagccu

SEQ ID NO: 882967 - RNA, 22 nt, Human
uucacaaaaugguuuguugaug

SEQ ID NO: 882968 - RNA, 22 nt, Human
ugccaguugggaaaacagacau

SEQ ID NO: 882969 - RNA, 22 nt, Human
acaugcaugguguuggguugga

SEQ ID NO: 882970 - RNA, 17 nt, Human
cugccuggagucccauc

SEQ ID NO: 882971 - RNA, 22 nt, Human
gcugggagucgcgucuguggcc

SEQ ID NO: 882972 - RNA, 22 nt, Human
gggucuccugagagaagaugcu

SEQ ID NO: 882973 - RNA, 22 nt, Human
caucucaucagugagagucagc

SEQ ID NO: 882974 - RNA, 22 nt, Human
uaucuagaacuccagaauguag

SEQ ID NO: 882975 - RNA, 22 nt, Human
gaacuuuaauuagcuuuugucu

SEQ ID NO: 882976 - RNA, 22 nt, Human
agcagcugugggcaauauguaa

SEQ ID NO: 882977 - RNA, 22 nt, Human
ccugaggcaaggacuugguggc

SEQ ID NO: 882978 - RNA, 22 nt, Human
cucuccaggcugggacaggacc

SEQ ID NO: 882979 - RNA, 22 nt, Human
gagcaucuuguucccaacuucu

SEQ ID NO: 882980 - RNA, 22 nt, Human
aaaguauauuuacuuacuguga

SEQ ID NO: 882981 - RNA, 22 nt, Human
gaaucucaggggaguuacugga

SEQ ID NO: 882982 - RNA, 22 nt, Human
uuucacauggaagcucucgaga

SEQ ID NO: 882983 - RNA, 22 nt, Human
aaguacaacgcauacagagaaa

SEQ ID NO: 882984 - RNA, 22 nt, Human
agaauaaacugcuuuagggcag

SEQ ID NO: 882985 - RNA, 22 nt, Human
gugcuccauugucuagaacugg

SEQ ID NO: 882986 - RNA, 22 nt, Human
agccaggcggggcagguuuccu

SEQ ID NO: 882987 - RNA, 22 nt, Human
caguuacauauuuaguagguua

SEQ ID NO: 882988 - RNA, 22 nt, Human
agcggcugcucuuuucagaucc

SEQ ID NO: 882989 - RNA, 22 nt, Human
uggcagauacccaggcaaaugg

SEQ ID NO: 882990 - RNA, 22 nt, Human
uuggugcaaauuccuguaagag

SEQ ID NO: 882991 - RNA, 22 nt, Human
acuuagcauuauguaauuacua

SEQ ID NO: 882992 - RNA, 22 nt, Human
ccagggaagcuggucacgcagg

SEQ ID NO: 882993 - RNA, 22 nt, Human
cagaggcuggauggacuugccu

SEQ ID NO: 882994 - RNA, 23 nt, Human
auguccaaagggauucgucugau

SEQ ID NO: 882995 - RNA, 22 nt, Human
gcugagagugggugcagugcuu

SEQ ID NO: 882996 - RNA, 22 nt, Human
uuaugagauauuuauacugcug

SEQ ID NO: 882997 - RNA, 22 nt, Human
gggauccauccgugcagcagag

SEQ ID NO: 882998 - RNA, 22 nt, Human
ucugagagagcaccuauccacu

SEQ ID NO: 882999 - RNA, 18 nt, Human
agccucuggcagagagaa

SEQ ID NO: 883000 - RNA, 22 nt, Human
uggaaggggagcuggaaagggg

SEQ ID NO: 883001 - RNA, 20 nt, Human
uacaggagugaguggguggg

SEQ ID NO: 883002 - RNA, 22 nt, Human
aacagugauaucaagacagaca

SEQ ID NO: 883003 - RNA, 22 nt, Human
ggccagagagcagccaggauuc

SEQ ID NO: 883004 - RNA, 22 nt, Human
ucuguuaugcauaagcaucagu

SEQ ID NO: 883005 - RNA, 22 nt, Human
caggaugccaucugcugcugcu

SEQ ID NO: 883006 - RNA, 22 nt, Human
agcugcagcuguuuucugagug

SEQ ID NO: 883007 - RNA, 22 nt, Human
aaagcuauuuauuacagagaau

SEQ ID NO: 883008 - RNA, 22 nt, Human
aaacaguagaaguguauuuuau

SEQ ID NO: 883009 - RNA, 22 nt, Human
uuagaacuuaagaauacugucu

SEQ ID NO: 883010 - RNA, 22 nt, Human
aggcuguggugcugaaggaggg

SEQ ID NO: 883011 - RNA, 22 nt, Human
auaacuuaaugggucaugcucu

SEQ ID NO: 883012 - RNA, 22 nt, Human
uaacacaaaagaauaugugugu

SEQ ID NO: 883013 - RNA, 22 nt, Human
uuaggaaggcacugggugccaa

SEQ ID NO: 883014 - RNA, 22 nt, Human
uucaaacucuugcucugcuagu

SEQ ID NO: 883015 - RNA, 22 nt, Human
guuuaugaguuacguagggguu

SEQ ID NO: 883016 - RNA, 22 nt, Human
uuugguaaaugcagguucuucu

SEQ ID NO: 883017 - RNA, 22 nt, Human
uuugugcauaaagggcuauagu

SEQ ID NO: 883018 - RNA, 22 nt, Human
aacagcauaaguauuuauuuca

SEQ ID NO: 883019 - RNA, 22 nt, Human
uauuauugaaucaguucuuuga

SEQ ID NO: 883020 - RNA, 22 nt, Human
aacauacauauuucagugucca

SEQ ID NO: 883021 - RNA, 22 nt, Human
uaaugcuuauguuaugcaauuu

SEQ ID NO: 883022 - RNA, 19 nt, Human
aggcagcaggccagggaug

SEQ ID NO: 883023 - RNA, 22 nt, Human
gguuacauggaagaaauauaau

SEQ ID NO: 883024 - RNA, 22 nt, Human
gaaauacaaagccagccauuuu

SEQ ID NO: 883025 - RNA, 22 nt, Human
ucuuuagagccuuuccucccga

SEQ ID NO: 883026 - RNA, 18 nt, Human
ugcaugcuuuuguuucca

SEQ ID NO: 883027 - RNA, 22 nt, Human
uggucaaagaccaggaaaugcu

SEQ ID NO: 883028 - RNA, 22 nt, Human
uaugucaugucuuagagaauga

SEQ ID NO: 883029 - RNA, 21 nt, Human
uccugggggguaggugaguuu

SEQ ID NO: 883030 - RNA, 23 nt, Human
auuagaaaggcuuucuggugaaa

SEQ ID NO: 883031 - RNA, 22 nt, Human
uuagaagugguaaguagaaaga

SEQ ID NO: 883032 - RNA, 22 nt, Human
ucugaaaucuaaugcucugugg

SEQ ID NO: 883033 - RNA, 22 nt, Human
aguucucuccccugcuguucag

SEQ ID NO: 883034 - RNA, 22 nt, Human
gacaguuacccccaaaagaauu

SEQ ID NO: 883035 - RNA, 22 nt, Human
augaaauugaucuugaacuuuu

SEQ ID NO: 883036 - RNA, 22 nt, Human
cauuuguuaaccaguguggauu

SEQ ID NO: 883037 - RNA, 22 nt, Human
aggaagagguagcugucaaggg

SEQ ID NO: 883038 - RNA, 22 nt, Human
gggagcugagggaccucugugg

SEQ ID NO: 883039 - RNA, 22 nt, Human
ccagagggagccaccagggugu

SEQ ID NO: 883040 - RNA, 22 nt, Human
gagacagagaucuugcugaguc

SEQ ID NO: 883041 - RNA, 22 nt, Human
gggcuuggguauugugagaggu

SEQ ID NO: 883042 - RNA, 19 nt, Human
ucagugcuccuauguccuu

SEQ ID NO: 883043 - RNA, 22 nt, Human
uuguucaucaggugacacauac

SEQ ID NO: 883044 - RNA, 22 nt, Human
agacaguguaauguaauuguua

SEQ ID NO: 883045 - RNA, 22 nt, Human
ccagggcaauaggaacacuuuu

SEQ ID NO: 883046 - RNA, 22 nt, Human
uccaggagcucauccacgucaa

SEQ ID NO: 883047 - RNA, 22 nt, Human
ugaggcuuggagaggucaggga

SEQ ID NO: 883048 - RNA, 22 nt, Human
gagggggcucccugaagccagu

SEQ ID NO: 883049 - RNA, 22 nt, Human
uucugcugaagucacugggagc

SEQ ID NO: 883050 - RNA, 22 nt, Human
uggcauggcauuuagagaauua

SEQ ID NO: 883051 - RNA, 22 nt, Human
gauuugucuauauucaaauaug

SEQ ID NO: 883052 - RNA, 22 nt, Human
gggcucuggaaggugcaccaug

SEQ ID NO: 883053 - RNA, 22 nt, Human
gcagacagccagacugcacugg

SEQ ID NO: 883054 - RNA, 22 nt, Human
ucucuuggugauagucuuucuu

SEQ ID NO: 883055 - RNA, 22 nt, Human
uuacaaagagugccagagugug

SEQ ID NO: 883056 - RNA, 22 nt, Human
acuccacauuugaacacaguuc

SEQ ID NO: 883057 - RNA, 22 nt, Human
uagcagcacaaauggacuauga

SEQ ID NO: 883058 - RNA, 22 nt, Human
ugaacuuuugcacagaggauuu

SEQ ID NO: 883059 - RNA, 22 nt, Human
uaaugucuucuuuuaauuuggc

SEQ ID NO: 883060 - RNA, 22 nt, Human
uuugcauuccugccugcauuca

SEQ ID NO: 883061 - RNA, 22 nt, Human
gcuguggcugaccaccaggggg

SEQ ID NO: 883062 - RNA, 22 nt, Human
ucuagcaccacauuaaauagca

SEQ ID NO: 883063 - RNA, 22 nt, Human
cagaagcauugacuccuugcuc

SEQ ID NO: 883064 - RNA, 22 nt, Human
agaaugugaagacccgguuugu

SEQ ID NO: 883065 - RNA, 22 nt, Human
agagcacagcagaucucugaug

SEQ ID NO: 883066 - RNA, 22 nt, Human
ggcagagcgcaugcgucgcaga

SEQ ID NO: 883067 - RNA, 22 nt, Human
uaacacaguguccucagaaaca

SEQ ID NO: 883068 - RNA, 22 nt, Human
cucagagcaaugaacaugcaaa

SEQ ID NO: 883069 - RNA, 22 nt, Human
acagcuccuaacaaaggcucuc

SEQ ID NO: 883070 - RNA, 22 nt, Human
cccucaugccagacagcaugca

SEQ ID NO: 883071 - RNA, 22 nt, Human
aauagagucaguucuacauucu

SEQ ID NO: 883072 - RNA, 22 nt, Human
uagacauuuuaagacauauacc

SEQ ID NO: 883073 - RNA, 22 nt, Human
ccuggcucccggaacagggucu

SEQ ID NO: 883074 - RNA, 22 nt, Human
ucuuuacauaguguggacuacu

SEQ ID NO: 883075 - RNA, 22 nt, Human
cugccugugauuuuucucuagu

SEQ ID NO: 883076 - RNA, 22 nt, Human
cagugucuuauuuguagcucag

SEQ ID NO: 883077 - RNA, 22 nt, Human
agacccuggggaaagucacuuc

SEQ ID NO: 883078 - RNA, 22 nt, Human
cugcccuggaaaacguaucuua

SEQ ID NO: 883079 - RNA, 22 nt, Human
uacauacauuaccucauuuagu

SEQ ID NO: 883080 - RNA, 22 nt, Human
aagaggcauaaaauuuauaugg

SEQ ID NO: 883081 - RNA, 22 nt, Human
cugaucuuaaguaacauuauuu

SEQ ID NO: 883082 - RNA, 22 nt, Human
aagggagacaguugugugagga

SEQ ID NO: 883083 - RNA, 22 nt, Human
cccuggcuuaaaaaccucauau

SEQ ID NO: 883084 - RNA, 23 nt, Human
ucugagcugucuuuucagcagaa

SEQ ID NO: 883085 - RNA, 22 nt, Human
ugccaaggguaugggcaagaua

SEQ ID NO: 883086 - RNA, 22 nt, Human
gaggaggccaguggaaggaagc

SEQ ID NO: 883087 - RNA, 22 nt, Human
cauguucaccuguggcacuagu

SEQ ID NO: 883088 - RNA, 22 nt, Human
ccaggguggggcaggcccacug

SEQ ID NO: 883089 - RNA, 22 nt, Human
uuucauugaacuaaagaaucug

SEQ ID NO: 883090 - RNA, 22 nt, Human
cugaggagcugaaggcccucca

SEQ ID NO: 883091 - RNA, 22 nt, Human
uacaucucaucugugcucuccg

SEQ ID NO: 883092 - RNA, 22 nt, Human
agggucuuuccugggagccagc

SEQ ID NO: 883093 - RNA, 22 nt, Human
agcaacaggaauauuauggcaa

SEQ ID NO: 883094 - RNA, 22 nt, Human
uucagggacuuugauguaucag

SEQ ID NO: 883095 - RNA, 22 nt, Human
aguaucaauaauagaggagcua

SEQ ID NO: 883096 - RNA, 22 nt, Human
uaagugagaacuaaaccuucug

SEQ ID NO: 883097 - RNA, 22 nt, Human
uuacuguuugaaaaaugaaugu

SEQ ID NO: 883098 - RNA, 22 nt, Human
ugucuuuagaaagaagcagaca

SEQ ID NO: 883099 - RNA, 22 nt, Human
ccugggccaggcuugggaaugc

SEQ ID NO: 883100 - RNA, 22 nt, Human
ccucccagaugugcccaaugga

SEQ ID NO: 883101 - RNA, 22 nt, Human
ugaugaggcauaugcuacacau

SEQ ID NO: 883102 - RNA, 22 nt, Human
gcagcaaacuuccacaaguaga

SEQ ID NO: 883103 - RNA, 22 nt, Human
cuuccucuauguucagguagaa

SEQ ID NO: 883104 - RNA, 22 nt, Human
gcucugugccagggcugggcca

SEQ ID NO: 883105 - RNA, 22 nt, Human
uuaaaagagcagcccagcauau

SEQ ID NO: 883106 - RNA, 22 nt, Human
cagggcuuggaucuguggucag

SEQ ID NO: 883107 - RNA, 21 nt, Human
aggcugcucuuucuuguggua

SEQ ID NO: 883108 - RNA, 22 nt, Human
auguuugugggauaaacaaaug

SEQ ID NO: 883109 - RNA, 22 nt, Human
gggagugguugauggugaaaau

SEQ ID NO: 883110 - RNA, 22 nt, Human
augcaggaugcagaggggcccg

SEQ ID NO: 883111 - RNA, 22 nt, Human
aucaguuucugugaagaacaca

SEQ ID NO: 883112 - RNA, 22 nt, Human
aguucagcuucaagcuaugagg

SEQ ID NO: 883113 - RNA, 19 nt, Human
cuccaaguuaagagggagg

SEQ ID NO: 883114 - RNA, 22 nt, Human
ccauggcuccuugcccuguagc

SEQ ID NO: 883115 - RNA, 22 nt, Human
uggcuucuuuccacuguccugu

SEQ ID NO: 883116 - RNA, 22 nt, Human
cagcccugcugacacugucuga

SEQ ID NO: 883117 - RNA, 22 nt, Human
aucucaccaaguuauuacgaga

SEQ ID NO: 883118 - RNA, 22 nt, Human
ugcccagccaguuuaugguaau

SEQ ID NO: 883119 - RNA, 22 nt, Human
acuguacacgugucauuuacag

SEQ ID NO: 883120 - RNA, 22 nt, Human
ucucagugcagagaggcuaucu

SEQ ID NO: 883121 - RNA, 22 nt, Human
uuucaugaggcugcauaaggag

SEQ ID NO: 883122 - RNA, 22 nt, Human
gacaauaaagugauacauggga

SEQ ID NO: 883123 - RNA, 22 nt, Human
caggcugagcucuggccugggc

SEQ ID NO: 883124 - RNA, 22 nt, Human
uuuucguuuauuugacauguaa

SEQ ID NO: 883125 - RNA, 22 nt, Human
aaagucuccacugggaaccaaa

SEQ ID NO: 883126 - RNA, 22 nt, Human
augugcuggcuaacuggauggg

SEQ ID NO: 883127 - RNA, 22 nt, Human
acucucccuuggagccucaggc

SEQ ID NO: 883128 - RNA, 22 nt, Human
aaauugcucuuuaaaaguacug

SEQ ID NO: 883129 - RNA, 22 nt, Human
gagcugaaggagaaagcagggg

SEQ ID NO: 883130 - RNA, 22 nt, Human
ugucuggaggucagguccuggg

SEQ ID NO: 883131 - RNA, 22 nt, Human
agauuuuggcuggcuggagaga

SEQ ID NO: 883132 - RNA, 22 nt, Human
gaacacaugauuauaaaugcua

SEQ ID NO: 883133 - RNA, 22 nt, Human
cagagcugcuucccaguuugug

SEQ ID NO: 883134 - RNA, 22 nt, Human
uuuuaauacugcuauuguagga

SEQ ID NO: 883135 - RNA, 22 nt, Human
cccaguguuacgugacagccug

SEQ ID NO: 883136 - RNA, 17 nt, Human
uggggaugguucaugag

SEQ ID NO: 883137 - RNA, 22 nt, Human
caauacuauucggaccaucucu

SEQ ID NO: 883138 - RNA, 22 nt, Human
auuucuugugggaaaugcagca

SEQ ID NO: 883139 - RNA, 22 nt, Human
uggaguugugucaucuuuguaa

SEQ ID NO: 883140 - RNA, 22 nt, Human
cuuauauuugucaacuuuacaa

SEQ ID NO: 883141 - RNA, 22 nt, Human
auauguuacucuuucaagcaga

SEQ ID NO: 883142 - RNA, 22 nt, Human
uaauacaucauucaucuaagga

SEQ ID NO: 883143 - RNA, 22 nt, Human
cagcugaacauguagagcaucu

SEQ ID NO: 883144 - RNA, 22 nt, Human
agaaggcuggccauggugcccu

SEQ ID NO: 883145 - RNA, 22 nt, Human
cugucucuguugccuguaggug

SEQ ID NO: 883146 - RNA, 22 nt, Human
uuauuuuguagcucugaucuuu

SEQ ID NO: 883147 - RNA, 22 nt, Human
uucuuuuuaucuucccauaaga

SEQ ID NO: 883148 - RNA, 22 nt, Human
auggugguagaagcacuaugug

SEQ ID NO: 883149 - RNA, 22 nt, Human
ggcugugacaaggcugcgggaa

SEQ ID NO: 883150 - RNA, 21 nt, Human
ucccacagaaacugcgaaauu

SEQ ID NO: 883151 - RNA, 22 nt, Human
gucuucuuguuuugaaggaaau

SEQ ID NO: 883152 - RNA, 22 nt, Human
uucuguccuguuggaugaauca

SEQ ID NO: 883153 - RNA, 22 nt, Human
uggaggaaguggacaguugugu

SEQ ID NO: 883154 - RNA, 22 nt, Human
cauggaucauaaaugugcuaaa

SEQ ID NO: 883155 - RNA, 22 nt, Human
ccuuuaaagacugcauaacuuc

SEQ ID NO: 883156 - RNA, 22 nt, Human
gccagccagaguggcugugugu

SEQ ID NO: 883157 - RNA, 22 nt, Human
aaucagagucccaagaucugua

SEQ ID NO: 883158 - RNA, 22 nt, Human
cugagcgaggaguuggagcuuu

SEQ ID NO: 883159 - RNA, 22 nt, Human
ggcaggcaggagcgugcuuggg

SEQ ID NO: 883160 - RNA, 22 nt, Human
uuucuguaaguucaggcuuucc

SEQ ID NO: 883161 - RNA, 22 nt, Human
gcagguggauuaucagaagugc

SEQ ID NO: 883162 - RNA, 22 nt, Human
auagauuugaauuuaagacuug

SEQ ID NO: 883163 - RNA, 19 nt, Human
cagugcccacccuagcaca

SEQ ID NO: 883164 - RNA, 22 nt, Human
acacacagguaaaggagccugg

SEQ ID NO: 883165 - RNA, 19 nt, Human
uuauauacuugguuucucu

SEQ ID NO: 883166 - RNA, 22 nt, Human
cagcuguggagggaggaaaugc

SEQ ID NO: 883167 - RNA, 22 nt, Human
acagauguuagcaaugaugaug

SEQ ID NO: 883168 - RNA, 21 nt, Human
ccuucuccacagggucuccgg

SEQ ID NO: 883169 - RNA, 22 nt, Human
cugcacagccugucugggggcc

SEQ ID NO: 883170 - RNA, 23 nt, Human
aguacauucgaaaaauucuguga

SEQ ID NO: 883171 - RNA, 22 nt, Human
uuuuacaaaugaggagcuggag

SEQ ID NO: 883172 - RNA, 22 nt, Human
agugcugggauuacaggcauaa

SEQ ID NO: 883173 - RNA, 22 nt, Human
agugcugggauugcaggcauga

SEQ ID NO: 883174 - RNA, 22 nt, Human
agaacaauugccccaaagcuug

SEQ ID NO: 883175 - RNA, 21 nt, Human
aggcuuuaccucuggguaggu

SEQ ID NO: 883176 - RNA, 22 nt, Human
agacaaaugguaauuaugucua

SEQ ID NO: 883177 - RNA, 22 nt, Human
cccaggcugcaugaguccaugg

SEQ ID NO: 883178 - RNA, 22 nt, Human
gcugaaguugaauauucuggga

SEQ ID NO: 883179 - RNA, 22 nt, Human
agaauuuaggaugcaugugaau

SEQ ID NO: 883180 - RNA, 22 nt, Human
uuagaaaugauuucaccucuuu

SEQ ID NO: 883181 - RNA, 22 nt, Human
ucuuuccuuagaauaauucuuu

SEQ ID NO: 883182 - RNA, 22 nt, Human
cucauggagggagugcucuucc

SEQ ID NO: 883183 - RNA, 22 nt, Human
uuucuauuggcgucacuguugu

SEQ ID NO: 883184 - RNA, 22 nt, Human
ucucuucuuuggggugggcuca

SEQ ID NO: 883185 - RNA, 22 nt, Human
uuugacaguacucuguaggauc

SEQ ID NO: 883186 - RNA, 22 nt, Human
aaagcuauuuguuaugagagaa

SEQ ID NO: 883187 - RNA, 22 nt, Human
cuguuauuucugaaugccaucc

SEQ ID NO: 883188 - RNA, 22 nt, Human
uuugcuuucccuuguagaaagu

SEQ ID NO: 883189 - RNA, 22 nt, Human
uagaugugagcccaggcugcuu

SEQ ID NO: 883190 - RNA, 19 nt, Human
agugguagaugagcaggag

SEQ ID NO: 883191 - RNA, 22 nt, Human
agaagugucagugcaggcagcu

SEQ ID NO: 883192 - RNA, 22 nt, Human
aaauuccauuaggaaacuucca

SEQ ID NO: 883193 - RNA, 22 nt, Human
aagcaugggaggccuggaggag

SEQ ID NO: 883194 - RNA, 22 nt, Human
ccacgcucauccucucugagag

SEQ ID NO: 883195 - RNA, 22 nt, Human
augucaaaucaguuuuaucaga

SEQ ID NO: 883196 - RNA, 22 nt, Human
uaggcugggcugagcuggacgg

SEQ ID NO: 883197 - RNA, 22 nt, Human
gaaauucugugucccagagugc

SEQ ID NO: 883198 - RNA, 19 nt, Human
auguucuauccuccaaguu

SEQ ID NO: 883199 - RNA, 22 nt, Human
cucugaagguuucuguuacugu

SEQ ID NO: 883200 - RNA, 20 nt, Human
cugaaaggagucgggauguc

SEQ ID NO: 883201 - RNA, 20 nt, Human
ggcaggugcucgcuuggucu

SEQ ID NO: 883202 - RNA, 19 nt, Human
uagaagcagggaagcugag

SEQ ID NO: 883203 - RNA, 22 nt, Human
augucuuuuauggagaugucau

SEQ ID NO: 883204 - RNA, 22 nt, Human
gggagucagagagguaauggga

SEQ ID NO: 883205 - RNA, 22 nt, Human
gccaagccugggaagagcccau

SEQ ID NO: 883206 - RNA, 22 nt, Human
ugccgccugguuucuccgcccc

SEQ ID NO: 883207 - RNA, 22 nt, Human
aaaugauaguauggaacuagga

SEQ ID NO: 883208 - RNA, 22 nt, Human
gccaggucgucuccauguccaa

SEQ ID NO: 883209 - RNA, 22 nt, Human
gcugccuccugagauuugggca

SEQ ID NO: 883210 - RNA, 22 nt, Human
uacaaacuguuauuauuauugu

SEQ ID NO: 883211 - RNA, 22 nt, Human
ugcuggccggccaggugcugag

SEQ ID NO: 883212 - RNA, 22 nt, Human
cugccagaagagaacaccaguu

SEQ ID NO: 883213 - RNA, 22 nt, Human
auuaauauacacuguuagcaug

SEQ ID NO: 883214 - RNA, 22 nt, Human
agacagugcaagaagagcaggc

SEQ ID NO: 883215 - RNA, 22 nt, Human
cucugccaucuuggagcucaag

SEQ ID NO: 883216 - RNA, 22 nt, Human
ccaggaagccucagaugcugag

SEQ ID NO: 883217 - RNA, 22 nt, Human
aauguauucugggaaaauguua

SEQ ID NO: 883218 - RNA, 22 nt, Human
uuucacaugcagcagggaagug

SEQ ID NO: 883219 - RNA, 22 nt, Human
gccuggcuuggggcucaguggu

SEQ ID NO: 883220 - RNA, 22 nt, Human
gacaguuuagguucaaaucuca

SEQ ID NO: 883221 - RNA, 22 nt, Human
auuuacucgugucuccagugcu

SEQ ID NO: 883222 - RNA, 21 nt, Human
uauacaugugugcauacgugu

SEQ ID NO: 883223 - RNA, 22 nt, Human
gccuggcacucacugaagaggc

SEQ ID NO: 883224 - RNA, 22 nt, Human
cuuauuucagcccugggcaccc

SEQ ID NO: 883225 - RNA, 22 nt, Human
uuagaaaaaacgucuucuagug

SEQ ID NO: 883226 - RNA, 22 nt, Human
aguggcaguggcugggcagagc

SEQ ID NO: 883227 - RNA, 16 nt, Human
agccuuaggaacagcc

SEQ ID NO: 883228 - RNA, 22 nt, Human
aauuucaauuacuuuugcacca

SEQ ID NO: 883229 - RNA, 22 nt, Human
agcugcugggaccccagaucca

SEQ ID NO: 883230 - RNA, 22 nt, Human
cuuauaguaugauguugagaau

SEQ ID NO: 883231 - RNA, 23 nt, Human
ccacaggcacagaggcuugcauc

SEQ ID NO: 883232 - RNA, 22 nt, Human
ccagaagugucuaucaagaugu

SEQ ID NO: 883233 - RNA, 18 nt, Human
acagugauuguucuaugc

SEQ ID NO: 883234 - RNA, 22 nt, Human
uuggcagaaugggcagcuugag

SEQ ID NO: 883235 - RNA, 22 nt, Human
ggaggaagggcccaggcuuuau

SEQ ID NO: 883236 - RNA, 22 nt, Human
uaagauaauccauuauaauguu

SEQ ID NO: 883237 - RNA, 22 nt, Human
cagacccucuucuauugguggg

SEQ ID NO: 883238 - RNA, 22 nt, Human
auacacguguguguacaugcac

SEQ ID NO: 883239 - RNA, 22 nt, Human
uggaaugacagagagucugaau

SEQ ID NO: 883240 - RNA, 22 nt, Human
aagguuuccagugauauugugg

SEQ ID NO: 883241 - RNA, 22 nt, Human
aaaucagagucugauuuuaagg

SEQ ID NO: 883242 - RNA, 22 nt, Human
acaugcugggcaauguuguuuu

SEQ ID NO: 883243 - RNA, 22 nt, Human
ugagcacagcucgcaccagcuu

SEQ ID NO: 883244 - RNA, 22 nt, Human
gcucaggcauguaugugguugc

SEQ ID NO: 883245 - RNA, 22 nt, Human
ucuggcccagccccugagguca

SEQ ID NO: 883246 - RNA, 22 nt, Human
gcaggcaccgcggcggcagguu

SEQ ID NO: 883247 - RNA, 22 nt, Human
auacuacaagguaugugcuaaa

SEQ ID NO: 883248 - RNA, 22 nt, Human
guagugcgcauggccuguuugu

SEQ ID NO: 883249 - RNA, 22 nt, Human
ugucccagguccuagaugacca

SEQ ID NO: 883250 - RNA, 22 nt, Human
auauuugcaggaaacuaguuuu

SEQ ID NO: 883251 - RNA, 22 nt, Human
ugucacaugaaacuugcucauc

SEQ ID NO: 883252 - RNA, 22 nt, Human
accugcagcuaaagauguaggg

SEQ ID NO: 883253 - RNA, 22 nt, Human
uccaaggacauuguucuaguug

SEQ ID NO: 883254 - RNA, 22 nt, Human
guguccagucauagcccagggc

SEQ ID NO: 883255 - RNA, 22 nt, Human
agugccuugugugugggcagcc

SEQ ID NO: 883256 - RNA, 22 nt, Human
caucuaaauuugacuccaagga

SEQ ID NO: 883257 - RNA, 22 nt, Human
gagguggcuccuucagggaaua

SEQ ID NO: 883258 - RNA, 22 nt, Human
uguuuuaaucucccauugcucu

SEQ ID NO: 883259 - RNA, 22 nt, Human
aguggcuguaucagucaacccu

SEQ ID NO: 883260 - RNA, 21 nt, Human
uaaguucugaucccuaucaac

SEQ ID NO: 883261 - RNA, 22 nt, Human
aagacuuucaaaccuauguuug

SEQ ID NO: 883262 - RNA, 22 nt, Human
acacuguaaagugaugcuuaaa

SEQ ID NO: 883263 - RNA, 21 nt, Human
gcagaugggagucaucaggcu

SEQ ID NO: 883264 - RNA, 22 nt, Human
agcagcauuuaaguuucuucua

SEQ ID NO: 883265 - RNA, 22 nt, Human
uuucacaaucaaauggugaaau

SEQ ID NO: 883266 - RNA, 22 nt, Human
uuaaaaucacagucacccagua

SEQ ID NO: 883267 - RNA, 22 nt, Human
uaguccauuaaauuagauucaa

SEQ ID NO: 883268 - RNA, 22 nt, Human
uggcugcagacaccuauggcag

SEQ ID NO: 883269 - RNA, 20 nt, Human
gcagucugccucuguguggu

SEQ ID NO: 883270 - RNA, 22 nt, Human
acuauucaagugcucauucaga

SEQ ID NO: 883271 - RNA, 22 nt, Human
cuuucaguuaaugacuccauag

SEQ ID NO: 883272 - RNA, 22 nt, Human
uucagaaagguuaaucuggauu

SEQ ID NO: 883273 - RNA, 18 nt, Human
uccaggcuccaggcuaac

SEQ ID NO: 883274 - RNA, 22 nt, Human
gaacaaugagucauucagguga

SEQ ID NO: 883275 - RNA, 22 nt, Human
aggaauuguguuguaguggaga

SEQ ID NO: 883276 - RNA, 22 nt, Human
agcccagcugccugccugcugu

SEQ ID NO: 883277 - RNA, 22 nt, Human
agcguggacugcugggcaaggu

SEQ ID NO: 883278 - RNA, 22 nt, Human
cuaaagugccaggaauacaggu

SEQ ID NO: 883279 - RNA, 22 nt, Human
uuacaguuguucuaucagcaug

SEQ ID NO: 883280 - RNA, 22 nt, Human
ucccugggaccggcagcucaca

SEQ ID NO: 883281 - RNA, 22 nt, Human
ggucccagguugacagggagac

SEQ ID NO: 883282 - RNA, 22 nt, Human
auugaaagcauggauuuggauu

SEQ ID NO: 883283 - RNA, 22 nt, Human
uccugggagaguuugauucauu

SEQ ID NO: 883284 - RNA, 22 nt, Human
ugagcccagaagcccacucggc

SEQ ID NO: 883285 - RNA, 20 nt, Human
ccagucccugagcaccaggg

SEQ ID NO: 883286 - RNA, 22 nt, Human
uggucuuuaagguagcugucau

SEQ ID NO: 883287 - RNA, 20 nt, Human
auggcaguccguguucaggg

SEQ ID NO: 883288 - RNA, 22 nt, Human
acaguacaagcaaugcauuuuu

SEQ ID NO: 883289 - RNA, 22 nt, Human
ggcagcuguaagaugagugaau

SEQ ID NO: 883290 - RNA, 22 nt, Human
auguuuaauuaucuggguuuug

SEQ ID NO: 883291 - RNA, 21 nt, Human
agagcuggccugccaggcccu

SEQ ID NO: 883292 - RNA, 22 nt, Human
cugugccucaguguccucgagu

SEQ ID NO: 883293 - RNA, 22 nt, Human
aguaacagcaucuccacuggaa

SEQ ID NO: 883294 - RNA, 22 nt, Human
gagucugaggggagagcugggu

SEQ ID NO: 883295 - RNA, 23 nt, Human
cccauuuucauguuaacuccugg

SEQ ID NO: 883296 - RNA, 22 nt, Human
aguguuaagagaaaauucugcu

SEQ ID NO: 883297 - RNA, 22 nt, Human
uuaaagaggcagguuaaauaau

SEQ ID NO: 883298 - RNA, 18 nt, Human
agcaggugugcagaaugu

SEQ ID NO: 883299 - RNA, 22 nt, Human
cuguggcauuaauaaaagugca

SEQ ID NO: 883300 - RNA, 22 nt, Human
caagucaaugauuauaagaguc

SEQ ID NO: 883301 - RNA, 20 nt, Human
auuagugcaucuggacaugc

SEQ ID NO: 883302 - RNA, 22 nt, Human
cuggaggagagucugaaugaca

SEQ ID NO: 883303 - RNA, 22 nt, Human
ucuucacagaugcauauacuuc

SEQ ID NO: 883304 - RNA, 22 nt, Human
ucuggaugggaugaggcaacaa

SEQ ID NO: 883305 - RNA, 22 nt, Human
uuucugaaaacugaaguagugc

SEQ ID NO: 883306 - RNA, 22 nt, Human
gcuguucuagcuucaguuucgc

SEQ ID NO: 883307 - RNA, 22 nt, Human
uacucaaaaaguuaugaaucau

SEQ ID NO: 883308 - RNA, 19 nt, Human
aggcugugaggggaaggaa

SEQ ID NO: 883309 - RNA, 22 nt, Human
accuagaguagucaaauucaua

SEQ ID NO: 883310 - RNA, 22 nt, Human
gguggggauuccugaucacugu

SEQ ID NO: 883311 - RNA, 22 nt, Human
agagcuguguccugugcacuag

SEQ ID NO: 883312 - RNA, 22 nt, Human
ucaauaaauagcuuggcucagc

SEQ ID NO: 883313 - RNA, 22 nt, Human
ugcuucugggccugguguuccc

SEQ ID NO: 883314 - RNA, 22 nt, Human
uccagagaggcauauuuacaag

SEQ ID NO: 883315 - RNA, 22 nt, Human
gaguucuaaaggcagaacauaa

SEQ ID NO: 883316 - RNA, 22 nt, Human
agaacauuaaugcgagguauua

SEQ ID NO: 883317 - RNA, 21 nt, Human
ugcuauuuaauuuuucuguuc

SEQ ID NO: 883318 - RNA, 22 nt, Human
ugaauucuuuuagaauucagug

SEQ ID NO: 883319 - RNA, 22 nt, Human
aaauucuguccugaaugccauu

SEQ ID NO: 883320 - RNA, 22 nt, Human
agcuguggggcaggcagcgagg

SEQ ID NO: 883321 - RNA, 22 nt, Human
cuuuccccaguauaucauugcc

SEQ ID NO: 883322 - RNA, 22 nt, Human
aaaugacaauaaaaguccaugc

SEQ ID NO: 883323 - RNA, 22 nt, Human
aguggugaggggcaugugugau

SEQ ID NO: 883324 - RNA, 22 nt, Human
uuucuuuccauacauauugcua

SEQ ID NO: 883325 - RNA, 22 nt, Human
gcuagcagaaagcaggcugcuc

SEQ ID NO: 883326 - RNA, 22 nt, Human
guauaucuucagaaauuauagg

SEQ ID NO: 883327 - RNA, 22 nt, Human
ucaggagguuuggauucaguua

SEQ ID NO: 883328 - RNA, 22 nt, Human
agcauacaggucugaaacagcu

SEQ ID NO: 883329 - RNA, 22 nt, Human
gaagucugacucuuuguaagcu

SEQ ID NO: 883330 - RNA, 22 nt, Human
ggucacuucagauaacuggugu

SEQ ID NO: 883331 - RNA, 22 nt, Human
ggagcagagcucuucaucugca

SEQ ID NO: 883332 - RNA, 22 nt, Human
gggugggccacugagcagcgug

SEQ ID NO: 883333 - RNA, 22 nt, Human
uuucugucugacaucccugccu

SEQ ID NO: 883334 - RNA, 22 nt, Human
agucuagaaugugcaccaagcu

SEQ ID NO: 883335 - RNA, 16 nt, Human
uuucucauugucauca

SEQ ID NO: 883336 - RNA, 22 nt, Human
augagguacuuacauugagcuu

SEQ ID NO: 883337 - RNA, 22 nt, Human
ccaggugcuagcaaucacuguc

SEQ ID NO: 883338 - RNA, 22 nt, Human
aggacuucuccgauaagucaga

SEQ ID NO: 883339 - RNA, 22 nt, Human
uucauagaaagugcuuagauug

SEQ ID NO: 883340 - RNA, 22 nt, Human
aacauauuuggcugauauuccc

SEQ ID NO: 883341 - RNA, 20 nt, Human
cacuaacugcucaugacucc

SEQ ID NO: 883342 - RNA, 22 nt, Human
ugcagcagguuccaaaggguua

SEQ ID NO: 883343 - RNA, 22 nt, Human
gcuucuccucccgcucccaggc

SEQ ID NO: 883344 - RNA, 18 nt, Human
cacaauuuacagaugaca

SEQ ID NO: 883345 - RNA, 22 nt, Human
gcucagggagcgauuuaccaug

SEQ ID NO: 883346 - RNA, 22 nt, Human
guucacaagcugauugucuuuc

SEQ ID NO: 883347 - RNA, 22 nt, Human
uguagaaccuguuuauuauaga

SEQ ID NO: 883348 - RNA, 22 nt, Human
uacuuuagaaggaaauaaguuc

SEQ ID NO: 883349 - RNA, 22 nt, Human
uuucacauuuaggcgugaauug

SEQ ID NO: 883350 - RNA, 22 nt, Human
caguggaagcuggcugugaaga

SEQ ID NO: 883351 - RNA, 22 nt, Human
aaagugcauucgaaaguccauc

SEQ ID NO: 883352 - RNA, 22 nt, Human
uccaggucuuccuauuccaggu

SEQ ID NO: 883353 - RNA, 22 nt, Human
guccagggaaauagcgacaggg

SEQ ID NO: 883354 - RNA, 22 nt, Human
ggucaggguuccagguaucuuc

SEQ ID NO: 883355 - RNA, 22 nt, Human
cuuucacagucauaugaugaau

SEQ ID NO: 883356 - RNA, 22 nt, Human
ugaaucaaagcugaaguuuuca

SEQ ID NO: 883357 - RNA, 21 nt, Human
agagcggcggggcgcgucugc

SEQ ID NO: 883358 - RNA, 22 nt, Human
guucagugucucucuauuuuau

SEQ ID NO: 883359 - RNA, 22 nt, Human
aggcuggcuggggaugcgucuu

SEQ ID NO: 883360 - RNA, 22 nt, Human
ggacaaaccaauagacacuggc

SEQ ID NO: 883361 - RNA, 22 nt, Human
aaugugugaacuucagagcauc

SEQ ID NO: 883362 - RNA, 22 nt, Human
ccagcagagcuggaagugugcu

SEQ ID NO: 883363 - RNA, 22 nt, Human
gagagaccuugcuaagugccuu

SEQ ID NO: 883364 - RNA, 22 nt, Human
cagagccugccaccuuucuccc

SEQ ID NO: 883365 - RNA, 19 nt, Human
aacagcaacuuccuaguca

SEQ ID NO: 883366 - RNA, 22 nt, Human
agauuuguaugucuaaauguaa

SEQ ID NO: 883367 - RNA, 22 nt, Human
acaacagugugguggaaggagc

SEQ ID NO: 883368 - RNA, 22 nt, Human
ugaaggcaaaacauguuacacc

SEQ ID NO: 883369 - RNA, 22 nt, Human
cacaguaaccccaggacuggga

SEQ ID NO: 883370 - RNA, 22 nt, Human
agaaaguuagcagacucuuggc

SEQ ID NO: 883371 - RNA, 22 nt, Human
gagagcugcaagguagggcggg

SEQ ID NO: 883372 - RNA, 22 nt, Human
uugagguauaguugacaauuua

SEQ ID NO: 883373 - RNA, 22 nt, Human
uuggaaaacuuacacagagcug

SEQ ID NO: 883374 - RNA, 22 nt, Human
uucuguauggaaacauccucca

SEQ ID NO: 883375 - RNA, 22 nt, Human
uucacugaaguuucuuccaugu

SEQ ID NO: 883376 - RNA, 22 nt, Human
guauacacugucuccucuaggu

SEQ ID NO: 883377 - RNA, 19 nt, Human
gugaagugccagaagucag

SEQ ID NO: 883378 - RNA, 19 nt, Human
aggugaggggcaccauguc

SEQ ID NO: 883379 - RNA, 22 nt, Human
gaaggaagccguuucucuccag

SEQ ID NO: 883380 - RNA, 22 nt, Human
agagagcauggcacagaggggu

SEQ ID NO: 883381 - RNA, 22 nt, Human
uuuucuuccuggauuuuggcau

SEQ ID NO: 883382 - RNA, 22 nt, Human
uuguuaaaggcaaaacaagcac

SEQ ID NO: 883383 - RNA, 22 nt, Human
cagagcagggguuucccagguu

SEQ ID NO: 883384 - RNA, 22 nt, Human
ucagaagcauguggggagccug

SEQ ID NO: 883385 - RNA, 20 nt, Human
ugaggcucagagagguugag

SEQ ID NO: 883386 - RNA, 22 nt, Human
uguacagagacuaccauuaaua

SEQ ID NO: 883387 - RNA, 22 nt, Human
guguguguacucuguauauaaa

SEQ ID NO: 883388 - RNA, 23 nt, Human
gguccaggaaaggcagcagcacc

SEQ ID NO: 883389 - RNA, 22 nt, Human
ccgaggacauugggcuucuguu

SEQ ID NO: 883390 - RNA, 22 nt, Human
aucaccacuacaaacaucauug

SEQ ID NO: 883391 - RNA, 22 nt, Human
uguccuguucuggcgugagugg

SEQ ID NO: 883392 - RNA, 22 nt, Human
uuagugcuucuguccaaauaua

SEQ ID NO: 883393 - RNA, 22 nt, Human
gagucugaugucccccaggcca

SEQ ID NO: 883394 - RNA, 22 nt, Human
ugaaaucugucccacuuuagcu

SEQ ID NO: 883395 - RNA, 22 nt, Human
caggguggcccuguggucucau

SEQ ID NO: 883396 - RNA, 22 nt, Human
acauaacauaguugacauuuuu

SEQ ID NO: 883397 - RNA, 22 nt, Human
gugucagcuaauuugggagcuc

SEQ ID NO: 883398 - RNA, 22 nt, Human
auguaguacuggguauguuucu

SEQ ID NO: 883399 - RNA, 22 nt, Human
ccguguguaugguggaacugcu

SEQ ID NO: 883400 - RNA, 22 nt, Human
gggcagucacagugcuggagca

SEQ ID NO: 883401 - RNA, 22 nt, Human
ccaugcacaccagcaggcagac

SEQ ID NO: 883402 - RNA, 23 nt, Human
augagguaaagaucagcuuuaaa

SEQ ID NO: 883403 - RNA, 17 nt, Human
ccugagugggagaggaa

SEQ ID NO: 883404 - RNA, 22 nt, Human
ggggcugggauuugaacccagg

SEQ ID NO: 883405 - RNA, 22 nt, Human
ugccagcuagagaagcuagaaa

SEQ ID NO: 883406 - RNA, 22 nt, Human
ugugugcacugccuuuugugga

SEQ ID NO: 883407 - RNA, 22 nt, Human
uugauuuugccugaucugagag

SEQ ID NO: 883408 - RNA, 19 nt, Human
acaaacugaguacacuugu

SEQ ID NO: 883409 - RNA, 20 nt, Human
uacauuguagaaauauucaa

SEQ ID NO: 883410 - RNA, 22 nt, Human
gcagggcuccacuguggccaag

SEQ ID NO: 883411 - RNA, 22 nt, Human
gggcacuggaaggcucucaggc

SEQ ID NO: 883412 - RNA, 20 nt, Human
ggcagggcaucaacagcucu

SEQ ID NO: 883413 - RNA, 22 nt, Human
gagagucuagugcaccuaguuu

SEQ ID NO: 883414 - RNA, 20 nt, Human
agugccagggcaggugagag

SEQ ID NO: 883415 - RNA, 22 nt, Human
guccuguguacuccugauacuu

SEQ ID NO: 883416 - RNA, 22 nt, Human
gcagggcugagucaugugugcc

SEQ ID NO: 883417 - RNA, 22 nt, Human
agggggcauuaugaggcuuuuc

SEQ ID NO: 883418 - RNA, 22 nt, Human
cugcagcagugugucucauuuu

SEQ ID NO: 883419 - RNA, 22 nt, Human
gcugccauguugugaggacacu

SEQ ID NO: 883420 - RNA, 22 nt, Human
uguaacaaugaauauagugacu

SEQ ID NO: 883421 - RNA, 22 nt, Human
gcagcuggagaaauaccacccu

SEQ ID NO: 883422 - RNA, 22 nt, Human
gaggugcugcuguacuucuugc

SEQ ID NO: 883423 - RNA, 22 nt, Human
aaauuucuaagcagccacuucc

SEQ ID NO: 883424 - RNA, 22 nt, Human
ugucucuugagcugccugaugc

SEQ ID NO: 883425 - RNA, 20 nt, Human
agcaacaauaaaauguccug

SEQ ID NO: 883426 - RNA, 22 nt, Human
cccagcucucucaguucugcuu

SEQ ID NO: 883427 - RNA, 22 nt, Human
aggcccuggcccccagagauuc

SEQ ID NO: 883428 - RNA, 22 nt, Human
uguaaaaccaaaucaaucuagu

SEQ ID NO: 883429 - RNA, 22 nt, Human
augaaauaaauacccacacaua

SEQ ID NO: 883430 - RNA, 22 nt, Human
ucuguuuucucuguauuuugac

SEQ ID NO: 883431 - RNA, 22 nt, Human
ucaguaaccuuuagcacaguug

SEQ ID NO: 883432 - RNA, 22 nt, Human
ggaggcucuaaacuuuccuugg

SEQ ID NO: 883433 - RNA, 22 nt, Human
uagauacauuuuucuuuccugu

SEQ ID NO: 883434 - RNA, 22 nt, Human
uucaaguucuaguguucacuuc

SEQ ID NO: 883435 - RNA, 22 nt, Human
uagcaaauguguuaugcuaugc

SEQ ID NO: 883436 - RNA, 22 nt, Human
uaaagguugaaaacugacugcc

SEQ ID NO: 883437 - RNA, 22 nt, Human
uagaaagcaguaucuccauuuu

SEQ ID NO: 883438 - RNA, 20 nt, Human
caaauggcuuuuauuuccuu

SEQ ID NO: 883439 - RNA, 22 nt, Human
cuucuucccagcuucccucacc

SEQ ID NO: 883440 - RNA, 22 nt, Human
guggagggugauugccggcugu

SEQ ID NO: 883441 - RNA, 22 nt, Human
gcucuccaggucucaugcacug

SEQ ID NO: 883442 - RNA, 22 nt, Human
uguuuagaaucauucaaaaguu

SEQ ID NO: 883443 - RNA, 22 nt, Human
ucacagccuggucacucugccc

SEQ ID NO: 883444 - RNA, 22 nt, Human
uugcauguguauaaaaguugga

SEQ ID NO: 883445 - RNA, 22 nt, Human
gcaguggauggccagcaggggc

SEQ ID NO: 883446 - RNA, 22 nt, Human
cagcucugcuuccuuguacagg

SEQ ID NO: 883447 - RNA, 22 nt, Human
caggugucuaauucucaccccc

SEQ ID NO: 883448 - RNA, 22 nt, Human
gcuuagaaagugauugauacau

SEQ ID NO: 883449 - RNA, 22 nt, Human
gcuggcagggacagcugcgugu

SEQ ID NO: 883450 - RNA, 22 nt, Human
ugacaguagaagaugcuguuac

SEQ ID NO: 883451 - RNA, 21 nt, Human
gcaggcuggucaaaccucagu

SEQ ID NO: 883452 - RNA, 23 nt, Human
gggcuccagucucugcucaguug

SEQ ID NO: 883453 - RNA, 22 nt, Human
auaacuuucuucacccuugcug

SEQ ID NO: 883454 - RNA, 22 nt, Human
aaguacaaauuuugaagagcuu

SEQ ID NO: 883455 - RNA, 20 nt, Human
ccuggccaaugagauaggaa

SEQ ID NO: 883456 - RNA, 17 nt, Human
ugguggcuggagucagg

SEQ ID NO: 883457 - RNA, 22 nt, Human
ucacaagguccugguggauaga

SEQ ID NO: 883458 - RNA, 22 nt, Human
gagcuuugcuggaagccugggg

SEQ ID NO: 883459 - RNA, 22 nt, Human
ggggccagagaggacccaggug

SEQ ID NO: 883460 - RNA, 22 nt, Human
uuuuuaguagagguggguuuca

SEQ ID NO: 883461 - RNA, 19 nt, Human
augaagcauuguuuuugua

SEQ ID NO: 883462 - RNA, 22 nt, Human
gcaugcaggagagaaagacggc

SEQ ID NO: 883463 - RNA, 22 nt, Human
gcuuucuuaguguguuaauugg

SEQ ID NO: 883464 - RNA, 22 nt, Human
aauucagagacaugaagugaca

SEQ ID NO: 883465 - RNA, 22 nt, Human
uuucucuccuccaaaccaaaga

SEQ ID NO: 883466 - RNA, 22 nt, Human
uuaacauccuguuuaaauuugg

SEQ ID NO: 883467 - RNA, 22 nt, Human
aauuauguagccauaugaaaca

SEQ ID NO: 883468 - RNA, 22 nt, Human
ggaggcuccuaagcugacuuga

SEQ ID NO: 883469 - RNA, 22 nt, Human
cagcagcagacauuugaucuuc

SEQ ID NO: 883470 - RNA, 22 nt, Human
agccagaguugaaugugagucu

SEQ ID NO: 883471 - RNA, 22 nt, Human
uagaguguuguaauugaaaagg

SEQ ID NO: 883472 - RNA, 22 nt, Human
gacagugguuccaaggcagcuu

SEQ ID NO: 883473 - RNA, 22 nt, Human
cuaucauuuuacaugguuggug

SEQ ID NO: 883474 - RNA, 22 nt, Human
uuccuaacucuggcaccuaguc

SEQ ID NO: 883475 - RNA, 22 nt, Human
uuugugcugacauuugggucau

SEQ ID NO: 883476 - RNA, 22 nt, Human
cuuuggaaaaauaccuggcaua

SEQ ID NO: 883477 - RNA, 22 nt, Human
ggcagcuauuccaagcagcacu

SEQ ID NO: 883478 - RNA, 22 nt, Human
auuugguuacucaguugucuga

SEQ ID NO: 883479 - RNA, 22 nt, Human
gccaggagccagcuucuuagca

SEQ ID NO: 883480 - RNA, 18 nt, Human
ucaaacugucauugguga

SEQ ID NO: 883481 - RNA, 17 nt, Human
cccagagaugcugccuu

SEQ ID NO: 883482 - RNA, 17 nt, Human
cccugccaccaggaagc

SEQ ID NO: 883483 - RNA, 22 nt, Human
aaaguacauagcauauuccaac

SEQ ID NO: 883484 - RNA, 22 nt, Human
ugucaguggucauaguagaaaa

SEQ ID NO: 883485 - RNA, 22 nt, Human
cagagggcacucggagugacau

SEQ ID NO: 883486 - RNA, 22 nt, Human
cagcugagaaaggcaggcucac

SEQ ID NO: 883487 - RNA, 22 nt, Human
ggcuccagguuuaaggguaugu

SEQ ID NO: 883488 - RNA, 22 nt, Human
ucuacaagucaagucuaucaag

SEQ ID NO: 883489 - RNA, 22 nt, Human
gugggcugcauguuuacuauuc

SEQ ID NO: 883490 - RNA, 22 nt, Human
guagaaauagugguugacagga

SEQ ID NO: 883491 - RNA, 22 nt, Human
uuuuggcucugucuguaucuuu

SEQ ID NO: 883492 - RNA, 22 nt, Human
gcacacagccagcugagggcua

SEQ ID NO: 883493 - RNA, 22 nt, Human
auuagccuuaauaauuuagaag

SEQ ID NO: 883494 - RNA, 22 nt, Human
ugcagccuuggcaaccagggac

SEQ ID NO: 883495 - RNA, 22 nt, Human
cuggccagugacugcucacccg

SEQ ID NO: 883496 - RNA, 22 nt, Human
uugaaucuuagcucugccacuu

SEQ ID NO: 883497 - RNA, 22 nt, Human
aggucacccguuugacuaucca

SEQ ID NO: 883498 - RNA, 21 nt, Human
uagagaaaagaagcuguuccu

SEQ ID NO: 883499 - RNA, 22 nt, Human
cccaggagguguagcugcgugg

SEQ ID NO: 883500 - RNA, 22 nt, Human
ggucugaguagagggcuggcga

SEQ ID NO: 883501 - RNA, 22 nt, Human
ugagccaggaguuugaggcugu

SEQ ID NO: 883502 - RNA, 22 nt, Human
uauuacacagugaaagcaugga

SEQ ID NO: 883503 - RNA, 22 nt, Human
acaaaauuuuuagacaaggcuu

SEQ ID NO: 883504 - RNA, 17 nt, Human
agcugccucucccacca

SEQ ID NO: 883505 - RNA, 20 nt, Human
cuuguugauucuaggaauga

SEQ ID NO: 883506 - RNA, 18 nt, Human
agaagccacgaggagucc

SEQ ID NO: 883507 - RNA, 19 nt, Human
cuucuccagcuucuagaag

SEQ ID NO: 883508 - RNA, 22 nt, Human
uguuuaugugugugcauauaua

SEQ ID NO: 883509 - RNA, 22 nt, Human
gagcacagggaauagacagaua

SEQ ID NO: 883510 - RNA, 22 nt, Human
guuuccaucuccaggacauaau

SEQ ID NO: 883511 - RNA, 22 nt, Human
agcuagcuuagccugugaggua

SEQ ID NO: 883512 - RNA, 20 nt, Human
guccuagguuugaagguaaa

SEQ ID NO: 883513 - RNA, 22 nt, Human
cuggagaaaauccauguguaug

SEQ ID NO: 883514 - RNA, 22 nt, Human
ucacugcagacaaccucaguca

SEQ ID NO: 883515 - RNA, 22 nt, Human
gcuggagucuggaggugugcca

SEQ ID NO: 883516 - RNA, 22 nt, Human
gcugccaugguccaggcuccag

SEQ ID NO: 883517 - RNA, 20 nt, Human
cucaucucugagccuccugg

SEQ ID NO: 883518 - RNA, 22 nt, Human
guugaugaaaaugaauugcaug

SEQ ID NO: 883519 - RNA, 22 nt, Human
cagagacaaugucucugcuugu

SEQ ID NO: 883520 - RNA, 21 nt, Human
cugcaucucauagaacauguc

SEQ ID NO: 883521 - RNA, 22 nt, Human
ucucuccuuaucauuguguuua

SEQ ID NO: 883522 - RNA, 22 nt, Human
ugcucacugaacucuugcuguc

SEQ ID NO: 883523 - RNA, 22 nt, Human
ucagccuccgaaagugcuggga

SEQ ID NO: 883524 - RNA, 22 nt, Human
aagagccagcuagugaagaggc

SEQ ID NO: 883525 - RNA, 22 nt, Human
cccagcucucugcucuuagccu

SEQ ID NO: 883526 - RNA, 22 nt, Human
uuaucugguauaguggggaaga

SEQ ID NO: 883527 - RNA, 22 nt, Human
acugcuuuaucugagaaguccu

SEQ ID NO: 883528 - RNA, 20 nt, Human
cccaggugucugaagcucug

SEQ ID NO: 883529 - RNA, 22 nt, Human
uuggcugacaaauggaaucucu

SEQ ID NO: 883530 - RNA, 22 nt, Human
gucauuuuucacugcauauaga

SEQ ID NO: 883531 - RNA, 22 nt, Human
cauuagcaugguagccagguca

SEQ ID NO: 883532 - RNA, 22 nt, Human
cugucagagauggggagucaga

SEQ ID NO: 883533 - RNA, 22 nt, Human
agcaguuuuagggagacacauu

SEQ ID NO: 883534 - RNA, 22 nt, Human
gacccaggagagaggguugcau

SEQ ID NO: 883535 - RNA, 22 nt, Human
ggcaggcugggugucauggagu

SEQ ID NO: 883536 - RNA, 22 nt, Human
gggcuagaaguuagcuagagaa

SEQ ID NO: 883537 - RNA, 22 nt, Human
cuguuuuccuggguuccaugag

SEQ ID NO: 883538 - RNA, 22 nt, Human
aggcugugaacucuaugcugaa

SEQ ID NO: 883539 - RNA, 22 nt, Human
caggugggcuugggagaacacu

SEQ ID NO: 883540 - RNA, 22 nt, Human
aggggagcuaacaccagagccc

SEQ ID NO: 883541 - RNA, 22 nt, Human
uuggaugagguugagaaucauu

SEQ ID NO: 883542 - RNA, 22 nt, Human
uuuaagaugguauuuuauaaag

SEQ ID NO: 883543 - RNA, 22 nt, Human
augcuuuaguucaaaggacuua

SEQ ID NO: 883544 - RNA, 19 nt, Human
ccauggagagagaugcauu

SEQ ID NO: 883545 - RNA, 22 nt, Human
ccuggcucuggggcggacagcu

SEQ ID NO: 883546 - RNA, 22 nt, Human
uuccugggauuauugucaagca

SEQ ID NO: 883547 - RNA, 22 nt, Human
cauauacacuuccaccucugug

SEQ ID NO: 883548 - RNA, 22 nt, Human
auucuugcaguauacaacuacu

SEQ ID NO: 883549 - RNA, 22 nt, Human
aaugaucaccugguaaagagag

SEQ ID NO: 883550 - RNA, 22 nt, Human
uacuuuacaguauuagauaauu

SEQ ID NO: 883551 - RNA, 22 nt, Human
aaaucaaggagggauuauauuu

SEQ ID NO: 883552 - RNA, 22 nt, Human
aagagacaaugacacuugggag

SEQ ID NO: 883553 - RNA, 22 nt, Human
augucuuucuaguuaagagcua

SEQ ID NO: 883554 - RNA, 22 nt, Human
ucccaggaauugaagccagugu

SEQ ID NO: 883555 - RNA, 22 nt, Human
aaauaguuagcccugcauauau

SEQ ID NO: 883556 - RNA, 22 nt, Human
aacuuuggguaaugcuucaauu

SEQ ID NO: 883557 - RNA, 22 nt, Human
aaacaggcuuauauuuugcucu

SEQ ID NO: 883558 - RNA, 22 nt, Human
auauuaguuuggagacuacaau

SEQ ID NO: 883559 - RNA, 17 nt, Human
agaacuguaguagcucc

SEQ ID NO: 883560 - RNA, 22 nt, Human
ccaugcagugcuggagcugauu

SEQ ID NO: 883561 - RNA, 22 nt, Human
agcugcagugaacuguuuuguc

SEQ ID NO: 883562 - RNA, 22 nt, Human
ugcugagggagcaucaaagaaa

SEQ ID NO: 883563 - RNA, 22 nt, Human
gcucccacgcaauucuuuucag

SEQ ID NO: 883564 - RNA, 22 nt, Human
gccugcugcauccaggcuauug

SEQ ID NO: 883565 - RNA, 22 nt, Human
auuauccaacacccaguuacau

SEQ ID NO: 883566 - RNA, 22 nt, Human
agcuuuauuaacucuccaggug

SEQ ID NO: 883567 - RNA, 22 nt, Human
ucagaaaugaucguuauucauu

SEQ ID NO: 883568 - RNA, 22 nt, Human
gaagaaacaggggcuuggggag

SEQ ID NO: 883569 - RNA, 22 nt, Human
agguauaagucucauuucuguu

SEQ ID NO: 883570 - RNA, 22 nt, Human
aaaugcuacauacacaucaggg

SEQ ID NO: 883571 - RNA, 21 nt, Human
ggccuuccccugcagucuccg

SEQ ID NO: 883572 - RNA, 22 nt, Human
ugcuuuaucaaagcuauaguga

SEQ ID NO: 883573 - RNA, 22 nt, Human
guggaucuacuguaugggauag

SEQ ID NO: 883574 - RNA, 22 nt, Human
cauuucucauaauauuagcacu

SEQ ID NO: 883575 - RNA, 22 nt, Human
acagcacaggaguugaaugggc

SEQ ID NO: 883576 - RNA, 22 nt, Human
gcugaaguggcgugaucagaau

SEQ ID NO: 883577 - RNA, 22 nt, Human
uuuggaaauaauuccaucucau

SEQ ID NO: 883578 - RNA, 22 nt, Human
ugggaguguucuuggcuugcuu

SEQ ID NO: 883579 - RNA, 22 nt, Human
aaagcaaugcuuguggaaugua

SEQ ID NO: 883580 - RNA, 18 nt, Human
uccaggcuggauugauga

SEQ ID NO: 883581 - RNA, 22 nt, Human
cauaauuucacugucguauggc

SEQ ID NO: 883582 - RNA, 22 nt, Human
agguagggcuaggcugcgucug

SEQ ID NO: 883583 - RNA, 20 nt, Human
aagcacugugguggcaugga

SEQ ID NO: 883584 - RNA, 22 nt, Human
uccuggguaaacacugaccuuu

SEQ ID NO: 883585 - RNA, 22 nt, Human
ucccuguguccaugccaggagg

SEQ ID NO: 883586 - RNA, 20 nt, Human
uguuucuuuuaaugagcggc

SEQ ID NO: 883587 - RNA, 22 nt, Human
ugccuggcaucuagcccuggga

SEQ ID NO: 883588 - RNA, 22 nt, Human
ccagggugaccagcuggccuag

SEQ ID NO: 883589 - RNA, 22 nt, Human
augugagguagauaggaugcag

SEQ ID NO: 883590 - RNA, 22 nt, Human
uuucaguucaguuuauuauauc

SEQ ID NO: 883591 - RNA, 22 nt, Human
gagauuucaccccucuuaaccu

SEQ ID NO: 883592 - RNA, 22 nt, Human
uuuacaugucaagacuggcagu

SEQ ID NO: 883593 - RNA, 21 nt, Human
gggaaugagauucuuggagau

SEQ ID NO: 883594 - RNA, 22 nt, Human
uccaggcuacuuggauuccugg

SEQ ID NO: 883595 - RNA, 22 nt, Human
acuuuucccuugguagaguugc

SEQ ID NO: 883596 - RNA, 22 nt, Human
aaaggcuggaaacugaagauaa

SEQ ID NO: 883597 - RNA, 22 nt, Human
ugggccauuuuuggaagacugg

SEQ ID NO: 883598 - RNA, 22 nt, Human
guuauauuggcagaagagaaga

SEQ ID NO: 883599 - RNA, 23 nt, Human
uuuguacauugaggaggcagaau

SEQ ID NO: 883600 - RNA, 22 nt, Human
uuacauagguauguuugcuuug

SEQ ID NO: 883601 - RNA, 22 nt, Human
accugggucugguguugggacg

SEQ ID NO: 883602 - RNA, 18 nt, Human
uguguaugucucagggaa

SEQ ID NO: 883603 - RNA, 22 nt, Human
caugggaggccugcugcuggug

SEQ ID NO: 883604 - RNA, 22 nt, Human
acugccuucuuuaauccuaguu

SEQ ID NO: 883605 - RNA, 22 nt, Human
gccucugaguuuggagaagagc

SEQ ID NO: 883606 - RNA, 22 nt, Human
ggcugcagauuguagucuguua

SEQ ID NO: 883607 - RNA, 20 nt, Human
caacacugcccauuguuugc

SEQ ID NO: 883608 - RNA, 22 nt, Human
agguggcagagugacaggcuga

SEQ ID NO: 883609 - RNA, 22 nt, Human
aaguacagaaggagcgaacaau

SEQ ID NO: 883610 - RNA, 22 nt, Human
gcccuguucuggacaggcacaa

SEQ ID NO: 883611 - RNA, 22 nt, Human
ccugggucccugagagaugauu

SEQ ID NO: 883612 - RNA, 21 nt, Human
gggcagcagcagcaacaaggg

SEQ ID NO: 883613 - RNA, 22 nt, Human
agagaagauucuuauaugucuu

SEQ ID NO: 883614 - RNA, 22 nt, Human
gggcagcuccuguggaauccac

SEQ ID NO: 883615 - RNA, 22 nt, Human
ucaugcaaagccaauuccagcu

SEQ ID NO: 883616 - RNA, 22 nt, Human
uuucagagaauuagaagcugau

SEQ ID NO: 883617 - RNA, 22 nt, Human
caaaaguaauugcaguuuuugc

SEQ ID NO: 883618 - RNA, 22 nt, Human
ucuuugcaaauguuauuaucuu

SEQ ID NO: 883619 - RNA, 22 nt, Human
ugguauggucaaagccugugua

SEQ ID NO: 883620 - RNA, 18 nt, Human
uuagauacuagugugcua

SEQ ID NO: 883621 - RNA, 22 nt, Human
gccacaggaaagcacccuggag

SEQ ID NO: 883622 - RNA, 22 nt, Human
uuaaaaauauguagggcccgau

SEQ ID NO: 883623 - RNA, 22 nt, Human
agggcagcugugagccacugug

SEQ ID NO: 883624 - RNA, 22 nt, Human
uaaacauggcuguuucaguuau

SEQ ID NO: 883625 - RNA, 22 nt, Human
gcugcuucucugauggagucca

SEQ ID NO: 883626 - RNA, 22 nt, Human
acaaagcucuggaaggcucguc

SEQ ID NO: 883627 - RNA, 22 nt, Human
cugagguacgcuggcucccugg

SEQ ID NO: 883628 - RNA, 22 nt, Human
aaucacauuuacauugcuaauu

SEQ ID NO: 883629 - RNA, 22 nt, Human
ggcuguggcagcuggaaguggu

SEQ ID NO: 883630 - RNA, 22 nt, Human
gcagacacagggaaggcaagga

SEQ ID NO: 883631 - RNA, 22 nt, Human
acacacguauauauacguaugu

SEQ ID NO: 883632 - RNA, 18 nt, Human
uagcagggcuuguccuuu

SEQ ID NO: 883633 - RNA, 22 nt, Human
aaugucucuauaucucauaaga

SEQ ID NO: 883634 - RNA, 19 nt, Human
uaauccaaggcugcucuua

SEQ ID NO: 883635 - RNA, 22 nt, Human
agauauuuguaucuugcuauug

SEQ ID NO: 883636 - RNA, 17 nt, Human
caccaauuaagacccuc

SEQ ID NO: 883637 - RNA, 22 nt, Human
uucaacuaauguuuauuuuaug

SEQ ID NO: 883638 - RNA, 22 nt, Human
aaaguacagauggugagguugg

SEQ ID NO: 883639 - RNA, 22 nt, Human
gacagacaccugggggguugcu

SEQ ID NO: 883640 - RNA, 22 nt, Human
uacaagcucgggcagcucauua

SEQ ID NO: 883641 - RNA, 23 nt, Human
uuacaaguucugaaauuuccuuc

SEQ ID NO: 883642 - RNA, 22 nt, Human
auugaaagauaggcuacugugg

SEQ ID NO: 883643 - RNA, 22 nt, Human
ccagugcaccaagaggccuaga

SEQ ID NO: 883644 - RNA, 22 nt, Human
ccaggagcgggaaaaggaagaa

SEQ ID NO: 883645 - RNA, 22 nt, Human
caucugaauuugccuuaguuuc

SEQ ID NO: 883646 - RNA, 22 nt, Human
uacaguaagaugaaauagcaau

SEQ ID NO: 883647 - RNA, 21 nt, Human
ggcagagaagcuggaaguugg

SEQ ID NO: 883648 - RNA, 22 nt, Human
uuccucagacccucauugugag

SEQ ID NO: 883649 - RNA, 22 nt, Human
uuagaacaucucucuucugcca

SEQ ID NO: 883650 - RNA, 22 nt, Human
agcagacaggcugccacagugc

SEQ ID NO: 883651 - RNA, 22 nt, Human
ucugagugauguugagucagaa

SEQ ID NO: 883652 - RNA, 22 nt, Human
ccucaggcaagucacuuaacau

SEQ ID NO: 883653 - RNA, 22 nt, Human
uaagagcuccaauauuuguggc

SEQ ID NO: 883654 - RNA, 22 nt, Human
uguaugugcaauguuuauaugu

SEQ ID NO: 883655 - RNA, 22 nt, Human
gcacccagccagcaucucagag

SEQ ID NO: 883656 - RNA, 22 nt, Human
ugcagagugaggaagaacugca

SEQ ID NO: 883657 - RNA, 22 nt, Human
uguggcagaaggcuaagguguc

SEQ ID NO: 883658 - RNA, 22 nt, Human
uugcugaaaacaggucaucagg

SEQ ID NO: 883659 - RNA, 22 nt, Human
ggccuuccuguuguguccaccg

SEQ ID NO: 883660 - RNA, 22 nt, Human
uuuucucuuguuaauguacuga

SEQ ID NO: 883661 - RNA, 22 nt, Human
caggugacccucucaccugcuu

SEQ ID NO: 883662 - RNA, 22 nt, Human
aagguacagaaauuaacaagga

SEQ ID NO: 883663 - RNA, 22 nt, Human
uucugcaugcccucuguguggc

SEQ ID NO: 883664 - RNA, 22 nt, Human
ucuuaaaugacugauaagagga

SEQ ID NO: 883665 - RNA, 22 nt, Human
ggacaggcccggggagccugga

SEQ ID NO: 883666 - RNA, 22 nt, Human
agagcacaguaucugcacauca

SEQ ID NO: 883667 - RNA, 22 nt, Human
auuuggugguuccuuuuccgaa

SEQ ID NO: 883668 - RNA, 22 nt, Human
ugggccucuguuuccucaucug

SEQ ID NO: 883669 - RNA, 20 nt, Human
ugcugcaguuucaugggacu

SEQ ID NO: 883670 - RNA, 22 nt, Human
aggagggaauaagaaagaguca

SEQ ID NO: 883671 - RNA, 22 nt, Human
uggggagaguuacaaggaaucu

SEQ ID NO: 883672 - RNA, 22 nt, Human
ugugugaggugguucugagaag

SEQ ID NO: 883673 - RNA, 22 nt, Human
cuguguuucuaaguaaaggagc

SEQ ID NO: 883674 - RNA, 20 nt, Human
uuucacaaugaacaugucuc

SEQ ID NO: 883675 - RNA, 22 nt, Human
agagccaggacugugucucacu

SEQ ID NO: 883676 - RNA, 22 nt, Human
ucuggggaugagguccagugau

SEQ ID NO: 883677 - RNA, 22 nt, Human
uugaucagguugcuguggugua

SEQ ID NO: 883678 - RNA, 21 nt, Human
acagacagggccagugucccc

SEQ ID NO: 883679 - RNA, 22 nt, Human
acagcaguuacugaaauaaagu

SEQ ID NO: 883680 - RNA, 22 nt, Human
ucuaaagaaacauugagaccug

SEQ ID NO: 883681 - RNA, 22 nt, Human
cuggcccccacaccugucaggg

SEQ ID NO: 883682 - RNA, 22 nt, Human
ucauggcugaaacaguaacaca

SEQ ID NO: 883683 - RNA, 19 nt, Human
ccccaaaguuuagauguug

SEQ ID NO: 883684 - RNA, 22 nt, Human
ugugcccaucccucuggagugu

SEQ ID NO: 883685 - RNA, 22 nt, Human
uuaugcuaguauaguccuuaga

SEQ ID NO: 883686 - RNA, 22 nt, Human
auacaugacucacacauucugc

SEQ ID NO: 883687 - RNA, 22 nt, Human
gcagcuuccugaguguggacag

SEQ ID NO: 883688 - RNA, 22 nt, Human
ucagaaauagucuuuaaaauga

SEQ ID NO: 883689 - RNA, 22 nt, Human
ucccaagaugacacaguggacg

SEQ ID NO: 883690 - RNA, 22 nt, Human
gggucccagcauaggggaagca

SEQ ID NO: 883691 - RNA, 20 nt, Human
caguuuaucuuuccggagcu

SEQ ID NO: 883692 - RNA, 20 nt, Human
aaacuugauggcauagaaua

SEQ ID NO: 883693 - RNA, 22 nt, Human
gggagaaggagcuaguucuuga

SEQ ID NO: 883694 - RNA, 22 nt, Human
agugcuuuguggagaauuugua

SEQ ID NO: 883695 - RNA, 22 nt, Human
aagcagcauagcucccuuaguu

SEQ ID NO: 883696 - RNA, 19 nt, Human
uaaaaggauguggaaggau

SEQ ID NO: 883697 - RNA, 22 nt, Human
agccugucugucuccaaagcug

SEQ ID NO: 883698 - RNA, 22 nt, Human
aaggcagcaagaauuccagguu

SEQ ID NO: 883699 - RNA, 20 nt, Human
aagcagaagcugcucucagc

SEQ ID NO: 883700 - RNA, 21 nt, Human
gcccuaggcuaccuggagcgc

SEQ ID NO: 883701 - RNA, 19 nt, Human
cgcucuggguuucguguca

SEQ ID NO: 883702 - RNA, 22 nt, Human
ucucuaaaugcucucccauccc

SEQ ID NO: 883703 - RNA, 22 nt, Human
auucugaguuagagucagccag

SEQ ID NO: 883704 - RNA, 22 nt, Human
auacaagacucagcacagacgg

SEQ ID NO: 883705 - RNA, 22 nt, Human
uccaggcccacucagcugaaau

SEQ ID NO: 883706 - RNA, 22 nt, Human
ccugugggcccuggacagagac

SEQ ID NO: 883707 - RNA, 22 nt, Human
auuucuugccccugcucccuga

SEQ ID NO: 883708 - RNA, 22 nt, Human
ucaaacaccaucugaccuuaug

SEQ ID NO: 883709 - RNA, 22 nt, Human
auuuagcuuaccucguuacuga

SEQ ID NO: 883710 - RNA, 22 nt, Human
gguguccuugcagaaggcggcg

SEQ ID NO: 883711 - RNA, 22 nt, Human
agaguuuaacacaagaaaaguu

SEQ ID NO: 883712 - RNA, 22 nt, Human
uucugggcccaacccuagagug

SEQ ID NO: 883713 - RNA, 22 nt, Human
cagguggcaugacugccuacaa

SEQ ID NO: 883714 - RNA, 22 nt, Human
cuccucccacggucucaggaag

SEQ ID NO: 883715 - RNA, 22 nt, Human
caggugggccgggguuuguucu

SEQ ID NO: 883716 - RNA, 22 nt, Human
uucuguuugccauauauaguag

SEQ ID NO: 883717 - RNA, 22 nt, Human
cugagaggggaccaggguguuu

SEQ ID NO: 883718 - RNA, 22 nt, Human
ggagcuguugcgcaugcgcucg

SEQ ID NO: 883719 - RNA, 22 nt, Human
cugcugggaaggucugcucagu

SEQ ID NO: 883720 - RNA, 22 nt, Human
cauaauccuugauucaaauaau

SEQ ID NO: 883721 - RNA, 22 nt, Human
uuuagcagcaaauaaguagugc

SEQ ID NO: 883722 - RNA, 22 nt, Human
gagcgcgccacaaggagcggcg

SEQ ID NO: 883723 - RNA, 22 nt, Human
cauuaacacuuuggauuuagac

SEQ ID NO: 883724 - RNA, 22 nt, Human
gagcacagcgcaguuuguaauu

SEQ ID NO: 883725 - RNA, 22 nt, Human
uauuagcagacaagcugcugga

SEQ ID NO: 883726 - RNA, 22 nt, Human
ggaguuggaggcuccagggaac

SEQ ID NO: 883727 - RNA, 22 nt, Human
cuggcccuaggcaaacacagau

SEQ ID NO: 883728 - RNA, 22 nt, Human
gcagaggccaggccaccagcaa

SEQ ID NO: 883729 - RNA, 22 nt, Human
cauaggaaugaggacaauuagc

SEQ ID NO: 883730 - RNA, 19 nt, Human
ugagugucacgucagugcc

SEQ ID NO: 883731 - RNA, 23 nt, Human
uaauugcuugaguuaguaauaca

SEQ ID NO: 883732 - RNA, 22 nt, Human
agagccuugaagaucuggaaaa

SEQ ID NO: 883733 - RNA, 22 nt, Human
ccuuuuaugaacuugagcaggu

SEQ ID NO: 883734 - RNA, 22 nt, Human
aaugguuuaacauaugcuugag

SEQ ID NO: 883735 - RNA, 22 nt, Human
aagccaaauaauguagguacau

SEQ ID NO: 883736 - RNA, 22 nt, Human
gggaagggacuuguuuaagguc

SEQ ID NO: 883737 - RNA, 22 nt, Human
ugaacuacaaaaaucaacauuu

SEQ ID NO: 883738 - RNA, 22 nt, Human
cauuauuaauucagcacaugcu

SEQ ID NO: 883739 - RNA, 22 nt, Human
auagcaagcguucccaagccac

SEQ ID NO: 883740 - RNA, 22 nt, Human
ggcaggaggugaguggcgggug

SEQ ID NO: 883741 - RNA, 22 nt, Human
gaaucaaaucaaguucuuuuga

SEQ ID NO: 883742 - RNA, 22 nt, Human
ugacaguauacuugugauggga

SEQ ID NO: 883743 - RNA, 22 nt, Human
acugucacugacagaaucaaca

SEQ ID NO: 883744 - RNA, 22 nt, Human
ugagcaguggggccugcauucu

SEQ ID NO: 883745 - RNA, 23 nt, Human
uuguccagcugguuugggccaca

SEQ ID NO: 883746 - RNA, 23 nt, Human
caguucccacugucugucacaag

SEQ ID NO: 883747 - RNA, 22 nt, Human
aucucaggugaaacuucuaggu

SEQ ID NO: 883748 - RNA, 22 nt, Human
ucucugucccuaggagccuugc

SEQ ID NO: 883749 - RNA, 22 nt, Human
uuccaucuuucagcuuuguugg

SEQ ID NO: 883750 - RNA, 22 nt, Human
uagauucuuaguuucauagaau

SEQ ID NO: 883751 - RNA, 22 nt, Human
ucuucuuccucauuuauacaua

SEQ ID NO: 883752 - RNA, 22 nt, Human
agagugcuaaaaucuuaucuuu

SEQ ID NO: 883753 - RNA, 22 nt, Human
gagaagccgagucagcugagcc

SEQ ID NO: 883754 - RNA, 22 nt, Human
ugcauuugaagucagacaggcu

SEQ ID NO: 883755 - RNA, 22 nt, Human
ggcucagcuuggugcgcagaaa

SEQ ID NO: 883756 - RNA, 22 nt, Human
guucagugccaguucuaagacu

SEQ ID NO: 883757 - RNA, 22 nt, Human
agagaaauauuuaggaaaggag

SEQ ID NO: 883758 - RNA, 22 nt, Human
ucuuuuguugauggaauuaaug

SEQ ID NO: 883759 - RNA, 22 nt, Human
ucaacagccagaaauauuagcc

SEQ ID NO: 883760 - RNA, 22 nt, Human
cuggagcagcagguggccaggg

SEQ ID NO: 883761 - RNA, 22 nt, Human
uucaaagcugcagacuccuggg

SEQ ID NO: 883762 - RNA, 22 nt, Human
aggcuggcccuacuggcugccu

SEQ ID NO: 883763 - RNA, 22 nt, Human
caagggaaggcuaagggcaaca

SEQ ID NO: 883764 - RNA, 22 nt, Human
ggggccccucggacacgugcgg

SEQ ID NO: 883765 - RNA, 22 nt, Human
cugacccuagcaucucugugca

SEQ ID NO: 883766 - RNA, 22 nt, Human
agacaguggcucagccccaguc

SEQ ID NO: 883767 - RNA, 23 nt, Human
acagggcuagcugacagugguau

SEQ ID NO: 883768 - RNA, 22 nt, Human
gugcaggggaucagguugcagc

SEQ ID NO: 883769 - RNA, 22 nt, Human
aaugcuuccaaaauaccaagcc

SEQ ID NO: 883770 - RNA, 22 nt, Human
ugcuauuaaugaggcugcauuu

SEQ ID NO: 883771 - RNA, 23 nt, Human
aaacugcuuccaauuccugccau

SEQ ID NO: 883772 - RNA, 17 nt, Human
gcccugccugcugcccu

SEQ ID NO: 883773 - RNA, 22 nt, Human
caauaucagguccgcguaaguc

SEQ ID NO: 883774 - RNA, 22 nt, Human
uccaggagguugagugaguucc

SEQ ID NO: 883775 - RNA, 22 nt, Human
aaucccuucccuucucugggac

SEQ ID NO: 883776 - RNA, 22 nt, Human
gugagucuuuggagacaguuca

SEQ ID NO: 883777 - RNA, 22 nt, Human
uggccggccaccuccaggguug

SEQ ID NO: 883778 - RNA, 22 nt, Human
cuccaggacagauucagggcca

SEQ ID NO: 883779 - RNA, 22 nt, Human
aacugaaaccaaacacuuuagg

SEQ ID NO: 883780 - RNA, 22 nt, Human
ccauuauuauaggaggcucauu

SEQ ID NO: 883781 - RNA, 22 nt, Human
ugcagcugugaaagggaaccaa

SEQ ID NO: 883782 - RNA, 22 nt, Human
aaacucuauaggcagaagcaau

SEQ ID NO: 883783 - RNA, 20 nt, Human
aagaggugauaacaggugag

SEQ ID NO: 883784 - RNA, 22 nt, Human
aacagcagggaugacauggcca

SEQ ID NO: 883785 - RNA, 23 nt, Human
ucuguacaauugagaagagaaca

SEQ ID NO: 883786 - RNA, 22 nt, Human
uucaaagauaauguagcauuuu

SEQ ID NO: 883787 - RNA, 23 nt, Human
uaagaacagacaagcauuuacau

SEQ ID NO: 883788 - RNA, 22 nt, Human
aguuuucugggaucacuggaau

SEQ ID NO: 883789 - RNA, 22 nt, Human
gcauucauacaucaauaagcuu

SEQ ID NO: 883790 - RNA, 22 nt, Human
ccugagaauguuuaacagagaa

SEQ ID NO: 883791 - RNA, 22 nt, Human
uggccuagagaagccaaaagau

SEQ ID NO: 883792 - RNA, 23 nt, Human
acuaaggcuucuuuaagacagag

SEQ ID NO: 883793 - RNA, 22 nt, Human
cucugccugccacuguucaggc

SEQ ID NO: 883794 - RNA, 18 nt, Human
ccucuggguuuuguuccc

SEQ ID NO: 883795 - RNA, 22 nt, Human
cuccugagaauuuucaguugga

SEQ ID NO: 883796 - RNA, 22 nt, Human
uuugggaaacuuaggggucaga

SEQ ID NO: 883797 - RNA, 22 nt, Human
caguggauuagccagagcugga

SEQ ID NO: 883798 - RNA, 22 nt, Human
aggcagaccaugaaucaugacc

SEQ ID NO: 883799 - RNA, 22 nt, Human
aauucacauguugaaguccuaa

SEQ ID NO: 883800 - RNA, 22 nt, Human
aaauuucuaagucaagaagaac

SEQ ID NO: 883801 - RNA, 22 nt, Human
uacaggaaccagauuguucagc

SEQ ID NO: 883802 - RNA, 22 nt, Human
agauacaucuugaacuucuaga

SEQ ID NO: 883803 - RNA, 22 nt, Human
gagggggcgaacagaagcaagg

SEQ ID NO: 883804 - RNA, 22 nt, Human
ucacaguucaucugauaaacua

SEQ ID NO: 883805 - RNA, 22 nt, Human
auguaaaagauuauuuuccugu

SEQ ID NO: 883806 - RNA, 22 nt, Human
augucaauuuguucucucgaag

SEQ ID NO: 883807 - RNA, 22 nt, Human
guccuuggccuggguagagugg

SEQ ID NO: 883808 - RNA, 22 nt, Human
uucugggaacaaaguggagugg

SEQ ID NO: 883809 - RNA, 22 nt, Human
gcaggcacuccuaggaccauca

SEQ ID NO: 883810 - RNA, 22 nt, Human
agagggguuaagugcuaguccg

SEQ ID NO: 883811 - RNA, 22 nt, Human
aggugggcauagcuagaauauu

SEQ ID NO: 883812 - RNA, 21 nt, Human
augagguaauucacuaagcag

SEQ ID NO: 883813 - RNA, 22 nt, Human
aguguacaaaaugauagauaaa

SEQ ID NO: 883814 - RNA, 22 nt, Human
cuuugaaaacacacgaauagac

SEQ ID NO: 883815 - RNA, 22 nt, Human
aacacugaaguagugaauacug

SEQ ID NO: 883816 - RNA, 22 nt, Human
ucugucugacaggguaugaacu

SEQ ID NO: 883817 - RNA, 22 nt, Human
ugcuggcuuggaaggaaagcgc

SEQ ID NO: 883818 - RNA, 22 nt, Human
ggacaaaauccaaacuucuuag

SEQ ID NO: 883819 - RNA, 22 nt, Human
auggcagugacuugaaggguag

SEQ ID NO: 883820 - RNA, 22 nt, Human
ggccucaggguugggcccauua

SEQ ID NO: 883821 - RNA, 22 nt, Human
cucuucaaaugauuuccuuagg

SEQ ID NO: 883822 - RNA, 22 nt, Human
ugagaauauuugaagauguuag

SEQ ID NO: 883823 - RNA, 22 nt, Human
gaagagagagcccugggguccg

SEQ ID NO: 883824 - RNA, 22 nt, Human
agaaauucuaagcaucaauagc

SEQ ID NO: 883825 - RNA, 22 nt, Human
uagacauuuggaguuuuaugac

SEQ ID NO: 883826 - RNA, 22 nt, Human
ggcucuagagacucuagagaaa

SEQ ID NO: 883827 - RNA, 22 nt, Human
cagagagcuuagugugcugcau

SEQ ID NO: 883828 - RNA, 22 nt, Human
caaagcaagggcugaagacucc

SEQ ID NO: 883829 - RNA, 22 nt, Human
cucagcaguaaacguccggaac

SEQ ID NO: 883830 - RNA, 22 nt, Human
gccugcagugagugcagaaggu

SEQ ID NO: 883831 - RNA, 22 nt, Human
ugucugcccauucaugggcaca

SEQ ID NO: 883832 - RNA, 22 nt, Human
agucugaaccagauggcaaggu

SEQ ID NO: 883833 - RNA, 22 nt, Human
uguuucaacuguuaagauaugc

SEQ ID NO: 883834 - RNA, 22 nt, Human
ugagccuggguggucgaggcug

SEQ ID NO: 883835 - RNA, 22 nt, Human
augugacuuugugucuuccauc

SEQ ID NO: 883836 - RNA, 22 nt, Human
gcccagcuuuuugaggcaggca

SEQ ID NO: 883837 - RNA, 22 nt, Human
cgacagcagaagaagcaagcca

SEQ ID NO: 883838 - RNA, 22 nt, Human
aagcuaauagccaguuuucuuc

SEQ ID NO: 883839 - RNA, 22 nt, Human
agucccuguacuuuccacugcc

SEQ ID NO: 883840 - RNA, 22 nt, Human
accuuaaaugugacauagucua

SEQ ID NO: 883841 - RNA, 22 nt, Human
acagcaaaugguuuucugucug

SEQ ID NO: 883842 - RNA, 22 nt, Human
ccagugcgagccugugcuggcc

SEQ ID NO: 883843 - RNA, 22 nt, Human
ugccugcugauuggaguugaau

SEQ ID NO: 883844 - RNA, 22 nt, Human
gccaggcuguuuuuauuacugu

SEQ ID NO: 883845 - RNA, 22 nt, Human
agcagggcucuguggagggugg

SEQ ID NO: 883846 - RNA, 22 nt, Human
aggcaguggagaagguuuguga

SEQ ID NO: 883847 - RNA, 22 nt, Human
ugcaauuucaaauaucagaaag

SEQ ID NO: 883848 - RNA, 22 nt, Human
gaaugauauauuagcagauuuu

SEQ ID NO: 883849 - RNA, 22 nt, Human
ucauuuuuugcauaccuguguc

SEQ ID NO: 883850 - RNA, 22 nt, Human
ugcagcaagcaaguaugguucu

SEQ ID NO: 883851 - RNA, 22 nt, Human
aagaggcuggcauugaugguag

SEQ ID NO: 883852 - RNA, 22 nt, Human
aaauuuguucaaugucuauuug

SEQ ID NO: 883853 - RNA, 22 nt, Human
aggcaggugggagugauuccuu

SEQ ID NO: 883854 - RNA, 22 nt, Human
auaauuuacaacugcuuuuaau

SEQ ID NO: 883855 - RNA, 22 nt, Human
uggcagagguaauucaaauccc

SEQ ID NO: 883856 - RNA, 22 nt, Human
ggcucuggaauguguagucagg

SEQ ID NO: 883857 - RNA, 22 nt, Human
acagaacugggggcacagauag

SEQ ID NO: 883858 - RNA, 22 nt, Human
ugugcugcugugaauaagaccu

SEQ ID NO: 883859 - RNA, 23 nt, Human
ucacauuuaaccccucagaccuc

SEQ ID NO: 883860 - RNA, 22 nt, Human
gaggaagggacuuuauuaucug

SEQ ID NO: 883861 - RNA, 22 nt, Human
aaguauucauaaggacauaugu

SEQ ID NO: 883862 - RNA, 22 nt, Human
uugucugauguucccucaugau

SEQ ID NO: 883863 - RNA, 22 nt, Human
auccugggcaaaguaugcuguc

SEQ ID NO: 883864 - RNA, 23 nt, Human
gugugccaagcacugugccagga

SEQ ID NO: 883865 - RNA, 22 nt, Human
cacaggcucuucucacuugauu

SEQ ID NO: 883866 - RNA, 22 nt, Human
uuguacagggaaguaauacaag

SEQ ID NO: 883867 - RNA, 19 nt, Human
gcugggugaggucguugga

SEQ ID NO: 883868 - RNA, 20 nt, Human
ggcugcagugcaccucaucu

SEQ ID NO: 883869 - RNA, 18 nt, Human
ggaacagcucagggcagc

SEQ ID NO: 883870 - RNA, 21 nt, Human
auuuagaaggaaauuuugcaa

SEQ ID NO: 883871 - RNA, 22 nt, Human
agagguaugugaagugauacca

SEQ ID NO: 883872 - RNA, 22 nt, Human
ucucagggaguugaggcugccu

SEQ ID NO: 883873 - RNA, 22 nt, Human
gggcucuggaaaugggagcucc

SEQ ID NO: 883874 - RNA, 22 nt, Human
auucaguuccuugaggguauag

SEQ ID NO: 883875 - RNA, 22 nt, Human
auuucagugucuucuucucccu

SEQ ID NO: 883876 - RNA, 22 nt, Human
acagacugggguggggaauagg

SEQ ID NO: 883877 - RNA, 22 nt, Human
acaguucugcaagauauuuuuu

SEQ ID NO: 883878 - RNA, 22 nt, Human
uucuaguuuagggcucuucaac

SEQ ID NO: 883879 - RNA, 22 nt, Human
cccaaagggugucagcagcaag

SEQ ID NO: 883880 - RNA, 22 nt, Human
gcugggaggcagcaccuuuagc

SEQ ID NO: 883881 - RNA, 22 nt, Human
ccagaccugcaaggcugagagg

SEQ ID NO: 883882 - RNA, 22 nt, Human
acugucuuuauuagaaucuuau

SEQ ID NO: 883883 - RNA, 22 nt, Human
agaugagaauuuuuagagugcu

SEQ ID NO: 883884 - RNA, 22 nt, Human
auuucuguauccugcugucaga

SEQ ID NO: 883885 - RNA, 22 nt, Human
ggccucaguuucuccauggguu

SEQ ID NO: 883886 - RNA, 22 nt, Human
ugaagacaagugugcugguguu

SEQ ID NO: 883887 - RNA, 22 nt, Human
ugaagcaaauuguuuagccuga

SEQ ID NO: 883888 - RNA, 22 nt, Human
cugggcugucaauggcccucug

SEQ ID NO: 883889 - RNA, 22 nt, Human
ccccagccagcaggaccucuga

SEQ ID NO: 883890 - RNA, 22 nt, Human
aacauugcagcuuaauugcagg

SEQ ID NO: 883891 - RNA, 21 nt, Human
uagcaaauugcuauuaaggca

SEQ ID NO: 883892 - RNA, 22 nt, Human
acaguuugcacuguucaucaaa

SEQ ID NO: 883893 - RNA, 22 nt, Human
aacuaaaguaaccaaggauauc

SEQ ID NO: 883894 - RNA, 23 nt, Human
ggcaugcaauggacagagcugga

SEQ ID NO: 883895 - RNA, 22 nt, Human
gacaguaacugagagauguaau

SEQ ID NO: 883896 - RNA, 22 nt, Human
gcugaccugcucucagcagaga

SEQ ID NO: 883897 - RNA, 22 nt, Human
gccacagcucacguuccccauu

SEQ ID NO: 883898 - RNA, 22 nt, Human
uaccaugaucaggcucauccuu

SEQ ID NO: 883899 - RNA, 22 nt, Human
agaggccauggggcauuuuuca

SEQ ID NO: 883900 - RNA, 22 nt, Human
ucagggcauccauugccuguug

SEQ ID NO: 883901 - RNA, 22 nt, Human
ucuagggugaugauucaggaug

SEQ ID NO: 883902 - RNA, 21 nt, Human
agaguuacugucauccuaggu

SEQ ID NO: 883903 - RNA, 22 nt, Human
ucaauacucacaaagagauuuu

SEQ ID NO: 883904 - RNA, 22 nt, Human
guguggcuagaagugucuuguu

SEQ ID NO: 883905 - RNA, 22 nt, Human
agcucugggauucucaggccac

SEQ ID NO: 883906 - RNA, 22 nt, Human
uauguuuaaauguauguguaug

SEQ ID NO: 883907 - RNA, 22 nt, Human
gccacagguggaauuaagaaau

SEQ ID NO: 883908 - RNA, 18 nt, Human
aagccaggucaagauaag

SEQ ID NO: 883909 - RNA, 20 nt, Human
augcaaacucacaaaauacc

SEQ ID NO: 883910 - RNA, 22 nt, Human
guauuuccucgcuugugggauu

SEQ ID NO: 883911 - RNA, 22 nt, Human
ucuccuggaagaauaccacacu

SEQ ID NO: 883912 - RNA, 22 nt, Human
uuucuaaucuuuaguuacaaaa

SEQ ID NO: 883913 - RNA, 22 nt, Human
aauggcaugggaaaugcagugg

SEQ ID NO: 883914 - RNA, 23 nt, Human
ugugaauugaggacaucaaaagc

SEQ ID NO: 883915 - RNA, 22 nt, Human
aaguuuauuaauugacuugugc

SEQ ID NO: 883916 - RNA, 22 nt, Human
caggcaugagccaggccccucc

SEQ ID NO: 883917 - RNA, 22 nt, Human
gugccgugggccuuagugaucu

SEQ ID NO: 883918 - RNA, 22 nt, Human
auuuucacccugaauauauuga

SEQ ID NO: 883919 - RNA, 22 nt, Human
caaguacaaaaugauauuuagu

SEQ ID NO: 883920 - RNA, 22 nt, Human
ccagggaaaggagguugacuug

SEQ ID NO: 883921 - RNA, 22 nt, Human
uuccuggggugaagauauuuuu

SEQ ID NO: 883922 - RNA, 22 nt, Human
ugaguccaauaggggccuggaa

SEQ ID NO: 883923 - RNA, 22 nt, Human
acagaauaguagcuuaaaguca

SEQ ID NO: 883924 - RNA, 22 nt, Human
ugucuugucugugagggcauug

SEQ ID NO: 883925 - RNA, 22 nt, Human
augcugugguagacagcauucc

SEQ ID NO: 883926 - RNA, 22 nt, Human
uuuugaagaagaugggaauuua

SEQ ID NO: 883927 - RNA, 22 nt, Human
cugggccucaaucucagaguuu

SEQ ID NO: 883928 - RNA, 19 nt, Human
cuuucaugugguucuucuu

SEQ ID NO: 883929 - RNA, 22 nt, Human
aauuggaaaaagacuuaauugc

SEQ ID NO: 883930 - RNA, 22 nt, Human
ucuuagaaaaaugguauguuuu

SEQ ID NO: 883931 - RNA, 22 nt, Human
ucugcaagggguucuuuaggcc

SEQ ID NO: 883932 - RNA, 22 nt, Human
gaauacaucugaaggcuaugaa

SEQ ID NO: 883933 - RNA, 22 nt, Human
agagcuucacuggagagcacau

SEQ ID NO: 883934 - RNA, 17 nt, Human
aaggagcugagagaugg

SEQ ID NO: 883935 - RNA, 22 nt, Human
ugccugucuuaauaucuggaaa

SEQ ID NO: 883936 - RNA, 20 nt, Human
cuaggcagcgagugacugag

SEQ ID NO: 883937 - RNA, 22 nt, Human
gaggaggguuggccuuagguag

SEQ ID NO: 883938 - RNA, 22 nt, Human
agaguucacacucagugcaccc

SEQ ID NO: 883939 - RNA, 22 nt, Human
acugagacugccccuguaacaa

SEQ ID NO: 883940 - RNA, 20 nt, Human
agcuccuggacuagagagug

SEQ ID NO: 883941 - RNA, 22 nt, Human
ccugagagcccuagccaggcgc

SEQ ID NO: 883942 - RNA, 22 nt, Human
ucagcaggcacggacaggcugc

SEQ ID NO: 883943 - RNA, 22 nt, Human
uacacagacucuucaauucaga

SEQ ID NO: 883944 - RNA, 22 nt, Human
ucucuguggcaagcaugcugcu

SEQ ID NO: 883945 - RNA, 22 nt, Human
cugacccuggucaaguugccuc

SEQ ID NO: 883946 - RNA, 22 nt, Human
ucaaacaggacuacauucucau

SEQ ID NO: 883947 - RNA, 22 nt, Human
uacuuuaaaaacugauaauuca

SEQ ID NO: 883948 - RNA, 22 nt, Human
uauaaagagucucaaagaaguu

SEQ ID NO: 883949 - RNA, 22 nt, Human
gcuacagagcucugugaagaga

SEQ ID NO: 883950 - RNA, 22 nt, Human
agcauggggcaaugcaugugcu

SEQ ID NO: 883951 - RNA, 21 nt, Human
aagcaggacauaugaugcccu

SEQ ID NO: 883952 - RNA, 22 nt, Human
gcauuuguuugggcuaaucuua

SEQ ID NO: 883953 - RNA, 22 nt, Human
uucuaguuuugccacaggauac

SEQ ID NO: 883954 - RNA, 22 nt, Human
aaaguuguucaguaagaaacuc

SEQ ID NO: 883955 - RNA, 22 nt, Human
cuucuccuguaagaagaucaaa

SEQ ID NO: 883956 - RNA, 21 nt, Human
ucugggggugagccuagaaau

SEQ ID NO: 883957 - RNA, 22 nt, Human
ugugaggauuaaaugcauagug

SEQ ID NO: 883958 - RNA, 21 nt, Human
ucugggcagcccaguccugag

SEQ ID NO: 883959 - RNA, 22 nt, Human
uguauauauuucuuucauucua

SEQ ID NO: 883960 - RNA, 22 nt, Human
uuaaagcuugauucgaagcuua

SEQ ID NO: 883961 - RNA, 22 nt, Human
uugcuguaggcugauugcugaa

SEQ ID NO: 883962 - RNA, 22 nt, Human
uagaacauaagucauucauuug

SEQ ID NO: 883963 - RNA, 22 nt, Human
acagagcugggugcccccugga

SEQ ID NO: 883964 - RNA, 22 nt, Human
agcccaggucuggcccagccug

SEQ ID NO: 883965 - RNA, 22 nt, Human
gcuccagggaguacauuuauca

SEQ ID NO: 883966 - RNA, 22 nt, Human
acuggguggcugccuccuucuc

SEQ ID NO: 883967 - RNA, 22 nt, Human
ggaugcugauauagagcauucu

SEQ ID NO: 883968 - RNA, 22 nt, Human
uuuaauuauaucugggcaguua

SEQ ID NO: 883969 - RNA, 22 nt, Human
aauaacagugccaugaaauuga

SEQ ID NO: 883970 - RNA, 22 nt, Human
uaaaggcuuuuacaggagugca

SEQ ID NO: 883971 - RNA, 22 nt, Human
ccuggcucugcagccacuccag

SEQ ID NO: 883972 - RNA, 22 nt, Human
uguauguggcuacuuuucuugc

SEQ ID NO: 883973 - RNA, 22 nt, Human
gauuuuuauauaaagugagaaa

SEQ ID NO: 883974 - RNA, 22 nt, Human
acacccagagcgccagugccga

SEQ ID NO: 883975 - RNA, 22 nt, Human
cccacaggcaggggcagagaca

SEQ ID NO: 883976 - RNA, 19 nt, Human
uuguucguuccugacaggc

SEQ ID NO: 883977 - RNA, 22 nt, Human
guggggaggccuaagcaaguug

SEQ ID NO: 883978 - RNA, 22 nt, Human
uucauuuaaucagaaucucuaa

SEQ ID NO: 883979 - RNA, 22 nt, Human
acugauuaugcguacucucuac

SEQ ID NO: 883980 - RNA, 22 nt, Human
acauuucucagggaguuuugcu

SEQ ID NO: 883981 - RNA, 22 nt, Human
acuucaaauucugggggaagag

SEQ ID NO: 883982 - RNA, 22 nt, Human
gggaggcugccauccuucagga

SEQ ID NO: 883983 - RNA, 22 nt, Human
ugacacuuggaagcuuggcaac

SEQ ID NO: 883984 - RNA, 22 nt, Human
uggcuggggccugaauccugca

SEQ ID NO: 883985 - RNA, 22 nt, Human
uucauuccuucuguaccuugcc

SEQ ID NO: 883986 - RNA, 22 nt, Human
gguccagggaacuuugaaggau

SEQ ID NO: 883987 - RNA, 22 nt, Human
uuuccugagucagagacaccag

SEQ ID NO: 883988 - RNA, 22 nt, Human
cggggcagagggucuucuccag

SEQ ID NO: 883989 - RNA, 20 nt, Human
aggaggaaaaaaugacgagc

SEQ ID NO: 883990 - RNA, 21 nt, Human
acuuugggcacuuuccugccc

SEQ ID NO: 883991 - RNA, 22 nt, Human
auucaauaagucacuguggaau

SEQ ID NO: 883992 - RNA, 22 nt, Human
cuucaaguccagcucaugcucu

SEQ ID NO: 883993 - RNA, 17 nt, Human
ugccugccagcauugga

SEQ ID NO: 883994 - RNA, 22 nt, Human
ugaccaaagaguugcuuguauu

SEQ ID NO: 883995 - RNA, 20 nt, Human
agucacaggccuggaacaug

SEQ ID NO: 883996 - RNA, 22 nt, Human
ucaaaggcccauugucccguug

SEQ ID NO: 883997 - RNA, 21 nt, Human
uguguuugagacuauguuucc

SEQ ID NO: 883998 - RNA, 22 nt, Human
aaaugcagcugggcaugagagg

SEQ ID NO: 883999 - RNA, 20 nt, Human
aggcugaguucuaugcacuu

SEQ ID NO: 884000 - RNA, 22 nt, Human
acacagagcuucucaacuggga

SEQ ID NO: 884001 - RNA, 20 nt, Human
ugucugcugagcugcugccc

SEQ ID NO: 884002 - RNA, 22 nt, Human
aagagccucuguguuucagccu

SEQ ID NO: 884003 - RNA, 22 nt, Human
uucaagaugcacaguggcauuc

SEQ ID NO: 884004 - RNA, 22 nt, Human
uaagaagguaguuuccaaguca

SEQ ID NO: 884005 - RNA, 22 nt, Human
agcaguucauaaacauuuugag

SEQ ID NO: 884006 - RNA, 21 nt, Human
cccaggucguggucuucccag

SEQ ID NO: 884007 - RNA, 22 nt, Human
ucagcacuguguccagucuccc

SEQ ID NO: 884008 - RNA, 22 nt, Human
uggcaagaacugcaauugcuuu

SEQ ID NO: 884009 - RNA, 22 nt, Human
uagcaaaaacugcaguuacuuu

SEQ ID NO: 884010 - RNA, 22 nt, Human
auuauuauauagggaaaguccc

SEQ ID NO: 884011 - RNA, 22 nt, Human
cugugaaaugcuuugcgauggu

SEQ ID NO: 884012 - RNA, 22 nt, Human
aaugguuugauggacaaaauga

SEQ ID NO: 884013 - RNA, 23 nt, Human
augaaaugcuggcucagggaggu

SEQ ID NO: 884014 - RNA, 22 nt, Human
gagguccaggguggggccugag

SEQ ID NO: 884015 - RNA, 22 nt, Human
ucuucauuccguagauauuuau

SEQ ID NO: 884016 - RNA, 22 nt, Human
uaugugcuaucaaaugcucauu

SEQ ID NO: 884017 - RNA, 22 nt, Human
cugagguacaagaaaggcaccu

SEQ ID NO: 884018 - RNA, 22 nt, Human
uuuauuguuguuagucauaagu

SEQ ID NO: 884019 - RNA, 22 nt, Human
ugcauguguuugccacagugag

SEQ ID NO: 884020 - RNA, 22 nt, Human
aguaccauuauccaguaaagga

SEQ ID NO: 884021 - RNA, 22 nt, Human
ucaaacauccccaccagggacu

SEQ ID NO: 884022 - RNA, 22 nt, Human
aggaauguggcaaucuucaagu

SEQ ID NO: 884023 - RNA, 22 nt, Human
agacugggccauuuccccagcu

SEQ ID NO: 884024 - RNA, 20 nt, Human
gccuagggguugggaaagca

SEQ ID NO: 884025 - RNA, 22 nt, Human
ggugcuguggcagcuccuccuc

SEQ ID NO: 884026 - RNA, 22 nt, Human
auaguguguaaagugcagugau

SEQ ID NO: 884027 - RNA, 22 nt, Human
uguuauacagacacgaugguau

SEQ ID NO: 884028 - RNA, 22 nt, Human
cggagcugcgccgggacacggg

SEQ ID NO: 884029 - RNA, 22 nt, Human
auacccaguccaaucucuuagc

SEQ ID NO: 884030 - RNA, 22 nt, Human
ggcagcugaagaggaacuuugg

SEQ ID NO: 884031 - RNA, 22 nt, Human
cacaugacacuauuuuguucua

SEQ ID NO: 884032 - RNA, 22 nt, Human
uacaguuuuggugaugaugaug

SEQ ID NO: 884033 - RNA, 22 nt, Human
caaacuguaugacccuaggccg

SEQ ID NO: 884034 - RNA, 22 nt, Human
cucugagguccuucccagcucu

SEQ ID NO: 884035 - RNA, 22 nt, Human
uguucguagcacguaguuucuu

SEQ ID NO: 884036 - RNA, 22 nt, Human
ggagauaauccagggagggacu

SEQ ID NO: 884037 - RNA, 20 nt, Human
cuuugccuauucucugccug

SEQ ID NO: 884038 - RNA, 22 nt, Human
gggccagcaguaucggaggcau

SEQ ID NO: 884039 - RNA, 22 nt, Human
guguuauuagagcauuaauuuu

SEQ ID NO: 884040 - RNA, 22 nt, Human
aguuggugggugugagcuggac

SEQ ID NO: 884041 - RNA, 22 nt, Human
gcuggugccuuguuguuguuac

SEQ ID NO: 884042 - RNA, 22 nt, Human
cacaggaaguggucagugccag

SEQ ID NO: 884043 - RNA, 19 nt, Human
gauaaguuuccagguaacu

SEQ ID NO: 884044 - RNA, 22 nt, Human
gggagacccccaaugccagguc

SEQ ID NO: 884045 - RNA, 22 nt, Human
uggugggacaucugaggagagg

SEQ ID NO: 884046 - RNA, 22 nt, Human
aggguggcuggaggaaucagaa

SEQ ID NO: 884047 - RNA, 22 nt, Human
gcuuuagaaaugaguaaauuag

SEQ ID NO: 884048 - RNA, 22 nt, Human
cugggagacaagagagggcuga

SEQ ID NO: 884049 - RNA, 22 nt, Human
uggggagagauugaggaguuuu

SEQ ID NO: 884050 - RNA, 22 nt, Human
ucuuaaaaguaugccaauugga

SEQ ID NO: 884051 - RNA, 22 nt, Human
aggcuuguuuuacuaaaagcaa

SEQ ID NO: 884052 - RNA, 22 nt, Human
ccuggcucucugcagauccugg

SEQ ID NO: 884053 - RNA, 22 nt, Human
ucccuggguucccguggaagug

SEQ ID NO: 884054 - RNA, 22 nt, Human
ccaagggaaggauguauaugau

SEQ ID NO: 884055 - RNA, 22 nt, Human
uguguucugaaggagaagagug

SEQ ID NO: 884056 - RNA, 22 nt, Human
cauguauagcaaauauuuguuc

SEQ ID NO: 884057 - RNA, 22 nt, Human
uacauuguguuaaaacagaaga

SEQ ID NO: 884058 - RNA, 22 nt, Human
gaugcaaagauaaaacagacgc

SEQ ID NO: 884059 - RNA, 22 nt, Human
gcugggcagcugaggccucuca

SEQ ID NO: 884060 - RNA, 22 nt, Human
cauugucauucuaugcuauuca

SEQ ID NO: 884061 - RNA, 22 nt, Human
cugggagauucaggugaaguuu

SEQ ID NO: 884062 - RNA, 22 nt, Human
aauaaguugccuguugaaucau

SEQ ID NO: 884063 - RNA, 22 nt, Human
uggaaaggacaguugcugauag

SEQ ID NO: 884064 - RNA, 22 nt, Human
ggaacccagagcucauaaaauu

SEQ ID NO: 884065 - RNA, 22 nt, Human
aucaaaguaggcauauguuuuu

SEQ ID NO: 884066 - RNA, 22 nt, Human
ugcaaggcugccucugaggacc

SEQ ID NO: 884067 - RNA, 22 nt, Human
caguaagaauaugaaucaggau

SEQ ID NO: 884068 - RNA, 22 nt, Human
aggacggggacgcaagucagca

SEQ ID NO: 884069 - RNA, 22 nt, Human
uacugucugcuucuuauagcuu

SEQ ID NO: 884070 - RNA, 22 nt, Human
auagcaaugaucaagacagaca

SEQ ID NO: 884071 - RNA, 20 nt, Human
gaccugugucugggaugcgg

SEQ ID NO: 884072 - RNA, 16 nt, Human
augcugcuauuagagg

SEQ ID NO: 884073 - RNA, 22 nt, Human
cacauucaauuacacagauagg

SEQ ID NO: 884074 - RNA, 22 nt, Human
agugaaauagcauuuaugaagc

SEQ ID NO: 884075 - RNA, 22 nt, Human
uucaaguucauguguagucagu

SEQ ID NO: 884076 - RNA, 22 nt, Human
cugucccucaucaccucugggu

SEQ ID NO: 884077 - RNA, 22 nt, Human
uugaaaggccuguuuauccagc

SEQ ID NO: 884078 - RNA, 22 nt, Human
uaagaacaagauguuccuguuu

SEQ ID NO: 884079 - RNA, 22 nt, Human
uucaaacuuaaggagcagcaga

SEQ ID NO: 884080 - RNA, 22 nt, Human
ugcuuauuaaacaugcauauuc

SEQ ID NO: 884081 - RNA, 19 nt, Human
agaaaaacugguacugcug

SEQ ID NO: 884082 - RNA, 22 nt, Human
uucaggaggugagcaagaaggg

SEQ ID NO: 884083 - RNA, 22 nt, Human
ucuuucaagggcccuaguuugg

SEQ ID NO: 884084 - RNA, 22 nt, Human
uuuuugcaccaaccuaauagaa

SEQ ID NO: 884085 - RNA, 22 nt, Human
aguuggugagcgugugguaauc

SEQ ID NO: 884086 - RNA, 22 nt, Human
cugcuagcccaggaugcaggga

SEQ ID NO: 884087 - RNA, 22 nt, Human
ggagcucaguggggggacugug

SEQ ID NO: 884088 - RNA, 22 nt, Human
ugcacaggccuugaagggagag

SEQ ID NO: 884089 - RNA, 22 nt, Human
acagagcuucccagccugagca

SEQ ID NO: 884090 - RNA, 22 nt, Human
gcuggccugaccugaggcuggg

SEQ ID NO: 884091 - RNA, 22 nt, Human
ucccaggcgccugguggggagc

SEQ ID NO: 884092 - RNA, 22 nt, Human
ugccaggcugcccuccagucug

SEQ ID NO: 884093 - RNA, 22 nt, Human
gcuuccaccuacuaaaugccac

SEQ ID NO: 884094 - RNA, 22 nt, Human
uuagaguuaggauuugucuuua

SEQ ID NO: 884095 - RNA, 22 nt, Human
gccauaaauugcuggucaaaau

SEQ ID NO: 884096 - RNA, 22 nt, Human
uaaagccacgcuggaaaucagg

SEQ ID NO: 884097 - RNA, 22 nt, Human
uccugagauguggagcuccaug

SEQ ID NO: 884098 - RNA, 22 nt, Human
uguaaaugaaacagcuaaaucc

SEQ ID NO: 884099 - RNA, 22 nt, Human
agggagaguuugauguuuccuc

SEQ ID NO: 884100 - RNA, 22 nt, Human
acagaacaagaccugcuuauug

SEQ ID NO: 884101 - RNA, 19 nt, Human
agggccaggauucuggaac

SEQ ID NO: 884102 - RNA, 22 nt, Human
aaugacuaguccacauuuguaa

SEQ ID NO: 884103 - RNA, 22 nt, Human
agugggcaggcagggugcgcag

SEQ ID NO: 884104 - RNA, 22 nt, Human
aaagcugaugucuacuagagaa

SEQ ID NO: 884105 - RNA, 22 nt, Human
gccaugaggcuccgagaaguca

SEQ ID NO: 884106 - RNA, 22 nt, Human
uuucaucuucccagagaccuug

SEQ ID NO: 884107 - RNA, 22 nt, Human
uugcauuuuuagaugcuucugu

SEQ ID NO: 884108 - RNA, 22 nt, Human
gcaguaggggcuggagggcugu

SEQ ID NO: 884109 - RNA, 22 nt, Human
ggcacugagaggcucuuccuaa

SEQ ID NO: 884110 - RNA, 23 nt, Human
acuuuagauaaauuaugugcaca

SEQ ID NO: 884111 - RNA, 22 nt, Human
cacaucuucuuaacuccaaagu

SEQ ID NO: 884112 - RNA, 22 nt, Human
agguuaggaaccaguguuugac

SEQ ID NO: 884113 - RNA, 21 nt, Human
aaggcuggagaugcaggucug

SEQ ID NO: 884114 - RNA, 20 nt, Human
ggcuuggcugccuggggagg

SEQ ID NO: 884115 - RNA, 22 nt, Human
uggcccagucagcaggagaggg

SEQ ID NO: 884116 - RNA, 22 nt, Human
auucaaagcccaguaaacauug

SEQ ID NO: 884117 - RNA, 22 nt, Human
gcugcagccaaauucauuguca

SEQ ID NO: 884118 - RNA, 22 nt, Human
gaacaguacuaagagcuuuaca

SEQ ID NO: 884119 - RNA, 22 nt, Human
gcugccucccccauggcuggaa

SEQ ID NO: 884120 - RNA, 22 nt, Human
aacaguguuuugcucuuugccc

SEQ ID NO: 884121 - RNA, 23 nt, Human
acagcuguugaaauuucaguggg

SEQ ID NO: 884122 - RNA, 21 nt, Human
ucugcacagccccgcaggagg

SEQ ID NO: 884123 - RNA, 22 nt, Human
aggcucuggacagugaggaguu

SEQ ID NO: 884124 - RNA, 22 nt, Human
guucugcacaucacacaggugc

SEQ ID NO: 884125 - RNA, 22 nt, Human
cagaggcagaggucaucucugg

SEQ ID NO: 884126 - RNA, 22 nt, Human
uccagccucauuucuccugcuu

SEQ ID NO: 884127 - RNA, 22 nt, Human
caugggccauggugaagccagg

SEQ ID NO: 884128 - RNA, 22 nt, Human
aagcaauucagcaaaccuagaa

SEQ ID NO: 884129 - RNA, 22 nt, Human
uuaauauacaauuuuacgggcu

SEQ ID NO: 884130 - RNA, 22 nt, Human
uaguguaaugacauuuagacga

SEQ ID NO: 884131 - RNA, 22 nt, Human
gcugucugccgcaggcugccac

SEQ ID NO: 884132 - RNA, 22 nt, Human
aacaagaacaccuacaguucua

SEQ ID NO: 884133 - RNA, 22 nt, Human
ccaguggacuucucccuguggu

SEQ ID NO: 884134 - RNA, 22 nt, Human
uccugggagcccuugcuccacc

SEQ ID NO: 884135 - RNA, 22 nt, Human
aggccaagcucccagagaagcu

SEQ ID NO: 884136 - RNA, 22 nt, Human
aagggcagcuuaaauugguagc

SEQ ID NO: 884137 - RNA, 22 nt, Human
auuucucauuuugcuucaaagg

SEQ ID NO: 884138 - RNA, 22 nt, Human
uuuuccucugcagagcaguuag

SEQ ID NO: 884139 - RNA, 22 nt, Human
ugagaaccaagaccaagggccu

SEQ ID NO: 884140 - RNA, 22 nt, Human
acauacacaagcguacaugaac

SEQ ID NO: 884141 - RNA, 22 nt, Human
cugagccacugcuuguucagug

SEQ ID NO: 884142 - RNA, 17 nt, Human
ugcuccuguggcagccu

SEQ ID NO: 884143 - RNA, 22 nt, Human
gguggcaggcuggcauuggcaa

SEQ ID NO: 884144 - RNA, 22 nt, Human
acuucaaaucucuugaaagcaa

SEQ ID NO: 884145 - RNA, 22 nt, Human
aaacaguuucauuuucaugacc

SEQ ID NO: 884146 - RNA, 22 nt, Human
uggccagccagaaagaagccuu

SEQ ID NO: 884147 - RNA, 20 nt, Human
uguacacaguacuuuacaau

SEQ ID NO: 884148 - RNA, 22 nt, Human
ugaaucuuuuuggaaauaaaga

SEQ ID NO: 884149 - RNA, 22 nt, Human
uggcgagcuuuguucuccagga

SEQ ID NO: 884150 - RNA, 22 nt, Human
aggaaaggccucagcagaaacc

SEQ ID NO: 884151 - RNA, 22 nt, Human
ccuccaggccuugcagguuaac

SEQ ID NO: 884152 - RNA, 22 nt, Human
uuugcugauauuuugcugauac

SEQ ID NO: 884153 - RNA, 22 nt, Human
aguuauuuuggaaaaugaguca

SEQ ID NO: 884154 - RNA, 22 nt, Human
gugggcaggccccaaagcaggg

SEQ ID NO: 884155 - RNA, 22 nt, Human
agacaacaucacuaaagcugag

SEQ ID NO: 884156 - RNA, 22 nt, Human
acacagggcagagagcuggcuc

SEQ ID NO: 884157 - RNA, 22 nt, Human
uucucuaaggcuuggcuucccu

SEQ ID NO: 884158 - RNA, 22 nt, Human
uuaauacaacuguugucacugg

SEQ ID NO: 884159 - RNA, 22 nt, Human
ugcaaaauaaugaacgauuuuu

SEQ ID NO: 884160 - RNA, 22 nt, Human
uagcuuuuaguacuuaauggcu

SEQ ID NO: 884161 - RNA, 22 nt, Human
aaguguggggucucagagcuga

SEQ ID NO: 884162 - RNA, 22 nt, Human
ccuuggcccuagccucaggcaa

SEQ ID NO: 884163 - RNA, 22 nt, Human
gcaacacagaucuucuuuguug

SEQ ID NO: 884164 - RNA, 22 nt, Human
uacacaaaggcacucuguuguu

SEQ ID NO: 884165 - RNA, 22 nt, Human
gcugggaagaacaggagagaau

SEQ ID NO: 884166 - RNA, 22 nt, Human
agaguaauuucugcugaaaagg

SEQ ID NO: 884167 - RNA, 22 nt, Human
guucuacaugacacucaacauu

SEQ ID NO: 884168 - RNA, 23 nt, Human
ugguggggucuuggagacagcac

SEQ ID NO: 884169 - RNA, 20 nt, Human
gcagggcaucuuggccccca

SEQ ID NO: 884170 - RNA, 22 nt, Human
augugcuucauucuacaugaca

SEQ ID NO: 884171 - RNA, 22 nt, Human
ccaggacugcagggggcgagga

SEQ ID NO: 884172 - RNA, 22 nt, Human
augaggcuaugaauggggagau

SEQ ID NO: 884173 - RNA, 22 nt, Human
gcugccaucuccugaggacagg

SEQ ID NO: 884174 - RNA, 22 nt, Human
ucuaacucugccaggacacaga

SEQ ID NO: 884175 - RNA, 22 nt, Human
uccagggccaguccuugucugu

SEQ ID NO: 884176 - RNA, 22 nt, Human
cuucacaauucuaacagggcaa

SEQ ID NO: 884177 - RNA, 22 nt, Human
ucucugagcaugccauauugcu

SEQ ID NO: 884178 - RNA, 22 nt, Human
acauuacacugugguccuguuc

SEQ ID NO: 884179 - RNA, 22 nt, Human
aagcagcuggaagaguaagaug

SEQ ID NO: 884180 - RNA, 22 nt, Human
agcagaaacagccagucuggac

SEQ ID NO: 884181 - RNA, 22 nt, Human
guuuccugucugcuuuacuaua

SEQ ID NO: 884182 - RNA, 22 nt, Human
uuccuggguucccucucauucu

SEQ ID NO: 884183 - RNA, 22 nt, Human
gcuggcagguccaagauagagc

SEQ ID NO: 884184 - RNA, 22 nt, Human
ggcccugcugaagccgggucua

SEQ ID NO: 884185 - RNA, 22 nt, Human
uaccugagaagaaacccguguu

SEQ ID NO: 884186 - RNA, 22 nt, Human
ccugcugugaagccaggccugu

SEQ ID NO: 884187 - RNA, 22 nt, Human
ggcucugaagggugacagguuu

SEQ ID NO: 884188 - RNA, 22 nt, Human
agaaaaguuuucugagacugac

SEQ ID NO: 884189 - RNA, 23 nt, Human
ugcucugggaggcccuggagagc

SEQ ID NO: 884190 - RNA, 22 nt, Human
ugcagggaaaacccaggaugcu

SEQ ID NO: 884191 - RNA, 22 nt, Human
uaauuguagcuuuguaaucagc

SEQ ID NO: 884192 - RNA, 22 nt, Human
uucucuucuguucagugcccaa

SEQ ID NO: 884193 - RNA, 22 nt, Human
agugcagccgagaucaggugcu

SEQ ID NO: 884194 - RNA, 22 nt, Human
cagcugccacaggacuuucuga

SEQ ID NO: 884195 - RNA, 20 nt, Human
ugucauuuauuuaucaaaug

SEQ ID NO: 884196 - RNA, 22 nt, Human
agcugcccaauccugcagggcg

SEQ ID NO: 884197 - RNA, 22 nt, Human
aaggcauuaugauuugaguacc

SEQ ID NO: 884198 - RNA, 22 nt, Human
gugagaaaugacaaaugugucg

SEQ ID NO: 884199 - RNA, 22 nt, Human
agagcacagccaccauuuacaa

SEQ ID NO: 884200 - RNA, 22 nt, Human
auaagaaacauuauucuuucca

SEQ ID NO: 884201 - RNA, 23 nt, Human
uucucuuuagauuuacauuacuc

SEQ ID NO: 884202 - RNA, 22 nt, Human
uucuucaauuuuccauauacug

SEQ ID NO: 884203 - RNA, 22 nt, Human
uagaaacagcauauauuagccc

SEQ ID NO: 884204 - RNA, 22 nt, Human
gggccucagagauggucaguga

SEQ ID NO: 884205 - RNA, 22 nt, Human
gaggggcuggcacgauggcugc

SEQ ID NO: 884206 - RNA, 22 nt, Human
uacagauaaauuuuaaguagaa

SEQ ID NO: 884207 - RNA, 22 nt, Human
aguagucacuucacccauccca

SEQ ID NO: 884208 - RNA, 22 nt, Human
agauaugugccaauuguuauaa

SEQ ID NO: 884209 - RNA, 22 nt, Human
aucaucuuaagguaucucaagc

SEQ ID NO: 884210 - RNA, 22 nt, Human
gggcuucuauucaagucuguuu

SEQ ID NO: 884211 - RNA, 22 nt, Human
ccucugggccagccuggacccu

SEQ ID NO: 884212 - RNA, 22 nt, Human
ggaggccaggguggguggaucg

SEQ ID NO: 884213 - RNA, 22 nt, Human
acacagccgugaaucugcuucu

SEQ ID NO: 884214 - RNA, 22 nt, Human
gcccccagaccucagugggcug

SEQ ID NO: 884215 - RNA, 22 nt, Human
ugcacuugaggauuuuccacag

SEQ ID NO: 884216 - RNA, 22 nt, Human
ucugcaggcucuagaugagguu

SEQ ID NO: 884217 - RNA, 23 nt, Human
cacaggcagaaaucaagacggua

SEQ ID NO: 884218 - RNA, 21 nt, Human
ccugaaauucucacuagcuua

SEQ ID NO: 884219 - RNA, 21 nt, Human
ucuuuccugcccaguugcccu

SEQ ID NO: 884220 - RNA, 22 nt, Human
uagaacaggcugucagagcggg

SEQ ID NO: 884221 - RNA, 19 nt, Human
ggagucugagcccagguau

SEQ ID NO: 884222 - RNA, 22 nt, Human
caguggagaggcaugcuuggca

SEQ ID NO: 884223 - RNA, 22 nt, Human
uggucagaaggaagggcuccua

SEQ ID NO: 884224 - RNA, 22 nt, Human
cuuaaaaguugcuucccuaacu

SEQ ID NO: 884225 - RNA, 22 nt, Human
acuguguguuugucuagcacag

SEQ ID NO: 884226 - RNA, 22 nt, Human
gcugcagcccggcgcgccugag

SEQ ID NO: 884227 - RNA, 22 nt, Human
ucugaggccuuggcagcuaagg

SEQ ID NO: 884228 - RNA, 22 nt, Human
ugaggucaagcccagagcagca

SEQ ID NO: 884229 - RNA, 22 nt, Human
cugagcagggaccaaaagcauu

SEQ ID NO: 884230 - RNA, 22 nt, Human
aauugaaagaagugggauugcc

SEQ ID NO: 884231 - RNA, 22 nt, Human
gccugguggacacugggcauca

SEQ ID NO: 884232 - RNA, 22 nt, Human
ugaguuauaaugaauauuugaa

SEQ ID NO: 884233 - RNA, 22 nt, Human
uaauuauugucugaagaguuau

SEQ ID NO: 884234 - RNA, 22 nt, Human
acauauuuccaugcagcauguc

SEQ ID NO: 884235 - RNA, 22 nt, Human
uggugcugcaggugggcacagu

SEQ ID NO: 884236 - RNA, 22 nt, Human
augaacacaauacgugcaugca

SEQ ID NO: 884237 - RNA, 20 nt, Human
aaguuuggagucaggagacc

SEQ ID NO: 884238 - RNA, 22 nt, Human
uuuuguguugccauguuaagca

SEQ ID NO: 884239 - RNA, 22 nt, Human
cuucuuaacuguauauacuaug

SEQ ID NO: 884240 - RNA, 22 nt, Human
ugucuacugagaagcuaugcaa

SEQ ID NO: 884241 - RNA, 22 nt, Human
caggcagcugaggacuuugcua

SEQ ID NO: 884242 - RNA, 22 nt, Human
guggcaugacagugaaugggca

SEQ ID NO: 884243 - RNA, 22 nt, Human
acuuuacagaugguuuccugac

SEQ ID NO: 884244 - RNA, 22 nt, Human
gaggcacauauauacagagccc

SEQ ID NO: 884245 - RNA, 22 nt, Human
auuccacagcucagccucucuu

SEQ ID NO: 884246 - RNA, 22 nt, Human
guuuccauuguccuaucuauag

SEQ ID NO: 884247 - RNA, 22 nt, Human
ggccaggagcaagccaggcucu

SEQ ID NO: 884248 - RNA, 22 nt, Human
gagaaucuacaggaaaccgaag

SEQ ID NO: 884249 - RNA, 22 nt, Human
agcuucagcuugcagcugugau

SEQ ID NO: 884250 - RNA, 22 nt, Human
gugcugagaguuuauuaugaua

SEQ ID NO: 884251 - RNA, 19 nt, Human
augucucuguagcacauac

SEQ ID NO: 884252 - RNA, 22 nt, Human
uacugaaacucuuguaaauauc

SEQ ID NO: 884253 - RNA, 22 nt, Human
cucugcagaauuugagcugcuc

SEQ ID NO: 884254 - RNA, 22 nt, Human
agacagacugguuugaauuggu

SEQ ID NO: 884255 - RNA, 22 nt, Human
ugaaggcaacugagaaaaagca

SEQ ID NO: 884256 - RNA, 22 nt, Human
uaaucacaucaggguaaauggg

SEQ ID NO: 884257 - RNA, 22 nt, Human
gaggaagaagcaaaccagcuaa

SEQ ID NO: 884258 - RNA, 22 nt, Human
ggcagcugggugccuaauaaug

SEQ ID NO: 884259 - RNA, 18 nt, Human
caggagcaggaguugaac

SEQ ID NO: 884260 - RNA, 22 nt, Human
ugagggugugcggcccagacag

SEQ ID NO: 884261 - RNA, 22 nt, Human
agggccuugcugucugaagcug

SEQ ID NO: 884262 - RNA, 22 nt, Human
gaaagaagcuuuagauggcuau

SEQ ID NO: 884263 - RNA, 22 nt, Human
auaaaagaaguuuugguacuug

SEQ ID NO: 884264 - RNA, 22 nt, Human
aggcugugcacagggcaccugc

SEQ ID NO: 884265 - RNA, 22 nt, Human
gcaguggcuaagcucgcaugca

SEQ ID NO: 884266 - RNA, 22 nt, Human
uaggaagaugaguaucaacuug

SEQ ID NO: 884267 - RNA, 22 nt, Human
aaacagaugaguuauaauagcc

SEQ ID NO: 884268 - RNA, 22 nt, Human
gucaucuuccuaguguuaacua

SEQ ID NO: 884269 - RNA, 22 nt, Human
ugcugccucagcuuccugggcu

SEQ ID NO: 884270 - RNA, 15 nt, Human
ccaagaacuaauuag

SEQ ID NO: 884271 - RNA, 22 nt, Human
caggacaauggucauacuggau

SEQ ID NO: 884272 - RNA, 21 nt, Human
ggcaggugggucucuguugcu

SEQ ID NO: 884273 - RNA, 22 nt, Human
uggaagcagcauuaaugaguua

SEQ ID NO: 884274 - RNA, 22 nt, Human
uccauacccagcuuucucacac

SEQ ID NO: 884275 - RNA, 22 nt, Human
gauggggcuggcuuugaggguu

SEQ ID NO: 884276 - RNA, 22 nt, Human
guccuggggauuauagaguguu

SEQ ID NO: 884277 - RNA, 22 nt, Human
agucagaggaaugggccaggcu

SEQ ID NO: 884278 - RNA, 22 nt, Human
gcucugagucucagcuaccaca

SEQ ID NO: 884279 - RNA, 22 nt, Human
ccuagaauuauaaacuuauuag

SEQ ID NO: 884280 - RNA, 22 nt, Human
gaccaaggccaggccagggcgu

SEQ ID NO: 884281 - RNA, 22 nt, Human
auuagcagugccuugccugucu

SEQ ID NO: 884282 - RNA, 22 nt, Human
cucuucuuggcccccaugaggg

SEQ ID NO: 884283 - RNA, 22 nt, Human
cuccugggagcuguggcagagc

SEQ ID NO: 884284 - RNA, 22 nt, Human
aaaauuuucagcuugacuugau

SEQ ID NO: 884285 - RNA, 19 nt, Human
gccaugggcuggcagcaga

SEQ ID NO: 884286 - RNA, 22 nt, Human
agcagcuggaacuaauaguggu

SEQ ID NO: 884287 - RNA, 22 nt, Human
uuuuggcagauuacuuaauaug

SEQ ID NO: 884288 - RNA, 22 nt, Human
uccaggcuggaaaugucaaacu

SEQ ID NO: 884289 - RNA, 22 nt, Human
cagccugcaggaggccgucagc

SEQ ID NO: 884290 - RNA, 22 nt, Human
gugcaugaagacucagaaaguc

SEQ ID NO: 884291 - RNA, 22 nt, Human
acauaugaguacuauacagugc

SEQ ID NO: 884292 - RNA, 22 nt, Human
uucacaauggcaaaccauuaaa

SEQ ID NO: 884293 - RNA, 22 nt, Human
uuacuuuagaaauagucaucaa

SEQ ID NO: 884294 - RNA, 22 nt, Human
uggccugggccggcagauauac

SEQ ID NO: 884295 - RNA, 22 nt, Human
aguauuugaagauguugaguac

SEQ ID NO: 884296 - RNA, 22 nt, Human
cagucccaucucccagguggcu

SEQ ID NO: 884297 - RNA, 22 nt, Human
cuggcucuguggcuuccuucau

SEQ ID NO: 884298 - RNA, 22 nt, Human
gcauuagaaacuauugcugcaa

SEQ ID NO: 884299 - RNA, 22 nt, Human
augucuguauguggagaggggu

SEQ ID NO: 884300 - RNA, 22 nt, Human
ugaggccaagccuccucugcca

SEQ ID NO: 884301 - RNA, 20 nt, Human
aaugcugcuucuuuuugcau

SEQ ID NO: 884302 - RNA, 22 nt, Human
ugccauauuauugagcauauua

SEQ ID NO: 884303 - RNA, 21 nt, Human
ucucguuguauggucuugggg

SEQ ID NO: 884304 - RNA, 22 nt, Human
aaagugcaguccaugaaauuaa

SEQ ID NO: 884305 - RNA, 22 nt, Human
uuugugcacuucuguagcugcc

SEQ ID NO: 884306 - RNA, 22 nt, Human
gagagggcaaacuuguagcuaa

SEQ ID NO: 884307 - RNA, 21 nt, Human
cagcacaguacugggucuugc

SEQ ID NO: 884308 - RNA, 23 nt, Human
gcaucuuaaaaccuacauaugug

SEQ ID NO: 884309 - RNA, 22 nt, Human
ccuggagcaaaaaucuaaggag

SEQ ID NO: 884310 - RNA, 22 nt, Human
gcuuccagcaaacacuggcugc

SEQ ID NO: 884311 - RNA, 22 nt, Human
cuggcaggcaaauuggugggag

SEQ ID NO: 884312 - RNA, 22 nt, Human
gcuucaugggugugcaaccugu

SEQ ID NO: 884313 - RNA, 22 nt, Human
aagguuuuuuuccaguaucucu

SEQ ID NO: 884314 - RNA, 22 nt, Human
cucauuuacuacucaugugacc

SEQ ID NO: 884315 - RNA, 22 nt, Human
cccucucuuagaagaaacacag

SEQ ID NO: 884316 - RNA, 22 nt, Human
cagugcaggaagugagaugccu

SEQ ID NO: 884317 - RNA, 21 nt, Human
agguuucugugagcagagcag

SEQ ID NO: 884318 - RNA, 22 nt, Human
uguuaaauguuccuuuacugga

SEQ ID NO: 884319 - RNA, 22 nt, Human
acauucacgcucucaaagcuga

SEQ ID NO: 884320 - RNA, 22 nt, Human
ggaaguguuuccuugggcagca

SEQ ID NO: 884321 - RNA, 22 nt, Human
uaaguucaagucuuggauauaa

SEQ ID NO: 884322 - RNA, 21 nt, Human
cucuggaguuugaaggcuggg

SEQ ID NO: 884323 - RNA, 22 nt, Human
auuugcauaaggaugcuacugu

SEQ ID NO: 884324 - RNA, 22 nt, Human
agugggagagaagcaaguagua

SEQ ID NO: 884325 - RNA, 22 nt, Human
uuauuucuacuauuuugccuga

SEQ ID NO: 884326 - RNA, 22 nt, Human
agcagcaggagccgugggguga

SEQ ID NO: 884327 - RNA, 22 nt, Human
cugucucagcaggaagucauca

SEQ ID NO: 884328 - RNA, 22 nt, Human
gaaagcagcuaagucuuaugau

SEQ ID NO: 884329 - RNA, 20 nt, Human
agcugccccugggcacugcc

SEQ ID NO: 884330 - RNA, 22 nt, Human
cccuguggaggaggagagcagu

SEQ ID NO: 884331 - RNA, 22 nt, Human
cacucccuucaggagccuagga

SEQ ID NO: 884332 - RNA, 22 nt, Human
cacaaaaucuuucucgauuauu

SEQ ID NO: 884333 - RNA, 22 nt, Human
aggcccuguccauggugcugaa

SEQ ID NO: 884334 - RNA, 22 nt, Human
gaacacugagaaagucagcuuu

SEQ ID NO: 884335 - RNA, 22 nt, Human
ugguagugacucccccagggcu

SEQ ID NO: 884336 - RNA, 18 nt, Human
acauugauggcuuuaagc

SEQ ID NO: 884337 - RNA, 22 nt, Human
gucauauugaagaagacuggca

SEQ ID NO: 884338 - RNA, 22 nt, Human
agagaugucgccuugcccaggg

SEQ ID NO: 884339 - RNA, 22 nt, Human
acucaggaauggggcugggacu

SEQ ID NO: 884340 - RNA, 22 nt, Human
cuucuuuugaagggcguugugu

SEQ ID NO: 884341 - RNA, 22 nt, Human
gggcccugccccguggcucuga

SEQ ID NO: 884342 - RNA, 18 nt, Human
uaaaggaagugggagagg

SEQ ID NO: 884343 - RNA, 22 nt, Human
cacagaacaccaaagaaccuuc

SEQ ID NO: 884344 - RNA, 22 nt, Human
uggaaugugcuagggcuguggc

SEQ ID NO: 884345 - RNA, 22 nt, Human
gaugcuccuuggugauagaaua

SEQ ID NO: 884346 - RNA, 22 nt, Human
aaacacauuagcccuguggaaa

SEQ ID NO: 884347 - RNA, 22 nt, Human
caggugggagccacagcguaca

SEQ ID NO: 884348 - RNA, 22 nt, Human
cuguccuccagacgacaguccc

SEQ ID NO: 884349 - RNA, 22 nt, Human
gaaguuuaccucugccuugcuu

SEQ ID NO: 884350 - RNA, 22 nt, Human
auuuuagauuuaagaauaaggu

SEQ ID NO: 884351 - RNA, 22 nt, Human
ccaaaggccaggcacugagguu

SEQ ID NO: 884352 - RNA, 22 nt, Human
gcagcugcucacauucucacaa

SEQ ID NO: 884353 - RNA, 22 nt, Human
agcaauguugggguuagaggac

SEQ ID NO: 884354 - RNA, 17 nt, Human
aaacagugaguguuaug

SEQ ID NO: 884355 - RNA, 22 nt, Human
ucaaagcaauuucaccagugcc

SEQ ID NO: 884356 - RNA, 22 nt, Human
ugcagcaacaagauagaauggc

SEQ ID NO: 884357 - RNA, 22 nt, Human
aaaugcuuguauauuucuuggu

SEQ ID NO: 884358 - RNA, 22 nt, Human
agaaucuaaguacacagacaga

SEQ ID NO: 884359 - RNA, 22 nt, Human
ugaagcaagauagaaagcugcu

SEQ ID NO: 884360 - RNA, 22 nt, Human
ggcugugagcaggcagaaugcu

SEQ ID NO: 884361 - RNA, 22 nt, Human
cuggagggcugcagcgaggcug

SEQ ID NO: 884362 - RNA, 20 nt, Human
cuccagggaacagacuggag

SEQ ID NO: 884363 - RNA, 22 nt, Human
augcagggcagaguacguuagc

SEQ ID NO: 884364 - RNA, 20 nt, Human
ggcagcaaccauaugcuaca

SEQ ID NO: 884365 - RNA, 22 nt, Human
gauguauagggccaugacacca

SEQ ID NO: 884366 - RNA, 22 nt, Human
aagagcugcaucuaagccauga

SEQ ID NO: 884367 - RNA, 22 nt, Human
uccacagcuuuuaaaugucuag

SEQ ID NO: 884368 - RNA, 22 nt, Human
ucagcauuccugaagacaagca

SEQ ID NO: 884369 - RNA, 22 nt, Human
gcuucuguuaacuuauguuccc

SEQ ID NO: 884370 - RNA, 22 nt, Human
ggaagccaggccaaugagaaca

SEQ ID NO: 884371 - RNA, 22 nt, Human
aucaugacaucugaguuuaagu

SEQ ID NO: 884372 - RNA, 22 nt, Human
ugacccuucaaauauccucaaa

SEQ ID NO: 884373 - RNA, 22 nt, Human
caucugaagugaauugcuuuuu

SEQ ID NO: 884374 - RNA, 22 nt, Human
uucaguguucuuuucuguuagc

SEQ ID NO: 884375 - RNA, 22 nt, Human
cagcaugacagucugcagcaga

SEQ ID NO: 884376 - RNA, 22 nt, Human
acugcagacucuacaguuauaa

SEQ ID NO: 884377 - RNA, 19 nt, Human
uggaaaauggauugaauca

SEQ ID NO: 884378 - RNA, 22 nt, Human
uacuuccuguuuccaugucugu

SEQ ID NO: 884379 - RNA, 22 nt, Human
acaacaaaaucacuagucuucc

SEQ ID NO: 884380 - RNA, 22 nt, Human
uggucucucuccugcaacaacu

SEQ ID NO: 884381 - RNA, 22 nt, Human
aguggaauugcugauugaaaua

SEQ ID NO: 884382 - RNA, 22 nt, Human
ugcauuaaggccauugaaauuu

SEQ ID NO: 884383 - RNA, 22 nt, Human
uauguguuguauaugugcagag

SEQ ID NO: 884384 - RNA, 19 nt, Human
uggcagccuccacuuuugc

SEQ ID NO: 884385 - RNA, 22 nt, Human
ccaacagguugagagucugaau

SEQ ID NO: 884386 - RNA, 22 nt, Human
caguaacaugaagagacaugga

SEQ ID NO: 884387 - RNA, 22 nt, Human
gccuguccuugugaggucccag

SEQ ID NO: 884388 - RNA, 22 nt, Human
cugaggccucucuccugggcuu

SEQ ID NO: 884389 - RNA, 22 nt, Human
ucugcagcuucuugccagagag

SEQ ID NO: 884390 - RNA, 22 nt, Human
uagcauuccuuguggcuucuga

SEQ ID NO: 884391 - RNA, 22 nt, Human
gcugcuagggcauuaugauaaa

SEQ ID NO: 884392 - RNA, 22 nt, Human
ugaguauauacccagaagugga

SEQ ID NO: 884393 - RNA, 22 nt, Human
uuguccuuggaugaagcuggga

SEQ ID NO: 884394 - RNA, 22 nt, Human
aauaaccuuacuuauuacaugg

SEQ ID NO: 884395 - RNA, 22 nt, Human
guauacaacuauuguuggguaa

SEQ ID NO: 884396 - RNA, 22 nt, Human
cacccagacauguggucccaga

SEQ ID NO: 884397 - RNA, 22 nt, Human
caaaguaaacuaccacuguuuc

SEQ ID NO: 884398 - RNA, 22 nt, Human
uguuuuaugagccauauaaccu

SEQ ID NO: 884399 - RNA, 22 nt, Human
aagagcuggagcugcuacagga

SEQ ID NO: 884400 - RNA, 22 nt, Human
uuguuuuuaugaacauccagga

SEQ ID NO: 884401 - RNA, 22 nt, Human
cugggcugcuugcugaaggggu

SEQ ID NO: 884402 - RNA, 22 nt, Human
agagcaggggcaauguguugca

SEQ ID NO: 884403 - RNA, 15 nt, Human
uacauucauuuccac

SEQ ID NO: 884404 - RNA, 22 nt, Human
agucuagaaacaagguagagcu

SEQ ID NO: 884405 - RNA, 22 nt, Human
ugcuccaucucucgugguucca

SEQ ID NO: 884406 - RNA, 22 nt, Human
guccuuggggucauccauuauc

SEQ ID NO: 884407 - RNA, 22 nt, Human
aguuuacaucuucaaucucauu

SEQ ID NO: 884408 - RNA, 22 nt, Human
ucaaggugacugaacuauaaac

SEQ ID NO: 884409 - RNA, 22 nt, Human
caucacaucuacuauaagugau

SEQ ID NO: 884410 - RNA, 22 nt, Human
uugauaaaaugaugaaaucacu

SEQ ID NO: 884411 - RNA, 22 nt, Human
ucacagaaggagggaagcuagu

SEQ ID NO: 884412 - RNA, 22 nt, Human
agcugaagauccaggguugggg

SEQ ID NO: 884413 - RNA, 22 nt, Human
gaguucaguguuucuaguagug

SEQ ID NO: 884414 - RNA, 22 nt, Human
ccguguacauaaagcccuggua

SEQ ID NO: 884415 - RNA, 22 nt, Human
gcugaaaucccagcauucccca

SEQ ID NO: 884416 - RNA, 22 nt, Human
acacugugauuucuggguucca

SEQ ID NO: 884417 - RNA, 22 nt, Human
uuuggagauagggccuagcaau

SEQ ID NO: 884418 - RNA, 22 nt, Human
uuucauguuauuaauagugcug

SEQ ID NO: 884419 - RNA, 22 nt, Human
aaugccaacuuggauauacauu

SEQ ID NO: 884420 - RNA, 22 nt, Human
uauuagcaacagagcucuuguu

SEQ ID NO: 884421 - RNA, 22 nt, Human
ugagaggauauuuugggaggau

SEQ ID NO: 884422 - RNA, 22 nt, Human
aucucauaaucgucauugcuuu

SEQ ID NO: 884423 - RNA, 22 nt, Human
ugcugcccguaccugugcacuu

SEQ ID NO: 884424 - RNA, 22 nt, Human
ugaguggguuaucaggaaaggu

SEQ ID NO: 884425 - RNA, 19 nt, Human
caagacaaagcccaucuuc

SEQ ID NO: 884426 - RNA, 22 nt, Human
ucuggagaccugcauuuauauu

SEQ ID NO: 884427 - RNA, 22 nt, Human
ucuauguauggaccuuuucugu

SEQ ID NO: 884428 - RNA, 21 nt, Human
uaggcaauuuguugucauagc

SEQ ID NO: 884429 - RNA, 22 nt, Human
uagaacuuagcacuagacuugu

SEQ ID NO: 884430 - RNA, 21 nt, Human
aucaguaagguuggaggaaga

SEQ ID NO: 884431 - RNA, 22 nt, Human
ugagagugaaaugucacauguc

SEQ ID NO: 884432 - RNA, 22 nt, Human
uucucuuagcacuuuguguuac

SEQ ID NO: 884433 - RNA, 22 nt, Human
ugcuagaagauagcuagaagau

SEQ ID NO: 884434 - RNA, 18 nt, Human
acuaugcugaauaaaugg

SEQ ID NO: 884435 - RNA, 22 nt, Human
uuggccuucugguguucauuuu

SEQ ID NO: 884436 - RNA, 22 nt, Human
ucugucaccgagggcauccaaa

SEQ ID NO: 884437 - RNA, 22 nt, Human
cagcccuggccccagguggucu

SEQ ID NO: 884438 - RNA, 22 nt, Human
uugcugcucccaagaggcagcu

SEQ ID NO: 884439 - RNA, 22 nt, Human
gccagcuggaaaucugcuugaa

SEQ ID NO: 884440 - RNA, 22 nt, Human
uggggagguucgggaaucuugu

SEQ ID NO: 884441 - RNA, 20 nt, Human
gauuucaaagcagaguggcc

SEQ ID NO: 884442 - RNA, 22 nt, Human
agugcaugccuuccuguggaug

SEQ ID NO: 884443 - RNA, 22 nt, Human
uuucagggucagccuguaugug

SEQ ID NO: 884444 - RNA, 22 nt, Human
aggggagccccugguccuggug

SEQ ID NO: 884445 - RNA, 22 nt, Human
ccagggcaacgcugucucagag

SEQ ID NO: 884446 - RNA, 22 nt, Human
agacagcucuggguuccacacu

SEQ ID NO: 884447 - RNA, 22 nt, Human
cuacauucaacagcagaguuuu

SEQ ID NO: 884448 - RNA, 22 nt, Human
cacaguaagguaucccagugaa

SEQ ID NO: 884449 - RNA, 22 nt, Human
cccuuuuuuaugucaagcauug

SEQ ID NO: 884450 - RNA, 21 nt, Human
gcugcugugggccagggaggc

SEQ ID NO: 884451 - RNA, 18 nt, Human
accugccuguucuucucu

SEQ ID NO: 884452 - RNA, 22 nt, Human
uuucuaaguaucuugcaguuuu

SEQ ID NO: 884453 - RNA, 22 nt, Human
agaggucagagcaggaaaggca

SEQ ID NO: 884454 - RNA, 22 nt, Human
ggugggugagcccugggagcug

SEQ ID NO: 884455 - RNA, 22 nt, Human
cagcuuuaccuuuaggaguaac

SEQ ID NO: 884456 - RNA, 21 nt, Human
auacagaacauugauccaaga

SEQ ID NO: 884457 - RNA, 22 nt, Human
acaaaauuaccuaguuauuuuc

SEQ ID NO: 884458 - RNA, 22 nt, Human
agaguuuaaacacugucacaga

SEQ ID NO: 884459 - RNA, 15 nt, Human
ggcagguggaucacu

SEQ ID NO: 884460 - RNA, 22 nt, Human
uaaggcaauggcauucuugaca

SEQ ID NO: 884461 - RNA, 22 nt, Human
uauucugcaugaaaauaaacag

SEQ ID NO: 884462 - RNA, 22 nt, Human
gggagcaguuaaaaugauuccu

SEQ ID NO: 884463 - RNA, 22 nt, Human
ccaaauagucuuucauugaauu

SEQ ID NO: 884464 - RNA, 20 nt, Human
aaagucuguuuaucucugga

SEQ ID NO: 884465 - RNA, 22 nt, Human
ugcguaguacgaauuugugccu

SEQ ID NO: 884466 - RNA, 22 nt, Human
ggacaugugcaacuucuuugga

SEQ ID NO: 884467 - RNA, 22 nt, Human
gaauacaagccugccaccugga

SEQ ID NO: 884468 - RNA, 22 nt, Human
uuauaaagugagaagugcuaug

SEQ ID NO: 884469 - RNA, 22 nt, Human
uaagugagcccucagaguaugg

SEQ ID NO: 884470 - RNA, 22 nt, Human
ugagacaguuuuucuauuucca

SEQ ID NO: 884471 - RNA, 22 nt, Human
ugcuggaggcaguggaggugcc

SEQ ID NO: 884472 - RNA, 22 nt, Human
aaacugaggaacaaggaaggau

SEQ ID NO: 884473 - RNA, 17 nt, Human
ccagagaguaguuagga

SEQ ID NO: 884474 - RNA, 22 nt, Human
uguuuucuauuaccugagauug

SEQ ID NO: 884475 - RNA, 22 nt, Human
caggaagaaggguggugagucc

SEQ ID NO: 884476 - RNA, 22 nt, Human
gcugccugauguccagcaggac

SEQ ID NO: 884477 - RNA, 22 nt, Human
ucugagagcaggaggagcugcu

SEQ ID NO: 884478 - RNA, 22 nt, Human
agcccagcuuucaccccucugg

SEQ ID NO: 884479 - RNA, 22 nt, Human
uagcaaaggaugacuauguacc

SEQ ID NO: 884480 - RNA, 22 nt, Human
cccaggaggguggccucugccc

SEQ ID NO: 884481 - RNA, 22 nt, Human
ccagcccuugaggucuguccau

SEQ ID NO: 884482 - RNA, 20 nt, Human
uacugggcaagcccacagac

SEQ ID NO: 884483 - RNA, 22 nt, Human
uggacuaaagaggaaagaugua

SEQ ID NO: 884484 - RNA, 20 nt, Human
aucaucuuuacaaugucagu

SEQ ID NO: 884485 - RNA, 22 nt, Human
acauucucuuccuaaauauacu

SEQ ID NO: 884486 - RNA, 22 nt, Human
uggggaggacgggcgccuuccu

SEQ ID NO: 884487 - RNA, 21 nt, Human
uuucuuaucuguaaaguggga

SEQ ID NO: 884488 - RNA, 22 nt, Human
cagugccaguggaugaacuguu

SEQ ID NO: 884489 - RNA, 22 nt, Human
uguccuuuucuuuagugcagcu

SEQ ID NO: 884490 - RNA, 22 nt, Human
agggaagcccuggcugagaccc

SEQ ID NO: 884491 - RNA, 22 nt, Human
aaugugauuuucccaguagaau

SEQ ID NO: 884492 - RNA, 22 nt, Human
uccaguugccugucucugauua

SEQ ID NO: 884493 - RNA, 19 nt, Human
agcuuugccaaaaacuuag

SEQ ID NO: 884494 - RNA, 22 nt, Human
aguagauucucauugaucuggu

SEQ ID NO: 884495 - RNA, 22 nt, Human
cuucuuccugcugcagccucca

SEQ ID NO: 884496 - RNA, 22 nt, Human
ggcagcaggguagccauuucuc

SEQ ID NO: 884497 - RNA, 17 nt, Human
ugcuagggggagaguag

SEQ ID NO: 884498 - RNA, 22 nt, Human
caucuacaggagaaugucacug

SEQ ID NO: 884499 - RNA, 22 nt, Human
cugugcuuguguucauuguuaa

SEQ ID NO: 884500 - RNA, 22 nt, Human
auaauuaauuucaguaaucucc

SEQ ID NO: 884501 - RNA, 22 nt, Human
agggagccagaguugggagcuc

SEQ ID NO: 884502 - RNA, 22 nt, Human
gggccggagcugggucccgcgc

SEQ ID NO: 884503 - RNA, 22 nt, Human
uggaggaaaaaaccaggcagag

SEQ ID NO: 884504 - RNA, 22 nt, Human
auaguucucacucagaauuuga

SEQ ID NO: 884505 - RNA, 22 nt, Human
aggagcuggguuccuuuggugg

SEQ ID NO: 884506 - RNA, 22 nt, Human
aucuuugggcaaugaugaggga

SEQ ID NO: 884507 - RNA, 22 nt, Human
gugaugucacagaauaagugau

SEQ ID NO: 884508 - RNA, 22 nt, Human
ucagaggugguaaaggacagca

SEQ ID NO: 884509 - RNA, 22 nt, Human
cucugcaggccuugaguguggu

SEQ ID NO: 884510 - RNA, 22 nt, Human
agguauuuuaaguccaccagag

SEQ ID NO: 884511 - RNA, 22 nt, Human
ugguagcaacaucucaguggcu

SEQ ID NO: 884512 - RNA, 22 nt, Human
gaggcaguggucugaugcaagg

SEQ ID NO: 884513 - RNA, 22 nt, Human
cugcagggcuuaccuugcucug

SEQ ID NO: 884514 - RNA, 22 nt, Human
gaguuauagauggacuauuauu

SEQ ID NO: 884515 - RNA, 22 nt, Human
uuccauauguauauagcuguua

SEQ ID NO: 884516 - RNA, 22 nt, Human
cugucaggggcggguggagcgg

SEQ ID NO: 884517 - RNA, 16 nt, Human
gcagguggaucaccug

SEQ ID NO: 884518 - RNA, 22 nt, Human
cuggggagaagcgacucggcug

SEQ ID NO: 884519 - RNA, 22 nt, Human
agaaacagcauuagcaucaauu

SEQ ID NO: 884520 - RNA, 22 nt, Human
ucuugacauuguuguuagcagg

SEQ ID NO: 884521 - RNA, 22 nt, Human
aaaugcuagggagaaacucucc

SEQ ID NO: 884522 - RNA, 22 nt, Human
uuccuggagaguuuucccaaag

SEQ ID NO: 884523 - RNA, 22 nt, Human
ccaaagcaagucacaugaucaa

SEQ ID NO: 884524 - RNA, 22 nt, Human
cuauuuaugugcuauuuuguau

SEQ ID NO: 884525 - RNA, 22 nt, Human
acccuuuugccuuuaauucaug

SEQ ID NO: 884526 - RNA, 22 nt, Human
uguacaccugucuuuacacaua

SEQ ID NO: 884527 - RNA, 22 nt, Human
ucauagaaauaucacgucuuuu

SEQ ID NO: 884528 - RNA, 22 nt, Human
gguggggcuaggaccucaggau

SEQ ID NO: 884529 - RNA, 22 nt, Human
caguaacagugaucaccugugg

SEQ ID NO: 884530 - RNA, 22 nt, Human
aguggcagagccaaguagagcc

SEQ ID NO: 884531 - RNA, 22 nt, Human
ccugugugucugucacugcaca

SEQ ID NO: 884532 - RNA, 22 nt, Human
uuuuucauauuccccucucugg

SEQ ID NO: 884533 - RNA, 22 nt, Human
ccuugauggugagagcugcaga

SEQ ID NO: 884534 - RNA, 22 nt, Human
agguuucugcagcauaguggca

SEQ ID NO: 884535 - RNA, 22 nt, Human
ccauuuauagauguauuuggcu

SEQ ID NO: 884536 - RNA, 21 nt, Human
aaggacgagguuuugauuaca

SEQ ID NO: 884537 - RNA, 22 nt, Human
acauggaagcaaaguucuauuu

SEQ ID NO: 884538 - RNA, 22 nt, Human
agaggggaaguaaugaaugaua

SEQ ID NO: 884539 - RNA, 22 nt, Human
agcugagcacauucaaacaggu

SEQ ID NO: 884540 - RNA, 22 nt, Human
uaguaaaaguuuaguugaaagu

SEQ ID NO: 884541 - RNA, 22 nt, Human
auccuugggaagagaggaauau

SEQ ID NO: 884542 - RNA, 22 nt, Human
ucuguucuuuagccugcuugag

SEQ ID NO: 884543 - RNA, 22 nt, Human
acauucuucuugugaauuuacu

SEQ ID NO: 884544 - RNA, 22 nt, Human
uuucauugucaucuaucuuaga

SEQ ID NO: 884545 - RNA, 22 nt, Human
cuuggucuacuagagaaaaaga

SEQ ID NO: 884546 - RNA, 22 nt, Human
ucagggccaggacuaggaugag

SEQ ID NO: 884547 - RNA, 22 nt, Human
gagggugugaacacuggcugug

SEQ ID NO: 884548 - RNA, 22 nt, Human
ugcagagagauccucaggguuu

SEQ ID NO: 884549 - RNA, 22 nt, Human
gagcucauccccaugguccguc

SEQ ID NO: 884550 - RNA, 23 nt, Human
ccugugugcccuuaauucacagc

SEQ ID NO: 884551 - RNA, 18 nt, Human
agcuggcccuggcugccg

SEQ ID NO: 884552 - RNA, 22 nt, Human
uuagaaaucaccucugaagauc

SEQ ID NO: 884553 - RNA, 22 nt, Human
ucugccaggagccaugagcaag

SEQ ID NO: 884554 - RNA, 22 nt, Human
gcuggacuucaugcauuccugu

SEQ ID NO: 884555 - RNA, 22 nt, Human
uagaaauccccagucucauagu

SEQ ID NO: 884556 - RNA, 22 nt, Human
aggggagcaaggccguggugua

SEQ ID NO: 884557 - RNA, 22 nt, Human
uggucuguucaagguggcugau

SEQ ID NO: 884558 - RNA, 22 nt, Human
cuggggaggcagggcugccccu

SEQ ID NO: 884559 - RNA, 22 nt, Human
uaacugauauugaaaaacauca

SEQ ID NO: 884560 - RNA, 22 nt, Human
cccagccugaucucggccagcu

SEQ ID NO: 884561 - RNA, 22 nt, Human
aucuuacaauuacaagacacuc

SEQ ID NO: 884562 - RNA, 22 nt, Human
uugaacauuuucuauguuauag

SEQ ID NO: 884563 - RNA, 22 nt, Human
uucuuuuaauagagauccugug

SEQ ID NO: 884564 - RNA, 22 nt, Human
uaauguaccuccagauguugua

SEQ ID NO: 884565 - RNA, 22 nt, Human
gaccacagauuccuaaguggca

SEQ ID NO: 884566 - RNA, 22 nt, Human
auacagaacaagccucaccucc

SEQ ID NO: 884567 - RNA, 22 nt, Human
caagggaauugugugugagagg

SEQ ID NO: 884568 - RNA, 18 nt, Human
caggugggucuccugccc

SEQ ID NO: 884569 - RNA, 22 nt, Human
uugucugaauauguauguaucc

SEQ ID NO: 884570 - RNA, 22 nt, Human
gauucucuucauauggcaaagg

SEQ ID NO: 884571 - RNA, 22 nt, Human
acauucuuucaccuugugucca

SEQ ID NO: 884572 - RNA, 23 nt, Human
uggauaaaauacuuacauucaac

SEQ ID NO: 884573 - RNA, 22 nt, Human
ucaugaguggauuaauauggcu

SEQ ID NO: 884574 - RNA, 22 nt, Human
uggaggcaguaacugagcaaca

SEQ ID NO: 884575 - RNA, 18 nt, Human
uuaucucuggcaugugcc

SEQ ID NO: 884576 - RNA, 22 nt, Human
gcucggccccgacggccggcgg

SEQ ID NO: 884577 - RNA, 22 nt, Human
agggccuggugaccuggguccu

SEQ ID NO: 884578 - RNA, 22 nt, Human
gucuaaggaucuguuagcuuuu

SEQ ID NO: 884579 - RNA, 22 nt, Human
uaacacuggagaguugguugug

SEQ ID NO: 884580 - RNA, 20 nt, Human
cccucccagaugcuucccaa

SEQ ID NO: 884581 - RNA, 22 nt, Human
cagucucugggaaagaggacag

SEQ ID NO: 884582 - RNA, 22 nt, Human
cccuuagaugucuuccuccgga

SEQ ID NO: 884583 - RNA, 22 nt, Human
ggccaccuaggagccacaguga

SEQ ID NO: 884584 - RNA, 22 nt, Human
ugcuguuucauuuuccucaucc

SEQ ID NO: 884585 - RNA, 22 nt, Human
acauagaacuucgaugucuuuu

SEQ ID NO: 884586 - RNA, 22 nt, Human
ggaagagaaugauggcuauggg

SEQ ID NO: 884587 - RNA, 22 nt, Human
uacagaauauagaagcuggaag

SEQ ID NO: 884588 - RNA, 22 nt, Human
cagagcuggagcuugaauggag

SEQ ID NO: 884589 - RNA, 16 nt, Human
ucagggcagaauggca

SEQ ID NO: 884590 - RNA, 23 nt, Human
ucacauaauccuucauccacagg

SEQ ID NO: 884591 - RNA, 22 nt, Human
aauaacuuguaugguuauucca

SEQ ID NO: 884592 - RNA, 22 nt, Human
ggaggagcugcugugggggccc

SEQ ID NO: 884593 - RNA, 22 nt, Human
uccugguggucugugcuucuuc

SEQ ID NO: 884594 - RNA, 22 nt, Human
uccuugcaaauagcuuucugag

SEQ ID NO: 884595 - RNA, 22 nt, Human
cuggcagguuuggugucuggug

SEQ ID NO: 884596 - RNA, 22 nt, Human
caguuuuccaugacucagagag

SEQ ID NO: 884597 - RNA, 22 nt, Human
aauucaaauuacaauaguuguu

SEQ ID NO: 884598 - RNA, 22 nt, Human
cucuguguucagccuagcagaa

SEQ ID NO: 884599 - RNA, 22 nt, Human
aaagaauagccuuuguccaaau

SEQ ID NO: 884600 - RNA, 21 nt, Human
uggcagacuagaguauagaug

SEQ ID NO: 884601 - RNA, 22 nt, Human
aaaaguaauugcgguuuuugcu

SEQ ID NO: 884602 - RNA, 22 nt, Human
ugagaauuugcauuucuaacaa

SEQ ID NO: 884603 - RNA, 22 nt, Human
aggcagucuaguccccaggcaa

SEQ ID NO: 884604 - RNA, 22 nt, Human
aggucauuuccuuagaggcaga

SEQ ID NO: 884605 - RNA, 22 nt, Human
cuggcagcagcugguaccuuau

SEQ ID NO: 884606 - RNA, 22 nt, Human
guugaaaauacagauuccuagg

SEQ ID NO: 884607 - RNA, 22 nt, Human
ccaggguaccccaagggcaggu

SEQ ID NO: 884608 - RNA, 22 nt, Human
uuuugugagcugagaaauguau

SEQ ID NO: 884609 - RNA, 22 nt, Human
agguauauuuuguauauacucu

SEQ ID NO: 884610 - RNA, 22 nt, Human
uauguauucucagauuuacuaa

SEQ ID NO: 884611 - RNA, 22 nt, Human
cucaggccugaguggcaguccc

SEQ ID NO: 884612 - RNA, 22 nt, Human
aauguuccaccaacauuuggga

SEQ ID NO: 884613 - RNA, 22 nt, Human
uuucuagaucaaacuuuuauau

SEQ ID NO: 884614 - RNA, 19 nt, Human
cacaugagggcugagggac

SEQ ID NO: 884615 - RNA, 22 nt, Human
uuucaguuugaaggaaaggcca

SEQ ID NO: 884616 - RNA, 22 nt, Human
uaugcauuauacauuaauuucu

SEQ ID NO: 884617 - RNA, 22 nt, Human
acuugagagaaucggaggaguc

SEQ ID NO: 884618 - RNA, 22 nt, Human
gagguggcacugugaggagcac

SEQ ID NO: 884619 - RNA, 22 nt, Human
agggagcuucuacuucaaggca

SEQ ID NO: 884620 - RNA, 22 nt, Human
uguuucaugauugcugucauuu

SEQ ID NO: 884621 - RNA, 22 nt, Human
gcagagccagaauggccaggac

SEQ ID NO: 884622 - RNA, 22 nt, Human
agacacaguauaagcacaacaa

SEQ ID NO: 884623 - RNA, 22 nt, Human
cugccugugcaugcagucagaa

SEQ ID NO: 884624 - RNA, 22 nt, Human
uuggcugcuggucuuuggauau

SEQ ID NO: 884625 - RNA, 22 nt, Human
gaugucugucugagccgcugga

SEQ ID NO: 884626 - RNA, 22 nt, Human
agcuuugugacuuugagcuagu

SEQ ID NO: 884627 - RNA, 22 nt, Human
ugcaucaaauucugaaauuagc

SEQ ID NO: 884628 - RNA, 22 nt, Human
acaugguugaaugcuuuauuug

SEQ ID NO: 884629 - RNA, 22 nt, Human
agcccugauuaaccuuggcuuu

SEQ ID NO: 884630 - RNA, 22 nt, Human
auguuacacauaggcauaaaug

SEQ ID NO: 884631 - RNA, 22 nt, Human
ucaggagaaucagggcuguccu

SEQ ID NO: 884632 - RNA, 22 nt, Human
auuuguguuguauuaagcugcu

SEQ ID NO: 884633 - RNA, 22 nt, Human
uuaaauuagucaagcuucucug

SEQ ID NO: 884634 - RNA, 23 nt, Human
ucugccagugugugccaggagcc

SEQ ID NO: 884635 - RNA, 20 nt, Human
auguuuuauaaaagaacggg

SEQ ID NO: 884636 - RNA, 22 nt, Human
uaagaauuaucucauggauaau

SEQ ID NO: 884637 - RNA, 22 nt, Human
ggcuggcagugugagagaggga

SEQ ID NO: 884638 - RNA, 22 nt, Human
gccuggcccagggcucuuguug

SEQ ID NO: 884639 - RNA, 22 nt, Human
auguauguuaguguauuaucua

SEQ ID NO: 884640 - RNA, 22 nt, Human
uucauucccuuauauuagcauu

SEQ ID NO: 884641 - RNA, 22 nt, Human
aauggcagaggcaaagauggua

SEQ ID NO: 884642 - RNA, 22 nt, Human
auuggucuggggaaaugaagag

SEQ ID NO: 884643 - RNA, 19 nt, Human
gcagcugugggaagagcca

SEQ ID NO: 884644 - RNA, 22 nt, Human
cagaggucaagaucugaaguga

SEQ ID NO: 884645 - RNA, 22 nt, Human
agcuguugaaaaugguguccua

SEQ ID NO: 884646 - RNA, 22 nt, Human
ugagccuggggccugggcagcg

SEQ ID NO: 884647 - RNA, 22 nt, Human
ccagagucccuugcagcucagu

SEQ ID NO: 884648 - RNA, 22 nt, Human
uuccaaggcuagguuguaaagg

SEQ ID NO: 884649 - RNA, 22 nt, Human
ucagggcacaggccuguggguu

SEQ ID NO: 884650 - RNA, 22 nt, Human
agaggucagauuucuccuggug

SEQ ID NO: 884651 - RNA, 22 nt, Human
ucuucaaagaagccuuggauua

SEQ ID NO: 884652 - RNA, 23 nt, Human
gggcuucauuuuaauucagcugc

SEQ ID NO: 884653 - RNA, 22 nt, Human
cagugcagucaaggaagaacca

SEQ ID NO: 884654 - RNA, 22 nt, Human
acaggacauggcuucugugacg

SEQ ID NO: 884655 - RNA, 22 nt, Human
uggcccagggcacagcagggag

SEQ ID NO: 884656 - RNA, 22 nt, Human
uguauuuucagaguggcauuuc

SEQ ID NO: 884657 - RNA, 22 nt, Human
cugucacugaugggcucaccag

SEQ ID NO: 884658 - RNA, 16 nt, Human
ggggaaggcaagaggg

SEQ ID NO: 884659 - RNA, 22 nt, Human
gcgugugugauaugccucugca

SEQ ID NO: 884660 - RNA, 22 nt, Human
ucaggaaaauacugcuuaucca

SEQ ID NO: 884661 - RNA, 22 nt, Human
aguccuggguccagcagguccu

SEQ ID NO: 884662 - RNA, 19 nt, Human
cuccuggcucugucauuuu

SEQ ID NO: 884663 - RNA, 22 nt, Human
ugucuccaugugauaguggccu

SEQ ID NO: 884664 - RNA, 22 nt, Human
uugauacauuuuuaggauaaac

SEQ ID NO: 884665 - RNA, 22 nt, Human
gaguccagacaccauaccugau

SEQ ID NO: 884666 - RNA, 22 nt, Human
aagagucauagagacauugauu

SEQ ID NO: 884667 - RNA, 22 nt, Human
uauuagcaguuguaugugucug

SEQ ID NO: 884668 - RNA, 22 nt, Human
uucucugugagggugcuggauu

SEQ ID NO: 884669 - RNA, 22 nt, Human
agaguuaaaugaaaugguaugu

SEQ ID NO: 884670 - RNA, 22 nt, Human
ccaggaguuggagguugcagug

SEQ ID NO: 884671 - RNA, 22 nt, Human
ggcagauguugcagugagcaga

SEQ ID NO: 884672 - RNA, 22 nt, Human
ucucaucucaaauuguaauccc

SEQ ID NO: 884673 - RNA, 22 nt, Human
ucagucccuuaaagguggcagc

SEQ ID NO: 884674 - RNA, 22 nt, Human
uggcccagggucuacagccuca

SEQ ID NO: 884675 - RNA, 22 nt, Human
uggugggaguccgcugugcugc

SEQ ID NO: 884676 - RNA, 22 nt, Human
gaguccaguguuuaccaggggu

SEQ ID NO: 884677 - RNA, 22 nt, Human
aguauuuguugauugauaugaa

SEQ ID NO: 884678 - RNA, 22 nt, Human
cuaguaaaguacucaaauagcc

SEQ ID NO: 884679 - RNA, 21 nt, Human
aaguggagaagaaaagcugga

SEQ ID NO: 884680 - RNA, 22 nt, Human
guccuuggagguguggaaucug

SEQ ID NO: 884681 - RNA, 22 nt, Human
gggcagguacuggguggugagc

SEQ ID NO: 884682 - RNA, 22 nt, Human
agcaaggcucuuaaugcccaaa

SEQ ID NO: 884683 - RNA, 22 nt, Human
ggagaugcuauguaguuugguu

SEQ ID NO: 884684 - RNA, 18 nt, Human
ugaaacaagaauggugca

SEQ ID NO: 884685 - RNA, 22 nt, Human
uggcuggaauauguggagacca

SEQ ID NO: 884686 - RNA, 22 nt, Human
uccaggccucuagccccuaucu

SEQ ID NO: 884687 - RNA, 22 nt, Human
agcagugggugguuuuugagca

SEQ ID NO: 884688 - RNA, 19 nt, Human
ugcagcuguaugagcuuaa

SEQ ID NO: 884689 - RNA, 22 nt, Human
gaaccucuuuagugcauccuuc

SEQ ID NO: 884690 - RNA, 22 nt, Human
ggcuggcagaagugugcuggcu

SEQ ID NO: 884691 - RNA, 22 nt, Human
gucuucugcccaggcagacgga

SEQ ID NO: 884692 - RNA, 22 nt, Human
cugguuuugcccagucuugcac

SEQ ID NO: 884693 - RNA, 22 nt, Human
agcuggcuucucugcagacauu

SEQ ID NO: 884694 - RNA, 22 nt, Human
uccauucauucagguauuuagu

SEQ ID NO: 884695 - RNA, 22 nt, Human
uuauuguagcacuuuggcagug

SEQ ID NO: 884696 - RNA, 22 nt, Human
cagaugaacugugacugaaaau

SEQ ID NO: 884697 - RNA, 19 nt, Human
auuaacaucaguguuggcc

SEQ ID NO: 884698 - RNA, 22 nt, Human
auaacauggaguuugucauuua

SEQ ID NO: 884699 - RNA, 22 nt, Human
ucaugagucugcaaauuaugga

SEQ ID NO: 884700 - RNA, 22 nt, Human
auggcagcccacgauggcaaug

SEQ ID NO: 884701 - RNA, 22 nt, Human
uugcaaagugucaugcaaagua

SEQ ID NO: 884702 - RNA, 22 nt, Human
auguacagccacuucacaguua

SEQ ID NO: 884703 - RNA, 22 nt, Human
aagaauguucaacgcuuuuuug

SEQ ID NO: 884704 - RNA, 23 nt, Human
ccaggcucuuucaccugcuauuc

SEQ ID NO: 884705 - RNA, 22 nt, Human
cugggcuggacacacuuaaccu

SEQ ID NO: 884706 - RNA, 22 nt, Human
cugcuggugcagaguggggcug

SEQ ID NO: 884707 - RNA, 22 nt, Human
cuggcagguccagcuggacuca

SEQ ID NO: 884708 - RNA, 22 nt, Human
uuccugguaacaaucucaaagu

SEQ ID NO: 884709 - RNA, 22 nt, Human
ugaagccauaggacagaggaua

SEQ ID NO: 884710 - RNA, 22 nt, Human
ggcuguggccagcggggcugag

SEQ ID NO: 884711 - RNA, 22 nt, Human
ucccucugcuagugcuugagcu

SEQ ID NO: 884712 - RNA, 20 nt, Human
aaaauggccuuguauuaaaa

SEQ ID NO: 884713 - RNA, 22 nt, Human
agccagcuaagggaagcaugau

SEQ ID NO: 884714 - RNA, 22 nt, Human
aagcucugauacuuccuaccug

SEQ ID NO: 884715 - RNA, 22 nt, Human
uacugaaagucuguggguccuc

SEQ ID NO: 884716 - RNA, 23 nt, Human
ucugagggagugggcaguggcac

SEQ ID NO: 884717 - RNA, 22 nt, Human
ccucagaauaguccucagauca

SEQ ID NO: 884718 - RNA, 22 nt, Human
gaaugaagcaggucacacaguu

SEQ ID NO: 884719 - RNA, 22 nt, Human
ggcagcaggcgacuucccuauu

SEQ ID NO: 884720 - RNA, 22 nt, Human
aaacacugaagaccuaucuggu

SEQ ID NO: 884721 - RNA, 22 nt, Human
acauaacaaucauaggacauag

SEQ ID NO: 884722 - RNA, 22 nt, Human
caggccaauaucacaugcuaug

SEQ ID NO: 884723 - RNA, 22 nt, Human
aacaugaugugaagcaugaacu

SEQ ID NO: 884724 - RNA, 22 nt, Human
uuccaacuuugaaaauguuaug

SEQ ID NO: 884725 - RNA, 22 nt, Human
aaacuguaaauacuaguaagug

SEQ ID NO: 884726 - RNA, 22 nt, Human
uggcucaguagcagugugguca

SEQ ID NO: 884727 - RNA, 22 nt, Human
agcucagagauaaucaagagac

SEQ ID NO: 884728 - RNA, 22 nt, Human
gccauuuugaaaaccguugcua

SEQ ID NO: 884729 - RNA, 22 nt, Human
gaaaggagaggguuaaggagcu

SEQ ID NO: 884730 - RNA, 17 nt, Human
aaucagauuucugagga

SEQ ID NO: 884731 - RNA, 22 nt, Human
uuccaagaagucaacagguagu

SEQ ID NO: 884732 - RNA, 22 nt, Human
ugaacagauggcccagcagagg

SEQ ID NO: 884733 - RNA, 22 nt, Human
uuuguugugaacagaauaauau

SEQ ID NO: 884734 - RNA, 22 nt, Human
uacagauuuggggaguaaaguu

SEQ ID NO: 884735 - RNA, 22 nt, Human
augucuuucaaauucugccuag

SEQ ID NO: 884736 - RNA, 22 nt, Human
gugcugaauuugagaaacucug

SEQ ID NO: 884737 - RNA, 22 nt, Human
uuacaguaacauuuucagucug

SEQ ID NO: 884738 - RNA, 22 nt, Human
gaugugucccuuucaacucaga

SEQ ID NO: 884739 - RNA, 22 nt, Human
agggccagaguacaucagggcu

SEQ ID NO: 884740 - RNA, 22 nt, Human
uaacugaaaaucccucuucucc

SEQ ID NO: 884741 - RNA, 22 nt, Human
caggccuuaguaggugcucccu

SEQ ID NO: 884742 - RNA, 22 nt, Human
acugccugugucccuucagugc

SEQ ID NO: 884743 - RNA, 22 nt, Human
guauucauuuauuuacucaucc

SEQ ID NO: 884744 - RNA, 22 nt, Human
cccaggaggcagagguugcagu

SEQ ID NO: 884745 - RNA, 22 nt, Human
gagggggcgugcaaggcuccgc

SEQ ID NO: 884746 - RNA, 22 nt, Human
agcaggcaccagggcucguccu

SEQ ID NO: 884747 - RNA, 22 nt, Human
uguccaggcggccuugccuguu

SEQ ID NO: 884748 - RNA, 22 nt, Human
acucaucaacuguuacaaaugu

SEQ ID NO: 884749 - RNA, 22 nt, Human
cagugcuggaggggugcuugca

SEQ ID NO: 884750 - RNA, 22 nt, Human
uucaaaucacuuuggagcuuaa

SEQ ID NO: 884751 - RNA, 22 nt, Human
gaggagaagcuauuggaaggac

SEQ ID NO: 884752 - RNA, 22 nt, Human
acagagcaacuuuauuucaugg

SEQ ID NO: 884753 - RNA, 22 nt, Human
ccagccaugcacaaaccaugag

SEQ ID NO: 884754 - RNA, 22 nt, Human
accuucuggucugccugacagc

SEQ ID NO: 884755 - RNA, 22 nt, Human
uuguaacacucccacucuucuu

SEQ ID NO: 884756 - RNA, 22 nt, Human
uauuugcuuuugugccacagau

SEQ ID NO: 884757 - RNA, 22 nt, Human
uggccaguagauaggcaggcaa

SEQ ID NO: 884758 - RNA, 22 nt, Human
uucaugaauggaaucaaugcuc

SEQ ID NO: 884759 - RNA, 22 nt, Human
acugagacuuuguugaguucuu

SEQ ID NO: 884760 - RNA, 21 nt, Human
ggcaggauggcaguggacccc

SEQ ID NO: 884761 - RNA, 22 nt, Human
cucacauaccuguuuucccuuu

SEQ ID NO: 884762 - RNA, 22 nt, Human
guagaugagcucacaugaccuu

SEQ ID NO: 884763 - RNA, 22 nt, Human
uccagggcaccagcgucccccu

SEQ ID NO: 884764 - RNA, 22 nt, Human
ugccugcucuuaccacucuccc

SEQ ID NO: 884765 - RNA, 21 nt, Human
uaccaagaaguuugggaaagc

SEQ ID NO: 884766 - RNA, 22 nt, Human
ugcuccugcugcaugcaucucc

SEQ ID NO: 884767 - RNA, 22 nt, Human
cacuugaaaaucagaggaaauu

SEQ ID NO: 884768 - RNA, 22 nt, Human
uucugucucuguguuuacauua

SEQ ID NO: 884769 - RNA, 22 nt, Human
ccagggcaggagaaagacucac

SEQ ID NO: 884770 - RNA, 22 nt, Human
ucugggucuaucccaugccuuu

SEQ ID NO: 884771 - RNA, 22 nt, Human
cagcagccacuagagggcucac

SEQ ID NO: 884772 - RNA, 22 nt, Human
uuucuguacacccacuauucau

SEQ ID NO: 884773 - RNA, 22 nt, Human
ugcugcauuugcaguccuuuaa

SEQ ID NO: 884774 - RNA, 19 nt, Human
aucagcaagguaggaugug

SEQ ID NO: 884775 - RNA, 22 nt, Human
agcagcugguaggaguggccac

SEQ ID NO: 884776 - RNA, 22 nt, Human
agucagacauaauucuaacauu

SEQ ID NO: 884777 - RNA, 22 nt, Human
aaacauuuuucuaggucuuggu

SEQ ID NO: 884778 - RNA, 22 nt, Human
gcccucugcacagcucugagca

SEQ ID NO: 884779 - RNA, 22 nt, Human
cugcagggcuguggucuggagu

SEQ ID NO: 884780 - RNA, 22 nt, Human
gcuagcaaguggcauagcaggg

SEQ ID NO: 884781 - RNA, 22 nt, Human
acauaaaggugacuaacaucuu

SEQ ID NO: 884782 - RNA, 22 nt, Human
ugguguguacauuuuugcuucu

SEQ ID NO: 884783 - RNA, 23 nt, Human
ucuccaggccuuacuccaggccu

SEQ ID NO: 884784 - RNA, 21 nt, Human
guuauuuuaagugagcuuugc

SEQ ID NO: 884785 - RNA, 22 nt, Human
aagggagacccaccguccugga

SEQ ID NO: 884786 - RNA, 22 nt, Human
auuucuuucuggccacgguuuu

SEQ ID NO: 884787 - RNA, 22 nt, Human
gggccuggugcuucugacuccu

SEQ ID NO: 884788 - RNA, 22 nt, Human
ccagcagcucagcuacugguca

SEQ ID NO: 884789 - RNA, 23 nt, Human
ucacugcuacucagccugagauu

SEQ ID NO: 884790 - RNA, 19 nt, Human
agcagagcagggccguggg

SEQ ID NO: 884791 - RNA, 22 nt, Human
gauguucagugguugaccauaa

SEQ ID NO: 884792 - RNA, 22 nt, Human
gagauggaaucuguguggaggg

SEQ ID NO: 884793 - RNA, 22 nt, Human
uaacagaagagcaggcagcccu

SEQ ID NO: 884794 - RNA, 22 nt, Human
auaguuuacaaaaaugaugcau

SEQ ID NO: 884795 - RNA, 22 nt, Human
cuucuucuggacaggcagcucc

SEQ ID NO: 884796 - RNA, 22 nt, Human
ggccucuggugccugaagcgcc

SEQ ID NO: 884797 - RNA, 22 nt, Human
gacccuguggcucuguggcaga

SEQ ID NO: 884798 - RNA, 22 nt, Human
uugaggcccggcaggccgagcg

SEQ ID NO: 884799 - RNA, 22 nt, Human
ucuacuuuucccuauacaguuu

SEQ ID NO: 884800 - RNA, 22 nt, Human
uuucucaaguucagauauuuga

SEQ ID NO: 884801 - RNA, 22 nt, Human
ugugucaaauuguuuuacacag

SEQ ID NO: 884802 - RNA, 22 nt, Human
uagcugugacguaucucuaugg

SEQ ID NO: 884803 - RNA, 22 nt, Human
uguuaacacaauucuggagaga

SEQ ID NO: 884804 - RNA, 22 nt, Human
ggucacaagguacuguaagaaa

SEQ ID NO: 884805 - RNA, 22 nt, Human
cugaaauaguuucauagaacuu

SEQ ID NO: 884806 - RNA, 23 nt, Human
aucucucugguggucacagucag

SEQ ID NO: 884807 - RNA, 22 nt, Human
acugaugucuggggcagagucu

SEQ ID NO: 884808 - RNA, 22 nt, Human
ugcugugcuccauugucuucac

SEQ ID NO: 884809 - RNA, 21 nt, Human
acauggaagagaaauuaacca

SEQ ID NO: 884810 - RNA, 22 nt, Human
ggugugggagagauucuuuccu

SEQ ID NO: 884811 - RNA, 22 nt, Human
agcaaugugaccccugacagca

SEQ ID NO: 884812 - RNA, 22 nt, Human
cagcugccaugacauguccugc

SEQ ID NO: 884813 - RNA, 22 nt, Human
gggcuuggcacaugggcucagc

SEQ ID NO: 884814 - RNA, 22 nt, Human
agguucccagagauagagcugu

SEQ ID NO: 884815 - RNA, 22 nt, Human
cuccuccacagaccuacugaau

SEQ ID NO: 884816 - RNA, 22 nt, Human
caggggcucuaaugcaugauca

SEQ ID NO: 884817 - RNA, 22 nt, Human
cacagcagaaauaugaaggcag

SEQ ID NO: 884818 - RNA, 23 nt, Human
aagguguuuguuuucagaaagca

SEQ ID NO: 884819 - RNA, 22 nt, Human
aacaguguuuuucuucagcacu

SEQ ID NO: 884820 - RNA, 22 nt, Human
uaaucacagaaacagacuguuu

SEQ ID NO: 884821 - RNA, 23 nt, Human
ucagugauguugaaccuagcagu

SEQ ID NO: 884822 - RNA, 22 nt, Human
uaucuguauccccaucuagcua

SEQ ID NO: 884823 - RNA, 22 nt, Human
caucagugagccccuugaugag

SEQ ID NO: 884824 - RNA, 22 nt, Human
ucaggaguuucagguguaagug

SEQ ID NO: 884825 - RNA, 22 nt, Human
gcaaggaccuuugagcgugcca

SEQ ID NO: 884826 - RNA, 22 nt, Human
cuauuuugccugccuagaaauc

SEQ ID NO: 884827 - RNA, 22 nt, Human
ugcugguggagaaaguggaggu

SEQ ID NO: 884828 - RNA, 22 nt, Human
auaaaccagaaguaaaagcuac

SEQ ID NO: 884829 - RNA, 22 nt, Human
caggucugcagacagggccaug

SEQ ID NO: 884830 - RNA, 22 nt, Human
auaacagauacucucugugagg

SEQ ID NO: 884831 - RNA, 22 nt, Human
gcauggaauucccuuaugggcc

SEQ ID NO: 884832 - RNA, 22 nt, Human
uccagcagugcucuagagcgug

SEQ ID NO: 884833 - RNA, 22 nt, Human
agacaggaugcauacucuuggu

SEQ ID NO: 884834 - RNA, 22 nt, Human
agcagggacugagccaguggga

SEQ ID NO: 884835 - RNA, 22 nt, Human
ggcagugaaugaaacagaggcu

SEQ ID NO: 884836 - RNA, 22 nt, Human
ggcuucagauuucucaguuguu

SEQ ID NO: 884837 - RNA, 22 nt, Human
gggaaauugucaacacucucaa

SEQ ID NO: 884838 - RNA, 22 nt, Human
ucugcagcuuuuugguggggug

SEQ ID NO: 884839 - RNA, 22 nt, Human
uggcaagcuggguuggguagcc

SEQ ID NO: 884840 - RNA, 22 nt, Human
gggaaauuguaacaagucuguu

SEQ ID NO: 884841 - RNA, 22 nt, Human
cuaaacaugaacuacauuuagg

SEQ ID NO: 884842 - RNA, 22 nt, Human
aacaguuuauguaaauguccag

SEQ ID NO: 884843 - RNA, 22 nt, Human
ucugaggcaaacagaggagugu

SEQ ID NO: 884844 - RNA, 22 nt, Human
gugugucuuuauaagaagaggg

SEQ ID NO: 884845 - RNA, 22 nt, Human
cuagggacugggaccuuaguua

SEQ ID NO: 884846 - RNA, 20 nt, Human
ugcuggcacggguggacucc

SEQ ID NO: 884847 - RNA, 20 nt, Human
ucucuuuuagcuuacagcug

SEQ ID NO: 884848 - RNA, 21 nt, Human
ccuggcuccagaacuuccggu

SEQ ID NO: 884849 - RNA, 22 nt, Human
gcagcuguguaaugagcccaca

SEQ ID NO: 884850 - RNA, 22 nt, Human
uucauaaguuugucacugaugu

SEQ ID NO: 884851 - RNA, 22 nt, Human
caaucucuggugcuucugagag

SEQ ID NO: 884852 - RNA, 22 nt, Human
acauuucagugagcuauugaag

SEQ ID NO: 884853 - RNA, 17 nt, Human
ugcacaagagacaauag

SEQ ID NO: 884854 - RNA, 21 nt, Human
auuuggucaaggacaacucug

SEQ ID NO: 884855 - RNA, 22 nt, Human
gccuggagaagauggaacuagc

SEQ ID NO: 884856 - RNA, 22 nt, Human
agucccaggcagccgagccggu

SEQ ID NO: 884857 - RNA, 22 nt, Human
aaugcauaaugguuugugacaa

SEQ ID NO: 884858 - RNA, 22 nt, Human
caucaaagcuuuuuucuguguu

SEQ ID NO: 884859 - RNA, 22 nt, Human
uuuguucaaaaauuauaagaua

SEQ ID NO: 884860 - RNA, 22 nt, Human
cucuuguuuccuuucugcaguc

SEQ ID NO: 884861 - RNA, 22 nt, Human
acucagcucaggagcuggcugg

SEQ ID NO: 884862 - RNA, 22 nt, Human
cuucaugccuguuuuuaaauuu

SEQ ID NO: 884863 - RNA, 17 nt, Human
agcccccacucccaagu

SEQ ID NO: 884864 - RNA, 22 nt, Human
ugcuucuaaucuacugcauuag

SEQ ID NO: 884865 - RNA, 22 nt, Human
uguggcauggcagaagggcaca

SEQ ID NO: 884866 - RNA, 22 nt, Human
uuuaaaauuuagaccucuccac

SEQ ID NO: 884867 - RNA, 22 nt, Human
ucccagaaaaaggaggcuauga

SEQ ID NO: 884868 - RNA, 22 nt, Human
ggcucugccgugugcucacaug

SEQ ID NO: 884869 - RNA, 22 nt, Human
ucuauacaaguuucacuuugac

SEQ ID NO: 884870 - RNA, 22 nt, Human
caaauggcuggcauccuucuac

SEQ ID NO: 884871 - RNA, 17 nt, Human
uagcacagugccuggua

SEQ ID NO: 884872 - RNA, 22 nt, Human
ugcacugauccugaccagugaa

SEQ ID NO: 884873 - RNA, 22 nt, Human
ggacaacacuucauuccagcua

SEQ ID NO: 884874 - RNA, 20 nt, Human
cacccucccagcaccuaugc

SEQ ID NO: 884875 - RNA, 19 nt, Human
uccaguuuggcaggaagac

SEQ ID NO: 884876 - RNA, 22 nt, Human
caaacuuucaguuauaacauga

SEQ ID NO: 884877 - RNA, 22 nt, Human
ugaagccagucaauguuaaguu

SEQ ID NO: 884878 - RNA, 22 nt, Human
auacucuuuaugacauuccagc

SEQ ID NO: 884879 - RNA, 22 nt, Human
uuggcaacacauggaaaaauuu

SEQ ID NO: 884880 - RNA, 22 nt, Human
cauuuaaagguuguggguaaaa

SEQ ID NO: 884881 - RNA, 22 nt, Human
ucccacagugguacagcccuga

SEQ ID NO: 884882 - RNA, 22 nt, Human
aaaacaguuauaaacagaguca

SEQ ID NO: 884883 - RNA, 22 nt, Human
uuggaagcaguguacacuguac

SEQ ID NO: 884884 - RNA, 22 nt, Human
guuaugaaauaaauauagauca

SEQ ID NO: 884885 - RNA, 22 nt, Human
ucucuguggagcaguguguuca

SEQ ID NO: 884886 - RNA, 22 nt, Human
uuucugugaauuauaaaauuug

SEQ ID NO: 884887 - RNA, 22 nt, Human
agagcacaaauuaguuggucuu

SEQ ID NO: 884888 - RNA, 22 nt, Human
ggcuaggcucaccuggagaguu

SEQ ID NO: 884889 - RNA, 20 nt, Human
cugcaucagcggccgcgucu

SEQ ID NO: 884890 - RNA, 22 nt, Human
ggccuugggauguggcugcagc

SEQ ID NO: 884891 - RNA, 22 nt, Human
auagaaccacccagagccuuuu

SEQ ID NO: 884892 - RNA, 22 nt, Human
acuuuggaauaagcuauauaac

SEQ ID NO: 884893 - RNA, 22 nt, Human
uuucaguguuaugacuuucauu

SEQ ID NO: 884894 - RNA, 22 nt, Human
agaauaguggcaaugacugcac

SEQ ID NO: 884895 - RNA, 20 nt, Human
ugugugcacacaugacauuc

SEQ ID NO: 884896 - RNA, 22 nt, Human
caggcccugggcaggaucagcc

SEQ ID NO: 884897 - RNA, 22 nt, Human
aggagggagaugcccauccugg

SEQ ID NO: 884898 - RNA, 22 nt, Human
auugacagaaaagauguuggau

SEQ ID NO: 884899 - RNA, 17 nt, Human
gcuugggcugccuguug

SEQ ID NO: 884900 - RNA, 22 nt, Human
uaaucacaauucagaugucuua

SEQ ID NO: 884901 - RNA, 22 nt, Human
accaggcccaccgcaugcuccu

SEQ ID NO: 884902 - RNA, 22 nt, Human
ucguguguauucccucuccuuc

SEQ ID NO: 884903 - RNA, 22 nt, Human
cuguuaaucugcuugcaugaug

SEQ ID NO: 884904 - RNA, 22 nt, Human
ccuggcucagcagcucuuucuc

SEQ ID NO: 884905 - RNA, 22 nt, Human
uauauuguaggugcuauuugaa

SEQ ID NO: 884906 - RNA, 22 nt, Human
agcccuggggugcagaaccaug

SEQ ID NO: 884907 - RNA, 22 nt, Human
guuucaaaaugaugcuguaacu

SEQ ID NO: 884908 - RNA, 22 nt, Human
ucuguggccuccuuccacuuac

SEQ ID NO: 884909 - RNA, 22 nt, Human
ccuuuguauuuaccuagucuca

SEQ ID NO: 884910 - RNA, 23 nt, Human
gaggcagcuccugcagugcccug

SEQ ID NO: 884911 - RNA, 22 nt, Human
aucugguuuuggcugugucccu

SEQ ID NO: 884912 - RNA, 22 nt, Human
aauauagcucacuauaccaugg

SEQ ID NO: 884913 - RNA, 22 nt, Human
aaaauuauucauggcuuuugga

SEQ ID NO: 884914 - RNA, 22 nt, Human
ccacccugccuugggccaguga

SEQ ID NO: 884915 - RNA, 22 nt, Human
ccuccccacagcccaggagacu

SEQ ID NO: 884916 - RNA, 22 nt, Human
uagagagguuugaauuggcugc

SEQ ID NO: 884917 - RNA, 22 nt, Human
uuaaaaucuaaagcaguugucu

SEQ ID NO: 884918 - RNA, 22 nt, Human
agcuaguuaaacuaugaauaca

SEQ ID NO: 884919 - RNA, 22 nt, Human
cugaggugugaaaugguggcaa

SEQ ID NO: 884920 - RNA, 22 nt, Human
gccccaggauaaauuuguaaga

SEQ ID NO: 884921 - RNA, 22 nt, Human
uguggugagaaacugguagauu

SEQ ID NO: 884922 - RNA, 20 nt, Human
uuggggcauccaccgaaugg

SEQ ID NO: 884923 - RNA, 22 nt, Human
aaucagaacuucucaggguggg

SEQ ID NO: 884924 - RNA, 22 nt, Human
cugaggcugaagagggccuacg

SEQ ID NO: 884925 - RNA, 22 nt, Human
ugaaaugaagggcuuguucugg

SEQ ID NO: 884926 - RNA, 22 nt, Human
auguaaacuacugacuacacua

SEQ ID NO: 884927 - RNA, 22 nt, Human
agagaagagcaaugauaaauuu

SEQ ID NO: 884928 - RNA, 22 nt, Human
gccuggcugguagagggggcuc

SEQ ID NO: 884929 - RNA, 22 nt, Human
aguggcagggcuggcugcugca

SEQ ID NO: 884930 - RNA, 22 nt, Human
uuuccucuucuucccaugucau

SEQ ID NO: 884931 - RNA, 22 nt, Human
aagucuaguauccuucuugacu

SEQ ID NO: 884932 - RNA, 22 nt, Human
agagugaaguucaucgugcagc

SEQ ID NO: 884933 - RNA, 22 nt, Human
gagaaccucuccacaagucugg

SEQ ID NO: 884934 - RNA, 22 nt, Human
ucacagaaugucuagcauaauu

SEQ ID NO: 884935 - RNA, 22 nt, Human
augcaagagggaaaaggaaaua

SEQ ID NO: 884936 - RNA, 22 nt, Human
aguuauaccuuauacacauaug

SEQ ID NO: 884937 - RNA, 22 nt, Human
gucccaggcagagucaggaggg

SEQ ID NO: 884938 - RNA, 22 nt, Human
uggagugaaguaaagaggacaa

SEQ ID NO: 884939 - RNA, 22 nt, Human
cugcgugcauuaauauuuccuu

SEQ ID NO: 884940 - RNA, 22 nt, Human
ccaguacuugcuaccucaauug

SEQ ID NO: 884941 - RNA, 22 nt, Human
auuuguucucauaaagaaugaa

SEQ ID NO: 884942 - RNA, 22 nt, Human
augcaagucuuaauaguuuagg

SEQ ID NO: 884943 - RNA, 22 nt, Human
cuccuucccaugagugugggca

SEQ ID NO: 884944 - RNA, 22 nt, Human
ucagaggaacacuguuucaugc

SEQ ID NO: 884945 - RNA, 23 nt, Human
uggccagguagaggagguaguga

SEQ ID NO: 884946 - RNA, 22 nt, Human
uuaaguacaggguuagugacgg

SEQ ID NO: 884947 - RNA, 22 nt, Human
gacccuuugacuugugacauua

SEQ ID NO: 884948 - RNA, 22 nt, Human
ccuggaaaaugccacuuucaca

SEQ ID NO: 884949 - RNA, 22 nt, Human
gcaggcugcugagauccuuagg

SEQ ID NO: 884950 - RNA, 21 nt, Human
uccagccuuucccucacuucc

SEQ ID NO: 884951 - RNA, 21 nt, Human
uccaaaccugucucuggcucu

SEQ ID NO: 884952 - RNA, 22 nt, Human
accugaaacucaacuuuaucuc

SEQ ID NO: 884953 - RNA, 22 nt, Human
uuucauguuggauacuguuuca

SEQ ID NO: 884954 - RNA, 22 nt, Human
cacaaugucugguaggccacuu

SEQ ID NO: 884955 - RNA, 22 nt, Human
ucaggagggaguguggauagag

SEQ ID NO: 884956 - RNA, 22 nt, Human
gagucaugcacugucuuucucc

SEQ ID NO: 884957 - RNA, 22 nt, Human
cccaggcuucccaaucagaagg

SEQ ID NO: 884958 - RNA, 22 nt, Human
agcagcauaucagagaaaguca

SEQ ID NO: 884959 - RNA, 22 nt, Human
aggcccuaauccaacaugacug

SEQ ID NO: 884960 - RNA, 22 nt, Human
ugacagaugaagcuggggacca

SEQ ID NO: 884961 - RNA, 22 nt, Human
aggcuucaaggaccugagggaa

SEQ ID NO: 884962 - RNA, 22 nt, Human
gucacacacauuucuuuggugc

SEQ ID NO: 884963 - RNA, 22 nt, Human
cccaggaggcgcagguugcggu

SEQ ID NO: 884964 - RNA, 17 nt, Human
ugaaaucagcacccagg

SEQ ID NO: 884965 - RNA, 22 nt, Human
cuuccuggaugaagcccagcau

SEQ ID NO: 884966 - RNA, 22 nt, Human
uggagccuguucugagaagccg

SEQ ID NO: 884967 - RNA, 22 nt, Human
ugugcauguauugauuuguacc

SEQ ID NO: 884968 - RNA, 22 nt, Human
uaagaacagugucugucucaca

SEQ ID NO: 884969 - RNA, 22 nt, Human
cguagguggcucagcaccuggg

SEQ ID NO: 884970 - RNA, 22 nt, Human
cuaggguggauuugugcagagu

SEQ ID NO: 884971 - RNA, 22 nt, Human
gaacacaguuuagaaaaugcug

SEQ ID NO: 884972 - RNA, 22 nt, Human
agaucaaaucugggauuucuaa

SEQ ID NO: 884973 - RNA, 22 nt, Human
gugccuggagcuaauguguaua

SEQ ID NO: 884974 - RNA, 22 nt, Human
cccagggcugcagauggaggcu

SEQ ID NO: 884975 - RNA, 22 nt, Human
uucauguucauauguguauauc

SEQ ID NO: 884976 - RNA, 22 nt, Human
uuuguuuugaacuagcucagaa

SEQ ID NO: 884977 - RNA, 22 nt, Human
ucaugcucaucauuagagugac

SEQ ID NO: 884978 - RNA, 22 nt, Human
cagcccacuucccagcaccuac

SEQ ID NO: 884979 - RNA, 22 nt, Human
cuucuaauucuuauguaagcuu

SEQ ID NO: 884980 - RNA, 22 nt, Human
gugauucugauauagcuaaagu

SEQ ID NO: 884981 - RNA, 22 nt, Human
uuuucaaagacuggaggcugau

SEQ ID NO: 884982 - RNA, 20 nt, Human
guuuuucuugggcgagcuau

SEQ ID NO: 884983 - RNA, 22 nt, Human
gccuggcagggcccggacggca

SEQ ID NO: 884984 - RNA, 22 nt, Human
acagggccuggcuccaaaagau

SEQ ID NO: 884985 - RNA, 22 nt, Human
aggcuucugugagcucauacaa

SEQ ID NO: 884986 - RNA, 22 nt, Human
caggaccuaacucaccugucuc

SEQ ID NO: 884987 - RNA, 22 nt, Human
gggcagcaugucacuagcaugg

SEQ ID NO: 884988 - RNA, 22 nt, Human
gggcugaguuccugccucacuc

SEQ ID NO: 884989 - RNA, 22 nt, Human
uauauauaugcacacacaccua

SEQ ID NO: 884990 - RNA, 22 nt, Human
agcuuuggggacagccaagguu

SEQ ID NO: 884991 - RNA, 22 nt, Human
ucugaggccuucagcaugaauc

SEQ ID NO: 884992 - RNA, 22 nt, Human
ugaaauguguccauguuauuuc

SEQ ID NO: 884993 - RNA, 22 nt, Human
uaaacugugaaaggcuuaacau

SEQ ID NO: 884994 - RNA, 23 nt, Human
gggagcuguggugaaaagaggug

SEQ ID NO: 884995 - RNA, 22 nt, Human
ugacugccgauuguccuucucu

SEQ ID NO: 884996 - RNA, 22 nt, Human
auuguuaaacugaagcauuacu

SEQ ID NO: 884997 - RNA, 22 nt, Human
ugcagggcuacaggacuacaac

SEQ ID NO: 884998 - RNA, 22 nt, Human
acaauacuauuuucaguauccu

SEQ ID NO: 884999 - RNA, 22 nt, Human
uugacugugaugggcucagcug

SEQ ID NO: 885000 - RNA, 22 nt, Human
ucucacugcaaauauuauguau

SEQ ID NO: 885001 - RNA, 22 nt, Human
agguacaguagacagacaguua

SEQ ID NO: 885002 - RNA, 22 nt, Human
aggccugagccccagguuuguu

SEQ ID NO: 885003 - RNA, 22 nt, Human
cuuuagugguauuuuagcaagu

SEQ ID NO: 885004 - RNA, 22 nt, Human
caguuauaggagccauuguaua

SEQ ID NO: 885005 - RNA, 22 nt, Human
uucuuuggcuuacgucuggccu

SEQ ID NO: 885006 - RNA, 22 nt, Human
uggaaagagguagaggaucugg

SEQ ID NO: 885007 - RNA, 22 nt, Human
uccugcuucuucgagcuucugg

SEQ ID NO: 885008 - RNA, 22 nt, Human
uccugugaagaauagcacucaa

SEQ ID NO: 885009 - RNA, 22 nt, Human
gugccugugcggacucagggaa

SEQ ID NO: 885010 - RNA, 21 nt, Human
uucuaacugggugggccuuga

SEQ ID NO: 885011 - RNA, 22 nt, Human
uggcugaguuacgaacagagca

SEQ ID NO: 885012 - RNA, 20 nt, Human
uucauuugggaaaaucugcg

SEQ ID NO: 885013 - RNA, 22 nt, Human
uuugugcacauugcuuuucuau

SEQ ID NO: 885014 - RNA, 22 nt, Human
uuuauuauccaguguugucaug

SEQ ID NO: 885015 - RNA, 22 nt, Human
gaagauacacagagcugucuuu

SEQ ID NO: 885016 - RNA, 22 nt, Human
aggaagccugcaggugacugcu

SEQ ID NO: 885017 - RNA, 22 nt, Human
caggaggcuccuagggcucugu

SEQ ID NO: 885018 - RNA, 22 nt, Human
aaggcuucuuugcaggcuuuag

SEQ ID NO: 885019 - RNA, 22 nt, Human
agugaggggauucaggcaaggu

SEQ ID NO: 885020 - RNA, 22 nt, Human
auaaguuugucuuuguaaagau

SEQ ID NO: 885021 - RNA, 22 nt, Human
uuugacaauuagguagaaaaag

SEQ ID NO: 885022 - RNA, 22 nt, Human
ggcucugaguuuagaagggugg

SEQ ID NO: 885023 - RNA, 22 nt, Human
aguaacaaagugggagaaugau

SEQ ID NO: 885024 - RNA, 22 nt, Human
uccugggguuuuggccgcagcu

SEQ ID NO: 885025 - RNA, 22 nt, Human
uacacagccuguaaugaugacu

SEQ ID NO: 885026 - RNA, 22 nt, Human
gggucagggcugccugggcuca

SEQ ID NO: 885027 - RNA, 22 nt, Human
ccugcagaugugggacagcugu

SEQ ID NO: 885028 - RNA, 22 nt, Human
uccaaauaccagaugggcuaau

SEQ ID NO: 885029 - RNA, 22 nt, Human
ccugcuccaugcucaccaucag

SEQ ID NO: 885030 - RNA, 22 nt, Human
cugcaggcucgaagacacggau

SEQ ID NO: 885031 - RNA, 22 nt, Human
uaagagauucuaaagcuacugg

SEQ ID NO: 885032 - RNA, 22 nt, Human
cuguggccuuuguuggaggucc

SEQ ID NO: 885033 - RNA, 19 nt, Human
acaguucuaauuucugugg

SEQ ID NO: 885034 - RNA, 22 nt, Human
ugggccagcugaagugccgccc

SEQ ID NO: 885035 - RNA, 22 nt, Human
aguuugauuguauggguuuuaa

SEQ ID NO: 885036 - RNA, 22 nt, Human
cacccaguugacuacaaagggg

SEQ ID NO: 885037 - RNA, 22 nt, Human
gcaggccugcccagcaggaugg

SEQ ID NO: 885038 - RNA, 22 nt, Human
uguauuuugaguccaaucuccu

SEQ ID NO: 885039 - RNA, 22 nt, Human
uuuacaccaaaaugacacagag

SEQ ID NO: 885040 - RNA, 22 nt, Human
ugcacacacucugcauauacuu

SEQ ID NO: 885041 - RNA, 22 nt, Human
acuuugcccuacagcagcucug

SEQ ID NO: 885042 - RNA, 23 nt, Human
uccugcagauaagcugguugaca

SEQ ID NO: 885043 - RNA, 22 nt, Human
aaaagcuuuguuaauagguuug

SEQ ID NO: 885044 - RNA, 22 nt, Human
cagggucaggcugcuagaagcu

SEQ ID NO: 885045 - RNA, 22 nt, Human
gagggggucuaugagguagagc

SEQ ID NO: 885046 - RNA, 22 nt, Human
acaagcaguaaaggccacaguc

SEQ ID NO: 885047 - RNA, 22 nt, Human
uuggcacuuuuaggcaguaccg

SEQ ID NO: 885048 - RNA, 22 nt, Human
cagggucauggcaccugcacgg

SEQ ID NO: 885049 - RNA, 22 nt, Human
ugggagagcacugcagccccgg

SEQ ID NO: 885050 - RNA, 19 nt, Human
ccaggccaucccaguuccc

SEQ ID NO: 885051 - RNA, 22 nt, Human
cauaacauuaagccucuauuuc

SEQ ID NO: 885052 - RNA, 22 nt, Human
gccugccuuugugaggaagcgg

SEQ ID NO: 885053 - RNA, 22 nt, Human
uauugcauagaaggaaggaguu

SEQ ID NO: 885054 - RNA, 22 nt, Human
aggcuucaaggacagcagccac

SEQ ID NO: 885055 - RNA, 22 nt, Human
aaugagggggaugggaaagugu

SEQ ID NO: 885056 - RNA, 22 nt, Human
gggccuucagccuuggacugag

SEQ ID NO: 885057 - RNA, 22 nt, Human
agacaucucuaugcaggaucuc

SEQ ID NO: 885058 - RNA, 22 nt, Human
acaugaaaccugagucuaacuc

SEQ ID NO: 885059 - RNA, 22 nt, Human
ccacaguuuaggaagucacucu

SEQ ID NO: 885060 - RNA, 22 nt, Human
ucacauuaggaaguaauguugu

SEQ ID NO: 885061 - RNA, 22 nt, Human
uccauggggcccaggaugagag

SEQ ID NO: 885062 - RNA, 22 nt, Human
uauaggaaggcagauuuuagcu

SEQ ID NO: 885063 - RNA, 22 nt, Human
aaagagccgcugaugucagccc

SEQ ID NO: 885064 - RNA, 22 nt, Human
uucuaaacggcuucacaggaau

SEQ ID NO: 885065 - RNA, 22 nt, Human
ugcuaauaucuagaaguuuguu

SEQ ID NO: 885066 - RNA, 22 nt, Human
gagcucuguucucguccugcug

SEQ ID NO: 885067 - RNA, 22 nt, Human
acucaacagggaacaagaucag

SEQ ID NO: 885068 - RNA, 22 nt, Human
ggagccugggcauuaguaauuu

SEQ ID NO: 885069 - RNA, 22 nt, Human
uacacagauaugugaucaauca

SEQ ID NO: 885070 - RNA, 22 nt, Human
uggcugugggauaugugacuga

SEQ ID NO: 885071 - RNA, 22 nt, Human
aggcaaagaggauauuuugggg

SEQ ID NO: 885072 - RNA, 22 nt, Human
ucugucugcgcuugcccuggug

SEQ ID NO: 885073 - RNA, 22 nt, Human
gcacaugucuuauucacuguua

SEQ ID NO: 885074 - RNA, 22 nt, Human
uaugaagugaguuaugguugcu

SEQ ID NO: 885075 - RNA, 23 nt, Human
uaaagugcugauggugagggagc

SEQ ID NO: 885076 - RNA, 22 nt, Human
gggguggauuccuacaggucca

SEQ ID NO: 885077 - RNA, 22 nt, Human
aucuaaaguguuucaugaaaga

SEQ ID NO: 885078 - RNA, 22 nt, Human
aggugccugucgucucugguua

SEQ ID NO: 885079 - RNA, 22 nt, Human
aaguaagucuuacauucacauu

SEQ ID NO: 885080 - RNA, 22 nt, Human
caguucaggccggcugacucag

SEQ ID NO: 885081 - RNA, 22 nt, Human
uccagcucccacucucacugcu

SEQ ID NO: 885082 - RNA, 22 nt, Human
gggggacuggaccguccugggu

SEQ ID NO: 885083 - RNA, 23 nt, Human
aaaaaaccauguaggcacucagu

SEQ ID NO: 885084 - RNA, 21 nt, Human
ucagcuguagagauuacauuc

SEQ ID NO: 885085 - RNA, 22 nt, Human
ggcaggugagagcucuuugaaa

SEQ ID NO: 885086 - RNA, 22 nt, Human
guggcagagccgugcagguagg

SEQ ID NO: 885087 - RNA, 22 nt, Human
acaggcuuacuguuucauaggg

SEQ ID NO: 885088 - RNA, 22 nt, Human
gccaggcagagccccgugcagc

SEQ ID NO: 885089 - RNA, 22 nt, Human
auacccagccccagcugcagga

SEQ ID NO: 885090 - RNA, 22 nt, Human
agugugucuuauccugggagaa

SEQ ID NO: 885091 - RNA, 22 nt, Human
cagguggccuugccaucuccug

SEQ ID NO: 885092 - RNA, 22 nt, Human
uucuaggaagggaagcauggca

SEQ ID NO: 885093 - RNA, 22 nt, Human
guuccugugggguuaacccuga

SEQ ID NO: 885094 - RNA, 23 nt, Human
cugggcuguccugaggucaccuc

SEQ ID NO: 885095 - RNA, 22 nt, Human
uggccuggggaagaccaugggc

SEQ ID NO: 885096 - RNA, 22 nt, Human
caaggccacugcucagguuucc

SEQ ID NO: 885097 - RNA, 21 nt, Human
uuugaaagugggugauucuuu

SEQ ID NO: 885098 - RNA, 22 nt, Human
cagaaagcuuaggcaaguugga

SEQ ID NO: 885099 - RNA, 22 nt, Human
ggaggagcacuucugagcucag

SEQ ID NO: 885100 - RNA, 22 nt, Human
cugaagagaaauguacacaugg

SEQ ID NO: 885101 - RNA, 20 nt, Human
aaaauauguauaacucuucu

SEQ ID NO: 885102 - RNA, 22 nt, Human
auuucagagcuuugcagcuaau

SEQ ID NO: 885103 - RNA, 22 nt, Human
aggauguguuuugagcugacua

SEQ ID NO: 885104 - RNA, 22 nt, Human
uccagucucuacucugagauaa

SEQ ID NO: 885105 - RNA, 22 nt, Human
agugauguaacaaacagaguua

SEQ ID NO: 885106 - RNA, 22 nt, Human
ucauccugucucacuuuuugcu

SEQ ID NO: 885107 - RNA, 23 nt, Human
agcuuugugaaagcagacauggg

SEQ ID NO: 885108 - RNA, 22 nt, Human
ugacuaaacgcaugaauagcuc

SEQ ID NO: 885109 - RNA, 22 nt, Human
gaggaagagcauggccaguuuc

SEQ ID NO: 885110 - RNA, 22 nt, Human
agcugcugcggaaagaugccac

SEQ ID NO: 885111 - RNA, 22 nt, Human
ugacgucaacugcaaaggccuu

SEQ ID NO: 885112 - RNA, 22 nt, Human
uauuugucaagagagggggaua

SEQ ID NO: 885113 - RNA, 22 nt, Human
cugacaguaacuaauguggaga

SEQ ID NO: 885114 - RNA, 22 nt, Human
auauuuugguagcucucaauga

SEQ ID NO: 885115 - RNA, 21 nt, Human
auacagaagguggcaaaguac

SEQ ID NO: 885116 - RNA, 21 nt, Human
auauuucucauaagguuaugg

SEQ ID NO: 885117 - RNA, 22 nt, Human
aagacaggaacauagcaaaucc

SEQ ID NO: 885118 - RNA, 22 nt, Human
uauuagcagcaugagaaugggc

SEQ ID NO: 885119 - RNA, 22 nt, Human
agcuucuggaaggcaaggcuug

SEQ ID NO: 885120 - RNA, 22 nt, Human
ugaccucuugucggagcuccag

SEQ ID NO: 885121 - RNA, 22 nt, Human
aaagaacaaaugauauaugguu

SEQ ID NO: 885122 - RNA, 22 nt, Human
cacuucaaauauggcuucauga

SEQ ID NO: 885123 - RNA, 22 nt, Human
cugagguaugugggacuagccu

SEQ ID NO: 885124 - RNA, 22 nt, Human
ucagcucuaaguuuuaugcaaa

SEQ ID NO: 885125 - RNA, 22 nt, Human
acacuucagcaguaugcuuggg

SEQ ID NO: 885126 - RNA, 22 nt, Human
aguuuucugcuaaaccagcuaa

SEQ ID NO: 885127 - RNA, 22 nt, Human
gacccuuggcugcagcaucaca

SEQ ID NO: 885128 - RNA, 22 nt, Human
ugagguaugauuuacaugcagu

SEQ ID NO: 885129 - RNA, 22 nt, Human
ccuggcugguggcagcgacaag

SEQ ID NO: 885130 - RNA, 22 nt, Human
cagggcucuuccggagcaggga

SEQ ID NO: 885131 - RNA, 22 nt, Human
cauucacauucuucuuacuguu

SEQ ID NO: 885132 - RNA, 22 nt, Human
aguacuuugcacuuugcucaga

SEQ ID NO: 885133 - RNA, 22 nt, Human
gcuggggacuccccaccauagc

SEQ ID NO: 885134 - RNA, 22 nt, Human
uggcacagcccagagcucuuga

SEQ ID NO: 885135 - RNA, 22 nt, Human
uggagcaggccggaaguggcuu

SEQ ID NO: 885136 - RNA, 22 nt, Human
ccugaaauuugaagaccugaau

SEQ ID NO: 885137 - RNA, 22 nt, Human
uuaaaagaccuguugagguuag

SEQ ID NO: 885138 - RNA, 22 nt, Human
aggcuccauuuuccugcagcug

SEQ ID NO: 885139 - RNA, 22 nt, Human
uggggggauacuugcuacuggc

SEQ ID NO: 885140 - RNA, 22 nt, Human
cagcuacuccucccaugacuuc

SEQ ID NO: 885141 - RNA, 22 nt, Human
ucagaaucugaaaagcgcuugg

SEQ ID NO: 885142 - RNA, 22 nt, Human
cguucucucaugaucuucccga

SEQ ID NO: 885143 - RNA, 22 nt, Human
gugaauggggcaggaaggaugg

SEQ ID NO: 885144 - RNA, 22 nt, Human
cagcucuggccagaucuauccu

SEQ ID NO: 885145 - RNA, 22 nt, Human
caggcagaugcugacaagaguu

SEQ ID NO: 885146 - RNA, 22 nt, Human
gauuggucuacucaacagcaga

SEQ ID NO: 885147 - RNA, 22 nt, Human
agcugccugugcugggagccca

SEQ ID NO: 885148 - RNA, 22 nt, Human
ugaugggaggugcugcaggacc

SEQ ID NO: 885149 - RNA, 22 nt, Human
uucuuugggauuguagcugucu

SEQ ID NO: 885150 - RNA, 22 nt, Human
ucaacugauuuagucugugcca

SEQ ID NO: 885151 - RNA, 22 nt, Human
uauuuuacaugacagguguuua

SEQ ID NO: 885152 - RNA, 22 nt, Human
auuguauaacagcauguauuuu

SEQ ID NO: 885153 - RNA, 22 nt, Human
uacaucuagccuuacaauuauu

SEQ ID NO: 885154 - RNA, 22 nt, Human
aaagacacaugucucuuagauu

SEQ ID NO: 885155 - RNA, 22 nt, Human
aagggcagccugacucacgguc

SEQ ID NO: 885156 - RNA, 22 nt, Human
gccuucugauugcuggacugac

SEQ ID NO: 885157 - RNA, 22 nt, Human
gggcuggaugggagccuuggcc

SEQ ID NO: 885158 - RNA, 22 nt, Human
guacccagugauuccuucuuca

SEQ ID NO: 885159 - RNA, 22 nt, Human
ucacaugcacauacuuccugug

SEQ ID NO: 885160 - RNA, 22 nt, Human
auuugaagaaaguuuucuagau

SEQ ID NO: 885161 - RNA, 22 nt, Human
agagccugaggcccugagaggg

SEQ ID NO: 885162 - RNA, 22 nt, Human
acagcuaggaaauggaagaacu

SEQ ID NO: 885163 - RNA, 22 nt, Human
uagcgcaaugagagagcggugc

SEQ ID NO: 885164 - RNA, 22 nt, Human
cuggagucagcaaggacgaggc

SEQ ID NO: 885165 - RNA, 19 nt, Human
aacaugacagccacucugg

SEQ ID NO: 885166 - RNA, 20 nt, Human
ccugguguauuuccuggggu

SEQ ID NO: 885167 - RNA, 22 nt, Human
ucacaggcaaagaagauuggug

SEQ ID NO: 885168 - RNA, 22 nt, Human
ucugccaggcauugugcugcuc

SEQ ID NO: 885169 - RNA, 22 nt, Human
gccugggaagacuaagugggag

SEQ ID NO: 885170 - RNA, 22 nt, Human
aucauaagacccagccaguauu

SEQ ID NO: 885171 - RNA, 22 nt, Human
gacagagguguccuugagucca

SEQ ID NO: 885172 - RNA, 21 nt, Human
uacuguagccuugcacuguag

SEQ ID NO: 885173 - RNA, 22 nt, Human
ucuugcaccacacaaaaauuug

SEQ ID NO: 885174 - RNA, 22 nt, Human
agagcugucacauagagccaga

SEQ ID NO: 885175 - RNA, 21 nt, Human
acaauugauggcuuaaguugc

SEQ ID NO: 885176 - RNA, 22 nt, Human
ggacagugcgagacacaguaac

SEQ ID NO: 885177 - RNA, 22 nt, Human
aggcagaaaauagucauccaaa

SEQ ID NO: 885178 - RNA, 21 nt, Human
aguguccuugaucuugccuug

SEQ ID NO: 885179 - RNA, 23 nt, Human
gaggaaagaauauagaugcaauc

SEQ ID NO: 885180 - RNA, 22 nt, Human
uaaaauagcaugugcagugaaa

SEQ ID NO: 885181 - RNA, 22 nt, Human
cugaaguucgccagacucgggc

SEQ ID NO: 885182 - RNA, 22 nt, Human
aggcagaucacaggagggccug

SEQ ID NO: 885183 - RNA, 22 nt, Human
agcugcugggauacaguaguga

SEQ ID NO: 885184 - RNA, 22 nt, Human
cugucucugauaagcucgaggg

SEQ ID NO: 885185 - RNA, 22 nt, Human
cugccagagaucugggcagagu

SEQ ID NO: 885186 - RNA, 22 nt, Human
ucucccaguggugcagaaagca

SEQ ID NO: 885187 - RNA, 22 nt, Human
uaauuucuaauucauuuucagu

SEQ ID NO: 885188 - RNA, 22 nt, Human
uagggaugauggagccuaugua

SEQ ID NO: 885189 - RNA, 22 nt, Human
ucacagaguuaaaaguuucuuu

SEQ ID NO: 885190 - RNA, 22 nt, Human
gcuuagaaguacacaugccuuu

SEQ ID NO: 885191 - RNA, 22 nt, Human
cuauucaauuuugcuauuguag

SEQ ID NO: 885192 - RNA, 22 nt, Human
augggcuggcagccugaacagc

SEQ ID NO: 885193 - RNA, 22 nt, Human
cuggguccccucagugacacug

SEQ ID NO: 885194 - RNA, 22 nt, Human
ggaugggcagacaggacggcac

SEQ ID NO: 885195 - RNA, 22 nt, Human
ggcagcaacgaggcuugauacc

SEQ ID NO: 885196 - RNA, 22 nt, Human
uacugaaagagugguggacucu

SEQ ID NO: 885197 - RNA, 22 nt, Human
cagaggacuucccacucaucug

SEQ ID NO: 885198 - RNA, 21 nt, Human
agcagagugcuuugacuuugu

SEQ ID NO: 885199 - RNA, 22 nt, Human
ugaaacauuugaugaucuuugg

SEQ ID NO: 885200 - RNA, 22 nt, Human
auagaaccuguugugaaauuca

SEQ ID NO: 885201 - RNA, 22 nt, Human
aacaugaagguaggaugguuuu

SEQ ID NO: 885202 - RNA, 21 nt, Human
uuuugcuguuuuagaaugaga

SEQ ID NO: 885203 - RNA, 22 nt, Human
caaucacaaagagacaaguguc

SEQ ID NO: 885204 - RNA, 22 nt, Human
gcacucuccuggcugccacagu

SEQ ID NO: 885205 - RNA, 22 nt, Human
cuagagaagaggcucagccagc

SEQ ID NO: 885206 - RNA, 22 nt, Human
ugucucugucuuccagggcugu

SEQ ID NO: 885207 - RNA, 22 nt, Human
acguauauugaaauaucaugag

SEQ ID NO: 885208 - RNA, 22 nt, Human
aucuuuagacaggaagcaauca

SEQ ID NO: 885209 - RNA, 22 nt, Human
ucaggcugcagcugucagcagc

SEQ ID NO: 885210 - RNA, 22 nt, Human
auugacaagaaagauauuuuua

SEQ ID NO: 885211 - RNA, 22 nt, Human
caggacagugcagguccauccu

SEQ ID NO: 885212 - RNA, 22 nt, Human
acuuucaagcaagaacacuuug

SEQ ID NO: 885213 - RNA, 22 nt, Human
ugaggggagcuagcaugccuug

SEQ ID NO: 885214 - RNA, 22 nt, Human
cgugggaggaaaaaugggcuuc

SEQ ID NO: 885215 - RNA, 21 nt, Human
ugcucugguagaaacucuuuc

SEQ ID NO: 885216 - RNA, 22 nt, Human
ucuucuccauaaucaacacucu

SEQ ID NO: 885217 - RNA, 22 nt, Human
uuuccuuguuauuauuuguccu

SEQ ID NO: 885218 - RNA, 22 nt, Human
ugcuauuuuggucuacagcacu

SEQ ID NO: 885219 - RNA, 22 nt, Human
guacaaauuuugacaucuagga

SEQ ID NO: 885220 - RNA, 22 nt, Human
agaaaucuauuauuucagaguu

SEQ ID NO: 885221 - RNA, 22 nt, Human
uugacucuaaauuuacuuuucc

SEQ ID NO: 885222 - RNA, 22 nt, Human
gcugcucuguuaauugcuguaa

SEQ ID NO: 885223 - RNA, 21 nt, Human
acaguuuauuagaguaagugc

SEQ ID NO: 885224 - RNA, 22 nt, Human
auuuauaacgugcagccagggu

SEQ ID NO: 885225 - RNA, 22 nt, Human
aagaacaguguccugggacucg

SEQ ID NO: 885226 - RNA, 22 nt, Human
ucuccagaaauggggcugggga

SEQ ID NO: 885227 - RNA, 22 nt, Human
gcgugcauggccguguguaugc

SEQ ID NO: 885228 - RNA, 23 nt, Human
aggaagcuuggcaauaagguuug

SEQ ID NO: 885229 - RNA, 22 nt, Human
caauuauauuuagaaugauaca

SEQ ID NO: 885230 - RNA, 22 nt, Human
gaucugcacucugagaggcuug

SEQ ID NO: 885231 - RNA, 22 nt, Human
gcugggccccaucccucgagca

SEQ ID NO: 885232 - RNA, 22 nt, Human
caggcuuuacuuucucucugaa

SEQ ID NO: 885233 - RNA, 22 nt, Human
acaugaaacuguugcauuagaa

SEQ ID NO: 885234 - RNA, 22 nt, Human
gugccuggcaugcgccggugcu

SEQ ID NO: 885235 - RNA, 22 nt, Human
aggaagcaguuuauaaugcauu

SEQ ID NO: 885236 - RNA, 18 nt, Human
aguccaugcauggcuaua

SEQ ID NO: 885237 - RNA, 22 nt, Human
ccuccucugugcagcugugggu

SEQ ID NO: 885238 - RNA, 22 nt, Human
cagcagcaguguucuagaaucu

SEQ ID NO: 885239 - RNA, 22 nt, Human
auucaaguacaguuuucuucuu

SEQ ID NO: 885240 - RNA, 22 nt, Human
ggcugagacuagagugaggcau

SEQ ID NO: 885241 - RNA, 22 nt, Human
uucauguaacuuuucuucucca

SEQ ID NO: 885242 - RNA, 22 nt, Human
ggaguuggugagcaccaggcuu

SEQ ID NO: 885243 - RNA, 22 nt, Human
ccagggcuccauugcucauccu

SEQ ID NO: 885244 - RNA, 22 nt, Human
uugcugauuuguuucuauucca

SEQ ID NO: 885245 - RNA, 22 nt, Human
gaaugacauugaaaagacauug

SEQ ID NO: 885246 - RNA, 22 nt, Human
uguacagagguguacauaugau

SEQ ID NO: 885247 - RNA, 22 nt, Human
agugaaggaaguuugucuuggg

SEQ ID NO: 885248 - RNA, 22 nt, Human
agcaaugacuuugaaaucauga

SEQ ID NO: 885249 - RNA, 22 nt, Human
ugauuaaagguggaaggcaggu

SEQ ID NO: 885250 - RNA, 22 nt, Human
aggcugcucugcgaagucagcu

SEQ ID NO: 885251 - RNA, 22 nt, Human
ugauuuaugaccaaguuagaau

SEQ ID NO: 885252 - RNA, 22 nt, Human
gguuccugugccucuagcuggc

SEQ ID NO: 885253 - RNA, 22 nt, Human
uggaaucucugguaucugggga

SEQ ID NO: 885254 - RNA, 22 nt, Human
uagucacacaauuguguacauu

SEQ ID NO: 885255 - RNA, 22 nt, Human
agaacuuuuggagacuuuuagu

SEQ ID NO: 885256 - RNA, 22 nt, Human
cacuugcagacuuugccugguu

SEQ ID NO: 885257 - RNA, 22 nt, Human
ccauggaucuggaucuaucuuu

SEQ ID NO: 885258 - RNA, 22 nt, Human
ccuggcucaguguugaaggggu

SEQ ID NO: 885259 - RNA, 22 nt, Human
ugggggaguauagucuggccuc

SEQ ID NO: 885260 - RNA, 22 nt, Human
aauagcauguucaugauaaaau

SEQ ID NO: 885261 - RNA, 22 nt, Human
uguuuauugcugcaauugugcc

SEQ ID NO: 885262 - RNA, 22 nt, Human
gcaaaacagucgaugccuccca

SEQ ID NO: 885263 - RNA, 18 nt, Human
aaguccauggguuuggga

SEQ ID NO: 885264 - RNA, 22 nt, Human
caggcagagugagaagcccuug

SEQ ID NO: 885265 - RNA, 22 nt, Human
ggggauggaauguaguagugau

SEQ ID NO: 885266 - RNA, 22 nt, Human
agagcccuuucuccaggcaccu

SEQ ID NO: 885267 - RNA, 22 nt, Human
agggcugccauuucuggcccaa

SEQ ID NO: 885268 - RNA, 22 nt, Human
augaaaauguacauguguauaa

SEQ ID NO: 885269 - RNA, 22 nt, Human
cacauacaaugguguuauuugg

SEQ ID NO: 885270 - RNA, 22 nt, Human
agccauucauugugcucucaga

SEQ ID NO: 885271 - RNA, 21 nt, Human
aaccacauggauuagucagag

SEQ ID NO: 885272 - RNA, 22 nt, Human
uuucucuuuggaggggcugaau

SEQ ID NO: 885273 - RNA, 22 nt, Human
gaaacauuggucugccccuuau

SEQ ID NO: 885274 - RNA, 22 nt, Human
guccugcuuguuaggccuaguc

SEQ ID NO: 885275 - RNA, 22 nt, Human
cuuaaaggagguuuuguuucca

SEQ ID NO: 885276 - RNA, 20 nt, Human
uggaagaagaacucaggcuu

SEQ ID NO: 885277 - RNA, 22 nt, Human
aaguuugugucagagcuguuac

SEQ ID NO: 885278 - RNA, 22 nt, Human
ggggccuuggaucugugccccg

SEQ ID NO: 885279 - RNA, 22 nt, Human
cagagccagucagucagaaacu

SEQ ID NO: 885280 - RNA, 22 nt, Human
ggcuauggaagauaaggcugaa

SEQ ID NO: 885281 - RNA, 22 nt, Human
uacugcaucgaaaugcuuuuau

SEQ ID NO: 885282 - RNA, 22 nt, Human
cauguaaaacacucagaacagu

SEQ ID NO: 885283 - RNA, 22 nt, Human
augcagcacugaucuuuagcca

SEQ ID NO: 885284 - RNA, 22 nt, Human
uaaacaguuaacaugccagaau

SEQ ID NO: 885285 - RNA, 22 nt, Human
acagauggagcuacuagguaaa

SEQ ID NO: 885286 - RNA, 22 nt, Human
uaugcaaaucauuagauuuccu

SEQ ID NO: 885287 - RNA, 22 nt, Human
aggcaguguguagcuggaagag

SEQ ID NO: 885288 - RNA, 22 nt, Human
agugauuuuaucaauuuacuca

SEQ ID NO: 885289 - RNA, 22 nt, Human
acacaguucgugcuuuucuauu

SEQ ID NO: 885290 - RNA, 22 nt, Human
gggccagagcuuggcagcuggg

SEQ ID NO: 885291 - RNA, 22 nt, Human
ucaguuaacaacuauuuauuga

SEQ ID NO: 885292 - RNA, 22 nt, Human
cucagaagaacccaggguccca

SEQ ID NO: 885293 - RNA, 22 nt, Human
uucaaguacauuguguuuuccu

SEQ ID NO: 885294 - RNA, 22 nt, Human
auaucucauuaccuugcuguuc

SEQ ID NO: 885295 - RNA, 22 nt, Human
acugaggcuuacaaagguaaag

SEQ ID NO: 885296 - RNA, 22 nt, Human
cuucugagauguuguuuuacag

SEQ ID NO: 885297 - RNA, 22 nt, Human
cugcagagagugccgggcagcc

SEQ ID NO: 885298 - RNA, 19 nt, Human
gagcaacauauguaaacuc

SEQ ID NO: 885299 - RNA, 20 nt, Human
acacauagauaagaagcuga

SEQ ID NO: 885300 - RNA, 22 nt, Human
gcuggcugcuaggacagcuaca

SEQ ID NO: 885301 - RNA, 22 nt, Human
guggcuggcccuggacccuaag

SEQ ID NO: 885302 - RNA, 22 nt, Human
ggcagaggaaggaugaauucac

SEQ ID NO: 885303 - RNA, 22 nt, Human
cauagcaaggugcuuuccacau

SEQ ID NO: 885304 - RNA, 22 nt, Human
uaagacuucauuaguaauaugg

SEQ ID NO: 885305 - RNA, 22 nt, Human
cuagaaguuggggcuagggaua

SEQ ID NO: 885306 - RNA, 22 nt, Human
ugcuggcuuuaagguuaaagug

SEQ ID NO: 885307 - RNA, 19 nt, Human
ggaaggugacaguggugaa

SEQ ID NO: 885308 - RNA, 23 nt, Human
ucauuccacaaauacuuaucuag

SEQ ID NO: 885309 - RNA, 22 nt, Human
ucaaagcaugguuuugaaagac

SEQ ID NO: 885310 - RNA, 22 nt, Human
aauguguagucauugaucaaga

SEQ ID NO: 885311 - RNA, 22 nt, Human
aaguguauauaugacuuauaaa

SEQ ID NO: 885312 - RNA, 22 nt, Human
gagagaaauuaguugguuugcu

SEQ ID NO: 885313 - RNA, 22 nt, Human
acaguuuauugcacagguaacc

SEQ ID NO: 885314 - RNA, 22 nt, Human
ugauuucucauauuguucaaaa

SEQ ID NO: 885315 - RNA, 22 nt, Human
gauggaggagauggcagggugc

SEQ ID NO: 885316 - RNA, 22 nt, Human
aaacacaauguuucuuuguucu

SEQ ID NO: 885317 - RNA, 22 nt, Human
uaauguuacacugcaugguuca

SEQ ID NO: 885318 - RNA, 22 nt, Human
cgugugcgcacaccuguuucca

SEQ ID NO: 885319 - RNA, 22 nt, Human
agagggguuaugcuugacauuu

SEQ ID NO: 885320 - RNA, 22 nt, Human
gccuggcucugaguuucucucc

SEQ ID NO: 885321 - RNA, 17 nt, Human
gcccaggaaggacggcc

SEQ ID NO: 885322 - RNA, 22 nt, Human
ggcccaugcauccugugcagcc

SEQ ID NO: 885323 - RNA, 22 nt, Human
augcauaugcaucuguguacau

SEQ ID NO: 885324 - RNA, 18 nt, Human
caauguuuuagaucucua

SEQ ID NO: 885325 - RNA, 22 nt, Human
gcugggcuuguggccagcuggg

SEQ ID NO: 885326 - RNA, 22 nt, Human
uaugcaugucuuugcacacaaa

SEQ ID NO: 885327 - RNA, 22 nt, Human
ucucagaaggguggugcuggag

SEQ ID NO: 885328 - RNA, 22 nt, Human
auggcugggauuuccuuugcgu

SEQ ID NO: 885329 - RNA, 23 nt, Human
ugccaaaguuuaccuaacacugg

SEQ ID NO: 885330 - RNA, 22 nt, Human
cuuagaauaaaagggggcuaua

SEQ ID NO: 885331 - RNA, 22 nt, Human
uccuuagaccuggcaaaugggg

SEQ ID NO: 885332 - RNA, 22 nt, Human
gggaagugagcuggaaucaagg

SEQ ID NO: 885333 - RNA, 22 nt, Human
agggucagugaugagggagccc

SEQ ID NO: 885334 - RNA, 22 nt, Human
auaaaguagccacuggaaagcu

SEQ ID NO: 885335 - RNA, 22 nt, Human
ggcaggcaacggaccacuaguc

SEQ ID NO: 885336 - RNA, 22 nt, Human
ugaaggcagcaugcacacuagu

SEQ ID NO: 885337 - RNA, 22 nt, Human
uccaagaagucaucuaaacugu

SEQ ID NO: 885338 - RNA, 22 nt, Human
ugucccaggcugaaguacagug

SEQ ID NO: 885339 - RNA, 22 nt, Human
gggagagaagggcauguacacu

SEQ ID NO: 885340 - RNA, 22 nt, Human
uugagaggauggauuagacaaa

SEQ ID NO: 885341 - RNA, 19 nt, Human
ggcaggugugcuuaugcuu

SEQ ID NO: 885342 - RNA, 22 nt, Human
acauuucacuguucacagcagg

SEQ ID NO: 885343 - RNA, 22 nt, Human
uauucacaggcuggagugaugu

SEQ ID NO: 885344 - RNA, 22 nt, Human
ugcuggcuuucugucccuggca

SEQ ID NO: 885345 - RNA, 22 nt, Human
uccugccucuccaugcuaacua

SEQ ID NO: 885346 - RNA, 22 nt, Human
aacuucauuuauaaugucauua

SEQ ID NO: 885347 - RNA, 22 nt, Human
aaaguucuccuggauugugcug

SEQ ID NO: 885348 - RNA, 22 nt, Human
acucuggggugaugucucugag

SEQ ID NO: 885349 - RNA, 22 nt, Human
cuccugaggaaaagcuugguca

SEQ ID NO: 885350 - RNA, 22 nt, Human
uaauuccuuaagcugaagacuu

SEQ ID NO: 885351 - RNA, 22 nt, Human
cugcagcuuaagggagggguug

SEQ ID NO: 885352 - RNA, 22 nt, Human
uggcuucauguaguuugaguug

SEQ ID NO: 885353 - RNA, 22 nt, Human
ccaggcagagggaauagcaagu

SEQ ID NO: 885354 - RNA, 22 nt, Human
uugggggaagaggauagacagu

SEQ ID NO: 885355 - RNA, 22 nt, Human
ccucugaggucauggacuuggc

SEQ ID NO: 885356 - RNA, 22 nt, Human
auaccuguguauccacaagcgu

SEQ ID NO: 885357 - RNA, 22 nt, Human
cagggcacuuaaauugccucgu

SEQ ID NO: 885358 - RNA, 22 nt, Human
uggaggcccacacuggguagau

SEQ ID NO: 885359 - RNA, 22 nt, Human
acaugugaggugugagugauac

SEQ ID NO: 885360 - RNA, 22 nt, Human
ggagucugagcuuguguccugg

SEQ ID NO: 885361 - RNA, 22 nt, Human
uguuaggacuccccagaagcug

SEQ ID NO: 885362 - RNA, 22 nt, Human
agagaacagacagaugcaauga

SEQ ID NO: 885363 - RNA, 21 nt, Human
gauuaaauuuaagcuacaugc

SEQ ID NO: 885364 - RNA, 22 nt, Human
ucuucauguuaguuggguuuuc

SEQ ID NO: 885365 - RNA, 22 nt, Human
cagcccuguccagcagagggug

SEQ ID NO: 885366 - RNA, 22 nt, Human
agugccaggagcaaggagcucc

SEQ ID NO: 885367 - RNA, 22 nt, Human
uggguggcagcuucagcauguu

SEQ ID NO: 885368 - RNA, 22 nt, Human
ugaggcagcuuuuucugugugu

SEQ ID NO: 885369 - RNA, 22 nt, Human
cuucaugagacuccacugccau

SEQ ID NO: 885370 - RNA, 22 nt, Human
agcuuguuuuguugaauacuua

SEQ ID NO: 885371 - RNA, 22 nt, Human
agaggcugauggaguagugucu

SEQ ID NO: 885372 - RNA, 22 nt, Human
agcuucuuggcucagcacuugg

SEQ ID NO: 885373 - RNA, 22 nt, Human
agucaucuccaauauacaaagc

SEQ ID NO: 885374 - RNA, 22 nt, Human
aggaggugcguggugauccccu

SEQ ID NO: 885375 - RNA, 22 nt, Human
gggcugacgaaggccaugugug

SEQ ID NO: 885376 - RNA, 22 nt, Human
ucacugaugcuuaugaaagugu

SEQ ID NO: 885377 - RNA, 22 nt, Human
guuacacaggaaaacauuagca

SEQ ID NO: 885378 - RNA, 22 nt, Human
ggccugccucacagucagcacc

SEQ ID NO: 885379 - RNA, 22 nt, Human
acugugugcccugacgccaggg

SEQ ID NO: 885380 - RNA, 22 nt, Human
caaggacacucccugcugggca

SEQ ID NO: 885381 - RNA, 18 nt, Human
gugugcaguugcaggggu

SEQ ID NO: 885382 - RNA, 22 nt, Human
gagcugaggccagagucuucug

SEQ ID NO: 885383 - RNA, 21 nt, Human
uggauaaaggcacuuuucauc

SEQ ID NO: 885384 - RNA, 22 nt, Human
acacacaacucauuguguaaua

SEQ ID NO: 885385 - RNA, 22 nt, Human
aguggcugcuucugguugcucc

SEQ ID NO: 885386 - RNA, 22 nt, Human
uuccccuuuuugugugcagcug

SEQ ID NO: 885387 - RNA, 22 nt, Human
ugcuucuggguaggccucagga

SEQ ID NO: 885388 - RNA, 19 nt, Human
uggaggagaggaaaaguca

SEQ ID NO: 885389 - RNA, 22 nt, Human
ucauuuugccugccauuugagu

SEQ ID NO: 885390 - RNA, 22 nt, Human
aggaagcucagagaagucuuuu

SEQ ID NO: 885391 - RNA, 22 nt, Human
agauugguuccuugcuuugaaa

SEQ ID NO: 885392 - RNA, 22 nt, Human
uuccuggcucacagcagugggg

SEQ ID NO: 885393 - RNA, 22 nt, Human
aaccaguuguauguccuccagc

SEQ ID NO: 885394 - RNA, 22 nt, Human
ggcuucugaaccaggcccugga

SEQ ID NO: 885395 - RNA, 22 nt, Human
cugcccugaccugccucagagu

SEQ ID NO: 885396 - RNA, 20 nt, Human
ucacagaugaaaguucaaga

SEQ ID NO: 885397 - RNA, 22 nt, Human
cuggggcuucaaugcuucggug

SEQ ID NO: 885398 - RNA, 19 nt, Human
cagagcugcuggccucguc

SEQ ID NO: 885399 - RNA, 22 nt, Human
cauuuguaauacugacuugcag

SEQ ID NO: 885400 - RNA, 22 nt, Human
aaagcuuucuagcuauguucua

SEQ ID NO: 885401 - RNA, 22 nt, Human
aaguuuggggagaauuucauuu

SEQ ID NO: 885402 - RNA, 22 nt, Human
aagucacauucugagguauugg

SEQ ID NO: 885403 - RNA, 22 nt, Human
guuuccugcacacguguuauau

SEQ ID NO: 885404 - RNA, 22 nt, Human
gugaaggauuggagggcaucuu

SEQ ID NO: 885405 - RNA, 22 nt, Human
gggcuccugccuccuggcaccu

SEQ ID NO: 885406 - RNA, 22 nt, Human
ugcacagggagggggccagcuc

SEQ ID NO: 885407 - RNA, 22 nt, Human
ggagcugagacccaguggcuga

SEQ ID NO: 885408 - RNA, 23 nt, Human
ggcucugugcugggccugcagga

SEQ ID NO: 885409 - RNA, 22 nt, Human
agccugagagccaagcugugca

SEQ ID NO: 885410 - RNA, 22 nt, Human
ggaggugggagccuccaguggu

SEQ ID NO: 885411 - RNA, 22 nt, Human
aaggcaguuaccgcaauggagg

SEQ ID NO: 885412 - RNA, 22 nt, Human
agaagauguugcaguugaugcg

SEQ ID NO: 885413 - RNA, 22 nt, Human
ccuggcagguggagguugcagu

SEQ ID NO: 885414 - RNA, 22 nt, Human
guggcagaguucaggcguuugg

SEQ ID NO: 885415 - RNA, 22 nt, Human
uagagcagccuucagagcaguu

SEQ ID NO: 885416 - RNA, 22 nt, Human
agagaaaguccugaucucucua

SEQ ID NO: 885417 - RNA, 22 nt, Human
aguaacauuuagcuucucacug

SEQ ID NO: 885418 - RNA, 22 nt, Human
uauauucauuuuaaagccaucu

SEQ ID NO: 885419 - RNA, 20 nt, Human
auuagcuuggagacaguggc

SEQ ID NO: 885420 - RNA, 23 nt, Human
uuucaacaggcagagaagacuua

SEQ ID NO: 885421 - RNA, 22 nt, Human
aguucugugacaauaucauuac

SEQ ID NO: 885422 - RNA, 22 nt, Human
uugcuuuaaaauggcuaagucu

SEQ ID NO: 885423 - RNA, 22 nt, Human
agcuguguaggaucauaacacg

SEQ ID NO: 885424 - RNA, 22 nt, Human
cucagucugucuugucuguguu

SEQ ID NO: 885425 - RNA, 22 nt, Human
gaugucuuugcuguuauccacu

SEQ ID NO: 885426 - RNA, 22 nt, Human
uggauggccccacuggauccau

SEQ ID NO: 885427 - RNA, 22 nt, Human
auaugauuguccuuagcaaauu

SEQ ID NO: 885428 - RNA, 22 nt, Human
gacccagugggggccugaucug

SEQ ID NO: 885429 - RNA, 22 nt, Human
ggggagugacgcagggccauag

SEQ ID NO: 885430 - RNA, 22 nt, Human
uuccuuggccccaugcccaggg

SEQ ID NO: 885431 - RNA, 22 nt, Human
cauguccuucucauugccucau

SEQ ID NO: 885432 - RNA, 22 nt, Human
cugugcuggagaugggccagag

SEQ ID NO: 885433 - RNA, 22 nt, Human
agccuuggccguaagguaugcu

SEQ ID NO: 885434 - RNA, 22 nt, Human
agcugaaggcuagaacagcugg

SEQ ID NO: 885435 - RNA, 22 nt, Human
gauugaaacauaggcagucgag

SEQ ID NO: 885436 - RNA, 22 nt, Human
ucagacagauuuugacacuugc

SEQ ID NO: 885437 - RNA, 22 nt, Human
acauucuuucucuucaggaaac

SEQ ID NO: 885438 - RNA, 22 nt, Human
ggcccagcugugcuuccagccc

SEQ ID NO: 885439 - RNA, 22 nt, Human
uuagccauguugaagauuuaga

SEQ ID NO: 885440 - RNA, 22 nt, Human
caucagcucuucauucuugauu

SEQ ID NO: 885441 - RNA, 22 nt, Human
guggcucaucuuugggaaguaa

SEQ ID NO: 885442 - RNA, 22 nt, Human
guggcucacgucugucaucuca

SEQ ID NO: 885443 - RNA, 22 nt, Human
agcaccauuuaucaucuaggua

SEQ ID NO: 885444 - RNA, 22 nt, Human
agcagccuuagguauugugauu

SEQ ID NO: 885445 - RNA, 22 nt, Human
ucagugcagggugggagagaga

SEQ ID NO: 885446 - RNA, 22 nt, Human
ugaggcaggagguugagaacug

SEQ ID NO: 885447 - RNA, 22 nt, Human
augaaugcugaauuaugaacug

SEQ ID NO: 885448 - RNA, 22 nt, Human
aaggaagacacagaugaaguga

SEQ ID NO: 885449 - RNA, 22 nt, Human
uucacauaggagcaugguuuuu

SEQ ID NO: 885450 - RNA, 22 nt, Human
guggcagcugguaugcagacag

SEQ ID NO: 885451 - RNA, 22 nt, Human
aagcagagccaccagcuuugga

SEQ ID NO: 885452 - RNA, 22 nt, Human
uuccaccauucaugcuaauauu

SEQ ID NO: 885453 - RNA, 22 nt, Human
gacagacacuguguccucacuu

SEQ ID NO: 885454 - RNA, 22 nt, Human
cugugcccagcucccugacugc

SEQ ID NO: 885455 - RNA, 22 nt, Human
ucacacaugcuaagccagagau

SEQ ID NO: 885456 - RNA, 22 nt, Human
guuucucuguaccucuguccca

SEQ ID NO: 885457 - RNA, 22 nt, Human
aaugucuuuucccuuacuuucc

SEQ ID NO: 885458 - RNA, 22 nt, Human
aaguaucuuggaaaacucuucu

SEQ ID NO: 885459 - RNA, 22 nt, Human
ugggaccuguuacauugaguua

SEQ ID NO: 885460 - RNA, 22 nt, Human
uuucucuggcauuagguauaaa

SEQ ID NO: 885461 - RNA, 22 nt, Human
cggcucagcuagcuuggcccca

SEQ ID NO: 885462 - RNA, 23 nt, Human
cuuuucauugccuuagcgcagag

SEQ ID NO: 885463 - RNA, 22 nt, Human
aaaugcaaggauuuuguuaggc

SEQ ID NO: 885464 - RNA, 22 nt, Human
acaacacagcaaaaccccaucu

SEQ ID NO: 885465 - RNA, 20 nt, Human
uuuuagcacuuguuauggug

SEQ ID NO: 885466 - RNA, 21 nt, Human
ugaauuucgguauggcuauaa

SEQ ID NO: 885467 - RNA, 22 nt, Human
acaggugauucaggcucuggga

SEQ ID NO: 885468 - RNA, 22 nt, Human
cuguccugaaagggagauuggg

SEQ ID NO: 885469 - RNA, 22 nt, Human
auugagaagcuugcagauuuuu

SEQ ID NO: 885470 - RNA, 22 nt, Human
uccaguggaacagauguugccu

SEQ ID NO: 885471 - RNA, 22 nt, Human
uacaaauggguuaaaauauagu

SEQ ID NO: 885472 - RNA, 22 nt, Human
uacaagaaggauggagcccacu

SEQ ID NO: 885473 - RNA, 22 nt, Human
ugaguucucacccauucuucuu

SEQ ID NO: 885474 - RNA, 22 nt, Human
aagagcagccuccaggggugga

SEQ ID NO: 885475 - RNA, 22 nt, Human
uggagcugggaguccugggcug

SEQ ID NO: 885476 - RNA, 22 nt, Human
uuaugacagaaaugaaaagcug

SEQ ID NO: 885477 - RNA, 22 nt, Human
gaggccacgguuuuccuugggg

SEQ ID NO: 885478 - RNA, 22 nt, Human
cugugcagcuggcuuccuggaa

SEQ ID NO: 885479 - RNA, 22 nt, Human
gugcuuuccauccucccugcug

SEQ ID NO: 885480 - RNA, 22 nt, Human
cacaaagcccucccugcgccag

SEQ ID NO: 885481 - RNA, 22 nt, Human
accugaggcuguuagucuaggu

SEQ ID NO: 885482 - RNA, 22 nt, Human
ucagaauuggaacgugaagauu

SEQ ID NO: 885483 - RNA, 22 nt, Human
uucaucuugauggcuuccuaau

SEQ ID NO: 885484 - RNA, 19 nt, Human
ugaggggcucacagucuca

SEQ ID NO: 885485 - RNA, 22 nt, Human
ugggaauacaaguuauucaccu

SEQ ID NO: 885486 - RNA, 22 nt, Human
ccugggauuuccugagcacucu

SEQ ID NO: 885487 - RNA, 22 nt, Human
cuuggugcccagcagguggcug

SEQ ID NO: 885488 - RNA, 22 nt, Human
aaggccuuucuuaucaguagau

SEQ ID NO: 885489 - RNA, 22 nt, Human
aggcagguguuaacccucugag

SEQ ID NO: 885490 - RNA, 22 nt, Human
aggcuuuugcucuggcuccucu

SEQ ID NO: 885491 - RNA, 22 nt, Human
acaugcauguuguguagggggg

SEQ ID NO: 885492 - RNA, 22 nt, Human
ugggaagauggagugacaggca

SEQ ID NO: 885493 - RNA, 22 nt, Human
caggguggaauggaaugcuggc

SEQ ID NO: 885494 - RNA, 22 nt, Human
ugcaggaguuaagugcucuccu

SEQ ID NO: 885495 - RNA, 22 nt, Human
ugucagugugcaccgggaggcc

SEQ ID NO: 885496 - RNA, 22 nt, Human
cacacagcucaggggcacugcc

SEQ ID NO: 885497 - RNA, 23 nt, Human
ccagcuccgugagccucgggcuc

SEQ ID NO: 885498 - RNA, 22 nt, Human
ugggaccugcuccuggaaugag

SEQ ID NO: 885499 - RNA, 20 nt, Human
ugggaguacaaucaugagca

SEQ ID NO: 885500 - RNA, 22 nt, Human
gcagagcugggucuguauccaa

SEQ ID NO: 885501 - RNA, 22 nt, Human
uagaaacagaauaugagugaga

SEQ ID NO: 885502 - RNA, 22 nt, Human
uuugaucaugaagaggauaaac

SEQ ID NO: 885503 - RNA, 22 nt, Human
ugucuuuuaccuaaugagcugg

SEQ ID NO: 885504 - RNA, 22 nt, Human
ggccuggaaugcuuuccuacca

SEQ ID NO: 885505 - RNA, 22 nt, Human
aaugguaaauguaacagcauuc

SEQ ID NO: 885506 - RNA, 22 nt, Human
ggcuguguuucuguuugacauu

SEQ ID NO: 885507 - RNA, 22 nt, Human
gagcagcuggacaggccucccu

SEQ ID NO: 885508 - RNA, 19 nt, Human
gccuggcaguguacaaggc

SEQ ID NO: 885509 - RNA, 22 nt, Human
aggcagcuucugauuagcagcg

SEQ ID NO: 885510 - RNA, 22 nt, Human
ugugaauaccuugaauucauca

SEQ ID NO: 885511 - RNA, 22 nt, Human
aaggcucaauuaacuaagaagu

SEQ ID NO: 885512 - RNA, 22 nt, Human
gacaggggcuuugcaugcuuua

SEQ ID NO: 885513 - RNA, 22 nt, Human
ggccucaguuucuucaacugua

SEQ ID NO: 885514 - RNA, 22 nt, Human
cacuagagguugaugagaggug

SEQ ID NO: 885515 - RNA, 20 nt, Human
auuuguuucuacucucugac

SEQ ID NO: 885516 - RNA, 22 nt, Human
aagugcaguggcgugaucuugg

SEQ ID NO: 885517 - RNA, 22 nt, Human
gcucugccagacacuguggcca

SEQ ID NO: 885518 - RNA, 22 nt, Human
gggagguguucugccaacgcgg

SEQ ID NO: 885519 - RNA, 22 nt, Human
ugcaggcuguaaucugaggcua

SEQ ID NO: 885520 - RNA, 22 nt, Human
ucuucauacaauuucagacauc

SEQ ID NO: 885521 - RNA, 22 nt, Human
ugagguucaguucuuggccaca

SEQ ID NO: 885522 - RNA, 22 nt, Human
caccagcuuacagucucacccc

SEQ ID NO: 885523 - RNA, 22 nt, Human
gccugucucuuggaacuuggua

SEQ ID NO: 885524 - RNA, 22 nt, Human
ugcugugggcaguacauaagcu

SEQ ID NO: 885525 - RNA, 22 nt, Human
gugcuuaauacaugucaauaac

SEQ ID NO: 885526 - RNA, 22 nt, Human
ugcaaauaagcuauuauggaau

SEQ ID NO: 885527 - RNA, 22 nt, Human
ugagaaaagguugagaugauaa

SEQ ID NO: 885528 - RNA, 22 nt, Human
ccuggcucugcgugcagcuccg

SEQ ID NO: 885529 - RNA, 22 nt, Human
uuucauugacaguugggggaaa

SEQ ID NO: 885530 - RNA, 22 nt, Human
uucuccagacccuccugcagac

SEQ ID NO: 885531 - RNA, 22 nt, Human
gcuuucugaugagcuuaagaaa

SEQ ID NO: 885532 - RNA, 22 nt, Human
gcuucagacugugcuucuguug

SEQ ID NO: 885533 - RNA, 22 nt, Human
gugugcaugugcuugcacagau

SEQ ID NO: 885534 - RNA, 22 nt, Human
acagggugacuuugugacagau

SEQ ID NO: 885535 - RNA, 22 nt, Human
aagcugccaccagcccagggca

SEQ ID NO: 885536 - RNA, 22 nt, Human
aaaucagucccucuuggaauuu

SEQ ID NO: 885537 - RNA, 22 nt, Human
acagugaaaaguagcuaacaca

SEQ ID NO: 885538 - RNA, 22 nt, Human
ggcagcucugcuaauugagccu

SEQ ID NO: 885539 - RNA, 22 nt, Human
aggucacagcuuucucgugagg

SEQ ID NO: 885540 - RNA, 22 nt, Human
uauuuugaaagucuguuuugaa

SEQ ID NO: 885541 - RNA, 22 nt, Human
uccuggggcucuuugaugugau

SEQ ID NO: 885542 - RNA, 22 nt, Human
uuacaagaugggaaagggaagu

SEQ ID NO: 885543 - RNA, 22 nt, Human
uguucuaaauuugcauggucca

SEQ ID NO: 885544 - RNA, 22 nt, Human
gcagagugggagcccagggcug

SEQ ID NO: 885545 - RNA, 22 nt, Human
ugcagggcaguuuguuucggca

SEQ ID NO: 885546 - RNA, 22 nt, Human
ccuagcagaagcugcaaugccu

SEQ ID NO: 885547 - RNA, 22 nt, Human
uucuggaaaugcacaacuaauu

SEQ ID NO: 885548 - RNA, 22 nt, Human
gcagccagggcuaagcugggga

SEQ ID NO: 885549 - RNA, 22 nt, Human
caggggcucugagauugucuaa

SEQ ID NO: 885550 - RNA, 22 nt, Human
ucugccuguugcuagaauguca

SEQ ID NO: 885551 - RNA, 22 nt, Human
cccuccagccauggacccaggu

SEQ ID NO: 885552 - RNA, 22 nt, Human
ugcagagaaaccaguggaggac

SEQ ID NO: 885553 - RNA, 22 nt, Human
cucugugucugaagcccuauuu

SEQ ID NO: 885554 - RNA, 22 nt, Human
gugaugucagcaagaauaggaa

SEQ ID NO: 885555 - RNA, 22 nt, Human
aggcaggcucaggcccaugcuu

SEQ ID NO: 885556 - RNA, 22 nt, Human
gcagcagcggggccccugcgcg

SEQ ID NO: 885557 - RNA, 22 nt, Human
gaacauuauuguacaaaugucu

SEQ ID NO: 885558 - RNA, 22 nt, Human
ucuuuuaaaagcccugcugucu

SEQ ID NO: 885559 - RNA, 22 nt, Human
aauggagacugacacaaagaua

SEQ ID NO: 885560 - RNA, 22 nt, Human
cacagcuggugacagagcccag

SEQ ID NO: 885561 - RNA, 22 nt, Human
auagacauagccguaauuuauu

SEQ ID NO: 885562 - RNA, 22 nt, Human
gccuuggcugaugugcgaauga

SEQ ID NO: 885563 - RNA, 20 nt, Human
ugguugaauuuuuagugacc

SEQ ID NO: 885564 - RNA, 22 nt, Human
gccuggcaggccugggccagca

SEQ ID NO: 885565 - RNA, 22 nt, Human
acaggacuguggaaggaucucu

SEQ ID NO: 885566 - RNA, 22 nt, Human
ugugucaggagauagcaaaggg

SEQ ID NO: 885567 - RNA, 22 nt, Human
uaacauuacagacaccuugugu

SEQ ID NO: 885568 - RNA, 22 nt, Human
cagggccuggagcugggccugc

SEQ ID NO: 885569 - RNA, 22 nt, Human
uuuuccuucugauacuccauuu

SEQ ID NO: 885570 - RNA, 22 nt, Human
gccaggcuaagaaaggugugau

SEQ ID NO: 885571 - RNA, 22 nt, Human
ugggaccugcucuuggaaugag

SEQ ID NO: 885572 - RNA, 23 nt, Human
ucagugugcaagaauggagaagc

SEQ ID NO: 885573 - RNA, 22 nt, Human
gagcugaguuaccuccagauca

SEQ ID NO: 885574 - RNA, 22 nt, Human
ugagauggggagggcugcagaa

SEQ ID NO: 885575 - RNA, 22 nt, Human
auuggaacugauugaugauaau

SEQ ID NO: 885576 - RNA, 22 nt, Human
aaagaguuuccauugacauuuc

SEQ ID NO: 885577 - RNA, 22 nt, Human
caagguuugaaaacgccauggc

SEQ ID NO: 885578 - RNA, 22 nt, Human
uaguacaguggcauucaaacuu

SEQ ID NO: 885579 - RNA, 22 nt, Human
gaacaaggauucccaaagaaga

SEQ ID NO: 885580 - RNA, 22 nt, Human
uuuuagaaucagguugucuggg

SEQ ID NO: 885581 - RNA, 22 nt, Human
ggagcauguggggugagcaggg

SEQ ID NO: 885582 - RNA, 22 nt, Human
gugccgcgacgcagucggugcc

SEQ ID NO: 885583 - RNA, 22 nt, Human
agcauuugauauguuuaaaaag

SEQ ID NO: 885584 - RNA, 22 nt, Human
gaagccacuauagauauucuaa

SEQ ID NO: 885585 - RNA, 22 nt, Human
cagcagccagacaagauacauc

SEQ ID NO: 885586 - RNA, 22 nt, Human
uaagaguaagugauuaagaaga

SEQ ID NO: 885587 - RNA, 22 nt, Human
uagggggcuuugcugcuugaca

SEQ ID NO: 885588 - RNA, 22 nt, Human
augugucuggcauggaaagugu

SEQ ID NO: 885589 - RNA, 22 nt, Human
ccugggcaggaugggcccggug

SEQ ID NO: 885590 - RNA, 22 nt, Human
uuccuucagcaaguccugagca

SEQ ID NO: 885591 - RNA, 22 nt, Human
gugcuuaaggcagucugucaaa

SEQ ID NO: 885592 - RNA, 22 nt, Human
aagggcaggcacccacccucac

SEQ ID NO: 885593 - RNA, 22 nt, Human
aggaaccagagguugagcaacu

SEQ ID NO: 885594 - RNA, 22 nt, Human
aggccaagauuuuggaucagcu

SEQ ID NO: 885595 - RNA, 22 nt, Human
ucugccacuguggccaugggag

SEQ ID NO: 885596 - RNA, 22 nt, Human
uuugcuuaaaguucuuucuggu

SEQ ID NO: 885597 - RNA, 22 nt, Human
cauaaauuguacccauuccaac

SEQ ID NO: 885598 - RNA, 22 nt, Human
uuuuggugcccugguucccacc

SEQ ID NO: 885599 - RNA, 20 nt, Human
aguggggagucaggagugcc

SEQ ID NO: 885600 - RNA, 22 nt, Human
aagcaaauauuucuagagacug

SEQ ID NO: 885601 - RNA, 20 nt, Human
aaguugcagagaguugucuu

SEQ ID NO: 885602 - RNA, 22 nt, Human
uccagaguuguaaguguugaca

SEQ ID NO: 885603 - RNA, 22 nt, Human
cagccacucucagacaguccca

SEQ ID NO: 885604 - RNA, 22 nt, Human
ggccagagucuauaugcagaca

SEQ ID NO: 885605 - RNA, 22 nt, Human
aacaguaguggucaauaugcca

SEQ ID NO: 885606 - RNA, 22 nt, Human
auaacaaguauuuauugagcau

SEQ ID NO: 885607 - RNA, 22 nt, Human
acuagauuuuggccauuauaca

SEQ ID NO: 885608 - RNA, 22 nt, Human
cuuuggugucauguuucugcgg

SEQ ID NO: 885609 - RNA, 17 nt, Human
ucaaauguacagaacua

SEQ ID NO: 885610 - RNA, 21 nt, Human
ugggcucuuuaacccaggcac

SEQ ID NO: 885611 - RNA, 22 nt, Human
aaggccagccugagagcuaaca

SEQ ID NO: 885612 - RNA, 22 nt, Human
aacaugaugacaaagguauauu

SEQ ID NO: 885613 - RNA, 22 nt, Human
cuuccucuguggccagagugua

SEQ ID NO: 885614 - RNA, 22 nt, Human
uacagagaguacagcauccaca

SEQ ID NO: 885615 - RNA, 22 nt, Human
agucauaucugaggaggaaucc

SEQ ID NO: 885616 - RNA, 22 nt, Human
ucuuuaugcacauaaagaaacu

SEQ ID NO: 885617 - RNA, 22 nt, Human
gcagggccuuagcagcggcugc

SEQ ID NO: 885618 - RNA, 21 nt, Human
uggagcugaauuuuuggcauc

SEQ ID NO: 885619 - RNA, 22 nt, Human
ucuacagguggggccuggcaau

SEQ ID NO: 885620 - RNA, 23 nt, Human
gugacccaaggaccuuccagaau

SEQ ID NO: 885621 - RNA, 22 nt, Human
gggcccugcgacucgcggcgga

SEQ ID NO: 885622 - RNA, 22 nt, Human
gaaugaaaaccuuggcucaaau

SEQ ID NO: 885623 - RNA, 22 nt, Human
gagggggcucugccaaccuguc

SEQ ID NO: 885624 - RNA, 20 nt, Human
agggccuguugcaagcguuu

SEQ ID NO: 885625 - RNA, 22 nt, Human
uaaauagagaaucagcuuggag

SEQ ID NO: 885626 - RNA, 22 nt, Human
uuguacagaaaaaauucuuggu

SEQ ID NO: 885627 - RNA, 22 nt, Human
cugccagggcccuacucaguuu

SEQ ID NO: 885628 - RNA, 18 nt, Human
caggcccugucuggccuc

SEQ ID NO: 885629 - RNA, 22 nt, Human
uaacaaaguauuguuuguguau

SEQ ID NO: 885630 - RNA, 21 nt, Human
aaucaaaugucauauccccag

SEQ ID NO: 885631 - RNA, 22 nt, Human
gucucagaccacccucuuuggc

SEQ ID NO: 885632 - RNA, 22 nt, Human
ugaaugaccuuugaggauggaa

SEQ ID NO: 885633 - RNA, 22 nt, Human
uacauuuucuaggggaccaaga

SEQ ID NO: 885634 - RNA, 23 nt, Human
aaaguucuagaaugacuuccugu

SEQ ID NO: 885635 - RNA, 22 nt, Human
acagaauuugcuugggcaaugg

SEQ ID NO: 885636 - RNA, 22 nt, Human
gaggcgagaagcuggagauggu

SEQ ID NO: 885637 - RNA, 20 nt, Human
cuggccagaacgccuacaca

SEQ ID NO: 885638 - RNA, 22 nt, Human
ccuucugcucccuggccagggc

SEQ ID NO: 885639 - RNA, 22 nt, Human
uacaguaaagcugcuaugaauu

SEQ ID NO: 885640 - RNA, 22 nt, Human
uauuaucauuaacuguugaauu

SEQ ID NO: 885641 - RNA, 22 nt, Human
augccaaauucuacuuucagca

SEQ ID NO: 885642 - RNA, 22 nt, Human
aaaagggaaagcagaaugacuu

SEQ ID NO: 885643 - RNA, 23 nt, Human
ucuuuucaaugguucuuuaugug

SEQ ID NO: 885644 - RNA, 21 nt, Human
cacaugcaugcacagguugua

SEQ ID NO: 885645 - RNA, 22 nt, Human
acaauguaggauauguacuugu

SEQ ID NO: 885646 - RNA, 22 nt, Human
uuagaaguacauuuagaacaua

SEQ ID NO: 885647 - RNA, 22 nt, Human
gcaggcaauuuuggaaggucag

SEQ ID NO: 885648 - RNA, 22 nt, Human
gcuccuggucuggagcuucaag

SEQ ID NO: 885649 - RNA, 22 nt, Human
acagagucuuacguggugauaa

SEQ ID NO: 885650 - RNA, 19 nt, Human
cucuggagucauugcuccc

SEQ ID NO: 885651 - RNA, 22 nt, Human
cugggcuuguguuagcugacaa

SEQ ID NO: 885652 - RNA, 22 nt, Human
cagacagagcucacaagucuuu

SEQ ID NO: 885653 - RNA, 22 nt, Human
gaauuucuggacccuuugagaa

SEQ ID NO: 885654 - RNA, 22 nt, Human
acacagagcuggaacugcuuca

SEQ ID NO: 885655 - RNA, 22 nt, Human
gagagcugcauucucagacaca

SEQ ID NO: 885656 - RNA, 22 nt, Human
ugcugcagauugcagauuaacu

SEQ ID NO: 885657 - RNA, 22 nt, Human
gaauuucagagguaacaucauc

SEQ ID NO: 885658 - RNA, 20 nt, Human
uacccagugguggaugguaa

SEQ ID NO: 885659 - RNA, 22 nt, Human
gagcaacacgcaguaguauacg

SEQ ID NO: 885660 - RNA, 22 nt, Human
gagccacagugguggcccacgu

SEQ ID NO: 885661 - RNA, 22 nt, Human
cuaaagauaaggaaaguauccu

SEQ ID NO: 885662 - RNA, 22 nt, Human
gugucuuaggguugcacagagu

SEQ ID NO: 885663 - RNA, 22 nt, Human
uugaaugauuaaagucaucuga

SEQ ID NO: 885664 - RNA, 22 nt, Human
agcagccguauuauggugguuu

SEQ ID NO: 885665 - RNA, 22 nt, Human
gcucagagaaguuaaggaauuu

SEQ ID NO: 885666 - RNA, 19 nt, Human
ucacaaggccucuuagucu

SEQ ID NO: 885667 - RNA, 22 nt, Human
aaaggcuggggacugaggaagg

SEQ ID NO: 885668 - RNA, 22 nt, Human
aacaaguucuaccucacaaggu

SEQ ID NO: 885669 - RNA, 22 nt, Human
ucuccagguagauaugucagga

SEQ ID NO: 885670 - RNA, 23 nt, Human
caaguuauucugacacucaucaa

SEQ ID NO: 885671 - RNA, 22 nt, Human
aagggcagagggaaucccacau

SEQ ID NO: 885672 - RNA, 18 nt, Human
uggcuucugaacaacugc

SEQ ID NO: 885673 - RNA, 22 nt, Human
cccauuuuggaacgaguagcca

SEQ ID NO: 885674 - RNA, 22 nt, Human
aggcagccauccaggaggcuca

SEQ ID NO: 885675 - RNA, 22 nt, Human
cagcuggcccuuugguagccuu

SEQ ID NO: 885676 - RNA, 22 nt, Human
gugugcaggccacaggccaggg

SEQ ID NO: 885677 - RNA, 22 nt, Human
acacuacaacagcagaggugag

SEQ ID NO: 885678 - RNA, 22 nt, Human
gcucuaugucgaaagccaguua

SEQ ID NO: 885679 - RNA, 22 nt, Human
aauggacaaacuugggaaguau

SEQ ID NO: 885680 - RNA, 22 nt, Human
auccauuuuuucagaaugcucu

SEQ ID NO: 885681 - RNA, 22 nt, Human
acugaucuguuuucagauucug

SEQ ID NO: 885682 - RNA, 22 nt, Human
gcuccaggcagcauaguggaug

SEQ ID NO: 885683 - RNA, 22 nt, Human
aaaccuuucucagugcuaaaau

SEQ ID NO: 885684 - RNA, 22 nt, Human
aagacagagggaagcaaugaug

SEQ ID NO: 885685 - RNA, 22 nt, Human
augcuccucgagugucucacag

SEQ ID NO: 885686 - RNA, 22 nt, Human
caaguuuagucauggugguagu

SEQ ID NO: 885687 - RNA, 22 nt, Human
cugccacuuucacccagugcuc

SEQ ID NO: 885688 - RNA, 22 nt, Human
ugcugcaguuauugaaacuaug

SEQ ID NO: 885689 - RNA, 22 nt, Human
acaaaaaccguggauucagcau

SEQ ID NO: 885690 - RNA, 22 nt, Human
uuuacagcuucuauacuaugug

SEQ ID NO: 885691 - RNA, 23 nt, Human
aggcugagcucucccagcuucag

SEQ ID NO: 885692 - RNA, 22 nt, Human
ggaaggcuuuguagaagugcca

SEQ ID NO: 885693 - RNA, 20 nt, Human
aggguggcaaguuagugaca

SEQ ID NO: 885694 - RNA, 22 nt, Human
agaagccauaguaucucagggu

SEQ ID NO: 885695 - RNA, 20 nt, Human
auacacaugcagacagaugc

SEQ ID NO: 885696 - RNA, 17 nt, Human
gccaaaggguuccaauc

SEQ ID NO: 885697 - RNA, 22 nt, Human
gaggggucacaugggcuggcuu

SEQ ID NO: 885698 - RNA, 22 nt, Human
uugacagaaauguauuugcaug

SEQ ID NO: 885699 - RNA, 22 nt, Human
acauaaugaaaugcagaaauca

SEQ ID NO: 885700 - RNA, 22 nt, Human
uagggcagauucgguggaguuu

SEQ ID NO: 885701 - RNA, 22 nt, Human
cauguaaaccauugugagcauc

SEQ ID NO: 885702 - RNA, 22 nt, Human
uuugcauauuaauaucugcgcu

SEQ ID NO: 885703 - RNA, 22 nt, Human
aauacuuugccaaguucgaaga

SEQ ID NO: 885704 - RNA, 21 nt, Human
gggcucagcgcucggcuccuc

SEQ ID NO: 885705 - RNA, 22 nt, Human
ccuucaugauggaaaggguuca

SEQ ID NO: 885706 - RNA, 22 nt, Human
aaugcuuuuugcgaaaugugca

SEQ ID NO: 885707 - RNA, 22 nt, Human
acaguaaggguaaauaagaaca

SEQ ID NO: 885708 - RNA, 22 nt, Human
uuuguguguguauaggaaagga

SEQ ID NO: 885709 - RNA, 22 nt, Human
ucuuauuauuguuguaaaagca

SEQ ID NO: 885710 - RNA, 22 nt, Human
uauuuccugcauggugauguaa

SEQ ID NO: 885711 - RNA, 22 nt, Human
uaagacacaguccgcacucucu

SEQ ID NO: 885712 - RNA, 22 nt, Human
uucuggauauggauuuugguga

SEQ ID NO: 885713 - RNA, 22 nt, Human
aagacauuuauuugaaucaauu

SEQ ID NO: 885714 - RNA, 22 nt, Human
uuuccuugcacauugguuucca

SEQ ID NO: 885715 - RNA, 22 nt, Human
gaauccaggguuguuugagcua

SEQ ID NO: 885716 - RNA, 22 nt, Human
uaagcaggugccuucugugacc

SEQ ID NO: 885717 - RNA, 23 nt, Human
aaugcuggaaauucaggcaugau

SEQ ID NO: 885718 - RNA, 21 nt, Human
aggcuguccuuugccagcccu

SEQ ID NO: 885719 - RNA, 22 nt, Human
ccugcagguccccggaugcgca

SEQ ID NO: 885720 - RNA, 22 nt, Human
gaaaggcucacuuuagaucaug

SEQ ID NO: 885721 - RNA, 22 nt, Human
gggaauaggacaaaugaaggag

SEQ ID NO: 885722 - RNA, 20 nt, Human
gggaguggugguagccugug

SEQ ID NO: 885723 - RNA, 22 nt, Human
gcugggaaugauuuuggagagg

SEQ ID NO: 885724 - RNA, 22 nt, Human
aaagacauugaagaaggacuua

SEQ ID NO: 885725 - RNA, 22 nt, Human
uaguuacagugcauagcaagau

SEQ ID NO: 885726 - RNA, 23 nt, Human
cuauuucucauaguucaggucuu

SEQ ID NO: 885727 - RNA, 22 nt, Human
aggggaagagcccuuuacaugg

SEQ ID NO: 885728 - RNA, 22 nt, Human
agccagggaaggauaacaagaa

SEQ ID NO: 885729 - RNA, 22 nt, Human
gcucugcugcuuacuagauggu

SEQ ID NO: 885730 - RNA, 22 nt, Human
uggcuuucgcuauagagcacgg

SEQ ID NO: 885731 - RNA, 22 nt, Human
aagauucuuauuagguaauuuu

SEQ ID NO: 885732 - RNA, 22 nt, Human
ugguggcuucugaggauggcga

SEQ ID NO: 885733 - RNA, 22 nt, Human
uucaauucugcucugaucuuag

SEQ ID NO: 885734 - RNA, 22 nt, Human
cccagaggaggcaaagcucugu

SEQ ID NO: 885735 - RNA, 22 nt, Human
uucuuaacucaaauauauaucc

SEQ ID NO: 885736 - RNA, 22 nt, Human
cacagugcaugaugggcagaag

SEQ ID NO: 885737 - RNA, 22 nt, Human
uuauacauguuuauaagguuga

SEQ ID NO: 885738 - RNA, 22 nt, Human
cagucagggacaccagcuagga

SEQ ID NO: 885739 - RNA, 22 nt, Human
uuugguuugaaugagcauaaga

SEQ ID NO: 885740 - RNA, 22 nt, Human
acuacaaaagcacuggguauua

SEQ ID NO: 885741 - RNA, 22 nt, Human
ugccuugguuuccccaucugua

SEQ ID NO: 885742 - RNA, 22 nt, Human
ggacccuuggcuucugcagauu

SEQ ID NO: 885743 - RNA, 16 nt, Human
cucuuuggcuuccaag

SEQ ID NO: 885744 - RNA, 19 nt, Human
agagaaagaauugagucua

SEQ ID NO: 885745 - RNA, 23 nt, Human
aggcccagguauguuuguuuugg

SEQ ID NO: 885746 - RNA, 22 nt, Human
aguucugccuauauagaaacuc

SEQ ID NO: 885747 - RNA, 22 nt, Human
uucugagcaagcuggacagucu

SEQ ID NO: 885748 - RNA, 22 nt, Human
uccugcagcugcagaccugggg

SEQ ID NO: 885749 - RNA, 22 nt, Human
gcacaaagaugaauacagaaug

SEQ ID NO: 885750 - RNA, 22 nt, Human
ugcuuucuccugucugaaagau

SEQ ID NO: 885751 - RNA, 22 nt, Human
guggaaggugcuagaacaagga

SEQ ID NO: 885752 - RNA, 22 nt, Human
guagcuauuuaugauacucaug

SEQ ID NO: 885753 - RNA, 22 nt, Human
gaaaucaaacccuuuucugaua

SEQ ID NO: 885754 - RNA, 22 nt, Human
ugacaacaaggauccugccugg

SEQ ID NO: 885755 - RNA, 22 nt, Human
cuggagaguaaucucuguguua

SEQ ID NO: 885756 - RNA, 19 nt, Human
aggguggcaaaggagggug

SEQ ID NO: 885757 - RNA, 22 nt, Human
cucuccauucccuacaguuuuc

SEQ ID NO: 885758 - RNA, 22 nt, Human
agcaauauuuaaagguuugcaa

SEQ ID NO: 885759 - RNA, 22 nt, Human
uugucucuggaaggaaaaagca

SEQ ID NO: 885760 - RNA, 22 nt, Human
ucuguguguugucaggaggauu

SEQ ID NO: 885761 - RNA, 22 nt, Human
ugagcuguagcagaugcuguug

SEQ ID NO: 885762 - RNA, 22 nt, Human
aguggcugauguaggcaguggg

SEQ ID NO: 885763 - RNA, 22 nt, Human
ucugugggggugucuuaaccua

SEQ ID NO: 885764 - RNA, 22 nt, Human
guaaagaaguuuuugaaugcau

SEQ ID NO: 885765 - RNA, 22 nt, Human
acuguucugcauguaccugagg

SEQ ID NO: 885766 - RNA, 22 nt, Human
agcaguuuggaaaauacuagaa

SEQ ID NO: 885767 - RNA, 22 nt, Human
cacucugagaaguacaagcucc

SEQ ID NO: 885768 - RNA, 22 nt, Human
caguucagcuagaagaaacaaa

SEQ ID NO: 885769 - RNA, 22 nt, Human
ucacauuuucuacuacuguacg

SEQ ID NO: 885770 - RNA, 21 nt, Human
cgacaguguauagauuagagc

SEQ ID NO: 885771 - RNA, 21 nt, Human
ucucugagacacucuggagcc

SEQ ID NO: 885772 - RNA, 22 nt, Human
ugcaggagaaaguacggagcgu

SEQ ID NO: 885773 - RNA, 18 nt, Human
agaagccugccucaaugc

SEQ ID NO: 885774 - RNA, 22 nt, Human
agugucugaaccugcaguggga

SEQ ID NO: 885775 - RNA, 22 nt, Human
gagaauuucccagucugugcug

SEQ ID NO: 885776 - RNA, 22 nt, Human
cagugaggaugauaauuaaggu

SEQ ID NO: 885777 - RNA, 22 nt, Human
augaaacaaaccucuauggagu

SEQ ID NO: 885778 - RNA, 22 nt, Human
aaagaagguagggcuggugacu

SEQ ID NO: 885779 - RNA, 22 nt, Human
auugcacagcugaauauuuugg

SEQ ID NO: 885780 - RNA, 22 nt, Human
uuagaagugggccuauaguccu

SEQ ID NO: 885781 - RNA, 18 nt, Human
gcagauggagauucaggg

SEQ ID NO: 885782 - RNA, 22 nt, Human
ccagccuggagggcaguggugg

SEQ ID NO: 885783 - RNA, 22 nt, Human
uucugggcagagcuggagcugc

SEQ ID NO: 885784 - RNA, 22 nt, Human
uuugaagacauauuguuacaua

SEQ ID NO: 885785 - RNA, 22 nt, Human
gguauaguauuauuugaaagag

SEQ ID NO: 885786 - RNA, 19 nt, Human
ucccaggaaccuuuuauuu

SEQ ID NO: 885787 - RNA, 22 nt, Human
uuccagcuaacucacaucccuu

SEQ ID NO: 885788 - RNA, 22 nt, Human
aaauauagugacacuuauaguc

SEQ ID NO: 885789 - RNA, 21 nt, Human
agccagcaacacagcaucucc

SEQ ID NO: 885790 - RNA, 23 nt, Human
aucaccagcggaagcugcagacc

SEQ ID NO: 885791 - RNA, 22 nt, Human
uucuucaguguagcaacuguau

SEQ ID NO: 885792 - RNA, 22 nt, Human
uggcagauguggcauagagcau

SEQ ID NO: 885793 - RNA, 22 nt, Human
gccagcagguugucaaggagcu

SEQ ID NO: 885794 - RNA, 22 nt, Human
gagguuuuaaguugaaggggga

SEQ ID NO: 885795 - RNA, 22 nt, Human
aucuacaaugucuggcugcacu

SEQ ID NO: 885796 - RNA, 22 nt, Human
uuguguacuguugguugauauu

SEQ ID NO: 885797 - RNA, 22 nt, Human
ucacauucucagcaucuauaca

SEQ ID NO: 885798 - RNA, 22 nt, Human
ugucugaaucucgguuuccuca

SEQ ID NO: 885799 - RNA, 22 nt, Human
ccaggcucugucuggucagaag

SEQ ID NO: 885800 - RNA, 22 nt, Human
acacaucagaaauaugaaugag

SEQ ID NO: 885801 - RNA, 22 nt, Human
uacauugaacuaugaguucagu

SEQ ID NO: 885802 - RNA, 19 nt, Human
aagcauggugccucaccuc

SEQ ID NO: 885803 - RNA, 22 nt, Human
ugauucaacuuucuugaaugca

SEQ ID NO: 885804 - RNA, 22 nt, Human
aucuguguaugaaaguauaacu

SEQ ID NO: 885805 - RNA, 22 nt, Human
ucuuaaaggcacauagugucua

SEQ ID NO: 885806 - RNA, 22 nt, Human
uagacugugagcuccuugaggg

SEQ ID NO: 885807 - RNA, 22 nt, Human
caacaugccagacauuaguuug

SEQ ID NO: 885808 - RNA, 21 nt, Human
aguucauacugaguaacaaaa

SEQ ID NO: 885809 - RNA, 22 nt, Human
uagcugugaaacagcagaagag

SEQ ID NO: 885810 - RNA, 22 nt, Human
ugggagcucugagccugcugug

SEQ ID NO: 885811 - RNA, 22 nt, Human
ugaucagacaguuaugugcaug

SEQ ID NO: 885812 - RNA, 22 nt, Human
uuggaaggaagaaccgcgguag

SEQ ID NO: 885813 - RNA, 22 nt, Human
auacaucuuccuuuuaaaaugc

SEQ ID NO: 885814 - RNA, 22 nt, Human
ugagacaggagaggccccuccu

SEQ ID NO: 885815 - RNA, 22 nt, Human
caggcuggcaaugcgucaagca

SEQ ID NO: 885816 - RNA, 22 nt, Human
acaaggcaguacaaugaugaca

SEQ ID NO: 885817 - RNA, 22 nt, Human
acuggguguaaaggacuuaagc

SEQ ID NO: 885818 - RNA, 22 nt, Human
gagcccagggcaggcaaggcag

SEQ ID NO: 885819 - RNA, 22 nt, Human
aggugcagugaaggaaaaggaa

SEQ ID NO: 885820 - RNA, 22 nt, Human
gagaggcuuaagggcugugaag

SEQ ID NO: 885821 - RNA, 23 nt, Human
aggugcagcccuggaccugcccc

SEQ ID NO: 885822 - RNA, 19 nt, Human
aggugacaugugacagccu

SEQ ID NO: 885823 - RNA, 22 nt, Human
guccccuggcccccagcgucgg

SEQ ID NO: 885824 - RNA, 22 nt, Human
ccaggggcucucagggugugug

SEQ ID NO: 885825 - RNA, 17 nt, Human
gcugcagcgguaggcag

SEQ ID NO: 885826 - RNA, 22 nt, Human
ugagcuaggugugcagauauga

SEQ ID NO: 885827 - RNA, 22 nt, Human
uucuuucugaauacaguugagu

SEQ ID NO: 885828 - RNA, 20 nt, Human
ccuggcuuugcaucugugau

SEQ ID NO: 885829 - RNA, 22 nt, Human
ccaggucugucuucuuagcuca

SEQ ID NO: 885830 - RNA, 22 nt, Human
uagacauuuggcaugguuuuca

SEQ ID NO: 885831 - RNA, 22 nt, Human
auauacaguauguacugugguu

SEQ ID NO: 885832 - RNA, 22 nt, Human
gagcaagacuacaggcagauga

SEQ ID NO: 885833 - RNA, 22 nt, Human
cugaagccacgauagcuuccua

SEQ ID NO: 885834 - RNA, 22 nt, Human
aucaggaaaaauugugaaaggg

SEQ ID NO: 885835 - RNA, 22 nt, Human
acauucuuauaagagugaggca

SEQ ID NO: 885836 - RNA, 22 nt, Human
gcagaugcuguggugauagaag

SEQ ID NO: 885837 - RNA, 22 nt, Human
agaggcaggagguugacuugag

SEQ ID NO: 885838 - RNA, 22 nt, Human
augaggcaugugaggagaaggg

SEQ ID NO: 885839 - RNA, 22 nt, Human
ucuuggcaauuugaucucaguu

SEQ ID NO: 885840 - RNA, 22 nt, Human
gcagacagcauguugggcuauu

SEQ ID NO: 885841 - RNA, 20 nt, Human
gugcuucagaagccauugcu

SEQ ID NO: 885842 - RNA, 22 nt, Human
guucagugauucucgguguuca

SEQ ID NO: 885843 - RNA, 22 nt, Human
aggucaccauggcaugcuccac

SEQ ID NO: 885844 - RNA, 21 nt, Human
ucagggcagugggagguuccu

SEQ ID NO: 885845 - RNA, 22 nt, Human
auuugcauuuagaaagaucacu

SEQ ID NO: 885846 - RNA, 22 nt, Human
uuuguguuguacuucugugcau

SEQ ID NO: 885847 - RNA, 19 nt, Human
agccagcagcguagcaucu

SEQ ID NO: 885848 - RNA, 22 nt, Human
uccaggccaggguaagaggaga

SEQ ID NO: 885849 - RNA, 22 nt, Human
ggcagcuccaaaaggaaacacu

SEQ ID NO: 885850 - RNA, 22 nt, Human
auucaucuaugacucuaaugug

SEQ ID NO: 885851 - RNA, 22 nt, Human
cccugccugugggcaucaacau

SEQ ID NO: 885852 - RNA, 22 nt, Human
gcugccucaggcaccuccuggc

SEQ ID NO: 885853 - RNA, 22 nt, Human
uagaguccugugugcucugugg

SEQ ID NO: 885854 - RNA, 22 nt, Human
gccaggcaguucaaguacacca

SEQ ID NO: 885855 - RNA, 22 nt, Human
guuuucuuccugcaauuggcau

SEQ ID NO: 885856 - RNA, 22 nt, Human
gugccugguuuggggaguguuc

SEQ ID NO: 885857 - RNA, 22 nt, Human
ucuguggcacgauugcacugca

SEQ ID NO: 885858 - RNA, 22 nt, Human
gccacagccucugggaaaacuc

SEQ ID NO: 885859 - RNA, 22 nt, Human
cagcagcuguuuacggaacacc

SEQ ID NO: 885860 - RNA, 22 nt, Human
auagacauuuugcauucaagca

SEQ ID NO: 885861 - RNA, 22 nt, Human
agagcuggacgucugagcccua

SEQ ID NO: 885862 - RNA, 22 nt, Human
uugcucugauuagguggaaaca

SEQ ID NO: 885863 - RNA, 23 nt, Human
gccuccuagcaguaaacauguua

SEQ ID NO: 885864 - RNA, 22 nt, Human
ggccccagcuguggugaauaga

SEQ ID NO: 885865 - RNA, 22 nt, Human
cuccuccaguccuccaaggaca

SEQ ID NO: 885866 - RNA, 22 nt, Human
gcaggguggauggcagggccag

SEQ ID NO: 885867 - RNA, 22 nt, Human
ccagcucaucucagugaaaugc

SEQ ID NO: 885868 - RNA, 22 nt, Human
acuguaaaguuacgaucaaguu

SEQ ID NO: 885869 - RNA, 22 nt, Human
cugcacagcugggcaagauaua

SEQ ID NO: 885870 - RNA, 22 nt, Human
uggcacugaccccaggccugug

SEQ ID NO: 885871 - RNA, 22 nt, Human
ucauuucuccgaccugcugucc

SEQ ID NO: 885872 - RNA, 22 nt, Human
agaaggaguguacaggucaugc

SEQ ID NO: 885873 - RNA, 22 nt, Human
gcagggcacaaggacgcacagg

SEQ ID NO: 885874 - RNA, 22 nt, Human
auacaaaggaacacaggcaugu

SEQ ID NO: 885875 - RNA, 22 nt, Human
aacagugagaagguggacagga

SEQ ID NO: 885876 - RNA, 22 nt, Human
aaucagccauuuuuccaaggag

SEQ ID NO: 885877 - RNA, 22 nt, Human
uuuucauuuacauuagggaaga

SEQ ID NO: 885878 - RNA, 22 nt, Human
aaggcagcccuggcucagccug

SEQ ID NO: 885879 - RNA, 22 nt, Human
cuuucauaauucagcacauuga

SEQ ID NO: 885880 - RNA, 22 nt, Human
gggcugagcuaagcuggguuga

SEQ ID NO: 885881 - RNA, 22 nt, Human
uuauuaaucuuaucuuuggaaa

SEQ ID NO: 885882 - RNA, 22 nt, Human
acuuugugcccaacagaaagaa

SEQ ID NO: 885883 - RNA, 21 nt, Human
cauugagauaggagagauugu

SEQ ID NO: 885884 - RNA, 22 nt, Human
gagcugaggcucaggcuggcgu

SEQ ID NO: 885885 - RNA, 22 nt, Human
aaggccagauucacuuuacaau

SEQ ID NO: 885886 - RNA, 22 nt, Human
aguggcuguuccaggugaggac

SEQ ID NO: 885887 - RNA, 22 nt, Human
uauuugaaggcauacauuuuga

SEQ ID NO: 885888 - RNA, 20 nt, Human
gcaauguugguuccugucac

SEQ ID NO: 885889 - RNA, 22 nt, Human
ugcuggccaacaaggcuccaag

SEQ ID NO: 885890 - RNA, 22 nt, Human
uuuagugccugggccaguucca

SEQ ID NO: 885891 - RNA, 22 nt, Human
caugcaaacacguaaacauuca

SEQ ID NO: 885892 - RNA, 22 nt, Human
ucacucuguuuuacucacuguu

SEQ ID NO: 885893 - RNA, 22 nt, Human
gcugggcagccccuacagagag

SEQ ID NO: 885894 - RNA, 21 nt, Human
agacucuggggaucucugucc

SEQ ID NO: 885895 - RNA, 22 nt, Human
agaaugcauuuuguguagcuau

SEQ ID NO: 885896 - RNA, 22 nt, Human
caagaggcaaauugucuagaag

SEQ ID NO: 885897 - RNA, 22 nt, Human
gcugggagaggcagcuuucgga

SEQ ID NO: 885898 - RNA, 22 nt, Human
gagaaggagcucaaauauggcu

SEQ ID NO: 885899 - RNA, 22 nt, Human
cuuuuauuuugaauuaagggcu

SEQ ID NO: 885900 - RNA, 22 nt, Human
uuucaugugcaauuagcaauau

SEQ ID NO: 885901 - RNA, 22 nt, Human
ugggggagaguuuagaugauuu

SEQ ID NO: 885902 - RNA, 22 nt, Human
ugggacuucaaugcaaugaggu

SEQ ID NO: 885903 - RNA, 22 nt, Human
uauguaaguugcaaaugaagga

SEQ ID NO: 885904 - RNA, 22 nt, Human
augucuuuuaugauuacgggau

SEQ ID NO: 885905 - RNA, 22 nt, Human
uacaugcacaugaacaugugug

SEQ ID NO: 885906 - RNA, 22 nt, Human
gucagcgugcucagccuauuau

SEQ ID NO: 885907 - RNA, 22 nt, Human
augaaugaaugagaguagguca

SEQ ID NO: 885908 - RNA, 22 nt, Human
gugaaaaaugauuuguuaacug

SEQ ID NO: 885909 - RNA, 22 nt, Human
ccuggcagcaggugggcccgug

SEQ ID NO: 885910 - RNA, 22 nt, Human
agcuggcuuugagcugggaggu

SEQ ID NO: 885911 - RNA, 22 nt, Human
augacaggaauaacuaugaugg

SEQ ID NO: 885912 - RNA, 22 nt, Human
ucccagcugagauugagcaagg

SEQ ID NO: 885913 - RNA, 22 nt, Human
aggcaggcuggucugaagagug

SEQ ID NO: 885914 - RNA, 22 nt, Human
cacagcuucugucugacccaug

SEQ ID NO: 885915 - RNA, 22 nt, Human
cagcagagggagccauugaaau

SEQ ID NO: 885916 - RNA, 22 nt, Human
cagagcaccagugggagacaag

SEQ ID NO: 885917 - RNA, 22 nt, Human
cugcagggccauggguucuaua

SEQ ID NO: 885918 - RNA, 17 nt, Human
ugcugccaagucccaac

SEQ ID NO: 885919 - RNA, 22 nt, Human
guguacaguaagugaaucuagg

SEQ ID NO: 885920 - RNA, 22 nt, Human
agcaucuuuaggaagagaaaga

SEQ ID NO: 885921 - RNA, 22 nt, Human
aguucuauuucuaacauguuau

SEQ ID NO: 885922 - RNA, 22 nt, Human
gggcuucucccuaaggacucug

SEQ ID NO: 885923 - RNA, 22 nt, Human
gaaggggaguggcuagugugug

SEQ ID NO: 885924 - RNA, 22 nt, Human
caggcccacgaggcacacagag

SEQ ID NO: 885925 - RNA, 22 nt, Human
gagggugggcuuuguuccucca

SEQ ID NO: 885926 - RNA, 19 nt, Human
acccauuuucaguauuggc

SEQ ID NO: 885927 - RNA, 22 nt, Human
ugcaugaacggaggguaagcug

SEQ ID NO: 885928 - RNA, 22 nt, Human
uuacuagccaugugugagaaga

SEQ ID NO: 885929 - RNA, 21 nt, Human
gcuccuggugcugcguggcgc

SEQ ID NO: 885930 - RNA, 22 nt, Human
uggcucagaggggaagugguuu

SEQ ID NO: 885931 - RNA, 22 nt, Human
ccauuuuucauaaacuauccaa

SEQ ID NO: 885932 - RNA, 22 nt, Human
gaucaacaacuuuugaauagcu

SEQ ID NO: 885933 - RNA, 22 nt, Human
caacuauauagaaauugauugu

SEQ ID NO: 885934 - RNA, 22 nt, Human
uggcuggagaacuuggggaucu

SEQ ID NO: 885935 - RNA, 22 nt, Human
ucugggucacugugggagggca

SEQ ID NO: 885936 - RNA, 22 nt, Human
guggucaguuaggcaaucaugu

SEQ ID NO: 885937 - RNA, 22 nt, Human
caauuucuggaacuaauucuga

SEQ ID NO: 885938 - RNA, 22 nt, Human
gcugggcugcgucggggaagcc

SEQ ID NO: 885939 - RNA, 22 nt, Human
caggcugugggagucaggaccc

SEQ ID NO: 885940 - RNA, 22 nt, Human
uguauuuugugaggaucacucu

SEQ ID NO: 885941 - RNA, 22 nt, Human
ucacagaacacaaaugccacuu

SEQ ID NO: 885942 - RNA, 22 nt, Human
uauuagauuuguuucuguagau

SEQ ID NO: 885943 - RNA, 22 nt, Human
ugagagagcgccugggaucauu

SEQ ID NO: 885944 - RNA, 19 nt, Human
agcagcagaagugugccuu

SEQ ID NO: 885945 - RNA, 22 nt, Human
auauuccaguuauaucaaauca

SEQ ID NO: 885946 - RNA, 22 nt, Human
ucucucuuuuuaaucauguaau

SEQ ID NO: 885947 - RNA, 22 nt, Human
aucuguuguuuguuugcuaaag

SEQ ID NO: 885948 - RNA, 23 nt, Human
acauagaacagaauauauuugug

SEQ ID NO: 885949 - RNA, 22 nt, Human
cagcuucuguccuagaaacugg

SEQ ID NO: 885950 - RNA, 22 nt, Human
agaaggaaggaagcauucuguu

SEQ ID NO: 885951 - RNA, 22 nt, Human
agcaauaagggauccucuauaa

SEQ ID NO: 885952 - RNA, 21 nt, Human
cagcagugugucugagcuaga

SEQ ID NO: 885953 - RNA, 22 nt, Human
ucagggaggugucugccagaga

SEQ ID NO: 885954 - RNA, 22 nt, Human
ggucccugcccaccugggagcu

SEQ ID NO: 885955 - RNA, 22 nt, Human
gaggacgugccaggcgaucucc

SEQ ID NO: 885956 - RNA, 22 nt, Human
cagugagggcauucagugcugg

SEQ ID NO: 885957 - RNA, 23 nt, Human
aaagacucuccagagggaaguag

SEQ ID NO: 885958 - RNA, 22 nt, Human
gacuacaggugugugccaccau

SEQ ID NO: 885959 - RNA, 22 nt, Human
auauugcauggcuuugcugguu

SEQ ID NO: 885960 - RNA, 22 nt, Human
gcagguggggcugcuaccagaa

SEQ ID NO: 885961 - RNA, 22 nt, Human
cagaacaguaccuagcacauag

SEQ ID NO: 885962 - RNA, 19 nt, Human
ucaguaacuuuuaagagga

SEQ ID NO: 885963 - RNA, 22 nt, Human
uguaguguuucucagauauuug

SEQ ID NO: 885964 - RNA, 22 nt, Human
gaaauauucuugucuuguuuuc

SEQ ID NO: 885965 - RNA, 21 nt, Human
acaguucugccggcaucuuuc

SEQ ID NO: 885966 - RNA, 22 nt, Human
gccagccacguuagacuggccc

SEQ ID NO: 885967 - RNA, 22 nt, Human
ccuggcagcagcacaugccuuc

SEQ ID NO: 885968 - RNA, 22 nt, Human
accaaaaauuguggggcugaau

SEQ ID NO: 885969 - RNA, 22 nt, Human
cucuuuuucaccucugucagcg

SEQ ID NO: 885970 - RNA, 22 nt, Human
auuuaauuuucucaacagugcu

SEQ ID NO: 885971 - RNA, 22 nt, Human
uucccacagagauuacauugaa

SEQ ID NO: 885972 - RNA, 22 nt, Human
ccagccagaugauaagcucuau

SEQ ID NO: 885973 - RNA, 23 nt, Human
acuuuaagaguauaugacuuccc

SEQ ID NO: 885974 - RNA, 20 nt, Human
cccugagacgacugagcucc

SEQ ID NO: 885975 - RNA, 22 nt, Human
cagcaacuggucauugcucucc

SEQ ID NO: 885976 - RNA, 22 nt, Human
auauuuguuuggcagaguucag

SEQ ID NO: 885977 - RNA, 22 nt, Human
auuucauguugaucuuucgagg

SEQ ID NO: 885978 - RNA, 22 nt, Human
cagaagcacuaggaggaaacgu

SEQ ID NO: 885979 - RNA, 22 nt, Human
gcucuagaucauaggucauuau

SEQ ID NO: 885980 - RNA, 22 nt, Human
uccaugguuucagucuggcugg

SEQ ID NO: 885981 - RNA, 22 nt, Human
ccugagcugacucuccuuucag

SEQ ID NO: 885982 - RNA, 23 nt, Human
gcagagguuauguuuuuuaggcu

SEQ ID NO: 885983 - RNA, 22 nt, Human
uggcuugguaaggaccagcagg

SEQ ID NO: 885984 - RNA, 22 nt, Human
guuuuaugagaccucaggaaua

SEQ ID NO: 885985 - RNA, 22 nt, Human
augucaacaggccuuuaaacau

SEQ ID NO: 885986 - RNA, 22 nt, Human
ugcaaggcugcagagggugcua

SEQ ID NO: 885987 - RNA, 22 nt, Human
cuccagagucacacugccuggg

SEQ ID NO: 885988 - RNA, 22 nt, Human
gagaugggcgagaagguggacu

SEQ ID NO: 885989 - RNA, 20 nt, Human
gccugugucuucucugcugu

SEQ ID NO: 885990 - RNA, 22 nt, Human
aaauuauuauaggcagagcuga

SEQ ID NO: 885991 - RNA, 22 nt, Human
aguuuacaaaguuucacuguuc

SEQ ID NO: 885992 - RNA, 22 nt, Human
aaggcaccauaggcaaauccag

SEQ ID NO: 885993 - RNA, 22 nt, Human
cagcagcaucaggucugugguu

SEQ ID NO: 885994 - RNA, 22 nt, Human
agugauaaugugguaauuauuu

SEQ ID NO: 885995 - RNA, 22 nt, Human
ugucauuccuucaauguagaua

SEQ ID NO: 885996 - RNA, 22 nt, Human
gugcagagagguggagggacuu

SEQ ID NO: 885997 - RNA, 22 nt, Human
aaaguaagaccaagugaucauu

SEQ ID NO: 885998 - RNA, 22 nt, Human
gaagccaggggccugacaggca

SEQ ID NO: 885999 - RNA, 22 nt, Human
uguuagaaguuaaucacuaauu

SEQ ID NO: 886000 - RNA, 22 nt, Human
cucccuucaggagaggcucaca

SEQ ID NO: 886001 - RNA, 21 nt, Human
acuuuaugaccuacccuuuuu

SEQ ID NO: 886002 - RNA, 22 nt, Human
acugaguguaggacuuugaguu

SEQ ID NO: 886003 - RNA, 18 nt, Human
aaagaaggauuggagagc

SEQ ID NO: 886004 - RNA, 22 nt, Human
ggagggagagugacccuaccaa

SEQ ID NO: 886005 - RNA, 22 nt, Human
uuguucagaaguuuaaagaauu

SEQ ID NO: 886006 - RNA, 22 nt, Human
uggguccucgucuuccaaggca

SEQ ID NO: 886007 - RNA, 22 nt, Human
acaaaggcagagaauucaacau

SEQ ID NO: 886008 - RNA, 22 nt, Human
agagcuuugggacauuugcuag

SEQ ID NO: 886009 - RNA, 20 nt, Human
cgauucaguggaguuugaaa

SEQ ID NO: 886010 - RNA, 22 nt, Human
caacagaagguguacuacugaa

SEQ ID NO: 886011 - RNA, 22 nt, Human
auaauuuggcuuccuagaugua

SEQ ID NO: 886012 - RNA, 19 nt, Human
cuccaggauggcugggcga

SEQ ID NO: 886013 - RNA, 22 nt, Human
cuagaauugcauucuaugaaua

SEQ ID NO: 886014 - RNA, 22 nt, Human
gcuggccugagggccgaggcuc

SEQ ID NO: 886015 - RNA, 22 nt, Human
cggcucagacuucccaagaaca

SEQ ID NO: 886016 - RNA, 22 nt, Human
aucauuugaacagaauuuguuu

SEQ ID NO: 886017 - RNA, 22 nt, Human
gcucucuggguggugggcaaca

SEQ ID NO: 886018 - RNA, 22 nt, Human
uauuccuggguuccagcccaga

SEQ ID NO: 886019 - RNA, 22 nt, Human
caggcuucagggaacgcagucu

SEQ ID NO: 886020 - RNA, 22 nt, Human
aucaggaaagaguggaacucug

SEQ ID NO: 886021 - RNA, 22 nt, Human
ugcagcuuugcucuggucccca

SEQ ID NO: 886022 - RNA, 22 nt, Human
ugguuugucuaaaugaguaaua

SEQ ID NO: 886023 - RNA, 21 nt, Human
acuaagagaucucugucucau

SEQ ID NO: 886024 - RNA, 22 nt, Human
auugcagguuguagcccauuag

SEQ ID NO: 886025 - RNA, 22 nt, Human
agcugcagugaauucgcuaacu

SEQ ID NO: 886026 - RNA, 22 nt, Human
ucagcugcugugguauguacau

SEQ ID NO: 886027 - RNA, 22 nt, Human
aaacaguauuaucaauauauuu

SEQ ID NO: 886028 - RNA, 22 nt, Human
uuguuuuaacgacucagcuugu

SEQ ID NO: 886029 - RNA, 22 nt, Human
ccagauuuguaggggcucuuac

SEQ ID NO: 886030 - RNA, 23 nt, Human
gcuaagaaccuggguacgcaacu

SEQ ID NO: 886031 - RNA, 22 nt, Human
cugggccuuuaccuacggaguu

SEQ ID NO: 886032 - RNA, 17 nt, Human
cuggggaugugggacuc

SEQ ID NO: 886033 - RNA, 23 nt, Human
ugcuggcuaagaaucugcauuuu

SEQ ID NO: 886034 - RNA, 22 nt, Human
ucaguguguuacuuucuccuau

SEQ ID NO: 886035 - RNA, 18 nt, Human
cuauuacaaugcaguggu

SEQ ID NO: 886036 - RNA, 22 nt, Human
cuggcuuuuccuaaacugggaa

SEQ ID NO: 886037 - RNA, 22 nt, Human
uaaauuauggcuggcagagcag

SEQ ID NO: 886038 - RNA, 22 nt, Human
cagggggcagcguagaaaauga

SEQ ID NO: 886039 - RNA, 22 nt, Human
cagguauuuucaaggcuugugu

SEQ ID NO: 886040 - RNA, 22 nt, Human
ucugucucuuuguucugugagu

SEQ ID NO: 886041 - RNA, 22 nt, Human
uuugugcuaaugcuagauuacu

SEQ ID NO: 886042 - RNA, 22 nt, Human
uagcaugucagucgccacacgu

SEQ ID NO: 886043 - RNA, 22 nt, Human
augcugagcagagcugacaugc

SEQ ID NO: 886044 - RNA, 22 nt, Human
augguggugaagagcacaguga

SEQ ID NO: 886045 - RNA, 18 nt, Human
uuuaggaauuccaagaga

SEQ ID NO: 886046 - RNA, 22 nt, Human
cuggcuuuuagugugaagacuu

SEQ ID NO: 886047 - RNA, 22 nt, Human
ccaagguuuauuuugauacauu

SEQ ID NO: 886048 - RNA, 22 nt, Human
ucauuguuaauuguaugaucug

SEQ ID NO: 886049 - RNA, 22 nt, Human
ccucuccuugcacccgucccgc

SEQ ID NO: 886050 - RNA, 22 nt, Human
caggcccaucugcucccaggcu

SEQ ID NO: 886051 - RNA, 22 nt, Human
aaauucucaagugauccuguug

SEQ ID NO: 886052 - RNA, 22 nt, Human
aucagagcugcauuuuagagcc

SEQ ID NO: 886053 - RNA, 22 nt, Human
cagagccuggcgaugucaugga

SEQ ID NO: 886054 - RNA, 22 nt, Human
gcagagguuggauuggugacuu

SEQ ID NO: 886055 - RNA, 22 nt, Human
uggccaagaaugauaugugaag

SEQ ID NO: 886056 - RNA, 22 nt, Human
cugcccugugguuguggguucu

SEQ ID NO: 886057 - RNA, 22 nt, Human
cccugagagugagugccaccuu

SEQ ID NO: 886058 - RNA, 22 nt, Human
aauuaggagaaaacuguugucu

SEQ ID NO: 886059 - RNA, 22 nt, Human
ggaugacaaggaaagcaaacca

SEQ ID NO: 886060 - RNA, 22 nt, Human
gagugggggguccgucucagug

SEQ ID NO: 886061 - RNA, 22 nt, Human
guuuaugaggaaaaguuaugau

SEQ ID NO: 886062 - RNA, 22 nt, Human
caagcagagacuagauagcugu

SEQ ID NO: 886063 - RNA, 22 nt, Human
agauaacauguugcagauucug

SEQ ID NO: 886064 - RNA, 22 nt, Human
cuggugaccuugccccagguca

SEQ ID NO: 886065 - RNA, 22 nt, Human
aaugcaaacuucuuguuacuug

SEQ ID NO: 886066 - RNA, 22 nt, Human
gaggcucuuuaaaucuuuugga

SEQ ID NO: 886067 - RNA, 22 nt, Human
auggcccacucuggucccggca

SEQ ID NO: 886068 - RNA, 22 nt, Human
uggagguggggcucaggaaucu

SEQ ID NO: 886069 - RNA, 22 nt, Human
gggcgagggcgaaagcgagagc

SEQ ID NO: 886070 - RNA, 22 nt, Human
cugggaagaagggacaacagcg

SEQ ID NO: 886071 - RNA, 22 nt, Human
agguaaugcauauaaagugcuu

SEQ ID NO: 886072 - RNA, 22 nt, Human
ucaacccuuccuccauauuucc

SEQ ID NO: 886073 - RNA, 22 nt, Human
uuuccagucaccacuagaucag

SEQ ID NO: 886074 - RNA, 22 nt, Human
ggcacagggagccgcaguugca

SEQ ID NO: 886075 - RNA, 22 nt, Human
aauucaaugguuuuuaggauau

SEQ ID NO: 886076 - RNA, 22 nt, Human
uccuaacuccacuagccuuggg

SEQ ID NO: 886077 - RNA, 22 nt, Human
uuucuucucacccaggacagag

SEQ ID NO: 886078 - RNA, 22 nt, Human
ucuauaaaacucaagagcaauu

SEQ ID NO: 886079 - RNA, 19 nt, Human
uguuuucaagugggauuau

SEQ ID NO: 886080 - RNA, 19 nt, Human
uccuucagucagaucuggg

SEQ ID NO: 886081 - RNA, 22 nt, Human
aaagcauuguuucaagauuaac

SEQ ID NO: 886082 - RNA, 20 nt, Human
uuuuccuuguugccgcugcu

SEQ ID NO: 886083 - RNA, 22 nt, Human
uuugauucuaaguucugucaac

SEQ ID NO: 886084 - RNA, 22 nt, Human
ggagaggguguggaaaguuauc

SEQ ID NO: 886085 - RNA, 22 nt, Human
cccagcaugcacgcugacacuc

SEQ ID NO: 886086 - RNA, 22 nt, Human
ucaaucaaugguuuccaaauuu

SEQ ID NO: 886087 - RNA, 19 nt, Human
uucucaguucaggagaaga

SEQ ID NO: 886088 - RNA, 18 nt, Human
gccuguucccuacuaucc

SEQ ID NO: 886089 - RNA, 22 nt, Human
gcccuccaugagacacagugua

SEQ ID NO: 886090 - RNA, 22 nt, Human
uggucagcguuugucagagcag

SEQ ID NO: 886091 - RNA, 22 nt, Human
gugucgugcuugccauggguac

SEQ ID NO: 886092 - RNA, 22 nt, Human
ucuaucugaggaggugacauuu

SEQ ID NO: 886093 - RNA, 22 nt, Human
aggcagauuuaggagaaaagaa

SEQ ID NO: 886094 - RNA, 22 nt, Human
ggcagccauacucagaccuggg

SEQ ID NO: 886095 - RNA, 22 nt, Human
ugcuggcucccaggagccgcug

SEQ ID NO: 886096 - RNA, 22 nt, Human
auaaauucucugauguauagua

SEQ ID NO: 886097 - RNA, 22 nt, Human
agcauuagaagaaaugauuaua

SEQ ID NO: 886098 - RNA, 22 nt, Human
aggacuuuaacauauuaacugu

SEQ ID NO: 886099 - RNA, 23 nt, Human
ugggcaucuccucugugccaggc

SEQ ID NO: 886100 - RNA, 21 nt, Human
uggaaggcugcucugccaggg

SEQ ID NO: 886101 - RNA, 22 nt, Human
ucccagccuggacccugccagu

SEQ ID NO: 886102 - RNA, 22 nt, Human
agaggcucagaggccugguccu

SEQ ID NO: 886103 - RNA, 22 nt, Human
auaugggggggcgugcagagga

SEQ ID NO: 886104 - RNA, 22 nt, Human
ugugccuacugauagagccaag

SEQ ID NO: 886105 - RNA, 21 nt, Human
ucucuccucaagcucgacccc

SEQ ID NO: 886106 - RNA, 22 nt, Human
agcugcaaguguugccuccuac

SEQ ID NO: 886107 - RNA, 22 nt, Human
uccuuaaaugaacucugcauga

SEQ ID NO: 886108 - RNA, 22 nt, Human
ccagaggaugcuggucagccuc

SEQ ID NO: 886109 - RNA, 22 nt, Human
gcuggaggauggacuggaagaa

SEQ ID NO: 886110 - RNA, 22 nt, Human
ugcauccuuccauggguuucaa

SEQ ID NO: 886111 - RNA, 22 nt, Human
ccuuggcaaaccagggcagcug

SEQ ID NO: 886112 - RNA, 22 nt, Human
auaggaaaucgcuauuaaccua

SEQ ID NO: 886113 - RNA, 22 nt, Human
aaacauggccauucagacugug

SEQ ID NO: 886114 - RNA, 22 nt, Human
uuuuacaggucauagguauagu

SEQ ID NO: 886115 - RNA, 22 nt, Human
agguggggaggagugucucuuu

SEQ ID NO: 886116 - RNA, 22 nt, Human
aaugcauguuuccucucagcag

SEQ ID NO: 886117 - RNA, 22 nt, Human
uacuguuucaagcccucacaga

SEQ ID NO: 886118 - RNA, 20 nt, Human
aggauagcaugcaagugaga

SEQ ID NO: 886119 - RNA, 22 nt, Human
cagagccuaaaacgacuccacu

SEQ ID NO: 886120 - RNA, 22 nt, Human
aagcaacuggcucauugucuca

SEQ ID NO: 886121 - RNA, 22 nt, Human
aagaggacaguauucaauauga

SEQ ID NO: 886122 - RNA, 22 nt, Human
uuguuucugaguuuucauguau

SEQ ID NO: 886123 - RNA, 22 nt, Human
ccaggcaaagcccaugcaagag

SEQ ID NO: 886124 - RNA, 22 nt, Human
ugaggcaguucuuacuuguauu

SEQ ID NO: 886125 - RNA, 22 nt, Human
ccuacaguuauauucuugauug

SEQ ID NO: 886126 - RNA, 19 nt, Human
ggcagcuggacgcuguuca

SEQ ID NO: 886127 - RNA, 22 nt, Human
auaugugugaugcauggacuaa

SEQ ID NO: 886128 - RNA, 22 nt, Human
cccaggcagccccagaagcuug

SEQ ID NO: 886129 - RNA, 22 nt, Human
aguauacaaauaaauguguaau

SEQ ID NO: 886130 - RNA, 22 nt, Human
guagauuccaguggucuguguc

SEQ ID NO: 886131 - RNA, 22 nt, Human
uggagcugagaguuaauaagga

SEQ ID NO: 886132 - RNA, 22 nt, Human
ggacagcacagcucuugacaac

SEQ ID NO: 886133 - RNA, 22 nt, Human
agacacagugcugggugcugag

SEQ ID NO: 886134 - RNA, 23 nt, Human
cccagcuuucccacugccgagag

SEQ ID NO: 886135 - RNA, 22 nt, Human
ucauuacagagauauaaucuac

SEQ ID NO: 886136 - RNA, 22 nt, Human
uuucauguacuuuuuugauaga

SEQ ID NO: 886137 - RNA, 22 nt, Human
uccaggcccauggagcagagcu

SEQ ID NO: 886138 - RNA, 22 nt, Human
ggcagauggaaggacagacgga

SEQ ID NO: 886139 - RNA, 22 nt, Human
aaugagcuagaccugcuuccuc

SEQ ID NO: 886140 - RNA, 22 nt, Human
ugucucuugaguuuguuuuaau

SEQ ID NO: 886141 - RNA, 22 nt, Human
ugaaguuugaacuguguugcug

SEQ ID NO: 886142 - RNA, 22 nt, Human
cugccagugaaauugugucagu

SEQ ID NO: 886143 - RNA, 22 nt, Human
aggcuaagugggugucagggcc

SEQ ID NO: 886144 - RNA, 22 nt, Human
uggcucagugcauucacaguaa

SEQ ID NO: 886145 - RNA, 22 nt, Human
ucuggcuccugaguccaugcuc

SEQ ID NO: 886146 - RNA, 22 nt, Human
aggaagcccuugucauuucugu

SEQ ID NO: 886147 - RNA, 22 nt, Human
ccccagggucaguguguggagg

SEQ ID NO: 886148 - RNA, 19 nt, Human
uguacaaggauuaugcagg

SEQ ID NO: 886149 - RNA, 22 nt, Human
ugcagcucaagcuggugaggug

SEQ ID NO: 886150 - RNA, 22 nt, Human
gcuggcuuccuucugcagcuag

SEQ ID NO: 886151 - RNA, 22 nt, Human
caguuugcauaacaagagauuc

SEQ ID NO: 886152 - RNA, 22 nt, Human
ggcagucagugugguucauaaa

SEQ ID NO: 886153 - RNA, 22 nt, Human
ccacaggcggaguggcgggcag

SEQ ID NO: 886154 - RNA, 22 nt, Human
uccugcagagccgcccucaggu

SEQ ID NO: 886155 - RNA, 22 nt, Human
uagcugccaaaagggugggcua

SEQ ID NO: 886156 - RNA, 22 nt, Human
aagaugcagcuuccacuuuugc

SEQ ID NO: 886157 - RNA, 21 nt, Human
ggucacacagcugguaaauag

SEQ ID NO: 886158 - RNA, 22 nt, Human
uagaaacagagagauaugcccc

SEQ ID NO: 886159 - RNA, 22 nt, Human
aagcuuauaucagaacaaugcu

SEQ ID NO: 886160 - RNA, 22 nt, Human
cagcauggggaucacuguaggc

SEQ ID NO: 886161 - RNA, 22 nt, Human
auaugcuuacagcuuaaaaucc

SEQ ID NO: 886162 - RNA, 22 nt, Human
aaaguacuugaugcuacagagu

SEQ ID NO: 886163 - RNA, 22 nt, Human
aguaaagcauugucuucagagu

SEQ ID NO: 886164 - RNA, 22 nt, Human
cuacaguaugaaaccuuuacuc

SEQ ID NO: 886165 - RNA, 22 nt, Human
aguucucuaugaagucuauugu

SEQ ID NO: 886166 - RNA, 22 nt, Human
uggcuggcaguaggcuaguggc

SEQ ID NO: 886167 - RNA, 22 nt, Human
auuucccuccagggaaagcuua

SEQ ID NO: 886168 - RNA, 22 nt, Human
uuuguccucuccauguacaaua

SEQ ID NO: 886169 - RNA, 22 nt, Human
acagaggccucggccugcccag

SEQ ID NO: 886170 - RNA, 22 nt, Human
gcaagacaauggagcauaaacg

SEQ ID NO: 886171 - RNA, 17 nt, Human
cuccuggcagccucagg

SEQ ID NO: 886172 - RNA, 22 nt, Human
ggcacugauuccauucaugaag

SEQ ID NO: 886173 - RNA, 22 nt, Human
cucagaggguugaaggugcucu

SEQ ID NO: 886174 - RNA, 22 nt, Human
gccugugguuugauuaagcauu

SEQ ID NO: 886175 - RNA, 23 nt, Human
cagcaggagggugccugggcugc

SEQ ID NO: 886176 - RNA, 22 nt, Human
uucaaguuaacucuccuuguac

SEQ ID NO: 886177 - RNA, 22 nt, Human
uucugaaagccaauucauugaa

SEQ ID NO: 886178 - RNA, 21 nt, Human
aaagaacaggcagauguucuu

SEQ ID NO: 886179 - RNA, 22 nt, Human
uaccauuguaccaagguaauuu

SEQ ID NO: 886180 - RNA, 22 nt, Human
ugagcccuaagggucaagcagg

SEQ ID NO: 886181 - RNA, 22 nt, Human
ccccaaagccucagccugccug

SEQ ID NO: 886182 - RNA, 22 nt, Human
cagcccagugcacgcccguuuc

SEQ ID NO: 886183 - RNA, 22 nt, Human
acuuuccuuauggauggggaaa

SEQ ID NO: 886184 - RNA, 22 nt, Human
gcaggcagguggcaucuuguga

SEQ ID NO: 886185 - RNA, 22 nt, Human
agggaagccaagccuuagagaa

SEQ ID NO: 886186 - RNA, 22 nt, Human
auauucuuccaaaacaucauuu

SEQ ID NO: 886187 - RNA, 22 nt, Human
uggcacagacagaucaggaguc

SEQ ID NO: 886188 - RNA, 22 nt, Human
uauauuaacacccacuugccuc

SEQ ID NO: 886189 - RNA, 22 nt, Human
uggcagugguaccggcucucag

SEQ ID NO: 886190 - RNA, 21 nt, Human
ccugugcuccacacagggucc

SEQ ID NO: 886191 - RNA, 22 nt, Human
aauauacuauacuacuuucugg

SEQ ID NO: 886192 - RNA, 22 nt, Human
auauuuugaaguuaauaaugug

SEQ ID NO: 886193 - RNA, 22 nt, Human
ugggcugcagagcccggccuuc

SEQ ID NO: 886194 - RNA, 21 nt, Human
ucuggaccaccuuguaaagcu

SEQ ID NO: 886195 - RNA, 22 nt, Human
auucucucuucugcugcccgug

SEQ ID NO: 886196 - RNA, 22 nt, Human
agggcugagacuaaggccagau

SEQ ID NO: 886197 - RNA, 22 nt, Human
acauucugucaacagugagcag

SEQ ID NO: 886198 - RNA, 22 nt, Human
cagcaggauaugguggagagag

SEQ ID NO: 886199 - RNA, 22 nt, Human
agcuuuauuugucauucacggc

SEQ ID NO: 886200 - RNA, 17 nt, Human
gggcagggacuccuggg

SEQ ID NO: 886201 - RNA, 22 nt, Human
uauaauccauucauugauuucu

SEQ ID NO: 886202 - RNA, 22 nt, Human
uggcaguuucaugugauucaac

SEQ ID NO: 886203 - RNA, 22 nt, Human
aaaggcucuaacaaggagagag

SEQ ID NO: 886204 - RNA, 22 nt, Human
gcccaggagguggaggugcagu

SEQ ID NO: 886205 - RNA, 18 nt, Human
aguuuuuaggaagaaaug

SEQ ID NO: 886206 - RNA, 22 nt, Human
acaguguuuaaaaaucagaucu

SEQ ID NO: 886207 - RNA, 22 nt, Human
aguccuuugggaaaaaugacua

SEQ ID NO: 886208 - RNA, 22 nt, Human
cuccugggcuaugucugcuugg

SEQ ID NO: 886209 - RNA, 22 nt, Human
ucuacaaagaagaauuaauguc

SEQ ID NO: 886210 - RNA, 22 nt, Human
uauguuuacgcugguagaauua

SEQ ID NO: 886211 - RNA, 22 nt, Human
ucacaguuuccauaggucagca

SEQ ID NO: 886212 - RNA, 16 nt, Human
ccugggcucuguugga

SEQ ID NO: 886213 - RNA, 22 nt, Human
uagauaucagaaauagaauuua

SEQ ID NO: 886214 - RNA, 22 nt, Human
aguuugaagaaggaucuaugaa

SEQ ID NO: 886215 - RNA, 22 nt, Human
ugucccagacacaguaugcgcu

SEQ ID NO: 886216 - RNA, 22 nt, Human
cauucuaucuuggacuggaucu

SEQ ID NO: 886217 - RNA, 22 nt, Human
uacacacaugcauuugccuuau

SEQ ID NO: 886218 - RNA, 19 nt, Human
cgccuggcaggcccugcgc

SEQ ID NO: 886219 - RNA, 22 nt, Human
caagagcugcaaauagcgugac

SEQ ID NO: 886220 - RNA, 22 nt, Human
uaaaaguuuuaguuguacauaa

SEQ ID NO: 886221 - RNA, 22 nt, Human
uuuguacaccuaccuaauacag

SEQ ID NO: 886222 - RNA, 22 nt, Human
ugguucauagccucacaggaua

SEQ ID NO: 886223 - RNA, 22 nt, Human
gaggcagugcauugucuagggg

SEQ ID NO: 886224 - RNA, 22 nt, Human
gcagcugggccccagccucucc

SEQ ID NO: 886225 - RNA, 22 nt, Human
caguguggugagauuccaggug

SEQ ID NO: 886226 - RNA, 22 nt, Human
ggccucgcggcuucugguggcu

SEQ ID NO: 886227 - RNA, 19 nt, Human
agauggggaagagugugag

SEQ ID NO: 886228 - RNA, 22 nt, Human
auuuguaauuucuuaucugugu

SEQ ID NO: 886229 - RNA, 22 nt, Human
ggcaguguccuugcagcucuac

SEQ ID NO: 886230 - RNA, 22 nt, Human
uaggguggagacuggaagcagg

SEQ ID NO: 886231 - RNA, 23 nt, Human
uucuaggcucugauugggcuucc

SEQ ID NO: 886232 - RNA, 22 nt, Human
gcagcugucggaaagcuaagug

SEQ ID NO: 886233 - RNA, 23 nt, Human
gagugcagaauagacaugcagug

SEQ ID NO: 886234 - RNA, 22 nt, Human
uuuuguaauuuccugacgacua

SEQ ID NO: 886235 - RNA, 22 nt, Human
uaaagugccucagguccugggu

SEQ ID NO: 886236 - RNA, 22 nt, Human
aguggcagagcaggugcuggaa

SEQ ID NO: 886237 - RNA, 22 nt, Human
auuccacagcuacguuuugagc

SEQ ID NO: 886238 - RNA, 23 nt, Human
uugaaagguagcuggcagcuaga

SEQ ID NO: 886239 - RNA, 22 nt, Human
cacagggaacaacuagaacaaa

SEQ ID NO: 886240 - RNA, 22 nt, Human
ccugugugccuggccgcgggag

SEQ ID NO: 886241 - RNA, 22 nt, Human
uggcugagaaguucugguggga

SEQ ID NO: 886242 - RNA, 22 nt, Human
cauguuuucuaggcuuucacaa

SEQ ID NO: 886243 - RNA, 22 nt, Human
aagacuguaugagacaauauaa

SEQ ID NO: 886244 - RNA, 22 nt, Human
aagugugagacacacaaaauua

SEQ ID NO: 886245 - RNA, 22 nt, Human
uucuggaguuugaagaucaggu

SEQ ID NO: 886246 - RNA, 22 nt, Human
aguguuauugaggcaaaacugu

SEQ ID NO: 886247 - RNA, 22 nt, Human
gagcuccugaaacguuccugcc

SEQ ID NO: 886248 - RNA, 22 nt, Human
cucuccagggcaugaguuccac

SEQ ID NO: 886249 - RNA, 22 nt, Human
ucagugugucucugcauuuggg

SEQ ID NO: 886250 - RNA, 22 nt, Human
gauguggaugaucuuagauggu

SEQ ID NO: 886251 - RNA, 22 nt, Human
cugggcugauuuagucacguuu

SEQ ID NO: 886252 - RNA, 22 nt, Human
ccugggcuccacuccaagagca

SEQ ID NO: 886253 - RNA, 23 nt, Human
aauaucaaggugauguucccaga

SEQ ID NO: 886254 - RNA, 22 nt, Human
cucugggcaaagaugccucauc

SEQ ID NO: 886255 - RNA, 22 nt, Human
cuuaugauucaaauaggaucuu

SEQ ID NO: 886256 - RNA, 22 nt, Human
gaagaacaagcagugcuuuccu

SEQ ID NO: 886257 - RNA, 22 nt, Human
cauauuagacacuuauguccac

SEQ ID NO: 886258 - RNA, 21 nt, Human
ggagggcagcccagacuggcu

SEQ ID NO: 886259 - RNA, 19 nt, Human
ggcucagugacauaggugc

SEQ ID NO: 886260 - RNA, 21 nt, Human
aacuaaggaacugaaaaaugg

SEQ ID NO: 886261 - RNA, 22 nt, Human
ugcagggaaugcuugcagcaug

SEQ ID NO: 886262 - RNA, 22 nt, Human
auuaaaugauggcaugucuuau

SEQ ID NO: 886263 - RNA, 22 nt, Human
uccugguggugccagcugcagg

SEQ ID NO: 886264 - RNA, 22 nt, Human
uagaccugaaauauggaccugg

SEQ ID NO: 886265 - RNA, 22 nt, Human
gggcaguuuauucuagaugguu

SEQ ID NO: 886266 - RNA, 22 nt, Human
uuucacagaacucacuaaggag

SEQ ID NO: 886267 - RNA, 19 nt, Human
gggcacagccuccccccag

SEQ ID NO: 886268 - RNA, 22 nt, Human
uccagaauacucugaaaucauu

SEQ ID NO: 886269 - RNA, 22 nt, Human
cacagucacauaucuaugugug

SEQ ID NO: 886270 - RNA, 22 nt, Human
uucguuuucuaggaccaacaga

SEQ ID NO: 886271 - RNA, 22 nt, Human
uccaguguggaccccugcaguc

SEQ ID NO: 886272 - RNA, 22 nt, Human
acacaguucuuagcaggugucu

SEQ ID NO: 886273 - RNA, 20 nt, Human
ugcuccaggaacacuggccg

SEQ ID NO: 886274 - RNA, 22 nt, Human
ccucacagcccuccucuagcac

SEQ ID NO: 886275 - RNA, 22 nt, Human
gaguggggcuuuaaaggcucag

SEQ ID NO: 886276 - RNA, 23 nt, Human
ucugaagaugcuguuuccaguga

SEQ ID NO: 886277 - RNA, 22 nt, Human
ccagccaggcauugcaaacuga

SEQ ID NO: 886278 - RNA, 22 nt, Human
guggcugguuuccugcaugcaa

SEQ ID NO: 886279 - RNA, 22 nt, Human
ugggaaccaggacuggcugagg

SEQ ID NO: 886280 - RNA, 22 nt, Human
aagguauuguucccuaguuucu

SEQ ID NO: 886281 - RNA, 22 nt, Human
gcugucugcaagccaggaaaug

SEQ ID NO: 886282 - RNA, 22 nt, Human
aagcagccuggacuugggcugg

SEQ ID NO: 886283 - RNA, 22 nt, Human
agaaaagggcaggagggauaca

SEQ ID NO: 886284 - RNA, 22 nt, Human
ugccauuuaaaaaugaccaaau

SEQ ID NO: 886285 - RNA, 22 nt, Human
ucugccaucaagaugcucuggc

SEQ ID NO: 886286 - RNA, 22 nt, Human
ucauugaagacuuacuggcuuc

SEQ ID NO: 886287 - RNA, 19 nt, Human
ugagacugggugcaguacu

SEQ ID NO: 886288 - RNA, 22 nt, Human
ugccaggcauguaguagacuug

SEQ ID NO: 886289 - RNA, 22 nt, Human
cagagggcccccuggccacagu

SEQ ID NO: 886290 - RNA, 22 nt, Human
gcagugggcaacaagagcugga

SEQ ID NO: 886291 - RNA, 18 nt, Human
ugaggcucagcuccuggu

SEQ ID NO: 886292 - RNA, 22 nt, Human
uccacagugguugaacuaguuu

SEQ ID NO: 886293 - RNA, 20 nt, Human
gccuagggucacuucaguga

SEQ ID NO: 886294 - RNA, 22 nt, Human
uauucagugacaggguauuaug

SEQ ID NO: 886295 - RNA, 22 nt, Human
aaacacugcaggguuuacuuga

SEQ ID NO: 886296 - RNA, 22 nt, Human
uaaggcaaagugauuucuuaaa

SEQ ID NO: 886297 - RNA, 22 nt, Human
ggaccaucucuagccagagcuu

SEQ ID NO: 886298 - RNA, 22 nt, Human
ugugugcuuaagggcugaaccu

SEQ ID NO: 886299 - RNA, 22 nt, Human
aguucugcaugaaaaaggacua

SEQ ID NO: 886300 - RNA, 22 nt, Human
gcuacaggggucaguccuuugc

SEQ ID NO: 886301 - RNA, 22 nt, Human
uuccuuggugcccgauguauuu

SEQ ID NO: 886302 - RNA, 22 nt, Human
caucacauuagucucaagagaa

SEQ ID NO: 886303 - RNA, 22 nt, Human
ugaaguaucuauggauauaaga

SEQ ID NO: 886304 - RNA, 21 nt, Human
gagugcagcaagguagagucu

SEQ ID NO: 886305 - RNA, 22 nt, Human
uuucacauuuguuuuaagaagu

SEQ ID NO: 886306 - RNA, 22 nt, Human
ucuccugcucccaacugcugca

SEQ ID NO: 886307 - RNA, 22 nt, Human
gaguccagcucauugucuggga

SEQ ID NO: 886308 - RNA, 20 nt, Human
gcucuaaagccacagauuga

SEQ ID NO: 886309 - RNA, 22 nt, Human
ccugggcaucaacaagcagaga

SEQ ID NO: 886310 - RNA, 18 nt, Human
aagaggaggaaacccagg

SEQ ID NO: 886311 - RNA, 23 nt, Human
agccacagccagagcuaucucca

SEQ ID NO: 886312 - RNA, 22 nt, Human
gcugauggcuugcuggcugaca

SEQ ID NO: 886313 - RNA, 22 nt, Human
cccauuuaaacacaagcuuuca

SEQ ID NO: 886314 - RNA, 21 nt, Human
aaagagguuaauauuguaagu

SEQ ID NO: 886315 - RNA, 22 nt, Human
auuugggcaguccaugaaauaa

SEQ ID NO: 886316 - RNA, 22 nt, Human
gagcuugggugccaugcugagc

SEQ ID NO: 886317 - RNA, 22 nt, Human
gucaacauguucugggugaaug

SEQ ID NO: 886318 - RNA, 22 nt, Human
ucaguggagcuaagcaugagau

SEQ ID NO: 886319 - RNA, 22 nt, Human
gcuauguucccuuuugcuauaa

SEQ ID NO: 886320 - RNA, 22 nt, Human
uccuguguguggccuuucccag

SEQ ID NO: 886321 - RNA, 22 nt, Human
ucuuggaagccucaagauacuc

SEQ ID NO: 886322 - RNA, 18 nt, Human
gaggaaacaaggcagagg

SEQ ID NO: 886323 - RNA, 18 nt, Human
ccagcugugcagcaucug

SEQ ID NO: 886324 - RNA, 22 nt, Human
ccuagaaugugcagacuuaggg

SEQ ID NO: 886325 - RNA, 22 nt, Human
ccagcuccuucugucuguggag

SEQ ID NO: 886326 - RNA, 22 nt, Human
cgcaccacugaauuccagccug

SEQ ID NO: 886327 - RNA, 22 nt, Human
cuauguuuaucuguauuucugu

SEQ ID NO: 886328 - RNA, 22 nt, Human
gcugcugcuggucuggggccac

SEQ ID NO: 886329 - RNA, 22 nt, Human
agucacaguuucccugagagag

SEQ ID NO: 886330 - RNA, 22 nt, Human
aaauacauaaagguuguaccag

SEQ ID NO: 886331 - RNA, 22 nt, Human
ugcuggagcuccgggcuguagg

SEQ ID NO: 886332 - RNA, 22 nt, Human
gauguacaagauuguaggaaug

SEQ ID NO: 886333 - RNA, 22 nt, Human
cauugcugccacuggauauuuc

SEQ ID NO: 886334 - RNA, 22 nt, Human
uauuucuauuccccaggcaagu

SEQ ID NO: 886335 - RNA, 18 nt, Human
uacaggaaaaguguuaca

SEQ ID NO: 886336 - RNA, 22 nt, Human
ccuggggcuccagagcagcgga

SEQ ID NO: 886337 - RNA, 22 nt, Human
ugucacaaacauacauuauaga

SEQ ID NO: 886338 - RNA, 22 nt, Human
cuagggucaggggccugcgucg

SEQ ID NO: 886339 - RNA, 22 nt, Human
cagugagagagaacgcauucau

SEQ ID NO: 886340 - RNA, 22 nt, Human
uuacaauuacuugaucucagcu

SEQ ID NO: 886341 - RNA, 22 nt, Human
uccugagggcucggggcucaug

SEQ ID NO: 886342 - RNA, 22 nt, Human
uugggcaggaacagaugcuuga

SEQ ID NO: 886343 - RNA, 22 nt, Human
agcugccuccuggugccccauc

SEQ ID NO: 886344 - RNA, 22 nt, Human
gcuuucugauugcgaaaacaaa

SEQ ID NO: 886345 - RNA, 23 nt, Human
ucacauaucaagaaagugguaga

SEQ ID NO: 886346 - RNA, 22 nt, Human
cuccucagggcugguuacaugg

SEQ ID NO: 886347 - RNA, 22 nt, Human
agggugcagguguggagucuag

SEQ ID NO: 886348 - RNA, 22 nt, Human
cuggaaggucuguccccacugc

SEQ ID NO: 886349 - RNA, 22 nt, Human
gcuggcuuuugaagucuagcua

SEQ ID NO: 886350 - RNA, 22 nt, Human
uugauacacaauggaacaaugu

SEQ ID NO: 886351 - RNA, 19 nt, Human
uuugaugagaauuuaagca

SEQ ID NO: 886352 - RNA, 22 nt, Human
cagcugucuaaguugagcagga

SEQ ID NO: 886353 - RNA, 22 nt, Human
agugccuggaccccaugacaua

SEQ ID NO: 886354 - RNA, 20 nt, Human
uuaagaaaagcacauccugc

SEQ ID NO: 886355 - RNA, 22 nt, Human
uacuuacacagcuguagaaggu

SEQ ID NO: 886356 - RNA, 22 nt, Human
gaucccuugggccaaggaguug

SEQ ID NO: 886357 - RNA, 22 nt, Human
caggcaggucagugaagaagga

SEQ ID NO: 886358 - RNA, 22 nt, Human
ugucagugcuauagugggaaua

SEQ ID NO: 886359 - RNA, 22 nt, Human
acauagaagugaugcuuaucca

SEQ ID NO: 886360 - RNA, 18 nt, Human
gaucucugcagugccuac

SEQ ID NO: 886361 - RNA, 22 nt, Human
agguuuccagcauggggaaggc

SEQ ID NO: 886362 - RNA, 21 nt, Human
gaauaguucuguggcagcagu

SEQ ID NO: 886363 - RNA, 22 nt, Human
aaaacuguaucuucuugggacu

SEQ ID NO: 886364 - RNA, 22 nt, Human
acaguggaguugggguagcccu

SEQ ID NO: 886365 - RNA, 22 nt, Human
uaggaaacucaaagggaagugg

SEQ ID NO: 886366 - RNA, 22 nt, Human
cugcagcagggcuugcccaccu

SEQ ID NO: 886367 - RNA, 22 nt, Human
gucccuuccucauuccacuuua

SEQ ID NO: 886368 - RNA, 22 nt, Human
cacagagaucggaacagaagua

SEQ ID NO: 886369 - RNA, 22 nt, Human
cuguacuaauugcuuuacaugu

SEQ ID NO: 886370 - RNA, 22 nt, Human
acauguguacuuuuaaggaugu

SEQ ID NO: 886371 - RNA, 22 nt, Human
auuggauagacauaagaaaaau

SEQ ID NO: 886372 - RNA, 22 nt, Human
gcuuaggaguuucaggcucuca

SEQ ID NO: 886373 - RNA, 22 nt, Human
acaguguuauuucugaguaaug

SEQ ID NO: 886374 - RNA, 19 nt, Human
cugagcagcggcagcacuu

SEQ ID NO: 886375 - RNA, 22 nt, Human
ucuuuauugcuacugguuuguc

SEQ ID NO: 886376 - RNA, 22 nt, Human
guuccugguggucauggcagcu

SEQ ID NO: 886377 - RNA, 22 nt, Human
acacauuucuaaauuuuuaccg

SEQ ID NO: 886378 - RNA, 22 nt, Human
auucauagcucaguacagacuc

SEQ ID NO: 886379 - RNA, 22 nt, Human
uugcuuuacaaaaauugauggu

SEQ ID NO: 886380 - RNA, 22 nt, Human
gcauauggcuucauuuaauucu

SEQ ID NO: 886381 - RNA, 22 nt, Human
uuaaacaguauaucugagcaag

SEQ ID NO: 886382 - RNA, 22 nt, Human
aagauguugacuccuuugaugu

SEQ ID NO: 886383 - RNA, 22 nt, Human
ugucagugaccuagcacggugc

SEQ ID NO: 886384 - RNA, 22 nt, Human
ucugauuagcaguuuagggaaa

SEQ ID NO: 886385 - RNA, 22 nt, Human
gugcuggaacugugcuaagaga

SEQ ID NO: 886386 - RNA, 22 nt, Human
ucucuucuaacacuagaaauuc

SEQ ID NO: 886387 - RNA, 22 nt, Human
agaaacugcagcucagagaagu

SEQ ID NO: 886388 - RNA, 22 nt, Human
ucagaacagguuguacuauguc

SEQ ID NO: 886389 - RNA, 22 nt, Human
caggguggggcuggcuaucaaa

SEQ ID NO: 886390 - RNA, 18 nt, Human
gaagugaagugacucaau

SEQ ID NO: 886391 - RNA, 22 nt, Human
gagggugucuggaugcuagacu

SEQ ID NO: 886392 - RNA, 22 nt, Human
ugcaggagagugagucaguagg

SEQ ID NO: 886393 - RNA, 22 nt, Human
uaguuuuagucccauuuuacag

SEQ ID NO: 886394 - RNA, 22 nt, Human
uccucugggcucccugcaacag

SEQ ID NO: 886395 - RNA, 22 nt, Human
aggcuccaggccucccugcaug

SEQ ID NO: 886396 - RNA, 22 nt, Human
ggcugccuucauagaccauggg

SEQ ID NO: 886397 - RNA, 20 nt, Human
aaucagaaagugugagcucu

SEQ ID NO: 886398 - RNA, 22 nt, Human
ggcuuggcuugggcucagaggc

SEQ ID NO: 886399 - RNA, 22 nt, Human
uagaacuugugaaauaucaaug

SEQ ID NO: 886400 - RNA, 22 nt, Human
caagaaggcauccccagucccu

SEQ ID NO: 886401 - RNA, 22 nt, Human
cccagagaagugaagugacuug

SEQ ID NO: 886402 - RNA, 22 nt, Human
uuauuuauggcacuguuggugg

SEQ ID NO: 886403 - RNA, 22 nt, Human
aacagcugcaaaagguugccug

SEQ ID NO: 886404 - RNA, 22 nt, Human
gcagagcuucuguccuucagga

SEQ ID NO: 886405 - RNA, 22 nt, Human
ucugccaggccacacagggcac

SEQ ID NO: 886406 - RNA, 22 nt, Human
cccucaggagaugucagcugga

SEQ ID NO: 886407 - RNA, 22 nt, Human
ucuucagacccuuagcugugau

SEQ ID NO: 886408 - RNA, 22 nt, Human
cuccagggagcugcgggagcca

SEQ ID NO: 886409 - RNA, 22 nt, Human
ugaggcagugcugggaagccug

SEQ ID NO: 886410 - RNA, 22 nt, Human
caaguuaucagggcaguuagag

SEQ ID NO: 886411 - RNA, 22 nt, Human
uacugaaaacugagucuuccgu

SEQ ID NO: 886412 - RNA, 22 nt, Human
gagggccagaguccugggguca

SEQ ID NO: 886413 - RNA, 22 nt, Human
uuuacacaaaagauagcacacc

SEQ ID NO: 886414 - RNA, 22 nt, Human
ugucauaaucaguuuugcaugu

SEQ ID NO: 886415 - RNA, 22 nt, Human
gcugugucagaaacucugggga

SEQ ID NO: 886416 - RNA, 20 nt, Human
gaggcugaaguguuuuugcu

SEQ ID NO: 886417 - RNA, 22 nt, Human
gagggagucugugcaaagaauu

SEQ ID NO: 886418 - RNA, 22 nt, Human
uagcauuucacugaucuucacu

SEQ ID NO: 886419 - RNA, 17 nt, Human
aggaaagucugcugucc

SEQ ID NO: 886420 - RNA, 16 nt, Human
ccucuggcaauuagau

SEQ ID NO: 886421 - RNA, 22 nt, Human
gaaccuguccugagugaggagu

SEQ ID NO: 886422 - RNA, 22 nt, Human
aggaaacuaacuuaucuuuaua

SEQ ID NO: 886423 - RNA, 22 nt, Human
agguuaggaauuuggacagaga

SEQ ID NO: 886424 - RNA, 22 nt, Human
uguuaaggagacacaugaaaaa

SEQ ID NO: 886425 - RNA, 22 nt, Human
agggucuguggaugcaucuggg

SEQ ID NO: 886426 - RNA, 22 nt, Human
cagcauuuaucuuguagcagga

SEQ ID NO: 886427 - RNA, 22 nt, Human
acccaccacaguggcuggcaca

SEQ ID NO: 886428 - RNA, 22 nt, Human
ucugcacauguaguaaauauua

SEQ ID NO: 886429 - RNA, 22 nt, Human
aaacagaaggguagguaaacau

SEQ ID NO: 886430 - RNA, 22 nt, Human
cuuccucucuugcccauaagag

SEQ ID NO: 886431 - RNA, 22 nt, Human
acagaauuaggagauccucuug

SEQ ID NO: 886432 - RNA, 23 nt, Human
caguacuuaguguagcguuaauu

SEQ ID NO: 886433 - RNA, 22 nt, Human
gaggcaggcagauugcuugagg

SEQ ID NO: 886434 - RNA, 22 nt, Human
aacaugcucuguuucuuggaug

SEQ ID NO: 886435 - RNA, 22 nt, Human
ucugccuagugggacagcagcc

SEQ ID NO: 886436 - RNA, 22 nt, Human
uccucuggucuucgguguggac

SEQ ID NO: 886437 - RNA, 22 nt, Human
cagugccaaggcucuuggucug

SEQ ID NO: 886438 - RNA, 22 nt, Human
ucuacgaagccaccauggagac

SEQ ID NO: 886439 - RNA, 22 nt, Human
uggcugagccuuuggggcuuuc

SEQ ID NO: 886440 - RNA, 22 nt, Human
ucacacauuucucaaguguagg

SEQ ID NO: 886441 - RNA, 22 nt, Human
acucuaaaaugcuaugagaucu

SEQ ID NO: 886442 - RNA, 22 nt, Human
ugcuuuuaggagauuaaaauua

SEQ ID NO: 886443 - RNA, 22 nt, Human
uagccaggcgaggucagugucg

SEQ ID NO: 886444 - RNA, 22 nt, Human
cuggcccugcuccgcgccgcgg

SEQ ID NO: 886445 - RNA, 22 nt, Human
uguacacauuaagcucuuuaga

SEQ ID NO: 886446 - RNA, 22 nt, Human
uccugggaccaggcaccuacug

SEQ ID NO: 886447 - RNA, 22 nt, Human
uaaagacauaggaucagggaga

SEQ ID NO: 886448 - RNA, 21 nt, Human
cagaaacuugcuuugccuucu

SEQ ID NO: 886449 - RNA, 22 nt, Human
uacaaagcaguuccaacacgaa

SEQ ID NO: 886450 - RNA, 22 nt, Human
ccaggaggcucugacuggaccc

SEQ ID NO: 886451 - RNA, 22 nt, Human
agacaauuagcacaucacgggg

SEQ ID NO: 886452 - RNA, 22 nt, Human
caaaaugugagucccaccucaa

SEQ ID NO: 886453 - RNA, 22 nt, Human
gaaaguauucucccugaauuuu

SEQ ID NO: 886454 - RNA, 22 nt, Human
ucucuccuaauuucaggugcuu

SEQ ID NO: 886455 - RNA, 22 nt, Human
agagucuuggcugagaacaaga

SEQ ID NO: 886456 - RNA, 22 nt, Human
agcaaacauucagcagauuggc

SEQ ID NO: 886457 - RNA, 22 nt, Human
ugaaacuuuugagguucuucca

SEQ ID NO: 886458 - RNA, 22 nt, Human
gccacagcaacaauaaugcagc

SEQ ID NO: 886459 - RNA, 22 nt, Human
aguggcuggucuaaggucacag

SEQ ID NO: 886460 - RNA, 19 nt, Human
cucugccauuugcugccug

SEQ ID NO: 886461 - RNA, 18 nt, Human
uccaccagucaaucuguc

SEQ ID NO: 886462 - RNA, 22 nt, Human
aauguauaauauuuaaugcuuu

SEQ ID NO: 886463 - RNA, 18 nt, Human
gggcucacacaggucauc

SEQ ID NO: 886464 - RNA, 22 nt, Human
gcucugggccgggcaccagccu

SEQ ID NO: 886465 - RNA, 22 nt, Human
aaaucaugaggacauuaugcca

SEQ ID NO: 886466 - RNA, 22 nt, Human
ggaagccagaaagugagaauau

SEQ ID NO: 886467 - RNA, 22 nt, Human
uuucuaaguguauugagcuugg

SEQ ID NO: 886468 - RNA, 19 nt, Human
ugguggaggccccauguuc

SEQ ID NO: 886469 - RNA, 22 nt, Human
ggcugugggaugcauaggagcu

SEQ ID NO: 886470 - RNA, 22 nt, Human
aucccaggcggcacagguugca

SEQ ID NO: 886471 - RNA, 22 nt, Human
uccuuggcaagcugcaauggga

SEQ ID NO: 886472 - RNA, 18 nt, Human
acagacacuuaguaugag

SEQ ID NO: 886473 - RNA, 22 nt, Human
cccaggaaaagcagugccagca

SEQ ID NO: 886474 - RNA, 22 nt, Human
acuguuucucaaauuauguggu

SEQ ID NO: 886475 - RNA, 22 nt, Human
agucuucagcaggguuaaaccc

SEQ ID NO: 886476 - RNA, 22 nt, Human
aaauccuugauaguuugcccua

SEQ ID NO: 886477 - RNA, 22 nt, Human
ggugggcacauucagucucugu

SEQ ID NO: 886478 - RNA, 22 nt, Human
ucuuuccuaggugauaugcaau

SEQ ID NO: 886479 - RNA, 22 nt, Human
uuuucaguggcuugcauauguu

SEQ ID NO: 886480 - RNA, 22 nt, Human
aaagcagcagcaccugcauuuc

SEQ ID NO: 886481 - RNA, 22 nt, Human
cucugggugagacagaccuggu

SEQ ID NO: 886482 - RNA, 22 nt, Human
cacauacauacguauguauaca

SEQ ID NO: 886483 - RNA, 22 nt, Human
aucucucuaugcacugaggacu

SEQ ID NO: 886484 - RNA, 22 nt, Human
ugcagguggacacgggagacgg

SEQ ID NO: 886485 - RNA, 22 nt, Human
agcagcucccuccucagccacc

SEQ ID NO: 886486 - RNA, 22 nt, Human
cuggaagaccccccaggacuca

SEQ ID NO: 886487 - RNA, 22 nt, Human
caaguuggucuccuguagcaac

SEQ ID NO: 886488 - RNA, 22 nt, Human
ggcugagggucccagacccuaa

SEQ ID NO: 886489 - RNA, 22 nt, Human
cuggcaggcucucuggucgguu

SEQ ID NO: 886490 - RNA, 22 nt, Human
ucacugaauacuugucucaucc

SEQ ID NO: 886491 - RNA, 22 nt, Human
ugcucccaaacgaccuacugug

SEQ ID NO: 886492 - RNA, 22 nt, Human
uucacaaagcugguuccuucug

SEQ ID NO: 886493 - RNA, 22 nt, Human
agcugcagauaggauguuauuu

SEQ ID NO: 886494 - RNA, 22 nt, Human
uaaauguuggcauuggaggccg

SEQ ID NO: 886495 - RNA, 22 nt, Human
agugggcuuacugagggagugu

SEQ ID NO: 886496 - RNA, 22 nt, Human
aggcugggaaaccugaaguugu

SEQ ID NO: 886497 - RNA, 22 nt, Human
ccucacucugcacccugcagca

SEQ ID NO: 886498 - RNA, 22 nt, Human
aagcucugcucagcagacuagg

SEQ ID NO: 886499 - RNA, 22 nt, Human
acaguacaccacuguguacagu

SEQ ID NO: 886500 - RNA, 18 nt, Human
uggaagcuggugagcaga

SEQ ID NO: 886501 - RNA, 22 nt, Human
uuucugacagagugcucagagu

SEQ ID NO: 886502 - RNA, 22 nt, Human
ucuuccaaaugcagcuaaagcu

SEQ ID NO: 886503 - RNA, 22 nt, Human
uguuaugugccacacuugaggg

SEQ ID NO: 886504 - RNA, 22 nt, Human
uucuagaauguuuugaaaggga

SEQ ID NO: 886505 - RNA, 22 nt, Human
cucuaaggaacucccccaaacu

SEQ ID NO: 886506 - RNA, 22 nt, Human
auaugaguugauuuuuagaaua

SEQ ID NO: 886507 - RNA, 22 nt, Human
ucugggauuuuugacacugaag

SEQ ID NO: 886508 - RNA, 22 nt, Human
cuccauggaaccggggcugcuu

SEQ ID NO: 886509 - RNA, 22 nt, Human
ugugucccuuggaaccucagcu

SEQ ID NO: 886510 - RNA, 22 nt, Human
gagccagauuuuaugcaagaca

SEQ ID NO: 886511 - RNA, 22 nt, Human
cuuuucaugccagcccaucaca

SEQ ID NO: 886512 - RNA, 22 nt, Human
gauacaagacuaauaggaaaca

SEQ ID NO: 886513 - RNA, 22 nt, Human
auuccaggauuccaggacaaau

SEQ ID NO: 886514 - RNA, 17 nt, Human
gcccacccuuaggagcu

SEQ ID NO: 886515 - RNA, 22 nt, Human
ggcuauggaaauggcaggacau

SEQ ID NO: 886516 - RNA, 20 nt, Human
aagaagccgggaaggcaggc

SEQ ID NO: 886517 - RNA, 22 nt, Human
cagagagaaucuuggcagcuga

SEQ ID NO: 886518 - RNA, 22 nt, Human
ccuggcucccccaucauagcug

SEQ ID NO: 886519 - RNA, 22 nt, Human
gauacacacccuugauaggacu

SEQ ID NO: 886520 - RNA, 22 nt, Human
aaggaucugacagacuauagaa

SEQ ID NO: 886521 - RNA, 22 nt, Human
cuggcaggaucuaaccagggaa

SEQ ID NO: 886522 - RNA, 21 nt, Human
ugcccaggggccaaccgcugc

SEQ ID NO: 886523 - RNA, 22 nt, Human
gacagacaggagcucacaggca

SEQ ID NO: 886524 - RNA, 22 nt, Human
ccagggcagcgccccuccacgc

SEQ ID NO: 886525 - RNA, 21 nt, Human
uacagcaacggagguuuucua

SEQ ID NO: 886526 - RNA, 22 nt, Human
auccauuuguaaauguuagagu

SEQ ID NO: 886527 - RNA, 22 nt, Human
cagcaagacaaggaacaaacug

SEQ ID NO: 886528 - RNA, 22 nt, Human
gcuuggggagcucaguguccuu

SEQ ID NO: 886529 - RNA, 22 nt, Human
ugagcaccucccugacaguggg

SEQ ID NO: 886530 - RNA, 22 nt, Human
ugaagcaaugauagcagaauga

SEQ ID NO: 886531 - RNA, 22 nt, Human
aaaauuacuauuguuccugggc

SEQ ID NO: 886532 - RNA, 22 nt, Human
cucucucuuguguugcugcaga

SEQ ID NO: 886533 - RNA, 22 nt, Human
gggcuggcaggaccugggcuga

SEQ ID NO: 886534 - RNA, 22 nt, Human
agaacucugaacacugucugga

SEQ ID NO: 886535 - RNA, 22 nt, Human
cugagaggcacaaggcauuucg

SEQ ID NO: 886536 - RNA, 22 nt, Human
auggaagacuaacagaaacaug

SEQ ID NO: 886537 - RNA, 18 nt, Human
uagcagcacuggccgcuu

SEQ ID NO: 886538 - RNA, 22 nt, Human
gaugggcuucuuccaugaagaa

SEQ ID NO: 886539 - RNA, 22 nt, Human
caggagcaguuagaagcccacu

SEQ ID NO: 886540 - RNA, 22 nt, Human
uuccugagaaauuuguaccugg

SEQ ID NO: 886541 - RNA, 22 nt, Human
acagugucaugucguguucccc

SEQ ID NO: 886542 - RNA, 22 nt, Human
uagucacaguacaggauaaaga

SEQ ID NO: 886543 - RNA, 22 nt, Human
auuucucacccuaccucacucc

SEQ ID NO: 886544 - RNA, 22 nt, Human
cucucagguagagcccaagaau

SEQ ID NO: 886545 - RNA, 22 nt, Human
cuuuaacaguuccauucaauuu

SEQ ID NO: 886546 - RNA, 22 nt, Human
ugcugaggacuaaaggagauga

SEQ ID NO: 886547 - RNA, 22 nt, Human
auacauacauguaugcacauac

SEQ ID NO: 886548 - RNA, 22 nt, Human
cagaggcugacaaaauauugcu

SEQ ID NO: 886549 - RNA, 22 nt, Human
ccaggcagcaaauuuucugaau

SEQ ID NO: 886550 - RNA, 22 nt, Human
cggggaagcgguucuggcggua

SEQ ID NO: 886551 - RNA, 23 nt, Human
accaugaugggagugcaaauaag

SEQ ID NO: 886552 - RNA, 22 nt, Human
aaggauuuuuggaaugagaugg

SEQ ID NO: 886553 - RNA, 22 nt, Human
ucccagccuuucuuucuccagc

SEQ ID NO: 886554 - RNA, 22 nt, Human
ggcucuggggaagcucucuuca

SEQ ID NO: 886555 - RNA, 22 nt, Human
aagcacugagcacaguggcuga

SEQ ID NO: 886556 - RNA, 22 nt, Human
auuagccugcucuuuagugaaa

SEQ ID NO: 886557 - RNA, 19 nt, Human
accaaacaguggacggagc

SEQ ID NO: 886558 - RNA, 22 nt, Human
ugagccugcaauaagcacagcc

SEQ ID NO: 886559 - RNA, 22 nt, Human
gcuggagaaacaggaggaggaa

SEQ ID NO: 886560 - RNA, 22 nt, Human
cacagcugcccuaacuguacuc

SEQ ID NO: 886561 - RNA, 22 nt, Human
uggagacauuucucauuaaaaa

SEQ ID NO: 886562 - RNA, 20 nt, Human
uacaggaaucaagacugcau

SEQ ID NO: 886563 - RNA, 22 nt, Human
uuaauuuauacauaaucacagg

SEQ ID NO: 886564 - RNA, 22 nt, Human
ucagagucuaugcaacagaauu

SEQ ID NO: 886565 - RNA, 22 nt, Human
aagauuuacuuucuuuguaaua

SEQ ID NO: 886566 - RNA, 22 nt, Human
aauccauugcugugcugccagg

SEQ ID NO: 886567 - RNA, 22 nt, Human
augccuggauuugggacucaaa

SEQ ID NO: 886568 - RNA, 20 nt, Human
gggaggcauuggucccucac

SEQ ID NO: 886569 - RNA, 22 nt, Human
agacauuuggagccaacuuucc

SEQ ID NO: 886570 - RNA, 20 nt, Human
uucuacaaaacugauucuga

SEQ ID NO: 886571 - RNA, 22 nt, Human
ugcuucugaugugagcagcccc

SEQ ID NO: 886572 - RNA, 22 nt, Human
ucaaagaacaucaucugaaaug

SEQ ID NO: 886573 - RNA, 22 nt, Human
augcaaaugaacauguugcuag

SEQ ID NO: 886574 - RNA, 22 nt, Human
aagucuuaggaaauagcaaaga

SEQ ID NO: 886575 - RNA, 22 nt, Human
gagcuuggaugucuuuuguuca

SEQ ID NO: 886576 - RNA, 22 nt, Human
gcugccuuuagggggugcucag

SEQ ID NO: 886577 - RNA, 20 nt, Human
gugaccagaagacagugggu

SEQ ID NO: 886578 - RNA, 22 nt, Human
caugccaugugugaggagagga

SEQ ID NO: 886579 - RNA, 22 nt, Human
cagagcggccacuagagggcgc

SEQ ID NO: 886580 - RNA, 22 nt, Human
ggacugccucugucaccccagc

SEQ ID NO: 886581 - RNA, 22 nt, Human
aguaauuuguuauaaagcaaua

SEQ ID NO: 886582 - RNA, 22 nt, Human
aguccaugguuguaguucucuc

SEQ ID NO: 886583 - RNA, 22 nt, Human
gcugcccuacccgaggcacucu

SEQ ID NO: 886584 - RNA, 22 nt, Human
ucccucagacagauguguuccu

SEQ ID NO: 886585 - RNA, 22 nt, Human
uggcuacauuuauacucucauu

SEQ ID NO: 886586 - RNA, 22 nt, Human
ucuuuguuauugcuuuaucuau

SEQ ID NO: 886587 - RNA, 22 nt, Human
ccacagccauuccagggaggcu

SEQ ID NO: 886588 - RNA, 22 nt, Human
cagugccucaggccagccugca

SEQ ID NO: 886589 - RNA, 22 nt, Human
auucauuugcuauuguguaugg

SEQ ID NO: 886590 - RNA, 22 nt, Human
uuucagagaacugaguccuugc

SEQ ID NO: 886591 - RNA, 22 nt, Human
ugucauuuauuuugcugucugu

SEQ ID NO: 886592 - RNA, 22 nt, Human
aagcacauuuuccagcagcucu

SEQ ID NO: 886593 - RNA, 17 nt, Human
ugcuccugggacaagga

SEQ ID NO: 886594 - RNA, 22 nt, Human
aucaagcauauauaaaacugca

SEQ ID NO: 886595 - RNA, 22 nt, Human
acuucacagaaauuuuaugagg

SEQ ID NO: 886596 - RNA, 22 nt, Human
ggcuggaauguguggaugugau

SEQ ID NO: 886597 - RNA, 22 nt, Human
agagaaggucacuaaggaccca

SEQ ID NO: 886598 - RNA, 22 nt, Human
cuggccugggagcugcuagcgu

SEQ ID NO: 886599 - RNA, 22 nt, Human
caggggcggguaaaaggccucc

SEQ ID NO: 886600 - RNA, 22 nt, Human
ugcucaggagcuuagagcacag

SEQ ID NO: 886601 - RNA, 22 nt, Human
uccagggcuguuacuuuacaua

SEQ ID NO: 886602 - RNA, 22 nt, Human
uuugcaaaugcucugcagagcu

SEQ ID NO: 886603 - RNA, 21 nt, Human
ugaaugcuucgucauccuggc

SEQ ID NO: 886604 - RNA, 22 nt, Human
ucuggguggcugccaaucugcc

SEQ ID NO: 886605 - RNA, 22 nt, Human
aaugucaugggaauuuauucau

SEQ ID NO: 886606 - RNA, 22 nt, Human
gugauaacucaggcagagaaua

SEQ ID NO: 886607 - RNA, 22 nt, Human
cagccagaucaaacucagaugu

SEQ ID NO: 886608 - RNA, 21 nt, Human
ccugccaggaaacugaguguc

SEQ ID NO: 886609 - RNA, 22 nt, Human
acagagcauuugggacagagag

SEQ ID NO: 886610 - RNA, 22 nt, Human
aaguguuuauuuauaacgaucu

SEQ ID NO: 886611 - RNA, 22 nt, Human
ugagguaugagugugccaggug

SEQ ID NO: 886612 - RNA, 22 nt, Human
acagugauuggcacugauucag

SEQ ID NO: 886613 - RNA, 22 nt, Human
uuugaacaucacuguaggguga

SEQ ID NO: 886614 - RNA, 22 nt, Human
accagguggccccagcgugguu

SEQ ID NO: 886615 - RNA, 22 nt, Human
ggcugaugggcaugagcuguca

SEQ ID NO: 886616 - RNA, 22 nt, Human
augucuauggaauuuccacaca

SEQ ID NO: 886617 - RNA, 22 nt, Human
augcuacagcccucuuugcaua

SEQ ID NO: 886618 - RNA, 22 nt, Human
ucuccaggggcagggucuggag

SEQ ID NO: 886619 - RNA, 22 nt, Human
agaaaggucaaaaucgugacau

SEQ ID NO: 886620 - RNA, 22 nt, Human
uaaccaaagggccuaaggaaug

SEQ ID NO: 886621 - RNA, 22 nt, Human
uggcuggggagccccgacuccc

SEQ ID NO: 886622 - RNA, 22 nt, Human
aaacauuccauauauaccuugu

SEQ ID NO: 886623 - RNA, 22 nt, Human
cugcaucauuggugauucagga

SEQ ID NO: 886624 - RNA, 22 nt, Human
agcagcagaaaguugauggcag

SEQ ID NO: 886625 - RNA, 22 nt, Human
aaaugacauuaggauccugcau

SEQ ID NO: 886626 - RNA, 17 nt, Human
agggucaggugaaguuc

SEQ ID NO: 886627 - RNA, 22 nt, Human
uagcuucuggaguguuugaaaa

SEQ ID NO: 886628 - RNA, 22 nt, Human
guuccagggaagggaaggcaga

SEQ ID NO: 886629 - RNA, 22 nt, Human
aagacacugggggcugcagcca

SEQ ID NO: 886630 - RNA, 22 nt, Human
ggagaggggcaaguuuaucuag

SEQ ID NO: 886631 - RNA, 22 nt, Human
agggaagccccgaggaggcacc

SEQ ID NO: 886632 - RNA, 22 nt, Human
gaaagugccucaguccucuuau

SEQ ID NO: 886633 - RNA, 22 nt, Human
uguguacacaugacaggcaccc

SEQ ID NO: 886634 - RNA, 22 nt, Human
aggaaagccaaucucucuugac

SEQ ID NO: 886635 - RNA, 22 nt, Human
uucagcaaacacgaugcuuguu

SEQ ID NO: 886636 - RNA, 22 nt, Human
cucuggcuguuugcagcucaag

SEQ ID NO: 886637 - RNA, 22 nt, Human
gaagggaaggaaagaaccagca

SEQ ID NO: 886638 - RNA, 22 nt, Human
uuacuuuggcaaacuccugccc

SEQ ID NO: 886639 - RNA, 22 nt, Human
aggaauuggcacggccuucuca

SEQ ID NO: 886640 - RNA, 22 nt, Human
gggcaggagaagguggaugucc

SEQ ID NO: 886641 - RNA, 22 nt, Human
uaaaggcaguuggaguugagga

SEQ ID NO: 886642 - RNA, 22 nt, Human
acauugaagggaaugcaaagau

SEQ ID NO: 886643 - RNA, 22 nt, Human
uggcuuuauguacucaagucac

SEQ ID NO: 886644 - RNA, 22 nt, Human
gcagaacauggaaagagaacua

SEQ ID NO: 886645 - RNA, 22 nt, Human
agcuccuugaaggcaguagcug

SEQ ID NO: 886646 - RNA, 21 nt, Human
uguucuaucagcucagguguc

SEQ ID NO: 886647 - RNA, 22 nt, Human
aggugggaacccagcagggccc

SEQ ID NO: 886648 - RNA, 22 nt, Human
gaggcucagagaagucauggua

SEQ ID NO: 886649 - RNA, 22 nt, Human
aaguuuaguagggacagaugga

SEQ ID NO: 886650 - RNA, 22 nt, Human
cauucauaggaagaaaaugggc

SEQ ID NO: 886651 - RNA, 22 nt, Human
auuguuaugaaaauaagauguu

SEQ ID NO: 886652 - RNA, 22 nt, Human
agugcguggaccccuggcugcu

SEQ ID NO: 886653 - RNA, 23 nt, Human
acucguggaauucucugcgaucg

SEQ ID NO: 886654 - RNA, 22 nt, Human
ugggcagccaucccagccucuc

SEQ ID NO: 886655 - RNA, 22 nt, Human
ggcucuggcgagcuuuaguaca

SEQ ID NO: 886656 - RNA, 22 nt, Human
cagcagagaugagauuccuaua

SEQ ID NO: 886657 - RNA, 22 nt, Human
gcaucccaaaucugaaagucca

SEQ ID NO: 886658 - RNA, 22 nt, Human
aaaggcaugugggcugguugua

SEQ ID NO: 886659 - RNA, 20 nt, Human
ugcagaauccugugaucagu

SEQ ID NO: 886660 - RNA, 22 nt, Human
aacagcuuugcuucuggagaca

SEQ ID NO: 886661 - RNA, 22 nt, Human
guuaaguaccagauugucugaa

SEQ ID NO: 886662 - RNA, 22 nt, Human
auucacaugcccaagcagcacc

SEQ ID NO: 886663 - RNA, 22 nt, Human
cugucuguaucccuguugguaa

SEQ ID NO: 886664 - RNA, 22 nt, Human
guaaugaaucaacauuaaugau

SEQ ID NO: 886665 - RNA, 22 nt, Human
caucugccuaaguggcccuguu

SEQ ID NO: 886666 - RNA, 22 nt, Human
gugagcuggaauaguggagaaa

SEQ ID NO: 886667 - RNA, 22 nt, Human
gaaucuuuugucucgugaauaa

SEQ ID NO: 886668 - RNA, 23 nt, Human
agugcugaauugaaagcuccagg

SEQ ID NO: 886669 - RNA, 22 nt, Human
auggguaggauuuacucagaug

SEQ ID NO: 886670 - RNA, 22 nt, Human
cuggcccagguggucguugagg

SEQ ID NO: 886671 - RNA, 22 nt, Human
uuccuugguagagagaauauuu

SEQ ID NO: 886672 - RNA, 22 nt, Human
accagagcuggcucugagcacc

SEQ ID NO: 886673 - RNA, 22 nt, Human
caggugagaggcgguccugcau

SEQ ID NO: 886674 - RNA, 22 nt, Human
gcagcaaggaugaagcacuugg

SEQ ID NO: 886675 - RNA, 22 nt, Human
aaacuucaguaggagccaaccu

SEQ ID NO: 886676 - RNA, 22 nt, Human
ccuggccagcgccggcugcucg

SEQ ID NO: 886677 - RNA, 22 nt, Human
agaaguuugggggcgaaggcag

SEQ ID NO: 886678 - RNA, 22 nt, Human
caguaaaagauggaaauagaau

SEQ ID NO: 886679 - RNA, 19 nt, Human
gcagaugaugaggcugguc

SEQ ID NO: 886680 - RNA, 22 nt, Human
ggucugaguggggccugagauu

SEQ ID NO: 886681 - RNA, 22 nt, Human
auugagaagaaaaucuaauaua

SEQ ID NO: 886682 - RNA, 22 nt, Human
gaggagcucaugaaagcggugu

SEQ ID NO: 886683 - RNA, 22 nt, Human
aaguuugucucauuugaucuuc

SEQ ID NO: 886684 - RNA, 22 nt, Human
cuacaaagaaaguauacuggac

SEQ ID NO: 886685 - RNA, 22 nt, Human
uuauagaacagccuccucuaga

SEQ ID NO: 886686 - RNA, 22 nt, Human
guggcuuucauuucaggaugug

SEQ ID NO: 886687 - RNA, 20 nt, Human
ccucucugaagaggucaucu

SEQ ID NO: 886688 - RNA, 22 nt, Human
cagugugucucuuguccuggcu

SEQ ID NO: 886689 - RNA, 22 nt, Human
acgaugaugaaagagaacauuc

SEQ ID NO: 886690 - RNA, 22 nt, Human
gauauuuuugcagacaccuggg

SEQ ID NO: 886691 - RNA, 22 nt, Human
uguguggccuccauaggguacu

SEQ ID NO: 886692 - RNA, 21 nt, Human
cccugcaggccagggcugagc

SEQ ID NO: 886693 - RNA, 22 nt, Human
auucuaguguuuccauuacaag

SEQ ID NO: 886694 - RNA, 22 nt, Human
uccucaggaugugggguagaau

SEQ ID NO: 886695 - RNA, 23 nt, Human
ucucugugugccucaguuucuuc

SEQ ID NO: 886696 - RNA, 22 nt, Human
gcaaauauucaagacuuuucca

SEQ ID NO: 886697 - RNA, 22 nt, Human
uggcccugcuaugauccugcaa

SEQ ID NO: 886698 - RNA, 22 nt, Human
uuccaauuuguggugaguuaau

SEQ ID NO: 886699 - RNA, 18 nt, Human
aggugcagccucugaggc

SEQ ID NO: 886700 - RNA, 22 nt, Human
uauuucauucuuuaucaggagc

SEQ ID NO: 886701 - RNA, 22 nt, Human
caaaguauaguguaggauggca

SEQ ID NO: 886702 - RNA, 22 nt, Human
gcaggcugaugacuggaguugg

SEQ ID NO: 886703 - RNA, 22 nt, Human
uugcugaucugaaacguuacug

SEQ ID NO: 886704 - RNA, 22 nt, Human
acugucacuccaacugagucgu

SEQ ID NO: 886705 - RNA, 22 nt, Human
agguuugguuugacaagacuga

SEQ ID NO: 886706 - RNA, 22 nt, Human
guguacagugauuugaguucac

SEQ ID NO: 886707 - RNA, 22 nt, Human
gggagcugagcucugagccacg

SEQ ID NO: 886708 - RNA, 22 nt, Human
gccugcagggugaugggcugcc

SEQ ID NO: 886709 - RNA, 22 nt, Human
ugugcucugcaaucaguucuuu

SEQ ID NO: 886710 - RNA, 22 nt, Human
cccacagguccccaugaacucg

SEQ ID NO: 886711 - RNA, 22 nt, Human
aagugauuaaccaugcucugcu

SEQ ID NO: 886712 - RNA, 22 nt, Human
gagagccugccagugaguguau

SEQ ID NO: 886713 - RNA, 22 nt, Human
uauuguacauuuccaaauugcu

SEQ ID NO: 886714 - RNA, 22 nt, Human
gcaggagaacaaagcaagcugc

SEQ ID NO: 886715 - RNA, 22 nt, Human
gcuuuuguggugauggagaggc

SEQ ID NO: 886716 - RNA, 22 nt, Human
ugcccucuaggcuacaguucca

SEQ ID NO: 886717 - RNA, 22 nt, Human
gcagcuggugcaaaugucacuc

SEQ ID NO: 886718 - RNA, 22 nt, Human
aauaauuauuugagagcagacc

SEQ ID NO: 886719 - RNA, 22 nt, Human
uucacauuugcccuuaugugug

SEQ ID NO: 886720 - RNA, 22 nt, Human
uuuguucauuaaaagugcugua

SEQ ID NO: 886721 - RNA, 22 nt, Human
aacaagcagaugcaaugcacuu

SEQ ID NO: 886722 - RNA, 20 nt, Human
agcugcagaacccacuggac

SEQ ID NO: 886723 - RNA, 22 nt, Human
aaaugugauacuguucuuuuua

SEQ ID NO: 886724 - RNA, 22 nt, Human
aacacaugaaaguuggugagua

SEQ ID NO: 886725 - RNA, 22 nt, Human
caugagaaugaagaagacuuaa

SEQ ID NO: 886726 - RNA, 20 nt, Human
uuggcagcuucaggguacua

SEQ ID NO: 886727 - RNA, 22 nt, Human
cgaggugggcagaucacagagu

SEQ ID NO: 886728 - RNA, 22 nt, Human
ucugggagguguuuugagaacu

SEQ ID NO: 886729 - RNA, 22 nt, Human
aaauacauuagacggagaguua

SEQ ID NO: 886730 - RNA, 22 nt, Human
acaacaaggcuuuucauucaua

SEQ ID NO: 886731 - RNA, 22 nt, Human
uccagcuccugaguucacugcu

SEQ ID NO: 886732 - RNA, 22 nt, Human
gaguuuaaaacgcuuguauuua

SEQ ID NO: 886733 - RNA, 22 nt, Human
ucucacaggugcacguggcugu

SEQ ID NO: 886734 - RNA, 22 nt, Human
acaguguaugauauuucacagu

SEQ ID NO: 886735 - RNA, 22 nt, Human
ugcuuuauuuauaaaauagcaa

SEQ ID NO: 886736 - RNA, 22 nt, Human
auagcuuuuugucauagagucu

SEQ ID NO: 886737 - RNA, 22 nt, Human
uuacaaacaacagacauuuauu

SEQ ID NO: 886738 - RNA, 22 nt, Human
cagcuccugggccaucuccuag

SEQ ID NO: 886739 - RNA, 22 nt, Human
ugucucugcuuuccuugcaggg

SEQ ID NO: 886740 - RNA, 22 nt, Human
cuucuugaaguccuccagaagu

SEQ ID NO: 886741 - RNA, 22 nt, Human
cuggagaaguacugagacauuu

SEQ ID NO: 886742 - RNA, 22 nt, Human
gaaggaggucugcauucuacag

SEQ ID NO: 886743 - RNA, 22 nt, Human
cuuacaacuuguaugugauugu

SEQ ID NO: 886744 - RNA, 22 nt, Human
agcugguggauuaugcuguaca

SEQ ID NO: 886745 - RNA, 18 nt, Human
augugucuuucuuguuug

SEQ ID NO: 886746 - RNA, 22 nt, Human
acccugcuuuaugccguccucu

SEQ ID NO: 886747 - RNA, 22 nt, Human
agucaacacauuaaaccuaggg

SEQ ID NO: 886748 - RNA, 22 nt, Human
aaauguauugcauaggauauuu

SEQ ID NO: 886749 - RNA, 22 nt, Human
uaagugaaauaagucagauaca

SEQ ID NO: 886750 - RNA, 22 nt, Human
auggcagaaagaauagaggcua

SEQ ID NO: 886751 - RNA, 22 nt, Human
cagugggauugggauuggaacc

SEQ ID NO: 886752 - RNA, 17 nt, Human
uagcugccccgaaugcu

SEQ ID NO: 886753 - RNA, 22 nt, Human
gccaggcuggugucacaacucu

SEQ ID NO: 886754 - RNA, 22 nt, Human
cagcaagggauaaagaguuacu

SEQ ID NO: 886755 - RNA, 22 nt, Human
uucagcaaccagaaaggcuggg

SEQ ID NO: 886756 - RNA, 22 nt, Human
auaggacugagauugucaguuu

SEQ ID NO: 886757 - RNA, 19 nt, Human
uucuacuuuguuucccccu

SEQ ID NO: 886758 - RNA, 22 nt, Human
agggagcucuaaguagagggac

SEQ ID NO: 886759 - RNA, 22 nt, Human
uugcucuaucacagugauggga

SEQ ID NO: 886760 - RNA, 23 nt, Human
uuguucuaucaaccuagacuuag

SEQ ID NO: 886761 - RNA, 22 nt, Human
gacaggaauguguggaugcgga

SEQ ID NO: 886762 - RNA, 22 nt, Human
aggaagggauacauaggauagu

SEQ ID NO: 886763 - RNA, 22 nt, Human
ucaacccuguuuucuuugcaau

SEQ ID NO: 886764 - RNA, 18 nt, Human
ugcucuggucucacuugg

SEQ ID NO: 886765 - RNA, 22 nt, Human
ggagaggcgaugagucacagcc

SEQ ID NO: 886766 - RNA, 22 nt, Human
cagcuuggcuucacauucugua

SEQ ID NO: 886767 - RNA, 22 nt, Human
auguauaugaagcuaguauuuu

SEQ ID NO: 886768 - RNA, 22 nt, Human
aagcagcauaauugcuauuuua

SEQ ID NO: 886769 - RNA, 22 nt, Human
aaagacacaaauguagaccaaa

SEQ ID NO: 886770 - RNA, 22 nt, Human
uuacaaguuucuggcuucaucc

SEQ ID NO: 886771 - RNA, 22 nt, Human
agugcagcaugaagcacaugug

SEQ ID NO: 886772 - RNA, 22 nt, Human
aaugaugacaggauaaagaaca

SEQ ID NO: 886773 - RNA, 21 nt, Human
aaugucauugaauggugagac

SEQ ID NO: 886774 - RNA, 22 nt, Human
uugagcuugaggaguuauuuga

SEQ ID NO: 886775 - RNA, 22 nt, Human
ggcugggcaaacaagacucuuc

SEQ ID NO: 886776 - RNA, 17 nt, Human
cagagucugucugcauc

SEQ ID NO: 886777 - RNA, 22 nt, Human
agucagagucgccgacagucaa

SEQ ID NO: 886778 - RNA, 22 nt, Human
caggggcaagaaugcugucagc

SEQ ID NO: 886779 - RNA, 22 nt, Human
ggcagcaagcagaaguucuaug

SEQ ID NO: 886780 - RNA, 22 nt, Human
cacaugagugagaacaugcagu

SEQ ID NO: 886781 - RNA, 22 nt, Human
ucugcagggaugugagggguga

SEQ ID NO: 886782 - RNA, 22 nt, Human
augacacuguccuaguaaggaa

SEQ ID NO: 886783 - RNA, 22 nt, Human
aggccaggaauccuugucccag

SEQ ID NO: 886784 - RNA, 22 nt, Human
cacuuucaaguuucagaggaua

SEQ ID NO: 886785 - RNA, 22 nt, Human
cagcuacaaauacuuuuguaug

SEQ ID NO: 886786 - RNA, 22 nt, Human
agacagcauggagcugauaaca

SEQ ID NO: 886787 - RNA, 22 nt, Human
ugcagcugacccacuccagucc

SEQ ID NO: 886788 - RNA, 22 nt, Human
caguuuaggagagacgcguucu

SEQ ID NO: 886789 - RNA, 22 nt, Human
cagcuguggagauggggugcau

SEQ ID NO: 886790 - RNA, 18 nt, Human
cccugagaugaugcugug

SEQ ID NO: 886791 - RNA, 22 nt, Human
gcugauuauuacaugucugugg

SEQ ID NO: 886792 - RNA, 22 nt, Human
ucacagaaagcuguguccugac

SEQ ID NO: 886793 - RNA, 22 nt, Human
aggcagacaaggucccuggucu

SEQ ID NO: 886794 - RNA, 18 nt, Human
gccugcucugcucucccc

SEQ ID NO: 886795 - RNA, 22 nt, Human
aggcugugaugagccucaugga

SEQ ID NO: 886796 - RNA, 17 nt, Human
ugagcaguagaagaugc

SEQ ID NO: 886797 - RNA, 23 nt, Human
aaugaugucagaagaugaagucu

SEQ ID NO: 886798 - RNA, 22 nt, Human
cuacucuuuugagucuucagau

SEQ ID NO: 886799 - RNA, 21 nt, Human
ugcagggaucuuucugccuga

SEQ ID NO: 886800 - RNA, 22 nt, Human
agggccugggaagaggaacccu

SEQ ID NO: 886801 - RNA, 17 nt, Human
ccacagccuggcacuug

SEQ ID NO: 886802 - RNA, 22 nt, Human
uccugggcaaagaggggcagug

SEQ ID NO: 886803 - RNA, 18 nt, Human
ugccugccccguaagggu

SEQ ID NO: 886804 - RNA, 22 nt, Human
acuuuccuggcccuguccucug

SEQ ID NO: 886805 - RNA, 22 nt, Human
caugaaagcaggaaugguuuua

SEQ ID NO: 886806 - RNA, 22 nt, Human
ugaguuauauauacuggcucug

SEQ ID NO: 886807 - RNA, 22 nt, Human
aaauauguaagauuagcacuag

SEQ ID NO: 886808 - RNA, 22 nt, Human
gccaguuuaaaccuugugaaua

SEQ ID NO: 886809 - RNA, 22 nt, Human
cccuggacggggaauaugacuu

SEQ ID NO: 886810 - RNA, 22 nt, Human
cugaaaugguugccuggagaau

SEQ ID NO: 886811 - RNA, 22 nt, Human
aggcaagagugacuacgugaaa

SEQ ID NO: 886812 - RNA, 22 nt, Human
uuugucauucuguguauuuaaa

SEQ ID NO: 886813 - RNA, 22 nt, Human
gagacacaaucucauuuacauu

SEQ ID NO: 886814 - RNA, 22 nt, Human
ugagggugggccugcaggaaga

SEQ ID NO: 886815 - RNA, 20 nt, Human
uccauucagcauuguggaaa

SEQ ID NO: 886816 - RNA, 22 nt, Human
uacaaacuuguuuuaaguaagu

SEQ ID NO: 886817 - RNA, 22 nt, Human
uggcuagcaacucaacuguuaa

SEQ ID NO: 886818 - RNA, 22 nt, Human
acaaauagagauucaaauaaag

SEQ ID NO: 886819 - RNA, 22 nt, Human
agauacagaaugguuguuuguc

SEQ ID NO: 886820 - RNA, 22 nt, Human
uguggucucguuauguugccca

SEQ ID NO: 886821 - RNA, 22 nt, Human
uuucacauguauauaggcauua

SEQ ID NO: 886822 - RNA, 19 nt, Human
uucuguguuaauuccuuua

SEQ ID NO: 886823 - RNA, 22 nt, Human
ucagucccuaaggauaugggcu

SEQ ID NO: 886824 - RNA, 22 nt, Human
auggaacugaucaggagugcca

SEQ ID NO: 886825 - RNA, 22 nt, Human
augugucuggcauggcucuauu

SEQ ID NO: 886826 - RNA, 22 nt, Human
guucacaauuuuuacugauugg

SEQ ID NO: 886827 - RNA, 22 nt, Human
uucugggcaguuggaaauuuca

SEQ ID NO: 886828 - RNA, 22 nt, Human
aaauguaguugaaaaguuaagg

SEQ ID NO: 886829 - RNA, 22 nt, Human
gaccagagaaaggcacuggaag

SEQ ID NO: 886830 - RNA, 22 nt, Human
gcaguggcagcugaggggguau

SEQ ID NO: 886831 - RNA, 22 nt, Human
guuacaauguucuucaguucug

SEQ ID NO: 886832 - RNA, 22 nt, Human
cacccacauggaaauucacagu

SEQ ID NO: 886833 - RNA, 17 nt, Human
ucuaggagagcagagcu

SEQ ID NO: 886834 - RNA, 23 nt, Human
uggcaggaaaugagaauguuccu

SEQ ID NO: 886835 - RNA, 22 nt, Human
aggucuggaggcggagucagga

SEQ ID NO: 886836 - RNA, 20 nt, Human
gcaaauggacacucagggaa

SEQ ID NO: 886837 - RNA, 22 nt, Human
ucagaauugauuuucaaaacag

SEQ ID NO: 886838 - RNA, 22 nt, Human
gcuuuagagcccagcuuggugg

SEQ ID NO: 886839 - RNA, 22 nt, Human
uucaugaauaccccuucuguaa

SEQ ID NO: 886840 - RNA, 22 nt, Human
gauaaacacaaggugauuucau

SEQ ID NO: 886841 - RNA, 22 nt, Human
uauuuauaccaggugaucggag

SEQ ID NO: 886842 - RNA, 22 nt, Human
agauuuccguucucucuucagu

SEQ ID NO: 886843 - RNA, 22 nt, Human
acccaggauagagugcugcagu

SEQ ID NO: 886844 - RNA, 22 nt, Human
cagcaagaacagccugaugugc

SEQ ID NO: 886845 - RNA, 19 nt, Human
gauuuaaacguggcucuau

SEQ ID NO: 886846 - RNA, 22 nt, Human
uguauacacguaccuuuucuuu

SEQ ID NO: 886847 - RNA, 22 nt, Human
ggcauuaacucuguuucaauuu

SEQ ID NO: 886848 - RNA, 22 nt, Human
ggagaacaggcaagcaucuggc

SEQ ID NO: 886849 - RNA, 22 nt, Human
uuuguguuuuagcuggugaggc

SEQ ID NO: 886850 - RNA, 22 nt, Human
uggcuggcugucaguaggcugu

SEQ ID NO: 886851 - RNA, 22 nt, Human
ugccauauugaugugcuguacc

SEQ ID NO: 886852 - RNA, 22 nt, Human
cagcaaauacuacuaguuuuua

SEQ ID NO: 886853 - RNA, 22 nt, Human
gcugaaggucucuggagagguc

SEQ ID NO: 886854 - RNA, 22 nt, Human
ggcuccuguccccucagcugcu

SEQ ID NO: 886855 - RNA, 23 nt, Human
aaacauuucucuuuuccugccuc

SEQ ID NO: 886856 - RNA, 22 nt, Human
caguacauaaugcgcaaaaccg

SEQ ID NO: 886857 - RNA, 22 nt, Human
gcccagggcagggcaagaguga

SEQ ID NO: 886858 - RNA, 22 nt, Human
ugcagaguccucuggagggacu

SEQ ID NO: 886859 - RNA, 22 nt, Human
agcuugaaccacaugaaauugc

SEQ ID NO: 886860 - RNA, 22 nt, Human
auccauuucuaucuugcugagg

SEQ ID NO: 886861 - RNA, 22 nt, Human
uuuccacccagagcauuuguuu

SEQ ID NO: 886862 - RNA, 22 nt, Human
ugaaccagagucuccagugguu

SEQ ID NO: 886863 - RNA, 22 nt, Human
cugccagcucaaagcgcagcua

SEQ ID NO: 886864 - RNA, 22 nt, Human
caaguuuugauuuugcaguaaa

SEQ ID NO: 886865 - RNA, 22 nt, Human
ucugugaacaucacauugacag

SEQ ID NO: 886866 - RNA, 22 nt, Human
uuacaagacagugugguaaaua

SEQ ID NO: 886867 - RNA, 22 nt, Human
uuaugauuugccacagauuggu

SEQ ID NO: 886868 - RNA, 17 nt, Human
augcucuauagucagug

SEQ ID NO: 886869 - RNA, 22 nt, Human
cagcuugggaguuugguuuuau

SEQ ID NO: 886870 - RNA, 21 nt, Human
cugagcuggggugaagguugc

SEQ ID NO: 886871 - RNA, 22 nt, Human
uggccguguuagauguuuggcu

SEQ ID NO: 886872 - RNA, 22 nt, Human
acauagaacuucccagugagca

SEQ ID NO: 886873 - RNA, 22 nt, Human
uuaaaugacuuuuauuauucuc

SEQ ID NO: 886874 - RNA, 22 nt, Human
acaauucucucauaucuuauua

SEQ ID NO: 886875 - RNA, 22 nt, Human
ucauaaauugauuaugugcuuu

SEQ ID NO: 886876 - RNA, 22 nt, Human
aaaggcaagcauuuauauagga

SEQ ID NO: 886877 - RNA, 22 nt, Human
ugaggggaacugaugcccauug

SEQ ID NO: 886878 - RNA, 22 nt, Human
aaagcacucguuaguauuucug

SEQ ID NO: 886879 - RNA, 22 nt, Human
caagagacgggcaaggcaagag

SEQ ID NO: 886880 - RNA, 22 nt, Human
guuaaacaguuacaugugcugg

SEQ ID NO: 886881 - RNA, 19 nt, Human
ggaaccuuagagcuucagc

SEQ ID NO: 886882 - RNA, 22 nt, Human
ucacacagugguaaaacccuga

SEQ ID NO: 886883 - RNA, 22 nt, Human
caaaggcuucaucucagagcag

SEQ ID NO: 886884 - RNA, 22 nt, Human
agaacagcugcaaaacuuaauc

SEQ ID NO: 886885 - RNA, 22 nt, Human
gaagucucauaguuaaaauucu

SEQ ID NO: 886886 - RNA, 22 nt, Human
uacuuuauuguaaaugcugaug

SEQ ID NO: 886887 - RNA, 22 nt, Human
ccaguacuuugugcaacaaaug

SEQ ID NO: 886888 - RNA, 22 nt, Human
gcugccugcaguguuuucccag

SEQ ID NO: 886889 - RNA, 23 nt, Human
ucagaaguuugguuguaacaugg

SEQ ID NO: 886890 - RNA, 22 nt, Human
aaggcuuggucuagucaugcca

SEQ ID NO: 886891 - RNA, 22 nt, Human
uugacaauguccuuugaauuuc

SEQ ID NO: 886892 - RNA, 17 nt, Human
ccugucuuguuucugcc

SEQ ID NO: 886893 - RNA, 22 nt, Human
uuacuugcuuauaaucaaaaca

SEQ ID NO: 886894 - RNA, 22 nt, Human
gaacugucauuggggacaucag

SEQ ID NO: 886895 - RNA, 22 nt, Human
cacagugaacauucugucaggg

SEQ ID NO: 886896 - RNA, 22 nt, Human
aagcaaagugaauuuugccaag

SEQ ID NO: 886897 - RNA, 22 nt, Human
gugcaggagcuucuggccugac

SEQ ID NO: 886898 - RNA, 22 nt, Human
gggcuucaggagggucagccca

SEQ ID NO: 886899 - RNA, 22 nt, Human
uucuaacucaaagcuucuuuca

SEQ ID NO: 886900 - RNA, 22 nt, Human
auguggccuaguauagaaauga

SEQ ID NO: 886901 - RNA, 22 nt, Human
gccagcagggcggagccaucua

SEQ ID NO: 886902 - RNA, 22 nt, Human
gaggcucuggaguagguacaca

SEQ ID NO: 886903 - RNA, 22 nt, Human
cacagagaccccuucuggggcc

SEQ ID NO: 886904 - RNA, 22 nt, Human
ggcaucagcccgguccugggcu

SEQ ID NO: 886905 - RNA, 22 nt, Human
uccuggcucaggccccuggugc

SEQ ID NO: 886906 - RNA, 22 nt, Human
auucagugaccuaauuacuuac

SEQ ID NO: 886907 - RNA, 22 nt, Human
caaaccuuguuccagucaacuc

SEQ ID NO: 886908 - RNA, 22 nt, Human
aauggguuguagggaaagucaa

SEQ ID NO: 886909 - RNA, 22 nt, Human
uccuggguccugggaagcccug

SEQ ID NO: 886910 - RNA, 22 nt, Human
aaacaguuuucucauuuagugu

SEQ ID NO: 886911 - RNA, 19 nt, Human
uuuuuacaaguagguguga

SEQ ID NO: 886912 - RNA, 22 nt, Human
cagaggaagagauacaagcccu

SEQ ID NO: 886913 - RNA, 21 nt, Human
cucugcccagggccuccugcc

SEQ ID NO: 886914 - RNA, 22 nt, Human
ucaggaggccaccaggaccugu

SEQ ID NO: 886915 - RNA, 22 nt, Human
caguggaugguuugucuugccu

SEQ ID NO: 886916 - RNA, 22 nt, Human
ugugugugcaggagagcaggug

SEQ ID NO: 886917 - RNA, 22 nt, Human
ugauaucuaagaaauucuacca

SEQ ID NO: 886918 - RNA, 22 nt, Human
uggcuggauaucagaggaagug

SEQ ID NO: 886919 - RNA, 22 nt, Human
uuuaccaaaugagacuauuguu

SEQ ID NO: 886920 - RNA, 22 nt, Human
uuuggugagcugcgagugagga

SEQ ID NO: 886921 - RNA, 23 nt, Human
uagugucaagagggaguguaauu

SEQ ID NO: 886922 - RNA, 22 nt, Human
ccaguguggccaggucuucugg

SEQ ID NO: 886923 - RNA, 19 nt, Human
uuugagaaguuauuaucua

SEQ ID NO: 886924 - RNA, 22 nt, Human
acaauguguuuuuauacauuug

SEQ ID NO: 886925 - RNA, 22 nt, Human
gccagcugagaaaucauugaua

SEQ ID NO: 886926 - RNA, 22 nt, Human
gcuguguggcugugccgucacg

SEQ ID NO: 886927 - RNA, 21 nt, Human
aaaaaugaaguuguucaggaa

SEQ ID NO: 886928 - RNA, 22 nt, Human
ugcuacaugcacugugaucuag

SEQ ID NO: 886929 - RNA, 22 nt, Human
cccuguccuuggcugugaggcu

SEQ ID NO: 886930 - RNA, 22 nt, Human
acauuagagaagcuuggagaug

SEQ ID NO: 886931 - RNA, 22 nt, Human
gccagagagacugauacaugcu

SEQ ID NO: 886932 - RNA, 22 nt, Human
ucacugaaagaaugacauuaug

SEQ ID NO: 886933 - RNA, 22 nt, Human
uuuauacauggagaauuuuugc

SEQ ID NO: 886934 - RNA, 22 nt, Human
auucagaauggcaaacuucuag

SEQ ID NO: 886935 - RNA, 22 nt, Human
gaccccaaacccuguauucuuc

SEQ ID NO: 886936 - RNA, 21 nt, Human
guauaucagcagugaauucaa

SEQ ID NO: 886937 - RNA, 22 nt, Human
uggcucucaauggcuguacuau

SEQ ID NO: 886938 - RNA, 22 nt, Human
ucauuuuucacacagggucacc

SEQ ID NO: 886939 - RNA, 22 nt, Human
cucugucacuucuccagcugag

SEQ ID NO: 886940 - RNA, 22 nt, Human
ucaggaguaaggguaacccaga

SEQ ID NO: 886941 - RNA, 22 nt, Human
gagaaacuaacaucugaaggug

SEQ ID NO: 886942 - RNA, 22 nt, Human
aucucuccuucagcugaggccc

SEQ ID NO: 886943 - RNA, 22 nt, Human
aauacagugaaagugagcaagg

SEQ ID NO: 886944 - RNA, 23 nt, Human
gaggagggucugacaaguguagc

SEQ ID NO: 886945 - RNA, 22 nt, Human
aguaaagcggugucacagaaug

SEQ ID NO: 886946 - RNA, 22 nt, Human
caauuuuauugguccaaauaca

SEQ ID NO: 886947 - RNA, 19 nt, Human
aggcuggaugcccaucuua

SEQ ID NO: 886948 - RNA, 22 nt, Human
cacacauggucaguggcuacuc

SEQ ID NO: 886949 - RNA, 18 nt, Human
cugcugcaggcacucagg

SEQ ID NO: 886950 - RNA, 22 nt, Human
gaaaucuuccaauggucacauc

SEQ ID NO: 886951 - RNA, 22 nt, Human
cugccaggccuggggugcuguc

SEQ ID NO: 886952 - RNA, 22 nt, Human
ggcagccacccugggaggcaga

SEQ ID NO: 886953 - RNA, 22 nt, Human
ugaguuuuggaagacaacacaa

SEQ ID NO: 886954 - RNA, 22 nt, Human
aagucuugguagagaaggacuu

SEQ ID NO: 886955 - RNA, 22 nt, Human
gcugucacaucaaggcacuaaa

SEQ ID NO: 886956 - RNA, 22 nt, Human
aggcagccagauggcagccugc

SEQ ID NO: 886957 - RNA, 22 nt, Human
gcaggagcccuggcauguucuu

SEQ ID NO: 886958 - RNA, 21 nt, Human
cagaucuguagguacuaccau

SEQ ID NO: 886959 - RNA, 22 nt, Human
aagcuauagaguguaagaugau

SEQ ID NO: 886960 - RNA, 22 nt, Human
augcauauuucuuggagcaccu

SEQ ID NO: 886961 - RNA, 23 nt, Human
cacagucauuuacuuugccauca

SEQ ID NO: 886962 - RNA, 18 nt, Human
cuacauucauaggaaagg

SEQ ID NO: 886963 - RNA, 22 nt, Human
aaacagcagcuguuuaauuugc

SEQ ID NO: 886964 - RNA, 22 nt, Human
ggcagcugggucacaccgaucu

SEQ ID NO: 886965 - RNA, 22 nt, Human
uuuagaaggacuacagugugau

SEQ ID NO: 886966 - RNA, 22 nt, Human
uuugauaagagcugcugaaacu

SEQ ID NO: 886967 - RNA, 22 nt, Human
ccugcugugaaacuggcauaug

SEQ ID NO: 886968 - RNA, 22 nt, Human
cagcaucuguuuuucugaccca

SEQ ID NO: 886969 - RNA, 22 nt, Human
acagagggggccuuggagugca

SEQ ID NO: 886970 - RNA, 22 nt, Human
aaagucugagcagaauuucuca

SEQ ID NO: 886971 - RNA, 22 nt, Human
gccugggugaauuugauccuaa

SEQ ID NO: 886972 - RNA, 22 nt, Human
aaaugaacaucaagaauagccu

SEQ ID NO: 886973 - RNA, 22 nt, Human
auuuccuucggacaguuugggu

SEQ ID NO: 886974 - RNA, 22 nt, Human
uuacagagaggugauugugaag

SEQ ID NO: 886975 - RNA, 22 nt, Human
aggcaauuguuuguguaauagg

SEQ ID NO: 886976 - RNA, 22 nt, Human
gcauugaagaucuuagacuagg

SEQ ID NO: 886977 - RNA, 22 nt, Human
uacucaaacucacuaagacaga

SEQ ID NO: 886978 - RNA, 22 nt, Human
cugggacccugcccuguggccu

SEQ ID NO: 886979 - RNA, 22 nt, Human
uuugaagacuacugggagugaa

SEQ ID NO: 886980 - RNA, 22 nt, Human
gggggagaagauucugcugcuu

SEQ ID NO: 886981 - RNA, 22 nt, Human
ccugcuggaccucaacacauuu

SEQ ID NO: 886982 - RNA, 22 nt, Human
agucagcuuggcuccucccaug

SEQ ID NO: 886983 - RNA, 22 nt, Human
aagaggcaguggugaugaaugg

SEQ ID NO: 886984 - RNA, 22 nt, Human
cagaggcuagacugugcuuccu

SEQ ID NO: 886985 - RNA, 22 nt, Human
ggucagaggucccagaagaagc

SEQ ID NO: 886986 - RNA, 22 nt, Human
aggaaaacacaguauugaugga

SEQ ID NO: 886987 - RNA, 22 nt, Human
augacagaggauuguaaagagg

SEQ ID NO: 886988 - RNA, 22 nt, Human
ggcuaggcgggcacauggugga

SEQ ID NO: 886989 - RNA, 23 nt, Human
uccucgcaggagggagaugaugc

SEQ ID NO: 886990 - RNA, 22 nt, Human
uucucuuugacauuauucaggu

SEQ ID NO: 886991 - RNA, 22 nt, Human
uccaacuuucuccuccggcuug

SEQ ID NO: 886992 - RNA, 22 nt, Human
gcucugcucuaacauuccugac

SEQ ID NO: 886993 - RNA, 22 nt, Human
uguaagaaaaguaaauagugac

SEQ ID NO: 886994 - RNA, 22 nt, Human
ggagucaccugggaggacuggg

SEQ ID NO: 886995 - RNA, 22 nt, Human
ugauuagacaaaggaaucaugc

SEQ ID NO: 886996 - RNA, 22 nt, Human
gacccugccaugagugacaggg

SEQ ID NO: 886997 - RNA, 22 nt, Human
gucugggacaggacuggggaac

SEQ ID NO: 886998 - RNA, 22 nt, Human
gaggagagccugcacuuugacc

SEQ ID NO: 886999 - RNA, 22 nt, Human
uggcuucagaucugccccggag

SEQ ID NO: 887000 - RNA, 22 nt, Human
ucagggcccuggacaacccucc

SEQ ID NO: 887001 - RNA, 22 nt, Human
ugggucccucuggaguaguaca

SEQ ID NO: 887002 - RNA, 22 nt, Human
aggccugacuugaauuuagggc

SEQ ID NO: 887003 - RNA, 22 nt, Human
uggccuccucgggcugacccug

SEQ ID NO: 887004 - RNA, 22 nt, Human
ugcuccagcaugacccucaaug

SEQ ID NO: 887005 - RNA, 22 nt, Human
cuggaggugggggcaagagugu

SEQ ID NO: 887006 - RNA, 22 nt, Human
ggcaggcaccagcucagcaaua

SEQ ID NO: 887007 - RNA, 22 nt, Human
cugagggcuggagcugaggccu

SEQ ID NO: 887008 - RNA, 22 nt, Human
uuugagaagauguaauguuaag

SEQ ID NO: 887009 - RNA, 22 nt, Human
auggcacugaccucccuuguaa

SEQ ID NO: 887010 - RNA, 18 nt, Human
aacuucaacuacaaugga

SEQ ID NO: 887011 - RNA, 22 nt, Human
ggaggcucagugaggaaaugga

SEQ ID NO: 887012 - RNA, 22 nt, Human
gugauucuaaagcuuugagcag

SEQ ID NO: 887013 - RNA, 22 nt, Human
agggauguaaauucuucuucuu

SEQ ID NO: 887014 - RNA, 22 nt, Human
ugggcucagggucgaggacuuu

SEQ ID NO: 887015 - RNA, 22 nt, Human
aacaucucauggacuacauucu

SEQ ID NO: 887016 - RNA, 18 nt, Human
cugggucuccaggcugcc

SEQ ID NO: 887017 - RNA, 22 nt, Human
caaguuugcugauccuuguuuu

SEQ ID NO: 887018 - RNA, 22 nt, Human
cacaggaaucagcauuaauggc

SEQ ID NO: 887019 - RNA, 18 nt, Human
gccaggaagaggaaugug

SEQ ID NO: 887020 - RNA, 21 nt, Human
ucacaguucaagaugaacccc

SEQ ID NO: 887021 - RNA, 23 nt, Human
ucccuguguacagccugcaugag

SEQ ID NO: 887022 - RNA, 22 nt, Human
ggcagccaugcuccaggugcag

SEQ ID NO: 887023 - RNA, 22 nt, Human
gcauaauuaaacaggcaagauu

SEQ ID NO: 887024 - RNA, 22 nt, Human
cagugcagguggcagaggacag

SEQ ID NO: 887025 - RNA, 22 nt, Human
uuacuguucauguuguacacuu

SEQ ID NO: 887026 - RNA, 22 nt, Human
cauguacauucuguagauggag

SEQ ID NO: 887027 - RNA, 23 nt, Human
uggcucugugucacauacaggau

SEQ ID NO: 887028 - RNA, 22 nt, Human
uccugaaggcagauggggauca

SEQ ID NO: 887029 - RNA, 22 nt, Human
aucuguuguuuuucaccaccca

SEQ ID NO: 887030 - RNA, 23 nt, Human
uguguguguauucuacgcaaggu

SEQ ID NO: 887031 - RNA, 22 nt, Human
gcaggaauauaguauuucgagg

SEQ ID NO: 887032 - RNA, 22 nt, Human
ggagguauuugucaaucuguuu

SEQ ID NO: 887033 - RNA, 22 nt, Human
uccaggagggguaggcaguaug

SEQ ID NO: 887034 - RNA, 22 nt, Human
uuguggcucaucuucagcuccc

SEQ ID NO: 887035 - RNA, 22 nt, Human
guuuuucucugaaauaguugac

SEQ ID NO: 887036 - RNA, 22 nt, Human
agaaguuugaaauuaggagaaa

SEQ ID NO: 887037 - RNA, 22 nt, Human
gugucaugcacacucaguguug

SEQ ID NO: 887038 - RNA, 22 nt, Human
auuucaugaaugcugcuguuga

SEQ ID NO: 887039 - RNA, 22 nt, Human
aaggcagggaaaguggauuagg

SEQ ID NO: 887040 - RNA, 22 nt, Human
ccagcagguguagggcucaugg

SEQ ID NO: 887041 - RNA, 22 nt, Human
uggccagaccugacugucaggg

SEQ ID NO: 887042 - RNA, 22 nt, Human
cauuaacaauuguuuaugcugu

SEQ ID NO: 887043 - RNA, 22 nt, Human
accaggcuggagugcaguggcg

SEQ ID NO: 887044 - RNA, 22 nt, Human
aagaucauaauauuuaucucau

SEQ ID NO: 887045 - RNA, 22 nt, Human
ugugugcacaugauuugaaaug

SEQ ID NO: 887046 - RNA, 22 nt, Human
cucagggacguuagaggacagg

SEQ ID NO: 887047 - RNA, 22 nt, Human
ucagguuuuucucaaaucaggu

SEQ ID NO: 887048 - RNA, 22 nt, Human
cuuggauucauugugggaggga

SEQ ID NO: 887049 - RNA, 22 nt, Human
auguuucugaguguauauacau

SEQ ID NO: 887050 - RNA, 22 nt, Human
ucucccacuggccuuguaugau

SEQ ID NO: 887051 - RNA, 22 nt, Human
aagagcuggcucuugcagcagc

SEQ ID NO: 887052 - RNA, 22 nt, Human
agguccaggcauuuggguuggg

SEQ ID NO: 887053 - RNA, 22 nt, Human
cccugcacagccuggcucucuu

SEQ ID NO: 887054 - RNA, 22 nt, Human
ccucugagagaaggccuucagc

SEQ ID NO: 887055 - RNA, 22 nt, Human
cuucaaacacuagaaacacagg

SEQ ID NO: 887056 - RNA, 22 nt, Human
aaguuaggagaguaaaguggua

SEQ ID NO: 887057 - RNA, 22 nt, Human
aggcagccauuaccaagggcau

SEQ ID NO: 887058 - RNA, 22 nt, Human
gagcugcagacauagauaagcg

SEQ ID NO: 887059 - RNA, 22 nt, Human
gaggccugggagaacuguuuuu

SEQ ID NO: 887060 - RNA, 22 nt, Human
uagggcugcagaacaauggccu

SEQ ID NO: 887061 - RNA, 16 nt, Human
acacaguuuuaaggca

SEQ ID NO: 887062 - RNA, 22 nt, Human
cugggcuucucccccuggcaga

SEQ ID NO: 887063 - RNA, 22 nt, Human
aaucacaaaugcaaguugucac

SEQ ID NO: 887064 - RNA, 22 nt, Human
cagaacauuccaugugcccugc

SEQ ID NO: 887065 - RNA, 22 nt, Human
gcccuugggagguuccacuggg

SEQ ID NO: 887066 - RNA, 22 nt, Human
gagagcuguaauagucaugucu

SEQ ID NO: 887067 - RNA, 21 nt, Human
cugcugcuggggucugggcag

SEQ ID NO: 887068 - RNA, 22 nt, Human
agggcuagaguugagaugggga

SEQ ID NO: 887069 - RNA, 22 nt, Human
gacauucauuaagccuuucugu

SEQ ID NO: 887070 - RNA, 22 nt, Human
auagaauucguguuuguaauuc

SEQ ID NO: 887071 - RNA, 22 nt, Human
ccucuggaucuuucuccacacu

SEQ ID NO: 887072 - RNA, 22 nt, Human
ccagggggcuuggugaggccau

SEQ ID NO: 887073 - RNA, 22 nt, Human
acagugugaugggccugccuga

SEQ ID NO: 887074 - RNA, 22 nt, Human
caggggggcaggagucauugau

SEQ ID NO: 887075 - RNA, 22 nt, Human
uaauuuauauggaauuguugcu

SEQ ID NO: 887076 - RNA, 19 nt, Human
cuuccuugcuccccaugug

SEQ ID NO: 887077 - RNA, 22 nt, Human
cagaguacauaggagcaaauca

SEQ ID NO: 887078 - RNA, 18 nt, Human
gccuggcuucggagccgc

SEQ ID NO: 887079 - RNA, 17 nt, Human
gacuucaacuucugcug

SEQ ID NO: 887080 - RNA, 22 nt, Human
cagcaucccucaggggccucug

SEQ ID NO: 887081 - RNA, 22 nt, Human
ccaguccauauuuauacugccg

SEQ ID NO: 887082 - RNA, 22 nt, Human
ggggaacaccgggcagaggcgc

SEQ ID NO: 887083 - RNA, 22 nt, Human
ugaaacauuauagaauauuuau

SEQ ID NO: 887084 - RNA, 22 nt, Human
acacugaaucagaaauuguugg

SEQ ID NO: 887085 - RNA, 22 nt, Human
acagccaguaaggaaagaccca

SEQ ID NO: 887086 - RNA, 22 nt, Human
cauaaaguuaagcuguaaguau

SEQ ID NO: 887087 - RNA, 22 nt, Human
uucucaaagaaagcugucauua

SEQ ID NO: 887088 - RNA, 22 nt, Human
gucuuauuuaaagagaucauac

SEQ ID NO: 887089 - RNA, 22 nt, Human
cugccacuuuggagugcucaga

SEQ ID NO: 887090 - RNA, 22 nt, Human
ucuuuauguaagacugggcuug

SEQ ID NO: 887091 - RNA, 19 nt, Human
agccagaguggcccagggg

SEQ ID NO: 887092 - RNA, 22 nt, Human
acuaaauggaaugauuacuaua

SEQ ID NO: 887093 - RNA, 22 nt, Human
uucacagugagcuaugucuugu

SEQ ID NO: 887094 - RNA, 22 nt, Human
caggcagcagaggaguguggga

SEQ ID NO: 887095 - RNA, 20 nt, Human
cuguggcucaugcaucugcc

SEQ ID NO: 887096 - RNA, 22 nt, Human
uaucagugugguuucuggacug

SEQ ID NO: 887097 - RNA, 22 nt, Human
acauuucauuugcaguauggau

SEQ ID NO: 887098 - RNA, 22 nt, Human
cacaggagcccugaggccuccc

SEQ ID NO: 887099 - RNA, 23 nt, Human
acaacuuuacagauacauuuugu

SEQ ID NO: 887100 - RNA, 22 nt, Human
aggacucacauagcuucagaug

SEQ ID NO: 887101 - RNA, 22 nt, Human
gucuggagccccagucaaugag

SEQ ID NO: 887102 - RNA, 22 nt, Human
cuuuacuugcuuuguuacaaaa

SEQ ID NO: 887103 - RNA, 22 nt, Human
uugcugaggacgcagugcagug

SEQ ID NO: 887104 - RNA, 22 nt, Human
acagagcaugauggaagaucga

SEQ ID NO: 887105 - RNA, 18 nt, Human
ggguccuguucuuggaag

SEQ ID NO: 887106 - RNA, 22 nt, Human
ucccugcucagcucaccuggca

SEQ ID NO: 887107 - RNA, 22 nt, Human
uucucauaugcacucuauuuga

SEQ ID NO: 887108 - RNA, 22 nt, Human
ugcuagggauauaguggcgagu

SEQ ID NO: 887109 - RNA, 22 nt, Human
uggcuucaaaaucuaguggucu

SEQ ID NO: 887110 - RNA, 22 nt, Human
ccacccuggacaggccucugag

SEQ ID NO: 887111 - RNA, 22 nt, Human
gugcagagaaggagcaguaguu

SEQ ID NO: 887112 - RNA, 23 nt, Human
ccagggagguugauugguuaccc

SEQ ID NO: 887113 - RNA, 22 nt, Human
cacagcauaaugaaauauacuu

SEQ ID NO: 887114 - RNA, 22 nt, Human
aaugaauaccguuucacucagu

SEQ ID NO: 887115 - RNA, 22 nt, Human
gccaggaggggagaguguguca

SEQ ID NO: 887116 - RNA, 22 nt, Human
gaggcagagacuccaccuucag

SEQ ID NO: 887117 - RNA, 22 nt, Human
agauaucaccaguuuuacauac

SEQ ID NO: 887118 - RNA, 22 nt, Human
guuccacauaacacaucuacaa

SEQ ID NO: 887119 - RNA, 22 nt, Human
ugaauuuaccuugccuauauuu

SEQ ID NO: 887120 - RNA, 22 nt, Human
ugcuguguuccucaguuucaug

SEQ ID NO: 887121 - RNA, 22 nt, Human
auccugggaaugggagggucau

SEQ ID NO: 887122 - RNA, 22 nt, Human
ggcagcaaguaggauucuuauu

SEQ ID NO: 887123 - RNA, 22 nt, Human
uguuucacugaaagccuuacua

SEQ ID NO: 887124 - RNA, 22 nt, Human
aaaggcagugugauacuguggu

SEQ ID NO: 887125 - RNA, 22 nt, Human
uugagauauucaguuccauuga

SEQ ID NO: 887126 - RNA, 22 nt, Human
acuuaacagacauuauuuaccu

SEQ ID NO: 887127 - RNA, 22 nt, Human
agucaguggcuccgagccuggu

SEQ ID NO: 887128 - RNA, 22 nt, Human
agcugccuaguagauugauugg

SEQ ID NO: 887129 - RNA, 22 nt, Human
gcaggccuccccugcuggagcu

SEQ ID NO: 887130 - RNA, 22 nt, Human
gccuggcauuggagccggggca

SEQ ID NO: 887131 - RNA, 22 nt, Human
uaaaugcuaucgcauaaaaccu

SEQ ID NO: 887132 - RNA, 20 nt, Human
acagaguagaacauaugcca

SEQ ID NO: 887133 - RNA, 22 nt, Human
gauggcaggcaggugaguagag

SEQ ID NO: 887134 - RNA, 22 nt, Human
uccuggagaaacucagagaucu

SEQ ID NO: 887135 - RNA, 22 nt, Human
uccagggaucuuuagagucuuu

SEQ ID NO: 887136 - RNA, 22 nt, Human
ucugcauggagaggagaugcua

SEQ ID NO: 887137 - RNA, 22 nt, Human
uguucuuuucucuaaacugaua

SEQ ID NO: 887138 - RNA, 22 nt, Human
uugcagagccaugaggcuggcu

SEQ ID NO: 887139 - RNA, 22 nt, Human
gaaaaggcucucacucccuccg

SEQ ID NO: 887140 - RNA, 22 nt, Human
auuuccuaauuuaugcaggagu

SEQ ID NO: 887141 - RNA, 22 nt, Human
gauuaauaguacagguucuuag

SEQ ID NO: 887142 - RNA, 18 nt, Human
aggaagcaggaggaaggc

SEQ ID NO: 887143 - RNA, 22 nt, Human
cugcacauguucaucaugacaa

SEQ ID NO: 887144 - RNA, 22 nt, Human
uauaugcuugugcaugucuuug

SEQ ID NO: 887145 - RNA, 22 nt, Human
uucuggaguucaggucccuaaa

SEQ ID NO: 887146 - RNA, 22 nt, Human
ugggugccaaccucugguggcc

SEQ ID NO: 887147 - RNA, 22 nt, Human
uucuagacaaauguguucauuc

SEQ ID NO: 887148 - RNA, 22 nt, Human
aagccuugcagcauuaggcucu

SEQ ID NO: 887149 - RNA, 22 nt, Human
ucuucucccagggucgcccaag

SEQ ID NO: 887150 - RNA, 22 nt, Human
agcagugagugggaggaccaug

SEQ ID NO: 887151 - RNA, 22 nt, Human
acuuuaugugcuugcucuuucc

SEQ ID NO: 887152 - RNA, 21 nt, Human
ccugaccuaauuugccaucag

SEQ ID NO: 887153 - RNA, 22 nt, Human
caggcugggcuccggagauaaa

SEQ ID NO: 887154 - RNA, 22 nt, Human
ugacccuuguggcagaaaacag

SEQ ID NO: 887155 - RNA, 22 nt, Human
uuauauguuucuguuuggaggc

SEQ ID NO: 887156 - RNA, 22 nt, Human
ugcagagagauauggcaagagg

SEQ ID NO: 887157 - RNA, 22 nt, Human
uucuaguucuuaggaacagaca

SEQ ID NO: 887158 - RNA, 22 nt, Human
uuaggaaacaucauuuuugcug

SEQ ID NO: 887159 - RNA, 22 nt, Human
ucccucagaugagcuccuagca

SEQ ID NO: 887160 - RNA, 22 nt, Human
uagguuuacugaauuaguggaa

SEQ ID NO: 887161 - RNA, 22 nt, Human
ucacuuuugaucccuaugcagu

SEQ ID NO: 887162 - RNA, 22 nt, Human
aaaggcucagaugaggcccugg

SEQ ID NO: 887163 - RNA, 22 nt, Human
aacauuuaugguagucauugca

SEQ ID NO: 887164 - RNA, 23 nt, Human
aagauguauuuuuaccaaauguc

SEQ ID NO: 887165 - RNA, 19 nt, Human
acuggcaguuucugcaugg

SEQ ID NO: 887166 - RNA, 22 nt, Human
ucuuuuauccuacauuuagcuc

SEQ ID NO: 887167 - RNA, 22 nt, Human
gaagauuuguuguaauuuuuag

SEQ ID NO: 887168 - RNA, 22 nt, Human
acccagagaacugugccuugag

SEQ ID NO: 887169 - RNA, 22 nt, Human
auccucucuguuuucguguaug

SEQ ID NO: 887170 - RNA, 22 nt, Human
uaugcuuucauucauaugugag

SEQ ID NO: 887171 - RNA, 19 nt, Human
ggaaggcagaggggcugug

SEQ ID NO: 887172 - RNA, 20 nt, Human
gugggcagagcaccaccugg

SEQ ID NO: 887173 - RNA, 22 nt, Human
aggacuuccaaaccucccaaau

SEQ ID NO: 887174 - RNA, 22 nt, Human
ggccagcugggccaccaggugc

SEQ ID NO: 887175 - RNA, 23 nt, Human
uuccacaaugaaaauaaagcagg

SEQ ID NO: 887176 - RNA, 22 nt, Human
gggcagcauaacaaucacugaa

SEQ ID NO: 887177 - RNA, 22 nt, Human
agccuggaguucccaggagaag

SEQ ID NO: 887178 - RNA, 22 nt, Human
aaugguaauauuggcacagaaa

SEQ ID NO: 887179 - RNA, 22 nt, Human
aaguccagguccucauuccauc

SEQ ID NO: 887180 - RNA, 20 nt, Human
augccucuaauuuugcaaac

SEQ ID NO: 887181 - RNA, 20 nt, Human
augcagcauuguuguggcaa

SEQ ID NO: 887182 - RNA, 22 nt, Human
gggcucuggacccaggcaagag

SEQ ID NO: 887183 - RNA, 22 nt, Human
ccagcuccucuugucucuagca

SEQ ID NO: 887184 - RNA, 22 nt, Human
caguggguaguggggauuagca

SEQ ID NO: 887185 - RNA, 22 nt, Human
uuucuucagagagagcuuuccc

SEQ ID NO: 887186 - RNA, 22 nt, Human
caggaagcaccagcccggcccc

SEQ ID NO: 887187 - RNA, 22 nt, Human
ugaaguuugguggaaauuuccu

SEQ ID NO: 887188 - RNA, 22 nt, Human
uuuuucuugugcuggaucuaau

SEQ ID NO: 887189 - RNA, 22 nt, Human
ucccaagauuagguuggaaagg

SEQ ID NO: 887190 - RNA, 22 nt, Human
acaacuuuucuaucauguggaa

SEQ ID NO: 887191 - RNA, 22 nt, Human
aggggaaggccagccuguagag

SEQ ID NO: 887192 - RNA, 22 nt, Human
uucauuuucuuucacgcugcug

SEQ ID NO: 887193 - RNA, 22 nt, Human
agcuguguggugucugacagcu

SEQ ID NO: 887194 - RNA, 22 nt, Human
aagugugaauuuuagagucagg

SEQ ID NO: 887195 - RNA, 22 nt, Human
agcuggcagcucucagggguac

SEQ ID NO: 887196 - RNA, 22 nt, Human
aagauuuaccacuuuauucaag

SEQ ID NO: 887197 - RNA, 22 nt, Human
gccuggcauuacagcacuccug

SEQ ID NO: 887198 - RNA, 22 nt, Human
aggaccagaggccagagucagc

SEQ ID NO: 887199 - RNA, 22 nt, Human
aucaaguucugucacauuuguc

SEQ ID NO: 887200 - RNA, 22 nt, Human
ugucuccugcaggggugugggc

SEQ ID NO: 887201 - RNA, 22 nt, Human
gcagcugucauuuacaacaggg

SEQ ID NO: 887202 - RNA, 22 nt, Human
cagugauuguacuguugugccu

SEQ ID NO: 887203 - RNA, 22 nt, Human
aggcagcagucaugaggaaaga

SEQ ID NO: 887204 - RNA, 22 nt, Human
gagcaagacccuggguucucuc

SEQ ID NO: 887205 - RNA, 22 nt, Human
uucugaagcucccuuuuguagu

SEQ ID NO: 887206 - RNA, 22 nt, Human
auccccagaaaauaggugccua

SEQ ID NO: 887207 - RNA, 22 nt, Human
cuugcuggagcggagcgggugu

SEQ ID NO: 887208 - RNA, 22 nt, Human
cagguucuggggcuccacugug

SEQ ID NO: 887209 - RNA, 22 nt, Human
ggguccagauggugagaguuaa

SEQ ID NO: 887210 - RNA, 22 nt, Human
gugcugugcgcuuuuucuguau

SEQ ID NO: 887211 - RNA, 22 nt, Human
guuugcauaaaguggaugcagg

SEQ ID NO: 887212 - RNA, 22 nt, Human
gcugucaggaacaugccuuggu

SEQ ID NO: 887213 - RNA, 21 nt, Human
agagcugggacuugccugaga

SEQ ID NO: 887214 - RNA, 20 nt, Human
auuggcugggguucugaugc

SEQ ID NO: 887215 - RNA, 22 nt, Human
uauacacauaucuucuaggccu

SEQ ID NO: 887216 - RNA, 22 nt, Human
uugucugaagucacacagaugc

SEQ ID NO: 887217 - RNA, 22 nt, Human
ggcuccacugcugaccacucca

SEQ ID NO: 887218 - RNA, 22 nt, Human
cuggcaggaagaggaaagguca

SEQ ID NO: 887219 - RNA, 22 nt, Human
cagcccagcagggucuggcccu

SEQ ID NO: 887220 - RNA, 22 nt, Human
agauucuaaacuugauucugcu

SEQ ID NO: 887221 - RNA, 22 nt, Human
gauuacauucuccuuguauuag

SEQ ID NO: 887222 - RNA, 22 nt, Human
uuauuaagugcguacuguaugc

SEQ ID NO: 887223 - RNA, 22 nt, Human
ggcagccagcacgcaguugaug

SEQ ID NO: 887224 - RNA, 22 nt, Human
cuuccucuagccuaguaaugcc

SEQ ID NO: 887225 - RNA, 22 nt, Human
uccauuuuguagguaugcuaca

SEQ ID NO: 887226 - RNA, 22 nt, Human
aaauagcuucuaagccuuuuga

SEQ ID NO: 887227 - RNA, 22 nt, Human
agcauauacaaacucauauaca

SEQ ID NO: 887228 - RNA, 22 nt, Human
ucaaauaaugccauucaucauc

SEQ ID NO: 887229 - RNA, 18 nt, Human
cugaaggcaccagggcag

SEQ ID NO: 887230 - RNA, 19 nt, Human
ucugucacuggggguauuc

SEQ ID NO: 887231 - RNA, 22 nt, Human
auuuaugacaaccaaagaguga

SEQ ID NO: 887232 - RNA, 21 nt, Human
gcagacugcccugcugucccc

SEQ ID NO: 887233 - RNA, 22 nt, Human
ggacccuggagacccacuggga

SEQ ID NO: 887234 - RNA, 22 nt, Human
caaugcugugcuccucaugagg

SEQ ID NO: 887235 - RNA, 22 nt, Human
ggcaggugugagaucgaggcca

SEQ ID NO: 887236 - RNA, 22 nt, Human
gccugccuucggugcgcagcgg

SEQ ID NO: 887237 - RNA, 22 nt, Human
agccugcugggaagggaggcuu

SEQ ID NO: 887238 - RNA, 22 nt, Human
gacuccagagugacuauuuguc

SEQ ID NO: 887239 - RNA, 22 nt, Human
caaaguuuggcucucaugacau

SEQ ID NO: 887240 - RNA, 22 nt, Human
ucucacagggcuaggcccugcc

SEQ ID NO: 887241 - RNA, 22 nt, Human
acagacugucccaccacaugga

SEQ ID NO: 887242 - RNA, 22 nt, Human
gccugcaagauggcuggucacu

SEQ ID NO: 887243 - RNA, 22 nt, Human
gggaaagacuuauuuugacuuc

SEQ ID NO: 887244 - RNA, 22 nt, Human
uucuggaagcugcagguggccg

SEQ ID NO: 887245 - RNA, 22 nt, Human
cacuggaccaaggaaacucuuc

SEQ ID NO: 887246 - RNA, 22 nt, Human
auguuucccagagcaaaucugg

SEQ ID NO: 887247 - RNA, 22 nt, Human
cacauaagaaaugaauaugaga

SEQ ID NO: 887248 - RNA, 22 nt, Human
gaauacauaucagauguguuuc

SEQ ID NO: 887249 - RNA, 22 nt, Human
aguaacagaaggccugacuuaa

SEQ ID NO: 887250 - RNA, 19 nt, Human
acuuucuccaggaccuguu

SEQ ID NO: 887251 - RNA, 22 nt, Human
aggaggugacagccugcaucug

SEQ ID NO: 887252 - RNA, 22 nt, Human
gauggucaggcuuuaacaucug

SEQ ID NO: 887253 - RNA, 22 nt, Human
gugaugucacacccuugauaga

SEQ ID NO: 887254 - RNA, 22 nt, Human
agaaaagaggcuuucuaagcau

SEQ ID NO: 887255 - RNA, 18 nt, Human
ugucuuuggaccacugaa

SEQ ID NO: 887256 - RNA, 22 nt, Human
ggugcggagacuccaugaggcc

SEQ ID NO: 887257 - RNA, 17 nt, Human
caucuuuaaaauccuga

SEQ ID NO: 887258 - RNA, 22 nt, Human
agcuuugggcagaagaggauuc

SEQ ID NO: 887259 - RNA, 21 nt, Human
aaaguguucagaccaguucug

SEQ ID NO: 887260 - RNA, 23 nt, Human
cuucacagguucaggggauuaag

SEQ ID NO: 887261 - RNA, 18 nt, Human
aggcagacacuagagguc

SEQ ID NO: 887262 - RNA, 22 nt, Human
uuauucuguugcuuuuacagua

SEQ ID NO: 887263 - RNA, 22 nt, Human
cuuauuuacugauccacagaug

SEQ ID NO: 887264 - RNA, 22 nt, Human
ccagugcucuuaaaggucauaa

SEQ ID NO: 887265 - RNA, 22 nt, Human
ugugcccauuccacuugaguac

SEQ ID NO: 887266 - RNA, 19 nt, Human
aggguccagggagcggcuc

SEQ ID NO: 887267 - RNA, 22 nt, Human
agcccugugggccuuguggcac

SEQ ID NO: 887268 - RNA, 22 nt, Human
ucagaagucccagaauucacau

SEQ ID NO: 887269 - RNA, 23 nt, Human
gccugggacucaggaggagcuca

SEQ ID NO: 887270 - RNA, 22 nt, Human
ucagacaugggauaugaagcuc

SEQ ID NO: 887271 - RNA, 22 nt, Human
caggcuagauuggggccaguag

SEQ ID NO: 887272 - RNA, 22 nt, Human
cuguuuuugugcugugucuccc

SEQ ID NO: 887273 - RNA, 22 nt, Human
ccugcuccugcuauucuucugg

SEQ ID NO: 887274 - RNA, 23 nt, Human
acauuacacgcaguaauugcccc

SEQ ID NO: 887275 - RNA, 22 nt, Human
cagaggcuguguaggcagacug

SEQ ID NO: 887276 - RNA, 22 nt, Human
uucaguguuacucaaggggcag

SEQ ID NO: 887277 - RNA, 22 nt, Human
ucucaaaucaaacuuugagcuu

SEQ ID NO: 887278 - RNA, 22 nt, Human
auuucucacugagcagauaaaa

SEQ ID NO: 887279 - RNA, 22 nt, Human
ccuggcagguuacaaccaguua

SEQ ID NO: 887280 - RNA, 22 nt, Human
uccaccuagcauucaccuccua

SEQ ID NO: 887281 - RNA, 22 nt, Human
auuuaugauagcugcauuaaag

SEQ ID NO: 887282 - RNA, 22 nt, Human
ggcugccacgucgaggguccaa

SEQ ID NO: 887283 - RNA, 22 nt, Human
aagcagaauuucccacuaguug

SEQ ID NO: 887284 - RNA, 22 nt, Human
uuugacaacguuguugugagga

SEQ ID NO: 887285 - RNA, 22 nt, Human
caaaaguucucacccagacaug

SEQ ID NO: 887286 - RNA, 22 nt, Human
uuuuccuuugaaaggugagggc

SEQ ID NO: 887287 - RNA, 22 nt, Human
agguaugagagccacucuguag

SEQ ID NO: 887288 - RNA, 23 nt, Human
uagauagcacacugacaucugac

SEQ ID NO: 887289 - RNA, 22 nt, Human
gcagacacauccacuccuacag

SEQ ID NO: 887290 - RNA, 22 nt, Human
ggaggccauaguuugggaguca

SEQ ID NO: 887291 - RNA, 22 nt, Human
uccaaauauucaucuacuucug

SEQ ID NO: 887292 - RNA, 22 nt, Human
gaaacauucauaugagaaaccu

SEQ ID NO: 887293 - RNA, 22 nt, Human
auucuuuuuuaaggaauagaac

SEQ ID NO: 887294 - RNA, 22 nt, Human
caggaauguagcagcgauggaa

SEQ ID NO: 887295 - RNA, 22 nt, Human
uguauuuaauuguaucaucaca

SEQ ID NO: 887296 - RNA, 22 nt, Human
cugcccugugcacaggaaacug

SEQ ID NO: 887297 - RNA, 20 nt, Human
uuucaguuaucuugaccuuc

SEQ ID NO: 887298 - RNA, 22 nt, Human
caugaaccaaaccaaagugucc

SEQ ID NO: 887299 - RNA, 22 nt, Human
uguguauguaagcaugugcaua

SEQ ID NO: 887300 - RNA, 22 nt, Human
cccuggagugugacgaggcauu

SEQ ID NO: 887301 - RNA, 22 nt, Human
gacaccaggaauaguucugucu

SEQ ID NO: 887302 - RNA, 22 nt, Human
aggcccuauucaauggggccca

SEQ ID NO: 887303 - RNA, 18 nt, Human
cagaaaguuauuuacucu

SEQ ID NO: 887304 - RNA, 22 nt, Human
aagaucaggcguggaaaacacu

SEQ ID NO: 887305 - RNA, 21 nt, Human
acaggcaaauuuuagacaaug

SEQ ID NO: 887306 - RNA, 22 nt, Human
uguuacaguacuacaauucugc

SEQ ID NO: 887307 - RNA, 18 nt, Human
cuuucaguaauuucagcc

SEQ ID NO: 887308 - RNA, 22 nt, Human
ccagggcugagcugugaccaug

SEQ ID NO: 887309 - RNA, 22 nt, Human
uuuagguuuuuucacguggcua

SEQ ID NO: 887310 - RNA, 22 nt, Human
cuuuauauauucccaggcugcc

SEQ ID NO: 887311 - RNA, 23 nt, Human
uugaaaaauauagucccauuguc

SEQ ID NO: 887312 - RNA, 22 nt, Human
aggccagacuuuggccaaaucc

SEQ ID NO: 887313 - RNA, 22 nt, Human
agagaaaguaaagauucuaccu

SEQ ID NO: 887314 - RNA, 22 nt, Human
accauacacaauuugcaacggu

SEQ ID NO: 887315 - RNA, 22 nt, Human
gcgcgccucugcccgguguucc

SEQ ID NO: 887316 - RNA, 22 nt, Human
ggauacagcggcuucugcgcga

SEQ ID NO: 887317 - RNA, 22 nt, Human
uuacuuuaugugauggauuagu

SEQ ID NO: 887318 - RNA, 20 nt, Human
aaguguuuugacuucugacc

SEQ ID NO: 887319 - RNA, 22 nt, Human
uaaaacuuaacuauccagauua

SEQ ID NO: 887320 - RNA, 18 nt, Human
gucaggcaugaaucuggg

SEQ ID NO: 887321 - RNA, 22 nt, Human
ccuuagaaggcugaauaauucu

SEQ ID NO: 887322 - RNA, 20 nt, Human
acaaaguauugaggacaagu

SEQ ID NO: 887323 - RNA, 22 nt, Human
acagagcaacuugaguauccuc

SEQ ID NO: 887324 - RNA, 22 nt, Human
guuuacauguaauguguuauug

SEQ ID NO: 887325 - RNA, 20 nt, Human
gggugagauguaggagaggg

SEQ ID NO: 887326 - RNA, 22 nt, Human
cucuagggcucugugagguugg

SEQ ID NO: 887327 - RNA, 22 nt, Human
gcugagagcaaagcaugucuag

SEQ ID NO: 887328 - RNA, 22 nt, Human
cugaaguuaaaguaguuuuuau

SEQ ID NO: 887329 - RNA, 22 nt, Human
gcagcuggauuucaagagggag

SEQ ID NO: 887330 - RNA, 22 nt, Human
gauauucaacuaaagugaauua

SEQ ID NO: 887331 - RNA, 22 nt, Human
aaaguauucuugacuguuuuuc

SEQ ID NO: 887332 - RNA, 22 nt, Human
aagugcuuuuucuugagcugcu

SEQ ID NO: 887333 - RNA, 22 nt, Human
cugggccugucccugauugagg

SEQ ID NO: 887334 - RNA, 22 nt, Human
gggguggauuucaggcgguguc

SEQ ID NO: 887335 - RNA, 22 nt, Human
agcugaaguguuggugguuuca

SEQ ID NO: 887336 - RNA, 22 nt, Human
uuucacagagaaauauaacagg

SEQ ID NO: 887337 - RNA, 22 nt, Human
aggaaaaagaguugcugccuuc

SEQ ID NO: 887338 - RNA, 21 nt, Human
uuaaagcuaugguagugggcu

SEQ ID NO: 887339 - RNA, 22 nt, Human
acauauaugcgugggcucaugg

SEQ ID NO: 887340 - RNA, 22 nt, Human
uguuucuagagaaaauauuuac

SEQ ID NO: 887341 - RNA, 22 nt, Human
uuaggaaguguguccagaagcg

SEQ ID NO: 887342 - RNA, 22 nt, Human
ucugucaucuguucagugcuca

SEQ ID NO: 887343 - RNA, 22 nt, Human
aacaggaaaacagcacaauagc

SEQ ID NO: 887344 - RNA, 21 nt, Human
uccuucccccuuggccuggga

SEQ ID NO: 887345 - RNA, 22 nt, Human
augcuacuauccuucugcuuaa

SEQ ID NO: 887346 - RNA, 22 nt, Human
ggucccagcuggucacugucag

SEQ ID NO: 887347 - RNA, 22 nt, Human
cagugaggaagcugucuggacc

SEQ ID NO: 887348 - RNA, 22 nt, Human
aagauuauuuaagacaggaacc

SEQ ID NO: 887349 - RNA, 22 nt, Human
cacaggcaggagguucuccagu

SEQ ID NO: 887350 - RNA, 22 nt, Human
uguccucuuccagugcuccuuc

SEQ ID NO: 887351 - RNA, 22 nt, Human
caauguuucuuguaaccaguga

SEQ ID NO: 887352 - RNA, 22 nt, Human
uguguguuaucuuaguucaucu

SEQ ID NO: 887353 - RNA, 22 nt, Human
ggccccagcagugcuuguuuau

SEQ ID NO: 887354 - RNA, 18 nt, Human
acaaaggaucaugaggga

SEQ ID NO: 887355 - RNA, 22 nt, Human
gauuucucauuuguggauugaa

SEQ ID NO: 887356 - RNA, 22 nt, Human
ggacaggugacugcccagagug

SEQ ID NO: 887357 - RNA, 22 nt, Human
auucaucucugcauauagaguc

SEQ ID NO: 887358 - RNA, 22 nt, Human
ucuaggagcugagaguguguac

SEQ ID NO: 887359 - RNA, 22 nt, Human
uucuaaacuucaauucuaaauu

SEQ ID NO: 887360 - RNA, 22 nt, Human
uucaaacuaugacuucagcuac

SEQ ID NO: 887361 - RNA, 22 nt, Human
ggcuuuauauuguuugagcaga

SEQ ID NO: 887362 - RNA, 22 nt, Human
ucccauuguggaaggcagaaga

SEQ ID NO: 887363 - RNA, 22 nt, Human
uaucuugugcagaugaaagaau

SEQ ID NO: 887364 - RNA, 22 nt, Human
uuaaagcaguuuguauacaugg

SEQ ID NO: 887365 - RNA, 22 nt, Human
augagguaggacaucaggaaau

SEQ ID NO: 887366 - RNA, 22 nt, Human
uccuggcugcaccagugacccu

SEQ ID NO: 887367 - RNA, 22 nt, Human
aggcuuggaaguggcagaacug

SEQ ID NO: 887368 - RNA, 22 nt, Human
uuuggacuuagccugcagaauu

SEQ ID NO: 887369 - RNA, 22 nt, Human
agccagagaguguuggagaugu

SEQ ID NO: 887370 - RNA, 22 nt, Human
ucuguucuucuccacuguaugu

SEQ ID NO: 887371 - RNA, 22 nt, Human
auugcauuguuugaggcagagg

SEQ ID NO: 887372 - RNA, 17 nt, Human
aaaggucgauaaggugg

SEQ ID NO: 887373 - RNA, 22 nt, Human
gaaggcugagcagacaggccaa

SEQ ID NO: 887374 - RNA, 22 nt, Human
acaugcaugucaucagcccuuu

SEQ ID NO: 887375 - RNA, 22 nt, Human
aaugaacauggacaaguuaaua

SEQ ID NO: 887376 - RNA, 20 nt, Human
ugaaaaggucaggagacaug

SEQ ID NO: 887377 - RNA, 22 nt, Human
agggaccaaucaccgacaggcu

SEQ ID NO: 887378 - RNA, 23 nt, Human
cuucuggcucuauaucagaauuc

SEQ ID NO: 887379 - RNA, 22 nt, Human
gggcacugagggcccacaggau

SEQ ID NO: 887380 - RNA, 22 nt, Human
guucuucucuuguaauggaauc

SEQ ID NO: 887381 - RNA, 22 nt, Human
aaagacuuucaccuagcaaaga

SEQ ID NO: 887382 - RNA, 22 nt, Human
ccauuuugucuccugaaaucua

SEQ ID NO: 887383 - RNA, 22 nt, Human
gucccugacacccggguggagg

SEQ ID NO: 887384 - RNA, 22 nt, Human
aggugggcacagauggagaagu

SEQ ID NO: 887385 - RNA, 22 nt, Human
gccaggaggucagccccucaac

SEQ ID NO: 887386 - RNA, 22 nt, Human
aggccagcagacgugggacuga

SEQ ID NO: 887387 - RNA, 22 nt, Human
acagaaagaugauuugaaaugg

SEQ ID NO: 887388 - RNA, 22 nt, Human
augccagccucuaagcacuuua

SEQ ID NO: 887389 - RNA, 22 nt, Human
gcauugaaccaucuagauuucu

SEQ ID NO: 887390 - RNA, 22 nt, Human
ggcuccaaagggcagugugagg

SEQ ID NO: 887391 - RNA, 22 nt, Human
agcugccuuauggaguaugaaa

SEQ ID NO: 887392 - RNA, 22 nt, Human
ugaaaacagaauccuuguuuuc

SEQ ID NO: 887393 - RNA, 22 nt, Human
caguaauaagcuggagggugug

SEQ ID NO: 887394 - RNA, 22 nt, Human
ucauugaagcauuuuguguauu

SEQ ID NO: 887395 - RNA, 22 nt, Human
uaggaaauuggaaacucuucac

SEQ ID NO: 887396 - RNA, 22 nt, Human
ggagggaguuucauuccugccc

SEQ ID NO: 887397 - RNA, 22 nt, Human
acagauagaugauaauggcuuu

SEQ ID NO: 887398 - RNA, 22 nt, Human
cagccccucacagagcuguccu

SEQ ID NO: 887399 - RNA, 22 nt, Human
gcugggccagagcagcagcacu

SEQ ID NO: 887400 - RNA, 22 nt, Human
uuugcuuugacugucagcaagu

SEQ ID NO: 887401 - RNA, 22 nt, Human
aaaaugagccaugaaccaacca

SEQ ID NO: 887402 - RNA, 22 nt, Human
aaguccagaacuccugugauag

SEQ ID NO: 887403 - RNA, 22 nt, Human
uggcucaguuuagcagcucagu

SEQ ID NO: 887404 - RNA, 22 nt, Human
aggcuaaaagagaaucauuuag

SEQ ID NO: 887405 - RNA, 22 nt, Human
cuggugccauucuguggccuag

SEQ ID NO: 887406 - RNA, 22 nt, Human
guuuccuuugccaguaaauggg

SEQ ID NO: 887407 - RNA, 22 nt, Human
gcagcauuucucaaaggguggu

SEQ ID NO: 887408 - RNA, 22 nt, Human
ugggaaaguguagccugcaggc

SEQ ID NO: 887409 - RNA, 22 nt, Human
ugggccagcucccugccccugg

SEQ ID NO: 887410 - RNA, 22 nt, Human
ugcuccuggaugagguacucca

SEQ ID NO: 887411 - RNA, 22 nt, Human
cuguuuaucucuaaccuguuua

SEQ ID NO: 887412 - RNA, 22 nt, Human
ucccagaaucuccagugcuaca

SEQ ID NO: 887413 - RNA, 20 nt, Human
gcugaggucauuaugccuca

SEQ ID NO: 887414 - RNA, 22 nt, Human
uugcccugcagcggugaguggu

SEQ ID NO: 887415 - RNA, 22 nt, Human
auuuggaacugggcaugcaaac

SEQ ID NO: 887416 - RNA, 22 nt, Human
cagagccaggccugcccucuuu

SEQ ID NO: 887417 - RNA, 22 nt, Human
uuacaaagcaggucagcugaaa

SEQ ID NO: 887418 - RNA, 22 nt, Human
ugacaauuuauagaaugugacu

SEQ ID NO: 887419 - RNA, 22 nt, Human
ugacuugucaaagaaaugugug

SEQ ID NO: 887420 - RNA, 22 nt, Human
uaucucuuuauugacaauaaaa

SEQ ID NO: 887421 - RNA, 22 nt, Human
uacauguggccagaaauuugag

SEQ ID NO: 887422 - RNA, 22 nt, Human
auccugggcaguuuugagugcu

SEQ ID NO: 887423 - RNA, 22 nt, Human
uuaaaaugcagauuaugacuca

SEQ ID NO: 887424 - RNA, 22 nt, Human
acaugcauucucuaaaagcaaa

SEQ ID NO: 887425 - RNA, 22 nt, Human
ugaaaugucugaaagccaaucu

SEQ ID NO: 887426 - RNA, 22 nt, Human
aagagucuauuggaacuagaca

SEQ ID NO: 887427 - RNA, 22 nt, Human
uaaagacacugguuuuaaucau

SEQ ID NO: 887428 - RNA, 22 nt, Human
agaucacaguggcaacucccuu

SEQ ID NO: 887429 - RNA, 22 nt, Human
aucuuucuuauuugaagaaaga

SEQ ID NO: 887430 - RNA, 22 nt, Human
cuucauuuggagaacugugcuu

SEQ ID NO: 887431 - RNA, 22 nt, Human
uggacagagaggaaggccauuu

SEQ ID NO: 887432 - RNA, 22 nt, Human
aaaaugauauccugacuuuuau

SEQ ID NO: 887433 - RNA, 18 nt, Human
gcugcaggcgccugcggu

SEQ ID NO: 887434 - RNA, 22 nt, Human
cacaauuagcagcucuuuauuu

SEQ ID NO: 887435 - RNA, 20 nt, Human
ccacuccaggugauucugau

SEQ ID NO: 887436 - RNA, 22 nt, Human
auguaauuuauguuauccauaa

SEQ ID NO: 887437 - RNA, 22 nt, Human
gagcugaguaugaaggauguga

SEQ ID NO: 887438 - RNA, 22 nt, Human
ggaaaauacugauucaugccau

SEQ ID NO: 887439 - RNA, 22 nt, Human
ugagaaccacgacugugcuuaa

SEQ ID NO: 887440 - RNA, 22 nt, Human
aaacugcaauuauuuuugcaau

SEQ ID NO: 887441 - RNA, 22 nt, Human
uccaccugggcaacagugccuc

SEQ ID NO: 887442 - RNA, 22 nt, Human
aucuaagauguauugagcacuu

SEQ ID NO: 887443 - RNA, 22 nt, Human
cuggccgccgucccaaccucga

SEQ ID NO: 887444 - RNA, 22 nt, Human
uggcuccaaaucaacugcuguu

SEQ ID NO: 887445 - RNA, 22 nt, Human
uuguuucuggaaaaggcgagaa

SEQ ID NO: 887446 - RNA, 20 nt, Human
aauuuuaucuccauccuuug

SEQ ID NO: 887447 - RNA, 22 nt, Human
cagagcuucagggaauaagaau

SEQ ID NO: 887448 - RNA, 22 nt, Human
cugagguguggucugggaguau

SEQ ID NO: 887449 - RNA, 22 nt, Human
cucuggguccuggggcuacaag

SEQ ID NO: 887450 - RNA, 22 nt, Human
uuuuauucucaagacaauggga

SEQ ID NO: 887451 - RNA, 22 nt, Human
ugggccacacacagaagaauca

SEQ ID NO: 887452 - RNA, 22 nt, Human
cugaagauucgccuuuguuuau

SEQ ID NO: 887453 - RNA, 15 nt, Human
ccaggcaagcaggaa

SEQ ID NO: 887454 - RNA, 22 nt, Human
caguggcaaugggacagagcac

SEQ ID NO: 887455 - RNA, 20 nt, Human
acaguguuagguuuuuccuu

SEQ ID NO: 887456 - RNA, 22 nt, Human
cagcagccucuugugccugugg

SEQ ID NO: 887457 - RNA, 19 nt, Human
agcagcagcuaccacuugu

SEQ ID NO: 887458 - RNA, 22 nt, Human
aagagguugucugugaugaguu

SEQ ID NO: 887459 - RNA, 22 nt, Human
aagcagcauugugguaggggag

SEQ ID NO: 887460 - RNA, 20 nt, Human
caggcagaggaugcugacca

SEQ ID NO: 887461 - RNA, 22 nt, Human
uggcuucaguuucccagucugg

SEQ ID NO: 887462 - RNA, 20 nt, Human
ggcaccaggcuaggauugga

SEQ ID NO: 887463 - RNA, 22 nt, Human
guggaagggucacagccccuac

SEQ ID NO: 887464 - RNA, 22 nt, Human
aggcgugggaggaucugaggcc

SEQ ID NO: 887465 - RNA, 22 nt, Human
uuucuaggucuuccauacugcc

SEQ ID NO: 887466 - RNA, 22 nt, Human
acuuuuaucaaggaagugaucu

SEQ ID NO: 887467 - RNA, 22 nt, Human
aguuucccccuucacagcuuaa

SEQ ID NO: 887468 - RNA, 22 nt, Human
uguggcaggaugcggaagaugc

SEQ ID NO: 887469 - RNA, 22 nt, Human
gagcccaggcagagguugcagu

SEQ ID NO: 887470 - RNA, 22 nt, Human
ggugggaggcaggcugcuccca

SEQ ID NO: 887471 - RNA, 22 nt, Human
ccccucagguacccgugcagca

SEQ ID NO: 887472 - RNA, 22 nt, Human
gugugagcucagccuugggaga

SEQ ID NO: 887473 - RNA, 22 nt, Human
uuuccucacuucaugagaguuu

SEQ ID NO: 887474 - RNA, 22 nt, Human
auuagacaucauaugauucagc

SEQ ID NO: 887475 - RNA, 20 nt, Human
uccagcccugcuucucucuu

SEQ ID NO: 887476 - RNA, 22 nt, Human
ccugucaccuagguacugagca

SEQ ID NO: 887477 - RNA, 22 nt, Human
gaggcuucuguucacucacgcu

SEQ ID NO: 887478 - RNA, 22 nt, Human
ugugaagaauuaaugugaauca

SEQ ID NO: 887479 - RNA, 22 nt, Human
ucaggccuggagaaaggaauga

SEQ ID NO: 887480 - RNA, 22 nt, Human
aucuagcaguucauugugcuau

SEQ ID NO: 887481 - RNA, 22 nt, Human
uuaacaaggugacugcauuaaa

SEQ ID NO: 887482 - RNA, 22 nt, Human
uaauuuuguauugccauuguag

SEQ ID NO: 887483 - RNA, 22 nt, Human
uacauagugaacauuuacagag

SEQ ID NO: 887484 - RNA, 21 nt, Human
gcuguucuuucagcuggucuu

SEQ ID NO: 887485 - RNA, 22 nt, Human
acagaggucaccuuuguaucuu

SEQ ID NO: 887486 - RNA, 22 nt, Human
gaaaaggccuccccauaggaau

SEQ ID NO: 887487 - RNA, 22 nt, Human
acaggcagguccugucccagcu

SEQ ID NO: 887488 - RNA, 22 nt, Human
aaacacugcgugguggcaacuc

SEQ ID NO: 887489 - RNA, 22 nt, Human
ccuggcucuucagagguuccua

SEQ ID NO: 887490 - RNA, 22 nt, Human
cagggaugagaaagcucucuaa

SEQ ID NO: 887491 - RNA, 23 nt, Human
ugugucuguuuagggaggaugug

SEQ ID NO: 887492 - RNA, 22 nt, Human
uccaggggcugucuuggaaucu

SEQ ID NO: 887493 - RNA, 22 nt, Human
guuggcuaugagagcuuuagug

SEQ ID NO: 887494 - RNA, 22 nt, Human
gaugggcuggggagaaagcaug

SEQ ID NO: 887495 - RNA, 22 nt, Human
acucuggguucuuucacuugac

SEQ ID NO: 887496 - RNA, 22 nt, Human
uuacuuucaaguggcugggggu

SEQ ID NO: 887497 - RNA, 22 nt, Human
caguccugcuagugugaaaagc

SEQ ID NO: 887498 - RNA, 23 nt, Human
agggccacugggaaggauuacug

SEQ ID NO: 887499 - RNA, 22 nt, Human
gggccugugcacaguucuguua

SEQ ID NO: 887500 - RNA, 22 nt, Human
acacauguauguuuuguauuug

SEQ ID NO: 887501 - RNA, 22 nt, Human
guacauuucauuuaaaugaugu

SEQ ID NO: 887502 - RNA, 23 nt, Human
acauacauggagauaaagugaug

SEQ ID NO: 887503 - RNA, 22 nt, Human
agucugcaggcugugauuuuuu

SEQ ID NO: 887504 - RNA, 22 nt, Human
acauagaaauuuauuucuuaca

SEQ ID NO: 887505 - RNA, 22 nt, Human
uccuggauuuaacccuggcucu

SEQ ID NO: 887506 - RNA, 22 nt, Human
uaucauuuagaguauuucuuca

SEQ ID NO: 887507 - RNA, 22 nt, Human
agcacaugagcugauggugggc

SEQ ID NO: 887508 - RNA, 22 nt, Human
auuugccuuacugaagaaggag

SEQ ID NO: 887509 - RNA, 22 nt, Human
cuggcucccaugagcucucacg

SEQ ID NO: 887510 - RNA, 22 nt, Human
ugugcagagcccacaggcagcu

SEQ ID NO: 887511 - RNA, 22 nt, Human
acuuagcagagugaguugacua

SEQ ID NO: 887512 - RNA, 22 nt, Human
agagguucagagaaggcgaucu

SEQ ID NO: 887513 - RNA, 22 nt, Human
gggaaggcaggauucucuggug

SEQ ID NO: 887514 - RNA, 22 nt, Human
guucuccuuguggcugcagcag

SEQ ID NO: 887515 - RNA, 22 nt, Human
gaguccuuuguuccuugccaca

SEQ ID NO: 887516 - RNA, 22 nt, Human
aauguuuucugacugcuaacuu

SEQ ID NO: 887517 - RNA, 22 nt, Human
uuaauccaauaacaagguucaa

SEQ ID NO: 887518 - RNA, 22 nt, Human
aggguaggguaaaugaugcauc

SEQ ID NO: 887519 - RNA, 21 nt, Human
uaagcauaucagauagacucu

SEQ ID NO: 887520 - RNA, 22 nt, Human
gcucagaguggccuggcuaggg

SEQ ID NO: 887521 - RNA, 22 nt, Human
uaagugcaugauugaacuuggc

SEQ ID NO: 887522 - RNA, 22 nt, Human
gcauccaggcugccccucugcg

SEQ ID NO: 887523 - RNA, 22 nt, Human
uuaaauuauugagggauuguca

SEQ ID NO: 887524 - RNA, 22 nt, Human
ucagaggcagcugauguucugu

SEQ ID NO: 887525 - RNA, 18 nt, Human
cccagugcucacugccuc

SEQ ID NO: 887526 - RNA, 22 nt, Human
auucacuguggguccuuuggau

SEQ ID NO: 887527 - RNA, 22 nt, Human
auaguuugcuuuaauacaacug

SEQ ID NO: 887528 - RNA, 22 nt, Human
cucugugggggagaggcagcug

SEQ ID NO: 887529 - RNA, 22 nt, Human
ucaugggguuuggcuggauguc

SEQ ID NO: 887530 - RNA, 22 nt, Human
gggacacagccaucuguguuuu

SEQ ID NO: 887531 - RNA, 22 nt, Human
cagggugcuuccguggagcugu

SEQ ID NO: 887532 - RNA, 22 nt, Human
auuagcaacucuuauguaagca

SEQ ID NO: 887533 - RNA, 22 nt, Human
gcccaggauaaugcugucccug

SEQ ID NO: 887534 - RNA, 22 nt, Human
agagcacacugacgucagucug

SEQ ID NO: 887535 - RNA, 22 nt, Human
ugcugugguucccagaguggau

SEQ ID NO: 887536 - RNA, 22 nt, Human
acagacuaaaauugcacagugg

SEQ ID NO: 887537 - RNA, 19 nt, Human
accaggcuuauggucagug

SEQ ID NO: 887538 - RNA, 22 nt, Human
ggguguccugugccaagcuggg

SEQ ID NO: 887539 - RNA, 22 nt, Human
uguccucagauaugucuacucu

SEQ ID NO: 887540 - RNA, 22 nt, Human
guauuacaaauaaauguuacug

SEQ ID NO: 887541 - RNA, 22 nt, Human
uggaaucaguuacaugugguug

SEQ ID NO: 887542 - RNA, 22 nt, Human
gccaggcagcaggaagccagug

SEQ ID NO: 887543 - RNA, 22 nt, Human
cauuuauucaugaucuguagcu

SEQ ID NO: 887544 - RNA, 22 nt, Human
ccacagggcacagacaggaagc

SEQ ID NO: 887545 - RNA, 22 nt, Human
auaugagaguaaaugccgaucu

SEQ ID NO: 887546 - RNA, 22 nt, Human
ucaguaacuuacuuauucaccu

SEQ ID NO: 887547 - RNA, 22 nt, Human
aacaaguuagggucuuuuacuu

SEQ ID NO: 887548 - RNA, 22 nt, Human
uuucuagcuguaggaagcugag

SEQ ID NO: 887549 - RNA, 22 nt, Human
cuggcucugggccucagacacu

SEQ ID NO: 887550 - RNA, 22 nt, Human
agaguuuggauuuuaggacauc

SEQ ID NO: 887551 - RNA, 22 nt, Human
caguacuuuucaaccaguauga

SEQ ID NO: 887552 - RNA, 22 nt, Human
cacuggcagauuugggaucugg

SEQ ID NO: 887553 - RNA, 22 nt, Human
cacagcagacagggaggcggcu

SEQ ID NO: 887554 - RNA, 22 nt, Human
uucucaggcuguggagccgucu

SEQ ID NO: 887555 - RNA, 22 nt, Human
aggccuggccccaguugcuagg

SEQ ID NO: 887556 - RNA, 22 nt, Human
uucaggugggccuuuugagcau

SEQ ID NO: 887557 - RNA, 22 nt, Human
auaagguauaaggccuauuuuu

SEQ ID NO: 887558 - RNA, 22 nt, Human
gccagccuucuguggccugcaa

SEQ ID NO: 887559 - RNA, 22 nt, Human
acagaacagaggguuuuagaau

SEQ ID NO: 887560 - RNA, 22 nt, Human
caguggccaugguggcaggggu

SEQ ID NO: 887561 - RNA, 22 nt, Human
agggagcaugggugaagcaggc

SEQ ID NO: 887562 - RNA, 23 nt, Human
uggcacagcaggugugcuuuguu

SEQ ID NO: 887563 - RNA, 22 nt, Human
ucuuggcugcguccuggcugug

SEQ ID NO: 887564 - RNA, 22 nt, Human
aacauuaagauggcggaacagu

SEQ ID NO: 887565 - RNA, 22 nt, Human
uuauacuaaaacgcauugaauu

SEQ ID NO: 887566 - RNA, 22 nt, Human
cuacccagcaccuaggcugccu

SEQ ID NO: 887567 - RNA, 22 nt, Human
aagcagcugauuucacagcuca

SEQ ID NO: 887568 - RNA, 22 nt, Human
aaguccaugaucaagauguggc

SEQ ID NO: 887569 - RNA, 22 nt, Human
ucuuggaggagaguaaguaccu

SEQ ID NO: 887570 - RNA, 22 nt, Human
auaaagauuucuuuuucucuac

SEQ ID NO: 887571 - RNA, 22 nt, Human
uauaacaccauguucuacagau

SEQ ID NO: 887572 - RNA, 22 nt, Human
ugcucuggcugggaugagugca

SEQ ID NO: 887573 - RNA, 22 nt, Human
aaguucuauaucugccucacca

SEQ ID NO: 887574 - RNA, 21 nt, Human
auggaaauuggcaaaugcuac

SEQ ID NO: 887575 - RNA, 22 nt, Human
uaaaguaauccuucauaaggag

SEQ ID NO: 887576 - RNA, 22 nt, Human
uggaaucugugcuguuuuagug

SEQ ID NO: 887577 - RNA, 22 nt, Human
agcaugaaaacaugaaacagca

SEQ ID NO: 887578 - RNA, 21 nt, Human
auccuauuucugaaaaccugc

SEQ ID NO: 887579 - RNA, 22 nt, Human
auucaguuaagggucuugagau

SEQ ID NO: 887580 - RNA, 22 nt, Human
augucuuucuuauggucuguug

SEQ ID NO: 887581 - RNA, 22 nt, Human
gccagcaguccugcugugugcc

SEQ ID NO: 887582 - RNA, 22 nt, Human
agcugagagccccugcccugug

SEQ ID NO: 887583 - RNA, 22 nt, Human
auucuucagaauaucuggcacu

SEQ ID NO: 887584 - RNA, 22 nt, Human
cucugagcugaaacaugagcau

SEQ ID NO: 887585 - RNA, 22 nt, Human
uuuguucuagaucguguuugug

SEQ ID NO: 887586 - RNA, 22 nt, Human
uuugaaaagaaccaucgccuua

SEQ ID NO: 887587 - RNA, 22 nt, Human
aauuccaacagacaaaguuaga

SEQ ID NO: 887588 - RNA, 22 nt, Human
ugcacagagagaugagacacgu

SEQ ID NO: 887589 - RNA, 23 nt, Human
agcugcagaugcucagcgggcag

SEQ ID NO: 887590 - RNA, 22 nt, Human
uccauaaaccagaaaaucaaga

SEQ ID NO: 887591 - RNA, 22 nt, Human
aagugcaaugaauagcugcaau

SEQ ID NO: 887592 - RNA, 22 nt, Human
ucccaggaggugcuuccuagga

SEQ ID NO: 887593 - RNA, 22 nt, Human
cucuccagaucugcugagccag

SEQ ID NO: 887594 - RNA, 21 nt, Human
ugugugaccuuggacuugagc

SEQ ID NO: 887595 - RNA, 22 nt, Human
uguuuucugauucucguguggu

SEQ ID NO: 887596 - RNA, 22 nt, Human
gccaaggauaccagcugugaga

SEQ ID NO: 887597 - RNA, 22 nt, Human
ugagccaggcucaagugauccu

SEQ ID NO: 887598 - RNA, 22 nt, Human
acuguuauuuguaauccauuau

SEQ ID NO: 887599 - RNA, 22 nt, Human
uuuuaugugucaaagcaguggu

SEQ ID NO: 887600 - RNA, 22 nt, Human
ccagcugugcuguuggcuuguc

SEQ ID NO: 887601 - RNA, 18 nt, Human
aggcaggugcuggaaguc

SEQ ID NO: 887602 - RNA, 22 nt, Human
acuucccugugggcagguagug

SEQ ID NO: 887603 - RNA, 22 nt, Human
uauaaagugugaacugugagua

SEQ ID NO: 887604 - RNA, 22 nt, Human
uaagaccauacauuuccacaga

SEQ ID NO: 887605 - RNA, 22 nt, Human
gaacccaggagguugcagugag

SEQ ID NO: 887606 - RNA, 22 nt, Human
gggggcuguccugugcauugua

SEQ ID NO: 887607 - RNA, 22 nt, Human
ugagcaacugugcucugcuaaa

SEQ ID NO: 887608 - RNA, 22 nt, Human
gcccaggaguuugcauuuuaac

SEQ ID NO: 887609 - RNA, 22 nt, Human
ggaacuccugcuccaagcagcu

SEQ ID NO: 887610 - RNA, 22 nt, Human
aacaugauggggaagaacaaga

SEQ ID NO: 887611 - RNA, 22 nt, Human
guguggcugauugacaugguca

SEQ ID NO: 887612 - RNA, 22 nt, Human
ugccugggggacuaaggccaaa

SEQ ID NO: 887613 - RNA, 19 nt, Human
cucuuggguggcagaggcc

SEQ ID NO: 887614 - RNA, 22 nt, Human
gcauguguuauuuuauguauga

SEQ ID NO: 887615 - RNA, 20 nt, Human
cuccacaccuguucgcaggc

SEQ ID NO: 887616 - RNA, 22 nt, Human
agaaugcuccagagcugaaaga

SEQ ID NO: 887617 - RNA, 22 nt, Human
gaagacauuuuaugcauacucu

SEQ ID NO: 887618 - RNA, 22 nt, Human
aaacaugaauagauauuaaaca

SEQ ID NO: 887619 - RNA, 22 nt, Human
aggugggcggaucacaagguca

SEQ ID NO: 887620 - RNA, 22 nt, Human
ucuuuucaggaauggcucuagu

SEQ ID NO: 887621 - RNA, 23 nt, Human
gcccagagaggcucaccaggaau

SEQ ID NO: 887622 - RNA, 17 nt, Human
gacuuuggaguuucaua

SEQ ID NO: 887623 - RNA, 17 nt, Human
cgggcauggagggcagg

SEQ ID NO: 887624 - RNA, 22 nt, Human
uucucuugacuaccaguuagga

SEQ ID NO: 887625 - RNA, 22 nt, Human
ccuccacaggagcugcagugcu

SEQ ID NO: 887626 - RNA, 22 nt, Human
agcuuugggggagguagucugu

SEQ ID NO: 887627 - RNA, 22 nt, Human
uucugagccucauucaugaggc

SEQ ID NO: 887628 - RNA, 22 nt, Human
agccagcuguccucccuuuccu

SEQ ID NO: 887629 - RNA, 19 nt, Human
acauuuagaauguacuugc

SEQ ID NO: 887630 - RNA, 22 nt, Human
uucugcccaccacacuuuaucu

SEQ ID NO: 887631 - RNA, 22 nt, Human
acaggagacccugcugguucug

SEQ ID NO: 887632 - RNA, 22 nt, Human
gugaaaaaucaucaugacuuga

SEQ ID NO: 887633 - RNA, 18 nt, Human
uuucucagacucucuuuc

SEQ ID NO: 887634 - RNA, 22 nt, Human
cacagagaggcuugucuccaag

SEQ ID NO: 887635 - RNA, 22 nt, Human
ugagaaaauuacuauaauuguc

SEQ ID NO: 887636 - RNA, 22 nt, Human
aguguuucaccguauguucuca

SEQ ID NO: 887637 - RNA, 22 nt, Human
aaauccaucaaaucuucuagaa

SEQ ID NO: 887638 - RNA, 22 nt, Human
gagagcccucacuccuucccug

SEQ ID NO: 887639 - RNA, 22 nt, Human
guguuaauuauuggugaauaga

SEQ ID NO: 887640 - RNA, 22 nt, Human
aacauuaauuacagucaaacau

SEQ ID NO: 887641 - RNA, 22 nt, Human
acaaggacauaggaaacuacaa

SEQ ID NO: 887642 - RNA, 22 nt, Human
uggcccugguggcacagccugc

SEQ ID NO: 887643 - RNA, 22 nt, Human
ggcgccagcgguaaguaagaca

SEQ ID NO: 887644 - RNA, 22 nt, Human
ccugugcaauguugagguuuca

SEQ ID NO: 887645 - RNA, 22 nt, Human
ccucacaguguucgugucagau

SEQ ID NO: 887646 - RNA, 22 nt, Human
ugcuucauuaaaacaauauuuu

SEQ ID NO: 887647 - RNA, 17 nt, Human
uauguguguguuuauac

SEQ ID NO: 887648 - RNA, 22 nt, Human
ucaguugcuaaaugguguagug

SEQ ID NO: 887649 - RNA, 22 nt, Human
agccaaggcagcuagagcucug

SEQ ID NO: 887650 - RNA, 22 nt, Human
aaaaaauuaucauaguuccuga

SEQ ID NO: 887651 - RNA, 22 nt, Human
uguuugcaaccccuugugagaa

SEQ ID NO: 887652 - RNA, 21 nt, Human
acaguaaauucccugcaaaga

SEQ ID NO: 887653 - RNA, 22 nt, Human
uguguucuuaaaagcagugaua

SEQ ID NO: 887654 - RNA, 22 nt, Human
aggaagcugcuggaguagugug

SEQ ID NO: 887655 - RNA, 22 nt, Human
aacauaauguggccaaagucac

SEQ ID NO: 887656 - RNA, 22 nt, Human
augcagcuucaggauuaugaug

SEQ ID NO: 887657 - RNA, 22 nt, Human
aggaucugugccucaacccaga

SEQ ID NO: 887658 - RNA, 22 nt, Human
auguacaauucuccuugguagg

SEQ ID NO: 887659 - RNA, 22 nt, Human
aggugaggauagguggccaagg

SEQ ID NO: 887660 - RNA, 22 nt, Human
cucuucuuggaaugcugacugu

SEQ ID NO: 887661 - RNA, 22 nt, Human
gcagagugagccgaggcugcuc

SEQ ID NO: 887662 - RNA, 22 nt, Human
ugggccuguggcuuggcucuag

SEQ ID NO: 887663 - RNA, 22 nt, Human
caacuuuaauuugggugucaga

SEQ ID NO: 887664 - RNA, 23 nt, Human
auucuaagaugugaucuuauaac

SEQ ID NO: 887665 - RNA, 22 nt, Human
aauagcauccuaaaacauacuu

SEQ ID NO: 887666 - RNA, 19 nt, Human
ucugaagaauuagagagca

SEQ ID NO: 887667 - RNA, 22 nt, Human
gauucuuuggccuuuauugaca

SEQ ID NO: 887668 - RNA, 22 nt, Human
caguuacagcugcaccagagcc

SEQ ID NO: 887669 - RNA, 22 nt, Human
cacaucugcgcucugccucaua

SEQ ID NO: 887670 - RNA, 22 nt, Human
aagccauggcugcaucagccug

SEQ ID NO: 887671 - RNA, 19 nt, Human
auacaagacuagcauuuac

SEQ ID NO: 887672 - RNA, 22 nt, Human
uccugggguccugacugcuucc

SEQ ID NO: 887673 - RNA, 22 nt, Human
ugacagaacuuuuucacaucuc

SEQ ID NO: 887674 - RNA, 22 nt, Human
augauguaugacuguguucaaa

SEQ ID NO: 887675 - RNA, 22 nt, Human
ccaggaagauuuauuuuggcuu

SEQ ID NO: 887676 - RNA, 22 nt, Human
uuucauugucuacauaugacau

SEQ ID NO: 887677 - RNA, 22 nt, Human
ucaucuaauuuuggaacagaga

SEQ ID NO: 887678 - RNA, 22 nt, Human
uaacauuugcugucuccuaugu

SEQ ID NO: 887679 - RNA, 22 nt, Human
cagagccuuaguucuccuagaa

SEQ ID NO: 887680 - RNA, 22 nt, Human
uccugggcagaaugggauggcu

SEQ ID NO: 887681 - RNA, 22 nt, Human
gaggcagcaggcugaggaggau

SEQ ID NO: 887682 - RNA, 22 nt, Human
agcagcugccacuggaauagga

SEQ ID NO: 887683 - RNA, 22 nt, Human
uagugucagggagugauaaaug

SEQ ID NO: 887684 - RNA, 22 nt, Human
aggcccugcauuguacugaggg

SEQ ID NO: 887685 - RNA, 22 nt, Human
ucuggcauuucaggcaucuaua

SEQ ID NO: 887686 - RNA, 22 nt, Human
aaaggccuugagcugggugcca

SEQ ID NO: 887687 - RNA, 22 nt, Human
gacuggccuggggcugggcaca

SEQ ID NO: 887688 - RNA, 22 nt, Human
aaaauguaaagcuugaguguag

SEQ ID NO: 887689 - RNA, 22 nt, Human
aaagguuuuguucaucgauuuu

SEQ ID NO: 887690 - RNA, 20 nt, Human
agcuccaugaaguagucacu

SEQ ID NO: 887691 - RNA, 22 nt, Human
gaaggcugaguggguacggagg

SEQ ID NO: 887692 - RNA, 21 nt, Human
aggauuucugucauuucagau

SEQ ID NO: 887693 - RNA, 22 nt, Human
uggccagucuguggaagccagg

SEQ ID NO: 887694 - RNA, 21 nt, Human
aggcucagagagaaacucuug

SEQ ID NO: 887695 - RNA, 22 nt, Human
caagauuugggggcacggaauc

SEQ ID NO: 887696 - RNA, 22 nt, Human
uuggaagacagccgucuuuauu

SEQ ID NO: 887697 - RNA, 21 nt, Human
caccuuauagauaaaauuaga

SEQ ID NO: 887698 - RNA, 22 nt, Human
uagaaauguuagauguauugag

SEQ ID NO: 887699 - RNA, 22 nt, Human
agagccuuuggagcugcuauua

SEQ ID NO: 887700 - RNA, 22 nt, Human
gcccugagugccuguguaagaa

SEQ ID NO: 887701 - RNA, 22 nt, Human
uguuccuggaaagccagguggg

SEQ ID NO: 887702 - RNA, 22 nt, Human
gugccuuaucugcacccucccc

SEQ ID NO: 887703 - RNA, 22 nt, Human
uugagaaacucuggguuagaau

SEQ ID NO: 887704 - RNA, 22 nt, Human
ugaaacaagggaccguccuuuc

SEQ ID NO: 887705 - RNA, 22 nt, Human
ucaggaguccugccugcagccu

SEQ ID NO: 887706 - RNA, 22 nt, Human
cucucugcuguauccuuaggcu

SEQ ID NO: 887707 - RNA, 22 nt, Human
agagaggcauucggugauccca

SEQ ID NO: 887708 - RNA, 22 nt, Human
aaaggagauaaagggcccuuca

SEQ ID NO: 887709 - RNA, 22 nt, Human
uaaaacuagugguugggacuaa

SEQ ID NO: 887710 - RNA, 22 nt, Human
agguuccuuauggggauggcua

SEQ ID NO: 887711 - RNA, 22 nt, Human
uccugggcacaagugagucucc

SEQ ID NO: 887712 - RNA, 22 nt, Human
agacauuaugcugagugaaaga

SEQ ID NO: 887713 - RNA, 22 nt, Human
uaucuguuagcuaaugaaugag

SEQ ID NO: 887714 - RNA, 22 nt, Human
aucccagauggaggcuggucac

SEQ ID NO: 887715 - RNA, 22 nt, Human
gauuguggaagucagugguucu

SEQ ID NO: 887716 - RNA, 22 nt, Human
cuggucacuggucucauccagc

SEQ ID NO: 887717 - RNA, 22 nt, Human
augaagcagcguuguagaguga

SEQ ID NO: 887718 - RNA, 22 nt, Human
uccagacauuuuauagcagucu

SEQ ID NO: 887719 - RNA, 22 nt, Human
gugcauuugugcaugcacaugu

SEQ ID NO: 887720 - RNA, 22 nt, Human
aagauuucucuccuggaaagca

SEQ ID NO: 887721 - RNA, 22 nt, Human
auuuuccaaaauaauuguuacu

SEQ ID NO: 887722 - RNA, 22 nt, Human
caggccugagacaucugagaua

SEQ ID NO: 887723 - RNA, 22 nt, Human
gauucccaugucugaggaggug

SEQ ID NO: 887724 - RNA, 22 nt, Human
aacaguuuccugacuccuauga

SEQ ID NO: 887725 - RNA, 22 nt, Human
ccugaaaugaguucugcucacu

SEQ ID NO: 887726 - RNA, 22 nt, Human
cuuaacucuacacugcacuuua

SEQ ID NO: 887727 - RNA, 22 nt, Human
gccugagugcaucugcagacau

SEQ ID NO: 887728 - RNA, 22 nt, Human
uagagcaguuggcagcuguauu

SEQ ID NO: 887729 - RNA, 22 nt, Human
aggaagcuggugugaggaugaa

SEQ ID NO: 887730 - RNA, 22 nt, Human
caggguggcacucagcgcaucu

SEQ ID NO: 887731 - RNA, 18 nt, Human
gugugcucagagagugag

SEQ ID NO: 887732 - RNA, 22 nt, Human
aagugugacacuguguuaauua

SEQ ID NO: 887733 - RNA, 22 nt, Human
gguagacugucaaacacuagcc

SEQ ID NO: 887734 - RNA, 22 nt, Human
auuaugcauauacauuugacua

SEQ ID NO: 887735 - RNA, 22 nt, Human
gaaugucuguuucaacaagcac

SEQ ID NO: 887736 - RNA, 22 nt, Human
ccagaggcuggggaaggauaca

SEQ ID NO: 887737 - RNA, 23 nt, Human
aaguacauauauuuagauaguga

SEQ ID NO: 887738 - RNA, 22 nt, Human
uuugaaaauuagacacaggcua

SEQ ID NO: 887739 - RNA, 22 nt, Human
auguuaaauaaucccuuaaagc

SEQ ID NO: 887740 - RNA, 22 nt, Human
uauuuccacaccuuuugaaucu

SEQ ID NO: 887741 - RNA, 22 nt, Human
uccaaauauacagaaucuccuc

SEQ ID NO: 887742 - RNA, 22 nt, Human
uggggagucgcugcagagcgau

SEQ ID NO: 887743 - RNA, 21 nt, Human
aguguuaauggaaauuauauu

SEQ ID NO: 887744 - RNA, 22 nt, Human
accaggagagauuuuauugaga

SEQ ID NO: 887745 - RNA, 22 nt, Human
uuucaaagguggaagagugaau

SEQ ID NO: 887746 - RNA, 22 nt, Human
gcacugaugcaaaaaucacuca

SEQ ID NO: 887747 - RNA, 22 nt, Human
ugaagcaggugaauggaugucg

SEQ ID NO: 887748 - RNA, 22 nt, Human
uucagcacuguuauggauuugc

SEQ ID NO: 887749 - RNA, 22 nt, Human
gcuggccgaacggugcccuggc

SEQ ID NO: 887750 - RNA, 22 nt, Human
cagauucuucauucauucuaca

SEQ ID NO: 887751 - RNA, 22 nt, Human
acccaaagcaauauucaucagu

SEQ ID NO: 887752 - RNA, 22 nt, Human
gugaagcauaugcuucucugcc

SEQ ID NO: 887753 - RNA, 22 nt, Human
auugugcagcacagaucaugac

SEQ ID NO: 887754 - RNA, 22 nt, Human
ccucaggcuucuaguucaguga

SEQ ID NO: 887755 - RNA, 22 nt, Human
guuacagugcuuggcaauaagu

SEQ ID NO: 887756 - RNA, 22 nt, Human
caugaagucaggauuuccauga

SEQ ID NO: 887757 - RNA, 22 nt, Human
aucauuuacaaacucagcauug

SEQ ID NO: 887758 - RNA, 22 nt, Human
uaauagaauaguggaaacauug

SEQ ID NO: 887759 - RNA, 22 nt, Human
uugugucuuaaagauuaaaugg

SEQ ID NO: 887760 - RNA, 22 nt, Human
uggugcagguguugaugcagga

SEQ ID NO: 887761 - RNA, 22 nt, Human
uccagccaagggagguuacuag

SEQ ID NO: 887762 - RNA, 22 nt, Human
gaucaucugggcuccuuguagu

SEQ ID NO: 887763 - RNA, 22 nt, Human
gcccugaggauuugcauuuccu

SEQ ID NO: 887764 - RNA, 22 nt, Human
ucugggcucacgagucuggaca

SEQ ID NO: 887765 - RNA, 22 nt, Human
agaaggcucauuugacugcauu

SEQ ID NO: 887766 - RNA, 22 nt, Human
uaccuguggcuuguuggaugga

SEQ ID NO: 887767 - RNA, 22 nt, Human
cugcccugcagcuccacggacu

SEQ ID NO: 887768 - RNA, 22 nt, Human
ugaggguaaccuggagcugcug

SEQ ID NO: 887769 - RNA, 20 nt, Human
acauaugaaugauagagcca

SEQ ID NO: 887770 - RNA, 19 nt, Human
gcuuccagcacugcaggag

SEQ ID NO: 887771 - RNA, 22 nt, Human
agcagcuguacuuucaucuguu

SEQ ID NO: 887772 - RNA, 22 nt, Human
aaaguacugggauuacaggucu

SEQ ID NO: 887773 - RNA, 22 nt, Human
acagacacaggcguggagucgc

SEQ ID NO: 887774 - RNA, 22 nt, Human
ugggucuuuaugggggccagga

SEQ ID NO: 887775 - RNA, 22 nt, Human
agaggccagaaaguaugccacc

SEQ ID NO: 887776 - RNA, 22 nt, Human
auggaacugcuaauaauaguug

SEQ ID NO: 887777 - RNA, 23 nt, Human
acugcagccuccgccugccgggu

SEQ ID NO: 887778 - RNA, 17 nt, Human
cauucuguaaucuuucu

SEQ ID NO: 887779 - RNA, 22 nt, Human
ucagaggagggacucagaccca

SEQ ID NO: 887780 - RNA, 22 nt, Human
ggcugcccuagagcuggcaagg

SEQ ID NO: 887781 - RNA, 22 nt, Human
gaggggcguccugagugggccu

SEQ ID NO: 887782 - RNA, 23 nt, Human
uuacaacaguguccauauuugua

SEQ ID NO: 887783 - RNA, 22 nt, Human
acagccugauuuauggagcagu

SEQ ID NO: 887784 - RNA, 22 nt, Human
acccaggacaaaauaaccaggu

SEQ ID NO: 887785 - RNA, 22 nt, Human
auaaaguuuaaaagucaauagu

SEQ ID NO: 887786 - RNA, 22 nt, Human
uggcauggaccuuggaagaauu

SEQ ID NO: 887787 - RNA, 20 nt, Human
gcuuuuucuaauagcagucc

SEQ ID NO: 887788 - RNA, 22 nt, Human
gaggaggucgcugcugagcccc

SEQ ID NO: 887789 - RNA, 22 nt, Human
ugagggagcugaccuuucugug

SEQ ID NO: 887790 - RNA, 22 nt, Human
ugcauucaaauccugauccugc

SEQ ID NO: 887791 - RNA, 22 nt, Human
agagugcaaccgaaacaagcag

SEQ ID NO: 887792 - RNA, 22 nt, Human
caaguuguuuaggagguguugu

SEQ ID NO: 887793 - RNA, 18 nt, Human
gauguaaaauaguagcuu

SEQ ID NO: 887794 - RNA, 22 nt, Human
aauuucucucucaugcuucaug

SEQ ID NO: 887795 - RNA, 22 nt, Human
auucacaaguugauggauauuu

SEQ ID NO: 887796 - RNA, 22 nt, Human
ucucuucuugauuuucacugga

SEQ ID NO: 887797 - RNA, 23 nt, Human
acucugacuuaguuauagcuauu

SEQ ID NO: 887798 - RNA, 22 nt, Human
caguuuauauucuagugcuguu

SEQ ID NO: 887799 - RNA, 22 nt, Human
aauuuaguccuuacagugcaga

SEQ ID NO: 887800 - RNA, 20 nt, Human
agugaguuaucagcuacagu

SEQ ID NO: 887801 - RNA, 22 nt, Human
ccuucugugugcccacguuuau

SEQ ID NO: 887802 - RNA, 19 nt, Human
ucugaggcuucuccccuug

SEQ ID NO: 887803 - RNA, 22 nt, Human
gcgggggcggcgcagaccucag

SEQ ID NO: 887804 - RNA, 22 nt, Human
agcugcaggcccaugcucaguc

SEQ ID NO: 887805 - RNA, 22 nt, Human
agcaccugugcccugauggaga

SEQ ID NO: 887806 - RNA, 22 nt, Human
cugugucccacacgagguguau

SEQ ID NO: 887807 - RNA, 22 nt, Human
uguggcucugcccccugguaag

SEQ ID NO: 887808 - RNA, 22 nt, Human
auguaauaggguaacauaacau

SEQ ID NO: 887809 - RNA, 22 nt, Human
acaauuucuaauauagaucuua

SEQ ID NO: 887810 - RNA, 22 nt, Human
uggcuucacugcucaagugauu

SEQ ID NO: 887811 - RNA, 22 nt, Human
aguagaggccaggccucccugg

SEQ ID NO: 887812 - RNA, 22 nt, Human
agcugggaagacuggaagacag

SEQ ID NO: 887813 - RNA, 22 nt, Human
aguggguguagucuuccuccug

SEQ ID NO: 887814 - RNA, 20 nt, Human
agccaggccucaaguuaagu

SEQ ID NO: 887815 - RNA, 22 nt, Human
agcuguuuuccugguuagagac

SEQ ID NO: 887816 - RNA, 22 nt, Human
cagggcuggcucaugaaaaguu

SEQ ID NO: 887817 - RNA, 22 nt, Human
aaggaaaggaugagcaugcauu

SEQ ID NO: 887818 - RNA, 22 nt, Human
gaacacagugguuguuuggagg

SEQ ID NO: 887819 - RNA, 22 nt, Human
acacauauauuugcauauacac

SEQ ID NO: 887820 - RNA, 22 nt, Human
ugggcugagcagugaagcucau

SEQ ID NO: 887821 - RNA, 22 nt, Human
gugcccaggggccagcugccgg

SEQ ID NO: 887822 - RNA, 22 nt, Human
uccauuuucuugcucuagguaa

SEQ ID NO: 887823 - RNA, 22 nt, Human
ucagagacaucagguuguagca

SEQ ID NO: 887824 - RNA, 22 nt, Human
gauauuccugaaggacaggguu

SEQ ID NO: 887825 - RNA, 22 nt, Human
auggcagcaguccauugccuca

SEQ ID NO: 887826 - RNA, 22 nt, Human
auuaucacauggacuuugcuuu

SEQ ID NO: 887827 - RNA, 22 nt, Human
ccagaauuuggaucaugauuuu

SEQ ID NO: 887828 - RNA, 22 nt, Human
agagucugugcuuucaucagga

SEQ ID NO: 887829 - RNA, 22 nt, Human
uccagcacagaauuuccuagcu

SEQ ID NO: 887830 - RNA, 22 nt, Human
cauauuuauagaucuggcauuu

SEQ ID NO: 887831 - RNA, 22 nt, Human
uuauuugaaucuggcuagagaa

SEQ ID NO: 887832 - RNA, 22 nt, Human
uucuaagagucauuaauggccu

SEQ ID NO: 887833 - RNA, 22 nt, Human
agggaagugauggaguucgauc

SEQ ID NO: 887834 - RNA, 22 nt, Human
cuacaaugacagaauugaguag

SEQ ID NO: 887835 - RNA, 22 nt, Human
aagggcaggcagagaucauaua

SEQ ID NO: 887836 - RNA, 22 nt, Human
agcauuuucugagaguauagau

SEQ ID NO: 887837 - RNA, 22 nt, Human
uaucuuuaacuugcaguauuua

SEQ ID NO: 887838 - RNA, 22 nt, Human
gacacaguagccagugcaguga

SEQ ID NO: 887839 - RNA, 22 nt, Human
aaacaucuacuguaggcuggag

SEQ ID NO: 887840 - RNA, 18 nt, Human
augggaggggccaagaga

SEQ ID NO: 887841 - RNA, 22 nt, Human
ccuggagaggagaaagggccca

SEQ ID NO: 887842 - RNA, 22 nt, Human
ugucccacugacuucacaucca

SEQ ID NO: 887843 - RNA, 22 nt, Human
auacauagcagagucaauuaau

SEQ ID NO: 887844 - RNA, 22 nt, Human
uuucaaggcuaguuuuaauuag

SEQ ID NO: 887845 - RNA, 22 nt, Human
cauugaaaaacguugacugagu

SEQ ID NO: 887846 - RNA, 22 nt, Human
gugcccugucucuugucuccag

SEQ ID NO: 887847 - RNA, 22 nt, Human
uugggcagaggcugugcagagg

SEQ ID NO: 887848 - RNA, 22 nt, Human
aggcccugagaaaaucccugca

SEQ ID NO: 887849 - RNA, 22 nt, Human
ccuggagcuuggucacgcugcg

SEQ ID NO: 887850 - RNA, 22 nt, Human
ucccucaggugguucuuguuuc

SEQ ID NO: 887851 - RNA, 22 nt, Human
uuccaagggaauguuuaugagu

SEQ ID NO: 887852 - RNA, 18 nt, Human
cuugagcuaagggacccc

SEQ ID NO: 887853 - RNA, 20 nt, Human
aggagcugaauuagaggguu

SEQ ID NO: 887854 - RNA, 22 nt, Human
ugguuccugguucacuuggcag

SEQ ID NO: 887855 - RNA, 22 nt, Human
cuggccuggucuggccucucca

SEQ ID NO: 887856 - RNA, 22 nt, Human
ggagucaaggaaggcucuguga

SEQ ID NO: 887857 - RNA, 22 nt, Human
ucaauuuuaugaaacaaaguga

SEQ ID NO: 887858 - RNA, 22 nt, Human
aggcuucaagguucuuggcagg

SEQ ID NO: 887859 - RNA, 19 nt, Human
cuggaaaguuggcagugag

SEQ ID NO: 887860 - RNA, 22 nt, Human
aagcacaauuuaggacugaaau

SEQ ID NO: 887861 - RNA, 22 nt, Human
cauuaaacaaccuugaaucaau

SEQ ID NO: 887862 - RNA, 22 nt, Human
agccucugugacucacagguca

SEQ ID NO: 887863 - RNA, 20 nt, Human
uuguuuauuauguucugauc

SEQ ID NO: 887864 - RNA, 22 nt, Human
ugugacugagcugcagaguguc

SEQ ID NO: 887865 - RNA, 22 nt, Human
gggcgaggacugacucugggca

SEQ ID NO: 887866 - RNA, 22 nt, Human
cuagcagcauucuucuaguuag

SEQ ID NO: 887867 - RNA, 19 nt, Human
ggcugccuucugcucaucu

SEQ ID NO: 887868 - RNA, 20 nt, Human
uugguugagccagggccugg

SEQ ID NO: 887869 - RNA, 22 nt, Human
gacagcagcauaauacaugaac

SEQ ID NO: 887870 - RNA, 22 nt, Human
auauuucaugggguuccauacu

SEQ ID NO: 887871 - RNA, 22 nt, Human
caguaauagcagagucuuccau

SEQ ID NO: 887872 - RNA, 22 nt, Human
uagcagggaaggugugcugagc

SEQ ID NO: 887873 - RNA, 22 nt, Human
ugagcccaggaggcagagguug

SEQ ID NO: 887874 - RNA, 22 nt, Human
agguguggcuugaagucucuau

SEQ ID NO: 887875 - RNA, 16 nt, Human
ugguaagguuaccaga

SEQ ID NO: 887876 - RNA, 22 nt, Human
ugucucugucucccagguugug

SEQ ID NO: 887877 - RNA, 21 nt, Human
acagccugucaucucaugguc

SEQ ID NO: 887878 - RNA, 22 nt, Human
ucccagauuguugauggcuuaa

SEQ ID NO: 887879 - RNA, 21 nt, Human
uuuuaacaaggauuucccuag

SEQ ID NO: 887880 - RNA, 22 nt, Human
cggcagcaucgaaacuacauuc

SEQ ID NO: 887881 - RNA, 22 nt, Human
aggagcugcuuaaaugguuggu

SEQ ID NO: 887882 - RNA, 22 nt, Human
uguaguuaggcugggaauuggc

SEQ ID NO: 887883 - RNA, 22 nt, Human
uccugggagcauggugccguga

SEQ ID NO: 887884 - RNA, 22 nt, Human
acauuucucuugaugucucuau

SEQ ID NO: 887885 - RNA, 22 nt, Human
cagcuguggcugccacugcucc

SEQ ID NO: 887886 - RNA, 19 nt, Human
gacuacagggggaagaagu

SEQ ID NO: 887887 - RNA, 22 nt, Human
agccuucucugaaauucuguuu

SEQ ID NO: 887888 - RNA, 20 nt, Human
uuggaaucaccuggagaggu

SEQ ID NO: 887889 - RNA, 22 nt, Human
cuucuuaaugcauaaacugugu

SEQ ID NO: 887890 - RNA, 22 nt, Human
ugcaucuuucugcauauguaaa

SEQ ID NO: 887891 - RNA, 22 nt, Human
uggggugacagugcagugguca

SEQ ID NO: 887892 - RNA, 22 nt, Human
agaucuuuagugaagcuaaauc

SEQ ID NO: 887893 - RNA, 22 nt, Human
uucugggugccaccuaagacau

SEQ ID NO: 887894 - RNA, 22 nt, Human
cuguggagaugcagaccaggcc

SEQ ID NO: 887895 - RNA, 22 nt, Human
aauagaggagcuuuggacuccc

SEQ ID NO: 887896 - RNA, 22 nt, Human
uggcucucugggagguccuggc

SEQ ID NO: 887897 - RNA, 22 nt, Human
gggcagcagccacucauuuagc

SEQ ID NO: 887898 - RNA, 22 nt, Human
gaggacagagccgccuggcaag

SEQ ID NO: 887899 - RNA, 22 nt, Human
agcaggggcaggguuuugugcu

SEQ ID NO: 887900 - RNA, 22 nt, Human
guccucaggcuugaguguuuau

SEQ ID NO: 887901 - RNA, 22 nt, Human
acuugucuuuguaaaauagaaa

SEQ ID NO: 887902 - RNA, 20 nt, Human
ugcauuuguuauuuguacuc

SEQ ID NO: 887903 - RNA, 22 nt, Human
ucccagggauuaggacauggau

SEQ ID NO: 887904 - RNA, 19 nt, Human
ugcauauaucuaugaaaga

SEQ ID NO: 887905 - RNA, 22 nt, Human
aacuuucagcaaguaauucugg

SEQ ID NO: 887906 - RNA, 19 nt, Human
uugagaaaguugauuuggg

SEQ ID NO: 887907 - RNA, 22 nt, Human
uggaaaaucaggggacauugau

SEQ ID NO: 887908 - RNA, 22 nt, Human
gcuuucuguggugauguaaagg

SEQ ID NO: 887909 - RNA, 22 nt, Human
uguauuaacauuaauaaaaugg

SEQ ID NO: 887910 - RNA, 22 nt, Human
agggucugacugaauggaaaag

SEQ ID NO: 887911 - RNA, 22 nt, Human
auacaguagacaaucucaugaa

SEQ ID NO: 887912 - RNA, 19 nt, Human
agcagcucagggaggcacc

SEQ ID NO: 887913 - RNA, 22 nt, Human
aggcuaugguggggccaguggc

SEQ ID NO: 887914 - RNA, 22 nt, Human
uagcuuuuauccacugcuuuug

SEQ ID NO: 887915 - RNA, 22 nt, Human
uguguaaauggcaucucucagc

SEQ ID NO: 887916 - RNA, 22 nt, Human
uuuccaauguagaugucucugg

SEQ ID NO: 887917 - RNA, 22 nt, Human
cugaauaucauuuacauuugga

SEQ ID NO: 887918 - RNA, 22 nt, Human
aaaggccacacagagcagggag

SEQ ID NO: 887919 - RNA, 22 nt, Human
agcagauggagaauggagucag

SEQ ID NO: 887920 - RNA, 22 nt, Human
caggagaggaggcuacuucuua

SEQ ID NO: 887921 - RNA, 22 nt, Human
ccagcauucacacugguuccuu

SEQ ID NO: 887922 - RNA, 22 nt, Human
augaaaugaaguuggccuggcu

SEQ ID NO: 887923 - RNA, 19 nt, Human
uguccagugaugucaagga

SEQ ID NO: 887924 - RNA, 22 nt, Human
gagggccuggcacagggaggcu

SEQ ID NO: 887925 - RNA, 22 nt, Human
gagauucugugaaacggacauu

SEQ ID NO: 887926 - RNA, 22 nt, Human
uuccuuccugucuuccuuacug

SEQ ID NO: 887927 - RNA, 22 nt, Human
cuggcugaucuccugaaugucu

SEQ ID NO: 887928 - RNA, 22 nt, Human
uuuauguaauuucauaggugug

SEQ ID NO: 887929 - RNA, 22 nt, Human
gagugcagaugccagccccagu

SEQ ID NO: 887930 - RNA, 22 nt, Human
gcccaucuucuagcagcuguua

SEQ ID NO: 887931 - RNA, 22 nt, Human
uccagcucuaaggcugauagcc

SEQ ID NO: 887932 - RNA, 22 nt, Human
uucucaggguagaggugacacu

SEQ ID NO: 887933 - RNA, 22 nt, Human
gagauggggaauaggagcaagc

SEQ ID NO: 887934 - RNA, 22 nt, Human
caugaucagaaagagaagcuag

SEQ ID NO: 887935 - RNA, 22 nt, Human
ucugauguugaugcuucugccu

SEQ ID NO: 887936 - RNA, 22 nt, Human
ugguccagcuugauucucuucu

SEQ ID NO: 887937 - RNA, 22 nt, Human
ggcagcaugagccuggugaauu

SEQ ID NO: 887938 - RNA, 22 nt, Human
cacaggccugucucuuucuaac

SEQ ID NO: 887939 - RNA, 22 nt, Human
gagaucuucaagguuuuagaua

SEQ ID NO: 887940 - RNA, 22 nt, Human
aggcuuggcucuccuaugagaa

SEQ ID NO: 887941 - RNA, 22 nt, Human
cagcuguguagaugcaggguca

SEQ ID NO: 887942 - RNA, 22 nt, Human
ccaccgccauggcguuguacag

SEQ ID NO: 887943 - RNA, 22 nt, Human
ugagguggcacacacuuccugc

SEQ ID NO: 887944 - RNA, 22 nt, Human
ugugugcaggcacugugccaga

SEQ ID NO: 887945 - RNA, 18 nt, Human
uuacacuagccuugguuc

SEQ ID NO: 887946 - RNA, 22 nt, Human
ugggaggcagguaggugaugau

SEQ ID NO: 887947 - RNA, 22 nt, Human
gcucugagccgggggccugucc

SEQ ID NO: 887948 - RNA, 22 nt, Human
aacagcuaguggucuagacuuu

SEQ ID NO: 887949 - RNA, 22 nt, Human
ccagaagcuucuacacaggaga

SEQ ID NO: 887950 - RNA, 17 nt, Human
gagugcugguggagcuc

SEQ ID NO: 887951 - RNA, 22 nt, Human
gacugcauaggaccaaauagua

SEQ ID NO: 887952 - RNA, 23 nt, Human
ggugggagauuauccagaauuau

SEQ ID NO: 887953 - RNA, 22 nt, Human
gacaggcacgaaauugggcugg

SEQ ID NO: 887954 - RNA, 22 nt, Human
gcaagcucucugcaggcagagc

SEQ ID NO: 887955 - RNA, 22 nt, Human
gggcaccuugggucucaggcaa

SEQ ID NO: 887956 - RNA, 19 nt, Human
aggagaagacucucucccc

SEQ ID NO: 887957 - RNA, 22 nt, Human
aaagugcagggugcucugguau

SEQ ID NO: 887958 - RNA, 22 nt, Human
auuauguaacugugguucagca

SEQ ID NO: 887959 - RNA, 22 nt, Human
uauccuuguacuauaguauuua

SEQ ID NO: 887960 - RNA, 22 nt, Human
cauuguacaguuauuuuaaaau

SEQ ID NO: 887961 - RNA, 22 nt, Human
aacacuuuccugccuuucugau

SEQ ID NO: 887962 - RNA, 22 nt, Human
aaaguuuccaaguuacaccauu

SEQ ID NO: 887963 - RNA, 22 nt, Human
aggcugugggaauggcugcuug

SEQ ID NO: 887964 - RNA, 22 nt, Human
ccauggcuuacagauggagcau

SEQ ID NO: 887965 - RNA, 22 nt, Human
cugacagucucauugauuugcu

SEQ ID NO: 887966 - RNA, 22 nt, Human
gccaccuggacucagagccagg

SEQ ID NO: 887967 - RNA, 22 nt, Human
cuccaggauaccuguuccuaua

SEQ ID NO: 887968 - RNA, 22 nt, Human
aacuacaguaguuugcccuucu

SEQ ID NO: 887969 - RNA, 22 nt, Human
uuuauuauguacaggcacuaua

SEQ ID NO: 887970 - RNA, 22 nt, Human
aagugucugcuggcucuacccu

SEQ ID NO: 887971 - RNA, 22 nt, Human
uauguuauuuucauacaacaga

SEQ ID NO: 887972 - RNA, 22 nt, Human
agggacagucuacuguucacug

SEQ ID NO: 887973 - RNA, 21 nt, Human
gcuggcuggcugaccggccuu

SEQ ID NO: 887974 - RNA, 22 nt, Human
uugcgcgcggcuaggucucggu

SEQ ID NO: 887975 - RNA, 22 nt, Human
gaggagggccuggugucccuuc

SEQ ID NO: 887976 - RNA, 22 nt, Human
cucuggucuucaaggccaccuc

SEQ ID NO: 887977 - RNA, 22 nt, Human
aguuucuuauucuuaguuaugu

SEQ ID NO: 887978 - RNA, 22 nt, Human
aacaucugugaacuccgaaaau

SEQ ID NO: 887979 - RNA, 22 nt, Human
aguuuuugagaauuuacuaugu

SEQ ID NO: 887980 - RNA, 19 nt, Human
ucagcaucaauuugguccu

SEQ ID NO: 887981 - RNA, 21 nt, Human
cucuugucuuugcucaguagc

SEQ ID NO: 887982 - RNA, 22 nt, Human
aucucuugccagucagaauggu

SEQ ID NO: 887983 - RNA, 22 nt, Human
gugcaugugguaaagaggagag

SEQ ID NO: 887984 - RNA, 22 nt, Human
cagaccagccauuugccucuuc

SEQ ID NO: 887985 - RNA, 22 nt, Human
cuguacaggucaaugauaagau

SEQ ID NO: 887986 - RNA, 22 nt, Human
gcagcaucuagggcacuggccu

SEQ ID NO: 887987 - RNA, 22 nt, Human
uccucugguccugcagcagauc

SEQ ID NO: 887988 - RNA, 22 nt, Human
acuggcaggcugcuggccggcg

SEQ ID NO: 887989 - RNA, 22 nt, Human
agccagugaugaagacucugga

SEQ ID NO: 887990 - RNA, 22 nt, Human
aagcugccuuccaugugaggaa

SEQ ID NO: 887991 - RNA, 22 nt, Human
uguccaggacccuauucucacu

SEQ ID NO: 887992 - RNA, 22 nt, Human
gccuggaguggacuuggccccu

SEQ ID NO: 887993 - RNA, 23 nt, Human
ucauggaaugaauucuucuguua

SEQ ID NO: 887994 - RNA, 22 nt, Human
auuccuucuuugagaauaagca

SEQ ID NO: 887995 - RNA, 22 nt, Human
ugccucugugggccuuccuggc

SEQ ID NO: 887996 - RNA, 22 nt, Human
acacagcaacuugcaguaugga

SEQ ID NO: 887997 - RNA, 22 nt, Human
ugugaaaugcuauugugacaaa

SEQ ID NO: 887998 - RNA, 22 nt, Human
cuaaaugucauggaguuguaga

SEQ ID NO: 887999 - RNA, 22 nt, Human
aggggugacacauaucagugca

SEQ ID NO: 888000 - RNA, 23 nt, Human
ugugucugaggauauaugugcau

SEQ ID NO: 888001 - RNA, 22 nt, Human
uggcccugcacccagagcaguu

SEQ ID NO: 888002 - RNA, 22 nt, Human
aauauuuaugacaggaaguagc

SEQ ID NO: 888003 - RNA, 22 nt, Human
aagggcaggaaaagauggaugu

SEQ ID NO: 888004 - RNA, 22 nt, Human
cagucacauugcccugcauuua

SEQ ID NO: 888005 - RNA, 17 nt, Human
agcugcagaugaaguug

SEQ ID NO: 888006 - RNA, 22 nt, Human
uuccagaauuuuguucugcuug

SEQ ID NO: 888007 - RNA, 22 nt, Human
uggaagcuucugaccauuuuug

SEQ ID NO: 888008 - RNA, 22 nt, Human
uuuauuguuuagaagggggcug

SEQ ID NO: 888009 - RNA, 22 nt, Human
ggcuccaguuugugccuucagc

SEQ ID NO: 888010 - RNA, 22 nt, Human
ugaacagugguucaugucacgg

SEQ ID NO: 888011 - RNA, 22 nt, Human
uacauuuguuauagaaaugaag

SEQ ID NO: 888012 - RNA, 22 nt, Human
gaguggggcccacugcugggug

SEQ ID NO: 888013 - RNA, 22 nt, Human
cuggggagugaagguaauuaca

SEQ ID NO: 888014 - RNA, 22 nt, Human
uggcuggaagucagaaauggga

SEQ ID NO: 888015 - RNA, 22 nt, Human
ugucaguucugguuggcuccca

SEQ ID NO: 888016 - RNA, 22 nt, Human
uagaacuuauuagaaaggcuca

SEQ ID NO: 888017 - RNA, 22 nt, Human
aaaugucagagcuggaaggggc

SEQ ID NO: 888018 - RNA, 22 nt, Human
acugggccagaucagagcaacu

SEQ ID NO: 888019 - RNA, 22 nt, Human
uuaucagaguccccaaaagaaa

SEQ ID NO: 888020 - RNA, 22 nt, Human
uuugauuuucagcaauaguggc

SEQ ID NO: 888021 - RNA, 22 nt, Human
uauuucaggggguacaagaaga

SEQ ID NO: 888022 - RNA, 23 nt, Human
ggcagagagcauggcuggggccc

SEQ ID NO: 888023 - RNA, 22 nt, Human
aucucugcaucccucaagguug

SEQ ID NO: 888024 - RNA, 22 nt, Human
uuacaagauuaauuauuggagu

SEQ ID NO: 888025 - RNA, 22 nt, Human
aaucacauuagugaaacacuga

SEQ ID NO: 888026 - RNA, 22 nt, Human
aucauaaaauugcaccauuucu

SEQ ID NO: 888027 - RNA, 21 nt, Human
gauuuguauuauugguuccaa

SEQ ID NO: 888028 - RNA, 19 nt, Human
ccugaggugggguggaagg

SEQ ID NO: 888029 - RNA, 22 nt, Human
uuguagaacaugcagcacaaug

SEQ ID NO: 888030 - RNA, 22 nt, Human
acagauuuuauuauucagguau

SEQ ID NO: 888031 - RNA, 22 nt, Human
gugcucugccuggggucauggc

SEQ ID NO: 888032 - RNA, 22 nt, Human
cagagccccucagcucucuccc

SEQ ID NO: 888033 - RNA, 22 nt, Human
auugagaaaauucgagcaaguu

SEQ ID NO: 888034 - RNA, 22 nt, Human
agugucugaaggauuuggcuuc

SEQ ID NO: 888035 - RNA, 22 nt, Human
gacuuuauucguuaacuguuaa

SEQ ID NO: 888036 - RNA, 23 nt, Human
ggcugggagcuccgggugcacgu

SEQ ID NO: 888037 - RNA, 22 nt, Human
agaacaggaggaagccagcucc

SEQ ID NO: 888038 - RNA, 22 nt, Human
ucugugucucaaucccaugcug

SEQ ID NO: 888039 - RNA, 22 nt, Human
ucacaaagcuuugauaagcaga

SEQ ID NO: 888040 - RNA, 22 nt, Human
gaaguuaucaaagauguauucu

SEQ ID NO: 888041 - RNA, 22 nt, Human
ggucagaggaggaauaggacau

SEQ ID NO: 888042 - RNA, 22 nt, Human
ccauuacuuagaaaggaacuga

SEQ ID NO: 888043 - RNA, 22 nt, Human
cagcugcuuacuagcuguguga

SEQ ID NO: 888044 - RNA, 22 nt, Human
acauuugagcauauuucuuguc

SEQ ID NO: 888045 - RNA, 22 nt, Human
gcuccagguggcuuauuuguau

SEQ ID NO: 888046 - RNA, 22 nt, Human
uauuacaagaaagggcaugaau

SEQ ID NO: 888047 - RNA, 22 nt, Human
ugaggcagcccacuuuccuuag

SEQ ID NO: 888048 - RNA, 22 nt, Human
agguagcgcaauuuccugggac

SEQ ID NO: 888049 - RNA, 22 nt, Human
acccagcucuuugauggucuug

SEQ ID NO: 888050 - RNA, 22 nt, Human
uuuugcuguguccuugagccgg

SEQ ID NO: 888051 - RNA, 22 nt, Human
aaacuuucauguaucucuuuca

SEQ ID NO: 888052 - RNA, 22 nt, Human
acauucuuggacuccacucuag

SEQ ID NO: 888053 - RNA, 22 nt, Human
ugauuuaugcauuauacuguug

SEQ ID NO: 888054 - RNA, 22 nt, Human
aggcccaguagugcugccuuua

SEQ ID NO: 888055 - RNA, 22 nt, Human
aaaagucucucugaguaaaagu

SEQ ID NO: 888056 - RNA, 22 nt, Human
aguaaguuuugauagcauuagg

SEQ ID NO: 888057 - RNA, 22 nt, Human
auuuuucaacuuuggaaauggc

SEQ ID NO: 888058 - RNA, 22 nt, Human
ucuuagaaacuguaucgauuag

SEQ ID NO: 888059 - RNA, 22 nt, Human
ccugucucuguuaccacauuug

SEQ ID NO: 888060 - RNA, 22 nt, Human
uguagacuuucuuuguguuagu

SEQ ID NO: 888061 - RNA, 22 nt, Human
guaggccagugugaaaccuggu

SEQ ID NO: 888062 - RNA, 22 nt, Human
acauucuuaacaguuaaaaacu

SEQ ID NO: 888063 - RNA, 22 nt, Human
agaaaagguugaaaguaggauu

SEQ ID NO: 888064 - RNA, 22 nt, Human
gcaaacaagcugccugaagauu

SEQ ID NO: 888065 - RNA, 22 nt, Human
ccacuggcauccagcugccauc

SEQ ID NO: 888066 - RNA, 22 nt, Human
uugcugaugguauuaugcuagu

SEQ ID NO: 888067 - RNA, 22 nt, Human
agggcuguuuuuggcaccuggg

SEQ ID NO: 888068 - RNA, 22 nt, Human
caauguguuugcauauuaaaau

SEQ ID NO: 888069 - RNA, 22 nt, Human
gcuguggcccuuggcaucugcg

SEQ ID NO: 888070 - RNA, 22 nt, Human
uugcaaaugaccauugccacau

SEQ ID NO: 888071 - RNA, 22 nt, Human
ugagaucauugacuuguuccug

SEQ ID NO: 888072 - RNA, 22 nt, Human
acuuuguugaugaaauaguuuu

SEQ ID NO: 888073 - RNA, 22 nt, Human
ucaucaaagcgcuuggaguagg

SEQ ID NO: 888074 - RNA, 22 nt, Human
gcuucucauguuuauuuuuaca

SEQ ID NO: 888075 - RNA, 22 nt, Human
agacagacauagaaauuaguaa

SEQ ID NO: 888076 - RNA, 22 nt, Human
cagagugaaauaggggaucaag

SEQ ID NO: 888077 - RNA, 22 nt, Human
agcucuccacacauaggacuag

SEQ ID NO: 888078 - RNA, 22 nt, Human
uauguacuaacuuucauucuag

SEQ ID NO: 888079 - RNA, 22 nt, Human
uuucuacagcuggugcaacuuu

SEQ ID NO: 888080 - RNA, 22 nt, Human
uuauguaugaauauaguagaag

SEQ ID NO: 888081 - RNA, 22 nt, Human
uccugcugccauuucaagugcu

SEQ ID NO: 888082 - RNA, 22 nt, Human
caguuuaguguugcauuuggag

SEQ ID NO: 888083 - RNA, 20 nt, Human
auagauaucaucuuuagaag

SEQ ID NO: 888084 - RNA, 22 nt, Human
uugugaaaagccgcaaguauag

SEQ ID NO: 888085 - RNA, 22 nt, Human
aauauaguucuagaaauauuuu

SEQ ID NO: 888086 - RNA, 22 nt, Human
ucacagcauucgcaauggacag

SEQ ID NO: 888087 - RNA, 22 nt, Human
uugcuuauuugauuaaaugucu

SEQ ID NO: 888088 - RNA, 22 nt, Human
cagagugagggccugcaccugc

SEQ ID NO: 888089 - RNA, 22 nt, Human
uggcuacagacauuccuaggga

SEQ ID NO: 888090 - RNA, 19 nt, Human
uaagacagauuccuagagu

SEQ ID NO: 888091 - RNA, 22 nt, Human
ugagggugggcccugggcaucu

SEQ ID NO: 888092 - RNA, 22 nt, Human
ugaaacaagauccacagacuug

SEQ ID NO: 888093 - RNA, 22 nt, Human
acauuucuuucuauucaguagc

SEQ ID NO: 888094 - RNA, 22 nt, Human
gaggugaguggggucuccaggg

SEQ ID NO: 888095 - RNA, 22 nt, Human
cagacccucgggugaguuggcc

SEQ ID NO: 888096 - RNA, 22 nt, Human
auuaguaaaacauuguauaugu

SEQ ID NO: 888097 - RNA, 22 nt, Human
uggaggaggaacuucuuaucuc

SEQ ID NO: 888098 - RNA, 22 nt, Human
caguccaggccuggaggagcca

SEQ ID NO: 888099 - RNA, 23 nt, Human
ugcugaaguguuggcccugccca

SEQ ID NO: 888100 - RNA, 22 nt, Human
cuaguuugguuagauaagucuc

SEQ ID NO: 888101 - RNA, 22 nt, Human
acagguccuuauaagagcacuc

SEQ ID NO: 888102 - RNA, 22 nt, Human
ucugcaggcuuauaggaugggu

SEQ ID NO: 888103 - RNA, 22 nt, Human
ugugacaccacacccgacuaau

SEQ ID NO: 888104 - RNA, 22 nt, Human
agccaggcuaaaugagccauga

SEQ ID NO: 888105 - RNA, 22 nt, Human
uuuucguuggucauuccccagc

SEQ ID NO: 888106 - RNA, 22 nt, Human
ugcugugcucuuuaaggugcug

SEQ ID NO: 888107 - RNA, 23 nt, Human
agucugaauugagaugugcugug

SEQ ID NO: 888108 - RNA, 22 nt, Human
gcacacuccuggauccuagaga

SEQ ID NO: 888109 - RNA, 22 nt, Human
uuuggagagcagcuaggcccuu

SEQ ID NO: 888110 - RNA, 22 nt, Human
ggcacacucacuucugcccuga

SEQ ID NO: 888111 - RNA, 22 nt, Human
uggaaguggcagaggaaguggu

SEQ ID NO: 888112 - RNA, 22 nt, Human
ugacagggacaguggagaugga

SEQ ID NO: 888113 - RNA, 22 nt, Human
gguuuuauagcaguacuaucag

SEQ ID NO: 888114 - RNA, 22 nt, Human
agauaucugcaauauaauuuaa

SEQ ID NO: 888115 - RNA, 22 nt, Human
ucccaggauguuuauggcuggu

SEQ ID NO: 888116 - RNA, 22 nt, Human
augacuuauuacaagucauauu

SEQ ID NO: 888117 - RNA, 22 nt, Human
cugccagaucauuggauucaca

SEQ ID NO: 888118 - RNA, 22 nt, Human
ccuccuggccugugcagagccc

SEQ ID NO: 888119 - RNA, 22 nt, Human
uccuguguuacccuugcaguga

SEQ ID NO: 888120 - RNA, 17 nt, Human
cucuggaauuggugaag

SEQ ID NO: 888121 - RNA, 22 nt, Human
agcugggccugagcuggaagcu

SEQ ID NO: 888122 - RNA, 22 nt, Human
ucauugaauauggggccauaca

SEQ ID NO: 888123 - RNA, 22 nt, Human
agcuauuuauugagcuccauug

SEQ ID NO: 888124 - RNA, 22 nt, Human
ugucugaagcagccagugcugu

SEQ ID NO: 888125 - RNA, 22 nt, Human
guauaucucuuacauacacaca

SEQ ID NO: 888126 - RNA, 22 nt, Human
cucagggaugggcagauguuaa

SEQ ID NO: 888127 - RNA, 22 nt, Human
aguuuccugggagauucuuaca

SEQ ID NO: 888128 - RNA, 17 nt, Human
guauucuuugccuucca

SEQ ID NO: 888129 - RNA, 22 nt, Human
agccagggagguggagguugca

SEQ ID NO: 888130 - RNA, 22 nt, Human
ugcccucaguuucacaugagug

SEQ ID NO: 888131 - RNA, 22 nt, Human
agcugcaauucuggacauaguc

SEQ ID NO: 888132 - RNA, 22 nt, Human
aggcuggcaaggcagaugugug

SEQ ID NO: 888133 - RNA, 22 nt, Human
ugcugccuugaccuccugggcu

SEQ ID NO: 888134 - RNA, 22 nt, Human
agaaugaagaugacuucggaga

SEQ ID NO: 888135 - RNA, 22 nt, Human
acuucauauuguuuccacuaga

SEQ ID NO: 888136 - RNA, 22 nt, Human
acugauaaguugcuugcucuca

SEQ ID NO: 888137 - RNA, 22 nt, Human
ucugggcaguucggauccucug

SEQ ID NO: 888138 - RNA, 22 nt, Human
augaauugaggaaaacagucgu

SEQ ID NO: 888139 - RNA, 22 nt, Human
uuagacaagggcuccuuaaaag

SEQ ID NO: 888140 - RNA, 22 nt, Human
agaaguaggcagggcuguauca

SEQ ID NO: 888141 - RNA, 22 nt, Human
guggcugcugguacucugggaa

SEQ ID NO: 888142 - RNA, 22 nt, Human
cagaggcaaaagagguggaggu

SEQ ID NO: 888143 - RNA, 22 nt, Human
aggcuuaaugaguuaaaucacu

SEQ ID NO: 888144 - RNA, 22 nt, Human
cagacagcugcuuucuugcugu

SEQ ID NO: 888145 - RNA, 22 nt, Human
uggggaaaaugcuuguagucag

SEQ ID NO: 888146 - RNA, 22 nt, Human
cuaacuuuauuugcuaaguaga

SEQ ID NO: 888147 - RNA, 22 nt, Human
auuuuguuuccuuuggaguaga

SEQ ID NO: 888148 - RNA, 22 nt, Human
gaaccuuaugguaaaucuagag

SEQ ID NO: 888149 - RNA, 22 nt, Human
ugccuggggauugcucugggcc

SEQ ID NO: 888150 - RNA, 23 nt, Human
uuauugcaagguaaaauugcuga

SEQ ID NO: 888151 - RNA, 22 nt, Human
aucacaaucccucucucugaua

SEQ ID NO: 888152 - RNA, 22 nt, Human
agaaaucagaacccugaaguuc

SEQ ID NO: 888153 - RNA, 22 nt, Human
augucacaucugggauggcccu

SEQ ID NO: 888154 - RNA, 22 nt, Human
acagacugugagucucauuuuc

SEQ ID NO: 888155 - RNA, 20 nt, Human
gaagugucuuguuucuggau

SEQ ID NO: 888156 - RNA, 22 nt, Human
ugaggccugaagccuggagccu

SEQ ID NO: 888157 - RNA, 22 nt, Human
uggagguggugcccagcaauuu

SEQ ID NO: 888158 - RNA, 22 nt, Human
cucagugcagcuaggcaugaga

SEQ ID NO: 888159 - RNA, 22 nt, Human
gcuuccaggucauucucacccu

SEQ ID NO: 888160 - RNA, 22 nt, Human
uucaacaugcaaacauguuugu

SEQ ID NO: 888161 - RNA, 22 nt, Human
uuuacagucaccaaacuuugcu

SEQ ID NO: 888162 - RNA, 22 nt, Human
cagguuuagguggacgugcagg

SEQ ID NO: 888163 - RNA, 22 nt, Human
ccugggcaaaugccagagacaa

SEQ ID NO: 888164 - RNA, 22 nt, Human
aaguuauuuuucaagauccuuu

SEQ ID NO: 888165 - RNA, 22 nt, Human
cacagagaaaauguuggugcuu

SEQ ID NO: 888166 - RNA, 20 nt, Human
cagcagaaauggggugggaa

SEQ ID NO: 888167 - RNA, 22 nt, Human
ucuacaggguaaggggcuugcc

SEQ ID NO: 888168 - RNA, 20 nt, Human
caaagcaguaggauaaaaau

SEQ ID NO: 888169 - RNA, 22 nt, Human
ccaggucucgggucugcucgug

SEQ ID NO: 888170 - RNA, 22 nt, Human
auauuucuugagcaccugguau

SEQ ID NO: 888171 - RNA, 22 nt, Human
ugggcugcugcggugcucuugg

SEQ ID NO: 888172 - RNA, 22 nt, Human
ucuccuucgaggcccagcuccc

SEQ ID NO: 888173 - RNA, 22 nt, Human
uggcugcccucaugggccugau

SEQ ID NO: 888174 - RNA, 22 nt, Human
agacagcauuucuagcaccagg

SEQ ID NO: 888175 - RNA, 22 nt, Human
aauucuguaaagcuugucaugc

SEQ ID NO: 888176 - RNA, 20 nt, Human
ucuaggcaggcaggcucgug

SEQ ID NO: 888177 - RNA, 22 nt, Human
uucugcaggagcccuaguguau

SEQ ID NO: 888178 - RNA, 22 nt, Human
uugucuuucccagcuucuagag

SEQ ID NO: 888179 - RNA, 22 nt, Human
gagcaacaguuuaugguuuuuc

SEQ ID NO: 888180 - RNA, 22 nt, Human
agagcuuuuugacaucucucua

SEQ ID NO: 888181 - RNA, 22 nt, Human
uguuuacaaggaguuuauauug

SEQ ID NO: 888182 - RNA, 22 nt, Human
ugcacacauguauguauaugug

SEQ ID NO: 888183 - RNA, 22 nt, Human
aauuucuucagcucuaaaaugg

SEQ ID NO: 888184 - RNA, 20 nt, Human
uauuccaaggguagagaaaa

SEQ ID NO: 888185 - RNA, 20 nt, Human
acccuuugccggaugccaag

SEQ ID NO: 888186 - RNA, 22 nt, Human
acugaaauauuuagaagugaag

SEQ ID NO: 888187 - RNA, 22 nt, Human
guggagugcaacgguuggaguu

SEQ ID NO: 888188 - RNA, 22 nt, Human
auuucucagugugaucaggccu

SEQ ID NO: 888189 - RNA, 22 nt, Human
ccugccugacagagaagguuca

SEQ ID NO: 888190 - RNA, 22 nt, Human
auggcacaggagaggagggcug

SEQ ID NO: 888191 - RNA, 22 nt, Human
ccaggcaaggacaugaaacuga

SEQ ID NO: 888192 - RNA, 22 nt, Human
caauuugguuuauguguucaga

SEQ ID NO: 888193 - RNA, 22 nt, Human
uccagcagaaaagagguaggga

SEQ ID NO: 888194 - RNA, 22 nt, Human
gcagaaggauccgcaggugcaa

SEQ ID NO: 888195 - RNA, 22 nt, Human
uaaaacuucucauuuuuauggu

SEQ ID NO: 888196 - RNA, 22 nt, Human
aaaaguauuuuggaucucagau

SEQ ID NO: 888197 - RNA, 22 nt, Human
aggccaaagcucaccugcagcu

SEQ ID NO: 888198 - RNA, 22 nt, Human
agcuucuuuuaccaggaaguug

SEQ ID NO: 888199 - RNA, 22 nt, Human
ccugggagguggagguugcagu

SEQ ID NO: 888200 - RNA, 22 nt, Human
gaauguuccucagacuucccca

SEQ ID NO: 888201 - RNA, 22 nt, Human
acaugcauaaacuacuucuuau

SEQ ID NO: 888202 - RNA, 22 nt, Human
aacaguuucuauguuagugguu

SEQ ID NO: 888203 - RNA, 22 nt, Human
auuuguaucaaucucaauauau

SEQ ID NO: 888204 - RNA, 22 nt, Human
uuuucagaaagaugagaaauua

SEQ ID NO: 888205 - RNA, 22 nt, Human
accugugucuccucuguguucu

SEQ ID NO: 888206 - RNA, 22 nt, Human
caggcccucugcacccucgucu

SEQ ID NO: 888207 - RNA, 22 nt, Human
caucuugugaggaccuucuugc

SEQ ID NO: 888208 - RNA, 22 nt, Human
uugcuuuacauguucugguaaa

SEQ ID NO: 888209 - RNA, 22 nt, Human
gaagaguauauuuagugaaauc

SEQ ID NO: 888210 - RNA, 22 nt, Human
gccuggaggggacagucucugg

SEQ ID NO: 888211 - RNA, 22 nt, Human
gacacagggacgugcucugccu

SEQ ID NO: 888212 - RNA, 22 nt, Human
agcuuucacgauuuggaacagg

SEQ ID NO: 888213 - RNA, 16 nt, Human
aucucaggagagucuu

SEQ ID NO: 888214 - RNA, 22 nt, Human
cuucagaagccugcagccuuug

SEQ ID NO: 888215 - RNA, 22 nt, Human
ucaggaagcugaauuacaaaaa

SEQ ID NO: 888216 - RNA, 22 nt, Human
gcucuguguuccucuggauugc

SEQ ID NO: 888217 - RNA, 22 nt, Human
gcugccuguggcccuucugggu

SEQ ID NO: 888218 - RNA, 22 nt, Human
ugcauauuuguaugauguuuag

SEQ ID NO: 888219 - RNA, 22 nt, Human
gugauaaaauucaaauagcucu

SEQ ID NO: 888220 - RNA, 22 nt, Human
ggggcagcuaccggaaguaggg

SEQ ID NO: 888221 - RNA, 21 nt, Human
gggaaauuaggauugcucauc

SEQ ID NO: 888222 - RNA, 22 nt, Human
cauguacaguuuuucuguccug

SEQ ID NO: 888223 - RNA, 22 nt, Human
ucucugucugagccuggcagac

SEQ ID NO: 888224 - RNA, 17 nt, Human
gccuggcccagccuggc

SEQ ID NO: 888225 - RNA, 22 nt, Human
uagacucugcauuuaccuccca

SEQ ID NO: 888226 - RNA, 22 nt, Human
gagaacaguguuguauuuuuuc

SEQ ID NO: 888227 - RNA, 22 nt, Human
ucuuugauuuuguuacuaagac

SEQ ID NO: 888228 - RNA, 22 nt, Human
ugaguccugucuuugucacuua

SEQ ID NO: 888229 - RNA, 21 nt, Human
ucugccagcugaagaggugga

SEQ ID NO: 888230 - RNA, 22 nt, Human
agcuguggggaggaggcuagca

SEQ ID NO: 888231 - RNA, 22 nt, Human
aagaguuuaugauauaacaugu

SEQ ID NO: 888232 - RNA, 22 nt, Human
uucagugucccuaguagaaguu

SEQ ID NO: 888233 - RNA, 22 nt, Human
ugaguccauaguggauccuuca

SEQ ID NO: 888234 - RNA, 22 nt, Human
gagaagcagguuuagcagacaa

SEQ ID NO: 888235 - RNA, 22 nt, Human
aaaauggcuuaauaggcaauaa

SEQ ID NO: 888236 - RNA, 22 nt, Human
ucuccugcucagaacagccuca

SEQ ID NO: 888237 - RNA, 22 nt, Human
uagaauguggagguaacagacu

SEQ ID NO: 888238 - RNA, 22 nt, Human
cuguuauuugagaguguugaau

SEQ ID NO: 888239 - RNA, 20 nt, Human
agggucaguagcacagagcu

SEQ ID NO: 888240 - RNA, 22 nt, Human
cuuucuuaauuuuuaaggacac

SEQ ID NO: 888241 - RNA, 22 nt, Human
ugaaagcacaaguucuaacagg

SEQ ID NO: 888242 - RNA, 22 nt, Human
aaaugguauuuacucuguauua

SEQ ID NO: 888243 - RNA, 22 nt, Human
acugacuuuggaauauuucuag

SEQ ID NO: 888244 - RNA, 22 nt, Human
agucacugagauggugaggcua

SEQ ID NO: 888245 - RNA, 22 nt, Human
uggucaggggcuucugagcugu

SEQ ID NO: 888246 - RNA, 23 nt, Human
gcugccuccuacaaaagcccagc

SEQ ID NO: 888247 - RNA, 22 nt, Human
uuugacaguguuggggcaggcu

SEQ ID NO: 888248 - RNA, 22 nt, Human
cagauguaauuacucaagucaa

SEQ ID NO: 888249 - RNA, 22 nt, Human
agaaacaucgcuuaguccucau

SEQ ID NO: 888250 - RNA, 22 nt, Human
ccaggcaucacgggcauguggc

SEQ ID NO: 888251 - RNA, 22 nt, Human
acacagauauuuugaauacaua

SEQ ID NO: 888252 - RNA, 22 nt, Human
gaaggcuguggcuggucucagu

SEQ ID NO: 888253 - RNA, 22 nt, Human
cugggcucagugucucacuccu

SEQ ID NO: 888254 - RNA, 22 nt, Human
uucuaguuauagaaaaagcauu

SEQ ID NO: 888255 - RNA, 22 nt, Human
uagauuguucuuaacuuuauaa

SEQ ID NO: 888256 - RNA, 22 nt, Human
guuuucagccaggagcacauuu

SEQ ID NO: 888257 - RNA, 23 nt, Human
ugguccugguugaggugggcccc

SEQ ID NO: 888258 - RNA, 20 nt, Human
gccuggcacccggggcuggc

SEQ ID NO: 888259 - RNA, 22 nt, Human
cagggaugugaugagcugagcc

SEQ ID NO: 888260 - RNA, 22 nt, Human
ugccugcuaggcccugcugggu

SEQ ID NO: 888261 - RNA, 22 nt, Human
gaaagaggaaggagauguauua

SEQ ID NO: 888262 - RNA, 22 nt, Human
ugagguaguaaagguguuaguu

SEQ ID NO: 888263 - RNA, 22 nt, Human
agugcccugggccuuccaggac

SEQ ID NO: 888264 - RNA, 22 nt, Human
cgcagcugccuugucagccguu

SEQ ID NO: 888265 - RNA, 22 nt, Human
ugccugggccuucccaccucug

SEQ ID NO: 888266 - RNA, 22 nt, Human
guauauaagguaaagcgauugu

SEQ ID NO: 888267 - RNA, 22 nt, Human
uaauuuaugaugcaaagaaaag

SEQ ID NO: 888268 - RNA, 22 nt, Human
aucuuucagggccauuuguauu

SEQ ID NO: 888269 - RNA, 22 nt, Human
gcagacaccuuguaggugugua

SEQ ID NO: 888270 - RNA, 22 nt, Human
gaaaucaucugaguaauaaucu

SEQ ID NO: 888271 - RNA, 22 nt, Human
uucugaggcacuggcucuccca

SEQ ID NO: 888272 - RNA, 22 nt, Human
uuagcaaacaaaugaaaugguu

SEQ ID NO: 888273 - RNA, 23 nt, Human
ugucacauuuaguuggcauuguu

SEQ ID NO: 888274 - RNA, 23 nt, Human
cuggcuccgaagacuccaggauc

SEQ ID NO: 888275 - RNA, 22 nt, Human
agcugugguacuugauucacaa

SEQ ID NO: 888276 - RNA, 22 nt, Human
ucaagcaaaguuuagcugguua

SEQ ID NO: 888277 - RNA, 22 nt, Human
caguguuacugggccugggugu

SEQ ID NO: 888278 - RNA, 22 nt, Human
cuucuggggauggagcccagaa

SEQ ID NO: 888279 - RNA, 22 nt, Human
uaagaaguaccucuuuuccuga

SEQ ID NO: 888280 - RNA, 22 nt, Human
uuggaaauguagaaaagcagau

SEQ ID NO: 888281 - RNA, 22 nt, Human
gagagagagcuaauauuaagcu

SEQ ID NO: 888282 - RNA, 22 nt, Human
gcagauuucauuuaaaccuuuc

SEQ ID NO: 888283 - RNA, 22 nt, Human
uguuaucugagcaacgucgacg

SEQ ID NO: 888284 - RNA, 22 nt, Human
caagguucuauagcaaaaucug

SEQ ID NO: 888285 - RNA, 22 nt, Human
aggaagaggugugcaauggugu

SEQ ID NO: 888286 - RNA, 21 nt, Human
gcugcccuggcucagcauuca

SEQ ID NO: 888287 - RNA, 22 nt, Human
uacaacaggaauuucaacuuug

SEQ ID NO: 888288 - RNA, 22 nt, Human
ugccugaaugaucagucagauu

SEQ ID NO: 888289 - RNA, 22 nt, Human
augcaaaucuuaaguaugugug

SEQ ID NO: 888290 - RNA, 17 nt, Human
uuaucuugcuguuucua

SEQ ID NO: 888291 - RNA, 20 nt, Human
agaaucugacccagagagac

SEQ ID NO: 888292 - RNA, 22 nt, Human
ucugccugcuucuucauagucu

SEQ ID NO: 888293 - RNA, 22 nt, Human
gccugcuggaggagccucaggg

SEQ ID NO: 888294 - RNA, 22 nt, Human
gucagugucuuaacagagauua

SEQ ID NO: 888295 - RNA, 22 nt, Human
agaccuuguaacuagaggccca

SEQ ID NO: 888296 - RNA, 22 nt, Human
uaagaaucuauuaggaauaugu

SEQ ID NO: 888297 - RNA, 22 nt, Human
guccuuggcuucuuguugacug

SEQ ID NO: 888298 - RNA, 22 nt, Human
acagaagagcacauuuaguaug

SEQ ID NO: 888299 - RNA, 22 nt, Human
ccauuuguuguguauuaauauu

SEQ ID NO: 888300 - RNA, 23 nt, Human
ucagcugcuuccuccugccugcc

SEQ ID NO: 888301 - RNA, 22 nt, Human
gagggcagugaauuuugaagcu

SEQ ID NO: 888302 - RNA, 22 nt, Human
aggcugaggugugcugugaucg

SEQ ID NO: 888303 - RNA, 22 nt, Human
gagcaaggauggccggggccgu

SEQ ID NO: 888304 - RNA, 22 nt, Human
agagccuugccuggggcccugu

SEQ ID NO: 888305 - RNA, 22 nt, Human
ucucucuugaaguauuagcuag

SEQ ID NO: 888306 - RNA, 22 nt, Human
cuugcagggcugaugggaagug

SEQ ID NO: 888307 - RNA, 22 nt, Human
acagugacaacccaggauaaau

SEQ ID NO: 888308 - RNA, 22 nt, Human
uuaucuguuuaacaaaguaucu

SEQ ID NO: 888309 - RNA, 22 nt, Human
cauggcugccuguggacacugc

SEQ ID NO: 888310 - RNA, 22 nt, Human
ugucuguccuuguuugguauca

SEQ ID NO: 888311 - RNA, 22 nt, Human
uggagucugugaugcucugggu

SEQ ID NO: 888312 - RNA, 22 nt, Human
aggcaaagcgauaccagagcua

SEQ ID NO: 888313 - RNA, 22 nt, Human
gccuggcugcugguucugagga

SEQ ID NO: 888314 - RNA, 22 nt, Human
uagcugugaagagcuaaaaaau

SEQ ID NO: 888315 - RNA, 22 nt, Human
aguauuuagagacacaagaugg

SEQ ID NO: 888316 - RNA, 21 nt, Human
uggcugccuacaugcugcagg

SEQ ID NO: 888317 - RNA, 22 nt, Human
gagcugaauugcugccauuugc

SEQ ID NO: 888318 - RNA, 22 nt, Human
aaggcagaaauucaacuacugg

SEQ ID NO: 888319 - RNA, 18 nt, Human
ggcugccuguuccugaag

SEQ ID NO: 888320 - RNA, 22 nt, Human
gcacagaauaacacucugggcu

SEQ ID NO: 888321 - RNA, 22 nt, Human
gaaagccauagcccagcuuuac

SEQ ID NO: 888322 - RNA, 22 nt, Human
ggcugagguguggggaacuaua

SEQ ID NO: 888323 - RNA, 22 nt, Human
aaggcagauauaaagacuagag

SEQ ID NO: 888324 - RNA, 22 nt, Human
ugacuuuagagaugggagguca

SEQ ID NO: 888325 - RNA, 22 nt, Human
ugagggcaaaguggugcugagg

SEQ ID NO: 888326 - RNA, 22 nt, Human
uccucccugcacucagugaagu

SEQ ID NO: 888327 - RNA, 22 nt, Human
ggcugcagagcuggugcccugg

SEQ ID NO: 888328 - RNA, 22 nt, Human
acugaugaaaacuaauaaauua

SEQ ID NO: 888329 - RNA, 22 nt, Human
cugacugucucuucucccauga

SEQ ID NO: 888330 - RNA, 22 nt, Human
gugcagggcccuccuaacaucu

SEQ ID NO: 888331 - RNA, 22 nt, Human
cagaaucucgacuucuggcccc

SEQ ID NO: 888332 - RNA, 22 nt, Human
uuagaauuucugcucacuuuga

SEQ ID NO: 888333 - RNA, 22 nt, Human
gagcuuccuuuuucugcaugac

SEQ ID NO: 888334 - RNA, 22 nt, Human
aaacacagauuucuuuguccca

SEQ ID NO: 888335 - RNA, 22 nt, Human
cugggaguugacgaggcuugua

SEQ ID NO: 888336 - RNA, 22 nt, Human
ucagucccaagguccugaggug

SEQ ID NO: 888337 - RNA, 22 nt, Human
uucuuuaaaauagugagaaaga

SEQ ID NO: 888338 - RNA, 22 nt, Human
cugaccuguaacuguaagagac

SEQ ID NO: 888339 - RNA, 22 nt, Human
aauuaauggaaaguaaggaagg

SEQ ID NO: 888340 - RNA, 22 nt, Human
ccagcugucacucagaaaggcc

SEQ ID NO: 888341 - RNA, 22 nt, Human
ucuccaagcagggcugcaaggc

SEQ ID NO: 888342 - RNA, 22 nt, Human
aggcaggucuguaucuagucuc

SEQ ID NO: 888343 - RNA, 22 nt, Human
gccagcuguucagacauucuuu

SEQ ID NO: 888344 - RNA, 22 nt, Human
aauuugccuuaccuucuuccaa

SEQ ID NO: 888345 - RNA, 22 nt, Human
ugaucaaaacauuacuccacca

SEQ ID NO: 888346 - RNA, 22 nt, Human
agggccugagcuggcugaccuc

SEQ ID NO: 888347 - RNA, 22 nt, Human
aagauuaaaggggagacaagcu

SEQ ID NO: 888348 - RNA, 22 nt, Human
caggaagcaagugauuuucuug

SEQ ID NO: 888349 - RNA, 22 nt, Human
aagauguugucguuagugauga

SEQ ID NO: 888350 - RNA, 22 nt, Human
uugagguaaagcuacuaguuag

SEQ ID NO: 888351 - RNA, 22 nt, Human
gaggcugaaguguacaugggug

SEQ ID NO: 888352 - RNA, 22 nt, Human
cauauuuaguguuuggagaucg

SEQ ID NO: 888353 - RNA, 22 nt, Human
gguggagagcuggaugagaggu

SEQ ID NO: 888354 - RNA, 22 nt, Human
agugacagauuaccggcagagc

SEQ ID NO: 888355 - RNA, 21 nt, Human
uccuguaagcuuggguggcuc

SEQ ID NO: 888356 - RNA, 22 nt, Human
caugccauuucuucucuuuaug

SEQ ID NO: 888357 - RNA, 22 nt, Human
ggagccugacagugcccagcau

SEQ ID NO: 888358 - RNA, 22 nt, Human
cucugcaucaggcauuauggau

SEQ ID NO: 888359 - RNA, 22 nt, Human
gggcuugaggugaagguaggga

SEQ ID NO: 888360 - RNA, 22 nt, Human
gugcuuuaaaccacugugcugu

SEQ ID NO: 888361 - RNA, 22 nt, Human
gacccaggaagcuacuucuggu

SEQ ID NO: 888362 - RNA, 22 nt, Human
uggggagguaacaauuucaggc

SEQ ID NO: 888363 - RNA, 22 nt, Human
ggagcuggucagccuugagcau

SEQ ID NO: 888364 - RNA, 22 nt, Human
aaggaagguucauagucaaaga

SEQ ID NO: 888365 - RNA, 22 nt, Human
cagcaagggauaaacaaggacg

SEQ ID NO: 888366 - RNA, 22 nt, Human
cagggcagaaggcacucuacuc

SEQ ID NO: 888367 - RNA, 22 nt, Human
gggagggagaggacaguucuau

SEQ ID NO: 888368 - RNA, 22 nt, Human
gacauaaaugaaguuugacuau

SEQ ID NO: 888369 - RNA, 22 nt, Human
uuuuacauugggaaaugccucu

SEQ ID NO: 888370 - RNA, 22 nt, Human
aaagaugucacaagaugugaug

SEQ ID NO: 888371 - RNA, 22 nt, Human
aaaaauuuaugguucuucucug

SEQ ID NO: 888372 - RNA, 22 nt, Human
cugugaggcggaaaggacucuc

SEQ ID NO: 888373 - RNA, 22 nt, Human
auagcaauggcaacaacuaagc

SEQ ID NO: 888374 - RNA, 22 nt, Human
uuuauucuugagagugagaaga

SEQ ID NO: 888375 - RNA, 23 nt, Human
acagcuuccuggcauggagaacc

SEQ ID NO: 888376 - RNA, 22 nt, Human
agcagcaguguguggucauguu

SEQ ID NO: 888377 - RNA, 22 nt, Human
uuucauuacguguuugacuugu

SEQ ID NO: 888378 - RNA, 22 nt, Human
caaagcagugauccuuaaagga

SEQ ID NO: 888379 - RNA, 20 nt, Human
gcugaccccugcugucaugc

SEQ ID NO: 888380 - RNA, 22 nt, Human
aaaagguuuugaguacaaauau

SEQ ID NO: 888381 - RNA, 19 nt, Human
ucuuucauuucuagcucug

SEQ ID NO: 888382 - RNA, 22 nt, Human
uuuuauaaagagagucaguugg

SEQ ID NO: 888383 - RNA, 22 nt, Human
aagacuuucccucaucagaacg

SEQ ID NO: 888384 - RNA, 22 nt, Human
aaaggagagugagucagaugcc

SEQ ID NO: 888385 - RNA, 22 nt, Human
aagucucuggugaugcaggaaa

SEQ ID NO: 888386 - RNA, 22 nt, Human
acagauuuuaaauuuguaguug

SEQ ID NO: 888387 - RNA, 22 nt, Human
guguuuuaucagacaaaguaua

SEQ ID NO: 888388 - RNA, 22 nt, Human
aaguccauagguuucaugaggg

SEQ ID NO: 888389 - RNA, 22 nt, Human
aaaucaugguggaagaaacaga

SEQ ID NO: 888390 - RNA, 22 nt, Human
ugcuuaaaaacaguaugguagu

SEQ ID NO: 888391 - RNA, 22 nt, Human
acagguguugaaugaugucaca

SEQ ID NO: 888392 - RNA, 17 nt, Human
acagagugucccgcagu

SEQ ID NO: 888393 - RNA, 22 nt, Human
gaaggcaagcuuuggauaugag

SEQ ID NO: 888394 - RNA, 22 nt, Human
agcaccugcuuaaugugcagug

SEQ ID NO: 888395 - RNA, 22 nt, Human
agccuuacauaaacagccuuau

SEQ ID NO: 888396 - RNA, 20 nt, Human
aggaaagccugugugagucu

SEQ ID NO: 888397 - RNA, 22 nt, Human
uuuagagaggcucuguaaaaug

SEQ ID NO: 888398 - RNA, 22 nt, Human
uaauuauagccgcuauuuugcu

SEQ ID NO: 888399 - RNA, 22 nt, Human
cuuacccaaauuagaguuacca

SEQ ID NO: 888400 - RNA, 22 nt, Human
ucaaucaaagccagauguccuu

SEQ ID NO: 888401 - RNA, 23 nt, Human
ucguugaauagcaauagcacaac

SEQ ID NO: 888402 - RNA, 22 nt, Human
acaaugcauaccuagcagcuca

SEQ ID NO: 888403 - RNA, 22 nt, Human
ugaggugguccaaagacuguuu

SEQ ID NO: 888404 - RNA, 22 nt, Human
ugcccagucuccgggccagccc

SEQ ID NO: 888405 - RNA, 22 nt, Human
caaauugaucugucuuuaugaa

SEQ ID NO: 888406 - RNA, 22 nt, Human
acugccugaugugguucuaaau

SEQ ID NO: 888407 - RNA, 19 nt, Human
ggcuucgaggcuggggaag

SEQ ID NO: 888408 - RNA, 22 nt, Human
agugugugaccuuuuaauuuaa

SEQ ID NO: 888409 - RNA, 22 nt, Human
agucacuuuaugagagaaccau

SEQ ID NO: 888410 - RNA, 22 nt, Human
aaggcagaggaaggucuaguuu

SEQ ID NO: 888411 - RNA, 22 nt, Human
ugguaccugaaugaagggagga

SEQ ID NO: 888412 - RNA, 22 nt, Human
uucuaagagaguacaagcaauu

SEQ ID NO: 888413 - RNA, 22 nt, Human
gucagaggaggcugaguaggaa

SEQ ID NO: 888414 - RNA, 22 nt, Human
aaagcaguccuucccuuaaggu

SEQ ID NO: 888415 - RNA, 22 nt, Human
ucaauaaaauuguuuuccuauc

SEQ ID NO: 888416 - RNA, 17 nt, Human
gaugaaaugaugcacac

SEQ ID NO: 888417 - RNA, 22 nt, Human
uuugcaaauaccaugaaacuug

SEQ ID NO: 888418 - RNA, 22 nt, Human
ccugaggcuggcccuuccaucc

SEQ ID NO: 888419 - RNA, 22 nt, Human
ugucuagacaagaaguauugcc

SEQ ID NO: 888420 - RNA, 22 nt, Human
cugccuguuuucugauagauuu

SEQ ID NO: 888421 - RNA, 22 nt, Human
ucuugucaugcccuugguaacu

SEQ ID NO: 888422 - RNA, 22 nt, Human
cuaccuuacuuuaacccugcaa

SEQ ID NO: 888423 - RNA, 22 nt, Human
uuuaaugugagucccuuucaag

SEQ ID NO: 888424 - RNA, 22 nt, Human
ucuuuucuugcauuauugcacu

SEQ ID NO: 888425 - RNA, 22 nt, Human
aagaacaugcuauaauuaucuu

SEQ ID NO: 888426 - RNA, 22 nt, Human
uguucuucuagauugccuuuua

SEQ ID NO: 888427 - RNA, 22 nt, Human
gcagagucaggauuccauccca

SEQ ID NO: 888428 - RNA, 22 nt, Human
ggcugcucggcagcuccugagc

SEQ ID NO: 888429 - RNA, 22 nt, Human
auauuuuuccaugugggacucu

SEQ ID NO: 888430 - RNA, 22 nt, Human
cugguggaccagccuccccagc

SEQ ID NO: 888431 - RNA, 22 nt, Human
uucaaacaaaacucuuuccuau

SEQ ID NO: 888432 - RNA, 22 nt, Human
cugagguaccuggagcaggucc

SEQ ID NO: 888433 - RNA, 22 nt, Human
agccacaggaaacagagacagc

SEQ ID NO: 888434 - RNA, 22 nt, Human
uacucacauucuguuucuugcu

SEQ ID NO: 888435 - RNA, 22 nt, Human
cugcagcuggcucaugggauau

SEQ ID NO: 888436 - RNA, 22 nt, Human
agcuuuguuucacauacaccuu

SEQ ID NO: 888437 - RNA, 22 nt, Human
uuugucuaauugcaaggcaagu

SEQ ID NO: 888438 - RNA, 22 nt, Human
uuggaagggaacaccauuugac

SEQ ID NO: 888439 - RNA, 22 nt, Human
gcugggcuguaguuugcugacc

SEQ ID NO: 888440 - RNA, 18 nt, Human
cagucccaaaccuuagga

SEQ ID NO: 888441 - RNA, 22 nt, Human
agcagcaaggaagcgaggaugg

SEQ ID NO: 888442 - RNA, 22 nt, Human
aaaagugaggcagcccaaggga

SEQ ID NO: 888443 - RNA, 22 nt, Human
acccuuugccuagaggggcuuu

SEQ ID NO: 888444 - RNA, 22 nt, Human
acuuuguucuaauaguaucucu

SEQ ID NO: 888445 - RNA, 22 nt, Human
acugcucuguuuucauauguuu

SEQ ID NO: 888446 - RNA, 22 nt, Human
gagaagguggaccugaaggagc

SEQ ID NO: 888447 - RNA, 22 nt, Human
acugugcauuucaugucuuuuc

SEQ ID NO: 888448 - RNA, 22 nt, Human
uucuaugugaacguuauaguuu

SEQ ID NO: 888449 - RNA, 22 nt, Human
acaugaaauucuagcugaaccc

SEQ ID NO: 888450 - RNA, 22 nt, Human
aggaauuacucaucugugguau

SEQ ID NO: 888451 - RNA, 22 nt, Human
uaagcaaauagcuagaucagag

SEQ ID NO: 888452 - RNA, 22 nt, Human
gucacacagguugaaaugcagu

SEQ ID NO: 888453 - RNA, 22 nt, Human
agcuuguuagggcaguggucgc

SEQ ID NO: 888454 - RNA, 22 nt, Human
uguguauauguaaauauaguug

SEQ ID NO: 888455 - RNA, 22 nt, Human
ggcuucacugacugguucuagg

SEQ ID NO: 888456 - RNA, 22 nt, Human
uaccguacacauuaacuacagu

SEQ ID NO: 888457 - RNA, 22 nt, Human
uuacaaugacagguguaucauu

SEQ ID NO: 888458 - RNA, 22 nt, Human
cuucaugucggcggcucucggg

SEQ ID NO: 888459 - RNA, 22 nt, Human
uggagguggaguuggaaacuga

SEQ ID NO: 888460 - RNA, 22 nt, Human
guagaggggugauucugugaga

SEQ ID NO: 888461 - RNA, 22 nt, Human
cccaggacucuucacugcagcc

SEQ ID NO: 888462 - RNA, 22 nt, Human
gagacguggccuuugccugagc

SEQ ID NO: 888463 - RNA, 22 nt, Human
ugagaugggucaucagguuugg

SEQ ID NO: 888464 - RNA, 22 nt, Human
cccacaggcuagggguagggca

SEQ ID NO: 888465 - RNA, 22 nt, Human
uguuuucucuugaaaagcaguc

SEQ ID NO: 888466 - RNA, 22 nt, Human
ccagcagagggucuuggccauu

SEQ ID NO: 888467 - RNA, 20 nt, Human
uuguuagaggaaugccauag

SEQ ID NO: 888468 - RNA, 22 nt, Human
uuucaagaagcaaauuaaaguc

SEQ ID NO: 888469 - RNA, 20 nt, Human
uuggaugugcauggccgugc

SEQ ID NO: 888470 - RNA, 22 nt, Human
auucaguugucuacuacugccu

SEQ ID NO: 888471 - RNA, 22 nt, Human
gaauaucugggagugggaagcu

SEQ ID NO: 888472 - RNA, 22 nt, Human
agaaggccagauggacggggcu

SEQ ID NO: 888473 - RNA, 22 nt, Human
ggcgagcagagcacugccagga

SEQ ID NO: 888474 - RNA, 22 nt, Human
gaggaugcugcagugcaggaca

SEQ ID NO: 888475 - RNA, 22 nt, Human
aaagcacuugaaaucuggcagu

SEQ ID NO: 888476 - RNA, 22 nt, Human
auccugucucuacccaucggcu

SEQ ID NO: 888477 - RNA, 22 nt, Human
cuuguaaaagguacauuaugcu

SEQ ID NO: 888478 - RNA, 22 nt, Human
ugagucacagccuugccuuggu

SEQ ID NO: 888479 - RNA, 22 nt, Human
aggugggcccagugggcuccag

SEQ ID NO: 888480 - RNA, 22 nt, Human
gauaaaagaggaaauuuguuca

SEQ ID NO: 888481 - RNA, 22 nt, Human
uacagaaaucacaucgcuuuga

SEQ ID NO: 888482 - RNA, 22 nt, Human
agcugaaguuuagaauugugaa

SEQ ID NO: 888483 - RNA, 23 nt, Human
uggggagaguuacccuggaagcg

SEQ ID NO: 888484 - RNA, 22 nt, Human
acaaugaccaaaauguuuccag

SEQ ID NO: 888485 - RNA, 22 nt, Human
uuuauauagagauuugugcaug

SEQ ID NO: 888486 - RNA, 19 nt, Human
guucccauugcaguugugg

SEQ ID NO: 888487 - RNA, 22 nt, Human
uuucugcaaaaucuaaguuaga

SEQ ID NO: 888488 - RNA, 22 nt, Human
ggaaaucaugggagaguuggaa

SEQ ID NO: 888489 - RNA, 22 nt, Human
uuuauaaaauagacugggucua

SEQ ID NO: 888490 - RNA, 22 nt, Human
ucagugaaugagauaacuuuag

SEQ ID NO: 888491 - RNA, 22 nt, Human
cacaggagugcugcuauuguug

SEQ ID NO: 888492 - RNA, 22 nt, Human
aaagguuuauugcuaugguugu

SEQ ID NO: 888493 - RNA, 22 nt, Human
aagucagagcaacugagacauu

SEQ ID NO: 888494 - RNA, 20 nt, Human
cccuaggaacgcagcaggag

SEQ ID NO: 888495 - RNA, 22 nt, Human
gaacacugacauuuuccugacu

SEQ ID NO: 888496 - RNA, 22 nt, Human
acuuauuuauucauucagcuca

SEQ ID NO: 888497 - RNA, 22 nt, Human
uuuuacuucauuccugacuuca

SEQ ID NO: 888498 - RNA, 22 nt, Human
auguuuaugaccuccauaagga

SEQ ID NO: 888499 - RNA, 19 nt, Human
cugcuucaggcgccuugcc

SEQ ID NO: 888500 - RNA, 22 nt, Human
aguucuaagaugcuccacagag

SEQ ID NO: 888501 - RNA, 22 nt, Human
cagggaaggcugcaaauguuaa

SEQ ID NO: 888502 - RNA, 22 nt, Human
uaccagcaaugcuagucaacuc

SEQ ID NO: 888503 - RNA, 22 nt, Human
agcagcugaccagugaguccug

SEQ ID NO: 888504 - RNA, 21 nt, Human
auuucagaaauauugguggga

SEQ ID NO: 888505 - RNA, 22 nt, Human
cuguguggacugguugaggccc

SEQ ID NO: 888506 - RNA, 22 nt, Human
aucauacagaaccugagcacuu

SEQ ID NO: 888507 - RNA, 22 nt, Human
auguguuuugguaauuucugcu

SEQ ID NO: 888508 - RNA, 22 nt, Human
ugcauuuuacuuaccuguuagu

SEQ ID NO: 888509 - RNA, 22 nt, Human
cucagccccagcccagauagca

SEQ ID NO: 888510 - RNA, 22 nt, Human
gggccugagacugagggugagg

SEQ ID NO: 888511 - RNA, 22 nt, Human
uaagccacuagucuguuaugaa

SEQ ID NO: 888512 - RNA, 22 nt, Human
gggacccucaacaucugcuucu

SEQ ID NO: 888513 - RNA, 22 nt, Human
gcacagagccugguaccgagaa

SEQ ID NO: 888514 - RNA, 22 nt, Human
augcugugagugugccgcagag

SEQ ID NO: 888515 - RNA, 22 nt, Human
gaugcagggcagcucugggaca

SEQ ID NO: 888516 - RNA, 22 nt, Human
uauaaaauggcaucagcuccaa

SEQ ID NO: 888517 - RNA, 22 nt, Human
uauuuguuccagagauaaaaau

SEQ ID NO: 888518 - RNA, 20 nt, Human
ugcuguguggcccagcauga

SEQ ID NO: 888519 - RNA, 22 nt, Human
acauuagaugacucuuucuuuc

SEQ ID NO: 888520 - RNA, 20 nt, Human
gucuuuauguuuuaugaccu

SEQ ID NO: 888521 - RNA, 22 nt, Human
cugagaaaagcuuucuuauaca

SEQ ID NO: 888522 - RNA, 22 nt, Human
gucuuucuuaaacaacagaaca

SEQ ID NO: 888523 - RNA, 22 nt, Human
uuaagauuuguagagaaaaagc

SEQ ID NO: 888524 - RNA, 22 nt, Human
caguaauauuuuacucuaggcc

SEQ ID NO: 888525 - RNA, 22 nt, Human
ucauaaacacacuaguaugauu

SEQ ID NO: 888526 - RNA, 22 nt, Human
auguucauuugacaaguaguga

SEQ ID NO: 888527 - RNA, 22 nt, Human
acuguguggaaauuugugaggg

SEQ ID NO: 888528 - RNA, 22 nt, Human
aggcuuuuagaaucuuauuucu

SEQ ID NO: 888529 - RNA, 22 nt, Human
uucuagaaauccguaagugaau

SEQ ID NO: 888530 - RNA, 23 nt, Human
ucugcucugaaguucggcugagc

SEQ ID NO: 888531 - RNA, 21 nt, Human
gcagccacugccuucaacaau

SEQ ID NO: 888532 - RNA, 23 nt, Human
uucugcauguuucagagcuggga

SEQ ID NO: 888533 - RNA, 22 nt, Human
aaagccaaaugaaagaugguuc

SEQ ID NO: 888534 - RNA, 22 nt, Human
gagaggagguggcuaugacagc

SEQ ID NO: 888535 - RNA, 22 nt, Human
aguuuuaagaugcgcuucuguu

SEQ ID NO: 888536 - RNA, 22 nt, Human
aacuccagacuacuaauuuagu

SEQ ID NO: 888537 - RNA, 18 nt, Human
ucuauauggacauagaga

SEQ ID NO: 888538 - RNA, 22 nt, Human
agccacagcacauuguaagaaa

SEQ ID NO: 888539 - RNA, 22 nt, Human
uccugggaaguggcuggcugag

SEQ ID NO: 888540 - RNA, 22 nt, Human
ucauuucaaugauacuacuaag

SEQ ID NO: 888541 - RNA, 19 nt, Human
ugcuuugccuugauuagcu

SEQ ID NO: 888542 - RNA, 22 nt, Human
guauacuugcagacauuuauau

SEQ ID NO: 888543 - RNA, 19 nt, Human
aggaaggaaccugagucug

SEQ ID NO: 888544 - RNA, 22 nt, Human
uguauacauuuaacuagauaga

SEQ ID NO: 888545 - RNA, 22 nt, Human
aguaaaaaguucagaaugguug

SEQ ID NO: 888546 - RNA, 22 nt, Human
ggcuggcugauaaaggguugag

SEQ ID NO: 888547 - RNA, 22 nt, Human
gggccugggaacuugcauuuag

SEQ ID NO: 888548 - RNA, 22 nt, Human
auuuuguugagguaauugucaa

SEQ ID NO: 888549 - RNA, 22 nt, Human
ugggaaugcugauuucaggaac

SEQ ID NO: 888550 - RNA, 22 nt, Human
ggcugcagcagagggacucacg

SEQ ID NO: 888551 - RNA, 18 nt, Human
ucaggaguuuguggaugg

SEQ ID NO: 888552 - RNA, 22 nt, Human
uucaggagaaaguucaguacuu

SEQ ID NO: 888553 - RNA, 22 nt, Human
ccagcugcugugcagggaggcu

SEQ ID NO: 888554 - RNA, 22 nt, Human
aagcuguugaaguaauucagcc

SEQ ID NO: 888555 - RNA, 22 nt, Human
caguccugggcacagcccuggg

SEQ ID NO: 888556 - RNA, 22 nt, Human
agcauucucagaaugucauuuu

SEQ ID NO: 888557 - RNA, 22 nt, Human
ugcaggugacaccacucuuccu

SEQ ID NO: 888558 - RNA, 22 nt, Human
caguaauagagugccagggaug

SEQ ID NO: 888559 - RNA, 22 nt, Human
uaaacaugugagugugcauaua

SEQ ID NO: 888560 - RNA, 22 nt, Human
auucuucacauggauaggaucu

SEQ ID NO: 888561 - RNA, 22 nt, Human
guucaaauugagaugguauaaa

SEQ ID NO: 888562 - RNA, 22 nt, Human
guucuagguuagaaggacagau

SEQ ID NO: 888563 - RNA, 22 nt, Human
gcuagcagagugcauccuucua

SEQ ID NO: 888564 - RNA, 18 nt, Human
cagaugagaugcaaucuc

SEQ ID NO: 888565 - RNA, 22 nt, Human
ucuauuuuguuuccagcucuac

SEQ ID NO: 888566 - RNA, 20 nt, Human
uguaaauaggcauuguaguu

SEQ ID NO: 888567 - RNA, 22 nt, Human
uacagcugaguuuagguacagg

SEQ ID NO: 888568 - RNA, 22 nt, Human
gcagugcugagaggugaucgga

SEQ ID NO: 888569 - RNA, 22 nt, Human
aagggugguguaggagaucaaa

SEQ ID NO: 888570 - RNA, 22 nt, Human
cacauucagcucauuaaugguc

SEQ ID NO: 888571 - RNA, 22 nt, Human
uauacugagagcaaauacauuc

SEQ ID NO: 888572 - RNA, 22 nt, Human
cagcaucugaccaauaucuaca

SEQ ID NO: 888573 - RNA, 20 nt, Human
agccaaaggagaacagugcu

SEQ ID NO: 888574 - RNA, 22 nt, Human
auguauaaugcuaauuagcuag

SEQ ID NO: 888575 - RNA, 22 nt, Human
aagacagcucaggacagauuca

SEQ ID NO: 888576 - RNA, 22 nt, Human
cccacuguguugcagucuagug

SEQ ID NO: 888577 - RNA, 22 nt, Human
uccuccagaaacugaggcagaa

SEQ ID NO: 888578 - RNA, 23 nt, Human
uucuuccaaggugcuuugugguu

SEQ ID NO: 888579 - RNA, 22 nt, Human
uguggucuccccagugccagcu

SEQ ID NO: 888580 - RNA, 22 nt, Human
ucugaaauuguuaguaaaaaug

SEQ ID NO: 888581 - RNA, 22 nt, Human
ccauacacacaccaaauuugua

SEQ ID NO: 888582 - RNA, 19 nt, Human
aguuuauuauaggugauuc

SEQ ID NO: 888583 - RNA, 22 nt, Human
uauuuuugccucucagauaaaa

SEQ ID NO: 888584 - RNA, 22 nt, Human
ccugaggcucgcgcgccccugg

SEQ ID NO: 888585 - RNA, 22 nt, Human
acuguuacagggcacugaacau

SEQ ID NO: 888586 - RNA, 22 nt, Human
cagggcuguggaaaacuggugc

SEQ ID NO: 888587 - RNA, 22 nt, Human
acauagaaggaagaguaguagg

SEQ ID NO: 888588 - RNA, 22 nt, Human
gugaagaccagggaacgcuggc

SEQ ID NO: 888589 - RNA, 22 nt, Human
ggcuggcuggaugaauggauua

SEQ ID NO: 888590 - RNA, 22 nt, Human
auauauauugcccaggcugguu

SEQ ID NO: 888591 - RNA, 22 nt, Human
uuguagcauuuuaaaugagcau

SEQ ID NO: 888592 - RNA, 22 nt, Human
ugugaaaagcguguguucuagg

SEQ ID NO: 888593 - RNA, 22 nt, Human
gagggagcuggagcagacgccg

SEQ ID NO: 888594 - RNA, 22 nt, Human
ugggaggcccaggccuggcagg

SEQ ID NO: 888595 - RNA, 22 nt, Human
uauuucugaggcccaggaagug

SEQ ID NO: 888596 - RNA, 22 nt, Human
aaugauguuuuuaaagaacaua

SEQ ID NO: 888597 - RNA, 22 nt, Human
gggcaggagagaacagucaugg

SEQ ID NO: 888598 - RNA, 22 nt, Human
ugggugaaaauuuugguggcac

SEQ ID NO: 888599 - RNA, 19 nt, Human
ucagggaaguucaaagcuc

SEQ ID NO: 888600 - RNA, 22 nt, Human
gaggccagaagucugagaucag

SEQ ID NO: 888601 - RNA, 22 nt, Human
cuugagaaucuucucugaagag

SEQ ID NO: 888602 - RNA, 22 nt, Human
ugugagaauuccugaucacagg

SEQ ID NO: 888603 - RNA, 19 nt, Human
cuguacagguugcuucugg

SEQ ID NO: 888604 - RNA, 22 nt, Human
ccugagcuggcagugaccugga

SEQ ID NO: 888605 - RNA, 22 nt, Human
caggcucccuaagucagcagcc

SEQ ID NO: 888606 - RNA, 22 nt, Human
agggaugguggagguugcaagu

SEQ ID NO: 888607 - RNA, 18 nt, Human
ggaagaaaaggaacucag

SEQ ID NO: 888608 - RNA, 22 nt, Human
gaguuuaaagcauacauauuuu

SEQ ID NO: 888609 - RNA, 19 nt, Human
caggccagugucagggggc

SEQ ID NO: 888610 - RNA, 22 nt, Human
gaggccagauacucucuucugc

SEQ ID NO: 888611 - RNA, 22 nt, Human
uuugauaacagugaauaucaug

SEQ ID NO: 888612 - RNA, 23 nt, Human
aagaacuuugguccugcagaguc

SEQ ID NO: 888613 - RNA, 22 nt, Human
cagaacagagucaaaaguaugu

SEQ ID NO: 888614 - RNA, 22 nt, Human
acacauggguggggagcuaagu

SEQ ID NO: 888615 - RNA, 22 nt, Human
agaggucauaucucagaagaga

SEQ ID NO: 888616 - RNA, 20 nt, Human
gccaugaggggaggugacug

SEQ ID NO: 888617 - RNA, 22 nt, Human
cuggccagagguuccucugccc

SEQ ID NO: 888618 - RNA, 22 nt, Human
acauaaaguacugagagacucu

SEQ ID NO: 888619 - RNA, 18 nt, Human
caguuuuuauaucuggca

SEQ ID NO: 888620 - RNA, 22 nt, Human
ccagagaguaaacauuuuccgg

SEQ ID NO: 888621 - RNA, 22 nt, Human
aaaggcaggcuuucacaucuca

SEQ ID NO: 888622 - RNA, 22 nt, Human
acauucauugccaggguggaag

SEQ ID NO: 888623 - RNA, 18 nt, Human
augggcagguaagaucca

SEQ ID NO: 888624 - RNA, 22 nt, Human
uaccugagcccagugcagcaua

SEQ ID NO: 888625 - RNA, 22 nt, Human
uguguaugucuguaugcacaca

SEQ ID NO: 888626 - RNA, 22 nt, Human
agcauccaggccagguugggca

SEQ ID NO: 888627 - RNA, 23 nt, Human
uuucacaaugagcauuacagaau

SEQ ID NO: 888628 - RNA, 22 nt, Human
ggagccaguauuuaguggucuu

SEQ ID NO: 888629 - RNA, 22 nt, Human
agcagcugggcucagagcuggg

SEQ ID NO: 888630 - RNA, 23 nt, Human
gggaagugaggagccccucugcc

SEQ ID NO: 888631 - RNA, 22 nt, Human
ccuucagccaguuuucuuuguu

SEQ ID NO: 888632 - RNA, 21 nt, Human
gccuggcuagaagcuccuagc

SEQ ID NO: 888633 - RNA, 22 nt, Human
uuuugccugcacuguauauaua

SEQ ID NO: 888634 - RNA, 19 nt, Human
gcucuaaaagauuuugaag

SEQ ID NO: 888635 - RNA, 22 nt, Human
uugagguauauucacauauauc

SEQ ID NO: 888636 - RNA, 22 nt, Human
caccuguuguuuauucaucucu

SEQ ID NO: 888637 - RNA, 22 nt, Human
ccucugugcuuuguccagccuc

SEQ ID NO: 888638 - RNA, 22 nt, Human
uuuguaaaaggaggaagcaugg

SEQ ID NO: 888639 - RNA, 22 nt, Human
uauuucaccuuacuaagcugug

SEQ ID NO: 888640 - RNA, 22 nt, Human
ggaggcacuucccgucucagcc

SEQ ID NO: 888641 - RNA, 22 nt, Human
uguguuucucugaggggucccu

SEQ ID NO: 888642 - RNA, 20 nt, Human
uuggcucugaucaguggagc

SEQ ID NO: 888643 - RNA, 22 nt, Human
ugagggucuggaaucugggcuu

SEQ ID NO: 888644 - RNA, 22 nt, Human
cggggugggaauagaccugucu

SEQ ID NO: 888645 - RNA, 22 nt, Human
gaggcugacggcaccaucuucu

SEQ ID NO: 888646 - RNA, 22 nt, Human
gagggugcaggaggaugguagu

SEQ ID NO: 888647 - RNA, 23 nt, Human
acagaguacagugugcuuagugg

SEQ ID NO: 888648 - RNA, 22 nt, Human
aaaugccucccauucuacugac

SEQ ID NO: 888649 - RNA, 22 nt, Human
uauguacauacaugugcauacg

SEQ ID NO: 888650 - RNA, 22 nt, Human
uuuucuaacaucuaguaauuug

SEQ ID NO: 888651 - RNA, 22 nt, Human
ucuuucuuccuggagcccaaca

SEQ ID NO: 888652 - RNA, 22 nt, Human
agaggugacauaggagaggcuc

SEQ ID NO: 888653 - RNA, 22 nt, Human
gauuuauuuuuaaucagcaggg

SEQ ID NO: 888654 - RNA, 22 nt, Human
agggcccucuggcaggccaggc

SEQ ID NO: 888655 - RNA, 22 nt, Human
ucugcuugugucuguccagccu

SEQ ID NO: 888656 - RNA, 21 nt, Human
aggaggaacccguggcugggc

SEQ ID NO: 888657 - RNA, 22 nt, Human
ugcuaaauaaguggaauagaca

SEQ ID NO: 888658 - RNA, 22 nt, Human
ucuuccuuuuguaccuucugaa

SEQ ID NO: 888659 - RNA, 22 nt, Human
gagaaaugcaugcaugucauca

SEQ ID NO: 888660 - RNA, 22 nt, Human
caucucuguguccccagagcuu

SEQ ID NO: 888661 - RNA, 22 nt, Human
gcucugggccauccuggccggg

SEQ ID NO: 888662 - RNA, 22 nt, Human
uuggaagaucuaacagaggcau

SEQ ID NO: 888663 - RNA, 22 nt, Human
accaggagguguuugcucaagu

SEQ ID NO: 888664 - RNA, 22 nt, Human
cagcccugggaguuggggccga

SEQ ID NO: 888665 - RNA, 22 nt, Human
ucaggcugaggucaucugcauc

SEQ ID NO: 888666 - RNA, 22 nt, Human
aguugcagacgcagagauguug

SEQ ID NO: 888667 - RNA, 22 nt, Human
uucugggggccaggacaguggu

SEQ ID NO: 888668 - RNA, 22 nt, Human
aauaauguaggaugauaaauga

SEQ ID NO: 888669 - RNA, 22 nt, Human
accugaggccuccccagcagac

SEQ ID NO: 888670 - RNA, 22 nt, Human
cacaguuugcauaggaaaaaca

SEQ ID NO: 888671 - RNA, 22 nt, Human
ccugcuggccaguggagggcug

SEQ ID NO: 888672 - RNA, 22 nt, Human
ccagcagcccacaggcgucccu

SEQ ID NO: 888673 - RNA, 22 nt, Human
cacacagggagaaagaaagccu

SEQ ID NO: 888674 - RNA, 18 nt, Human
agcagagagugaauggga

SEQ ID NO: 888675 - RNA, 22 nt, Human
cauagcaacagcaucaagucaa

SEQ ID NO: 888676 - RNA, 22 nt, Human
ggugagaggcagugcuguggaa

SEQ ID NO: 888677 - RNA, 22 nt, Human
uuggaaggcagcauuuguccau

SEQ ID NO: 888678 - RNA, 22 nt, Human
cuucuuccaagcuuaugcucaa

SEQ ID NO: 888679 - RNA, 19 nt, Human
ucugcagaaggcauacaug

SEQ ID NO: 888680 - RNA, 22 nt, Human
ccaagcuggauuuagcugcaca

SEQ ID NO: 888681 - RNA, 22 nt, Human
ggacagaaaccauaugagugua

SEQ ID NO: 888682 - RNA, 20 nt, Human
uacagacaugacaauaaugg

SEQ ID NO: 888683 - RNA, 22 nt, Human
caacauauauaaggauuuacua

SEQ ID NO: 888684 - RNA, 22 nt, Human
uauugaagauuuugugguugcu

SEQ ID NO: 888685 - RNA, 22 nt, Human
cuccccagcucgcgggugacgg

SEQ ID NO: 888686 - RNA, 22 nt, Human
uuuaaaaaacuagucugagucu

SEQ ID NO: 888687 - RNA, 22 nt, Human
uacagauaacugaaugcagacu

SEQ ID NO: 888688 - RNA, 22 nt, Human
agggcagccucucagccuaggu

SEQ ID NO: 888689 - RNA, 22 nt, Human
aauauuucugcagaaugguuuu

SEQ ID NO: 888690 - RNA, 22 nt, Human
aacagcugcuucaguacuugaa

SEQ ID NO: 888691 - RNA, 22 nt, Human
auagaacaagguagacagcuuu

SEQ ID NO: 888692 - RNA, 23 nt, Human
uaagugauuccaaguuucaggga

SEQ ID NO: 888693 - RNA, 22 nt, Human
uaguucuagccagugaaaugua

SEQ ID NO: 888694 - RNA, 22 nt, Human
gauauaucacagcuuacuguca

SEQ ID NO: 888695 - RNA, 22 nt, Human
ccuggcucuggugaggagaagu

SEQ ID NO: 888696 - RNA, 22 nt, Human
aggaaggcacauuguuggcuaa

SEQ ID NO: 888697 - RNA, 22 nt, Human
auauauuuacucuccuguugca

SEQ ID NO: 888698 - RNA, 22 nt, Human
cugaggccucguuggcuggaac

SEQ ID NO: 888699 - RNA, 22 nt, Human
uucuugcucaaugucuguuuaa

SEQ ID NO: 888700 - RNA, 22 nt, Human
gggcaggugcccagggccagag

SEQ ID NO: 888701 - RNA, 22 nt, Human
caguuucuuagugacacaaauc

SEQ ID NO: 888702 - RNA, 22 nt, Human
ucuccucugcgcggcagugccc

SEQ ID NO: 888703 - RNA, 22 nt, Human
caggagaagguuuggagugcag

SEQ ID NO: 888704 - RNA, 22 nt, Human
ugcagcagccaagguucugugc

SEQ ID NO: 888705 - RNA, 22 nt, Human
aacagcaagggcggggucaaga

SEQ ID NO: 888706 - RNA, 22 nt, Human
gcaggugaugugaugugagcau

SEQ ID NO: 888707 - RNA, 22 nt, Human
ucugacauuagauuaauuggaa

SEQ ID NO: 888708 - RNA, 22 nt, Human
ugcugaaguccaagagcuccaa

SEQ ID NO: 888709 - RNA, 22 nt, Human
agagccccugggucacacagcc

SEQ ID NO: 888710 - RNA, 22 nt, Human
uuggcugaagguuaagugcugg

SEQ ID NO: 888711 - RNA, 22 nt, Human
uagcagcuguggaggggcugug

SEQ ID NO: 888712 - RNA, 21 nt, Human
uaagcuaaacauucaguuaac

SEQ ID NO: 888713 - RNA, 22 nt, Human
cuauuauuuccucaucuauaaa

SEQ ID NO: 888714 - RNA, 22 nt, Human
ugcugcagggccuucccugcau

SEQ ID NO: 888715 - RNA, 22 nt, Human
uggcugagguaacuaugaauaa

SEQ ID NO: 888716 - RNA, 21 nt, Human
uugcaacaaccuauauauuuu

SEQ ID NO: 888717 - RNA, 22 nt, Human
guggguggaucaccugagguca

SEQ ID NO: 888718 - RNA, 22 nt, Human
agcuggccuucggugucacugg

SEQ ID NO: 888719 - RNA, 22 nt, Human
ucugugugaccauaagccagcu

SEQ ID NO: 888720 - RNA, 22 nt, Human
agccauuuuccugaaauauaac

SEQ ID NO: 888721 - RNA, 22 nt, Human
uggcauuucuguuagacucuca

SEQ ID NO: 888722 - RNA, 22 nt, Human
acagacuggagcccuuuugccc

SEQ ID NO: 888723 - RNA, 22 nt, Human
gaggccagcuacccaaggguca

SEQ ID NO: 888724 - RNA, 18 nt, Human
guuucaugcaugugaaac

SEQ ID NO: 888725 - RNA, 22 nt, Human
aaucacaucucauucaacagcc

SEQ ID NO: 888726 - RNA, 22 nt, Human
ugcuucagugugucauuauuua

SEQ ID NO: 888727 - RNA, 22 nt, Human
gcagagcaggaaggaagucagg

SEQ ID NO: 888728 - RNA, 22 nt, Human
agagccccucgguggagggguc

SEQ ID NO: 888729 - RNA, 22 nt, Human
gcagggcuauuggaaggagaug

SEQ ID NO: 888730 - RNA, 22 nt, Human
cagucucugucaucucauggga

SEQ ID NO: 888731 - RNA, 22 nt, Human
acauuucuaauuuaauguaaca

SEQ ID NO: 888732 - RNA, 22 nt, Human
ucuucuccagugcuucugcaca

SEQ ID NO: 888733 - RNA, 22 nt, Human
ugcaaggcuauucacauguauu

SEQ ID NO: 888734 - RNA, 22 nt, Human
cacugcccuggggguugccauc

SEQ ID NO: 888735 - RNA, 22 nt, Human
ugggcacuguagcuggugcugg

SEQ ID NO: 888736 - RNA, 22 nt, Human
auguguauuuuguacuauuggg

SEQ ID NO: 888737 - RNA, 22 nt, Human
uuuggaauucagauggcuuagg

SEQ ID NO: 888738 - RNA, 22 nt, Human
uauuuggacaccaaguagaagu

SEQ ID NO: 888739 - RNA, 22 nt, Human
ggccagcuccuuggcagugccu

SEQ ID NO: 888740 - RNA, 22 nt, Human
aagcaacuaaggcaaggaaaug

SEQ ID NO: 888741 - RNA, 22 nt, Human
aaacuacaucucauggaugagg

SEQ ID NO: 888742 - RNA, 22 nt, Human
ucucuguaucccagaaccaaaa

SEQ ID NO: 888743 - RNA, 22 nt, Human
aggcaugugcuguuugucucca

SEQ ID NO: 888744 - RNA, 22 nt, Human
gagauuguuuagcuaccauggc

SEQ ID NO: 888745 - RNA, 22 nt, Human
gcugccacauuuucaggacuaa

SEQ ID NO: 888746 - RNA, 22 nt, Human
ggguccagagccucagcccaga

SEQ ID NO: 888747 - RNA, 22 nt, Human
gccugcagaacugugaggcaau

SEQ ID NO: 888748 - RNA, 22 nt, Human
uugggcaguagccucuuggugu

SEQ ID NO: 888749 - RNA, 22 nt, Human
gucaggagagaucaggacagca

SEQ ID NO: 888750 - RNA, 21 nt, Human
ucucuguauccauggguucca

SEQ ID NO: 888751 - RNA, 22 nt, Human
uacagcaaagaaacccucaguc

SEQ ID NO: 888752 - RNA, 22 nt, Human
ucagggccuuugcaguuguuuu

SEQ ID NO: 888753 - RNA, 17 nt, Human
auggcuuccauugacca

SEQ ID NO: 888754 - RNA, 22 nt, Human
cugagaaacauauuuccaucua

SEQ ID NO: 888755 - RNA, 22 nt, Human
uucugggcaccaccacagacuu

SEQ ID NO: 888756 - RNA, 22 nt, Human
guuauauugccaaguauauugu

SEQ ID NO: 888757 - RNA, 23 nt, Human
cagggcccugcucaauuucucca

SEQ ID NO: 888758 - RNA, 22 nt, Human
ggaauguucuggaacaccgcuu

SEQ ID NO: 888759 - RNA, 22 nt, Human
agcagcuggugcaacucuaaga

SEQ ID NO: 888760 - RNA, 22 nt, Human
caccagcuuugcccacugccca

SEQ ID NO: 888761 - RNA, 22 nt, Human
caacauuauauagccacaugcc

SEQ ID NO: 888762 - RNA, 21 nt, Human
uuccucugcaacugaugcuca

SEQ ID NO: 888763 - RNA, 22 nt, Human
cagggagucaacaaacagauca

SEQ ID NO: 888764 - RNA, 22 nt, Human
uagugauuccaaugugaagugg

SEQ ID NO: 888765 - RNA, 22 nt, Human
caguuuaugcagcuggaauaga

SEQ ID NO: 888766 - RNA, 22 nt, Human
ugccuuuuagugcucaauaaag

SEQ ID NO: 888767 - RNA, 22 nt, Human
aauuaugagguagauaucacau

SEQ ID NO: 888768 - RNA, 22 nt, Human
ucuucaugaccucuguguuuua

SEQ ID NO: 888769 - RNA, 22 nt, Human
aaaaguucauuagugagcuucu

SEQ ID NO: 888770 - RNA, 22 nt, Human
uugcugaucugugaaucagcca

SEQ ID NO: 888771 - RNA, 22 nt, Human
uaauuuuuccacguacacuggg

SEQ ID NO: 888772 - RNA, 22 nt, Human
uaacaugaaacuccaaauggua

SEQ ID NO: 888773 - RNA, 22 nt, Human
gggcuggaccgcgaccccugag

SEQ ID NO: 888774 - RNA, 21 nt, Human
ggaagcuguguccaugcuccu

SEQ ID NO: 888775 - RNA, 22 nt, Human
ugcauccuagggaaggcacuga

SEQ ID NO: 888776 - RNA, 22 nt, Human
aagcagcagcaggauuaaagag

SEQ ID NO: 888777 - RNA, 21 nt, Human
ugggagagggcucagcuaccc

SEQ ID NO: 888778 - RNA, 22 nt, Human
ggucugugaucuuauggauucu

SEQ ID NO: 888779 - RNA, 22 nt, Human
ccuggguggcugccugccuuuc

SEQ ID NO: 888780 - RNA, 22 nt, Human
gaaaccuauuuauaacuucuag

SEQ ID NO: 888781 - RNA, 22 nt, Human
acaacauuuaaggaggcacuga

SEQ ID NO: 888782 - RNA, 22 nt, Human
cuccagaggcccuaucccacua

SEQ ID NO: 888783 - RNA, 22 nt, Human
uggcccagcucagggugggcgg

SEQ ID NO: 888784 - RNA, 22 nt, Human
ccucacuggccagccaggggug

SEQ ID NO: 888785 - RNA, 22 nt, Human
aaagacauggaacuagagaugg

SEQ ID NO: 888786 - RNA, 22 nt, Human
aggagguggccugagcgugccc

SEQ ID NO: 888787 - RNA, 17 nt, Human
aggaagggcaaguuucu

SEQ ID NO: 888788 - RNA, 22 nt, Human
uaucuaauaaaucugauaagua

SEQ ID NO: 888789 - RNA, 18 nt, Human
auccauuuaaugccugga

SEQ ID NO: 888790 - RNA, 22 nt, Human
cagaugaggcaaccucauugcu

SEQ ID NO: 888791 - RNA, 22 nt, Human
uucuaaauuuuggaagaugcag

SEQ ID NO: 888792 - RNA, 22 nt, Human
aaggaagaagacucuuuacucc

SEQ ID NO: 888793 - RNA, 22 nt, Human
uuuauauaacagagacugcuau

SEQ ID NO: 888794 - RNA, 22 nt, Human
agugcccaccucucuucagcua

SEQ ID NO: 888795 - RNA, 22 nt, Human
ugcaggcuccaggugcacauau

SEQ ID NO: 888796 - RNA, 22 nt, Human
ccagcucuuggugcacuuacau

SEQ ID NO: 888797 - RNA, 22 nt, Human
ucaugcugugaacuguauacau

SEQ ID NO: 888798 - RNA, 22 nt, Human
aaaauagaugaaaggaagucug

SEQ ID NO: 888799 - RNA, 22 nt, Human
ugcaggugucuccagggcaggu

SEQ ID NO: 888800 - RNA, 17 nt, Human
agacuguacuguaaagc

SEQ ID NO: 888801 - RNA, 22 nt, Human
uauuucuaagcuguaagucuga

SEQ ID NO: 888802 - RNA, 22 nt, Human
cucuccagccacagaagcugcu

SEQ ID NO: 888803 - RNA, 22 nt, Human
ugcuuguucauggccuaguggc

SEQ ID NO: 888804 - RNA, 21 nt, Human
uuguguuuccccagucacuuu

SEQ ID NO: 888805 - RNA, 22 nt, Human
ccagccccgggaaccuggccgu

SEQ ID NO: 888806 - RNA, 18 nt, Human
gaugggagcaagagaaga

SEQ ID NO: 888807 - RNA, 22 nt, Human
gagcugugaaaagugccugggg

SEQ ID NO: 888808 - RNA, 20 nt, Human
agaaaucagcauguccucug

SEQ ID NO: 888809 - RNA, 22 nt, Human
aguccaaggagagacagcauuu

SEQ ID NO: 888810 - RNA, 22 nt, Human
ugacccugcuucuuggugcagg

SEQ ID NO: 888811 - RNA, 22 nt, Human
aaugaaguucuauucauuuucu

SEQ ID NO: 888812 - RNA, 22 nt, Human
agauucucgguccgggcagccc

SEQ ID NO: 888813 - RNA, 22 nt, Human
gcuuuugugagauuaagcuacu

SEQ ID NO: 888814 - RNA, 22 nt, Human
uggaagaagcuacaagcgguga

SEQ ID NO: 888815 - RNA, 22 nt, Human
aggccaaagcaagacccuguaa

SEQ ID NO: 888816 - RNA, 22 nt, Human
uguccuuuguucccugucucug

SEQ ID NO: 888817 - RNA, 22 nt, Human
auacaaugaaguauagaugaaa

SEQ ID NO: 888818 - RNA, 22 nt, Human
caaagcaaggcucaguuugaac

SEQ ID NO: 888819 - RNA, 22 nt, Human
uugaagcauuugcuauagcauu

SEQ ID NO: 888820 - RNA, 22 nt, Human
accacaguuucauucaugcagg

SEQ ID NO: 888821 - RNA, 22 nt, Human
ggaggccaauuuucuaacugca

SEQ ID NO: 888822 - RNA, 22 nt, Human
uucagagcucagaaaagugucu

SEQ ID NO: 888823 - RNA, 22 nt, Human
cuuccuuccuuccccgaaaugc

SEQ ID NO: 888824 - RNA, 22 nt, Human
augccagggucauccccugggu

SEQ ID NO: 888825 - RNA, 22 nt, Human
ucucuuccuugaccuauuguaa

SEQ ID NO: 888826 - RNA, 22 nt, Human
aagagcugauuaagucaugagg

SEQ ID NO: 888827 - RNA, 22 nt, Human
cagggcucugccuugagggaug

SEQ ID NO: 888828 - RNA, 22 nt, Human
ugagcaggagauaaacagguag

SEQ ID NO: 888829 - RNA, 22 nt, Human
ggccagcuucuggacaaagucc

SEQ ID NO: 888830 - RNA, 22 nt, Human
acagagccacuuuggugccuac

SEQ ID NO: 888831 - RNA, 21 nt, Human
gcagggaccgcgacuucuggg

SEQ ID NO: 888832 - RNA, 17 nt, Human
auuuguaacuagcucuu

SEQ ID NO: 888833 - RNA, 22 nt, Human
cagaauuuaaguggauuauucu

SEQ ID NO: 888834 - RNA, 22 nt, Human
gaauauguguuccuggacaaga

SEQ ID NO: 888835 - RNA, 22 nt, Human
ugaagcagagugaaggugaauu

SEQ ID NO: 888836 - RNA, 22 nt, Human
cagcagcaaaucuagaagagga

SEQ ID NO: 888837 - RNA, 22 nt, Human
uacugucuuuccauccuugccu

SEQ ID NO: 888838 - RNA, 22 nt, Human
gacaggaaaggggucuguuuuc

SEQ ID NO: 888839 - RNA, 22 nt, Human
cugcaaggcuggggugagcugg

SEQ ID NO: 888840 - RNA, 22 nt, Human
augguugaacuuaaagggaaug

SEQ ID NO: 888841 - RNA, 22 nt, Human
guuuccuuuuggaauuagagcu

SEQ ID NO: 888842 - RNA, 22 nt, Human
agggaagcugcuggguccaccu

SEQ ID NO: 888843 - RNA, 22 nt, Human
uccuucagccaugggcucucca

SEQ ID NO: 888844 - RNA, 22 nt, Human
gccagccccuuagggcucuccc

SEQ ID NO: 888845 - RNA, 22 nt, Human
aaacauucucagcccugcuugc

SEQ ID NO: 888846 - RNA, 22 nt, Human
uggccaagccacugcugggucu

SEQ ID NO: 888847 - RNA, 22 nt, Human
ccagggugaggaggcucccacg

SEQ ID NO: 888848 - RNA, 22 nt, Human
ucucaucugccauuugcaggag

SEQ ID NO: 888849 - RNA, 22 nt, Human
aacagauaauuucuaaguuacu

SEQ ID NO: 888850 - RNA, 22 nt, Human
uugcugugaaaccaugggaagu

SEQ ID NO: 888851 - RNA, 22 nt, Human
ccacagcaccugcagccaguug

SEQ ID NO: 888852 - RNA, 23 nt, Human
cucagcagccugcugcagauaag

SEQ ID NO: 888853 - RNA, 22 nt, Human
ggcugguggggaaagaggacca

SEQ ID NO: 888854 - RNA, 22 nt, Human
aagccagauuccuuaagcacag

SEQ ID NO: 888855 - RNA, 22 nt, Human
uuugcagggcugguaggaccac

SEQ ID NO: 888856 - RNA, 20 nt, Human
gccagaguuaugaugagagg

SEQ ID NO: 888857 - RNA, 22 nt, Human
ucaacacuggcuacaguuaugc

SEQ ID NO: 888858 - RNA, 19 nt, Human
ugcauguguucucccauug

SEQ ID NO: 888859 - RNA, 22 nt, Human
aagcauuugguucugaagacuc

SEQ ID NO: 888860 - RNA, 20 nt, Human
uaaacaguauuuacuaggag

SEQ ID NO: 888861 - RNA, 22 nt, Human
acagugugugggaaaugugacu

SEQ ID NO: 888862 - RNA, 22 nt, Human
gggcuggcgggaaaggcaauuc

SEQ ID NO: 888863 - RNA, 22 nt, Human
gucugggguccuuuuggcuuua

SEQ ID NO: 888864 - RNA, 22 nt, Human
uccuggguccauggcagccgaa

SEQ ID NO: 888865 - RNA, 22 nt, Human
agcugcuguggggcucggccug

SEQ ID NO: 888866 - RNA, 20 nt, Human
uguguagcaggugcugugcc

SEQ ID NO: 888867 - RNA, 22 nt, Human
gcaggguccauggaggcagccc

SEQ ID NO: 888868 - RNA, 22 nt, Human
cagugucaccaggcgagucucc

SEQ ID NO: 888869 - RNA, 22 nt, Human
acuauacauugaauguuaaggu

SEQ ID NO: 888870 - RNA, 22 nt, Human
auauagaauacacagggaaagu

SEQ ID NO: 888871 - RNA, 22 nt, Human
caucauuuguucacuugauucc

SEQ ID NO: 888872 - RNA, 22 nt, Human
uuucaagggaauaugaaauuca

SEQ ID NO: 888873 - RNA, 22 nt, Human
gcacacugcggugaugugaguc

SEQ ID NO: 888874 - RNA, 22 nt, Human
aagaaauggcuucaucugagua

SEQ ID NO: 888875 - RNA, 22 nt, Human
cugagcugucaggaauggaaag

SEQ ID NO: 888876 - RNA, 22 nt, Human
acucauguccuaggaguaaagc

SEQ ID NO: 888877 - RNA, 22 nt, Human
cugugcuucagagucagugcug

SEQ ID NO: 888878 - RNA, 22 nt, Human
aaguucguaggugagcugcugc

SEQ ID NO: 888879 - RNA, 22 nt, Human
cugccucuugacagaucguggc

SEQ ID NO: 888880 - RNA, 22 nt, Human
uaacaacuugcuuuuaucuuag

SEQ ID NO: 888881 - RNA, 22 nt, Human
gucagcaccucuuuggggagcu

SEQ ID NO: 888882 - RNA, 22 nt, Human
gcuuagaaguuccuauaaaaug

SEQ ID NO: 888883 - RNA, 22 nt, Human
ugcuauauaauggaauuucuaa

SEQ ID NO: 888884 - RNA, 22 nt, Human
cucuucaguuggucacuauucu

SEQ ID NO: 888885 - RNA, 22 nt, Human
ugcagagggacagccacagcuc

SEQ ID NO: 888886 - RNA, 22 nt, Human
gaaggcuaaaggggcagagguu

SEQ ID NO: 888887 - RNA, 22 nt, Human
agugaaaugauucugagcaaga

SEQ ID NO: 888888 - RNA, 22 nt, Human
agcaauguaaacccugaaguug

SEQ ID NO: 888889 - RNA, 22 nt, Human
ccuggaaaugcaaaagccauga

SEQ ID NO: 888890 - RNA, 22 nt, Human
ucaagcaaguguuugguguaaa

SEQ ID NO: 888891 - RNA, 22 nt, Human
uuugacagugaugauauauaca

SEQ ID NO: 888892 - RNA, 22 nt, Human
cacauucacuucucuguccacc

SEQ ID NO: 888893 - RNA, 22 nt, Human
ccagggugcucuguggcgucgc

SEQ ID NO: 888894 - RNA, 22 nt, Human
uucccagaauuguugggaacug

SEQ ID NO: 888895 - RNA, 22 nt, Human
ucucugucuuuguugucuucac

SEQ ID NO: 888896 - RNA, 22 nt, Human
guuucauuuacaucuguaggua

SEQ ID NO: 888897 - RNA, 22 nt, Human
agauacagcuuuuuugucaguc

SEQ ID NO: 888898 - RNA, 22 nt, Human
agcuucucaucuuccaaaauug

SEQ ID NO: 888899 - RNA, 22 nt, Human
ccagagcccgggaccuggacuu

SEQ ID NO: 888900 - RNA, 22 nt, Human
ugcauguguguauucagagacu

SEQ ID NO: 888901 - RNA, 22 nt, Human
uuagaaucagaagagagguauu

SEQ ID NO: 888902 - RNA, 22 nt, Human
agcaggcuuucaagagucuucu

SEQ ID NO: 888903 - RNA, 22 nt, Human
cccucccaggaguggccagaga

SEQ ID NO: 888904 - RNA, 22 nt, Human
gacaggcuuagggagggugcuc

SEQ ID NO: 888905 - RNA, 22 nt, Human
ucuguggaaauuuccugaggca

SEQ ID NO: 888906 - RNA, 22 nt, Human
ucuuaacauauuauuuuagcac

SEQ ID NO: 888907 - RNA, 22 nt, Human
uaggagaagagucagggccuaa

SEQ ID NO: 888908 - RNA, 20 nt, Human
ugcugaggccugaggccugg

SEQ ID NO: 888909 - RNA, 22 nt, Human
uauacagaacauuaagaacugu

SEQ ID NO: 888910 - RNA, 22 nt, Human
uggagagguugaauaacuuguc

SEQ ID NO: 888911 - RNA, 22 nt, Human
aagacagcauugcugagggcuu

SEQ ID NO: 888912 - RNA, 22 nt, Human
cugagccaguagucagggacaa

SEQ ID NO: 888913 - RNA, 22 nt, Human
uguuaugaguccucauauacua

SEQ ID NO: 888914 - RNA, 22 nt, Human
aaugcauuaaaguuagagacuu

SEQ ID NO: 888915 - RNA, 22 nt, Human
gcccugcuccuccgucccacga

SEQ ID NO: 888916 - RNA, 22 nt, Human
aaauguucugaaagacccgcuc

SEQ ID NO: 888917 - RNA, 22 nt, Human
uggcucuggugcgggcuccugc

SEQ ID NO: 888918 - RNA, 22 nt, Human
uucacagaugccugaugugugg

SEQ ID NO: 888919 - RNA, 22 nt, Human
uuccaacucugaaaugugaaau

SEQ ID NO: 888920 - RNA, 22 nt, Human
aucugcauuuacauugcuugua

SEQ ID NO: 888921 - RNA, 22 nt, Human
ugacugaggccugauaacaguu

SEQ ID NO: 888922 - RNA, 22 nt, Human
gugcugugugauccaugcuggc

SEQ ID NO: 888923 - RNA, 22 nt, Human
ugagggacugcauacccagcuu

SEQ ID NO: 888924 - RNA, 22 nt, Human
cuuuacauaaggauaaaccugg

SEQ ID NO: 888925 - RNA, 22 nt, Human
aagagcuggaguuugcagcccu

SEQ ID NO: 888926 - RNA, 22 nt, Human
guggcccaggcacccugaugac

SEQ ID NO: 888927 - RNA, 21 nt, Human
ucauuucagggccuuggcuuc

SEQ ID NO: 888928 - RNA, 22 nt, Human
cugccugcuucugagccagagg

SEQ ID NO: 888929 - RNA, 22 nt, Human
agcagcaucuucuguucuccgc

SEQ ID NO: 888930 - RNA, 22 nt, Human
auucuucaucagagaugcacua

SEQ ID NO: 888931 - RNA, 22 nt, Human
uguucuaaguguuuuguucaug

SEQ ID NO: 888932 - RNA, 22 nt, Human
ugaaauguaagcauagagguug

SEQ ID NO: 888933 - RNA, 22 nt, Human
cugggccuugcaucccagagcc

SEQ ID NO: 888934 - RNA, 22 nt, Human
uacuuacagagcuuauaaguua

SEQ ID NO: 888935 - RNA, 22 nt, Human
gcacaugaggcugucuuugucu

SEQ ID NO: 888936 - RNA, 20 nt, Human
uguugaauucauggugacuu

SEQ ID NO: 888937 - RNA, 22 nt, Human
uagagaaauaagcuuugccuug

SEQ ID NO: 888938 - RNA, 22 nt, Human
acuagaaagcacuaagcuaggc

SEQ ID NO: 888939 - RNA, 22 nt, Human
gagggucagaagggccugguuc

SEQ ID NO: 888940 - RNA, 22 nt, Human
uuccuuuucuuaugcaucauua

SEQ ID NO: 888941 - RNA, 22 nt, Human
auauuauuuucccuggaguugu

SEQ ID NO: 888942 - RNA, 20 nt, Human
ucaggcaguggggaaaggca

SEQ ID NO: 888943 - RNA, 22 nt, Human
caguuugucuugauucagaaca

SEQ ID NO: 888944 - RNA, 22 nt, Human
ugcugagagccagggcuggcau

SEQ ID NO: 888945 - RNA, 22 nt, Human
cuuugaauuccaguacaauaac

SEQ ID NO: 888946 - RNA, 22 nt, Human
agaaugcaucuaaaagcagaga

SEQ ID NO: 888947 - RNA, 22 nt, Human
aaauuauucucauguguuucuu

SEQ ID NO: 888948 - RNA, 22 nt, Human
augacaauacuucaauaagcug

SEQ ID NO: 888949 - RNA, 22 nt, Human
acuccacaccacgggggccgcc

SEQ ID NO: 888950 - RNA, 22 nt, Human
auuucucagggcugaggaggag

SEQ ID NO: 888951 - RNA, 22 nt, Human
ugagaagauugggcagagugga

SEQ ID NO: 888952 - RNA, 22 nt, Human
cagguccagucacuggucugca

SEQ ID NO: 888953 - RNA, 22 nt, Human
auucaagguauuuaaaacauaa

SEQ ID NO: 888954 - RNA, 22 nt, Human
uucuuucuuggggaacacacuc

SEQ ID NO: 888955 - RNA, 22 nt, Human
uagaggagaacacaaauuauag

SEQ ID NO: 888956 - RNA, 22 nt, Human
uuuagugagugugaaucaaaug

SEQ ID NO: 888957 - RNA, 22 nt, Human
cugcaaggucaugacucucugg

SEQ ID NO: 888958 - RNA, 21 nt, Human
acuggccaccacuggcagggg

SEQ ID NO: 888959 - RNA, 19 nt, Human
aagcugagggcuguccacc

SEQ ID NO: 888960 - RNA, 22 nt, Human
cuuaagauugucagcuucagcc

SEQ ID NO: 888961 - RNA, 22 nt, Human
guguacauagaauugugcuuug

SEQ ID NO: 888962 - RNA, 22 nt, Human
aagaacaugaagucacaaaugc

SEQ ID NO: 888963 - RNA, 22 nt, Human
ucucuacacaggauucacauga

SEQ ID NO: 888964 - RNA, 22 nt, Human
gcccugugagauuagaacagca

SEQ ID NO: 888965 - RNA, 22 nt, Human
ugcagcaggagccaggccuggu

SEQ ID NO: 888966 - RNA, 21 nt, Human
ccagcuguuccucguccgaug

SEQ ID NO: 888967 - RNA, 22 nt, Human
ggccaggccaagaggguuggaa

SEQ ID NO: 888968 - RNA, 22 nt, Human
uagaguccuucauucugugcag

SEQ ID NO: 888969 - RNA, 22 nt, Human
ucaagcaacagaacugugagac

SEQ ID NO: 888970 - RNA, 22 nt, Human
uacacuuauaacucugugugug

SEQ ID NO: 888971 - RNA, 22 nt, Human
uaagacacauuggaguagauga

SEQ ID NO: 888972 - RNA, 22 nt, Human
caauucaacuugccuuuguagc

SEQ ID NO: 888973 - RNA, 22 nt, Human
agcuagagaaugacagagucug

SEQ ID NO: 888974 - RNA, 20 nt, Human
acuuucucgguuucucaccu

SEQ ID NO: 888975 - RNA, 22 nt, Human
uauuuccuguggauacuuuuag

SEQ ID NO: 888976 - RNA, 20 nt, Human
agacacccccugacagggaa

SEQ ID NO: 888977 - RNA, 22 nt, Human
ugggggcugaguaagaugagau

SEQ ID NO: 888978 - RNA, 22 nt, Human
ucugugccaccucuccaguguc

SEQ ID NO: 888979 - RNA, 22 nt, Human
ggcucagauuccgaguggcccu

SEQ ID NO: 888980 - RNA, 22 nt, Human
aauuuugugugggaucaaagga

SEQ ID NO: 888981 - RNA, 22 nt, Human
uguuucaaagguuauacaguca

SEQ ID NO: 888982 - RNA, 22 nt, Human
ggccuguggcuuuggcgucuaa

SEQ ID NO: 888983 - RNA, 22 nt, Human
auuacacagcgguuacuacuag

SEQ ID NO: 888984 - RNA, 22 nt, Human
uccagggagauacuggcugcca

SEQ ID NO: 888985 - RNA, 22 nt, Human
ucagagccaaucauggugcauu

SEQ ID NO: 888986 - RNA, 22 nt, Human
ucagcaggcccauccuccaggc

SEQ ID NO: 888987 - RNA, 22 nt, Human
uugcuucauuuuaaauaaagac

SEQ ID NO: 888988 - RNA, 22 nt, Human
uaugaaauugccauuuuuaugg

SEQ ID NO: 888989 - RNA, 22 nt, Human
uuggcagaauuaaccacugaag

SEQ ID NO: 888990 - RNA, 22 nt, Human
uacaagagugagauuaucaugu

SEQ ID NO: 888991 - RNA, 22 nt, Human
ugugucugaacuaguugcucuc

SEQ ID NO: 888992 - RNA, 22 nt, Human
uugcauaugaagcugacuuaaa

SEQ ID NO: 888993 - RNA, 22 nt, Human
acuguccucgaaguaccugugc

SEQ ID NO: 888994 - RNA, 22 nt, Human
gguuuccaagugguugaaaagu

SEQ ID NO: 888995 - RNA, 19 nt, Human
acauauguggauauacaug

SEQ ID NO: 888996 - RNA, 22 nt, Human
ccaggcuuuaagagguggaaac

SEQ ID NO: 888997 - RNA, 22 nt, Human
uggccaguugaagacaaugcuc

SEQ ID NO: 888998 - RNA, 22 nt, Human
uacacagaggcagcugucugcu

SEQ ID NO: 888999 - RNA, 22 nt, Human
gagagugagauccuccugggga

SEQ ID NO: 889000 - RNA, 18 nt, Human
cggcagagugcuucuagc

SEQ ID NO: 889001 - RNA, 19 nt, Human
ugugucagcagggggcuuc

SEQ ID NO: 889002 - RNA, 22 nt, Human
ccccaggccuguuggauggcgc

SEQ ID NO: 889003 - RNA, 22 nt, Human
aauccauuuaccuuugcuugaa

SEQ ID NO: 889004 - RNA, 19 nt, Human
uuacagauguggaaauuga

SEQ ID NO: 889005 - RNA, 22 nt, Human
uggcucagaacuacuucuaguu

SEQ ID NO: 889006 - RNA, 22 nt, Human
ugggcucugcugcguaccaguu

SEQ ID NO: 889007 - RNA, 22 nt, Human
ugcucugguccucccucggcgc

SEQ ID NO: 889008 - RNA, 22 nt, Human
gccuucaguaguauccucauga

SEQ ID NO: 889009 - RNA, 20 nt, Human
caggcuccgcaggacuaggg

SEQ ID NO: 889010 - RNA, 22 nt, Human
cugaguucugcccaaggucugg

SEQ ID NO: 889011 - RNA, 22 nt, Human
aggcagagaaaaaccagauaug

SEQ ID NO: 889012 - RNA, 22 nt, Human
ucugacccguggcucugccucc

SEQ ID NO: 889013 - RNA, 22 nt, Human
uuuuauguuccugaagcuaucu

SEQ ID NO: 889014 - RNA, 22 nt, Human
cgcuggggcuuuuugcuugaga

SEQ ID NO: 889015 - RNA, 18 nt, Human
ugacucacccugucagug

SEQ ID NO: 889016 - RNA, 22 nt, Human
uaguucaaagucugucaaagga

SEQ ID NO: 889017 - RNA, 22 nt, Human
gugcugaauuggagaugcuccu

SEQ ID NO: 889018 - RNA, 22 nt, Human
cucuuguauuggaguuaguggg

SEQ ID NO: 889019 - RNA, 22 nt, Human
agcugcagcuacaguguugguu

SEQ ID NO: 889020 - RNA, 22 nt, Human
ucuagaauuugcguagguuaga

SEQ ID NO: 889021 - RNA, 22 nt, Human
cuuggagcaacacaugacaucu

SEQ ID NO: 889022 - RNA, 22 nt, Human
aagagaacagucaccaugcaca

SEQ ID NO: 889023 - RNA, 22 nt, Human
uagaacuugagaucaggucuuc

SEQ ID NO: 889024 - RNA, 22 nt, Human
gcugucugucucugugacuuaa

SEQ ID NO: 889025 - RNA, 22 nt, Human
ugcuccuggcuucagguugggc

SEQ ID NO: 889026 - RNA, 22 nt, Human
agucuguguacuggguuucugu

SEQ ID NO: 889027 - RNA, 22 nt, Human
ugguuucccauuaucugcagga

SEQ ID NO: 889028 - RNA, 22 nt, Human
gacuuugugccaaacgccagaa

SEQ ID NO: 889029 - RNA, 22 nt, Human
ugaagcuuuaggauggguucau

SEQ ID NO: 889030 - RNA, 22 nt, Human
auguguaugagugugcuucuuu

SEQ ID NO: 889031 - RNA, 22 nt, Human
uuaaggaaggagucuuaaaugg

SEQ ID NO: 889032 - RNA, 22 nt, Human
gaaaacauccagagauagaccu

SEQ ID NO: 889033 - RNA, 22 nt, Human
guuuccuggaaacugcuccacu

SEQ ID NO: 889034 - RNA, 19 nt, Human
agucacagaccuugucucc

SEQ ID NO: 889035 - RNA, 22 nt, Human
uugcacagaaugacaauaugua

SEQ ID NO: 889036 - RNA, 22 nt, Human
aacuuucuuugcaucuaaguuu

SEQ ID NO: 889037 - RNA, 22 nt, Human
caggccugugaguugaggcccc

SEQ ID NO: 889038 - RNA, 22 nt, Human
uggggacccggacuccuggguc

SEQ ID NO: 889039 - RNA, 22 nt, Human
cucaggaggugguagaggcccu

SEQ ID NO: 889040 - RNA, 17 nt, Human
agccagcaguagcuggu

SEQ ID NO: 889041 - RNA, 23 nt, Human
cccagaggagcagggcgugagau

SEQ ID NO: 889042 - RNA, 22 nt, Human
uucugccaaaggcuuuguuuug

SEQ ID NO: 889043 - RNA, 22 nt, Human
ucagauacuagcucucagccuc

SEQ ID NO: 889044 - RNA, 22 nt, Human
cuccucucaggcuggauggcgc

SEQ ID NO: 889045 - RNA, 22 nt, Human
uggcuucuuacuagggcucagu

SEQ ID NO: 889046 - RNA, 22 nt, Human
uguauaguugagucaaguuuca

SEQ ID NO: 889047 - RNA, 22 nt, Human
cuuucaugcacuucuuuagauc

SEQ ID NO: 889048 - RNA, 22 nt, Human
cuguguggccucaagccagccu

SEQ ID NO: 889049 - RNA, 22 nt, Human
aagagcugugggugguaguccu

SEQ ID NO: 889050 - RNA, 18 nt, Human
uggcagugccaccuucuc

SEQ ID NO: 889051 - RNA, 22 nt, Human
cauuuacauaacaguaacgcug

SEQ ID NO: 889052 - RNA, 22 nt, Human
auaaaaguuuccaaucaugccu

SEQ ID NO: 889053 - RNA, 22 nt, Human
agcuguccuggcucaggcugug

SEQ ID NO: 889054 - RNA, 22 nt, Human
ucugccuggauuccauucucca

SEQ ID NO: 889055 - RNA, 22 nt, Human
uuuaugcacacuuagacauggc

SEQ ID NO: 889056 - RNA, 22 nt, Human
agggcagcacaaggcauggacu

SEQ ID NO: 889057 - RNA, 19 nt, Human
ugcccugcacgcuguccug

SEQ ID NO: 889058 - RNA, 22 nt, Human
gucagcugggcaucugcagaug

SEQ ID NO: 889059 - RNA, 22 nt, Human
uacaguauagaauguguauuaa

SEQ ID NO: 889060 - RNA, 22 nt, Human
ggcugggcauccauccaugaga

SEQ ID NO: 889061 - RNA, 22 nt, Human
gcccaggaguugaaugcagcag

SEQ ID NO: 889062 - RNA, 22 nt, Human
cgaggcggcggaagugcccgua

SEQ ID NO: 889063 - RNA, 22 nt, Human
caucuucugggacuucucaguu

SEQ ID NO: 889064 - RNA, 22 nt, Human
acagccagaggugguccugggu

SEQ ID NO: 889065 - RNA, 22 nt, Human
uggcaguguauagguggcuccu

SEQ ID NO: 889066 - RNA, 22 nt, Human
gcagcuguggguuccaagucua

SEQ ID NO: 889067 - RNA, 22 nt, Human
uagggcugccuauggcuagaua

SEQ ID NO: 889068 - RNA, 22 nt, Human
ugcuuugcuuuggagagccagc

SEQ ID NO: 889069 - RNA, 22 nt, Human
gaccugaaagagauuaaaugac

SEQ ID NO: 889070 - RNA, 22 nt, Human
aucaguuauuuuuaagcuauaa

SEQ ID NO: 889071 - RNA, 22 nt, Human
uacaugcucaguaacuuucagu

SEQ ID NO: 889072 - RNA, 22 nt, Human
cauguguaugcauucauacaua

SEQ ID NO: 889073 - RNA, 22 nt, Human
aucuguaauuuugaaugcaaau

SEQ ID NO: 889074 - RNA, 22 nt, Human
uagguauaauauuuugaagaaa

SEQ ID NO: 889075 - RNA, 22 nt, Human
aggucaaagaaccuagcuauag

SEQ ID NO: 889076 - RNA, 22 nt, Human
cuuauucuacuccacaagcucu

SEQ ID NO: 889077 - RNA, 22 nt, Human
uacuagaaccucacaacaaucc

SEQ ID NO: 889078 - RNA, 22 nt, Human
uagacacaggggaaugugaggu

SEQ ID NO: 889079 - RNA, 22 nt, Human
gcaaagcagucuucugugccua

SEQ ID NO: 889080 - RNA, 22 nt, Human
agcagagccaggucucucugua

SEQ ID NO: 889081 - RNA, 22 nt, Human
ucuauaaagggccagauaguag

SEQ ID NO: 889082 - RNA, 21 nt, Human
ccuuagucuuccacauagucc

SEQ ID NO: 889083 - RNA, 22 nt, Human
ucaucugucaaauugcaauaag

SEQ ID NO: 889084 - RNA, 22 nt, Human
gacaggaaauauggggguuguu

SEQ ID NO: 889085 - RNA, 22 nt, Human
uaauuuaugguauguguguaau

SEQ ID NO: 889086 - RNA, 22 nt, Human
gugcauuuauauuugccuuugg

SEQ ID NO: 889087 - RNA, 22 nt, Human
acagccuguguaccagcuggga

SEQ ID NO: 889088 - RNA, 22 nt, Human
uauguacaguccuuaacuuaaa

SEQ ID NO: 889089 - RNA, 22 nt, Human
gugacagagauuaauagcuugg

SEQ ID NO: 889090 - RNA, 22 nt, Human
uccccagccgugaaggagagga

SEQ ID NO: 889091 - RNA, 22 nt, Human
uaugucaacugugcugguuaau

SEQ ID NO: 889092 - RNA, 22 nt, Human
ccacaugaugaggaagcugaac

SEQ ID NO: 889093 - RNA, 22 nt, Human
ucauacauucagcagauauuug

SEQ ID NO: 889094 - RNA, 22 nt, Human
uggaagugcucuucugaccaac

SEQ ID NO: 889095 - RNA, 22 nt, Human
gggggaagacugggcuagugau

SEQ ID NO: 889096 - RNA, 22 nt, Human
augcuuuauacaaaacacuuaa

SEQ ID NO: 889097 - RNA, 22 nt, Human
ucugaaagaaagauuuuguuuc

SEQ ID NO: 889098 - RNA, 22 nt, Human
ggcuuuaguguagguuucuguu

SEQ ID NO: 889099 - RNA, 22 nt, Human
guuuggggucugcagagcggcg

SEQ ID NO: 889100 - RNA, 22 nt, Human
agccagcacggcgccauggagu

SEQ ID NO: 889101 - RNA, 22 nt, Human
cagagcccugugugccauguga

SEQ ID NO: 889102 - RNA, 22 nt, Human
aagcauaacuugcugcacauag

SEQ ID NO: 889103 - RNA, 22 nt, Human
aagaccauaauguaagaugaau

SEQ ID NO: 889104 - RNA, 22 nt, Human
cugggugaguugaugaaggaga

SEQ ID NO: 889105 - RNA, 22 nt, Human
gcagcugucacuuucacaaugc

SEQ ID NO: 889106 - RNA, 22 nt, Human
ucccagccggugccuggguccc

SEQ ID NO: 889107 - RNA, 22 nt, Human
cccaagggguguugauggagga

SEQ ID NO: 889108 - RNA, 22 nt, Human
ggagauggccaaaaacacaaau

SEQ ID NO: 889109 - RNA, 23 nt, Human
gagaaaccucgguaagcaggagg

SEQ ID NO: 889110 - RNA, 22 nt, Human
caaacauuuaggaggagggagg

SEQ ID NO: 889111 - RNA, 22 nt, Human
agauuuccaucuuuuucaugug

SEQ ID NO: 889112 - RNA, 22 nt, Human
uguauacaagucguguaaacuu

SEQ ID NO: 889113 - RNA, 22 nt, Human
uccagccuuucuacucacugag

SEQ ID NO: 889114 - RNA, 22 nt, Human
cuaggaccacuguaacaaagua

SEQ ID NO: 889115 - RNA, 22 nt, Human
uuaacauuaaaagcagcauuuu

SEQ ID NO: 889116 - RNA, 22 nt, Human
cagaagaugcagugucugagaa

SEQ ID NO: 889117 - RNA, 22 nt, Human
agcuuugcuucuuuuccauagc

SEQ ID NO: 889118 - RNA, 22 nt, Human
gcggcccgagcaggacgggugg

SEQ ID NO: 889119 - RNA, 22 nt, Human
uuuugcugggguggcuagcuua

SEQ ID NO: 889120 - RNA, 22 nt, Human
caggugggagcgaggagcuacu

SEQ ID NO: 889121 - RNA, 22 nt, Human
agcacagggcccagccuaggcc

SEQ ID NO: 889122 - RNA, 22 nt, Human
agcuccaggauaagacaggugc

SEQ ID NO: 889123 - RNA, 22 nt, Human
guuuccaggcugggcagcgagc

SEQ ID NO: 889124 - RNA, 22 nt, Human
uucaguguggugcacaguuuug

SEQ ID NO: 889125 - RNA, 20 nt, Human
uuugcuaugcauaucugacc

SEQ ID NO: 889126 - RNA, 22 nt, Human
uuaaaacugcaaauccuacuga

SEQ ID NO: 889127 - RNA, 22 nt, Human
ccugucacucugagccgcuccg

SEQ ID NO: 889128 - RNA, 22 nt, Human
auccuuaagaaaguuuucuaua

SEQ ID NO: 889129 - RNA, 22 nt, Human
uccuccaggucuaggguggcuu

SEQ ID NO: 889130 - RNA, 22 nt, Human
auucugggucugggugugauca

SEQ ID NO: 889131 - RNA, 22 nt, Human
gacaggaagucugaaggaggga

SEQ ID NO: 889132 - RNA, 22 nt, Human
auaauaauacugugcaauggau

SEQ ID NO: 889133 - RNA, 22 nt, Human
ggcccugaagugauugugaguu

SEQ ID NO: 889134 - RNA, 22 nt, Human
aggcugggaaauguauuccagc

SEQ ID NO: 889135 - RNA, 22 nt, Human
gugcguccugggggcugggucg

SEQ ID NO: 889136 - RNA, 22 nt, Human
aggcuggaucucuguugccuuc

SEQ ID NO: 889137 - RNA, 22 nt, Human
guggcagguuccguagacagca

SEQ ID NO: 889138 - RNA, 22 nt, Human
gaagguuugauccuuauuuaua

SEQ ID NO: 889139 - RNA, 22 nt, Human
aaaagcaaggcagucugucuga

SEQ ID NO: 889140 - RNA, 22 nt, Human
aggcuucgcaagguuagagcug

SEQ ID NO: 889141 - RNA, 22 nt, Human
uccugggaggcugugccuggcu

SEQ ID NO: 889142 - RNA, 22 nt, Human
cccaggucugugccagcucuga

SEQ ID NO: 889143 - RNA, 22 nt, Human
agccagaggccagccugccuca

SEQ ID NO: 889144 - RNA, 23 nt, Human
cagaccuggcagucauccucaac

SEQ ID NO: 889145 - RNA, 22 nt, Human
ccacauucaccagcugcacgac

SEQ ID NO: 889146 - RNA, 22 nt, Human
ucaggaagaagacggggcagga

SEQ ID NO: 889147 - RNA, 22 nt, Human
ugagaaaugggucugcugaaga

SEQ ID NO: 889148 - RNA, 22 nt, Human
uaucauuguguuauuucuucca

SEQ ID NO: 889149 - RNA, 22 nt, Human
gagaagggauauggcuucuuga

SEQ ID NO: 889150 - RNA, 22 nt, Human
ccugugccugccugugaguucu

SEQ ID NO: 889151 - RNA, 22 nt, Human
uaauuagaguuugguaaacaau

SEQ ID NO: 889152 - RNA, 22 nt, Human
uggugcugccucagaugccuua

SEQ ID NO: 889153 - RNA, 22 nt, Human
ugaagccugaaagcuggacagg

SEQ ID NO: 889154 - RNA, 22 nt, Human
uuuccauauuuggucuuuggga

SEQ ID NO: 889155 - RNA, 22 nt, Human
ucccaaauauaaugcaagagac

SEQ ID NO: 889156 - RNA, 22 nt, Human
acugugcuuucucuggaggcau

SEQ ID NO: 889157 - RNA, 22 nt, Human
aggcaggugcuuaugacuugcu

SEQ ID NO: 889158 - RNA, 22 nt, Human
aggaccuuuggcaaggcugcuc

SEQ ID NO: 889159 - RNA, 22 nt, Human
auagaagcugauaaacuacuuc

SEQ ID NO: 889160 - RNA, 22 nt, Human
cccucucucgguugcugugguu

SEQ ID NO: 889161 - RNA, 22 nt, Human
cagguguugucuaaagcuucag

SEQ ID NO: 889162 - RNA, 19 nt, Human
cauggcugcugcuugggag

SEQ ID NO: 889163 - RNA, 22 nt, Human
ucucaucuagacucugcccuug

SEQ ID NO: 889164 - RNA, 22 nt, Human
ucagccucauuuucugcucugu

SEQ ID NO: 889165 - RNA, 22 nt, Human
aaaaugcucaucagcgauggcu

SEQ ID NO: 889166 - RNA, 22 nt, Human
uaaaugcaagggaaaggcaaga

SEQ ID NO: 889167 - RNA, 22 nt, Human
ucaggcaggaagccccugcaca

SEQ ID NO: 889168 - RNA, 22 nt, Human
cagcagaguaggugcuacuucu

SEQ ID NO: 889169 - RNA, 22 nt, Human
guagcagcuucagcccaaauua

SEQ ID NO: 889170 - RNA, 22 nt, Human
uauacauguuuuacauaaguga

SEQ ID NO: 889171 - RNA, 19 nt, Human
ggcaaauugaggccaguca

SEQ ID NO: 889172 - RNA, 22 nt, Human
caugucacaauucuuaauggga

SEQ ID NO: 889173 - RNA, 22 nt, Human
cugugucucguuaaagcauugg

SEQ ID NO: 889174 - RNA, 22 nt, Human
aucaaagaaugugacugaaaua

SEQ ID NO: 889175 - RNA, 22 nt, Human
agcagagcugcaguggccugcu

SEQ ID NO: 889176 - RNA, 22 nt, Human
ccuggaagagcugaaucaggca

SEQ ID NO: 889177 - RNA, 22 nt, Human
ucugcagcuugcacaggcaggc

SEQ ID NO: 889178 - RNA, 22 nt, Human
acccuggagcuuuucuggcccu

SEQ ID NO: 889179 - RNA, 20 nt, Human
ugggcugaggaucaggugcc

SEQ ID NO: 889180 - RNA, 22 nt, Human
uguuugaaguucuucugugacu

SEQ ID NO: 889181 - RNA, 22 nt, Human
gcugcucugaaaaugacuguug

SEQ ID NO: 889182 - RNA, 20 nt, Human
acauguacagacagguuucu

SEQ ID NO: 889183 - RNA, 22 nt, Human
aaguaaaacacacaguccaccg

SEQ ID NO: 889184 - RNA, 22 nt, Human
aaguuuguuuuagucuaaugau

SEQ ID NO: 889185 - RNA, 22 nt, Human
aagccaguguccagaaugggca

SEQ ID NO: 889186 - RNA, 22 nt, Human
agcagugugcuucguuucauga

SEQ ID NO: 889187 - RNA, 22 nt, Human
aaauccuuuucuauacagcaua

SEQ ID NO: 889188 - RNA, 22 nt, Human
acuucaaacaauuaacagagaa

SEQ ID NO: 889189 - RNA, 22 nt, Human
aaaguacaauauugagauugau

SEQ ID NO: 889190 - RNA, 22 nt, Human
ucccagagaagagcuggaugga

SEQ ID NO: 889191 - RNA, 22 nt, Human
ugcuucaaaaggcagcuuaaug

SEQ ID NO: 889192 - RNA, 22 nt, Human
cugcgugucucugucucauggc

SEQ ID NO: 889193 - RNA, 22 nt, Human
ugcuggcuuuagugauuggggu

SEQ ID NO: 889194 - RNA, 22 nt, Human
aacacauagacguuugauauca

SEQ ID NO: 889195 - RNA, 22 nt, Human
ucuucaaaugaguguggauuau

SEQ ID NO: 889196 - RNA, 22 nt, Human
acuuuuuuauaaggaagaagau

SEQ ID NO: 889197 - RNA, 22 nt, Human
ggcagauggagaagcagcaggu

SEQ ID NO: 889198 - RNA, 23 nt, Human
aguuuuuaauggucauagcugag

SEQ ID NO: 889199 - RNA, 22 nt, Human
ucauugaggaaagguaguggcu

SEQ ID NO: 889200 - RNA, 22 nt, Human
ugcuauuugggggcuacaugau

SEQ ID NO: 889201 - RNA, 22 nt, Human
agcagugggggaguguuaguuu

SEQ ID NO: 889202 - RNA, 22 nt, Human
aaaguccaggggcuggaggcgg

SEQ ID NO: 889203 - RNA, 21 nt, Human
uguucaaacguacacauuucu

SEQ ID NO: 889204 - RNA, 22 nt, Human
caggccuugcgucccauggccu

SEQ ID NO: 889205 - RNA, 22 nt, Human
uacauugauucaggauauaggc

SEQ ID NO: 889206 - RNA, 22 nt, Human
auagacauggucuuuugucauu

SEQ ID NO: 889207 - RNA, 22 nt, Human
agcugggaagaguuuucugcag

SEQ ID NO: 889208 - RNA, 22 nt, Human
uuuuccuuuggaagaugcauau

SEQ ID NO: 889209 - RNA, 22 nt, Human
gcugccugguuucucagcugca

SEQ ID NO: 889210 - RNA, 22 nt, Human
aagccaguccucuacugggcac

SEQ ID NO: 889211 - RNA, 22 nt, Human
cccccaggggcuccgccucgug

SEQ ID NO: 889212 - RNA, 22 nt, Human
agcaggugggcaugaaagcuga

SEQ ID NO: 889213 - RNA, 20 nt, Human
ggcaggcuuuauauggaggg

SEQ ID NO: 889214 - RNA, 22 nt, Human
ucagaccuugucgucacuuaga

SEQ ID NO: 889215 - RNA, 20 nt, Human
aggccugagagaugacuggg

SEQ ID NO: 889216 - RNA, 19 nt, Human
caucuuggaguacuccuuu

SEQ ID NO: 889217 - RNA, 22 nt, Human
cuuguauacagagaaggcucau

SEQ ID NO: 889218 - RNA, 22 nt, Human
ccaggaagccuuuuucuuugac

SEQ ID NO: 889219 - RNA, 22 nt, Human
ucaaacuguucagaacuccuuu

SEQ ID NO: 889220 - RNA, 22 nt, Human
aaguuuguucagggcuuacauu

SEQ ID NO: 889221 - RNA, 22 nt, Human
gcccugucccuuggcuucuagg

SEQ ID NO: 889222 - RNA, 22 nt, Human
uaagacaccucucugcccuuca

SEQ ID NO: 889223 - RNA, 22 nt, Human
cauuucaaugccuucaacauag

SEQ ID NO: 889224 - RNA, 22 nt, Human
cugucguguucacuguggccua

SEQ ID NO: 889225 - RNA, 22 nt, Human
uguauguauacacugaucauca

SEQ ID NO: 889226 - RNA, 22 nt, Human
ucagaggagaccaaggggaaua

SEQ ID NO: 889227 - RNA, 22 nt, Human
ggcaguggaggacccugugucu

SEQ ID NO: 889228 - RNA, 22 nt, Human
gucuuuuucuacgauagcgccu

SEQ ID NO: 889229 - RNA, 22 nt, Human
cuggggcccgagccuugggcca

SEQ ID NO: 889230 - RNA, 22 nt, Human
gucuccugcuagcaagcaccac

SEQ ID NO: 889231 - RNA, 22 nt, Human
uaggguacaugugcacaacaug

SEQ ID NO: 889232 - RNA, 22 nt, Human
uccagcagugcucaggacucac

SEQ ID NO: 889233 - RNA, 22 nt, Human
uucauacaaugggauauuauga

SEQ ID NO: 889234 - RNA, 19 nt, Human
gggcauggaugagcuuacc

SEQ ID NO: 889235 - RNA, 22 nt, Human
ggaggcagaacuucccgucagu

SEQ ID NO: 889236 - RNA, 22 nt, Human
gggcuggcugauuuuccucucu

SEQ ID NO: 889237 - RNA, 22 nt, Human
cagugcuagggcagagcacucc

SEQ ID NO: 889238 - RNA, 22 nt, Human
cagggguauucaagguaguuua

SEQ ID NO: 889239 - RNA, 22 nt, Human
cagaggaagcuggguguggagu

SEQ ID NO: 889240 - RNA, 22 nt, Human
gggugaggcccauuugaggcca

SEQ ID NO: 889241 - RNA, 23 nt, Human
cucuccugaaggacaagcugccg

SEQ ID NO: 889242 - RNA, 22 nt, Human
gaaccuguaaguauagaugugg

SEQ ID NO: 889243 - RNA, 22 nt, Human
gagagggccagggugagaacua

SEQ ID NO: 889244 - RNA, 22 nt, Human
agauggagaccuuggaugaacu

SEQ ID NO: 889245 - RNA, 19 nt, Human
uuacacuccugggcagugg

SEQ ID NO: 889246 - RNA, 21 nt, Human
ccagcccagccuccuucucuu

SEQ ID NO: 889247 - RNA, 23 nt, Human
ugaggaccucucaggggccaggc

SEQ ID NO: 889248 - RNA, 22 nt, Human
gcuggcccagugacccacagug

SEQ ID NO: 889249 - RNA, 22 nt, Human
cucucucaguguaauacaggau

SEQ ID NO: 889250 - RNA, 19 nt, Human
agcugccugugcgcgcccg

SEQ ID NO: 889251 - RNA, 22 nt, Human
gccccaggggaggugcccugca

SEQ ID NO: 889252 - RNA, 20 nt, Human
cccagcccgggccgcgcucg

SEQ ID NO: 889253 - RNA, 22 nt, Human
gaccucugaaggcagagcaggg

SEQ ID NO: 889254 - RNA, 23 nt, Human
uuugcaaauuggacacaaccaca

SEQ ID NO: 889255 - RNA, 19 nt, Human
acaagucacuuacuuagua

SEQ ID NO: 889256 - RNA, 22 nt, Human
aggucagaaaaggagagcauug

SEQ ID NO: 889257 - RNA, 22 nt, Human
gguaguacauggaagaguacac

SEQ ID NO: 889258 - RNA, 19 nt, Human
cagaacagaggucauggcc

SEQ ID NO: 889259 - RNA, 22 nt, Human
uccagggccugagguugaagug

SEQ ID NO: 889260 - RNA, 22 nt, Human
agacauuuugcauucccugaag

SEQ ID NO: 889261 - RNA, 22 nt, Human
ugucagcaagacaucagaguga

SEQ ID NO: 889262 - RNA, 22 nt, Human
cagcugcccaagccccagaugu

SEQ ID NO: 889263 - RNA, 20 nt, Human
uuuagcaaaagggacugcuc

SEQ ID NO: 889264 - RNA, 22 nt, Human
acacaucuuagacugaaauaug

SEQ ID NO: 889265 - RNA, 22 nt, Human
cucccugaccuggauuccaggc

SEQ ID NO: 889266 - RNA, 22 nt, Human
auuagaaugaaguauaggauuu

SEQ ID NO: 889267 - RNA, 22 nt, Human
uccugggucucuuccuuaguuc

SEQ ID NO: 889268 - RNA, 22 nt, Human
gcccugaacgaggggucuggag

SEQ ID NO: 889269 - RNA, 22 nt, Human
acuugacaccuaauuagucauc

SEQ ID NO: 889270 - RNA, 22 nt, Human
cuuucaaucaaaguuucuagug

SEQ ID NO: 889271 - RNA, 22 nt, Human
cugccuguuccugaucauucua

SEQ ID NO: 889272 - RNA, 22 nt, Human
aaucuucaacagaaugguagga

SEQ ID NO: 889273 - RNA, 22 nt, Human
cuuuuguucuacagcuggggaa

SEQ ID NO: 889274 - RNA, 22 nt, Human
accagagaugucuaauaggggc

SEQ ID NO: 889275 - RNA, 22 nt, Human
auuggucuaggcuuuaaaaaga

SEQ ID NO: 889276 - RNA, 22 nt, Human
ucuauuuucuugccaaaacugc

SEQ ID NO: 889277 - RNA, 22 nt, Human
uggcaaccgcauggccugcuuc

SEQ ID NO: 889278 - RNA, 22 nt, Human
ccugggcucaagugauccuccu

SEQ ID NO: 889279 - RNA, 22 nt, Human
ccuucuuaaacaucauuuuggc

SEQ ID NO: 889280 - RNA, 22 nt, Human
ucuuaacugacaguuuaauggg

SEQ ID NO: 889281 - RNA, 20 nt, Human
ccaggacugcuggggacucu

SEQ ID NO: 889282 - RNA, 22 nt, Human
uuucaauuuccaggcuagaauu

SEQ ID NO: 889283 - RNA, 22 nt, Human
ucuuuaagggauguucugcuuu

SEQ ID NO: 889284 - RNA, 22 nt, Human
ucagagcacuggugcuaccuug

SEQ ID NO: 889285 - RNA, 22 nt, Human
caaaguucucggcucaaguccu

SEQ ID NO: 889286 - RNA, 18 nt, Human
ggccuuaguaugugccuu

SEQ ID NO: 889287 - RNA, 22 nt, Human
cagaaggcaaacaaaaggauuu

SEQ ID NO: 889288 - RNA, 22 nt, Human
acuuugcagguacaugagcauc

SEQ ID NO: 889289 - RNA, 22 nt, Human
ugugucagaaguacuuuuggaa

SEQ ID NO: 889290 - RNA, 22 nt, Human
guauccaugggggauugguucc

SEQ ID NO: 889291 - RNA, 22 nt, Human
cccucagcuccacccucagcag

SEQ ID NO: 889292 - RNA, 22 nt, Human
agacaaugucaaggugaucauc

SEQ ID NO: 889293 - RNA, 22 nt, Human
uuucucuauuaggggcuagcuu

SEQ ID NO: 889294 - RNA, 22 nt, Human
aaggcuagagagguauucaagu

SEQ ID NO: 889295 - RNA, 22 nt, Human
ggcugagcguggcugccguggg

SEQ ID NO: 889296 - RNA, 22 nt, Human
caggaugagaggcccagggaag

SEQ ID NO: 889297 - RNA, 22 nt, Human
aagaugccuguagcaggaagau

SEQ ID NO: 889298 - RNA, 22 nt, Human
uguauaagccuagugaaauuuc

SEQ ID NO: 889299 - RNA, 22 nt, Human
ucugggaacacacgucacuuca

SEQ ID NO: 889300 - RNA, 22 nt, Human
aauguuauuucugcauaguagu

SEQ ID NO: 889301 - RNA, 22 nt, Human
gugucacaugguuuacugcagc

SEQ ID NO: 889302 - RNA, 22 nt, Human
uuggaaacuuggauggaaaacc

SEQ ID NO: 889303 - RNA, 22 nt, Human
cugggacucagaccaguucugu

SEQ ID NO: 889304 - RNA, 22 nt, Human
ggaggcucuccuggccuugucu

SEQ ID NO: 889305 - RNA, 22 nt, Human
uuucuacaugucaauccaaacc

SEQ ID NO: 889306 - RNA, 22 nt, Human
ugaggcagggagaguggauaug

SEQ ID NO: 889307 - RNA, 22 nt, Human
uuauuguuagugagacuguaga

SEQ ID NO: 889308 - RNA, 22 nt, Human
uuucacaaguuucaggauucug

SEQ ID NO: 889309 - RNA, 22 nt, Human
auggcuugcuuuuagagagauc

SEQ ID NO: 889310 - RNA, 22 nt, Human
auuuuucagcuucauugaggca

SEQ ID NO: 889311 - RNA, 22 nt, Human
gaggccagggaugcaaugagag

SEQ ID NO: 889312 - RNA, 22 nt, Human
gaggugugcugcggcccggugc

SEQ ID NO: 889313 - RNA, 22 nt, Human
cgcagcugcugcucugaaacag

SEQ ID NO: 889314 - RNA, 22 nt, Human
gaauuaguguugaaaucagggc

SEQ ID NO: 889315 - RNA, 22 nt, Human
uagugccaucuugagcugcuuu

SEQ ID NO: 889316 - RNA, 22 nt, Human
gacucccaagcuuggaggaagg

SEQ ID NO: 889317 - RNA, 22 nt, Human
uggcccaggucucucugagccc

SEQ ID NO: 889318 - RNA, 22 nt, Human
acucucugugauggaggccagc

SEQ ID NO: 889319 - RNA, 22 nt, Human
aguugggaguuauagacucuau

SEQ ID NO: 889320 - RNA, 22 nt, Human
cagaggcuggcggccgccccga

SEQ ID NO: 889321 - RNA, 22 nt, Human
cuggugggaggcaagguggaag

SEQ ID NO: 889322 - RNA, 22 nt, Human
uccugugaccagcuuccaugcu

SEQ ID NO: 889323 - RNA, 20 nt, Human
gacuucaauuucuaucuuuu

SEQ ID NO: 889324 - RNA, 21 nt, Human
ucaggcaggucccacugaaca

SEQ ID NO: 889325 - RNA, 22 nt, Human
gaacuuugcgcaguucccgggg

SEQ ID NO: 889326 - RNA, 22 nt, Human
cuucuuuucauggcuugggaag

SEQ ID NO: 889327 - RNA, 22 nt, Human
uucacugcagcccaugaaggga

SEQ ID NO: 889328 - RNA, 22 nt, Human
uaucauuauacagacguauaca

SEQ ID NO: 889329 - RNA, 22 nt, Human
auuauuugacuugagaacaggu

SEQ ID NO: 889330 - RNA, 22 nt, Human
agaggggaaggaugugauguga

SEQ ID NO: 889331 - RNA, 22 nt, Human
ugauucaucagaauaggaguuu

SEQ ID NO: 889332 - RNA, 22 nt, Human
cagggcagaacauauagauagu

SEQ ID NO: 889333 - RNA, 22 nt, Human
acuccagguuuucucucaaguu

SEQ ID NO: 889334 - RNA, 22 nt, Human
uacagggacucccgcagagaua

SEQ ID NO: 889335 - RNA, 22 nt, Human
cucugacagccuucauuaugca

SEQ ID NO: 889336 - RNA, 22 nt, Human
gguuuaaaagccaugcaugggg

SEQ ID NO: 889337 - RNA, 22 nt, Human
gugcccuggagggguugaaggg

SEQ ID NO: 889338 - RNA, 22 nt, Human
aaagcagccacagagagagcgu

SEQ ID NO: 889339 - RNA, 22 nt, Human
aagagucccaaaaugauucuua

SEQ ID NO: 889340 - RNA, 22 nt, Human
ugcugcagggaagucggggggu

SEQ ID NO: 889341 - RNA, 22 nt, Human
aagagugaguauuuccugauua

SEQ ID NO: 889342 - RNA, 22 nt, Human
uggguaggaaucgaguguaugg

SEQ ID NO: 889343 - RNA, 22 nt, Human
aggcucuggcaacagcuggugu

SEQ ID NO: 889344 - RNA, 22 nt, Human
uucuguccaggcgcccagcuau

SEQ ID NO: 889345 - RNA, 22 nt, Human
ugcaauaaggaguaauaguaaa

SEQ ID NO: 889346 - RNA, 22 nt, Human
ucugagagcuguagaagccuau

SEQ ID NO: 889347 - RNA, 22 nt, Human
uuggaacuggaggaacaugcua

SEQ ID NO: 889348 - RNA, 22 nt, Human
caaaggaaauacuaaucuggaa

SEQ ID NO: 889349 - RNA, 22 nt, Human
guuccaaauuuggaucuuuagg

SEQ ID NO: 889350 - RNA, 22 nt, Human
ccggcgggcgcggugacgucag

SEQ ID NO: 889351 - RNA, 19 nt, Human
cagauguuuucaguucauu

SEQ ID NO: 889352 - RNA, 22 nt, Human
uaaguaguuccauccaaacagc

SEQ ID NO: 889353 - RNA, 22 nt, Human
cugaaguuuaugcuuuucgggu

SEQ ID NO: 889354 - RNA, 18 nt, Human
auugucagaagucaugug

SEQ ID NO: 889355 - RNA, 22 nt, Human
ucuuccuucuuugaugacaagg

SEQ ID NO: 889356 - RNA, 22 nt, Human
uuuggcauagcucuuuguuccu

SEQ ID NO: 889357 - RNA, 22 nt, Human
ugcucuagcucauaggacucau

SEQ ID NO: 889358 - RNA, 22 nt, Human
aagcuggacucugccauuuacu

SEQ ID NO: 889359 - RNA, 20 nt, Human
augcaucugguaucuuuccu

SEQ ID NO: 889360 - RNA, 22 nt, Human
guccaaauuuuucacauguaga

SEQ ID NO: 889361 - RNA, 22 nt, Human
acuucuguccuccaagccacgu

SEQ ID NO: 889362 - RNA, 22 nt, Human
uuucaaaccuacuuguauguuu

SEQ ID NO: 889363 - RNA, 22 nt, Human
ggugggacagguaggaguggcu

SEQ ID NO: 889364 - RNA, 22 nt, Human
uuucagugaaagcuacuguuag

SEQ ID NO: 889365 - RNA, 22 nt, Human
uucuagacuucaggcauucucc

SEQ ID NO: 889366 - RNA, 22 nt, Human
ccaggcagcucugauuuauguc

SEQ ID NO: 889367 - RNA, 20 nt, Human
auuauucauacaugugugac

SEQ ID NO: 889368 - RNA, 23 nt, Human
ucccuggaggcagguccagggcc

SEQ ID NO: 889369 - RNA, 22 nt, Human
ggcagcuuugcccucacugucc

SEQ ID NO: 889370 - RNA, 22 nt, Human
uuucacagcauauagguguacu

SEQ ID NO: 889371 - RNA, 22 nt, Human
auuaggcauuauggggauaagg

SEQ ID NO: 889372 - RNA, 22 nt, Human
cugggccuuggauugacacugu

SEQ ID NO: 889373 - RNA, 22 nt, Human
aagcugcccucauucccagugc

SEQ ID NO: 889374 - RNA, 22 nt, Human
uguggcuuuugcuagcuuugca

SEQ ID NO: 889375 - RNA, 22 nt, Human
augagguaauacuuucaguccu

SEQ ID NO: 889376 - RNA, 22 nt, Human
gagcuggcagugguagacaugg

SEQ ID NO: 889377 - RNA, 22 nt, Human
uguguucaguaugacauucaca

SEQ ID NO: 889378 - RNA, 22 nt, Human
uuuaaucaggcaaagcauaaua

SEQ ID NO: 889379 - RNA, 22 nt, Human
auggcacacaggucugcaaggg

SEQ ID NO: 889380 - RNA, 22 nt, Human
uggcauuucaguauuuucauaa

SEQ ID NO: 889381 - RNA, 22 nt, Human
auuuaugacuggugaauagaac

SEQ ID NO: 889382 - RNA, 22 nt, Human
uucugcaugauauuaaauguaa

SEQ ID NO: 889383 - RNA, 22 nt, Human
acaugcauacaagcacauguag

SEQ ID NO: 889384 - RNA, 22 nt, Human
augcaagauucagcaggaagau

SEQ ID NO: 889385 - RNA, 22 nt, Human
gggacccugggaggcuggcgca

SEQ ID NO: 889386 - RNA, 22 nt, Human
auucuuuggacaauaaguggug

SEQ ID NO: 889387 - RNA, 22 nt, Human
ucagaacauggcauguuccauc

SEQ ID NO: 889388 - RNA, 22 nt, Human
gccaugggcaaaugcagagcug

SEQ ID NO: 889389 - RNA, 22 nt, Human
gcagagccuugcgucaugugcc

SEQ ID NO: 889390 - RNA, 22 nt, Human
uuuucacauugucccagcacua

SEQ ID NO: 889391 - RNA, 22 nt, Human
ugucaguuuggcucuaaaguuu

SEQ ID NO: 889392 - RNA, 22 nt, Human
cuaacuacaagcggggcauccu

SEQ ID NO: 889393 - RNA, 22 nt, Human
aguguuauaaaggccaaguuuu

SEQ ID NO: 889394 - RNA, 21 nt, Human
auuuucauuaauucagugugg

SEQ ID NO: 889395 - RNA, 22 nt, Human
aauagcuuaguccugauucugu

SEQ ID NO: 889396 - RNA, 22 nt, Human
agagucugcauuucuacaagcu

SEQ ID NO: 889397 - RNA, 19 nt, Human
agucacagggaagaggaac

SEQ ID NO: 889398 - RNA, 22 nt, Human
agagacuguaaugagagguaca

SEQ ID NO: 889399 - RNA, 20 nt, Human
ucucugcuguccacauuugc

SEQ ID NO: 889400 - RNA, 22 nt, Human
cugcugugcauauuuaucuagg

SEQ ID NO: 889401 - RNA, 22 nt, Human
aggagccugugccuggcacucc

SEQ ID NO: 889402 - RNA, 22 nt, Human
gugucuacugaucugauucaga

SEQ ID NO: 889403 - RNA, 22 nt, Human
aaagguuuuauucugagcucug

SEQ ID NO: 889404 - RNA, 20 nt, Human
ugacucugcaaccgucucuc

SEQ ID NO: 889405 - RNA, 21 nt, Human
uucuucuuggacuguuuuggc

SEQ ID NO: 889406 - RNA, 22 nt, Human
acagggcuggcguugggacaga

SEQ ID NO: 889407 - RNA, 22 nt, Human
cccagcucaagcagagagcuaa

SEQ ID NO: 889408 - RNA, 22 nt, Human
aucuuccaggugccggggguca

SEQ ID NO: 889409 - RNA, 22 nt, Human
cgaggcagacaaaaguuggaag

SEQ ID NO: 889410 - RNA, 22 nt, Human
guuuauuaacugucaagugauu

SEQ ID NO: 889411 - RNA, 23 nt, Human
agguacauauacuuggaggucag

SEQ ID NO: 889412 - RNA, 22 nt, Human
aaaugcucuccaaaaugaaagu

SEQ ID NO: 889413 - RNA, 22 nt, Human
uaagaaugacaaccauaccauu

SEQ ID NO: 889414 - RNA, 22 nt, Human
uggaagggguuacgcagcagga

SEQ ID NO: 889415 - RNA, 22 nt, Human
gagaagcaaucagcagccaccc

SEQ ID NO: 889416 - RNA, 20 nt, Human
uuccuuggauugugucuuga

SEQ ID NO: 889417 - RNA, 22 nt, Human
uucuggggcuaauacagagguc

SEQ ID NO: 889418 - RNA, 19 nt, Human
uagaagcacuaggcaaacu

SEQ ID NO: 889419 - RNA, 22 nt, Human
uuuuaagaggaggcuguuugaa

SEQ ID NO: 889420 - RNA, 22 nt, Human
uaguggaguagaaaccaaagaa

SEQ ID NO: 889421 - RNA, 22 nt, Human
uggaaauuuugaacaguuucua

SEQ ID NO: 889422 - RNA, 21 nt, Human
ggccucagccaccuggcucug

SEQ ID NO: 889423 - RNA, 22 nt, Human
augucuauguucuuuacugugu

SEQ ID NO: 889424 - RNA, 22 nt, Human
agcuccaggaucugaaaguucg

SEQ ID NO: 889425 - RNA, 22 nt, Human
auuuccaagaaagcuuuaggau

SEQ ID NO: 889426 - RNA, 22 nt, Human
uuacaaugaugggauucagcca

SEQ ID NO: 889427 - RNA, 22 nt, Human
cagaaauguuuaugcuuuugaa

SEQ ID NO: 889428 - RNA, 22 nt, Human
uaauuauaacaugcuuucuggc

SEQ ID NO: 889429 - RNA, 22 nt, Human
agacaggacacaagcugcauaa

SEQ ID NO: 889430 - RNA, 22 nt, Human
acucaggcuacaggggcagaag

SEQ ID NO: 889431 - RNA, 22 nt, Human
gacacagaguauuuuaaguacu

SEQ ID NO: 889432 - RNA, 22 nt, Human
uggccuuguguuuaagcaagaa

SEQ ID NO: 889433 - RNA, 22 nt, Human
agacacagaugguaccugagcc

SEQ ID NO: 889434 - RNA, 22 nt, Human
aguguauuaguuguccagcagu

SEQ ID NO: 889435 - RNA, 22 nt, Human
agucacuguuuaaucuagcuaa

SEQ ID NO: 889436 - RNA, 22 nt, Human
uccagagagccacggacagggg

SEQ ID NO: 889437 - RNA, 22 nt, Human
auuuccuugcaaguuucuguaa

SEQ ID NO: 889438 - RNA, 22 nt, Human
cugagcaugcuccucuuuucca

SEQ ID NO: 889439 - RNA, 22 nt, Human
augugaaacgcaaugggaucau

SEQ ID NO: 889440 - RNA, 22 nt, Human
cuggcugguagaauugugaccu

SEQ ID NO: 889441 - RNA, 22 nt, Human
uuaguacagaaucaaaagcaau

SEQ ID NO: 889442 - RNA, 19 nt, Human
ucugggaagccgggcucca

SEQ ID NO: 889443 - RNA, 22 nt, Human
ggcaggccugagaggcagggcu

SEQ ID NO: 889444 - RNA, 22 nt, Human
cugugucuucugcuuacagucu

SEQ ID NO: 889445 - RNA, 22 nt, Human
agcaagaagggcaaggaaguuu

SEQ ID NO: 889446 - RNA, 22 nt, Human
ccuccauguaaagguccccuca

SEQ ID NO: 889447 - RNA, 22 nt, Human
cccaggguccggauaacccugg

SEQ ID NO: 889448 - RNA, 22 nt, Human
aggacaggauugagcugaacug

SEQ ID NO: 889449 - RNA, 22 nt, Human
auguucaaacuuuuuacacacc

SEQ ID NO: 889450 - RNA, 21 nt, Human
gaguccuuccaauguccucag

SEQ ID NO: 889451 - RNA, 22 nt, Human
gcagggcucaacaggacacccc

SEQ ID NO: 889452 - RNA, 22 nt, Human
auuuacaggacagcuuggcauu

SEQ ID NO: 889453 - RNA, 22 nt, Human
gggaugaauugagucagaaggg

SEQ ID NO: 889454 - RNA, 22 nt, Human
gacaugcaugaaugcaggucuc

SEQ ID NO: 889455 - RNA, 22 nt, Human
gauacacagggcuaagauggau

SEQ ID NO: 889456 - RNA, 22 nt, Human
uugagcauaugcauuuccaauu

SEQ ID NO: 889457 - RNA, 22 nt, Human
uugcugauuuccccuugagugu

SEQ ID NO: 889458 - RNA, 22 nt, Human
gccucacagacugacugaaagc

SEQ ID NO: 889459 - RNA, 22 nt, Human
uccaggacagcggcaggcagau

SEQ ID NO: 889460 - RNA, 22 nt, Human
gagcugaauugaagcaaggagc

SEQ ID NO: 889461 - RNA, 22 nt, Human
auugaacauacauauccacacc

SEQ ID NO: 889462 - RNA, 22 nt, Human
caaggcuguguuagcugcccuc

SEQ ID NO: 889463 - RNA, 22 nt, Human
aaaaagcuuaaaugagcaguuc

SEQ ID NO: 889464 - RNA, 22 nt, Human
uuucagagcucuaggcucucag

SEQ ID NO: 889465 - RNA, 22 nt, Human
cgugauuggcuucugcauugga

SEQ ID NO: 889466 - RNA, 22 nt, Human
ggaguagcugcauuccgagcac

SEQ ID NO: 889467 - RNA, 22 nt, Human
ggcacuguguacacacagagac

SEQ ID NO: 889468 - RNA, 22 nt, Human
ucugcgugaugagggugcagca

SEQ ID NO: 889469 - RNA, 22 nt, Human
uuccucucaacaugccugccgg

SEQ ID NO: 889470 - RNA, 22 nt, Human
cagaaauguuuauauguggugu

SEQ ID NO: 889471 - RNA, 22 nt, Human
uaaaaucauucuggugucagua

SEQ ID NO: 889472 - RNA, 22 nt, Human
gugccuggacccucuuuccgga

SEQ ID NO: 889473 - RNA, 22 nt, Human
gugucauacagaaugcauaagu

SEQ ID NO: 889474 - RNA, 20 nt, Human
cuguaaaccaggcuucuugg

SEQ ID NO: 889475 - RNA, 22 nt, Human
uuguaugaguaugguguauagg

SEQ ID NO: 889476 - RNA, 22 nt, Human
gccuggagacaaggacaaaggg

SEQ ID NO: 889477 - RNA, 22 nt, Human
gggcugagggccaauuccuacu

SEQ ID NO: 889478 - RNA, 22 nt, Human
gcacaggcucucuuggggacac

SEQ ID NO: 889479 - RNA, 22 nt, Human
cucuccuugcagauggcugccu

SEQ ID NO: 889480 - RNA, 22 nt, Human
aaaauacacauacuaggggaaa

SEQ ID NO: 889481 - RNA, 22 nt, Human
ugagguaugcugaacucuguuu

SEQ ID NO: 889482 - RNA, 22 nt, Human
cacgaaaucuaggagaguaaca

SEQ ID NO: 889483 - RNA, 22 nt, Human
ugggccugggucuuugcugcca

SEQ ID NO: 889484 - RNA, 22 nt, Human
gauuuucauuauagcuaguuuc

SEQ ID NO: 889485 - RNA, 22 nt, Human
uuuacaaggcagaacugauuaa

SEQ ID NO: 889486 - RNA, 22 nt, Human
ucauccagccucaucaggagcu

SEQ ID NO: 889487 - RNA, 22 nt, Human
ggcccagaauacaugaaguaua

SEQ ID NO: 889488 - RNA, 22 nt, Human
uguuuaaucuucaggacagucu

SEQ ID NO: 889489 - RNA, 22 nt, Human
cagcugcagugggggaccacaa

SEQ ID NO: 889490 - RNA, 22 nt, Human
aguuucacagaauaugaagguu

SEQ ID NO: 889491 - RNA, 22 nt, Human
agcccugggcguuacugggaug

SEQ ID NO: 889492 - RNA, 22 nt, Human
ucuagcaguagcccaaauccag

SEQ ID NO: 889493 - RNA, 22 nt, Human
acagacauucauauccucggua

SEQ ID NO: 889494 - RNA, 22 nt, Human
cugaguccuugggcuuagagug

SEQ ID NO: 889495 - RNA, 22 nt, Human
cacccaggcagguggcugagaa

SEQ ID NO: 889496 - RNA, 22 nt, Human
uugauguaaagauaguuucugu

SEQ ID NO: 889497 - RNA, 22 nt, Human
agucuuaugguuaaauagaugc

SEQ ID NO: 889498 - RNA, 22 nt, Human
caggagggcccgagacucuucc

SEQ ID NO: 889499 - RNA, 22 nt, Human
gagcugggaggacugggaacuu

SEQ ID NO: 889500 - RNA, 22 nt, Human
uuuguaugugauaagacuauuc

SEQ ID NO: 889501 - RNA, 22 nt, Human
gccagcagcccagaaggacuuu

SEQ ID NO: 889502 - RNA, 22 nt, Human
ccugagugccaugagagcaccc

SEQ ID NO: 889503 - RNA, 22 nt, Human
agccugagccccauccagcuga

SEQ ID NO: 889504 - RNA, 22 nt, Human
cagguccaauugcgcuaaaauc

SEQ ID NO: 889505 - RNA, 22 nt, Human
ucaaaucccagcucagccucuc

SEQ ID NO: 889506 - RNA, 22 nt, Human
auguucauccaugucguagcag

SEQ ID NO: 889507 - RNA, 22 nt, Human
aaagcuuuucaguauguucaug

SEQ ID NO: 889508 - RNA, 22 nt, Human
uuucaguguguaaauugaaaua

SEQ ID NO: 889509 - RNA, 22 nt, Human
caaaaggcaggggaaagagugc

SEQ ID NO: 889510 - RNA, 22 nt, Human
cuucacuggaaucuguaauagu

SEQ ID NO: 889511 - RNA, 22 nt, Human
cagcacaggaagugggccuuca

SEQ ID NO: 889512 - RNA, 22 nt, Human
acaaagugugcggagcccaggg

SEQ ID NO: 889513 - RNA, 21 nt, Human
gugagguauuaggaccuacau

SEQ ID NO: 889514 - RNA, 22 nt, Human
ccuggggagccgccugagcccc

SEQ ID NO: 889515 - RNA, 22 nt, Human
ggagucagccugucagagugua

SEQ ID NO: 889516 - RNA, 22 nt, Human
gcaggagagucugugccagguu

SEQ ID NO: 889517 - RNA, 19 nt, Human
acucagggaaaggagaauu

SEQ ID NO: 889518 - RNA, 22 nt, Human
acauuccugaggaaauacauuc

SEQ ID NO: 889519 - RNA, 22 nt, Human
ccauucauagcaagcuacaucu

SEQ ID NO: 889520 - RNA, 22 nt, Human
uaucuguuucugaggauacaug

SEQ ID NO: 889521 - RNA, 22 nt, Human
uagaaagucaugaauuacacca

SEQ ID NO: 889522 - RNA, 19 nt, Human
ugugugcaugcgcacgugu

SEQ ID NO: 889523 - RNA, 20 nt, Human
uacaaagagccccucucuuc

SEQ ID NO: 889524 - RNA, 22 nt, Human
agaauguguuauuagagaagga

SEQ ID NO: 889525 - RNA, 22 nt, Human
gcagggaaggggcaugcuggag

SEQ ID NO: 889526 - RNA, 22 nt, Human
uuguacaaagauuucacagcuc

SEQ ID NO: 889527 - RNA, 22 nt, Human
uggcaggaaccaggaggcucuc

SEQ ID NO: 889528 - RNA, 22 nt, Human
agggcucaguugccuggagccc

SEQ ID NO: 889529 - RNA, 22 nt, Human
agaaccucacgagauuccuuca

SEQ ID NO: 889530 - RNA, 22 nt, Human
ggggccagguccagcuuccaaa

SEQ ID NO: 889531 - RNA, 22 nt, Human
uuucucucuacaguacuuucau

SEQ ID NO: 889532 - RNA, 22 nt, Human
cagaaucuacacccucagaaau

SEQ ID NO: 889533 - RNA, 22 nt, Human
aguaaacauuuucauauuuucu

SEQ ID NO: 889534 - RNA, 22 nt, Human
accaugggucagccaccucagc

SEQ ID NO: 889535 - RNA, 22 nt, Human
auaacucuguuuuuuucaugca

SEQ ID NO: 889536 - RNA, 22 nt, Human
acaaagagggaccagugacuug

SEQ ID NO: 889537 - RNA, 22 nt, Human
uuucuaacagcaaauguuuauc

SEQ ID NO: 889538 - RNA, 22 nt, Human
aaugccuugccugcuacaacuu

SEQ ID NO: 889539 - RNA, 22 nt, Human
guuccagguggucacagagcuc

SEQ ID NO: 889540 - RNA, 22 nt, Human
aagcuuuagagaugaguuccuu

SEQ ID NO: 889541 - RNA, 22 nt, Human
ugcugugucuuucugugaaaag

SEQ ID NO: 889542 - RNA, 23 nt, Human
ucuuccugaacuaucaggcacau

SEQ ID NO: 889543 - RNA, 22 nt, Human
ccaggagagcagaagcccaggc

SEQ ID NO: 889544 - RNA, 18 nt, Human
uggccccuuaucaguccu

SEQ ID NO: 889545 - RNA, 22 nt, Human
uuguuuuaaugagggagguuga

SEQ ID NO: 889546 - RNA, 22 nt, Human
aggacaguccgggguccuccac

SEQ ID NO: 889547 - RNA, 16 nt, Human
gcagaggaaaggggag

SEQ ID NO: 889548 - RNA, 22 nt, Human
guaacuuuggauuuaggguacc

SEQ ID NO: 889549 - RNA, 22 nt, Human
uggacagcaaacauggagagaa

SEQ ID NO: 889550 - RNA, 22 nt, Human
caugaggauccaggugacaggc

SEQ ID NO: 889551 - RNA, 22 nt, Human
cagaaauaucaguugaaagugc

SEQ ID NO: 889552 - RNA, 22 nt, Human
auuauuuauccucuuggucuau

SEQ ID NO: 889553 - RNA, 22 nt, Human
ugggcucugaagggucccggau

SEQ ID NO: 889554 - RNA, 22 nt, Human
cccugcaggcucagacuggagu

SEQ ID NO: 889555 - RNA, 22 nt, Human
cugcaucacagcaggaggcaca

SEQ ID NO: 889556 - RNA, 22 nt, Human
uccuggcuccuggagaccugcu

SEQ ID NO: 889557 - RNA, 22 nt, Human
cugcccugggccaggaagcggc

SEQ ID NO: 889558 - RNA, 22 nt, Human
aagcaauuugacaguacauauc

SEQ ID NO: 889559 - RNA, 22 nt, Human
uuuuccuucuagagcagauuuc

SEQ ID NO: 889560 - RNA, 22 nt, Human
uuacagauucaagcucuuugaa

SEQ ID NO: 889561 - RNA, 22 nt, Human
agcuucccaggagaaucaggga

SEQ ID NO: 889562 - RNA, 22 nt, Human
guggcagaguugcugacuagaa

SEQ ID NO: 889563 - RNA, 22 nt, Human
aacaaacaguuaaguguggaug

SEQ ID NO: 889564 - RNA, 22 nt, Human
ucaaagcacuggggaaagccug

SEQ ID NO: 889565 - RNA, 22 nt, Human
uuuuuguugcagagaggccacu

SEQ ID NO: 889566 - RNA, 22 nt, Human
aaauuguaggaucacaugaccu

SEQ ID NO: 889567 - RNA, 22 nt, Human
ggugcugaauaaauacuaguua

SEQ ID NO: 889568 - RNA, 22 nt, Human
ucuggcagcgaagcguguacuu

SEQ ID NO: 889569 - RNA, 22 nt, Human
aaaagacaucuauuucaggcag

SEQ ID NO: 889570 - RNA, 22 nt, Human
gcagccucugcaguucaggagg

SEQ ID NO: 889571 - RNA, 22 nt, Human
cagggacccgcacagguagcau

SEQ ID NO: 889572 - RNA, 22 nt, Human
gaaguucuuugcuccccaguac

SEQ ID NO: 889573 - RNA, 22 nt, Human
ucccagugagguccuggcuguc

SEQ ID NO: 889574 - RNA, 22 nt, Human
augcaaaauaaggcagaaacau

SEQ ID NO: 889575 - RNA, 22 nt, Human
ccuuuguauacaguucuuguga

SEQ ID NO: 889576 - RNA, 22 nt, Human
cuggcuggaggugagucacuga

SEQ ID NO: 889577 - RNA, 22 nt, Human
gugaaauauuuaacguccaggu

SEQ ID NO: 889578 - RNA, 22 nt, Human
uuauuuauggcccucaccugau

SEQ ID NO: 889579 - RNA, 22 nt, Human
gcugucacaaauuggguucuuu

SEQ ID NO: 889580 - RNA, 19 nt, Human
cugcugggugcugagggag

SEQ ID NO: 889581 - RNA, 22 nt, Human
auguauaugugaaagauguuua

SEQ ID NO: 889582 - RNA, 22 nt, Human
auuuguucuucaugauccuguc

SEQ ID NO: 889583 - RNA, 22 nt, Human
uaucagcaacucagagcagucu

SEQ ID NO: 889584 - RNA, 22 nt, Human
uacugcaugggugcaugcugcu

SEQ ID NO: 889585 - RNA, 22 nt, Human
gcccugugcuuggauggcagau

SEQ ID NO: 889586 - RNA, 22 nt, Human
uacagaauguuaugaagcauag

SEQ ID NO: 889587 - RNA, 22 nt, Human
cuccagugagcgcggggcaugg

SEQ ID NO: 889588 - RNA, 22 nt, Human
uccagcagagucucugaggggg

SEQ ID NO: 889589 - RNA, 22 nt, Human
cugaggcuuggaggggucuggu

SEQ ID NO: 889590 - RNA, 22 nt, Human
augugcuaaacucaacaaaucu

SEQ ID NO: 889591 - RNA, 22 nt, Human
auuucacagcgugguugacugc

SEQ ID NO: 889592 - RNA, 22 nt, Human
ccucuuccagcuguugcuucca

SEQ ID NO: 889593 - RNA, 22 nt, Human
gaaaucaauuucuugguugaua

SEQ ID NO: 889594 - RNA, 22 nt, Human
ugugggcacuaaugacaugcag

SEQ ID NO: 889595 - RNA, 22 nt, Human
uaauugguagcugguauaaugc

SEQ ID NO: 889596 - RNA, 22 nt, Human
ccagaauagaaggcagcuguca

SEQ ID NO: 889597 - RNA, 22 nt, Human
cugaaaauguuacacaggaaga

SEQ ID NO: 889598 - RNA, 22 nt, Human
acugugagaguuuuucuaggag

SEQ ID NO: 889599 - RNA, 22 nt, Human
ggcagagaaucuggcuguuuac

SEQ ID NO: 889600 - RNA, 23 nt, Human
uaugaacugcauugcuggugugu

SEQ ID NO: 889601 - RNA, 22 nt, Human
acaguuuggcgugauugauagu

SEQ ID NO: 889602 - RNA, 22 nt, Human
aggggagguguccccaaaucuc

SEQ ID NO: 889603 - RNA, 22 nt, Human
ugugaagauuuggcaugcagaa

SEQ ID NO: 889604 - RNA, 22 nt, Human
ggugucagugagagcacaguac

SEQ ID NO: 889605 - RNA, 22 nt, Human
ggggaugguagaccggugacgu

SEQ ID NO: 889606 - RNA, 22 nt, Human
ccucagccuuggccccaggcag

SEQ ID NO: 889607 - RNA, 22 nt, Human
ugcaaaugucaaggguuagugu

SEQ ID NO: 889608 - RNA, 21 nt, Human
ugcagagauaucugaagcaga

SEQ ID NO: 889609 - RNA, 21 nt, Human
agguuucucuuuuauggaggg

SEQ ID NO: 889610 - RNA, 22 nt, Human
cagcuccugcagcugcugccgu

SEQ ID NO: 889611 - RNA, 22 nt, Human
gugcgugugccuaucaauaaag

SEQ ID NO: 889612 - RNA, 22 nt, Human
cugcucuguuucuuagcugggu

SEQ ID NO: 889613 - RNA, 15 nt, Human
aacaggcauuuauau

SEQ ID NO: 889614 - RNA, 22 nt, Human
auccuaaagcagacagcagguu

SEQ ID NO: 889615 - RNA, 22 nt, Human
uucauguaugaggccaaucuuu

SEQ ID NO: 889616 - RNA, 22 nt, Human
uaacagcaggguuacaggcauu

SEQ ID NO: 889617 - RNA, 22 nt, Human
auguuuuaaauauguguguaaa

SEQ ID NO: 889618 - RNA, 21 nt, Human
uuucugaaggcaacaucuauc

SEQ ID NO: 889619 - RNA, 22 nt, Human
agcagcauagaagcugggagga

SEQ ID NO: 889620 - RNA, 22 nt, Human
ucuugcacuucaugaauauguu

SEQ ID NO: 889621 - RNA, 22 nt, Human
gggcuggagacaagugagccgc

SEQ ID NO: 889622 - RNA, 22 nt, Human
uauuuugacgauuuuaugcaaa

SEQ ID NO: 889623 - RNA, 22 nt, Human
gaggguggggaauagacugcua

SEQ ID NO: 889624 - RNA, 22 nt, Human
uuugaaagagcugauacaugaa

SEQ ID NO: 889625 - RNA, 22 nt, Human
uguguggcguugcguggcuagg

SEQ ID NO: 889626 - RNA, 22 nt, Human
aggcaguuuauccccagagccu

SEQ ID NO: 889627 - RNA, 22 nt, Human
auuucacaaagaacagaugcag

SEQ ID NO: 889628 - RNA, 22 nt, Human
ccaagcuacuuaggagucugag

SEQ ID NO: 889629 - RNA, 22 nt, Human
auccugcugcuguggacuucuc

SEQ ID NO: 889630 - RNA, 22 nt, Human
cacauugcuccacaggguuaac

SEQ ID NO: 889631 - RNA, 22 nt, Human
ccuguuguggaaaaagccugau

SEQ ID NO: 889632 - RNA, 22 nt, Human
agaaaugugagccccuuaucaa

SEQ ID NO: 889633 - RNA, 22 nt, Human
uuugagaagcaucugguccacu

SEQ ID NO: 889634 - RNA, 22 nt, Human
aagaaggaaguguggacaucac

SEQ ID NO: 889635 - RNA, 22 nt, Human
uacuuacaguuacggcaagugg

SEQ ID NO: 889636 - RNA, 22 nt, Human
ugacagcauuacuaauacaugu

SEQ ID NO: 889637 - RNA, 22 nt, Human
agacaacuagaaaacuagacag

SEQ ID NO: 889638 - RNA, 22 nt, Human
cacaugcaucugucauguuugg

SEQ ID NO: 889639 - RNA, 22 nt, Human
ggcaggcugggagucaucagag

SEQ ID NO: 889640 - RNA, 22 nt, Human
auugagcaauaguguuugcagc

SEQ ID NO: 889641 - RNA, 22 nt, Human
aagacucuguaucaugagggag

SEQ ID NO: 889642 - RNA, 22 nt, Human
caggguggaaaagcuaguugga

SEQ ID NO: 889643 - RNA, 22 nt, Human
gaacauuuggauuuguaaauuu

SEQ ID NO: 889644 - RNA, 22 nt, Human
uucuggaguguauugggucugc

SEQ ID NO: 889645 - RNA, 19 nt, Human
augcuuuauguuauuucuu

SEQ ID NO: 889646 - RNA, 22 nt, Human
gcugcuggaacaaaucacccca

SEQ ID NO: 889647 - RNA, 21 nt, Human
uguucacauggagcagaaugu

SEQ ID NO: 889648 - RNA, 22 nt, Human
aggagaauuaggaacucaagau

SEQ ID NO: 889649 - RNA, 22 nt, Human
acaaggcauuccggaaguaacc

SEQ ID NO: 889650 - RNA, 22 nt, Human
uguucauuacccaucccagguc

SEQ ID NO: 889651 - RNA, 22 nt, Human
ucagaaauaaugaaugaugggg

SEQ ID NO: 889652 - RNA, 20 nt, Human
agaagccaagugacauguuu

SEQ ID NO: 889653 - RNA, 22 nt, Human
acagcagccugcagcccugugu

SEQ ID NO: 889654 - RNA, 22 nt, Human
gcacuugacccccagagcuggu

SEQ ID NO: 889655 - RNA, 22 nt, Human
gagggcuccucacauucucuau

SEQ ID NO: 889656 - RNA, 22 nt, Human
uaggcaaguugcccaaucucuc

SEQ ID NO: 889657 - RNA, 22 nt, Human
acuguaaauuuugguugcaggu

SEQ ID NO: 889658 - RNA, 22 nt, Human
augauguagacaaaaauaugcu

SEQ ID NO: 889659 - RNA, 22 nt, Human
aaagcauuauucuguggaaaaa

SEQ ID NO: 889660 - RNA, 22 nt, Human
agcagccaagguaaccugugcu

SEQ ID NO: 889661 - RNA, 18 nt, Human
acagugguuugaugugcu

SEQ ID NO: 889662 - RNA, 22 nt, Human
guuacaaaggaagcuucacugc

SEQ ID NO: 889663 - RNA, 22 nt, Human
uucugggcccacuguagcaucc

SEQ ID NO: 889664 - RNA, 20 nt, Human
agaaauaccacauuuggcaa

SEQ ID NO: 889665 - RNA, 22 nt, Human
ugggugugagcccgggagccgc

SEQ ID NO: 889666 - RNA, 22 nt, Human
cuggaggggcuggcaugguagc

SEQ ID NO: 889667 - RNA, 22 nt, Human
ggcuucuguccucuggaucugu

SEQ ID NO: 889668 - RNA, 22 nt, Human
caggcuaaagcuuugagcaugu

SEQ ID NO: 889669 - RNA, 22 nt, Human
gggagcuguaguccagauaccg

SEQ ID NO: 889670 - RNA, 22 nt, Human
ucagggcauguauguuucuuua

SEQ ID NO: 889671 - RNA, 22 nt, Human
cacuacagggguccacagcuga

SEQ ID NO: 889672 - RNA, 23 nt, Human
auauuuccagguuagugagguaa

SEQ ID NO: 889673 - RNA, 23 nt, Human
gaauggcuaagcacauagacuug

SEQ ID NO: 889674 - RNA, 22 nt, Human
aaacauguuuagaaagcagcug

SEQ ID NO: 889675 - RNA, 22 nt, Human
aacuucaaaugugacuuugcau

SEQ ID NO: 889676 - RNA, 22 nt, Human
ugaugcugcugggaguggugcu

SEQ ID NO: 889677 - RNA, 22 nt, Human
agggccaguauuaagguaauua

SEQ ID NO: 889678 - RNA, 22 nt, Human
aggccugggcaagaaggggcgu

SEQ ID NO: 889679 - RNA, 22 nt, Human
aacacauuuugccuaggcaaua

SEQ ID NO: 889680 - RNA, 22 nt, Human
guugaaacuuaguugaaauuua

SEQ ID NO: 889681 - RNA, 17 nt, Human
ggcagccucaggcguuu

SEQ ID NO: 889682 - RNA, 22 nt, Human
uccuguguuacugccuggagcg

SEQ ID NO: 889683 - RNA, 22 nt, Human
gauauuuuuaggugaugcaggc

SEQ ID NO: 889684 - RNA, 22 nt, Human
accaaaugcugacagcaugacu

SEQ ID NO: 889685 - RNA, 22 nt, Human
cgccugcucuguuuccaugugg

SEQ ID NO: 889686 - RNA, 22 nt, Human
gaggcccaggucaagcagccac

SEQ ID NO: 889687 - RNA, 22 nt, Human
aggcagcaugggcccagagucc

SEQ ID NO: 889688 - RNA, 22 nt, Human
auguucuauaucauuauuguga

SEQ ID NO: 889689 - RNA, 22 nt, Human
acagccuggacuggcucucugc

SEQ ID NO: 889690 - RNA, 22 nt, Human
cuccugagggaugcuuaggcuu

SEQ ID NO: 889691 - RNA, 22 nt, Human
aacauugaguuagggagcguau

SEQ ID NO: 889692 - RNA, 22 nt, Human
cagggcuggauuucauuucuag

SEQ ID NO: 889693 - RNA, 23 nt, Human
cagcuucuuugggauucuuuaua

SEQ ID NO: 889694 - RNA, 20 nt, Human
gcugucuggauuagaagccu

SEQ ID NO: 889695 - RNA, 22 nt, Human
cccagcacucagcaggcucaua

SEQ ID NO: 889696 - RNA, 22 nt, Human
uuaaauuauuucuagugaggug

SEQ ID NO: 889697 - RNA, 22 nt, Human
aggaagcuagagccaccggacu

SEQ ID NO: 889698 - RNA, 22 nt, Human
gacagcagggacauguaggaag

SEQ ID NO: 889699 - RNA, 22 nt, Human
uuccagcaggguacuuguaauu

SEQ ID NO: 889700 - RNA, 22 nt, Human
aggagagagaacacuugggucc

SEQ ID NO: 889701 - RNA, 22 nt, Human
agcuuuaccugccuuggggcac

SEQ ID NO: 889702 - RNA, 22 nt, Human
uguucauuacugcuguuugcca

SEQ ID NO: 889703 - RNA, 22 nt, Human
uucuguaucuuucuucaagauu

SEQ ID NO: 889704 - RNA, 22 nt, Human
uagacaggagucaggcuagaau

SEQ ID NO: 889705 - RNA, 22 nt, Human
ugcagcaguguuccuuggcuug

SEQ ID NO: 889706 - RNA, 22 nt, Human
gagggcugcaaugagacagaga

SEQ ID NO: 889707 - RNA, 22 nt, Human
ucuucaaaugcuaguaauauca

SEQ ID NO: 889708 - RNA, 22 nt, Human
auuggaacggcuccgcgucuga

SEQ ID NO: 889709 - RNA, 22 nt, Human
ccuggagccccucuggccagcc

SEQ ID NO: 889710 - RNA, 17 nt, Human
aggggagagugggaaga

SEQ ID NO: 889711 - RNA, 22 nt, Human
ccugaaauccauaguuuacacu

SEQ ID NO: 889712 - RNA, 23 nt, Human
uuggcagcgggucaggcuguggg

SEQ ID NO: 889713 - RNA, 22 nt, Human
uaggaaggccugucacuacuug

SEQ ID NO: 889714 - RNA, 22 nt, Human
ggcagugggaaauaagugagaa

SEQ ID NO: 889715 - RNA, 22 nt, Human
aaggcugauuagacugauagcu

SEQ ID NO: 889716 - RNA, 22 nt, Human
uuagaacacugagaaagugaug

SEQ ID NO: 889717 - RNA, 22 nt, Human
cuggccaguuacugcuauuggc

SEQ ID NO: 889718 - RNA, 22 nt, Human
ugaggggagaagcagcagccug

SEQ ID NO: 889719 - RNA, 22 nt, Human
ugcauguggaccccuggugccu

SEQ ID NO: 889720 - RNA, 22 nt, Human
gagugcaguaugagaggcugcu

SEQ ID NO: 889721 - RNA, 20 nt, Human
aggggccuggaacaggccuu

SEQ ID NO: 889722 - RNA, 22 nt, Human
uauuuugacuauuaaaccaaca

SEQ ID NO: 889723 - RNA, 22 nt, Human
cagcuccugaggacugcuggga

SEQ ID NO: 889724 - RNA, 22 nt, Human
uaaagcauguguuagaagugca

SEQ ID NO: 889725 - RNA, 22 nt, Human
gcucacugcaaccucugcuucc

SEQ ID NO: 889726 - RNA, 22 nt, Human
auagauacauuguuauauuugu

SEQ ID NO: 889727 - RNA, 22 nt, Human
gucugagggucaugggucucac

SEQ ID NO: 889728 - RNA, 22 nt, Human
agccuggcuuaauccuccuuuu

SEQ ID NO: 889729 - RNA, 22 nt, Human
gaaaaggauugguaaaauaucu

SEQ ID NO: 889730 - RNA, 22 nt, Human
acccagagcacugggugugggc

SEQ ID NO: 889731 - RNA, 21 nt, Human
ggccacaagcggaggagccgc

SEQ ID NO: 889732 - RNA, 22 nt, Human
acugggcaucccauggcagagc

SEQ ID NO: 889733 - RNA, 22 nt, Human
agacagacggcuuuauacacag

SEQ ID NO: 889734 - RNA, 22 nt, Human
acugagcucuagguuuugaacc

SEQ ID NO: 889735 - RNA, 19 nt, Human
agcagcaacuguugauuca

SEQ ID NO: 889736 - RNA, 22 nt, Human
ugcuccaggccgccuggggcug

SEQ ID NO: 889737 - RNA, 22 nt, Human
caggcacacauccgugagagau

SEQ ID NO: 889738 - RNA, 22 nt, Human
uucauuacugcgguagucacac

SEQ ID NO: 889739 - RNA, 22 nt, Human
ggcugguccuuucucuguccua

SEQ ID NO: 889740 - RNA, 21 nt, Human
aguacaucucaaauguaaauc

SEQ ID NO: 889741 - RNA, 22 nt, Human
caagaacauugugaucacuuca

SEQ ID NO: 889742 - RNA, 22 nt, Human
uggcagugucuuaucaggagug

SEQ ID NO: 889743 - RNA, 22 nt, Human
ugggaaugggccuagaaggcug

SEQ ID NO: 889744 - RNA, 21 nt, Human
ccuuggcuggcaucuagcacc

SEQ ID NO: 889745 - RNA, 22 nt, Human
uguguguguccucauuugcaga

SEQ ID NO: 889746 - RNA, 22 nt, Human
uucuucagggaagcuuguuaau

SEQ ID NO: 889747 - RNA, 23 nt, Human
acaggaggggacagguggccgug

SEQ ID NO: 889748 - RNA, 22 nt, Human
uccaggaggcaccuuuggacca

SEQ ID NO: 889749 - RNA, 22 nt, Human
caccaggagccaucaggagucc

SEQ ID NO: 889750 - RNA, 20 nt, Human
aagcacauuucuacaauaau

SEQ ID NO: 889751 - RNA, 22 nt, Human
cugagaguguggcuuccaggcc

SEQ ID NO: 889752 - RNA, 22 nt, Human
uuguucuuggagcaggcagaga

SEQ ID NO: 889753 - RNA, 20 nt, Human
cugcccacuagaacuaccug

SEQ ID NO: 889754 - RNA, 20 nt, Human
uuuaucaggcacuuacuauu

SEQ ID NO: 889755 - RNA, 21 nt, Human
uucuucaguuuaauauaaaau

SEQ ID NO: 889756 - RNA, 22 nt, Human
ucuaaggagccaggacuauuag

SEQ ID NO: 889757 - RNA, 22 nt, Human
uacagggauuguuuuaaucacc

SEQ ID NO: 889758 - RNA, 22 nt, Human
auccuucuucugcuagugucua

SEQ ID NO: 889759 - RNA, 22 nt, Human
aggcugcccugccgccaguggg

SEQ ID NO: 889760 - RNA, 22 nt, Human
agucccagugacuuggccagaa

SEQ ID NO: 889761 - RNA, 17 nt, Human
agagagaaaagggccau

SEQ ID NO: 889762 - RNA, 22 nt, Human
agcggcuggaccagcguucaag

SEQ ID NO: 889763 - RNA, 22 nt, Human
aaugugcaggcucaaaccuugu

SEQ ID NO: 889764 - RNA, 22 nt, Human
gaggcucccaaggggcuaggcc

SEQ ID NO: 889765 - RNA, 22 nt, Human
uuucugcugugcuuucuugcgu

SEQ ID NO: 889766 - RNA, 22 nt, Human
gcccacacaccagcucaggagg

SEQ ID NO: 889767 - RNA, 22 nt, Human
caccugccugcaggggcuccac

SEQ ID NO: 889768 - RNA, 22 nt, Human
ggcugccaggagggaggccagu

SEQ ID NO: 889769 - RNA, 22 nt, Human
guggcuucuucuugggagcugc

SEQ ID NO: 889770 - RNA, 22 nt, Human
ucucaaauucccuuuuccuccu

SEQ ID NO: 889771 - RNA, 22 nt, Human
ggugggagagcucugucuccag

SEQ ID NO: 889772 - RNA, 20 nt, Human
gccugcagagaaggucagag

SEQ ID NO: 889773 - RNA, 22 nt, Human
ugccuuagagcacucaagagug

SEQ ID NO: 889774 - RNA, 18 nt, Human
agcucuggggagaugggc

SEQ ID NO: 889775 - RNA, 22 nt, Human
agcaccuugagaucaagcagug

SEQ ID NO: 889776 - RNA, 22 nt, Human
cagucccugggggagucaccag

SEQ ID NO: 889777 - RNA, 22 nt, Human
ggucuggccaauagacagcccc

SEQ ID NO: 889778 - RNA, 22 nt, Human
ugggguacuuguaucaaagcac

SEQ ID NO: 889779 - RNA, 22 nt, Human
aagauuuccuucaguagagcua

SEQ ID NO: 889780 - RNA, 22 nt, Human
uaucuagcaaguaacaugcuga

SEQ ID NO: 889781 - RNA, 22 nt, Human
agaaauguugaauacaucagga

SEQ ID NO: 889782 - RNA, 22 nt, Human
caugaucugguccuacuguggg

SEQ ID NO: 889783 - RNA, 22 nt, Human
agacucuuggucauuggcauua

SEQ ID NO: 889784 - RNA, 22 nt, Human
cagcagcugccucagcugggga

SEQ ID NO: 889785 - RNA, 22 nt, Human
gcagggcagggcaagaacuggg

SEQ ID NO: 889786 - RNA, 22 nt, Human
ucacagcuuugagcagagacca

SEQ ID NO: 889787 - RNA, 22 nt, Human
uggcagaggcucugugauguug

SEQ ID NO: 889788 - RNA, 22 nt, Human
cucugagaauaugagcucuuug

SEQ ID NO: 889789 - RNA, 22 nt, Human
gcagcuguaaagcagaaauagu

SEQ ID NO: 889790 - RNA, 22 nt, Human
gcagggaaguuguaauguaaug

SEQ ID NO: 889791 - RNA, 22 nt, Human
gcccucagaguuccccacagug

SEQ ID NO: 889792 - RNA, 20 nt, Human
cucuucaaauauuuuauucu

SEQ ID NO: 889793 - RNA, 22 nt, Human
gaggucaggcucaagcugggcc

SEQ ID NO: 889794 - RNA, 22 nt, Human
acacaauacagggcucaaaaua

SEQ ID NO: 889795 - RNA, 22 nt, Human
agggaaggaggccauguguccc

SEQ ID NO: 889796 - RNA, 17 nt, Human
ccugaaggcacuuccag

SEQ ID NO: 889797 - RNA, 22 nt, Human
gccagccaguuugcugauggcu

SEQ ID NO: 889798 - RNA, 22 nt, Human
cuguggcuaugguguacauacu

SEQ ID NO: 889799 - RNA, 22 nt, Human
aacaaauuaguugcaagacugg

SEQ ID NO: 889800 - RNA, 22 nt, Human
cuggagcugguauagggacaaa

SEQ ID NO: 889801 - RNA, 22 nt, Human
cucaucugucugggcugguuuu

SEQ ID NO: 889802 - RNA, 22 nt, Human
gacagcuguggagaggcaugug

SEQ ID NO: 889803 - RNA, 22 nt, Human
uuauaaagauccuuccagaguu

SEQ ID NO: 889804 - RNA, 22 nt, Human
ccuuaucacaauggagugucac

SEQ ID NO: 889805 - RNA, 22 nt, Human
cuccagcaggugcgucucagag

SEQ ID NO: 889806 - RNA, 22 nt, Human
gccuguguggaugggccccugg

SEQ ID NO: 889807 - RNA, 22 nt, Human
uuauguaggauaaugaauugcc

SEQ ID NO: 889808 - RNA, 22 nt, Human
ugaaaaacuuuaauccauaaag

SEQ ID NO: 889809 - RNA, 22 nt, Human
cacugugucaguuugguuagac

SEQ ID NO: 889810 - RNA, 22 nt, Human
gucuuggccgugcagaugaaga

SEQ ID NO: 889811 - RNA, 22 nt, Human
cacaugugugcugaggacugug

SEQ ID NO: 889812 - RNA, 22 nt, Human
ugguaagaauaggggcuuugga

SEQ ID NO: 889813 - RNA, 22 nt, Human
agcagaugagccucaugacugg

SEQ ID NO: 889814 - RNA, 22 nt, Human
ugagguaguuuguuguacagua

SEQ ID NO: 889815 - RNA, 22 nt, Human
gaauagaugaaagugucucuua

SEQ ID NO: 889816 - RNA, 22 nt, Human
cugaagcaaaugaaacagcucu

SEQ ID NO: 889817 - RNA, 19 nt, Human
ugucaguaguugucuaggg

SEQ ID NO: 889818 - RNA, 22 nt, Human
gagaccaggaaguacagcagcc

SEQ ID NO: 889819 - RNA, 22 nt, Human
gugucccaggagaggagacaau

SEQ ID NO: 889820 - RNA, 19 nt, Human
cuucuucuuggcagccaag

SEQ ID NO: 889821 - RNA, 18 nt, Human
aagcucuuaaaugguuca

SEQ ID NO: 889822 - RNA, 22 nt, Human
gggcauggccaggugagggguc

SEQ ID NO: 889823 - RNA, 22 nt, Human
agagccucugucauggagagaa

SEQ ID NO: 889824 - RNA, 22 nt, Human
acagugugugcuuucccuuacg

SEQ ID NO: 889825 - RNA, 22 nt, Human
cagcagaguauggcacucaacu

SEQ ID NO: 889826 - RNA, 22 nt, Human
aaagcugggggcccuggucuag

SEQ ID NO: 889827 - RNA, 22 nt, Human
guguggcuguuuagugacuuuc

SEQ ID NO: 889828 - RNA, 22 nt, Human
guguuaaaaaucccaugauaug

SEQ ID NO: 889829 - RNA, 22 nt, Human
gcagggagguuugcugaccugg

SEQ ID NO: 889830 - RNA, 22 nt, Human
aaugucugaaaaucagacugca

SEQ ID NO: 889831 - RNA, 22 nt, Human
cagugccaaggagaaggacagc

SEQ ID NO: 889832 - RNA, 22 nt, Human
aaggcaauaguauuaaacugga

SEQ ID NO: 889833 - RNA, 22 nt, Human
agacuaagcgguucuuuucaau

SEQ ID NO: 889834 - RNA, 22 nt, Human
ucagaacagcucucagauaucc

SEQ ID NO: 889835 - RNA, 22 nt, Human
ucugccuuagcaauugucaagg

SEQ ID NO: 889836 - RNA, 22 nt, Human
uugcagggcaaauggucagaua

SEQ ID NO: 889837 - RNA, 22 nt, Human
aaauguuccuuuggauuaaacu

SEQ ID NO: 889838 - RNA, 22 nt, Human
augaacaauaaucaugucuaug

SEQ ID NO: 889839 - RNA, 15 nt, Human
ggaggccaggcugug

SEQ ID NO: 889840 - RNA, 22 nt, Human
aguuucuaacauauagcauugg

SEQ ID NO: 889841 - RNA, 22 nt, Human
caaguuuugcauaguucuguau

SEQ ID NO: 889842 - RNA, 18 nt, Human
cagagcagagguggagcg

SEQ ID NO: 889843 - RNA, 22 nt, Human
aggugaguccugggcacaggua

SEQ ID NO: 889844 - RNA, 22 nt, Human
aaaggacacacaggaggugucu

SEQ ID NO: 889845 - RNA, 22 nt, Human
ugauuauauuaacuauguuccu

SEQ ID NO: 889846 - RNA, 22 nt, Human
agcaugcauuuuuggacugugc

SEQ ID NO: 889847 - RNA, 22 nt, Human
uguacauacauagauauacaca

SEQ ID NO: 889848 - RNA, 22 nt, Human
aggcccugcccagagcuccucg

SEQ ID NO: 889849 - RNA, 22 nt, Human
cugugugugucugcagcauacu

SEQ ID NO: 889850 - RNA, 22 nt, Human
ugcagccuuuagaaguucagau

SEQ ID NO: 889851 - RNA, 22 nt, Human
ucuuuacaguccucugucaauc

SEQ ID NO: 889852 - RNA, 20 nt, Human
ucagagaaggagcuuuccug

SEQ ID NO: 889853 - RNA, 22 nt, Human
ccaggcuguuuucaaacuuggg

SEQ ID NO: 889854 - RNA, 22 nt, Human
auguaaacuuuaccagcucuga

SEQ ID NO: 889855 - RNA, 22 nt, Human
auuuaaauuuucugauggagag

SEQ ID NO: 889856 - RNA, 22 nt, Human
uccaggggagacuagacccaca

SEQ ID NO: 889857 - RNA, 22 nt, Human
ccaggaagacacaugcucaucc

SEQ ID NO: 889858 - RNA, 22 nt, Human
agcagcaggcugggaugagucu

SEQ ID NO: 889859 - RNA, 22 nt, Human
uguguucaaugacuucaucuuu

SEQ ID NO: 889860 - RNA, 22 nt, Human
uagggaaguguauaggggucau

SEQ ID NO: 889861 - RNA, 22 nt, Human
uuauuuccaaacuggauauacc

SEQ ID NO: 889862 - RNA, 22 nt, Human
ugcagcucugggguaaggggug

SEQ ID NO: 889863 - RNA, 22 nt, Human
auauuauucuaguaacagugau

SEQ ID NO: 889864 - RNA, 22 nt, Human
agcucccugcacgacccugccc

SEQ ID NO: 889865 - RNA, 22 nt, Human
uaccagcaacuggaagucagau

SEQ ID NO: 889866 - RNA, 22 nt, Human
auacuaaaguauagaacuuagu

SEQ ID NO: 889867 - RNA, 22 nt, Human
cccagacuccucuggcuggugg

SEQ ID NO: 889868 - RNA, 22 nt, Human
uguccccaagguucagcccaca

SEQ ID NO: 889869 - RNA, 22 nt, Human
aaaucuguuucucauaggguag

SEQ ID NO: 889870 - RNA, 22 nt, Human
ugcuccagggcugccagacccu

SEQ ID NO: 889871 - RNA, 22 nt, Human
acaaauagguagauuugcaaca

SEQ ID NO: 889872 - RNA, 22 nt, Human
gcugggaggaucucucccuguc

SEQ ID NO: 889873 - RNA, 22 nt, Human
augcaaucauauggcauacagc

SEQ ID NO: 889874 - RNA, 22 nt, Human
ugaugugugggcaugcagacag

SEQ ID NO: 889875 - RNA, 22 nt, Human
cucccucauauacccagcgaga

SEQ ID NO: 889876 - RNA, 22 nt, Human
uauuucuugaguggucaguuuc

SEQ ID NO: 889877 - RNA, 22 nt, Human
uggucccuaggaaagcaguguu

SEQ ID NO: 889878 - RNA, 22 nt, Human
ccugaguuaguugcugugucuc

SEQ ID NO: 889879 - RNA, 22 nt, Human
acauaugugcuuauauccauga

SEQ ID NO: 889880 - RNA, 22 nt, Human
agucuagauccccagugcuguc

SEQ ID NO: 889881 - RNA, 22 nt, Human
cagggccuguacaagucccacc

SEQ ID NO: 889882 - RNA, 23 nt, Human
acagugaaacacgcaguaagagu

SEQ ID NO: 889883 - RNA, 22 nt, Human
accagcugaguaggggagggcc

SEQ ID NO: 889884 - RNA, 22 nt, Human
ugggagcaccuugagggcagaa

SEQ ID NO: 889885 - RNA, 22 nt, Human
gugaagagcuguugcagagauu

SEQ ID NO: 889886 - RNA, 22 nt, Human
uccucuggggcgugguccugga

SEQ ID NO: 889887 - RNA, 20 nt, Human
cugcaggguuagaggcucca

SEQ ID NO: 889888 - RNA, 23 nt, Human
uacauucuguauuuuuauagagu

SEQ ID NO: 889889 - RNA, 22 nt, Human
uuagaacauuccaucacugggu

SEQ ID NO: 889890 - RNA, 22 nt, Human
cugcagggagguuccuuguucu

SEQ ID NO: 889891 - RNA, 22 nt, Human
ucagggagagccugucugacgu

SEQ ID NO: 889892 - RNA, 22 nt, Human
ggcugccauaacugauaccaua

SEQ ID NO: 889893 - RNA, 21 nt, Human
agacuucuagaagugagauag

SEQ ID NO: 889894 - RNA, 19 nt, Human
uuuuuaaugggcuggagca

SEQ ID NO: 889895 - RNA, 22 nt, Human
aggaacugauuuauaacuuuag

SEQ ID NO: 889896 - RNA, 22 nt, Human
ccaggccuggccaggggaugcc

SEQ ID NO: 889897 - RNA, 20 nt, Human
aaagagaagccucaccuugu

SEQ ID NO: 889898 - RNA, 22 nt, Human
ccagcuggcaggagagucaggg

SEQ ID NO: 889899 - RNA, 23 nt, Human
cuagggcaguauuucacagacac

SEQ ID NO: 889900 - RNA, 22 nt, Human
uaggccaguugguggcccugga

SEQ ID NO: 889901 - RNA, 22 nt, Human
caggagaaacauaauuuucugg

SEQ ID NO: 889902 - RNA, 22 nt, Human
aguguuucaagugaugcuuugg

SEQ ID NO: 889903 - RNA, 22 nt, Human
uucugacaguaaucaguuugcu

SEQ ID NO: 889904 - RNA, 22 nt, Human
uugagguaguggccuccaaaug

SEQ ID NO: 889905 - RNA, 22 nt, Human
auguuauggcucaaacauuugg

SEQ ID NO: 889906 - RNA, 18 nt, Human
ugaucuuugaguauaaug

SEQ ID NO: 889907 - RNA, 22 nt, Human
caaauccugcagggcuuagaug

SEQ ID NO: 889908 - RNA, 23 nt, Human
uggcuggcgccugccucacccug

SEQ ID NO: 889909 - RNA, 22 nt, Human
acagugcugaucuagacugacc

SEQ ID NO: 889910 - RNA, 22 nt, Human
acaguaaucauaugauuuucuc

SEQ ID NO: 889911 - RNA, 22 nt, Human
cacacaguaguaugaggcaaaa

SEQ ID NO: 889912 - RNA, 22 nt, Human
uuggauccaucucaggcauagg

SEQ ID NO: 889913 - RNA, 22 nt, Human
cccugagccacacagagcaggu

SEQ ID NO: 889914 - RNA, 22 nt, Human
cuggagcccugaaugggcagga

SEQ ID NO: 889915 - RNA, 22 nt, Human
agugaaauaugcccauugcugu

SEQ ID NO: 889916 - RNA, 22 nt, Human
agaggaaguaaucaggaccugc

SEQ ID NO: 889917 - RNA, 22 nt, Human
auugcugugaugauguucugag

SEQ ID NO: 889918 - RNA, 23 nt, Human
cucugcaggagagugggcagggc

SEQ ID NO: 889919 - RNA, 23 nt, Human
auguuuuaugucucuagcugcca

SEQ ID NO: 889920 - RNA, 20 nt, Human
ugguggagagaagcuauuug

SEQ ID NO: 889921 - RNA, 22 nt, Human
uugcucugaaccacaccaucac

SEQ ID NO: 889922 - RNA, 22 nt, Human
gcacaacaccaagggagguauc

SEQ ID NO: 889923 - RNA, 22 nt, Human
uaaaauagaggaugucaugcua

SEQ ID NO: 889924 - RNA, 22 nt, Human
aaaauagcauauugcuuucuuu

SEQ ID NO: 889925 - RNA, 22 nt, Human
uucaggagugucaggagugccu

SEQ ID NO: 889926 - RNA, 22 nt, Human
uuucuucucugauuaaggcuca

SEQ ID NO: 889927 - RNA, 22 nt, Human
gcccugaaggcagagguggagc

SEQ ID NO: 889928 - RNA, 22 nt, Human
cucuccacucagcgucaugucc

SEQ ID NO: 889929 - RNA, 21 nt, Human
uaacacauuuugguacuuugg

SEQ ID NO: 889930 - RNA, 22 nt, Human
aacaauuacuaccaaggccugu

SEQ ID NO: 889931 - RNA, 20 nt, Human
auacacauauucuugcaacu

SEQ ID NO: 889932 - RNA, 20 nt, Human
ucagacagucgcaguucugg

SEQ ID NO: 889933 - RNA, 22 nt, Human
cucuugaaaauuggaacacaga

SEQ ID NO: 889934 - RNA, 22 nt, Human
ucuauguugugugucacacaga

SEQ ID NO: 889935 - RNA, 22 nt, Human
cugugucucuaccuccccaucc

SEQ ID NO: 889936 - RNA, 22 nt, Human
guguuaaacauguucacagcau

SEQ ID NO: 889937 - RNA, 22 nt, Human
cauuucuagggaucauaaagua

SEQ ID NO: 889938 - RNA, 22 nt, Human
ugggcacauaguuuuaugguca

SEQ ID NO: 889939 - RNA, 22 nt, Human
agccccaguccgcugcgggcgg

SEQ ID NO: 889940 - RNA, 22 nt, Human
auguggcugguaguugacaacu

SEQ ID NO: 889941 - RNA, 22 nt, Human
gccaguuccuguggagucagag

SEQ ID NO: 889942 - RNA, 22 nt, Human
ggcaggugccuucugugcuagc

SEQ ID NO: 889943 - RNA, 22 nt, Human
guuucauaggcaugugaccuau

SEQ ID NO: 889944 - RNA, 22 nt, Human
uggcaggaaaguaacagagcac

SEQ ID NO: 889945 - RNA, 22 nt, Human
ggucacaggggagaagagugau

SEQ ID NO: 889946 - RNA, 22 nt, Human
cagagccucucagaggucagac

SEQ ID NO: 889947 - RNA, 22 nt, Human
cacacaggagagugcuggaggu

SEQ ID NO: 889948 - RNA, 22 nt, Human
uaucaauugggccaaaugguac

SEQ ID NO: 889949 - RNA, 22 nt, Human
ccagguccuguuuucaccacag

SEQ ID NO: 889950 - RNA, 22 nt, Human
cuucucucggugcaucccucac

SEQ ID NO: 889951 - RNA, 22 nt, Human
uggcagcagcuaacuuaggcag

SEQ ID NO: 889952 - RNA, 22 nt, Human
agucuuagaacuacagugccua

SEQ ID NO: 889953 - RNA, 22 nt, Human
cuauacagcagcuuacuaguua

SEQ ID NO: 889954 - RNA, 22 nt, Human
ugugccugaguuggcugaguac

SEQ ID NO: 889955 - RNA, 21 nt, Human
agaagccugaugaggucugcu

SEQ ID NO: 889956 - RNA, 22 nt, Human
gagcaagguagcucucuggggc

SEQ ID NO: 889957 - RNA, 19 nt, Human
auauacauacugugugcau

SEQ ID NO: 889958 - RNA, 22 nt, Human
cuagugcucuaggggcugaagg

SEQ ID NO: 889959 - RNA, 22 nt, Human
ccugagaccaaguugcagccau

SEQ ID NO: 889960 - RNA, 22 nt, Human
cucaucagaaauaccugacaaa

SEQ ID NO: 889961 - RNA, 22 nt, Human
uuucucauggcccuuggcuuuu

SEQ ID NO: 889962 - RNA, 22 nt, Human
accaaauauaucuuuugaccug

SEQ ID NO: 889963 - RNA, 22 nt, Human
guucuucagucacaucacagaa

SEQ ID NO: 889964 - RNA, 22 nt, Human
agggaagaagcugguaguaggu

SEQ ID NO: 889965 - RNA, 22 nt, Human
uugauuuuaaaauagugacacu

SEQ ID NO: 889966 - RNA, 22 nt, Human
uauuuuaucugccagaguggag

SEQ ID NO: 889967 - RNA, 17 nt, Human
ggcagggugcuggguau

SEQ ID NO: 889968 - RNA, 22 nt, Human
uauguacaaucagcaguucaua

SEQ ID NO: 889969 - RNA, 22 nt, Human
uaggaaugucuaugcagugagg

SEQ ID NO: 889970 - RNA, 17 nt, Human
caguggcagaucuucuc

SEQ ID NO: 889971 - RNA, 23 nt, Human
cagaagcaccuguugacugcugc

SEQ ID NO: 889972 - RNA, 22 nt, Human
cacagcuuagaaaagaagccau

SEQ ID NO: 889973 - RNA, 17 nt, Human
cuguggccaccuggaug

SEQ ID NO: 889974 - RNA, 22 nt, Human
ggcagcaauucuucagaaucau

SEQ ID NO: 889975 - RNA, 22 nt, Human
cagcuuuagagaaaacauauuu

SEQ ID NO: 889976 - RNA, 22 nt, Human
ucacaacugggugucuucauca

SEQ ID NO: 889977 - RNA, 22 nt, Human
uagagcugaguugacuccauuu

SEQ ID NO: 889978 - RNA, 22 nt, Human
acagaaugcagagaugcccaga

SEQ ID NO: 889979 - RNA, 22 nt, Human
agcaguggagcgagauguuuaa

SEQ ID NO: 889980 - RNA, 19 nt, Human
agcagcuuaauuuuguagc

SEQ ID NO: 889981 - RNA, 22 nt, Human
caguggaggcucaagugugcuu

SEQ ID NO: 889982 - RNA, 22 nt, Human
uaguucuauaagcagauagagu

SEQ ID NO: 889983 - RNA, 22 nt, Human
aagauacauauuuguucuagug

SEQ ID NO: 889984 - RNA, 22 nt, Human
cucuagaacugauugggaagaa

SEQ ID NO: 889985 - RNA, 22 nt, Human
agcugcagccgcagcuguggcc

SEQ ID NO: 889986 - RNA, 22 nt, Human
uaauugcugaacuacuaucccu

SEQ ID NO: 889987 - RNA, 22 nt, Human
ucucugaauuguuuaaguuauu

SEQ ID NO: 889988 - RNA, 21 nt, Human
uacauuugagagcuauaagcu

SEQ ID NO: 889989 - RNA, 22 nt, Human
cagaaggcauagaugaaggccu

SEQ ID NO: 889990 - RNA, 19 nt, Human
auuuggaaauaaggucuuc

SEQ ID NO: 889991 - RNA, 23 nt, Human
aagguauuuauuuuaaagguaag

SEQ ID NO: 889992 - RNA, 23 nt, Human
uacuuaggaauggggacggcaag

SEQ ID NO: 889993 - RNA, 22 nt, Human
gaaguuuagaguguuguaauuu

SEQ ID NO: 889994 - RNA, 22 nt, Human
acucugggaucuugaaaagagu

SEQ ID NO: 889995 - RNA, 22 nt, Human
agacucugauaagcaacucuug

SEQ ID NO: 889996 - RNA, 22 nt, Human
cucuggugucuccccuaagcua

SEQ ID NO: 889997 - RNA, 17 nt, Human
uacaaugugauucaauc

SEQ ID NO: 889998 - RNA, 22 nt, Human
gcgcgggguacacgcgguggcc

SEQ ID NO: 889999 - RNA, 22 nt, Human
uuugugaacuuaggcaauuagg

SEQ ID NO: 890000 - RNA, 22 nt, Human
agagggcauuaacucugucuug

SEQ ID NO: 890001 - RNA, 22 nt, Human
uugagggacagaggugcugucu

SEQ ID NO: 890002 - RNA, 22 nt, Human
ccaccaggcacucacagggaag

SEQ ID NO: 890003 - RNA, 20 nt, Human
aacaaucuagaagcuauucu

SEQ ID NO: 890004 - RNA, 22 nt, Human
agcagcagauccaaaaaaugug

SEQ ID NO: 890005 - RNA, 21 nt, Human
guuugcaguugaguccuuccc

SEQ ID NO: 890006 - RNA, 22 nt, Human
agagacaaugccaaugcacacg

SEQ ID NO: 890007 - RNA, 22 nt, Human
uaggaaacaaaguggaugaaau

SEQ ID NO: 890008 - RNA, 22 nt, Human
aguauuuccuggcuuaucugcu

SEQ ID NO: 890009 - RNA, 21 nt, Human
aucugaaguuugagaggaaag

SEQ ID NO: 890010 - RNA, 22 nt, Human
cagaggcuucaagucauucucc

SEQ ID NO: 890011 - RNA, 22 nt, Human
cagcaggaggcauggcuucccu

SEQ ID NO: 890012 - RNA, 22 nt, Human
ucagcuguuuugaguuuaauug

SEQ ID NO: 890013 - RNA, 18 nt, Human
guccauggccuccaccca

SEQ ID NO: 890014 - RNA, 22 nt, Human
agaaucuacauuuuaacaagau

SEQ ID NO: 890015 - RNA, 22 nt, Human
uucacaggcuuggagguggggg

SEQ ID NO: 890016 - RNA, 22 nt, Human
ugccgugcccauauugugggug

SEQ ID NO: 890017 - RNA, 22 nt, Human
gcaggagucacugacuuggucc

SEQ ID NO: 890018 - RNA, 22 nt, Human
aaugaaacaauuagcuguaaua

SEQ ID NO: 890019 - RNA, 22 nt, Human
aaucacaguggguacuagauug

SEQ ID NO: 890020 - RNA, 21 nt, Human
caggccgggugagcaggcagc

SEQ ID NO: 890021 - RNA, 22 nt, Human
cugucacugaugcuccugccac

SEQ ID NO: 890022 - RNA, 22 nt, Human
acaugcuacacagagcuccucg

SEQ ID NO: 890023 - RNA, 22 nt, Human
aaguguuuaaugguuuugauga

SEQ ID NO: 890024 - RNA, 22 nt, Human
uguccaaugcccuuuccacaug

SEQ ID NO: 890025 - RNA, 22 nt, Human
aguuaacacagucaggaguaac

SEQ ID NO: 890026 - RNA, 20 nt, Human
acacauauagcagcauaaac

SEQ ID NO: 890027 - RNA, 22 nt, Human
ugcuagggaagaacgagggaau

SEQ ID NO: 890028 - RNA, 22 nt, Human
auccauuugaaagaacagucca

SEQ ID NO: 890029 - RNA, 22 nt, Human
augguugagaagguaagguacc

SEQ ID NO: 890030 - RNA, 22 nt, Human
uuuuuggcccuuagcucuguau

SEQ ID NO: 890031 - RNA, 22 nt, Human
auagcauauaaguuauaaaacu

SEQ ID NO: 890032 - RNA, 22 nt, Human
cucuccugguguggaggacagg

SEQ ID NO: 890033 - RNA, 22 nt, Human
uauuuagaggagaaaaguggcu

SEQ ID NO: 890034 - RNA, 22 nt, Human
uugugcuaagcaauuugcuuaa

SEQ ID NO: 890035 - RNA, 22 nt, Human
auggaaagggaagcaaggaaca

SEQ ID NO: 890036 - RNA, 22 nt, Human
uuacaguauuguuaaacucuuu

SEQ ID NO: 890037 - RNA, 20 nt, Human
ucccucaguuuccagcccug

SEQ ID NO: 890038 - RNA, 21 nt, Human
agcagcaaccacauaguuuuu

SEQ ID NO: 890039 - RNA, 22 nt, Human
cuguggcuccauagaaguugca

SEQ ID NO: 890040 - RNA, 22 nt, Human
ggcacuggguuguaggaauuaa

SEQ ID NO: 890041 - RNA, 22 nt, Human
cagggaagagccgaugcugcag

SEQ ID NO: 890042 - RNA, 22 nt, Human
gaagaauauggcucucagcaau

SEQ ID NO: 890043 - RNA, 22 nt, Human
caagauuuauauuuucacacaa

SEQ ID NO: 890044 - RNA, 22 nt, Human
aaacaguuuuuuaagucucuag

SEQ ID NO: 890045 - RNA, 22 nt, Human
agaccugggugcccugugcuuu

SEQ ID NO: 890046 - RNA, 22 nt, Human
aagggagccaagaaagcagggc

SEQ ID NO: 890047 - RNA, 21 nt, Human
gaggaaaugcucugguguuca

SEQ ID NO: 890048 - RNA, 22 nt, Human
uuguaacagcugcuuaauagag

SEQ ID NO: 890049 - RNA, 22 nt, Human
uacugauaagaguuguaggagu

SEQ ID NO: 890050 - RNA, 22 nt, Human
auguuuacaaaaaggaggcuug

SEQ ID NO: 890051 - RNA, 22 nt, Human
cucugggugugacagcaccugg

SEQ ID NO: 890052 - RNA, 22 nt, Human
auaauaaaccaggaugggucug

SEQ ID NO: 890053 - RNA, 22 nt, Human
uuagaaccacugaagacucaca

SEQ ID NO: 890054 - RNA, 22 nt, Human
uuaaucaagaguggggacugug

SEQ ID NO: 890055 - RNA, 22 nt, Human
gucuggcucaguccuagcugua

SEQ ID NO: 890056 - RNA, 22 nt, Human
ccucaaauugucaaauaagaau

SEQ ID NO: 890057 - RNA, 22 nt, Human
accuugggcaaccugcuccugc

SEQ ID NO: 890058 - RNA, 20 nt, Human
aggagggaccuggauuggcg

SEQ ID NO: 890059 - RNA, 22 nt, Human
aucuagauuagguauaagagcu

SEQ ID NO: 890060 - RNA, 22 nt, Human
uuguuucuuugaaguuucuaga

SEQ ID NO: 890061 - RNA, 22 nt, Human
uccugcagaccucagucagguc

SEQ ID NO: 890062 - RNA, 22 nt, Human
aacuucauguaauuuaaaacag

SEQ ID NO: 890063 - RNA, 22 nt, Human
uccucugccaaagggaguugcc

SEQ ID NO: 890064 - RNA, 22 nt, Human
ugugaggaacaggacuagagca

SEQ ID NO: 890065 - RNA, 22 nt, Human
auaugaaaguaagcaugugugu

SEQ ID NO: 890066 - RNA, 22 nt, Human
ucugacagguugggauauggaa

SEQ ID NO: 890067 - RNA, 20 nt, Human
uauuuguauuugggaaaguu

SEQ ID NO: 890068 - RNA, 22 nt, Human
uggcuucuugggaugggucauu

SEQ ID NO: 890069 - RNA, 22 nt, Human
ucugucaccccuguuucuggcu

SEQ ID NO: 890070 - RNA, 22 nt, Human
caggaccuggaaugcuugugaa

SEQ ID NO: 890071 - RNA, 22 nt, Human
aguggcagcugucaugcccuag

SEQ ID NO: 890072 - RNA, 22 nt, Human
agagacuggagaugggcagugu

SEQ ID NO: 890073 - RNA, 22 nt, Human
uggagugggcaauguaggcaag

SEQ ID NO: 890074 - RNA, 22 nt, Human
ucaaaaguuucacauagagaua

SEQ ID NO: 890075 - RNA, 22 nt, Human
agauugggauuagagaucugua

SEQ ID NO: 890076 - RNA, 22 nt, Human
uagcuucuaauacuuaccaauu

SEQ ID NO: 890077 - RNA, 22 nt, Human
aagcugccugggaggaagggcu

SEQ ID NO: 890078 - RNA, 22 nt, Human
uguccuuuuccccaaauucacu

SEQ ID NO: 890079 - RNA, 22 nt, Human
aagaacauugauauugucuaug

SEQ ID NO: 890080 - RNA, 22 nt, Human
ugggugaggaugaugaggcagc

SEQ ID NO: 890081 - RNA, 17 nt, Human
gggaaguggagaaagcu

SEQ ID NO: 890082 - RNA, 22 nt, Human
gaagggaauuuggaggguuuca

SEQ ID NO: 890083 - RNA, 22 nt, Human
cauucauaggaggagaugauua

SEQ ID NO: 890084 - RNA, 22 nt, Human
cuggaggagcauggacuggagu

SEQ ID NO: 890085 - RNA, 18 nt, Human
ucuuggaguaaugaucaa

SEQ ID NO: 890086 - RNA, 22 nt, Human
cuggccuggcagggagggcaug

SEQ ID NO: 890087 - RNA, 22 nt, Human
ggacauuuagaacagaguauuu

SEQ ID NO: 890088 - RNA, 22 nt, Human
aggaagugggaagggucugcca

SEQ ID NO: 890089 - RNA, 20 nt, Human
uauuuacaacuuagagccuc

SEQ ID NO: 890090 - RNA, 22 nt, Human
auuuggaagguuuacaaagaga

SEQ ID NO: 890091 - RNA, 17 nt, Human
cugggccucugcccuuu

SEQ ID NO: 890092 - RNA, 22 nt, Human
aggaugagauugcuguguugua

SEQ ID NO: 890093 - RNA, 21 nt, Human
ccaggaaggacugagcucccu

SEQ ID NO: 890094 - RNA, 22 nt, Human
agccugugaaaucucugccacu

SEQ ID NO: 890095 - RNA, 22 nt, Human
ucuuuuaucuguuguguaacaa

SEQ ID NO: 890096 - RNA, 22 nt, Human
uguuuugugcacuucuauagca

SEQ ID NO: 890097 - RNA, 22 nt, Human
cagagagcacauaggauacuuu

SEQ ID NO: 890098 - RNA, 22 nt, Human
uggaguggacuucaugaggcca

SEQ ID NO: 890099 - RNA, 22 nt, Human
cagcucccagagugaccagcag

SEQ ID NO: 890100 - RNA, 22 nt, Human
cuaauuuuuguucugcauugaa

SEQ ID NO: 890101 - RNA, 22 nt, Human
gcagggcaguaagagcuagagu

SEQ ID NO: 890102 - RNA, 22 nt, Human
ccugggcaacauagggagaccc

SEQ ID NO: 890103 - RNA, 20 nt, Human
uauuuugcaauuaugguuca

SEQ ID NO: 890104 - RNA, 17 nt, Human
ugaaacaccaagacugu

SEQ ID NO: 890105 - RNA, 22 nt, Human
agucugcauucacagcaauuau

SEQ ID NO: 890106 - RNA, 22 nt, Human
ucugugcaguucuugucuugac

SEQ ID NO: 890107 - RNA, 23 nt, Human
ugggagcucaagggaggcugccc

SEQ ID NO: 890108 - RNA, 22 nt, Human
aaggcagucugguuucaaagca

SEQ ID NO: 890109 - RNA, 22 nt, Human
ugaaagcuuugggacaguguga

SEQ ID NO: 890110 - RNA, 22 nt, Human
ugccucagagaccugacaguac

SEQ ID NO: 890111 - RNA, 22 nt, Human
ggccaaaagcauaauccucaca

SEQ ID NO: 890112 - RNA, 22 nt, Human
auucugauucauuaggucuagg

SEQ ID NO: 890113 - RNA, 22 nt, Human
caggacaguuugcuuugcccug

SEQ ID NO: 890114 - RNA, 23 nt, Human
ucagcagcagaagugcugggaug

SEQ ID NO: 890115 - RNA, 22 nt, Human
ucugucuucaucagcaugugau

SEQ ID NO: 890116 - RNA, 22 nt, Human
ccagggccuacagcuuaagucc

SEQ ID NO: 890117 - RNA, 22 nt, Human
ggagaaggaagaaagcuacuau

SEQ ID NO: 890118 - RNA, 22 nt, Human
uucauagacccaugugaggaag

SEQ ID NO: 890119 - RNA, 23 nt, Human
uaggggaaaaaucuucugcaauu

SEQ ID NO: 890120 - RNA, 22 nt, Human
uaaaguguguggguucuaaauu

SEQ ID NO: 890121 - RNA, 22 nt, Human
ucccaggacaggccacauggaa

SEQ ID NO: 890122 - RNA, 22 nt, Human
gcccaggaaauaaaagugggcu

SEQ ID NO: 890123 - RNA, 22 nt, Human
aguaacaaauagcugccuuuaa

SEQ ID NO: 890124 - RNA, 17 nt, Human
uuuuggugaccuuggcc

SEQ ID NO: 890125 - RNA, 22 nt, Human
uggcaguccagacccuggacuc

SEQ ID NO: 890126 - RNA, 22 nt, Human
auuuguaagcuagagccaugau

SEQ ID NO: 890127 - RNA, 22 nt, Human
cuggccagugccugugggcccc

SEQ ID NO: 890128 - RNA, 22 nt, Human
ggagggagcauccccuugcuga

SEQ ID NO: 890129 - RNA, 22 nt, Human
ggggggugcugaucaguggagc

SEQ ID NO: 890130 - RNA, 22 nt, Human
ugucugaacugcacugaaagac

SEQ ID NO: 890131 - RNA, 22 nt, Human
augugaggaagaaagagguaag

SEQ ID NO: 890132 - RNA, 22 nt, Human
guuagagggaaaaaucauuugc

SEQ ID NO: 890133 - RNA, 21 nt, Human
uccaccagcucuuccucuuca

SEQ ID NO: 890134 - RNA, 22 nt, Human
cuguuuccauacagguuuuugg

SEQ ID NO: 890135 - RNA, 22 nt, Human
cacagugaagcaugcagacauc

SEQ ID NO: 890136 - RNA, 22 nt, Human
aggaggcucucagguccucccc

SEQ ID NO: 890137 - RNA, 22 nt, Human
ucacauuugauaaugcccauug

SEQ ID NO: 890138 - RNA, 22 nt, Human
uccaggagagguagaggguucc

SEQ ID NO: 890139 - RNA, 22 nt, Human
cccuagaacacgcagacacuga

SEQ ID NO: 890140 - RNA, 22 nt, Human
ugcagccuagacauucugguca

SEQ ID NO: 890141 - RNA, 22 nt, Human
ugcaggaauuuuuugcagaaag

SEQ ID NO: 890142 - RNA, 22 nt, Human
ggcuugagacccgggagccaga

SEQ ID NO: 890143 - RNA, 22 nt, Human
uagggaugaaguugcuauuuac

SEQ ID NO: 890144 - RNA, 22 nt, Human
ugccaggccaauucuauuugac

SEQ ID NO: 890145 - RNA, 22 nt, Human
uacaguuacuuugaaaauugau

SEQ ID NO: 890146 - RNA, 22 nt, Human
ccaggaagguaugggaagaaaa

SEQ ID NO: 890147 - RNA, 22 nt, Human
caggcugccaaggcuggggagg

SEQ ID NO: 890148 - RNA, 22 nt, Human
uggaaugaagacauguuguuug

SEQ ID NO: 890149 - RNA, 22 nt, Human
agagaaggcauagaacuugagu

SEQ ID NO: 890150 - RNA, 22 nt, Human
uagcugugcccagggaaguugu

SEQ ID NO: 890151 - RNA, 22 nt, Human
cugcagcugugagugcuggaug

SEQ ID NO: 890152 - RNA, 22 nt, Human
auuuccaaaaccacuuauugcc

SEQ ID NO: 890153 - RNA, 22 nt, Human
ucccucagcaggaauguggcag

SEQ ID NO: 890154 - RNA, 22 nt, Human
agccuggauccauguggcuacc

SEQ ID NO: 890155 - RNA, 22 nt, Human
gcagggaagaucuuggagcugc

SEQ ID NO: 890156 - RNA, 22 nt, Human
uaucagaaaugccuuaaauugg

SEQ ID NO: 890157 - RNA, 19 nt, Human
uguuucuuccuccaucuga

SEQ ID NO: 890158 - RNA, 22 nt, Human
auuuccuauuucuuguccccua

SEQ ID NO: 890159 - RNA, 22 nt, Human
ccaguccagugccaugcauggc

SEQ ID NO: 890160 - RNA, 22 nt, Human
gucaggcagccuggagauucag

SEQ ID NO: 890161 - RNA, 18 nt, Human
aggaagaccaucagauau

SEQ ID NO: 890162 - RNA, 22 nt, Human
uuggcccagacucggggacuga

SEQ ID NO: 890163 - RNA, 22 nt, Human
gugaagacuuggagaaguuaag

SEQ ID NO: 890164 - RNA, 22 nt, Human
caucucuccacggcagcucucg

SEQ ID NO: 890165 - RNA, 22 nt, Human
uugggcagcauugcaguucccu

SEQ ID NO: 890166 - RNA, 22 nt, Human
ucuaggaaagccuuucacaacu

SEQ ID NO: 890167 - RNA, 22 nt, Human
gagcuuggcagugucacuaggg

SEQ ID NO: 890168 - RNA, 23 nt, Human
ucucccugagguuguuagcauua

SEQ ID NO: 890169 - RNA, 22 nt, Human
gcgucucaaggcccccaggcca

SEQ ID NO: 890170 - RNA, 22 nt, Human
auuccacaugaaaggagcugaa

SEQ ID NO: 890171 - RNA, 22 nt, Human
gaucugagaucuaaaccagagg

SEQ ID NO: 890172 - RNA, 22 nt, Human
uaaugucuuaguaccuuaauuu

SEQ ID NO: 890173 - RNA, 22 nt, Human
ugggugguuuaugaguggguuu

SEQ ID NO: 890174 - RNA, 22 nt, Human
cagagacaggagugcucccagu

SEQ ID NO: 890175 - RNA, 22 nt, Human
ucacccagccuuggcggguuug

SEQ ID NO: 890176 - RNA, 22 nt, Human
aagcacagacucccucugagug

SEQ ID NO: 890177 - RNA, 22 nt, Human
gggugacauagugauggggcau

SEQ ID NO: 890178 - RNA, 22 nt, Human
aguuucauccgaucuggucuca

SEQ ID NO: 890179 - RNA, 22 nt, Human
ccugaggauuguuggugcuucc

SEQ ID NO: 890180 - RNA, 22 nt, Human
cagucuccugggggcuguuguu

SEQ ID NO: 890181 - RNA, 22 nt, Human
guucuucacauuuuggggucac

SEQ ID NO: 890182 - RNA, 21 nt, Human
cuuggaguugguugaggaugc

SEQ ID NO: 890183 - RNA, 22 nt, Human
aaugguaauauuucauaguugu

SEQ ID NO: 890184 - RNA, 22 nt, Human
aagcuuuuuggauuugcuucag

SEQ ID NO: 890185 - RNA, 22 nt, Human
gcugagucuugccugugcuguc

SEQ ID NO: 890186 - RNA, 22 nt, Human
uucauaaggguggccauauaaa

SEQ ID NO: 890187 - RNA, 22 nt, Human
ccugggucuccuccugcuggcu

SEQ ID NO: 890188 - RNA, 20 nt, Human
caggcacacucauuccugcu

SEQ ID NO: 890189 - RNA, 20 nt, Human
acacacagagacaugcgcau

SEQ ID NO: 890190 - RNA, 22 nt, Human
aagacaauuugauacuaguugc

SEQ ID NO: 890191 - RNA, 22 nt, Human
uggcagcagccauggaaggccc

SEQ ID NO: 890192 - RNA, 22 nt, Human
uauuuauaacagugagaacggg

SEQ ID NO: 890193 - RNA, 22 nt, Human
agucucuuaaugggcagaaagu

SEQ ID NO: 890194 - RNA, 23 nt, Human
aaagccaagucagucuacuggaa

SEQ ID NO: 890195 - RNA, 22 nt, Human
aggcuucaggaagucuccuggg

SEQ ID NO: 890196 - RNA, 22 nt, Human
cuggcugugugcccccggcacc

SEQ ID NO: 890197 - RNA, 22 nt, Human
gcagggacgccagggacagcaa

SEQ ID NO: 890198 - RNA, 22 nt, Human
agaggcugucccuugcuauucc

SEQ ID NO: 890199 - RNA, 23 nt, Human
uguacaaguacgaccucucccuc

SEQ ID NO: 890200 - RNA, 22 nt, Human
aagggcagggaguuugugucua

SEQ ID NO: 890201 - RNA, 22 nt, Human
gugacagagcugggauuugaag

SEQ ID NO: 890202 - RNA, 22 nt, Human
agaugaaaauacgugacuuuaa

SEQ ID NO: 890203 - RNA, 22 nt, Human
auguacuaaagaaauuugcagg

SEQ ID NO: 890204 - RNA, 22 nt, Human
uccacagucuauuuuuagucua

SEQ ID NO: 890205 - RNA, 22 nt, Human
augaggcagaaaaaagucggag

SEQ ID NO: 890206 - RNA, 22 nt, Human
aagucagaaaacagagcaauua

SEQ ID NO: 890207 - RNA, 22 nt, Human
caguguggguuugggaggagua

SEQ ID NO: 890208 - RNA, 22 nt, Human
aggagcagauugguaagaucau

SEQ ID NO: 890209 - RNA, 22 nt, Human
ccacagaaaauaaagcacgauu

SEQ ID NO: 890210 - RNA, 22 nt, Human
uuugaagugggcauuagaaccu

SEQ ID NO: 890211 - RNA, 22 nt, Human
cagaaugagauaacccagauug

SEQ ID NO: 890212 - RNA, 22 nt, Human
ugauagaaaaugcugucaagcu

SEQ ID NO: 890213 - RNA, 22 nt, Human
ccuuuguucauugccuucaguc

SEQ ID NO: 890214 - RNA, 22 nt, Human
agugucuuuagcaaguuuaguc

SEQ ID NO: 890215 - RNA, 22 nt, Human
uacagaauaaagcgugaagcuu

SEQ ID NO: 890216 - RNA, 22 nt, Human
uucucuuuauguauuuaguggg

SEQ ID NO: 890217 - RNA, 22 nt, Human
ggcugggcuccgggagcaugcg

SEQ ID NO: 890218 - RNA, 22 nt, Human
cucucuuucauuggucgccuug

SEQ ID NO: 890219 - RNA, 22 nt, Human
aauauaaugcuguuuuaugcca

SEQ ID NO: 890220 - RNA, 22 nt, Human
auccugaaaauugaauggaagg

SEQ ID NO: 890221 - RNA, 22 nt, Human
uaauuggauguucucuggaagc

SEQ ID NO: 890222 - RNA, 22 nt, Human
ccuggaugauccaugucaugga

SEQ ID NO: 890223 - RNA, 22 nt, Human
uucacacacagcuuccuauugu

SEQ ID NO: 890224 - RNA, 22 nt, Human
uaacaacaugcaauuuaaccuu

SEQ ID NO: 890225 - RNA, 22 nt, Human
augggggaaaguacgagcaugg

SEQ ID NO: 890226 - RNA, 22 nt, Human
aggagccaggaaaccugcucug

SEQ ID NO: 890227 - RNA, 20 nt, Human
ggguccugacuuggucuccu

SEQ ID NO: 890228 - RNA, 22 nt, Human
ggagagaauuccauggacaugu

SEQ ID NO: 890229 - RNA, 22 nt, Human
uuugugugugcucacauagaug

SEQ ID NO: 890230 - RNA, 22 nt, Human
aggcucuggaguuagccaggca

SEQ ID NO: 890231 - RNA, 22 nt, Human
ugcuuuauguggcugauacuca

SEQ ID NO: 890232 - RNA, 22 nt, Human
uuaacagacauauauauuugua

SEQ ID NO: 890233 - RNA, 19 nt, Human
ccacagccugcugucuucc

SEQ ID NO: 890234 - RNA, 22 nt, Human
gcagauggcagcccaggcuggg

SEQ ID NO: 890235 - RNA, 22 nt, Human
gguccuggaaauugacggaaag

SEQ ID NO: 890236 - RNA, 22 nt, Human
agcaggcacaagaaagggaggu

SEQ ID NO: 890237 - RNA, 22 nt, Human
ucugcaagcgucacaugauucu

SEQ ID NO: 890238 - RNA, 22 nt, Human
gaagcagcuuucuggugaggag

SEQ ID NO: 890239 - RNA, 22 nt, Human
ccaggccugauugggaaucuug

SEQ ID NO: 890240 - RNA, 22 nt, Human
aaaaguaauugcaguuuucgcc

SEQ ID NO: 890241 - RNA, 22 nt, Human
aagguuaguuuucaauaauuac

SEQ ID NO: 890242 - RNA, 22 nt, Human
aagcugaagccggaucaaaaag

SEQ ID NO: 890243 - RNA, 22 nt, Human
gguuuccaggagaagagauuug

SEQ ID NO: 890244 - RNA, 22 nt, Human
uccuaagauagaagauagugaa

SEQ ID NO: 890245 - RNA, 22 nt, Human
auuauguagguuaggugguugu

SEQ ID NO: 890246 - RNA, 22 nt, Human
ugaggggcauguguuuacacau

SEQ ID NO: 890247 - RNA, 22 nt, Human
uccaggcugacgcagcuauuua

SEQ ID NO: 890248 - RNA, 22 nt, Human
acaguuuaucgauucaccuacc

SEQ ID NO: 890249 - RNA, 23 nt, Human
uguaacaauuucauauacaugca

SEQ ID NO: 890250 - RNA, 22 nt, Human
acauuaaaauggagaauuuuga

SEQ ID NO: 890251 - RNA, 22 nt, Human
cagggcuggcuguggcaaucuc

SEQ ID NO: 890252 - RNA, 22 nt, Human
cugcccacacucauggggaagg

SEQ ID NO: 890253 - RNA, 22 nt, Human
agcccggcuuccccgguugcua

SEQ ID NO: 890254 - RNA, 22 nt, Human
gaaugucuuauugcucguugua

SEQ ID NO: 890255 - RNA, 22 nt, Human
caaugcacauggacaucaggcu

SEQ ID NO: 890256 - RNA, 22 nt, Human
auacauacguacauacguaugu

SEQ ID NO: 890257 - RNA, 22 nt, Human
uccccacacagauacagaguag

SEQ ID NO: 890258 - RNA, 17 nt, Human
ugaaagaaucagggaga

SEQ ID NO: 890259 - RNA, 22 nt, Human
ugagaacauugggaaagcuaug

SEQ ID NO: 890260 - RNA, 22 nt, Human
gcuguaggucauuuaaucaccu

SEQ ID NO: 890261 - RNA, 22 nt, Human
auacaaguugugauaauguaaa

SEQ ID NO: 890262 - RNA, 22 nt, Human
agcagggaagccuccagaaccu

SEQ ID NO: 890263 - RNA, 22 nt, Human
uucaaguuuugacuuaguccuu

SEQ ID NO: 890264 - RNA, 22 nt, Human
ugcaccaagucuggcacugaau

SEQ ID NO: 890265 - RNA, 22 nt, Human
ucuucacaucauguuuuuuaau

SEQ ID NO: 890266 - RNA, 18 nt, Human
gcucagguauagacaggg

SEQ ID NO: 890267 - RNA, 22 nt, Human
uuggaggggccacugcagagcu

SEQ ID NO: 890268 - RNA, 22 nt, Human
uaguaauaaguugugcuuugau

SEQ ID NO: 890269 - RNA, 22 nt, Human
aauguuugaacuuugcauauuu

SEQ ID NO: 890270 - RNA, 22 nt, Human
uucugaaggucagcagcuuggu

SEQ ID NO: 890271 - RNA, 22 nt, Human
guggaggacaaaagaagccuuu

SEQ ID NO: 890272 - RNA, 22 nt, Human
cugagcugggacucaguagcaa

SEQ ID NO: 890273 - RNA, 22 nt, Human
uccagccuaggggaacagcugc

SEQ ID NO: 890274 - RNA, 22 nt, Human
acuccuggggauccauuccuuu

SEQ ID NO: 890275 - RNA, 22 nt, Human
uggcagagaugaagaguuguuu

SEQ ID NO: 890276 - RNA, 22 nt, Human
ccagagguggugggugcuacag

SEQ ID NO: 890277 - RNA, 22 nt, Human
acuauaaaaggauaaaccagaa

SEQ ID NO: 890278 - RNA, 22 nt, Human
ccugucuguccucucaugagcc

SEQ ID NO: 890279 - RNA, 22 nt, Human
guccugagcccucagcacagca

SEQ ID NO: 890280 - RNA, 22 nt, Human
gugugugugccugcacacacac

SEQ ID NO: 890281 - RNA, 22 nt, Human
ucugcacaccgccaggcugacu

SEQ ID NO: 890282 - RNA, 22 nt, Human
acauacaucaaguaucacaaga

SEQ ID NO: 890283 - RNA, 22 nt, Human
gaucuuucaucuauguauuuag

SEQ ID NO: 890284 - RNA, 18 nt, Human
guggucuuucugucuucu

SEQ ID NO: 890285 - RNA, 22 nt, Human
aucuagaacaauuauugucaca

SEQ ID NO: 890286 - RNA, 22 nt, Human
ugaaugaaugaauuaauagagu

SEQ ID NO: 890287 - RNA, 22 nt, Human
cuugggggccauuaaggggccu

SEQ ID NO: 890288 - RNA, 22 nt, Human
gaauuuuaaguguucgccucuu

SEQ ID NO: 890289 - RNA, 22 nt, Human
ucuccaggagaaauaugaagga

SEQ ID NO: 890290 - RNA, 22 nt, Human
agaacucucgcuggaucagacu

SEQ ID NO: 890291 - RNA, 22 nt, Human
gcuuuagaucugacuuucugug

SEQ ID NO: 890292 - RNA, 22 nt, Human
auuugugauaauuuguuacagc

SEQ ID NO: 890293 - RNA, 18 nt, Human
gugagcagagagcaucac

SEQ ID NO: 890294 - RNA, 22 nt, Human
auuuuacuuaguguaaugucca

SEQ ID NO: 890295 - RNA, 22 nt, Human
aaguguuaaagacuugaacacu

SEQ ID NO: 890296 - RNA, 18 nt, Human
augcucuagucuuuccug

SEQ ID NO: 890297 - RNA, 22 nt, Human
aucucagggcuggagcccugga

SEQ ID NO: 890298 - RNA, 22 nt, Human
cagaggcacagugcgggccacu

SEQ ID NO: 890299 - RNA, 22 nt, Human
uuuaaauguucaugauacugaa

SEQ ID NO: 890300 - RNA, 22 nt, Human
agcaauuucucgcaccagacgc

SEQ ID NO: 890301 - RNA, 22 nt, Human
ugagacaguuggugaaaucuaa

SEQ ID NO: 890302 - RNA, 22 nt, Human
uuauucuuggaucugagucucu

SEQ ID NO: 890303 - RNA, 22 nt, Human
ccaaacauuucaaauuuagaga

SEQ ID NO: 890304 - RNA, 22 nt, Human
augucagaagaacaaugagaua

SEQ ID NO: 890305 - RNA, 22 nt, Human
cuagggaguggcagagcuggga

SEQ ID NO: 890306 - RNA, 22 nt, Human
ucaugaaaauagaucagaaauu

SEQ ID NO: 890307 - RNA, 22 nt, Human
ucaaucuguuccauuagaacau

SEQ ID NO: 890308 - RNA, 22 nt, Human
auuacacaggauuugccuuacu

SEQ ID NO: 890309 - RNA, 21 nt, Human
agauuacaggugugauccacc

SEQ ID NO: 890310 - RNA, 22 nt, Human
acucccagguugccuggcaggc

SEQ ID NO: 890311 - RNA, 22 nt, Human
cuauuugggguagaagauggau

SEQ ID NO: 890312 - RNA, 22 nt, Human
acauucuucagcuuugucaggc

SEQ ID NO: 890313 - RNA, 22 nt, Human
ugggaugagggugagccacaug

SEQ ID NO: 890314 - RNA, 22 nt, Human
cugcuguguuggcauuggauag

SEQ ID NO: 890315 - RNA, 22 nt, Human
ggucuagaguggggccuggaaa

SEQ ID NO: 890316 - RNA, 22 nt, Human
auauacuuggagacuaucauug

SEQ ID NO: 890317 - RNA, 22 nt, Human
guguaaaaacauacuauuucua

SEQ ID NO: 890318 - RNA, 22 nt, Human
ccucaagucauuccggagaccu

SEQ ID NO: 890319 - RNA, 22 nt, Human
cacagauuaugagacgagauac

SEQ ID NO: 890320 - RNA, 22 nt, Human
augggccuugacacauggagug

SEQ ID NO: 890321 - RNA, 22 nt, Human
auuucucagaccagagaggugu

SEQ ID NO: 890322 - RNA, 20 nt, Human
ucuggggaugaggucuagga

SEQ ID NO: 890323 - RNA, 22 nt, Human
ucucagugggaagggcacaguu

SEQ ID NO: 890324 - RNA, 22 nt, Human
gggagagguuacccgagcaacu

SEQ ID NO: 890325 - RNA, 22 nt, Human
ucgccagggaugcuguaaggaa

SEQ ID NO: 890326 - RNA, 22 nt, Human
ucuguggcugucuuuccagagg

SEQ ID NO: 890327 - RNA, 18 nt, Human
guucaaggucaagagaga

SEQ ID NO: 890328 - RNA, 22 nt, Human
uuaugacauaugaguacaagua

SEQ ID NO: 890329 - RNA, 22 nt, Human
ccagcuguuucugaugcuaggc

SEQ ID NO: 890330 - RNA, 18 nt, Human
uguuuauucuccugacag

SEQ ID NO: 890331 - RNA, 22 nt, Human
cuccugagucuccacgccccgu

SEQ ID NO: 890332 - RNA, 22 nt, Human
ucaauucaguccaacaguaauu

SEQ ID NO: 890333 - RNA, 22 nt, Human
agucuuagagucugugucauga

SEQ ID NO: 890334 - RNA, 22 nt, Human
gagguauuuuugcaugccugau

SEQ ID NO: 890335 - RNA, 22 nt, Human
caucuuuguuucaucuguccag

SEQ ID NO: 890336 - RNA, 22 nt, Human
ccagcccuguuuaugugucacu

SEQ ID NO: 890337 - RNA, 22 nt, Human
cugggucuggcuacugcuuccu

SEQ ID NO: 890338 - RNA, 22 nt, Human
gccaaaguccuccagccaugca

SEQ ID NO: 890339 - RNA, 22 nt, Human
gcuuuucauagauaaaauucua

SEQ ID NO: 890340 - RNA, 22 nt, Human
ggccagcuuucugucuucuagg

SEQ ID NO: 890341 - RNA, 22 nt, Human
gugcuuuaaaaauaggagauga

SEQ ID NO: 890342 - RNA, 22 nt, Human
uuuagcaaggagaaauaauccu

SEQ ID NO: 890343 - RNA, 22 nt, Human
uugugcucuaaggucagggcga

SEQ ID NO: 890344 - RNA, 22 nt, Human
ggccaaaucuguaaggcaagau

SEQ ID NO: 890345 - RNA, 20 nt, Human
agcagcauuguucuagagca

SEQ ID NO: 890346 - RNA, 21 nt, Human
gcaggggauagaaauggucug

SEQ ID NO: 890347 - RNA, 22 nt, Human
ucugggcuuuuccaugccugug

SEQ ID NO: 890348 - RNA, 22 nt, Human
uugcuuuuaauuaaucauugcu

SEQ ID NO: 890349 - RNA, 22 nt, Human
caggaaaucacucugauuuugg

SEQ ID NO: 890350 - RNA, 22 nt, Human
cagaggcaggauaagaacugcg

SEQ ID NO: 890351 - RNA, 22 nt, Human
auuagcaaaacaacuuuucuau

SEQ ID NO: 890352 - RNA, 22 nt, Human
uacacagugaguccucucugcc

SEQ ID NO: 890353 - RNA, 22 nt, Human
ugcagcugcuugauucaucuug

SEQ ID NO: 890354 - RNA, 22 nt, Human
gcacugggugugaggcagcguc

SEQ ID NO: 890355 - RNA, 22 nt, Human
cagcaucaacauucucagcucu

SEQ ID NO: 890356 - RNA, 22 nt, Human
ccuuuugcucucccauccagaa

SEQ ID NO: 890357 - RNA, 22 nt, Human
gagugcaauguagacaucaggg

SEQ ID NO: 890358 - RNA, 22 nt, Human
gaggccuugggaugugccacgg

SEQ ID NO: 890359 - RNA, 22 nt, Human
uaagcaagggucucuguaucag

SEQ ID NO: 890360 - RNA, 22 nt, Human
ccagcucuguaagcugugaaau

SEQ ID NO: 890361 - RNA, 22 nt, Human
cuagaaaugcucaagagaaagu

SEQ ID NO: 890362 - RNA, 22 nt, Human
ugccuggcugaggugacagguu

SEQ ID NO: 890363 - RNA, 22 nt, Human
caugaucaccacuugacagccc

SEQ ID NO: 890364 - RNA, 22 nt, Human
ugaccauggugugcccugugcg

SEQ ID NO: 890365 - RNA, 22 nt, Human
uaagacauccuggauguucaaa

SEQ ID NO: 890366 - RNA, 19 nt, Human
aggcaggugcagagguccc

SEQ ID NO: 890367 - RNA, 18 nt, Human
uggguggcuagggaguuu

SEQ ID NO: 890368 - RNA, 23 nt, Human
agagacauuuggauacagaaaca

SEQ ID NO: 890369 - RNA, 22 nt, Human
agguggugaugacagaagacag

SEQ ID NO: 890370 - RNA, 19 nt, Human
ggggagaacuagagacagc

SEQ ID NO: 890371 - RNA, 22 nt, Human
gaugagguuuuugaaaugugga

SEQ ID NO: 890372 - RNA, 19 nt, Human
cucugcuugguccauaugc

SEQ ID NO: 890373 - RNA, 22 nt, Human
cgccugggaguccacaccugcu

SEQ ID NO: 890374 - RNA, 22 nt, Human
agcuggaauuacaggcacgcac

SEQ ID NO: 890375 - RNA, 22 nt, Human
aacaugcagugagccgaugagg

SEQ ID NO: 890376 - RNA, 22 nt, Human
cauaaugucugacacaguaaga

SEQ ID NO: 890377 - RNA, 22 nt, Human
acacaguuuaaacgauuaguac

SEQ ID NO: 890378 - RNA, 19 nt, Human
uguggggagucagggggcu

SEQ ID NO: 890379 - RNA, 22 nt, Human
caggggccaaggguccagaccu

SEQ ID NO: 890380 - RNA, 22 nt, Human
ugucagcagcugguuugcuguu

SEQ ID NO: 890381 - RNA, 22 nt, Human
agaaaaguuuaaaucuuggcac

SEQ ID NO: 890382 - RNA, 22 nt, Human
ccagcagcugcaaagccugggu

SEQ ID NO: 890383 - RNA, 22 nt, Human
ccauaaucuggcuuugagagag

SEQ ID NO: 890384 - RNA, 22 nt, Human
acagcuucgaggaucucauccc

SEQ ID NO: 890385 - RNA, 22 nt, Human
ucugugucagaagauaucaugg

SEQ ID NO: 890386 - RNA, 22 nt, Human
cuggagccacugggucuuguau

SEQ ID NO: 890387 - RNA, 22 nt, Human
ugcaggugcuccgggggugccc

SEQ ID NO: 890388 - RNA, 22 nt, Human
uauauuauaagcccuuucagaa

SEQ ID NO: 890389 - RNA, 22 nt, Human
caguguggcuuagggaauaggc

SEQ ID NO: 890390 - RNA, 23 nt, Human
acucacaaagcaggaucauguug

SEQ ID NO: 890391 - RNA, 22 nt, Human
agacacaguuugggauggguug

SEQ ID NO: 890392 - RNA, 22 nt, Human
gcagccaggaaagcuggacccu

SEQ ID NO: 890393 - RNA, 22 nt, Human
ucacacauaaaaagaagacuag

SEQ ID NO: 890394 - RNA, 22 nt, Human
augcauuugacgggauauauuu

SEQ ID NO: 890395 - RNA, 20 nt, Human
uggcggggaugagggaguua

SEQ ID NO: 890396 - RNA, 22 nt, Human
acuacaguacuauaucuauagg

SEQ ID NO: 890397 - RNA, 22 nt, Human
aagagcuccaggcaaugcgguc

SEQ ID NO: 890398 - RNA, 22 nt, Human
uuucuuauacuauauugucauc

SEQ ID NO: 890399 - RNA, 22 nt, Human
cuguagagaaagcauggaagcu

SEQ ID NO: 890400 - RNA, 22 nt, Human
cugcaguuggauaaagauacuu

SEQ ID NO: 890401 - RNA, 22 nt, Human
uuaggaauauagacuaaguaga

SEQ ID NO: 890402 - RNA, 22 nt, Human
caauguuuacuggggacccaga

SEQ ID NO: 890403 - RNA, 22 nt, Human
ggagguaugauagcuguguccu

SEQ ID NO: 890404 - RNA, 22 nt, Human
gcacugggaaugagggcagcuu

SEQ ID NO: 890405 - RNA, 23 nt, Human
uuauaagaagcaucacaggaaga

SEQ ID NO: 890406 - RNA, 21 nt, Human
uucuguuuuuuguaccagggc

SEQ ID NO: 890407 - RNA, 22 nt, Human
agcagcucuggcacuguagcau

SEQ ID NO: 890408 - RNA, 22 nt, Human
ucuuccuugcuccuugucacuu

SEQ ID NO: 890409 - RNA, 21 nt, Human
ugcaagaaucaggaagcugcc

SEQ ID NO: 890410 - RNA, 22 nt, Human
cagcuucuaaagugugaagcca

SEQ ID NO: 890411 - RNA, 23 nt, Human
uacagaaggaguagucacuaaga

SEQ ID NO: 890412 - RNA, 22 nt, Human
guguggcuugggugaggcgccu

SEQ ID NO: 890413 - RNA, 22 nt, Human
ggaagcugaauccagagacagg

SEQ ID NO: 890414 - RNA, 22 nt, Human
cauuuguacagaacagcuuuau

SEQ ID NO: 890415 - RNA, 22 nt, Human
uagcagggagggccagugucaa

SEQ ID NO: 890416 - RNA, 23 nt, Human
gagagcugacugucaagacuguu

SEQ ID NO: 890417 - RNA, 22 nt, Human
augcuucccuuugcuccacaug

SEQ ID NO: 890418 - RNA, 22 nt, Human
acucauauacuguuguuuuuaa

SEQ ID NO: 890419 - RNA, 22 nt, Human
gaauuacauaauaaaaugagag

SEQ ID NO: 890420 - RNA, 22 nt, Human
uuggcacugaccaaagaagucc

SEQ ID NO: 890421 - RNA, 23 nt, Human
gccaauuuaguaaaggcaguggg

SEQ ID NO: 890422 - RNA, 22 nt, Human
ugaaagaguuugacaugauucu

SEQ ID NO: 890423 - RNA, 23 nt, Human
gcucuaucaggaacaagccaggu

SEQ ID NO: 890424 - RNA, 22 nt, Human
ugcagcauugcaaagcagucuu

SEQ ID NO: 890425 - RNA, 22 nt, Human
cagcaauggcaggcggagagug

SEQ ID NO: 890426 - RNA, 23 nt, Human
ccugcagcugccacgcccugcuc

SEQ ID NO: 890427 - RNA, 22 nt, Human
ugucuuaugcugcauagacuau

SEQ ID NO: 890428 - RNA, 22 nt, Human
agcugggguugcacacauuuug

SEQ ID NO: 890429 - RNA, 22 nt, Human
caguggcacccacgggcugggc

SEQ ID NO: 890430 - RNA, 22 nt, Human
ccaggccagccuggagcauggc

SEQ ID NO: 890431 - RNA, 22 nt, Human
gugggcagauuauagaugaugc

SEQ ID NO: 890432 - RNA, 22 nt, Human
caugccauuugguggauugaga

SEQ ID NO: 890433 - RNA, 22 nt, Human
agccuccuggaguuucugggau

SEQ ID NO: 890434 - RNA, 21 nt, Human
gcagaggcacggcaccaaggg

SEQ ID NO: 890435 - RNA, 22 nt, Human
cacagagacaugaugucauugc

SEQ ID NO: 890436 - RNA, 22 nt, Human
uuugacagcuugcagugagacc

SEQ ID NO: 890437 - RNA, 22 nt, Human
cuaccuuaucagagugguaagg

SEQ ID NO: 890438 - RNA, 22 nt, Human
gcucugaggcugggagcacucu

SEQ ID NO: 890439 - RNA, 22 nt, Human
uacacagauuucaguaucauca

SEQ ID NO: 890440 - RNA, 22 nt, Human
agcuggcaggugaagaugauuu

SEQ ID NO: 890441 - RNA, 22 nt, Human
uggcuucacacaggcacuuccg

SEQ ID NO: 890442 - RNA, 22 nt, Human
auuauuuagaaaucgauugaaa

SEQ ID NO: 890443 - RNA, 22 nt, Human
gauaaauugcacuuuuucuuac

SEQ ID NO: 890444 - RNA, 22 nt, Human
acauuuuuacugggcaucugca

SEQ ID NO: 890445 - RNA, 22 nt, Human
caugcugggccuugggugcacu

SEQ ID NO: 890446 - RNA, 22 nt, Human
uucucuaagcuggcugaggucu

SEQ ID NO: 890447 - RNA, 22 nt, Human
ucucuaaagauauuuauggcaa

SEQ ID NO: 890448 - RNA, 22 nt, Human
ugccuggguucccaccccaaag

SEQ ID NO: 890449 - RNA, 22 nt, Human
aggcuguggcccuggucuagca

SEQ ID NO: 890450 - RNA, 22 nt, Human
uucaugaauguuccaugugagu

SEQ ID NO: 890451 - RNA, 22 nt, Human
auuucagauucgagaggaagug

SEQ ID NO: 890452 - RNA, 22 nt, Human
uuccucuuauuuucccagugau

SEQ ID NO: 890453 - RNA, 22 nt, Human
auguuucaaugcacuuuagccu

SEQ ID NO: 890454 - RNA, 22 nt, Human
gugcuggacccuggaagguggu

SEQ ID NO: 890455 - RNA, 23 nt, Human
acagggcuggcagcugcaagacc

SEQ ID NO: 890456 - RNA, 22 nt, Human
uuggcagccaggacccgccugg

SEQ ID NO: 890457 - RNA, 22 nt, Human
cucaggaugucggugacuauug

SEQ ID NO: 890458 - RNA, 22 nt, Human
gcagccacuuugcaaccaagag

SEQ ID NO: 890459 - RNA, 22 nt, Human
uaaugcuuuuccuucaaauaag

SEQ ID NO: 890460 - RNA, 22 nt, Human
aaguuucugauauuguuaaagc

SEQ ID NO: 890461 - RNA, 22 nt, Human
uuugccucucagagucuacaca

SEQ ID NO: 890462 - RNA, 22 nt, Human
cagagguguacagagggaggcc

SEQ ID NO: 890463 - RNA, 22 nt, Human
gcacagcucgagcucaggaggg

SEQ ID NO: 890464 - RNA, 19 nt, Human
agcccagcuuauuugucag

SEQ ID NO: 890465 - RNA, 23 nt, Human
uuucucugagaagcaguucucua

SEQ ID NO: 890466 - RNA, 20 nt, Human
auugugaauacugcauaugu

SEQ ID NO: 890467 - RNA, 22 nt, Human
cagaaguuagugucugccagua

SEQ ID NO: 890468 - RNA, 21 nt, Human
aaaguucaugcuuuaauauuc

SEQ ID NO: 890469 - RNA, 22 nt, Human
gacagugcuaugguaggacauu

SEQ ID NO: 890470 - RNA, 22 nt, Human
cuggucccagcucugccaccaa

SEQ ID NO: 890471 - RNA, 22 nt, Human
cugggccuggggcuguugagag

SEQ ID NO: 890472 - RNA, 22 nt, Human
caaucagauaugugacauauuu

SEQ ID NO: 890473 - RNA, 20 nt, Human
uuugcuguggguguaagaau

SEQ ID NO: 890474 - RNA, 22 nt, Human
augucaaacacaacaccagugg

SEQ ID NO: 890475 - RNA, 22 nt, Human
ugucuuuuaguuugugagaucu

SEQ ID NO: 890476 - RNA, 22 nt, Human
uugcaaaaaccacaauuacuuu

SEQ ID NO: 890477 - RNA, 23 nt, Human
uuuauacaagaaaccgcuggccu

SEQ ID NO: 890478 - RNA, 22 nt, Human
aagaaauauugggccuuauaaa

SEQ ID NO: 890479 - RNA, 22 nt, Human
gggugggauggcaggagccgcu

SEQ ID NO: 890480 - RNA, 22 nt, Human
aggaacugucauguauugcuca

SEQ ID NO: 890481 - RNA, 22 nt, Human
gggcugagagcuggaaucugag

SEQ ID NO: 890482 - RNA, 22 nt, Human
cugggcccacgagggcucuggg

SEQ ID NO: 890483 - RNA, 22 nt, Human
cugcuuuaauguaagauauacc

SEQ ID NO: 890484 - RNA, 22 nt, Human
cuugccugcuggagcagggcuc

SEQ ID NO: 890485 - RNA, 22 nt, Human
ggcagguguuuuuauauuaaag

SEQ ID NO: 890486 - RNA, 22 nt, Human
aguuuccaggcaggagcuaauu

SEQ ID NO: 890487 - RNA, 22 nt, Human
cugcccaccacaccugcuccug

SEQ ID NO: 890488 - RNA, 22 nt, Human
gugcagaaguaacaauuaaaga

SEQ ID NO: 890489 - RNA, 22 nt, Human
agucacuguucugucaugucaa

SEQ ID NO: 890490 - RNA, 22 nt, Human
ugguauauguguuagcacaagu

SEQ ID NO: 890491 - RNA, 22 nt, Human
uacauucaaacgauuuauugau

SEQ ID NO: 890492 - RNA, 22 nt, Human
uuaagguagucagccucugugu

SEQ ID NO: 890493 - RNA, 22 nt, Human
ccugccagaaaagagggaguuc

SEQ ID NO: 890494 - RNA, 22 nt, Human
gaauaucuuguacaucuaagua

SEQ ID NO: 890495 - RNA, 22 nt, Human
cucuagcagcagcccuuccuua

SEQ ID NO: 890496 - RNA, 22 nt, Human
caccugccugguccuuagggcu

SEQ ID NO: 890497 - RNA, 18 nt, Human
ugguuccuugaaggggca

SEQ ID NO: 890498 - RNA, 22 nt, Human
aaguuuuugguagagaaaagua

SEQ ID NO: 890499 - RNA, 22 nt, Human
cagcaugcagccccuggcagcu

SEQ ID NO: 890500 - RNA, 22 nt, Human
cuaaauuauuugcacauuagag

SEQ ID NO: 890501 - RNA, 22 nt, Human
ugcaaauuucuuuaguacauaa

SEQ ID NO: 890502 - RNA, 22 nt, Human
acugagagucaagauagcaugg

SEQ ID NO: 890503 - RNA, 21 nt, Human
ggcagcugaccgcgcggugca

SEQ ID NO: 890504 - RNA, 22 nt, Human
cagacagcaaaucugcuugcau

SEQ ID NO: 890505 - RNA, 22 nt, Human
uggccagaacucagacaugugg

SEQ ID NO: 890506 - RNA, 22 nt, Human
gaggccaaguuggagaccaggu

SEQ ID NO: 890507 - RNA, 22 nt, Human
cugggcagguauacaaaaaaug

SEQ ID NO: 890508 - RNA, 22 nt, Human
aaugucuucuucagcugaauaa

SEQ ID NO: 890509 - RNA, 22 nt, Human
ggcccagcucuauugaauuaca

SEQ ID NO: 890510 - RNA, 22 nt, Human
cuggccugaggucggcuguagg

SEQ ID NO: 890511 - RNA, 22 nt, Human
gcugggcucugucaugccuucc

SEQ ID NO: 890512 - RNA, 22 nt, Human
gugauucuguucuggugcugcc

SEQ ID NO: 890513 - RNA, 16 nt, Human
ccucugggauguuugc

SEQ ID NO: 890514 - RNA, 20 nt, Human
ucucacaggggcuuuucucu

SEQ ID NO: 890515 - RNA, 22 nt, Human
auccucucucccauaccagucu

SEQ ID NO: 890516 - RNA, 20 nt, Human
gccaacgcgcuggggcugcc

SEQ ID NO: 890517 - RNA, 22 nt, Human
aggaauucaagaccagcugggc

SEQ ID NO: 890518 - RNA, 22 nt, Human
cccugcagacgucuugaugccu

SEQ ID NO: 890519 - RNA, 22 nt, Human
aaugucaauuaccagaacagaa

SEQ ID NO: 890520 - RNA, 22 nt, Human
gugccaggcccagggagcgggg

SEQ ID NO: 890521 - RNA, 22 nt, Human
caggcagcugggucaccguccc

SEQ ID NO: 890522 - RNA, 23 nt, Human
uccucccaaauuucagccucauu

SEQ ID NO: 890523 - RNA, 22 nt, Human
uagccaaaaaguagcaauuauu

SEQ ID NO: 890524 - RNA, 22 nt, Human
gcugaagguaugaguuuuaucu

SEQ ID NO: 890525 - RNA, 22 nt, Human
agaagcaaggucugucaguaua

SEQ ID NO: 890526 - RNA, 22 nt, Human
aauuaaaaaaggagagcuugcu

SEQ ID NO: 890527 - RNA, 22 nt, Human
uugaauaauguguauguuguua

SEQ ID NO: 890528 - RNA, 22 nt, Human
gaucaucuuuuccugcuuccag

SEQ ID NO: 890529 - RNA, 22 nt, Human
cuccaggaguggccuggacacc

SEQ ID NO: 890530 - RNA, 22 nt, Human
augucacuguuguuauuguuau

SEQ ID NO: 890531 - RNA, 22 nt, Human
ucugagaacaucauuuccuaca

SEQ ID NO: 890532 - RNA, 22 nt, Human
acaacaucagcugagaccuuca

SEQ ID NO: 890533 - RNA, 22 nt, Human
ucccacaggggcucuguggguu

SEQ ID NO: 890534 - RNA, 22 nt, Human
guuuccaggcuuugguaugguu

SEQ ID NO: 890535 - RNA, 22 nt, Human
acaaaguuugugguauuccaag

SEQ ID NO: 890536 - RNA, 22 nt, Human
aacugaaacguauuuuugagau

SEQ ID NO: 890537 - RNA, 22 nt, Human
gagcuuccucagccuuucucac

SEQ ID NO: 890538 - RNA, 22 nt, Human
cccuaagaagcaaagugauacc

SEQ ID NO: 890539 - RNA, 22 nt, Human
cagcugccugcaacacaagcuu

SEQ ID NO: 890540 - RNA, 22 nt, Human
gggacaucuuucuagucagggu

SEQ ID NO: 890541 - RNA, 22 nt, Human
cagugaggcucugcugagcggu

SEQ ID NO: 890542 - RNA, 23 nt, Human
uggucagugccuugcauguggga

SEQ ID NO: 890543 - RNA, 22 nt, Human
uguuuagcauaaagauuuucca

SEQ ID NO: 890544 - RNA, 21 nt, Human
uucuccaggcaaccauuucag

SEQ ID NO: 890545 - RNA, 18 nt, Human
auauggaaugccuggcua

SEQ ID NO: 890546 - RNA, 22 nt, Human
agggcagcagcggcccaggccu

SEQ ID NO: 890547 - RNA, 23 nt, Human
cagaagacagucucaagacaagg

SEQ ID NO: 890548 - RNA, 22 nt, Human
agaccagcugccucccagggcc

SEQ ID NO: 890549 - RNA, 21 nt, Human
uggcucugcucagagcagucc

SEQ ID NO: 890550 - RNA, 22 nt, Human
uggcaggaaaaacauuggagau

SEQ ID NO: 890551 - RNA, 20 nt, Human
ucagugcucaggcaccaggu

SEQ ID NO: 890552 - RNA, 22 nt, Human
gccuggcugggcugaaugcuua

SEQ ID NO: 890553 - RNA, 22 nt, Human
caaggcaggaagccugucuuau

SEQ ID NO: 890554 - RNA, 18 nt, Human
cuuuuguuuucccuccuc

SEQ ID NO: 890555 - RNA, 22 nt, Human
agguuuccagcaggccauagau

SEQ ID NO: 890556 - RNA, 22 nt, Human
ggcaguguuauuuuucagaaau

SEQ ID NO: 890557 - RNA, 22 nt, Human
acauuucuaguuguucaucucc

SEQ ID NO: 890558 - RNA, 17 nt, Human
uccaggagaggcaaugg

SEQ ID NO: 890559 - RNA, 19 nt, Human
gcugcacacccagcaacug

SEQ ID NO: 890560 - RNA, 20 nt, Human
aaaaucucccagaaacuuau

SEQ ID NO: 890561 - RNA, 22 nt, Human
aagggaggaggauuuauuguac

SEQ ID NO: 890562 - RNA, 22 nt, Human
uuucucggcagagaugaugggc

SEQ ID NO: 890563 - RNA, 22 nt, Human
auggcagcagggcuugauuaug

SEQ ID NO: 890564 - RNA, 22 nt, Human
ggcucuggcguccaauggagcg

SEQ ID NO: 890565 - RNA, 22 nt, Human
ucagaaguccaauaccauggga

SEQ ID NO: 890566 - RNA, 21 nt, Human
aguuuucugaguuauaaaaua

SEQ ID NO: 890567 - RNA, 22 nt, Human
aagggagguaaagcuauuuaaa

SEQ ID NO: 890568 - RNA, 22 nt, Human
aaguccagacuccuuugcgugg

SEQ ID NO: 890569 - RNA, 22 nt, Human
augaagcaguuaaggugcauga

SEQ ID NO: 890570 - RNA, 22 nt, Human
uucuaugauucauuuagaaguu

SEQ ID NO: 890571 - RNA, 22 nt, Human
acauuuaaccuuugaggaacug

SEQ ID NO: 890572 - RNA, 22 nt, Human
uuugcagcaaggagagagcauu

SEQ ID NO: 890573 - RNA, 19 nt, Human
ccugggagucagcugaagg

SEQ ID NO: 890574 - RNA, 22 nt, Human
gcaugcaauuaugguauuagau

SEQ ID NO: 890575 - RNA, 22 nt, Human
gagcugagccuggguggaccgc

SEQ ID NO: 890576 - RNA, 22 nt, Human
ugcaagaaggcaauaaacucuu

SEQ ID NO: 890577 - RNA, 22 nt, Human
ugggcucuggggaaacugugau

SEQ ID NO: 890578 - RNA, 22 nt, Human
ggcuggcuacauuggaggaagg

SEQ ID NO: 890579 - RNA, 22 nt, Human
aguggagaagaggauggucucc

SEQ ID NO: 890580 - RNA, 22 nt, Human
cucuaaauccacgguauaguug

SEQ ID NO: 890581 - RNA, 22 nt, Human
agauucaggacuggccacagcc

SEQ ID NO: 890582 - RNA, 22 nt, Human
cuguggagguaggagcaggaca

SEQ ID NO: 890583 - RNA, 22 nt, Human
guguccugggcugguagagcug

SEQ ID NO: 890584 - RNA, 22 nt, Human
auguguguauauauagucauuu

SEQ ID NO: 890585 - RNA, 22 nt, Human
uaucuagauggauuuuagugaa

SEQ ID NO: 890586 - RNA, 17 nt, Human
aguggcaggcagauggg

SEQ ID NO: 890587 - RNA, 22 nt, Human
ucagcucucugggcucgaaccu

SEQ ID NO: 890588 - RNA, 22 nt, Human
cugaagcaggaacagcgagauu

SEQ ID NO: 890589 - RNA, 22 nt, Human
cccugagcagucugcagagagc

SEQ ID NO: 890590 - RNA, 19 nt, Human
agaggcaaggguggaagua

SEQ ID NO: 890591 - RNA, 22 nt, Human
guguuuuggccauuagugugau

SEQ ID NO: 890592 - RNA, 22 nt, Human
caggccugcaggaaaggcuccc

SEQ ID NO: 890593 - RNA, 22 nt, Human
agauguuuuagaguuugacuug

SEQ ID NO: 890594 - RNA, 22 nt, Human
aggcaggcagggcucacugucu

SEQ ID NO: 890595 - RNA, 22 nt, Human
cugagagaaucaugcugcaggu

SEQ ID NO: 890596 - RNA, 22 nt, Human
ccucugggcggagaucugcugc

SEQ ID NO: 890597 - RNA, 22 nt, Human
uguuuauagggucugucacuug

SEQ ID NO: 890598 - RNA, 22 nt, Human
uucucacuauguauguagauug

SEQ ID NO: 890599 - RNA, 22 nt, Human
ucaaaugcggucauggcuuuua

SEQ ID NO: 890600 - RNA, 21 nt, Human
uagggcaggcauuggaagaga

SEQ ID NO: 890601 - RNA, 22 nt, Human
cagcaguuguuucggauuggga

SEQ ID NO: 890602 - RNA, 22 nt, Human
ugaugagguggauucaaagcag

SEQ ID NO: 890603 - RNA, 22 nt, Human
gucugaagccagugguaguccg

SEQ ID NO: 890604 - RNA, 22 nt, Human
agcagagcagauaguauuaucu

SEQ ID NO: 890605 - RNA, 23 nt, Human
ugaaucaauuaugggauucaaug

SEQ ID NO: 890606 - RNA, 22 nt, Human
cagcaguucacacuuaacaagu

SEQ ID NO: 890607 - RNA, 22 nt, Human
aaauuagaaauacuuucaaagc

SEQ ID NO: 890608 - RNA, 22 nt, Human
cugagguguuuaguaggggcgg

SEQ ID NO: 890609 - RNA, 22 nt, Human
aauguacaccguggguuuuuua

SEQ ID NO: 890610 - RNA, 22 nt, Human
ggaagcuggcucuuauaaauau

SEQ ID NO: 890611 - RNA, 22 nt, Human
uccuaggaauacugccugaaau

SEQ ID NO: 890612 - RNA, 22 nt, Human
uugcagagugguugugaggauu

SEQ ID NO: 890613 - RNA, 22 nt, Human
guacaaauuaggaagcuuugug

SEQ ID NO: 890614 - RNA, 22 nt, Human
ucagaggaccuuacugagaacc

SEQ ID NO: 890615 - RNA, 18 nt, Human
agagcagcggcaucacac

SEQ ID NO: 890616 - RNA, 22 nt, Human
cagagacaggaucucgaagacu

SEQ ID NO: 890617 - RNA, 22 nt, Human
acagccagucaucucagcaggg

SEQ ID NO: 890618 - RNA, 22 nt, Human
aggacaguggcaaggcaggaca

SEQ ID NO: 890619 - RNA, 22 nt, Human
gcugggcuucaccuccagaguu

SEQ ID NO: 890620 - RNA, 22 nt, Human
aaagcucugagaagcacugcaa

SEQ ID NO: 890621 - RNA, 22 nt, Human
aguuuuaucuguaagcuguuca

SEQ ID NO: 890622 - RNA, 22 nt, Human
ugagcccagagaucugagcuau

SEQ ID NO: 890623 - RNA, 22 nt, Human
cuuguguggucuggucuugcua

SEQ ID NO: 890624 - RNA, 22 nt, Human
auaguuugaaggcuguucuacu

SEQ ID NO: 890625 - RNA, 22 nt, Human
auuacaacuguucccacugucu

SEQ ID NO: 890626 - RNA, 22 nt, Human
gcucccucccaccagccugcag

SEQ ID NO: 890627 - RNA, 22 nt, Human
aguacagaccugucucuuccug

SEQ ID NO: 890628 - RNA, 19 nt, Human
ccuuuuuuaacuucagcaa

SEQ ID NO: 890629 - RNA, 22 nt, Human
aguuuaguauaccaguacaucu

SEQ ID NO: 890630 - RNA, 22 nt, Human
ugcuccacccucacacucuucc

SEQ ID NO: 890631 - RNA, 22 nt, Human
cugggcagcugugcaaacaaua

SEQ ID NO: 890632 - RNA, 17 nt, Human
acaguaacuauguuaug

SEQ ID NO: 890633 - RNA, 22 nt, Human
ccagccaguccagcauuggugu

SEQ ID NO: 890634 - RNA, 22 nt, Human
ucucuaggcagugucagaauca

SEQ ID NO: 890635 - RNA, 22 nt, Human
auaaguguguaaggcauucugu

SEQ ID NO: 890636 - RNA, 22 nt, Human
uuccauaaaggugauaguauac

SEQ ID NO: 890637 - RNA, 22 nt, Human
agguaagggucacaguucauau

SEQ ID NO: 890638 - RNA, 22 nt, Human
aagcaguaaugagguacuauuu

SEQ ID NO: 890639 - RNA, 22 nt, Human
gucaauaucgccaagugucucu

SEQ ID NO: 890640 - RNA, 22 nt, Human
uguucugugcaucuagccagua

SEQ ID NO: 890641 - RNA, 22 nt, Human
cuucaguuuaucccaucaucca

SEQ ID NO: 890642 - RNA, 21 nt, Human
ucagaauuaccccuggaucug

SEQ ID NO: 890643 - RNA, 21 nt, Human
auggcugguggcucagccucc

SEQ ID NO: 890644 - RNA, 22 nt, Human
cucaacacguccucgagaagcg

SEQ ID NO: 890645 - RNA, 19 nt, Human
aucagcugaagccuucaga

SEQ ID NO: 890646 - RNA, 22 nt, Human
cauaauaucuccgauuacuugc

SEQ ID NO: 890647 - RNA, 22 nt, Human
auuuucagagacaucuggacuu

SEQ ID NO: 890648 - RNA, 22 nt, Human
caggcccacugcuugucuaguc

SEQ ID NO: 890649 - RNA, 19 nt, Human
ccucugcuccaguuuccuu

SEQ ID NO: 890650 - RNA, 22 nt, Human
gcagcugagagaagaacagggc

SEQ ID NO: 890651 - RNA, 22 nt, Human
aauagaauguaaucuaauacau

SEQ ID NO: 890652 - RNA, 20 nt, Human
guuuagcauggcagugaaag

SEQ ID NO: 890653 - RNA, 22 nt, Human
ccagauaaggcuuuuuaaaagc

SEQ ID NO: 890654 - RNA, 22 nt, Human
cauauugucuauugcuguuuuu

SEQ ID NO: 890655 - RNA, 22 nt, Human
ugugaggauguaaccagaaguc

SEQ ID NO: 890656 - RNA, 20 nt, Human
uuucaaaggcaccuaugaag

SEQ ID NO: 890657 - RNA, 22 nt, Human
ucuuuaucaagucuguucuuug

SEQ ID NO: 890658 - RNA, 22 nt, Human
ggaaggggugucgcccauggau

SEQ ID NO: 890659 - RNA, 22 nt, Human
uuaugcagauggcaugaggagg

SEQ ID NO: 890660 - RNA, 22 nt, Human
ggaagagggaaccacgacugua

SEQ ID NO: 890661 - RNA, 22 nt, Human
aguucuuugugauggaaauuua

SEQ ID NO: 890662 - RNA, 21 nt, Human
gaguggaacgcucuucacacc

SEQ ID NO: 890663 - RNA, 22 nt, Human
gcgcacauguucagauguguga

SEQ ID NO: 890664 - RNA, 22 nt, Human
guuuugauauaugcauacauua

SEQ ID NO: 890665 - RNA, 22 nt, Human
aauuuuauuaacuggauguagc

SEQ ID NO: 890666 - RNA, 22 nt, Human
acagucuggaagcagggggcaa

SEQ ID NO: 890667 - RNA, 22 nt, Human
ggccugaaugccugaguguggg

SEQ ID NO: 890668 - RNA, 22 nt, Human
ugcugacuccuggcugugacac

SEQ ID NO: 890669 - RNA, 22 nt, Human
uacauguauguguacgugcaug

SEQ ID NO: 890670 - RNA, 22 nt, Human
agugcaaagaaaucagcuuugu

SEQ ID NO: 890671 - RNA, 22 nt, Human
uccucuacucgcuugcccuuug

SEQ ID NO: 890672 - RNA, 22 nt, Human
auuccacauaggccuucaugac

SEQ ID NO: 890673 - RNA, 22 nt, Human
cauaaacucuugagauucuugu

SEQ ID NO: 890674 - RNA, 22 nt, Human
acuccugguucccaguugagau

SEQ ID NO: 890675 - RNA, 22 nt, Human
aauaaagcaugaggcauuuauc

SEQ ID NO: 890676 - RNA, 22 nt, Human
gugaccagagcgggagauuggg

SEQ ID NO: 890677 - RNA, 19 nt, Human
ccuaaaguuugaacccugg

SEQ ID NO: 890678 - RNA, 22 nt, Human
agugaugugaggugugagaggg

SEQ ID NO: 890679 - RNA, 22 nt, Human
uaucaauaucucagugugcuuc

SEQ ID NO: 890680 - RNA, 22 nt, Human
ugucaguucaucaguuggcuaa

SEQ ID NO: 890681 - RNA, 22 nt, Human
ucugucacccagagugcagugg

SEQ ID NO: 890682 - RNA, 22 nt, Human
gcaguaagaugggguaaucgua

SEQ ID NO: 890683 - RNA, 22 nt, Human
uuguuucucuggucuugaguga

SEQ ID NO: 890684 - RNA, 19 nt, Human
ggccagccaccucgccugg

SEQ ID NO: 890685 - RNA, 22 nt, Human
cugaggcuuugugugcaugccu

SEQ ID NO: 890686 - RNA, 21 nt, Human
acuuaaauuccuugauauuua

SEQ ID NO: 890687 - RNA, 22 nt, Human
agaggcugcaggcuggaaauca

SEQ ID NO: 890688 - RNA, 22 nt, Human
cugauacaaugucugcuuuaua

SEQ ID NO: 890689 - RNA, 22 nt, Human
gucaggcugcuggagcuugggu

SEQ ID NO: 890690 - RNA, 18 nt, Human
agggucagugucacuggc

SEQ ID NO: 890691 - RNA, 22 nt, Human
ugcuauuucucugcuguaaaau

SEQ ID NO: 890692 - RNA, 18 nt, Human
guucccagauggugcuga

SEQ ID NO: 890693 - RNA, 22 nt, Human
agcaaugacuaaggcacuuugg

SEQ ID NO: 890694 - RNA, 22 nt, Human
aguggugccauuaaaaucauug

SEQ ID NO: 890695 - RNA, 22 nt, Human
aagcaaaggaaagcugacuuuu

SEQ ID NO: 890696 - RNA, 22 nt, Human
uacaacauuguguugcuucaua

SEQ ID NO: 890697 - RNA, 22 nt, Human
ccaggccuccugugaguggacc

SEQ ID NO: 890698 - RNA, 22 nt, Human
gcccucagcauccucagggcca

SEQ ID NO: 890699 - RNA, 22 nt, Human
cugggcuugcacugcagcgaga

SEQ ID NO: 890700 - RNA, 22 nt, Human
acauuuauauaacucacuagga

SEQ ID NO: 890701 - RNA, 17 nt, Human
uccagagcacagagcuc

SEQ ID NO: 890702 - RNA, 22 nt, Human
ccagagacuggcugagagaucu

SEQ ID NO: 890703 - RNA, 22 nt, Human
cuucuuuaccaagagauagagu

SEQ ID NO: 890704 - RNA, 22 nt, Human
cuucccuuucuggugacuucuc

SEQ ID NO: 890705 - RNA, 20 nt, Human
ucuguggcagguggcgcuug

SEQ ID NO: 890706 - RNA, 22 nt, Human
cuguacaauguuaccuauuuau

SEQ ID NO: 890707 - RNA, 22 nt, Human
ggcuuccaagguccucuccacc

SEQ ID NO: 890708 - RNA, 22 nt, Human
uggcuucugcuuucaguggagg

SEQ ID NO: 890709 - RNA, 20 nt, Human
uuaaaaagagucacaggaga

SEQ ID NO: 890710 - RNA, 22 nt, Human
acacccaggaauaaggacuggg

SEQ ID NO: 890711 - RNA, 22 nt, Human
ccugccagcgcuuaucucucgg

SEQ ID NO: 890712 - RNA, 22 nt, Human
ggcagaagaaaggcuaagucuc

SEQ ID NO: 890713 - RNA, 22 nt, Human
uugucuacuaagaaagacaauu

SEQ ID NO: 890714 - RNA, 22 nt, Human
ucagugcuguguaaauguauua

SEQ ID NO: 890715 - RNA, 22 nt, Human
ccugggagugcacagguuucgu

SEQ ID NO: 890716 - RNA, 17 nt, Human
uagaaguuagaacacuu

SEQ ID NO: 890717 - RNA, 22 nt, Human
uuagaaaaaggcuguggucuua

SEQ ID NO: 890718 - RNA, 22 nt, Human
cugggacagcugagacaggaga

SEQ ID NO: 890719 - RNA, 22 nt, Human
aauaaucucccuuuuuguaugu

SEQ ID NO: 890720 - RNA, 22 nt, Human
agccagguuaaaccacagucaa

SEQ ID NO: 890721 - RNA, 22 nt, Human
aaaagugaugggauggcacuuc

SEQ ID NO: 890722 - RNA, 22 nt, Human
ugccaaaugccaccacagcugc

SEQ ID NO: 890723 - RNA, 22 nt, Human
agacagugauaccuugggaugu

SEQ ID NO: 890724 - RNA, 22 nt, Human
gggggcggagcacgugaccacg

SEQ ID NO: 890725 - RNA, 22 nt, Human
uuguaagaauaugaauacaaau

SEQ ID NO: 890726 - RNA, 22 nt, Human
aguauucuggaauucuauguga

SEQ ID NO: 890727 - RNA, 22 nt, Human
ugaggcucugcuucuguggcuc

SEQ ID NO: 890728 - RNA, 22 nt, Human
ugcaaggguagaagugauggca

SEQ ID NO: 890729 - RNA, 22 nt, Human
gucucagugcccaaugccauaa

SEQ ID NO: 890730 - RNA, 23 nt, Human
ggguccagccaauuccaaggaaa

SEQ ID NO: 890731 - RNA, 22 nt, Human
gccacaggcacuuaagggcugg

SEQ ID NO: 890732 - RNA, 22 nt, Human
aguacaagugaugugguaaaaa

SEQ ID NO: 890733 - RNA, 22 nt, Human
ccccacagccgccagcagggag

SEQ ID NO: 890734 - RNA, 22 nt, Human
gacaggcuagguugcuguccuc

SEQ ID NO: 890735 - RNA, 22 nt, Human
ucagaauggcccauaaauaguc

SEQ ID NO: 890736 - RNA, 22 nt, Human
ugucuaggucuagguuggcaau

SEQ ID NO: 890737 - RNA, 22 nt, Human
auggucaguugcagcuaauguu

SEQ ID NO: 890738 - RNA, 22 nt, Human
uggccagcuuuuuguagugcuc

SEQ ID NO: 890739 - RNA, 22 nt, Human
uguaccaaaaaugugucagacu

SEQ ID NO: 890740 - RNA, 22 nt, Human
aggaacugggcucagcaaacau

SEQ ID NO: 890741 - RNA, 22 nt, Human
cucuccaggacuuuggcccaau

SEQ ID NO: 890742 - RNA, 22 nt, Human
cgccuggcugcagccggcgagg

SEQ ID NO: 890743 - RNA, 22 nt, Human
cggggcaggagucccuguagag

SEQ ID NO: 890744 - RNA, 22 nt, Human
cuccagccucagaugacgguac

SEQ ID NO: 890745 - RNA, 22 nt, Human
cagggcacagaucggggcgcac

SEQ ID NO: 890746 - RNA, 22 nt, Human
gaauucuucugucuuuaacuga

SEQ ID NO: 890747 - RNA, 22 nt, Human
uauucauauuguaaaagaagug

SEQ ID NO: 890748 - RNA, 21 nt, Human
caaguucugcugaaucuucuu

SEQ ID NO: 890749 - RNA, 22 nt, Human
uucauaugugaacucagugaug

SEQ ID NO: 890750 - RNA, 22 nt, Human
acacaucuauauugcaucugca

SEQ ID NO: 890751 - RNA, 22 nt, Human
ccugaguucuuauuuccaguca

SEQ ID NO: 890752 - RNA, 22 nt, Human
aagaaaugugaauauugaauag

SEQ ID NO: 890753 - RNA, 22 nt, Human
gcgacgcucgggcuccgaugcc

SEQ ID NO: 890754 - RNA, 17 nt, Human
ugggugcugggaugagg

SEQ ID NO: 890755 - RNA, 22 nt, Human
gagcccagcucuaccucagacu

SEQ ID NO: 890756 - RNA, 21 nt, Human
uucucaugggauaaguacaug

SEQ ID NO: 890757 - RNA, 16 nt, Human
aggcucagaggcugga

SEQ ID NO: 890758 - RNA, 22 nt, Human
ucaggaaggcacuugguguguu

SEQ ID NO: 890759 - RNA, 22 nt, Human
cuccuccagacuuacugaaucc

SEQ ID NO: 890760 - RNA, 22 nt, Human
guucacaaaauucuggccagug

SEQ ID NO: 890761 - RNA, 22 nt, Human
cuggcucccuggacauggggcc

SEQ ID NO: 890762 - RNA, 22 nt, Human
cugccuuaaaaguacuuuuacu

SEQ ID NO: 890763 - RNA, 19 nt, Human
ucguggggaggugggcagc

SEQ ID NO: 890764 - RNA, 22 nt, Human
cccauuuauuuaaguaggucuu

SEQ ID NO: 890765 - RNA, 22 nt, Human
aauucacauauacauuauuccu

SEQ ID NO: 890766 - RNA, 20 nt, Human
uucuaauuugauggaguagc

SEQ ID NO: 890767 - RNA, 22 nt, Human
uccauagugaauggguaaugca

SEQ ID NO: 890768 - RNA, 22 nt, Human
ggauggccuucuugcucaggaa

SEQ ID NO: 890769 - RNA, 22 nt, Human
uugcaaaagcaauugcaguuuu

SEQ ID NO: 890770 - RNA, 22 nt, Human
uuccugguccuauuauauacac

SEQ ID NO: 890771 - RNA, 22 nt, Human
augcauguauucaugugugaca

SEQ ID NO: 890772 - RNA, 22 nt, Human
gcacaugugagaguagaggccu

SEQ ID NO: 890773 - RNA, 17 nt, Human
gaccaggagaaaccagg

SEQ ID NO: 890774 - RNA, 19 nt, Human
cagaaauagcgaaguguaa

SEQ ID NO: 890775 - RNA, 17 nt, Human
cagcugugagagccuua

SEQ ID NO: 890776 - RNA, 22 nt, Human
auaacaauagugguagugcugg

SEQ ID NO: 890777 - RNA, 22 nt, Human
ugcccagcacugugccagucac

SEQ ID NO: 890778 - RNA, 19 nt, Human
ugaggccaaggucacagau

SEQ ID NO: 890779 - RNA, 22 nt, Human
uuaccaaaucccgugcacauuc

SEQ ID NO: 890780 - RNA, 22 nt, Human
ucugaggucauuccaaggacau

SEQ ID NO: 890781 - RNA, 22 nt, Human
uagaacuuucagaaauuccaaa

SEQ ID NO: 890782 - RNA, 22 nt, Human
ugccucaguuucaucugcagaa

SEQ ID NO: 890783 - RNA, 22 nt, Human
cuugggccagcccagggggcau

SEQ ID NO: 890784 - RNA, 22 nt, Human
auauuauagacagagucuucug

SEQ ID NO: 890785 - RNA, 19 nt, Human
auacaagagagcaguugag

SEQ ID NO: 890786 - RNA, 22 nt, Human
aaugggaagucacuacuguuac

SEQ ID NO: 890787 - RNA, 22 nt, Human
ugggacagagugagcuuuggcc

SEQ ID NO: 890788 - RNA, 22 nt, Human
gcagcugcagguggucccaugc

SEQ ID NO: 890789 - RNA, 22 nt, Human
uguuuccaaaugguauaaagac

SEQ ID NO: 890790 - RNA, 22 nt, Human
ugcccugccaagacugaguggu

SEQ ID NO: 890791 - RNA, 22 nt, Human
ugucuucaguaaaauacacuau

SEQ ID NO: 890792 - RNA, 22 nt, Human
aggcccaguuauccuacuuguu

SEQ ID NO: 890793 - RNA, 22 nt, Human
ucuggaggcucugagggugagu

SEQ ID NO: 890794 - RNA, 22 nt, Human
uagaaacaaugacaugcuugua

SEQ ID NO: 890795 - RNA, 22 nt, Human
aagagcuggcccaaucugagca

SEQ ID NO: 890796 - RNA, 22 nt, Human
uacagacagacuucccacccuc

SEQ ID NO: 890797 - RNA, 22 nt, Human
aauucuugguccuaguguauaa

SEQ ID NO: 890798 - RNA, 22 nt, Human
uuacccagugaagccgaggcag

SEQ ID NO: 890799 - RNA, 22 nt, Human
ucauggcacuuagcacaguccu

SEQ ID NO: 890800 - RNA, 22 nt, Human
auauaauucucagguuugacua

SEQ ID NO: 890801 - RNA, 17 nt, Human
ugcagcugcucccaggc

SEQ ID NO: 890802 - RNA, 22 nt, Human
ucacuggggccaugugagggac

SEQ ID NO: 890803 - RNA, 22 nt, Human
cauguguaccagcuguucuuug

SEQ ID NO: 890804 - RNA, 20 nt, Human
ucaaaggcaaaggugggugu

SEQ ID NO: 890805 - RNA, 22 nt, Human
cagaggugacccauaguaccuc

SEQ ID NO: 890806 - RNA, 23 nt, Human
uguagcugucugagcagacacug

SEQ ID NO: 890807 - RNA, 22 nt, Human
acagugugguuugagcacuggg

SEQ ID NO: 890808 - RNA, 22 nt, Human
ucccagcccagauuugugugac

SEQ ID NO: 890809 - RNA, 22 nt, Human
agaagcugccuacaugaccagc

SEQ ID NO: 890810 - RNA, 22 nt, Human
gcuucaugcuugcuccaaagcu

SEQ ID NO: 890811 - RNA, 22 nt, Human
caaaaacugcaauuacuuuuac

SEQ ID NO: 890812 - RNA, 22 nt, Human
cugggccucauccucagaguuu

SEQ ID NO: 890813 - RNA, 22 nt, Human
aagccagggauggaaugauagg

SEQ ID NO: 890814 - RNA, 22 nt, Human
ugaaguuuuuccagacaagucc

SEQ ID NO: 890815 - RNA, 22 nt, Human
ccauucugccaugcuucaucua

SEQ ID NO: 890816 - RNA, 19 nt, Human
aggcagaggcuuggcuagc

SEQ ID NO: 890817 - RNA, 22 nt, Human
uaaguuuaacccucugggacua

SEQ ID NO: 890818 - RNA, 22 nt, Human
gggaaaggauuuacaguuugau

SEQ ID NO: 890819 - RNA, 22 nt, Human
uggcagcauguuauguaaggaa

SEQ ID NO: 890820 - RNA, 22 nt, Human
uggagcaggacugcugcccuca

SEQ ID NO: 890821 - RNA, 22 nt, Human
uggugaauaguagcuucagacu

SEQ ID NO: 890822 - RNA, 22 nt, Human
ucuacauuccuuuuauaauauc

SEQ ID NO: 890823 - RNA, 22 nt, Human
ggcaggugguaaggauuucaua

SEQ ID NO: 890824 - RNA, 22 nt, Human
ccuuagaaauguaccaaaggaa

SEQ ID NO: 890825 - RNA, 22 nt, Human
uuguuauuauuacuaagucuuc

SEQ ID NO: 890826 - RNA, 22 nt, Human
ccucagggucugaggagaccgu

SEQ ID NO: 890827 - RNA, 22 nt, Human
uugggaaagccacaaauuggag

SEQ ID NO: 890828 - RNA, 22 nt, Human
gcauggcauuugaagguagaag

SEQ ID NO: 890829 - RNA, 22 nt, Human
uaugucaaaguuaagaaauagg

SEQ ID NO: 890830 - RNA, 22 nt, Human
aaggcaggaugggaaaagauuu

SEQ ID NO: 890831 - RNA, 22 nt, Human
cuucaaacccagauuaaaugca

SEQ ID NO: 890832 - RNA, 22 nt, Human
acucucagggacagggucuggg

SEQ ID NO: 890833 - RNA, 22 nt, Human
cucuggaauugaccugggaggg

SEQ ID NO: 890834 - RNA, 22 nt, Human
uggcuccacuacuggguguguu

SEQ ID NO: 890835 - RNA, 22 nt, Human
cagcagcacucugcgggucccc

SEQ ID NO: 890836 - RNA, 22 nt, Human
ggccuggagcagagacuaggga

SEQ ID NO: 890837 - RNA, 22 nt, Human
gagcccagcugcggcccucagc

SEQ ID NO: 890838 - RNA, 22 nt, Human
agccuggguggggguucggaga

SEQ ID NO: 890839 - RNA, 22 nt, Human
guauggaugugugaacugguua

SEQ ID NO: 890840 - RNA, 22 nt, Human
cugucuguuucugauucaaccu

SEQ ID NO: 890841 - RNA, 22 nt, Human
aauguacaaggguuccaguuuu

SEQ ID NO: 890842 - RNA, 22 nt, Human
aggcuaggggaacacuagaauc

SEQ ID NO: 890843 - RNA, 22 nt, Human
ggagcagccgcgucucagggca

SEQ ID NO: 890844 - RNA, 22 nt, Human
aucuuaggguucuguuuuuaag

SEQ ID NO: 890845 - RNA, 22 nt, Human
uacacccagguaccgugauuuc

SEQ ID NO: 890846 - RNA, 20 nt, Human
ccuccuggucaggugugcag

SEQ ID NO: 890847 - RNA, 22 nt, Human
guuauaggucaugcuaugucaa

SEQ ID NO: 890848 - RNA, 20 nt, Human
uggcuccugcgguggaacca

SEQ ID NO: 890849 - RNA, 22 nt, Human
aacaguaaagacagaauuuauc

SEQ ID NO: 890850 - RNA, 22 nt, Human
agcugcccucgcuggggccaga

SEQ ID NO: 890851 - RNA, 22 nt, Human
ucuuguauguguauuuugcugu

SEQ ID NO: 890852 - RNA, 22 nt, Human
cugugccuggggggcagagcug

SEQ ID NO: 890853 - RNA, 22 nt, Human
ucccagcuguguggaggagaug

SEQ ID NO: 890854 - RNA, 22 nt, Human
uuccaugcuaagacacgcaggg

SEQ ID NO: 890855 - RNA, 22 nt, Human
uuguuaucugcgugaagaaaau

SEQ ID NO: 890856 - RNA, 22 nt, Human
uaggaaugcagaugcauaauaa

SEQ ID NO: 890857 - RNA, 22 nt, Human
cucagcagugacaagagaguau

SEQ ID NO: 890858 - RNA, 20 nt, Human
aagaaguugguaagcagugc

SEQ ID NO: 890859 - RNA, 20 nt, Human
cuggggaggaggauguguuc

SEQ ID NO: 890860 - RNA, 20 nt, Human
gugggcagcaggcauacugg

SEQ ID NO: 890861 - RNA, 22 nt, Human
augugcagcuuuucuagagaag

SEQ ID NO: 890862 - RNA, 22 nt, Human
aggcccagcccguccucgugcu

SEQ ID NO: 890863 - RNA, 22 nt, Human
gagcuuuugugggggccaaggu

SEQ ID NO: 890864 - RNA, 22 nt, Human
caguucuaucauuuuagagaug

SEQ ID NO: 890865 - RNA, 22 nt, Human
cuauauacuuuucacagauguu

SEQ ID NO: 890866 - RNA, 22 nt, Human
ucuggcccuauggcauguaccu

SEQ ID NO: 890867 - RNA, 22 nt, Human
ugcauguauuuaaaguugcaau

SEQ ID NO: 890868 - RNA, 22 nt, Human
ugaacuuagugggaauaucucu

SEQ ID NO: 890869 - RNA, 22 nt, Human
uuugcucacuuguguauuuuca

SEQ ID NO: 890870 - RNA, 22 nt, Human
agcuccuccugagugucuggga

SEQ ID NO: 890871 - RNA, 22 nt, Human
cagcucuggcgucagggagcga

SEQ ID NO: 890872 - RNA, 22 nt, Human
ccauugaaggcacuugagcaga

SEQ ID NO: 890873 - RNA, 22 nt, Human
cagcaggaaacuuaaagguaau

SEQ ID NO: 890874 - RNA, 22 nt, Human
cuuguacagaucuugcaaggac

SEQ ID NO: 890875 - RNA, 18 nt, Human
aagaaucucugacucuuu

SEQ ID NO: 890876 - RNA, 22 nt, Human
agaaacuucagcuauucuuuug

SEQ ID NO: 890877 - RNA, 22 nt, Human
auagauuauuugcucauuacuu

SEQ ID NO: 890878 - RNA, 22 nt, Human
uuauuugacuucuugcuaugcu

SEQ ID NO: 890879 - RNA, 22 nt, Human
uucagcagagaaauuacauaau

SEQ ID NO: 890880 - RNA, 22 nt, Human
cccaggucuccuucuuuagcug

SEQ ID NO: 890881 - RNA, 22 nt, Human
gaagcagggagcagucuuugca

SEQ ID NO: 890882 - RNA, 22 nt, Human
agacuguauucaaaaugugguu

SEQ ID NO: 890883 - RNA, 22 nt, Human
caguguuugcuuaaguuauaug

SEQ ID NO: 890884 - RNA, 22 nt, Human
auuucagugagaaagcaaucaa

SEQ ID NO: 890885 - RNA, 22 nt, Human
cuacuucugugaugaaacuaca

SEQ ID NO: 890886 - RNA, 19 nt, Human
ugagacagaagaugagccu

SEQ ID NO: 890887 - RNA, 17 nt, Human
guccugggaggagagag

SEQ ID NO: 890888 - RNA, 23 nt, Human
gugcugugagccccuuggccucc

SEQ ID NO: 890889 - RNA, 22 nt, Human
ccagucugaggccuggugaggg

SEQ ID NO: 890890 - RNA, 22 nt, Human
aaucuucacucuuaacugugca

SEQ ID NO: 890891 - RNA, 22 nt, Human
agcaguaagugaagacuaguuu

SEQ ID NO: 890892 - RNA, 22 nt, Human
caugcuuccuccaaacuacccu

SEQ ID NO: 890893 - RNA, 22 nt, Human
gccucuuguuuccuuacaugga

SEQ ID NO: 890894 - RNA, 22 nt, Human
ugugugccccagaugaguagcu

SEQ ID NO: 890895 - RNA, 22 nt, Human
augugggagauuucaggaggug

SEQ ID NO: 890896 - RNA, 22 nt, Human
aguggagacaggacagucgaua

SEQ ID NO: 890897 - RNA, 17 nt, Human
agcugccuugcuugagc

SEQ ID NO: 890898 - RNA, 22 nt, Human
ucagagaguccuggucauuugc

SEQ ID NO: 890899 - RNA, 22 nt, Human
cgcaggcucgguucacagagca

SEQ ID NO: 890900 - RNA, 22 nt, Human
agacuguaauugacaugucagc

SEQ ID NO: 890901 - RNA, 22 nt, Human
auguguauugagcaccuacugc

SEQ ID NO: 890902 - RNA, 22 nt, Human
agcagcuggugagcaagcucag

SEQ ID NO: 890903 - RNA, 22 nt, Human
auuauuaaagcuuaggucuuau

SEQ ID NO: 890904 - RNA, 22 nt, Human
ccuguucaaguugcagggcugg

SEQ ID NO: 890905 - RNA, 22 nt, Human
ggaagcuaagauaauuuaagua

SEQ ID NO: 890906 - RNA, 22 nt, Human
uucuucagcccauaucuuccag

SEQ ID NO: 890907 - RNA, 22 nt, Human
gagcagcuggcuguauugguuu

SEQ ID NO: 890908 - RNA, 22 nt, Human
acaagucuuuuucaugucuucu

SEQ ID NO: 890909 - RNA, 22 nt, Human
agugaaagguugagaauauucu

SEQ ID NO: 890910 - RNA, 22 nt, Human
ucaggaagcuacugccagcagc

SEQ ID NO: 890911 - RNA, 22 nt, Human
caaggccacguucugcaugcgg

SEQ ID NO: 890912 - RNA, 22 nt, Human
agaaagcacagcggguccauuu

SEQ ID NO: 890913 - RNA, 19 nt, Human
gccacauucuuccaggugu

SEQ ID NO: 890914 - RNA, 22 nt, Human
guacaaaguggaccugauagua

SEQ ID NO: 890915 - RNA, 22 nt, Human
augucuuuauaaauguauaaug

SEQ ID NO: 890916 - RNA, 22 nt, Human
ucaggcugugucuuuaaacaau

SEQ ID NO: 890917 - RNA, 22 nt, Human
aaucaagaggcgauggauggaa

SEQ ID NO: 890918 - RNA, 22 nt, Human
guuacacagcuaagcuucuccu

SEQ ID NO: 890919 - RNA, 22 nt, Human
cauuucauuccuuugaaagugg

SEQ ID NO: 890920 - RNA, 22 nt, Human
uucuuauuaugugcucugugaa

SEQ ID NO: 890921 - RNA, 22 nt, Human
ccaggccuuucuucuuggucug

SEQ ID NO: 890922 - RNA, 22 nt, Human
aaguauuucagcgguucuuugu

SEQ ID NO: 890923 - RNA, 22 nt, Human
ccuggggccccgagccagaagc

SEQ ID NO: 890924 - RNA, 22 nt, Human
ugaauaguguucuauaauaugg

SEQ ID NO: 890925 - RNA, 22 nt, Human
aagcagugauaagagcuaccau

SEQ ID NO: 890926 - RNA, 22 nt, Human
gugauucuguguguaaauuuua

SEQ ID NO: 890927 - RNA, 22 nt, Human
ugaggccugggcacauaaccuc

SEQ ID NO: 890928 - RNA, 17 nt, Human
aggagucucagaugagc

SEQ ID NO: 890929 - RNA, 22 nt, Human
cagccagccucucaaccaugca

SEQ ID NO: 890930 - RNA, 22 nt, Human
aaaauacuacugucuucuuccc

SEQ ID NO: 890931 - RNA, 22 nt, Human
uuauuuuaccuuccucugagcu

SEQ ID NO: 890932 - RNA, 22 nt, Human
gauuucuguaacacuucagaua

SEQ ID NO: 890933 - RNA, 19 nt, Human
uagguuggacaguaucccc

SEQ ID NO: 890934 - RNA, 22 nt, Human
uuugucaugcuuuccuuaugga

SEQ ID NO: 890935 - RNA, 22 nt, Human
gcaggcagagucaauuugaucc

SEQ ID NO: 890936 - RNA, 20 nt, Human
ucagaaguuuccuggagcau

SEQ ID NO: 890937 - RNA, 22 nt, Human
ugacuagaauuguauuuagugu

SEQ ID NO: 890938 - RNA, 22 nt, Human
gagaaguuuuucuuauuacaug

SEQ ID NO: 890939 - RNA, 22 nt, Human
agguucccaggaucugucuggg

SEQ ID NO: 890940 - RNA, 22 nt, Human
gcaaacagccaggcgcagaagu

SEQ ID NO: 890941 - RNA, 22 nt, Human
acauguuagcuacuauuguuau

SEQ ID NO: 890942 - RNA, 22 nt, Human
uuguaagauggauaggaacagc

SEQ ID NO: 890943 - RNA, 23 nt, Human
uccaggcacgcauuucuucuagc

SEQ ID NO: 890944 - RNA, 23 nt, Human
uuugaagcauuuuguaucuuagu

SEQ ID NO: 890945 - RNA, 17 nt, Human
acucaggaucugggagu

SEQ ID NO: 890946 - RNA, 22 nt, Human
uggugugggcguggcaggcaag

SEQ ID NO: 890947 - RNA, 19 nt, Human
aguuauuucuaaauuuacc

SEQ ID NO: 890948 - RNA, 22 nt, Human
gcccucagcaggaaagaucaac

SEQ ID NO: 890949 - RNA, 22 nt, Human
gcugagaauguuccuacuggua

SEQ ID NO: 890950 - RNA, 22 nt, Human
ggaggccaaggugggcggauca

SEQ ID NO: 890951 - RNA, 22 nt, Human
aaaucucaggccucuauuuacu

SEQ ID NO: 890952 - RNA, 22 nt, Human
agcucugggucacggcugccga

SEQ ID NO: 890953 - RNA, 22 nt, Human
uuuccucuuuguaccuugacua

SEQ ID NO: 890954 - RNA, 20 nt, Human
ucuccuggugacaguaccca

SEQ ID NO: 890955 - RNA, 22 nt, Human
uguuacaagucuugagguacuu

SEQ ID NO: 890956 - RNA, 22 nt, Human
auagaaaacagauguccuuaaa

SEQ ID NO: 890957 - RNA, 22 nt, Human
gugugcaucucacccuuccccg

SEQ ID NO: 890958 - RNA, 23 nt, Human
ggaggcucaaguaucacgggcag

SEQ ID NO: 890959 - RNA, 22 nt, Human
cauuuacacuucuaaccacaag

SEQ ID NO: 890960 - RNA, 22 nt, Human
cauucguggcccucuggauaag

SEQ ID NO: 890961 - RNA, 22 nt, Human
uggcaguggcuuugcuggugga

SEQ ID NO: 890962 - RNA, 22 nt, Human
agagccuggagguucugcugaa

SEQ ID NO: 890963 - RNA, 22 nt, Human
ggguguugauuuuacacuaaaa

SEQ ID NO: 890964 - RNA, 21 nt, Human
cuguccuggucuagaggcaca

SEQ ID NO: 890965 - RNA, 22 nt, Human
gcagugugaccgagcuugcuuc

SEQ ID NO: 890966 - RNA, 22 nt, Human
guuaacauucaauuaaacaguc

SEQ ID NO: 890967 - RNA, 22 nt, Human
uucuauguagauaaggcugcuc

SEQ ID NO: 890968 - RNA, 22 nt, Human
uuucaguuguccuguuaauagc

SEQ ID NO: 890969 - RNA, 22 nt, Human
uggagcagaggaagaaggcuuu

SEQ ID NO: 890970 - RNA, 22 nt, Human
uauuuggaaauagggcuuugua

SEQ ID NO: 890971 - RNA, 19 nt, Human
aaugugcuugggagacugc

SEQ ID NO: 890972 - RNA, 22 nt, Human
ucugcacacuuuuauugaccuc

SEQ ID NO: 890973 - RNA, 22 nt, Human
ugcagggcaucuuugaagugug

SEQ ID NO: 890974 - RNA, 22 nt, Human
aacaaaguguacuuccauacug

SEQ ID NO: 890975 - RNA, 22 nt, Human
agcaguggaccucagugcuauu

SEQ ID NO: 890976 - RNA, 22 nt, Human
ccugcuguuuucuucacuucag

SEQ ID NO: 890977 - RNA, 22 nt, Human
uucuagaagcugaaaaggggga

SEQ ID NO: 890978 - RNA, 21 nt, Human
caaaaggauaggaaauuaggg

SEQ ID NO: 890979 - RNA, 22 nt, Human
cucugccacucgaagucaagga

SEQ ID NO: 890980 - RNA, 22 nt, Human
uagugccaccuuccaaguauca

SEQ ID NO: 890981 - RNA, 22 nt, Human
uacaagcucacaaauuuuuaag

SEQ ID NO: 890982 - RNA, 22 nt, Human
cagaaguggccucagagggagu

SEQ ID NO: 890983 - RNA, 22 nt, Human
acauucacaagccuacaagguu

SEQ ID NO: 890984 - RNA, 22 nt, Human
ggggacgggacuuagcaugagu

SEQ ID NO: 890985 - RNA, 22 nt, Human
gcuccuggcuccaggcagccaa

SEQ ID NO: 890986 - RNA, 22 nt, Human
gaguauuccucagucauuuugu

SEQ ID NO: 890987 - RNA, 22 nt, Human
accaggcaguauggugcugcaa

SEQ ID NO: 890988 - RNA, 22 nt, Human
aacugagauuacaagagacauu

SEQ ID NO: 890989 - RNA, 21 nt, Human
ugugagcuuugugaaagcagg

SEQ ID NO: 890990 - RNA, 22 nt, Human
caaggcagugggcuaggaaccu

SEQ ID NO: 890991 - RNA, 22 nt, Human
uggcccugaggggcugugcccc

SEQ ID NO: 890992 - RNA, 23 nt, Human
ugucaucuccagacucccagugc

SEQ ID NO: 890993 - RNA, 22 nt, Human
uccugccuguuuaccuguacuu

SEQ ID NO: 890994 - RNA, 22 nt, Human
aagcugugaagagcaagugagg

SEQ ID NO: 890995 - RNA, 22 nt, Human
gaggccuggcucugcccuccug

SEQ ID NO: 890996 - RNA, 22 nt, Human
aggaccagccuccaggucucuu

SEQ ID NO: 890997 - RNA, 22 nt, Human
ucauuuuuuuccgguaggaaua

SEQ ID NO: 890998 - RNA, 22 nt, Human
uggaaugaaggagauggccuuu

SEQ ID NO: 890999 - RNA, 22 nt, Human
uauggaaacuaauucauuuuuc

SEQ ID NO: 891000 - RNA, 22 nt, Human
aauguuuuguaugccucugagc

SEQ ID NO: 891001 - RNA, 22 nt, Human
gaaucuuaaaucggaaucuuaa

SEQ ID NO: 891002 - RNA, 22 nt, Human
ucuguuucuuccuagccaugcu

SEQ ID NO: 891003 - RNA, 22 nt, Human
ucauuuacaggugaagcaacua

SEQ ID NO: 891004 - RNA, 21 nt, Human
agcagaacagucgagcacugc

SEQ ID NO: 891005 - RNA, 22 nt, Human
guuuaacaucugugaagcugcu

SEQ ID NO: 891006 - RNA, 22 nt, Human
gugaagcacgcugccgcacugg

SEQ ID NO: 891007 - RNA, 22 nt, Human
ugcagcaauguaguuugggaca

SEQ ID NO: 891008 - RNA, 22 nt, Human
acaggugucuaaggcagacagc

SEQ ID NO: 891009 - RNA, 22 nt, Human
uuucacauaaauggaguaaaga

SEQ ID NO: 891010 - RNA, 22 nt, Human
cuggcacaucacuccuaguuua

SEQ ID NO: 891011 - RNA, 22 nt, Human
ucccuguguguauauaaacggu

SEQ ID NO: 891012 - RNA, 22 nt, Human
accagagaaugugcaucucuaa

SEQ ID NO: 891013 - RNA, 20 nt, Human
augugaaguaggaagggugu

SEQ ID NO: 891014 - RNA, 22 nt, Human
ugacaggaguggcuagugggag

SEQ ID NO: 891015 - RNA, 22 nt, Human
cagcugcauuaauuuuagugaa

SEQ ID NO: 891016 - RNA, 22 nt, Human
caggcacugugcaagggucucg

SEQ ID NO: 891017 - RNA, 22 nt, Human
ggugggcagcucuuggcaggca

SEQ ID NO: 891018 - RNA, 22 nt, Human
ugggacagggaaucugaucccc

SEQ ID NO: 891019 - RNA, 22 nt, Human
aguguguccagaaaucuguauu

SEQ ID NO: 891020 - RNA, 22 nt, Human
uggaggucuccugguauugacc

SEQ ID NO: 891021 - RNA, 22 nt, Human
uauuuucauucugugugacugu

SEQ ID NO: 891022 - RNA, 22 nt, Human
aauguucaguaucugguccacc

SEQ ID NO: 891023 - RNA, 22 nt, Human
aaaacuaaauacgcuuugccuc

SEQ ID NO: 891024 - RNA, 22 nt, Human
ucaggagaguguucaguggagg

SEQ ID NO: 891025 - RNA, 22 nt, Human
gaaauauuguacuggagauguu

SEQ ID NO: 891026 - RNA, 22 nt, Human
aguuucuugaagacugauguuu

SEQ ID NO: 891027 - RNA, 22 nt, Human
uuuuaauccaucugguaaaccu

SEQ ID NO: 891028 - RNA, 22 nt, Human
uugaaccaggaacaauuagcuc

SEQ ID NO: 891029 - RNA, 22 nt, Human
uagacacaucuucauccacaau

SEQ ID NO: 891030 - RNA, 22 nt, Human
aggccagaaaugucagggagug

SEQ ID NO: 891031 - RNA, 22 nt, Human
auguggcaaugguuagcacugu

SEQ ID NO: 891032 - RNA, 22 nt, Human
agcugugaccuucaagagcuac

SEQ ID NO: 891033 - RNA, 22 nt, Human
acucaggaaaugaagacugguu

SEQ ID NO: 891034 - RNA, 22 nt, Human
cugccagggcauccuguggugg

SEQ ID NO: 891035 - RNA, 22 nt, Human
cauguauacaguagaauacuau

SEQ ID NO: 891036 - RNA, 22 nt, Human
guacaguaaauguaaauggauu

SEQ ID NO: 891037 - RNA, 22 nt, Human
uaaauguuuuguggguugaguu

SEQ ID NO: 891038 - RNA, 22 nt, Human
uuaggaauuuaucacagacugg

SEQ ID NO: 891039 - RNA, 22 nt, Human
uggccucaaccguccuaagcac

SEQ ID NO: 891040 - RNA, 22 nt, Human
auaauauuuggauaggacagua

SEQ ID NO: 891041 - RNA, 22 nt, Human
cugcagggcagggccuccuggc

SEQ ID NO: 891042 - RNA, 22 nt, Human
gaaggagagaaaggcaauucug

SEQ ID NO: 891043 - RNA, 22 nt, Human
ugcccugaugauccuccucgca

SEQ ID NO: 891044 - RNA, 22 nt, Human
aggcucagggacggggccccuu

SEQ ID NO: 891045 - RNA, 22 nt, Human
gagaggugaaaggauaguuuga

SEQ ID NO: 891046 - RNA, 22 nt, Human
aggcagugagcagggugucaug

SEQ ID NO: 891047 - RNA, 22 nt, Human
aggcagccaucugcaggaagga

SEQ ID NO: 891048 - RNA, 22 nt, Human
auuuagaguguucacucugagc

SEQ ID NO: 891049 - RNA, 22 nt, Human
aagauauacuauuaaguaccau

SEQ ID NO: 891050 - RNA, 22 nt, Human
auauuaaugagcaaguaaguga

SEQ ID NO: 891051 - RNA, 18 nt, Human
cuccuccacagccccugc

SEQ ID NO: 891052 - RNA, 22 nt, Human
uacacugaagugucuugguaua

SEQ ID NO: 891053 - RNA, 22 nt, Human
aaaaucuugugacuuaggaagg

SEQ ID NO: 891054 - RNA, 22 nt, Human
cuucaguguucccaucuguaaa

SEQ ID NO: 891055 - RNA, 22 nt, Human
agcagcauuccuggcuucuauc

SEQ ID NO: 891056 - RNA, 22 nt, Human
uaggccacaaauaagauccugu

SEQ ID NO: 891057 - RNA, 22 nt, Human
aacauguagcagaaacgacuaa

SEQ ID NO: 891058 - RNA, 22 nt, Human
gggucucucaugcaguugcugu

SEQ ID NO: 891059 - RNA, 22 nt, Human
gaauauuaguaucaguuauacc

SEQ ID NO: 891060 - RNA, 22 nt, Human
acauggaagauaaaaauacuca

SEQ ID NO: 891061 - RNA, 22 nt, Human
gggcuucaauagcagaggcgug

SEQ ID NO: 891062 - RNA, 22 nt, Human
ugcagcaaguaaccaucuuccu

SEQ ID NO: 891063 - RNA, 22 nt, Human
aggccacaggcacccuguguuc

SEQ ID NO: 891064 - RNA, 22 nt, Human
uuccuucuuccuuuaguaacca

SEQ ID NO: 891065 - RNA, 22 nt, Human
agagugacagccacugcaguaa

SEQ ID NO: 891066 - RNA, 22 nt, Human
guuucuuuuaaaauauguagac

SEQ ID NO: 891067 - RNA, 22 nt, Human
ucacuuuagaucuucaucucuu

SEQ ID NO: 891068 - RNA, 22 nt, Human
ccugagccuggcucaugcacuc

SEQ ID NO: 891069 - RNA, 22 nt, Human
gagcuaagcuauguuaugcagc

SEQ ID NO: 891070 - RNA, 22 nt, Human
ucuugcuguacggcuacuugca

SEQ ID NO: 891071 - RNA, 22 nt, Human
cugugagggucacagccaugcc

SEQ ID NO: 891072 - RNA, 21 nt, Human
aaaauguagacuuuucccuga

SEQ ID NO: 891073 - RNA, 22 nt, Human
cccaggugggcaccucgaggaa

SEQ ID NO: 891074 - RNA, 22 nt, Human
ucuuuggaagcuuucagagaag

SEQ ID NO: 891075 - RNA, 22 nt, Human
cuguuauuugcuggaagaguuu

SEQ ID NO: 891076 - RNA, 22 nt, Human
cagagggaccagaacauacugu

SEQ ID NO: 891077 - RNA, 22 nt, Human
ugcccaaguccuccaccgaggu

SEQ ID NO: 891078 - RNA, 23 nt, Human
ugaaauauucuuuugcaugagcu

SEQ ID NO: 891079 - RNA, 22 nt, Human
gcccugcaccccaauggcauga

SEQ ID NO: 891080 - RNA, 22 nt, Human
ccaggccaaauucagucagcag

SEQ ID NO: 891081 - RNA, 22 nt, Human
ccagcugguuaaaauagagaaa

SEQ ID NO: 891082 - RNA, 22 nt, Human
agccacagcauguguguaugua

SEQ ID NO: 891083 - RNA, 17 nt, Human
ugaggccugcaucagug

SEQ ID NO: 891084 - RNA, 22 nt, Human
ucagggaguaguuugugcuaug

SEQ ID NO: 891085 - RNA, 21 nt, Human
gccaagaacaagacagacaug

SEQ ID NO: 891086 - RNA, 22 nt, Human
caauuucaucuugugcuucaau

SEQ ID NO: 891087 - RNA, 22 nt, Human
gagcugugacacgcagcccagg

SEQ ID NO: 891088 - RNA, 22 nt, Human
auaguguuacccuucuuaaagu

SEQ ID NO: 891089 - RNA, 22 nt, Human
aagacaauguuucugauagaua

SEQ ID NO: 891090 - RNA, 22 nt, Human
cagggcugagaauuuagagaca

SEQ ID NO: 891091 - RNA, 22 nt, Human
agaucaaaaacuuaauggcuuu

SEQ ID NO: 891092 - RNA, 22 nt, Human
ucucugggccuguuuucucauc

SEQ ID NO: 891093 - RNA, 22 nt, Human
aggcaggcacuccggaaguguc

SEQ ID NO: 891094 - RNA, 23 nt, Human
cacagggagggaaacucuuucag

SEQ ID NO: 891095 - RNA, 20 nt, Human
aagagaagaagucuuugaaa

SEQ ID NO: 891096 - RNA, 22 nt, Human
cugugugcaacuugcaguuuug

SEQ ID NO: 891097 - RNA, 22 nt, Human
uugaagaguagaaaaugcaaau

SEQ ID NO: 891098 - RNA, 22 nt, Human
ugcucugguaacucacuuccau

SEQ ID NO: 891099 - RNA, 22 nt, Human
aacugagacacgaacuaugauu

SEQ ID NO: 891100 - RNA, 22 nt, Human
gaaagugcagucagacaaggca

SEQ ID NO: 891101 - RNA, 22 nt, Human
cuucucccuggcuucugcacac

SEQ ID NO: 891102 - RNA, 22 nt, Human
agagaucaguuaaaaucuuuuu

SEQ ID NO: 891103 - RNA, 22 nt, Human
uuacagaguagggaauugaagu

SEQ ID NO: 891104 - RNA, 22 nt, Human
guguguucagcaagagguaagg

SEQ ID NO: 891105 - RNA, 22 nt, Human
gcugagcugcuguucauccugc

SEQ ID NO: 891106 - RNA, 22 nt, Human
gcugaccuuugccaggaaggca

SEQ ID NO: 891107 - RNA, 22 nt, Human
accagggcagccgagguguguc

SEQ ID NO: 891108 - RNA, 22 nt, Human
agcuagggcaaauaugagauac

SEQ ID NO: 891109 - RNA, 22 nt, Human
augcuucuuguauuuggcugac

SEQ ID NO: 891110 - RNA, 22 nt, Human
aaacucuuuugcauauuagagg

SEQ ID NO: 891111 - RNA, 19 nt, Human
uagcugccuguuaccucca

SEQ ID NO: 891112 - RNA, 22 nt, Human
ggcugcaguuugucuuuugcuu

SEQ ID NO: 891113 - RNA, 22 nt, Human
agcuugccucuuaaucaccuca

SEQ ID NO: 891114 - RNA, 22 nt, Human
augggaggguggaaaggcucug

SEQ ID NO: 891115 - RNA, 22 nt, Human
ggcaggugaggcaugugccugg

SEQ ID NO: 891116 - RNA, 22 nt, Human
ccauguguugauucucugcaga

SEQ ID NO: 891117 - RNA, 22 nt, Human
uggcccaggccaaagcccugga

SEQ ID NO: 891118 - RNA, 22 nt, Human
ccugugggccaaggaccugcca

SEQ ID NO: 891119 - RNA, 22 nt, Human
uugcuauaaaugguuucauauu

SEQ ID NO: 891120 - RNA, 22 nt, Human
auguaccucugcauuccugccu

SEQ ID NO: 891121 - RNA, 22 nt, Human
cuuuggaaagugguucagguga

SEQ ID NO: 891122 - RNA, 22 nt, Human
ggaccugauguuuagucuuguu

SEQ ID NO: 891123 - RNA, 22 nt, Human
gccugcagaggugcugcuagcu

SEQ ID NO: 891124 - RNA, 22 nt, Human
gcagagacuaguagugcagacu

SEQ ID NO: 891125 - RNA, 22 nt, Human
cuccugggcuucgaaggcuccc

SEQ ID NO: 891126 - RNA, 22 nt, Human
gugacucugcauuuuauggauc

SEQ ID NO: 891127 - RNA, 22 nt, Human
uccaggccccagaccguacugc

SEQ ID NO: 891128 - RNA, 22 nt, Human
gcuggccaggaagagucucaga

SEQ ID NO: 891129 - RNA, 22 nt, Human
ugcuggcuguucuagggaggcc

SEQ ID NO: 891130 - RNA, 22 nt, Human
guuucucuuugaagccuggcug

SEQ ID NO: 891131 - RNA, 22 nt, Human
gaugcugagagguggagggaac

SEQ ID NO: 891132 - RNA, 22 nt, Human
ugucauuaguuucagccauucu

SEQ ID NO: 891133 - RNA, 22 nt, Human
aucagcccaccaucuucauaac

SEQ ID NO: 891134 - RNA, 22 nt, Human
aaagaagagcaaauuuguugua

SEQ ID NO: 891135 - RNA, 22 nt, Human
cuauuuggauguuagccucagu

SEQ ID NO: 891136 - RNA, 18 nt, Human
aguguuaaguaaguagca

SEQ ID NO: 891137 - RNA, 22 nt, Human
agcugcccuguggggaggguug

SEQ ID NO: 891138 - RNA, 22 nt, Human
cagccagguaugggcgugcggg

SEQ ID NO: 891139 - RNA, 22 nt, Human
uuuaucuggacugugauauaaa

SEQ ID NO: 891140 - RNA, 22 nt, Human
ugagauaacucugauuuauguu

SEQ ID NO: 891141 - RNA, 18 nt, Human
gaaagccaugcagcagug

SEQ ID NO: 891142 - RNA, 22 nt, Human
gcccaggccggagagcagugcu

SEQ ID NO: 891143 - RNA, 22 nt, Human
augaaaguggcuugauuaaaug

SEQ ID NO: 891144 - RNA, 22 nt, Human
gccuuaggggucagacagagcu

SEQ ID NO: 891145 - RNA, 22 nt, Human
gaagguguccaucaccaacugu

SEQ ID NO: 891146 - RNA, 22 nt, Human
gacuggauguuuaaucaacaga

SEQ ID NO: 891147 - RNA, 22 nt, Human
uaguggggccugggaggguucc

SEQ ID NO: 891148 - RNA, 22 nt, Human
ccaggcagaaugaaaccccugu

SEQ ID NO: 891149 - RNA, 23 nt, Human
agucugugcuuggugggagggcc

SEQ ID NO: 891150 - RNA, 22 nt, Human
agccuggagguaaugaggaaac

SEQ ID NO: 891151 - RNA, 22 nt, Human
gugcaugugcguugacugucca

SEQ ID NO: 891152 - RNA, 22 nt, Human
uucacauaaugauacaaagcuu

SEQ ID NO: 891153 - RNA, 22 nt, Human
gcacacaugugaguguccuuuc

SEQ ID NO: 891154 - RNA, 22 nt, Human
ugaggcaggagaaucacaugaa

SEQ ID NO: 891155 - RNA, 22 nt, Human
agaguaugcaucuauuguaccu

SEQ ID NO: 891156 - RNA, 21 nt, Human
uaacagcagggaaauacgugc

SEQ ID NO: 891157 - RNA, 22 nt, Human
aguauggggcugugugugcaca

SEQ ID NO: 891158 - RNA, 22 nt, Human
acuguacaaccucugccccugu

SEQ ID NO: 891159 - RNA, 22 nt, Human
uacaggucuucugccuucacuc

SEQ ID NO: 891160 - RNA, 22 nt, Human
auagcagugacauuuuaaugug

SEQ ID NO: 891161 - RNA, 22 nt, Human
cagugcaaacucccugaggugg

SEQ ID NO: 891162 - RNA, 19 nt, Human
gcugcucugggucucaucu

SEQ ID NO: 891163 - RNA, 22 nt, Human
aauauuaguuucucaagagaga

SEQ ID NO: 891164 - RNA, 20 nt, Human
ugugucaggcccugauuaaa

SEQ ID NO: 891165 - RNA, 22 nt, Human
uuacugaaaguauacauuucug

SEQ ID NO: 891166 - RNA, 22 nt, Human
caucaaauaaagaaauuccuug

SEQ ID NO: 891167 - RNA, 22 nt, Human
gcccaggaugguguguaguggu

SEQ ID NO: 891168 - RNA, 22 nt, Human
caggaaauugcaacagucugag

SEQ ID NO: 891169 - RNA, 22 nt, Human
gcaugauaccauagguuuugcc

SEQ ID NO: 891170 - RNA, 22 nt, Human
aacccaggagacggaguuugug

SEQ ID NO: 891171 - RNA, 22 nt, Human
gcuuuacagagaaaguuugccu

SEQ ID NO: 891172 - RNA, 21 nt, Human
agcugcagccauguacauggc

SEQ ID NO: 891173 - RNA, 19 nt, Human
acaaugaauguguucucuu

SEQ ID NO: 891174 - RNA, 22 nt, Human
cacugcuuuaaggcugaguaac

SEQ ID NO: 891175 - RNA, 22 nt, Human
aucuuuuugacauggugauggu

SEQ ID NO: 891176 - RNA, 22 nt, Human
auaaaugauucagcaggaaaua

SEQ ID NO: 891177 - RNA, 22 nt, Human
cacccagcuuuugcauccuccg

SEQ ID NO: 891178 - RNA, 22 nt, Human
uaaguuuaccacuuucagaauu

SEQ ID NO: 891179 - RNA, 22 nt, Human
aaaccuuaaaccaagcucuuga

SEQ ID NO: 891180 - RNA, 22 nt, Human
cagcccugcggagguguauacu

SEQ ID NO: 891181 - RNA, 22 nt, Human
cugguucugauuuugcugcauu

SEQ ID NO: 891182 - RNA, 22 nt, Human
ugaugagggcaguucuuguugc

SEQ ID NO: 891183 - RNA, 22 nt, Human
agagaguuguaccacacucaua

SEQ ID NO: 891184 - RNA, 22 nt, Human
cuguccuaugaguacucacuag

SEQ ID NO: 891185 - RNA, 22 nt, Human
cugccucuggccucaggcccag

SEQ ID NO: 891186 - RNA, 22 nt, Human
aaaaccuucuagacuuuauauu

SEQ ID NO: 891187 - RNA, 22 nt, Human
aggucugguguugggccugaaa

SEQ ID NO: 891188 - RNA, 22 nt, Human
auuugcuuuaagguauaaaagg

SEQ ID NO: 891189 - RNA, 22 nt, Human
agugcagaggcugggaaaugcu

SEQ ID NO: 891190 - RNA, 22 nt, Human
aaggcuuccacuuuguuggguc

SEQ ID NO: 891191 - RNA, 22 nt, Human
cuggguucuauuuuuggcuuca

SEQ ID NO: 891192 - RNA, 23 nt, Human
aacugcaagguugcugggaagua

SEQ ID NO: 891193 - RNA, 22 nt, Human
gacuguacgucauugaaggcca

SEQ ID NO: 891194 - RNA, 19 nt, Human
auguaugaggucuucugcu

SEQ ID NO: 891195 - RNA, 22 nt, Human
ccuucuagccugcgccagggca

SEQ ID NO: 891196 - RNA, 22 nt, Human
uagggcagccuuauagcuccca

SEQ ID NO: 891197 - RNA, 22 nt, Human
cucuccagggaagcaguguacu

SEQ ID NO: 891198 - RNA, 18 nt, Human
gggcacuggggacuggag

SEQ ID NO: 891199 - RNA, 22 nt, Human
ucccauucugccaaggacauug

SEQ ID NO: 891200 - RNA, 22 nt, Human
ggggcagcucccgagggcagga

SEQ ID NO: 891201 - RNA, 22 nt, Human
uauguauauaggugugugucuc

SEQ ID NO: 891202 - RNA, 22 nt, Human
agaguguggaaauguucagagu

SEQ ID NO: 891203 - RNA, 19 nt, Human
gcauuucaggcauguuugc

SEQ ID NO: 891204 - RNA, 22 nt, Human
gugguccucauaauucagugag

SEQ ID NO: 891205 - RNA, 19 nt, Human
gcuccuggaugaccugugg

SEQ ID NO: 891206 - RNA, 22 nt, Human
uccagcagggaauuaguagucu

SEQ ID NO: 891207 - RNA, 22 nt, Human
uccugggcuguggccccgggca

SEQ ID NO: 891208 - RNA, 23 nt, Human
uggggccaagugaggaagggucu

SEQ ID NO: 891209 - RNA, 22 nt, Human
aggaagcugccugggaugggaa

SEQ ID NO: 891210 - RNA, 22 nt, Human
cugacccuuuaggguauguuua

SEQ ID NO: 891211 - RNA, 22 nt, Human
acuguucuuguaacacuuaaau

SEQ ID NO: 891212 - RNA, 22 nt, Human
aaggacauuucugacuaaugca

SEQ ID NO: 891213 - RNA, 22 nt, Human
ucugaggaaucuugacacauuu

SEQ ID NO: 891214 - RNA, 22 nt, Human
ugguugaaaaacauuggcuuuu

SEQ ID NO: 891215 - RNA, 22 nt, Human
ugguuuguuuguucauguaaaa

SEQ ID NO: 891216 - RNA, 22 nt, Human
uuucaaacugcccagcacaccu

SEQ ID NO: 891217 - RNA, 22 nt, Human
uguuuacuugagguggaaacaa

SEQ ID NO: 891218 - RNA, 21 nt, Human
augucaaaugcuuuauuuuau

SEQ ID NO: 891219 - RNA, 22 nt, Human
ugggaggcagaaguugacugga

SEQ ID NO: 891220 - RNA, 22 nt, Human
aguucuagaagacuuuuccauu

SEQ ID NO: 891221 - RNA, 22 nt, Human
guacauauuauaaaauacagcu

SEQ ID NO: 891222 - RNA, 20 nt, Human
ccuggagccuggaaggaguc

SEQ ID NO: 891223 - RNA, 22 nt, Human
ccagguguaggacaccaaggga

SEQ ID NO: 891224 - RNA, 22 nt, Human
gaagaauauauaaugauuuugu

SEQ ID NO: 891225 - RNA, 22 nt, Human
cuggggccacaacggcgcacgc

SEQ ID NO: 891226 - RNA, 22 nt, Human
cuuuauucugcaaauugccuug

SEQ ID NO: 891227 - RNA, 22 nt, Human
gagguaagggcaggagagugaa

SEQ ID NO: 891228 - RNA, 22 nt, Human
uggcaguggcgggacucagggc

SEQ ID NO: 891229 - RNA, 22 nt, Human
acacaauaaauuuauccuuuga

SEQ ID NO: 891230 - RNA, 22 nt, Human
cuucccuuggugaacagagcau

SEQ ID NO: 891231 - RNA, 22 nt, Human
cucuuaguaaugccaugaagca

SEQ ID NO: 891232 - RNA, 22 nt, Human
acagacagauuuugucugaugu

SEQ ID NO: 891233 - RNA, 22 nt, Human
uuucauguuacaguguaaaagu

SEQ ID NO: 891234 - RNA, 22 nt, Human
gcaaacaugugcucauuuugug

SEQ ID NO: 891235 - RNA, 22 nt, Human
cugcuagcccgccggccagcga

SEQ ID NO: 891236 - RNA, 22 nt, Human
uacuguaugaauuauguuauuu

SEQ ID NO: 891237 - RNA, 22 nt, Human
cuuuaucagaaaacacauuagg

SEQ ID NO: 891238 - RNA, 22 nt, Human
uguccauugcuuauuucuacuu

SEQ ID NO: 891239 - RNA, 22 nt, Human
uauguguauguucauucaugca

SEQ ID NO: 891240 - RNA, 22 nt, Human
ugcuggcccaguacuaaugucu

SEQ ID NO: 891241 - RNA, 22 nt, Human
ugaaguuauauauguugaaaau

SEQ ID NO: 891242 - RNA, 20 nt, Human
uggggaguugagcacgagca

SEQ ID NO: 891243 - RNA, 22 nt, Human
guuccagacuugccaguggaag

SEQ ID NO: 891244 - RNA, 22 nt, Human
guccucuguuuccaucugacuu

SEQ ID NO: 891245 - RNA, 22 nt, Human
cuggaaguuuccuuccugguca

SEQ ID NO: 891246 - RNA, 22 nt, Human
cucaggaguuggaggcuacagu

SEQ ID NO: 891247 - RNA, 22 nt, Human
uccuucuucaugaagauauaug

SEQ ID NO: 891248 - RNA, 22 nt, Human
agcagguguuuguaucauaagg

SEQ ID NO: 891249 - RNA, 22 nt, Human
uacagaaauacugggggguucu

SEQ ID NO: 891250 - RNA, 22 nt, Human
cauuagcacaugacggaaagca

SEQ ID NO: 891251 - RNA, 21 nt, Human
auacauucuauuaagcauuua

SEQ ID NO: 891252 - RNA, 22 nt, Human
cucagagccaguuagcaggugc

SEQ ID NO: 891253 - RNA, 22 nt, Human
aaagucuucacggcacuagugu

SEQ ID NO: 891254 - RNA, 22 nt, Human
ucuuaugugcugugagauuuuu

SEQ ID NO: 891255 - RNA, 22 nt, Human
ucauuucucccggccaaaaacu

SEQ ID NO: 891256 - RNA, 22 nt, Human
ucugggcagccaugugccuggc

SEQ ID NO: 891257 - RNA, 22 nt, Human
guagcugucucggucaggaguu

SEQ ID NO: 891258 - RNA, 22 nt, Human
uguguucauguauguauacaua

SEQ ID NO: 891259 - RNA, 22 nt, Human
acagaguuguguuuguacaacg

SEQ ID NO: 891260 - RNA, 19 nt, Human
gcucugccagugguaacau

SEQ ID NO: 891261 - RNA, 22 nt, Human
agaaguuucuuugaacguguag

SEQ ID NO: 891262 - RNA, 22 nt, Human
uuuaauagggcccaaugagacu

SEQ ID NO: 891263 - RNA, 22 nt, Human
auuucaugaguuauuauagugg

SEQ ID NO: 891264 - RNA, 22 nt, Human
guuuccuuuuucugcccucaau

SEQ ID NO: 891265 - RNA, 22 nt, Human
cuucagugacagccacccaggc

SEQ ID NO: 891266 - RNA, 22 nt, Human
auauggaacuauucuguguaga

SEQ ID NO: 891267 - RNA, 22 nt, Human
auccugggccucagaggugugu

SEQ ID NO: 891268 - RNA, 22 nt, Human
guucagggagggacagaugaag

SEQ ID NO: 891269 - RNA, 22 nt, Human
uugaacauuaacuucagucuau

SEQ ID NO: 891270 - RNA, 22 nt, Human
aaggagacauuugcagagcacc

SEQ ID NO: 891271 - RNA, 21 nt, Human
gccuguguaaauugaguuucc

SEQ ID NO: 891272 - RNA, 21 nt, Human
acacugugucauaaugcuuaa

SEQ ID NO: 891273 - RNA, 22 nt, Human
cagaccugaggagcacugagcc

SEQ ID NO: 891274 - RNA, 22 nt, Human
agggcccuggggugcacugaca

SEQ ID NO: 891275 - RNA, 23 nt, Human
uuuuccuuuggacaggcuguauu

SEQ ID NO: 891276 - RNA, 22 nt, Human
uuggaaagauuauuauuaugaa

SEQ ID NO: 891277 - RNA, 22 nt, Human
gcccugagugguaccugugggu

SEQ ID NO: 891278 - RNA, 20 nt, Human
agccaccucauuucccuacc

SEQ ID NO: 891279 - RNA, 21 nt, Human
agcugaaaaguuguuuacaag

SEQ ID NO: 891280 - RNA, 22 nt, Human
cagguucccuugcagcuaagug

SEQ ID NO: 891281 - RNA, 22 nt, Human
aaaaugagauacaguuugaaag

SEQ ID NO: 891282 - RNA, 22 nt, Human
ugucuucagcaaaugccuuucu

SEQ ID NO: 891283 - RNA, 22 nt, Human
ugucuuuuggagcaucuuucuu

SEQ ID NO: 891284 - RNA, 22 nt, Human
uuucaugaggggcaaaaucuca

SEQ ID NO: 891285 - RNA, 22 nt, Human
aagcagccagccaucaugcccg

SEQ ID NO: 891286 - RNA, 22 nt, Human
ugugugucagagucuccauggu

SEQ ID NO: 891287 - RNA, 22 nt, Human
cacuuguugguggugaaaucac

SEQ ID NO: 891288 - RNA, 22 nt, Human
agucuagaggauggguccagau

SEQ ID NO: 891289 - RNA, 22 nt, Human
cugcugagaaaagacugaggga

SEQ ID NO: 891290 - RNA, 23 nt, Human
ggcuccugcuucaugucccaccu

SEQ ID NO: 891291 - RNA, 22 nt, Human
ugaggauggucccgaggacacu

SEQ ID NO: 891292 - RNA, 21 nt, Human
ucugagacuggguuagaaugu

SEQ ID NO: 891293 - RNA, 23 nt, Human
ugcguacggcugccagugugacu

SEQ ID NO: 891294 - RNA, 22 nt, Human
ccagggaaguaguugugagagc

SEQ ID NO: 891295 - RNA, 22 nt, Human
gauggucuuugucucugauaag

SEQ ID NO: 891296 - RNA, 22 nt, Human
uuguccuuggcucuagagguga

SEQ ID NO: 891297 - RNA, 22 nt, Human
ucucugggcucaggagcccggc

SEQ ID NO: 891298 - RNA, 22 nt, Human
acucugugaagucuuauuaugc

SEQ ID NO: 891299 - RNA, 22 nt, Human
ccuugggacagccagcuucaga

SEQ ID NO: 891300 - RNA, 19 nt, Human
ugcugacugggccucaccg

SEQ ID NO: 891301 - RNA, 22 nt, Human
ucucauaauuagguaagucaga

SEQ ID NO: 891302 - RNA, 19 nt, Human
cuguuauugucagagcucc

SEQ ID NO: 891303 - RNA, 22 nt, Human
ucauuacaguguuuauaugucu

SEQ ID NO: 891304 - RNA, 22 nt, Human
ugagcagcuuguuccgaguguu

SEQ ID NO: 891305 - RNA, 22 nt, Human
uguggcugcagacacuggagcc

SEQ ID NO: 891306 - RNA, 20 nt, Human
acagaaagagagaaugucag

SEQ ID NO: 891307 - RNA, 22 nt, Human
gcuggcuggcugugcaaaggca

SEQ ID NO: 891308 - RNA, 22 nt, Human
gaaacagauuaacagcauauuu

SEQ ID NO: 891309 - RNA, 22 nt, Human
caagaauaaccagacaauagca

SEQ ID NO: 891310 - RNA, 18 nt, Human
ugcucacacugaccucug

SEQ ID NO: 891311 - RNA, 22 nt, Human
gaggggcacaguaaaggguccc

SEQ ID NO: 891312 - RNA, 22 nt, Human
ucuuccaaggugcagaucuucu

SEQ ID NO: 891313 - RNA, 22 nt, Human
gaggccagaagugccucgggcu

SEQ ID NO: 891314 - RNA, 22 nt, Human
aagcacagugggcagagcagcc

SEQ ID NO: 891315 - RNA, 22 nt, Human
gccuuggacuaccacucccaca

SEQ ID NO: 891316 - RNA, 22 nt, Human
agcaggcacuaugccaggaucu

SEQ ID NO: 891317 - RNA, 22 nt, Human
aguggcaguuugggagcuacag

SEQ ID NO: 891318 - RNA, 22 nt, Human
gaaauacuguaaaguuauuauu

SEQ ID NO: 891319 - RNA, 22 nt, Human
uucaagaaagaguggcuauucc

SEQ ID NO: 891320 - RNA, 19 nt, Human
ggccaggcugacugugguc

SEQ ID NO: 891321 - RNA, 22 nt, Human
gcaggcaccucguggaguggaa

SEQ ID NO: 891322 - RNA, 19 nt, Human
agagucugugcucuuccua

SEQ ID NO: 891323 - RNA, 23 nt, Human
gcaagcaaggcaggguaaagaga

SEQ ID NO: 891324 - RNA, 22 nt, Human
augcuuuuccaggagaaauaua

SEQ ID NO: 891325 - RNA, 22 nt, Human
acuguaaaauacauaaguauug

SEQ ID NO: 891326 - RNA, 22 nt, Human
uuuaaacuaacaguacacguug

SEQ ID NO: 891327 - RNA, 22 nt, Human
uggaauguuguguauaggucag

SEQ ID NO: 891328 - RNA, 22 nt, Human
aacauauaaacucuuaaguuca

SEQ ID NO: 891329 - RNA, 22 nt, Human
gagaguggaaagcaagcugagu

SEQ ID NO: 891330 - RNA, 22 nt, Human
augagauuuuaaaacuucacuu

SEQ ID NO: 891331 - RNA, 22 nt, Human
ucuccaggacugagcuccagcc

SEQ ID NO: 891332 - RNA, 22 nt, Human
gagaaggacuacggaaaacaga

SEQ ID NO: 891333 - RNA, 19 nt, Human
uccaauuucuauucauguu

SEQ ID NO: 891334 - RNA, 22 nt, Human
ccugagaaaccuggugcaauua

SEQ ID NO: 891335 - RNA, 22 nt, Human
guguuucuggggcauucauagu

SEQ ID NO: 891336 - RNA, 22 nt, Human
auucaaaguacuagcuauuuuu

SEQ ID NO: 891337 - RNA, 22 nt, Human
cacagagaauacugcucuugcu

SEQ ID NO: 891338 - RNA, 22 nt, Human
cugugaggccuuuggccagaua

SEQ ID NO: 891339 - RNA, 22 nt, Human
ccugugcauugcaggguguuca

SEQ ID NO: 891340 - RNA, 22 nt, Human
uuaaauuuuagaaacagacucu

SEQ ID NO: 891341 - RNA, 22 nt, Human
aauagauggguuaaacagcaaa

SEQ ID NO: 891342 - RNA, 22 nt, Human
uagcagcauuaauuccauuugc

SEQ ID NO: 891343 - RNA, 22 nt, Human
cagcaggaggugagaugugacc

SEQ ID NO: 891344 - RNA, 22 nt, Human
auugcugaaaguauuuuaugac

SEQ ID NO: 891345 - RNA, 22 nt, Human
aaccugaauuuaauugaaauga

SEQ ID NO: 891346 - RNA, 22 nt, Human
acagaaaaugccagaagggugg

SEQ ID NO: 891347 - RNA, 22 nt, Human
uugacaagaaucguugccuugg

SEQ ID NO: 891348 - RNA, 22 nt, Human
ucaugacaacuauauuauucca

SEQ ID NO: 891349 - RNA, 22 nt, Human
ugagauaaucaugugauuucau

SEQ ID NO: 891350 - RNA, 22 nt, Human
ucuggcaaaggcaaccacaguu

SEQ ID NO: 891351 - RNA, 22 nt, Human
guacacauugucuguuuacuuc

SEQ ID NO: 891352 - RNA, 21 nt, Human
ggcugcucaccuaggucccaa

SEQ ID NO: 891353 - RNA, 22 nt, Human
aggcuuuaauuaucuacaggag

SEQ ID NO: 891354 - RNA, 22 nt, Human
gccagguguaguggccacaccu

SEQ ID NO: 891355 - RNA, 22 nt, Human
ccacagcugaaagcagaggcuc

SEQ ID NO: 891356 - RNA, 22 nt, Human
uggcagaggaaaaagucacugg

SEQ ID NO: 891357 - RNA, 22 nt, Human
agucacaugagcacuaauuagg

SEQ ID NO: 891358 - RNA, 22 nt, Human
augcuacaggauucuccuuauc

SEQ ID NO: 891359 - RNA, 22 nt, Human
auccacucucccauucaugcau

SEQ ID NO: 891360 - RNA, 22 nt, Human
ggagaagcagcuucuugaugaa

SEQ ID NO: 891361 - RNA, 22 nt, Human
ugguccuggaagguccugaggg

SEQ ID NO: 891362 - RNA, 22 nt, Human
ccuuuccugccucaggaaguag

SEQ ID NO: 891363 - RNA, 22 nt, Human
ccuggguggcagagguugcagu

SEQ ID NO: 891364 - RNA, 21 nt, Human
uuagaacaucaacagcaccua

SEQ ID NO: 891365 - RNA, 22 nt, Human
ugagcagaguuguuucuccuga

SEQ ID NO: 891366 - RNA, 22 nt, Human
uaagaaacccaggaauuucuua

SEQ ID NO: 891367 - RNA, 22 nt, Human
cauguccacaguucugagaggc

SEQ ID NO: 891368 - RNA, 23 nt, Human
aucaaaguggaaaucaauuaucu

SEQ ID NO: 891369 - RNA, 22 nt, Human
uccugcuguuuaccuacaaugg

SEQ ID NO: 891370 - RNA, 22 nt, Human
uccaggcugccacagugcaacg

SEQ ID NO: 891371 - RNA, 22 nt, Human
caguggcagagaacagagaccu

SEQ ID NO: 891372 - RNA, 22 nt, Human
ugagauucuguucagaaaaaug

SEQ ID NO: 891373 - RNA, 22 nt, Human
uggaagacaauguacaugcagu

SEQ ID NO: 891374 - RNA, 22 nt, Human
aaagaaugcagugccuuccagc

SEQ ID NO: 891375 - RNA, 23 nt, Human
cuugcaggaagcagauggcacac

SEQ ID NO: 891376 - RNA, 22 nt, Human
ugcagggcccuugggguugaac

SEQ ID NO: 891377 - RNA, 19 nt, Human
ggcugcagagccccggcgc

SEQ ID NO: 891378 - RNA, 18 nt, Human
auguauguacauauuuau

SEQ ID NO: 891379 - RNA, 19 nt, Human
uaaagagaauaccgguggc

SEQ ID NO: 891380 - RNA, 22 nt, Human
uccugggaacucggaaagcucu

SEQ ID NO: 891381 - RNA, 22 nt, Human
ccacaaaacugugugucaaaga

SEQ ID NO: 891382 - RNA, 22 nt, Human
acacugacgcuugacagucacc

SEQ ID NO: 891383 - RNA, 22 nt, Human
caagccagcaguuuaaugacuc

SEQ ID NO: 891384 - RNA, 22 nt, Human
ccugugucugaccaugcacaug

SEQ ID NO: 891385 - RNA, 22 nt, Human
ucuccaggcuuuuugugaauug

SEQ ID NO: 891386 - RNA, 22 nt, Human
agcuggcccacuguguggucca

SEQ ID NO: 891387 - RNA, 22 nt, Human
agccagggucucucgcucuguu

SEQ ID NO: 891388 - RNA, 22 nt, Human
gcauuacagcaguucaacuugg

SEQ ID NO: 891389 - RNA, 22 nt, Human
uucaaaaagguauguucaaguc

SEQ ID NO: 891390 - RNA, 22 nt, Human
ccagaugucugagccacacucc

SEQ ID NO: 891391 - RNA, 22 nt, Human
gauacacauuuuagcuuugucu

SEQ ID NO: 891392 - RNA, 22 nt, Human
ggccagagcucaaacagucgca

SEQ ID NO: 891393 - RNA, 22 nt, Human
aaacugagaccgaaagggguag

SEQ ID NO: 891394 - RNA, 22 nt, Human
aggcagcagagguugaggaaag

SEQ ID NO: 891395 - RNA, 22 nt, Human
agagaacagccuccuagagaaa

SEQ ID NO: 891396 - RNA, 22 nt, Human
aguuaaaugucaguagcuuaac

SEQ ID NO: 891397 - RNA, 19 nt, Human
ugcugcuuccagcucacuc

SEQ ID NO: 891398 - RNA, 22 nt, Human
aggguauguuuuaggcugaguu

SEQ ID NO: 891399 - RNA, 22 nt, Human
acagaaguguguguguaggaau

SEQ ID NO: 891400 - RNA, 21 nt, Human
gcuggcugucccagggaagca

SEQ ID NO: 891401 - RNA, 22 nt, Human
uugguuaugcaauuucuuugcu

SEQ ID NO: 891402 - RNA, 22 nt, Human
ccaugcccuugucaucuccagg

SEQ ID NO: 891403 - RNA, 22 nt, Human
ugaaacaagggccaugggaaac

SEQ ID NO: 891404 - RNA, 22 nt, Human
ccaccagcuucagcagccgcgg

SEQ ID NO: 891405 - RNA, 22 nt, Human
gacccaggggcagggagaaagu

SEQ ID NO: 891406 - RNA, 22 nt, Human
gagcucugggaaacaaagugua

SEQ ID NO: 891407 - RNA, 22 nt, Human
ugccaauuagagacauccaucu

SEQ ID NO: 891408 - RNA, 22 nt, Human
acuuccaaguuuauucauguga

SEQ ID NO: 891409 - RNA, 22 nt, Human
agcagaaucuguccuuggaaga

SEQ ID NO: 891410 - RNA, 22 nt, Human
auauuacucugauuuaguaaau

SEQ ID NO: 891411 - RNA, 22 nt, Human
uauauguaagcuauguaagagu

SEQ ID NO: 891412 - RNA, 22 nt, Human
gaaggccauugcguccugggau

SEQ ID NO: 891413 - RNA, 22 nt, Human
ugguuuuaaaaacaugcugcau

SEQ ID NO: 891414 - RNA, 22 nt, Human
ggagacaggguugaaccacgca

SEQ ID NO: 891415 - RNA, 22 nt, Human
gcuggcaggguucucacugaaa

SEQ ID NO: 891416 - RNA, 21 nt, Human
ucaucuuacaguccuuucuuu

SEQ ID NO: 891417 - RNA, 20 nt, Human
aaagucuuaugguuaauuuu

SEQ ID NO: 891418 - RNA, 19 nt, Human
ccagcagaagccacuccug

SEQ ID NO: 891419 - RNA, 22 nt, Human
gagacaggcagcuaguggguca

SEQ ID NO: 891420 - RNA, 22 nt, Human
auguucuuucagccagugcauc

SEQ ID NO: 891421 - RNA, 22 nt, Human
uggaagaaugcuccacagggaa

SEQ ID NO: 891422 - RNA, 22 nt, Human
auggccaggcaccucuggcuga

SEQ ID NO: 891423 - RNA, 22 nt, Human
uuuuaaaggcagauuauggcuu

SEQ ID NO: 891424 - RNA, 22 nt, Human
auuauuaugguugcucuuuucc

SEQ ID NO: 891425 - RNA, 22 nt, Human
agauacaacucagaaguguggu

SEQ ID NO: 891426 - RNA, 22 nt, Human
uacaaacuccgaaguuuguacc

SEQ ID NO: 891427 - RNA, 22 nt, Human
uagggcagaguccaggaugggc

SEQ ID NO: 891428 - RNA, 22 nt, Human
auauaucugcaguacugaagaa

SEQ ID NO: 891429 - RNA, 22 nt, Human
ugcccagcugucaaaguagaua

SEQ ID NO: 891430 - RNA, 22 nt, Human
uuuagaggaauugggagaacgu

SEQ ID NO: 891431 - RNA, 22 nt, Human
gcuagaaacuguuuaaucucuu

SEQ ID NO: 891432 - RNA, 21 nt, Human
gaauggcaccauuagcauaua

SEQ ID NO: 891433 - RNA, 22 nt, Human
agcuuuauggugccucacuuga

SEQ ID NO: 891434 - RNA, 22 nt, Human
cuacagaaaccuuuuucauaca

SEQ ID NO: 891435 - RNA, 22 nt, Human
uuugcuaaaaggccauugauuu

SEQ ID NO: 891436 - RNA, 22 nt, Human
agcaaugcaaucuuaaccuuga

SEQ ID NO: 891437 - RNA, 22 nt, Human
gcuguggaugcuauggaucauc

SEQ ID NO: 891438 - RNA, 22 nt, Human
cugaugagucggcugccaccag

SEQ ID NO: 891439 - RNA, 22 nt, Human
uggacccuggacugcccuggcc

SEQ ID NO: 891440 - RNA, 21 nt, Human
uauuaauuuuucuucccacua

SEQ ID NO: 891441 - RNA, 22 nt, Human
cucaaggacuuauucaugccug

SEQ ID NO: 891442 - RNA, 22 nt, Human
ugaggcucagaaauguaaguuu

SEQ ID NO: 891443 - RNA, 22 nt, Human
auauuuuggggugaugugcauc

SEQ ID NO: 891444 - RNA, 22 nt, Human
uaggaaaagucuagauugauga

SEQ ID NO: 891445 - RNA, 22 nt, Human
uggaauuuuguauuagcuuuga

SEQ ID NO: 891446 - RNA, 22 nt, Human
caggcccucguggugagcuggg

SEQ ID NO: 891447 - RNA, 22 nt, Human
ugaaggcacaguuuaaccagua

SEQ ID NO: 891448 - RNA, 22 nt, Human
ugucaugguauuugugagcugc

SEQ ID NO: 891449 - RNA, 22 nt, Human
gcauucuugguggagugcuaaa

SEQ ID NO: 891450 - RNA, 22 nt, Human
gagcccugaacaacagcaggaa

SEQ ID NO: 891451 - RNA, 22 nt, Human
aggugcaguggcucaugccugu

SEQ ID NO: 891452 - RNA, 22 nt, Human
uaguacaguggagagcaaagaa

SEQ ID NO: 891453 - RNA, 22 nt, Human
cuggggcucucuggaaugcuug

SEQ ID NO: 891454 - RNA, 22 nt, Human
ugucauuaugaggauuacaaua

SEQ ID NO: 891455 - RNA, 22 nt, Human
auuuuaccuuaaagucuauauu

SEQ ID NO: 891456 - RNA, 22 nt, Human
aggguggcaccuggaagggaug

SEQ ID NO: 891457 - RNA, 22 nt, Human
uuagagauugucuaguauugug

SEQ ID NO: 891458 - RNA, 22 nt, Human
uacugaaagacugaauauuuag

SEQ ID NO: 891459 - RNA, 22 nt, Human
agauaacugguuuacauuauug

SEQ ID NO: 891460 - RNA, 20 nt, Human
acagaacugagaacagucuc

SEQ ID NO: 891461 - RNA, 19 nt, Human
aagagcagggaaagaauug

SEQ ID NO: 891462 - RNA, 22 nt, Human
gcuuuagaaauaucacugugga

SEQ ID NO: 891463 - RNA, 22 nt, Human
uuucuacaguacugauuucaua

SEQ ID NO: 891464 - RNA, 22 nt, Human
acagcuuuugaaaaauuacugg

SEQ ID NO: 891465 - RNA, 22 nt, Human
caauaguaaauuacggaggaga

SEQ ID NO: 891466 - RNA, 22 nt, Human
uauguguguaugacagacagag

SEQ ID NO: 891467 - RNA, 22 nt, Human
uaaaaugcacagcaguugaaag

SEQ ID NO: 891468 - RNA, 22 nt, Human
guucacaaaguacuguaugcau

SEQ ID NO: 891469 - RNA, 23 nt, Human
ccuggaguacuaaggggauggaa

SEQ ID NO: 891470 - RNA, 22 nt, Human
ggggcuguuuuuggaauggcug

SEQ ID NO: 891471 - RNA, 22 nt, Human
cauaaugugugucauacagacu

SEQ ID NO: 891472 - RNA, 20 nt, Human
uccaugcaaauacagaguuu

SEQ ID NO: 891473 - RNA, 22 nt, Human
ucaugcugaggaugcugugaag

SEQ ID NO: 891474 - RNA, 22 nt, Human
gccacagggcagaugcgcagag

SEQ ID NO: 891475 - RNA, 20 nt, Human
cuguaaacugcgucuguaau

SEQ ID NO: 891476 - RNA, 22 nt, Human
aaauggcaacagaagggaguuc

SEQ ID NO: 891477 - RNA, 22 nt, Human
uuuauucuagcucagaauaguu

SEQ ID NO: 891478 - RNA, 22 nt, Human
cuucuguuacuguuagcugaag

SEQ ID NO: 891479 - RNA, 22 nt, Human
aaacagcuaaguacauucaagg

SEQ ID NO: 891480 - RNA, 22 nt, Human
cuguagccaguuuggccucacc

SEQ ID NO: 891481 - RNA, 18 nt, Human
ugagcagaguaaggcuuu

SEQ ID NO: 891482 - RNA, 22 nt, Human
uuucucuugcgauaugcuacac

SEQ ID NO: 891483 - RNA, 21 nt, Human
gcaggaacaggucaugaucug

SEQ ID NO: 891484 - RNA, 22 nt, Human
aaguguauuaagcaacguuauu

SEQ ID NO: 891485 - RNA, 22 nt, Human
acuucaugcuuuagagagauga

SEQ ID NO: 891486 - RNA, 22 nt, Human
auuuguaaagugcuuaaaagua

SEQ ID NO: 891487 - RNA, 22 nt, Human
ggucuggccuccgggcaggugg

SEQ ID NO: 891488 - RNA, 22 nt, Human
ugccuggaugugcuggccucac

SEQ ID NO: 891489 - RNA, 19 nt, Human
ucucagagcccuagaggcc

SEQ ID NO: 891490 - RNA, 22 nt, Human
ggacugaggacaugugaggcau

SEQ ID NO: 891491 - RNA, 22 nt, Human
aucuauuaugcugagaaacugu

SEQ ID NO: 891492 - RNA, 22 nt, Human
uucugccuuacgauauuuucaa

SEQ ID NO: 891493 - RNA, 22 nt, Human
gagcuggcugugguugagugca

SEQ ID NO: 891494 - RNA, 22 nt, Human
aacaauaggaccuuuauguucu

SEQ ID NO: 891495 - RNA, 22 nt, Human
ugauucucauuaucuuggggug

SEQ ID NO: 891496 - RNA, 22 nt, Human
uagcuguguguccuugggcaaa

SEQ ID NO: 891497 - RNA, 22 nt, Human
ucaacaaugggucuguaaugga

SEQ ID NO: 891498 - RNA, 20 nt, Human
cauauggaaagauauuguuc

SEQ ID NO: 891499 - RNA, 22 nt, Human
cuggagcugcuguccuugggug

SEQ ID NO: 891500 - RNA, 22 nt, Human
ucugugugguaguuucagugaa

SEQ ID NO: 891501 - RNA, 22 nt, Human
ugccuucaccaggccuucagcc

SEQ ID NO: 891502 - RNA, 22 nt, Human
cccagcaguacccaagcccuug

SEQ ID NO: 891503 - RNA, 22 nt, Human
guugcaggaggauggcugcaua

SEQ ID NO: 891504 - RNA, 22 nt, Human
ugugaggaacccggaauguggg

SEQ ID NO: 891505 - RNA, 22 nt, Human
uaaacagaaugcguaagaagug

SEQ ID NO: 891506 - RNA, 22 nt, Human
agcagaacugaugagacuugag

SEQ ID NO: 891507 - RNA, 22 nt, Human
auuucauguuaacugaacagaa

SEQ ID NO: 891508 - RNA, 22 nt, Human
gcuguuuccagacaaugucuuu

SEQ ID NO: 891509 - RNA, 22 nt, Human
ggcuggcuugccaagcucaggg

SEQ ID NO: 891510 - RNA, 22 nt, Human
gaggccaggggucagcaauugg

SEQ ID NO: 891511 - RNA, 22 nt, Human
ucaaauauuggcuauuucacau

SEQ ID NO: 891512 - RNA, 22 nt, Human
uucucagguagugcugaugcug

SEQ ID NO: 891513 - RNA, 22 nt, Human
ucagcuggauguggaagugcua

SEQ ID NO: 891514 - RNA, 22 nt, Human
agccuuagggauugagguugcu

SEQ ID NO: 891515 - RNA, 22 nt, Human
ucagugucugugggcaggaugg

SEQ ID NO: 891516 - RNA, 22 nt, Human
caugccaagcauguucagaagu

SEQ ID NO: 891517 - RNA, 22 nt, Human
aucauacacucacauaaacaga

SEQ ID NO: 891518 - RNA, 22 nt, Human
ucaauucaauugaacaguuacu

SEQ ID NO: 891519 - RNA, 22 nt, Human
ggagcccaagucugcacucggc

SEQ ID NO: 891520 - RNA, 22 nt, Human
agagaaaacucauugagguguc

SEQ ID NO: 891521 - RNA, 22 nt, Human
aggagacaucuaacuguagguu

SEQ ID NO: 891522 - RNA, 22 nt, Human
uuaucuuggcaauucuaaggua

SEQ ID NO: 891523 - RNA, 22 nt, Human
auggcuggcauccaggugggcu

SEQ ID NO: 891524 - RNA, 22 nt, Human
gacagggacucccugguuagaa

SEQ ID NO: 891525 - RNA, 22 nt, Human
uacacauguauuuauguguaca

SEQ ID NO: 891526 - RNA, 22 nt, Human
ggguggcagcuguugccaaggu

SEQ ID NO: 891527 - RNA, 22 nt, Human
cuucuguggauauguucucucu

SEQ ID NO: 891528 - RNA, 22 nt, Human
ugagaaugaggggguagaaggu

SEQ ID NO: 891529 - RNA, 22 nt, Human
cacagaggugauaguggucaag

SEQ ID NO: 891530 - RNA, 22 nt, Human
agggccugaggcugacggggag

SEQ ID NO: 891531 - RNA, 22 nt, Human
uauaaaguuggggcugaaguaa

SEQ ID NO: 891532 - RNA, 22 nt, Human
gagggccaauggauuucaacug

SEQ ID NO: 891533 - RNA, 22 nt, Human
ugcucuggaguggcuugugcac

SEQ ID NO: 891534 - RNA, 22 nt, Human
uuauuccagugggugguuucuc

SEQ ID NO: 891535 - RNA, 22 nt, Human
ucccauuucaugcuggcugugg

SEQ ID NO: 891536 - RNA, 22 nt, Human
ccugucuggugaggggguugca

SEQ ID NO: 891537 - RNA, 19 nt, Human
cuggaaugauagagaccuc

SEQ ID NO: 891538 - RNA, 22 nt, Human
aaacaucuuucuauugcaaguu

SEQ ID NO: 891539 - RNA, 22 nt, Human
uauucagaaaauaaauuggauu

SEQ ID NO: 891540 - RNA, 22 nt, Human
gcaaggcugaccucucuagacu

SEQ ID NO: 891541 - RNA, 22 nt, Human
uugaagaauuaggacgugagua

SEQ ID NO: 891542 - RNA, 22 nt, Human
gggcuaggucugaucagagaag

SEQ ID NO: 891543 - RNA, 22 nt, Human
cuggagauacugcucuccauau

SEQ ID NO: 891544 - RNA, 21 nt, Human
uagcauuuuuguauugcugaa

SEQ ID NO: 891545 - RNA, 22 nt, Human
aaggaagaugaggugcugcuua

SEQ ID NO: 891546 - RNA, 21 nt, Human
agguaccaaaagccugcauga

SEQ ID NO: 891547 - RNA, 22 nt, Human
aaguguuacagaaacaaaugaa

SEQ ID NO: 891548 - RNA, 21 nt, Human
gcccagaguccucccacucca

SEQ ID NO: 891549 - RNA, 22 nt, Human
cugagugauagcgauggggaac

SEQ ID NO: 891550 - RNA, 19 nt, Human
cuuuucaucaacagccaau

SEQ ID NO: 891551 - RNA, 22 nt, Human
uguuuugugcauuuacaacaug

SEQ ID NO: 891552 - RNA, 22 nt, Human
cagggaugcugcuuaggcaguu

SEQ ID NO: 891553 - RNA, 22 nt, Human
aguucucauugcaugagacaga

SEQ ID NO: 891554 - RNA, 18 nt, Human
gagaggagccagaauuuu

SEQ ID NO: 891555 - RNA, 22 nt, Human
aaggccaacuaggaugagcuag

SEQ ID NO: 891556 - RNA, 19 nt, Human
gcagagucaagagcugcug

SEQ ID NO: 891557 - RNA, 22 nt, Human
gugaggagucugaagcacauaa

SEQ ID NO: 891558 - RNA, 22 nt, Human
ucuugcugcuguccacacagua

SEQ ID NO: 891559 - RNA, 22 nt, Human
cuuauguaaacuacagauaaua

SEQ ID NO: 891560 - RNA, 22 nt, Human
cuagggagcacuagcugccuug

SEQ ID NO: 891561 - RNA, 18 nt, Human
gugugggcuccuccgagu

SEQ ID NO: 891562 - RNA, 22 nt, Human
ugaagcaauagagacaagacca

SEQ ID NO: 891563 - RNA, 22 nt, Human
agcaggaggguuuuguagaguc

SEQ ID NO: 891564 - RNA, 22 nt, Human
agugggcaaaacagcucagagc

SEQ ID NO: 891565 - RNA, 18 nt, Human
cucaguguuugcugaaaa

SEQ ID NO: 891566 - RNA, 22 nt, Human
cuucaucaacucuaacaaaugu

SEQ ID NO: 891567 - RNA, 21 nt, Human
ucagggaagugugcagaaggg

SEQ ID NO: 891568 - RNA, 21 nt, Human
uucaggugagaucauguugac

SEQ ID NO: 891569 - RNA, 22 nt, Human
cuuucucuguguuucacaugcu

SEQ ID NO: 891570 - RNA, 22 nt, Human
auucagacucuugagcaguccc

SEQ ID NO: 891571 - RNA, 22 nt, Human
uuaaauauuauguugucugcaa

SEQ ID NO: 891572 - RNA, 22 nt, Human
ucaggcagguuggcugcagguc

SEQ ID NO: 891573 - RNA, 22 nt, Human
uccccacucaccacuggccaaa

SEQ ID NO: 891574 - RNA, 22 nt, Human
uuagauacccaaguggaucugu

SEQ ID NO: 891575 - RNA, 22 nt, Human
caggccaagucccaagugcggg

SEQ ID NO: 891576 - RNA, 22 nt, Human
ggauucugccuuguugcuucaa

SEQ ID NO: 891577 - RNA, 22 nt, Human
aaguaaacuuacacauaguaaa

SEQ ID NO: 891578 - RNA, 22 nt, Human
gacagcauccaagagggaggga

SEQ ID NO: 891579 - RNA, 22 nt, Human
uaacacagacagccacuaguaa

SEQ ID NO: 891580 - RNA, 22 nt, Human
uccaggccccccacgcuaaugg

SEQ ID NO: 891581 - RNA, 22 nt, Human
gugggggcaggcagugcuagga

SEQ ID NO: 891582 - RNA, 22 nt, Human
uccagggcagugacuacagcgg

SEQ ID NO: 891583 - RNA, 22 nt, Human
ucuucuguauuguuaacucagg

SEQ ID NO: 891584 - RNA, 22 nt, Human
gaaaucuacuuuggguuagaca

SEQ ID NO: 891585 - RNA, 20 nt, Human
ucucaggcccccuccuugcu

SEQ ID NO: 891586 - RNA, 22 nt, Human
cccacuccuggagcuagggcuc

SEQ ID NO: 891587 - RNA, 21 nt, Human
cagcaaggaagucgaguaggu

SEQ ID NO: 891588 - RNA, 22 nt, Human
uuuuagaagugccuauccuaug

SEQ ID NO: 891589 - RNA, 22 nt, Human
auccauuugacauaauuucagc

SEQ ID NO: 891590 - RNA, 22 nt, Human
uucauuugucugcuauagaucc

SEQ ID NO: 891591 - RNA, 22 nt, Human
ggaagcacagcauaaaguuacu

SEQ ID NO: 891592 - RNA, 22 nt, Human
gccagcaaggaggggaaaaaug

SEQ ID NO: 891593 - RNA, 22 nt, Human
aggccagguggucaugcuugcu

SEQ ID NO: 891594 - RNA, 22 nt, Human
agaaaguuuugugcuauauaug

SEQ ID NO: 891595 - RNA, 22 nt, Human
auucuagcagauauuggaaauu

SEQ ID NO: 891596 - RNA, 22 nt, Human
aaagcaauagaggguaagacug

SEQ ID NO: 891597 - RNA, 22 nt, Human
cuuuauguccaccagacugcaa

SEQ ID NO: 891598 - RNA, 17 nt, Human
gacaagacagaauucau

SEQ ID NO: 891599 - RNA, 19 nt, Human
uuuucacauacuggauccu

SEQ ID NO: 891600 - RNA, 22 nt, Human
uggggccugcacaggcugaaug

SEQ ID NO: 891601 - RNA, 22 nt, Human
cauauuugguauaacuuaagca

SEQ ID NO: 891602 - RNA, 22 nt, Human
ugaugcuguuccaguuauauug

SEQ ID NO: 891603 - RNA, 22 nt, Human
cacugccuggaaggagagacau

SEQ ID NO: 891604 - RNA, 20 nt, Human
ccugucuggagacaaagaga

SEQ ID NO: 891605 - RNA, 18 nt, Human
ugcaucauuuauggguca

SEQ ID NO: 891606 - RNA, 22 nt, Human
uggcuggcauagccauugcucc

SEQ ID NO: 891607 - RNA, 22 nt, Human
aagaaagggcuauuguucucca

SEQ ID NO: 891608 - RNA, 22 nt, Human
aaggaaagauucucucucuaga

SEQ ID NO: 891609 - RNA, 22 nt, Human
aguuugucugucuucaaagccu

SEQ ID NO: 891610 - RNA, 22 nt, Human
cccaggagauggagguugcagu

SEQ ID NO: 891611 - RNA, 22 nt, Human
cuuagcaaggcugccuggagaa

SEQ ID NO: 891612 - RNA, 22 nt, Human
agucugaggcacccugaauauu

SEQ ID NO: 891613 - RNA, 22 nt, Human
aguucaggcauaaggcaugaac

SEQ ID NO: 891614 - RNA, 22 nt, Human
aauugcaacagguagacuuuuc

SEQ ID NO: 891615 - RNA, 23 nt, Human
uguggcugagaaauugacaacuu

SEQ ID NO: 891616 - RNA, 22 nt, Human
uggacaggugagugacucaggg

SEQ ID NO: 891617 - RNA, 22 nt, Human
gcaggggcugagcaccagcggg

SEQ ID NO: 891618 - RNA, 22 nt, Human
gcuuuggaacuuaaauccuugg

SEQ ID NO: 891619 - RNA, 20 nt, Human
cugaagagacuggaggggca

SEQ ID NO: 891620 - RNA, 22 nt, Human
acaaauuuguguaguuauggca

SEQ ID NO: 891621 - RNA, 22 nt, Human
agcugcccaaggucacagagcu

SEQ ID NO: 891622 - RNA, 22 nt, Human
agggauggaagacuugaagacc

SEQ ID NO: 891623 - RNA, 21 nt, Human
acacaggaguuucuucuuucu

SEQ ID NO: 891624 - RNA, 22 nt, Human
auccuuccagaguuauucucaa

SEQ ID NO: 891625 - RNA, 22 nt, Human
ucauaaaaguacucauguucau

SEQ ID NO: 891626 - RNA, 22 nt, Human
gcaccuggacagugacccuagc

SEQ ID NO: 891627 - RNA, 18 nt, Human
auuucuacuacuauaaag

SEQ ID NO: 891628 - RNA, 22 nt, Human
auuuccaccggcucaggaaguu

SEQ ID NO: 891629 - RNA, 21 nt, Human
auggacaauugagugucuguc

SEQ ID NO: 891630 - RNA, 22 nt, Human
gcagugggagcuuaggcagugc

SEQ ID NO: 891631 - RNA, 22 nt, Human
aguuuauuuuugauaagucuug

SEQ ID NO: 891632 - RNA, 22 nt, Human
gaggaagagagcucugccuugu

SEQ ID NO: 891633 - RNA, 22 nt, Human
ugccccugaccucaggcgaagg

SEQ ID NO: 891634 - RNA, 22 nt, Human
gacacaguucccuaugagguaa

SEQ ID NO: 891635 - RNA, 22 nt, Human
aaauauguaaccaaggugaagu

SEQ ID NO: 891636 - RNA, 22 nt, Human
cuuccaaauguaaauaaguuuc

SEQ ID NO: 891637 - RNA, 22 nt, Human
acauuucuuagccuaguuccag

SEQ ID NO: 891638 - RNA, 23 nt, Human
acaugauacacaauuagcaaacc

SEQ ID NO: 891639 - RNA, 22 nt, Human
cuuauuuuaagucaguuugggu

SEQ ID NO: 891640 - RNA, 22 nt, Human
agaguacugccucaguuaugaa

SEQ ID NO: 891641 - RNA, 22 nt, Human
uuccagaaaucuuucagcucaa

SEQ ID NO: 891642 - RNA, 22 nt, Human
ggcaggcauggccacucccuag

SEQ ID NO: 891643 - RNA, 17 nt, Human
uuacaacaauucaugag

SEQ ID NO: 891644 - RNA, 22 nt, Human
acccagccacagcauugaggga

SEQ ID NO: 891645 - RNA, 22 nt, Human
ucuuaaacuuugcuguaauucu

SEQ ID NO: 891646 - RNA, 22 nt, Human
ugccaggcagugucagauugag

SEQ ID NO: 891647 - RNA, 22 nt, Human
gugggaugcaguggugaguggc

SEQ ID NO: 891648 - RNA, 22 nt, Human
aguguuuaacuucguccugaag

SEQ ID NO: 891649 - RNA, 19 nt, Human
ggacagacgcagagaucug

SEQ ID NO: 891650 - RNA, 22 nt, Human
uaaucuguauuccuacuuugca

SEQ ID NO: 891651 - RNA, 22 nt, Human
guaacaaaguuucuaggugcug

SEQ ID NO: 891652 - RNA, 22 nt, Human
ggccugcuguguacugauguca

SEQ ID NO: 891653 - RNA, 22 nt, Human
uagcauaacagguaagagugag

SEQ ID NO: 891654 - RNA, 22 nt, Human
acugcaaggaggugggguauca

SEQ ID NO: 891655 - RNA, 22 nt, Human
auccugggcugcacccucagcc

SEQ ID NO: 891656 - RNA, 22 nt, Human
ccaaggagcugcaggcacuugu

SEQ ID NO: 891657 - RNA, 22 nt, Human
augcgugcagggguccuccugg

SEQ ID NO: 891658 - RNA, 22 nt, Human
agauacagaccucuuauuaagg

SEQ ID NO: 891659 - RNA, 22 nt, Human
cuagaauacucguauuauuccc

SEQ ID NO: 891660 - RNA, 20 nt, Human
auuugcaucugaauaacuua

SEQ ID NO: 891661 - RNA, 22 nt, Human
guuucuuuugugaucaccaacc

SEQ ID NO: 891662 - RNA, 22 nt, Human
acugcaggccuuggugccagca

SEQ ID NO: 891663 - RNA, 22 nt, Human
agggcugcccagugugagagcu

SEQ ID NO: 891664 - RNA, 22 nt, Human
agagggaucacccuguuucugg

SEQ ID NO: 891665 - RNA, 22 nt, Human
accuagaaacugacagaauauu

SEQ ID NO: 891666 - RNA, 22 nt, Human
guuugaaacaugcaccuggagg

SEQ ID NO: 891667 - RNA, 22 nt, Human
ugaaauacacaaauuuaguaag

SEQ ID NO: 891668 - RNA, 22 nt, Human
agggaguuccgaucugugcacc

SEQ ID NO: 891669 - RNA, 22 nt, Human
ugugacaguaacuugggaugga

SEQ ID NO: 891670 - RNA, 20 nt, Human
acaggcuuuggagucugaau

SEQ ID NO: 891671 - RNA, 22 nt, Human
augugucuucuguggguuugaa

SEQ ID NO: 891672 - RNA, 22 nt, Human
gagaaucucaggcacccagaag

SEQ ID NO: 891673 - RNA, 22 nt, Human
aguccaugguucugacucaucu

SEQ ID NO: 891674 - RNA, 22 nt, Human
cugugagggcagggaccagagg

SEQ ID NO: 891675 - RNA, 22 nt, Human
uaggaaaugcugucuuauugua

SEQ ID NO: 891676 - RNA, 22 nt, Human
uucuuucccuuccagcagcucc

SEQ ID NO: 891677 - RNA, 22 nt, Human
uuuugcaauauguuccugaaua

SEQ ID NO: 891678 - RNA, 22 nt, Human
ucuccaggaaagacacuggacu

SEQ ID NO: 891679 - RNA, 22 nt, Human
agacaaauuuguuuuccugucu

SEQ ID NO: 891680 - RNA, 23 nt, Human
ugggccuggccucccaguccagc

SEQ ID NO: 891681 - RNA, 22 nt, Human
cuuaggcagacugcugaugcag

SEQ ID NO: 891682 - RNA, 22 nt, Human
acagguguacaaugcaugacag

SEQ ID NO: 891683 - RNA, 22 nt, Human
uuucuaaacaaagggaguuugg

SEQ ID NO: 891684 - RNA, 22 nt, Human
ucuauuacuuaccacuaauuca

SEQ ID NO: 891685 - RNA, 22 nt, Human
agcagggcuggggcacgagcca

SEQ ID NO: 891686 - RNA, 22 nt, Human
uagcauuuauggucaugugucc

SEQ ID NO: 891687 - RNA, 22 nt, Human
guucaaaggccuguggaaaggg

SEQ ID NO: 891688 - RNA, 22 nt, Human
acaguguucugcuuuuuaaucc

SEQ ID NO: 891689 - RNA, 22 nt, Human
gcagggguagugucuuccugag

SEQ ID NO: 891690 - RNA, 22 nt, Human
ccucuucucaacuccagccaga

SEQ ID NO: 891691 - RNA, 19 nt, Human
uuacucacauuuagauucc

SEQ ID NO: 891692 - RNA, 22 nt, Human
cuucaaagggucacuauuuauc

SEQ ID NO: 891693 - RNA, 19 nt, Human
ucaguggaugaacauguuu

SEQ ID NO: 891694 - RNA, 22 nt, Human
uagagcaguguuguccaucaga

SEQ ID NO: 891695 - RNA, 22 nt, Human
aacauuucagcaaauaagaaca

SEQ ID NO: 891696 - RNA, 22 nt, Human
ccuggagcacagcccaguccca

SEQ ID NO: 891697 - RNA, 22 nt, Human
ggcagccuugacuagugacuua

SEQ ID NO: 891698 - RNA, 22 nt, Human
aggcucugcagaccccagcugu

SEQ ID NO: 891699 - RNA, 22 nt, Human
aaacacaagaggcaggguacag

SEQ ID NO: 891700 - RNA, 21 nt, Human
aagugccacccacagaugcau

SEQ ID NO: 891701 - RNA, 22 nt, Human
agugcacuggcaccaucucagc

SEQ ID NO: 891702 - RNA, 22 nt, Human
cuggaaguauaggggagaugau

SEQ ID NO: 891703 - RNA, 21 nt, Human
agcagcagaucuggugagggc

SEQ ID NO: 891704 - RNA, 22 nt, Human
ccauccugcauugcuauucaga

SEQ ID NO: 891705 - RNA, 22 nt, Human
uuggcugaaagccaugagaccg

SEQ ID NO: 891706 - RNA, 22 nt, Human
acuguacacacuucucugucuu

SEQ ID NO: 891707 - RNA, 22 nt, Human
ugugaaagcagccaugggcauu

SEQ ID NO: 891708 - RNA, 23 nt, Human
uggggcugauggagacggaccag

SEQ ID NO: 891709 - RNA, 22 nt, Human
aguugacucucaagauccuguu

SEQ ID NO: 891710 - RNA, 22 nt, Human
agaaguuucacaauggguuuua

SEQ ID NO: 891711 - RNA, 22 nt, Human
cuguccugugucagccugaaau

SEQ ID NO: 891712 - RNA, 22 nt, Human
ucugaauauguuuaucaucucu

SEQ ID NO: 891713 - RNA, 22 nt, Human
ugugcaggugcaggaagggggc

SEQ ID NO: 891714 - RNA, 22 nt, Human
aggaaagaaguacauucucaug

SEQ ID NO: 891715 - RNA, 22 nt, Human
cccagggguucugagcagcagc

SEQ ID NO: 891716 - RNA, 22 nt, Human
ugcccacugugucaaagaaaua

SEQ ID NO: 891717 - RNA, 22 nt, Human
uucaguuccuuaucauaggguu

SEQ ID NO: 891718 - RNA, 22 nt, Human
ugggaccucucuugagagagca

SEQ ID NO: 891719 - RNA, 22 nt, Human
gcuuggaguagaaugcauucuu

SEQ ID NO: 891720 - RNA, 22 nt, Human
acagggcuugugacaacuuuaa

SEQ ID NO: 891721 - RNA, 22 nt, Human
uuuggagaaguugcuaaagugu

SEQ ID NO: 891722 - RNA, 22 nt, Human
gaaguuauaaacuuuuccuccc

SEQ ID NO: 891723 - RNA, 20 nt, Human
auucucacauggcuccgggc

SEQ ID NO: 891724 - RNA, 22 nt, Human
cagcagccauguaccacacuca

SEQ ID NO: 891725 - RNA, 22 nt, Human
ccucuuuaaucccauccaugug

SEQ ID NO: 891726 - RNA, 22 nt, Human
augcagaaggagccaugcuugc

SEQ ID NO: 891727 - RNA, 22 nt, Human
auccauuuuaacuguuagugca

SEQ ID NO: 891728 - RNA, 22 nt, Human
cuguugcaugacugugcaugcu

SEQ ID NO: 891729 - RNA, 22 nt, Human
caggcagagacccucuccuaaa

SEQ ID NO: 891730 - RNA, 22 nt, Human
cagugcugggcagaggagagcg

SEQ ID NO: 891731 - RNA, 22 nt, Human
aaugcuaucggcucuaagcaug

SEQ ID NO: 891732 - RNA, 22 nt, Human
ucaauuuccccuauugauagac

SEQ ID NO: 891733 - RNA, 22 nt, Human
auugucuucugucuuauaguuc

SEQ ID NO: 891734 - RNA, 22 nt, Human
ggcagcugcacguugucccguc

SEQ ID NO: 891735 - RNA, 18 nt, Human
gcagugccagccucuccu

SEQ ID NO: 891736 - RNA, 22 nt, Human
aaguauucuggcagucauucag

SEQ ID NO: 891737 - RNA, 21 nt, Human
acuuuaauauacaugaggagg

SEQ ID NO: 891738 - RNA, 22 nt, Human
uaaagguagcaugaaacugcaa

SEQ ID NO: 891739 - RNA, 22 nt, Human
uccagcucaaauucagcuucca

SEQ ID NO: 891740 - RNA, 22 nt, Human
cugauuccagagucuguguucu

SEQ ID NO: 891741 - RNA, 18 nt, Human
uggcaggaaaugcacuuu

SEQ ID NO: 891742 - RNA, 22 nt, Human
uuggucuguaguuuucuuaugu

SEQ ID NO: 891743 - RNA, 22 nt, Human
ucugggagccugaaagugaaug

SEQ ID NO: 891744 - RNA, 22 nt, Human
ucuguccauucagaauggcccu

SEQ ID NO: 891745 - RNA, 22 nt, Human
ggcaagaaccacaauuacuuuu

SEQ ID NO: 891746 - RNA, 22 nt, Human
uugaaacauaaaauauuuccug

SEQ ID NO: 891747 - RNA, 21 nt, Human
cacaauguuggccagguuggu

SEQ ID NO: 891748 - RNA, 22 nt, Human
uaaagcuagaaggugcuguaca

SEQ ID NO: 891749 - RNA, 22 nt, Human
uuccaggacuggguguuugaag

SEQ ID NO: 891750 - RNA, 22 nt, Human
uaaagugcaggcuacucagaag

SEQ ID NO: 891751 - RNA, 22 nt, Human
ugagcagaauguucagauaaau

SEQ ID NO: 891752 - RNA, 22 nt, Human
gggagugugcagaagcuggggg

SEQ ID NO: 891753 - RNA, 22 nt, Human
ucuggcagagugauaggauaag

SEQ ID NO: 891754 - RNA, 22 nt, Human
cagguugguauucaucuccaca

SEQ ID NO: 891755 - RNA, 22 nt, Human
acuuauucugagauuaugauca

SEQ ID NO: 891756 - RNA, 22 nt, Human
uggcucaguuucaguccugguu

SEQ ID NO: 891757 - RNA, 21 nt, Human
agcaggaggcagucacagcuc

SEQ ID NO: 891758 - RNA, 22 nt, Human
aacagcuuugagcaguucugua

SEQ ID NO: 891759 - RNA, 22 nt, Human
gacagcuucuagaggaauuggu

SEQ ID NO: 891760 - RNA, 22 nt, Human
uuugcugacuggaugcaguugg

SEQ ID NO: 891761 - RNA, 22 nt, Human
aacacauauuuuugcugagcau

SEQ ID NO: 891762 - RNA, 22 nt, Human
aggaagggugucaugagcccuu

SEQ ID NO: 891763 - RNA, 22 nt, Human
uauuuggaggccacuguugagu

SEQ ID NO: 891764 - RNA, 22 nt, Human
ggccugaaauagcucugagguu

SEQ ID NO: 891765 - RNA, 22 nt, Human
uuauuccaaaucaugguugcau

SEQ ID NO: 891766 - RNA, 19 nt, Human
caggaaggggcgaaucugg

SEQ ID NO: 891767 - RNA, 22 nt, Human
uuguuauuuaggucuggguuag

SEQ ID NO: 891768 - RNA, 18 nt, Human
gcaaacauucuuccaguc

SEQ ID NO: 891769 - RNA, 22 nt, Human
gacagcagccacagggagaggg

SEQ ID NO: 891770 - RNA, 22 nt, Human
gggcauguaggaauccauggag

SEQ ID NO: 891771 - RNA, 20 nt, Human
ggcauccuucugacccagag

SEQ ID NO: 891772 - RNA, 22 nt, Human
gcacuugagccaaugcuaguag

SEQ ID NO: 891773 - RNA, 22 nt, Human
aaauacauacacuguacguggc

SEQ ID NO: 891774 - RNA, 22 nt, Human
uguuaaacuguauugcauaagg

SEQ ID NO: 891775 - RNA, 20 nt, Human
uccuccagaagggcagggug

SEQ ID NO: 891776 - RNA, 22 nt, Human
ccagaagaccccguccaccucc

SEQ ID NO: 891777 - RNA, 19 nt, Human
cuuccccuguuaccucacu

SEQ ID NO: 891778 - RNA, 22 nt, Human
uuccuccagaagcuguagggga

SEQ ID NO: 891779 - RNA, 22 nt, Human
gcagggcuggguccugucucau

SEQ ID NO: 891780 - RNA, 18 nt, Human
gcauucuguuaaugugga

SEQ ID NO: 891781 - RNA, 18 nt, Human
gggaagaggaucuggccc

SEQ ID NO: 891782 - RNA, 22 nt, Human
ugacacugcaaauauaaauauu

SEQ ID NO: 891783 - RNA, 22 nt, Human
uggcugagaaaaugguuuuagg

SEQ ID NO: 891784 - RNA, 22 nt, Human
cuuuauuagauguagacuuucu

SEQ ID NO: 891785 - RNA, 22 nt, Human
aggcugcuggcaggcguggacg

SEQ ID NO: 891786 - RNA, 22 nt, Human
gugauucugaaauauuagaaaa

SEQ ID NO: 891787 - RNA, 22 nt, Human
cugggcacaggggagcagaguc

SEQ ID NO: 891788 - RNA, 20 nt, Human
aggaggggauagaaucaaag

SEQ ID NO: 891789 - RNA, 22 nt, Human
cucuggagugcagccugguggc

SEQ ID NO: 891790 - RNA, 22 nt, Human
caggcacaagaucggcuagaua

SEQ ID NO: 891791 - RNA, 22 nt, Human
agcugcucuugggugacuucaa

SEQ ID NO: 891792 - RNA, 22 nt, Human
ucuucaugaaugaaucuuugac

SEQ ID NO: 891793 - RNA, 20 nt, Human
gaggcccagagaggugaagc

SEQ ID NO: 891794 - RNA, 22 nt, Human
agccagaaaggggcauuaucug

SEQ ID NO: 891795 - RNA, 22 nt, Human
gacagcagcauguuuacaggcc

SEQ ID NO: 891796 - RNA, 22 nt, Human
cagcccugcucuuagugucucc

SEQ ID NO: 891797 - RNA, 22 nt, Human
uggcccugaaucaaggccagca

SEQ ID NO: 891798 - RNA, 22 nt, Human
cacaaugcagcauguaaaugca

SEQ ID NO: 891799 - RNA, 22 nt, Human
ucucuaaacuuauaugaacuau

SEQ ID NO: 891800 - RNA, 22 nt, Human
gguuuuauuaacuuuaacauca

SEQ ID NO: 891801 - RNA, 22 nt, Human
gggaggcgccgaggguagcuaa

SEQ ID NO: 891802 - RNA, 22 nt, Human
gaggggcugggcagucccugga

SEQ ID NO: 891803 - RNA, 22 nt, Human
gccuucugaucgcuggacugac

SEQ ID NO: 891804 - RNA, 22 nt, Human
uuccaggaacaaacucaccuua

SEQ ID NO: 891805 - RNA, 22 nt, Human
gauuuuaucuuugugugcagua

SEQ ID NO: 891806 - RNA, 22 nt, Human
ccucagggaaugggaggcuggg

SEQ ID NO: 891807 - RNA, 22 nt, Human
ucuaugugcccuuugugugaug

SEQ ID NO: 891808 - RNA, 22 nt, Human
caggcuccacuguaggcagcuc

SEQ ID NO: 891809 - RNA, 22 nt, Human
cuguaaauggaacuauguagua

SEQ ID NO: 891810 - RNA, 22 nt, Human
uagugucugaaugcaccuguuu

SEQ ID NO: 891811 - RNA, 22 nt, Human
gaggcucccucaacucugggug

SEQ ID NO: 891812 - RNA, 22 nt, Human
cagaagaauggugucugagcuc

SEQ ID NO: 891813 - RNA, 22 nt, Human
uuuauccagcagcuauucaaaa

SEQ ID NO: 891814 - RNA, 22 nt, Human
gaugaggaaaccaaggcucagg

SEQ ID NO: 891815 - RNA, 22 nt, Human
cuggccuuuagccccagugucu

SEQ ID NO: 891816 - RNA, 22 nt, Human
uuacagcacagugcuuuuacug

SEQ ID NO: 891817 - RNA, 22 nt, Human
caccaggcugaaccagagggga

SEQ ID NO: 891818 - RNA, 22 nt, Human
gaguccaguuagugaggcuggg

SEQ ID NO: 891819 - RNA, 22 nt, Human
ugcauguggaucauauguccua

SEQ ID NO: 891820 - RNA, 22 nt, Human
gcccugagccaccaaugccauu

SEQ ID NO: 891821 - RNA, 23 nt, Human
gagaaagccggcuaugauccugg

SEQ ID NO: 891822 - RNA, 22 nt, Human
ccacuguaaguuugaaaauaac

SEQ ID NO: 891823 - RNA, 22 nt, Human
ccuucacacagguagaagcaga

SEQ ID NO: 891824 - RNA, 22 nt, Human
acaaguaauuuaugcaaacgga

SEQ ID NO: 891825 - RNA, 22 nt, Human
uccucugacuucugguugaguu

SEQ ID NO: 891826 - RNA, 22 nt, Human
uuucaacaccagagaccaugcg

SEQ ID NO: 891827 - RNA, 22 nt, Human
uguccaugcguauccagggagc

SEQ ID NO: 891828 - RNA, 20 nt, Human
ucuuagcaucacuugcuuaa

SEQ ID NO: 891829 - RNA, 22 nt, Human
gugcaugugucuuuauaguagc

SEQ ID NO: 891830 - RNA, 22 nt, Human
ucugagcacaucacacagcuca

SEQ ID NO: 891831 - RNA, 22 nt, Human
uaaagcuaaccuuagugaacac

SEQ ID NO: 891832 - RNA, 22 nt, Human
augggccuguuccuaugcuggu

SEQ ID NO: 891833 - RNA, 22 nt, Human
acuuuaaagcagaauggcuaug

SEQ ID NO: 891834 - RNA, 22 nt, Human
gacaaagcuuuggcauccuuac

SEQ ID NO: 891835 - RNA, 22 nt, Human
uuuccucugggcccugccaccc

SEQ ID NO: 891836 - RNA, 22 nt, Human
gcagcagcucccuauccaggcu

SEQ ID NO: 891837 - RNA, 22 nt, Human
ugcacacacaugaaguagcaug

SEQ ID NO: 891838 - RNA, 22 nt, Human
cccucucugacuucugaacuug

SEQ ID NO: 891839 - RNA, 22 nt, Human
uagauucuguaaauaaucaagg

SEQ ID NO: 891840 - RNA, 22 nt, Human
ggccaggcugguuccuugaccu

SEQ ID NO: 891841 - RNA, 22 nt, Human
ucuuuagaguuaacaauaauga

SEQ ID NO: 891842 - RNA, 23 nt, Human
ugucuugguuucuucacccuagu

SEQ ID NO: 891843 - RNA, 22 nt, Human
ucaggcagaugcagggauggau

SEQ ID NO: 891844 - RNA, 17 nt, Human
uaucaagaagucuggcc

SEQ ID NO: 891845 - RNA, 22 nt, Human
gccugggauucccagaggggca

SEQ ID NO: 891846 - RNA, 22 nt, Human
ucaaaauuuuauuucucaagga

SEQ ID NO: 891847 - RNA, 22 nt, Human
cacaaugauuugguucaaaaau

SEQ ID NO: 891848 - RNA, 19 nt, Human
acuguucuaacuugcagcu

SEQ ID NO: 891849 - RNA, 22 nt, Human
ggcaccagcacuugggauggcu

SEQ ID NO: 891850 - RNA, 22 nt, Human
aggaaaggccuuugcauuuggu

SEQ ID NO: 891851 - RNA, 22 nt, Human
ucucuuuguggccaggagagga

SEQ ID NO: 891852 - RNA, 22 nt, Human
uccugggacucaacuuagaagg

SEQ ID NO: 891853 - RNA, 22 nt, Human
uccagcagaccaucaaggcuca

SEQ ID NO: 891854 - RNA, 22 nt, Human
ugcuggcugggcugcuggagac

SEQ ID NO: 891855 - RNA, 22 nt, Human
gcauucuugagguguggacuca

SEQ ID NO: 891856 - RNA, 22 nt, Human
aggcccugaccugggagaucua

SEQ ID NO: 891857 - RNA, 22 nt, Human
gggcugcugcccaggaggcacc

SEQ ID NO: 891858 - RNA, 22 nt, Human
uugggcugaacccugcagcuga

SEQ ID NO: 891859 - RNA, 22 nt, Human
aguccagccuucaaucuuagug

SEQ ID NO: 891860 - RNA, 22 nt, Human
cucagaagaacaaaggcucuac

SEQ ID NO: 891861 - RNA, 22 nt, Human
ggagcagagcauuucacagccu

SEQ ID NO: 891862 - RNA, 22 nt, Human
aggaaagauggaaggaggauaa

SEQ ID NO: 891863 - RNA, 22 nt, Human
auuugcuuucagguauaaaagg

SEQ ID NO: 891864 - RNA, 22 nt, Human
augcuucucagcucaaggcaaa

SEQ ID NO: 891865 - RNA, 22 nt, Human
auagauuagcccuauaguuuua

SEQ ID NO: 891866 - RNA, 22 nt, Human
gaaacuuuuaaaccucaugagu

SEQ ID NO: 891867 - RNA, 22 nt, Human
cccaaagaaaacaguaccucag

SEQ ID NO: 891868 - RNA, 22 nt, Human
caaaccugcugcuauuuuaucc

SEQ ID NO: 891869 - RNA, 22 nt, Human
aggcacuuuuugcauuuuagaa

SEQ ID NO: 891870 - RNA, 22 nt, Human
gagcuaguagaacaagugagga

SEQ ID NO: 891871 - RNA, 22 nt, Human
ucccuccuuuaucaaaaagaga

SEQ ID NO: 891872 - RNA, 22 nt, Human
augaccacauuccagcugucca

SEQ ID NO: 891873 - RNA, 22 nt, Human
uccaaggagcagauccagagga

SEQ ID NO: 891874 - RNA, 22 nt, Human
ggguaggaugguagaagggacc

SEQ ID NO: 891875 - RNA, 22 nt, Human
gaugucugggucuuccuggcuu

SEQ ID NO: 891876 - RNA, 22 nt, Human
aagaugcuaauuguggaaguug

SEQ ID NO: 891877 - RNA, 22 nt, Human
augugcucuuauuacccugucg

SEQ ID NO: 891878 - RNA, 19 nt, Human
ucucagaauuggcaaucau

SEQ ID NO: 891879 - RNA, 22 nt, Human
gcaguggcaccgcuggcucugg

SEQ ID NO: 891880 - RNA, 22 nt, Human
ccaggcuggucugaauuucuag

SEQ ID NO: 891881 - RNA, 22 nt, Human
acagcucucccucagagaaaug

SEQ ID NO: 891882 - RNA, 22 nt, Human
uugcuuuagggcaaauauuuca

SEQ ID NO: 891883 - RNA, 22 nt, Human
auacaucaaggaugauggugua

SEQ ID NO: 891884 - RNA, 23 nt, Human
aguggcuggacagacuuuccugg

SEQ ID NO: 891885 - RNA, 21 nt, Human
agaagccuggguggagguggg

SEQ ID NO: 891886 - RNA, 22 nt, Human
acacacacaagcagguugugga

SEQ ID NO: 891887 - RNA, 23 nt, Human
ugcuggagacaagugugagaagg

SEQ ID NO: 891888 - RNA, 22 nt, Human
uggggugggcaugcgcuguccu

SEQ ID NO: 891889 - RNA, 22 nt, Human
cagggucugaaacugaucacag

SEQ ID NO: 891890 - RNA, 22 nt, Human
aacaguggucuggggaguggag

SEQ ID NO: 891891 - RNA, 22 nt, Human
aauaucaggaugcaaagcugug

SEQ ID NO: 891892 - RNA, 22 nt, Human
cuucaggaguaguuaccuagca

SEQ ID NO: 891893 - RNA, 22 nt, Human
acacaaacagucuauagcacca

SEQ ID NO: 891894 - RNA, 22 nt, Human
agaaauggaaauccaagcaacu

SEQ ID NO: 891895 - RNA, 22 nt, Human
ucagcacugaaucuggauuugc

SEQ ID NO: 891896 - RNA, 22 nt, Human
uggagcuggcuuguggaaguug

SEQ ID NO: 891897 - RNA, 22 nt, Human
ccugagcaaaggcccagaggga

SEQ ID NO: 891898 - RNA, 22 nt, Human
gagcagcaguuguuacaaugau

SEQ ID NO: 891899 - RNA, 22 nt, Human
agggaaaucuuucaacacuuca

SEQ ID NO: 891900 - RNA, 22 nt, Human
augccauuuuauacucauucaa

SEQ ID NO: 891901 - RNA, 21 nt, Human
agaggccaagucaucauuucc

SEQ ID NO: 891902 - RNA, 22 nt, Human
uugcaggguuaaaguaagguag

SEQ ID NO: 891903 - RNA, 22 nt, Human
ucagccaguauuugagugcuca

SEQ ID NO: 891904 - RNA, 22 nt, Human
acaguuguuuuccagauauguu

SEQ ID NO: 891905 - RNA, 19 nt, Human
ccugcugaagugaugcagc

SEQ ID NO: 891906 - RNA, 22 nt, Human
acuguccagaagauagaaauau

SEQ ID NO: 891907 - RNA, 22 nt, Human
agaggucagcugcaugccacau

SEQ ID NO: 891908 - RNA, 22 nt, Human
gcuggcauggagacucuggguc

SEQ ID NO: 891909 - RNA, 22 nt, Human
uuaauuaguagaggcauuuagu

SEQ ID NO: 891910 - RNA, 18 nt, Human
ucugaaggaaugauucca

SEQ ID NO: 891911 - RNA, 20 nt, Human
aacaguaccccccuuguucu

SEQ ID NO: 891912 - RNA, 22 nt, Human
gcaggcagaucaccugucagga

SEQ ID NO: 891913 - RNA, 22 nt, Human
uucaaaaguaaucaguauuaga

SEQ ID NO: 891914 - RNA, 22 nt, Human
acugcagguggauggcacuuua

SEQ ID NO: 891915 - RNA, 18 nt, Human
uguccauguuguuccuga

SEQ ID NO: 891916 - RNA, 22 nt, Human
aaucaaaaccuacagagguaau

SEQ ID NO: 891917 - RNA, 22 nt, Human
gccauucaauucuacaaguaua

SEQ ID NO: 891918 - RNA, 22 nt, Human
uaggcagggauuaggguugauu

SEQ ID NO: 891919 - RNA, 17 nt, Human
caggccuugagccuuua

SEQ ID NO: 891920 - RNA, 22 nt, Human
aauaaauguuuguuggauguuu

SEQ ID NO: 891921 - RNA, 23 nt, Human
ccaggccucucagagggugugcc

SEQ ID NO: 891922 - RNA, 22 nt, Human
cagcuucuggcguggagccuga

SEQ ID NO: 891923 - RNA, 22 nt, Human
uuucuugagugaugcuuagugu

SEQ ID NO: 891924 - RNA, 22 nt, Human
cucuuacauucuuuuacuagca

SEQ ID NO: 891925 - RNA, 22 nt, Human
aagcuagaugacguuauuuuuu

SEQ ID NO: 891926 - RNA, 19 nt, Human
gguccagacuucagacuag

SEQ ID NO: 891927 - RNA, 22 nt, Human
aucuuuuuacuaacacugcuua

SEQ ID NO: 891928 - RNA, 22 nt, Human
ugggccaguuucucauugaaau

SEQ ID NO: 891929 - RNA, 22 nt, Human
uuuggaauagcauagaagcuca

SEQ ID NO: 891930 - RNA, 22 nt, Human
ucacagagcucacaguuuagca

SEQ ID NO: 891931 - RNA, 22 nt, Human
gggcuucuugccauggggacgg

SEQ ID NO: 891932 - RNA, 22 nt, Human
uucacauuucucugcuguuuga

SEQ ID NO: 891933 - RNA, 22 nt, Human
gaccaaaugaaaggauggaugg

SEQ ID NO: 891934 - RNA, 22 nt, Human
gaugggaggaaccugggucccu

SEQ ID NO: 891935 - RNA, 22 nt, Human
cagaaggcuggcagauugagau

SEQ ID NO: 891936 - RNA, 22 nt, Human
ccucaggcugggcugccccugg

SEQ ID NO: 891937 - RNA, 22 nt, Human
cuuggagucaauaagaucuaga

SEQ ID NO: 891938 - RNA, 22 nt, Human
ucauauacugccuuguagauua

SEQ ID NO: 891939 - RNA, 22 nt, Human
uuucacaucaugggauggaagc

SEQ ID NO: 891940 - RNA, 22 nt, Human
uugcagcaugcauagacacugc

SEQ ID NO: 891941 - RNA, 22 nt, Human
aacacuaaaggucaguuagaag

SEQ ID NO: 891942 - RNA, 22 nt, Human
cugggcuuugguacugugauua

SEQ ID NO: 891943 - RNA, 22 nt, Human
ugcgcggcucagucaucuccag

SEQ ID NO: 891944 - RNA, 22 nt, Human
aauuaacagagggcuuauuacu

SEQ ID NO: 891945 - RNA, 22 nt, Human
gcaaauguucacggggagcaua

SEQ ID NO: 891946 - RNA, 22 nt, Human
ucaaaugcugccuuugugugcc

SEQ ID NO: 891947 - RNA, 22 nt, Human
uuugcugugcuuacauauguau

SEQ ID NO: 891948 - RNA, 22 nt, Human
caguucccuaauguguagaaga

SEQ ID NO: 891949 - RNA, 22 nt, Human
uuaacugagaggaucugaguag

SEQ ID NO: 891950 - RNA, 22 nt, Human
aagcagaaaaacugagcuccaa

SEQ ID NO: 891951 - RNA, 21 nt, Human
uugcuuauggcacugcuuugc

SEQ ID NO: 891952 - RNA, 18 nt, Human
ugauggaggagggcuggu

SEQ ID NO: 891953 - RNA, 22 nt, Human
ugaaguuuucugguugauuaag

SEQ ID NO: 891954 - RNA, 22 nt, Human
uaggagcuuuuggaguccugug

SEQ ID NO: 891955 - RNA, 22 nt, Human
ccucuguguccuggucauugaa

SEQ ID NO: 891956 - RNA, 22 nt, Human
ucuugucacuacuguuaugcau

SEQ ID NO: 891957 - RNA, 22 nt, Human
ccuuuagaaagucaguaguugc

SEQ ID NO: 891958 - RNA, 20 nt, Human
cugcuuaaguaagugacaca

SEQ ID NO: 891959 - RNA, 23 nt, Human
uccuugggccugcccagaguggu

SEQ ID NO: 891960 - RNA, 22 nt, Human
uggcugcuuguuuuagugaggc

SEQ ID NO: 891961 - RNA, 19 nt, Human
uuucaggagcuaugcaggg

SEQ ID NO: 891962 - RNA, 22 nt, Human
aaguuuagugaaacucuagggg

SEQ ID NO: 891963 - RNA, 22 nt, Human
uugaaacagacaaguaaauguc

SEQ ID NO: 891964 - RNA, 22 nt, Human
ggcugccugguuuagugcugac

SEQ ID NO: 891965 - RNA, 22 nt, Human
acuguuuucuguaaagggccag

SEQ ID NO: 891966 - RNA, 22 nt, Human
aaauuagucgguuuaggaauuu

SEQ ID NO: 891967 - RNA, 22 nt, Human
uuagaacaauauucucccuaca

SEQ ID NO: 891968 - RNA, 22 nt, Human
acaguucugaagacuagagccu

SEQ ID NO: 891969 - RNA, 22 nt, Human
uuuacacauaaauguguagaca

SEQ ID NO: 891970 - RNA, 22 nt, Human
uuuggaaaugaccccgucuaag

SEQ ID NO: 891971 - RNA, 22 nt, Human
uugugugcauaaauucugaugu

SEQ ID NO: 891972 - RNA, 22 nt, Human
uuucaguggguuuauuucaugu

SEQ ID NO: 891973 - RNA, 22 nt, Human
acaugcucuccaaggacagagc

SEQ ID NO: 891974 - RNA, 22 nt, Human
gccaggcacugcucuaagcccu

SEQ ID NO: 891975 - RNA, 22 nt, Human
uauuuucuggggagagugaacc

SEQ ID NO: 891976 - RNA, 22 nt, Human
ugcagauucaaaugaaaugcaa

SEQ ID NO: 891977 - RNA, 22 nt, Human
gaaguucaggugggaauugagc

SEQ ID NO: 891978 - RNA, 22 nt, Human
agucaggaagcuggagcugggg

SEQ ID NO: 891979 - RNA, 23 nt, Human
aacacuugcaugaacagcuacac

SEQ ID NO: 891980 - RNA, 22 nt, Human
uauguuaacauguuaggaacug

SEQ ID NO: 891981 - RNA, 22 nt, Human
gccugagcccaggugugcagag

SEQ ID NO: 891982 - RNA, 22 nt, Human
uccauacauacagauaugcauu

SEQ ID NO: 891983 - RNA, 22 nt, Human
acauuuacuuaucaaaagucag

SEQ ID NO: 891984 - RNA, 22 nt, Human
ucaguuucacagucugugcaga

SEQ ID NO: 891985 - RNA, 22 nt, Human
ugccugggcucgguagccaucg

SEQ ID NO: 891986 - RNA, 22 nt, Human
ggcagucacuuuugcuugugcc

SEQ ID NO: 891987 - RNA, 22 nt, Human
uauaauccugcuucacauugaa

SEQ ID NO: 891988 - RNA, 22 nt, Human
cuuucaguuaguaccuaguggc

SEQ ID NO: 891989 - RNA, 22 nt, Human
acaggggauugauuggaagucu

SEQ ID NO: 891990 - RNA, 22 nt, Human
uuuggaauuccauuucugcauu

SEQ ID NO: 891991 - RNA, 22 nt, Human
ugcucuggacgcugagugguuu

SEQ ID NO: 891992 - RNA, 22 nt, Human
uuucaaauggagucgugaaaug

SEQ ID NO: 891993 - RNA, 22 nt, Human
ucuuuggacuuuccaauuuguu

SEQ ID NO: 891994 - RNA, 22 nt, Human
cagucucuggcagcugcuggcc

SEQ ID NO: 891995 - RNA, 22 nt, Human
uaaaugcaaugugcuuuaccag

SEQ ID NO: 891996 - RNA, 22 nt, Human
aggcucaguuugguuuccauug

SEQ ID NO: 891997 - RNA, 22 nt, Human
gagagcuggauucuggauaggu

SEQ ID NO: 891998 - RNA, 18 nt, Human
gagcugagaagaggaugc

SEQ ID NO: 891999 - RNA, 19 nt, Human
gcagcaaacaaaacaggua

SEQ ID NO: 892000 - RNA, 22 nt, Human
ggucucgagccaggcagcugca

SEQ ID NO: 892001 - RNA, 22 nt, Human
ccugugggagggagcggcugga

SEQ ID NO: 892002 - RNA, 22 nt, Human
ugggccacagcucacacaucca

SEQ ID NO: 892003 - RNA, 22 nt, Human
gccggccagcaagcuucaggug

SEQ ID NO: 892004 - RNA, 22 nt, Human
agcugcaaagaugauuuguugu

SEQ ID NO: 892005 - RNA, 22 nt, Human
auuugcuuggucuucucuccgu

SEQ ID NO: 892006 - RNA, 22 nt, Human
acuucauguaguccaucagguu

SEQ ID NO: 892007 - RNA, 22 nt, Human
gugugccuaugaguggugaaca

SEQ ID NO: 892008 - RNA, 20 nt, Human
cucuggcaaaggaugccuau

SEQ ID NO: 892009 - RNA, 22 nt, Human
uuguauuucgaugcacguguag

SEQ ID NO: 892010 - RNA, 22 nt, Human
auuuucaucgcuagguuggccu

SEQ ID NO: 892011 - RNA, 17 nt, Human
agacagugagugccuug

SEQ ID NO: 892012 - RNA, 22 nt, Human
uacagaaagaccucucgggaaa

SEQ ID NO: 892013 - RNA, 22 nt, Human
auuugucaaaacacagagaaca

SEQ ID NO: 892014 - RNA, 22 nt, Human
auccacuucacuggaauguagg

SEQ ID NO: 892015 - RNA, 22 nt, Human
ggcugccucuauuuaggaucaa

SEQ ID NO: 892016 - RNA, 22 nt, Human
uacauugaauuuuuuagcaugu

SEQ ID NO: 892017 - RNA, 22 nt, Human
cugggcccuauggaagaaaggg

SEQ ID NO: 892018 - RNA, 22 nt, Human
caucccugguuccuguguuuaa

SEQ ID NO: 892019 - RNA, 22 nt, Human
gaauacaaagcagaacucauac

SEQ ID NO: 892020 - RNA, 22 nt, Human
agguggaguuggcuguaguuca

SEQ ID NO: 892021 - RNA, 22 nt, Human
cagggccuuguucaggagugaa

SEQ ID NO: 892022 - RNA, 23 nt, Human
cucccugaacaugacacaccaga

SEQ ID NO: 892023 - RNA, 22 nt, Human
ggcacauggagacuuggcauca

SEQ ID NO: 892024 - RNA, 22 nt, Human
uggcaguuauauugccuuaggg

SEQ ID NO: 892025 - RNA, 20 nt, Human
auuuauguauagcuuguugu

SEQ ID NO: 892026 - RNA, 22 nt, Human
acagguguagcaggagcaucaa

SEQ ID NO: 892027 - RNA, 22 nt, Human
gcuuaagauguuuguggcaauu

SEQ ID NO: 892028 - RNA, 17 nt, Human
aacaguaagcccuguuu

SEQ ID NO: 892029 - RNA, 22 nt, Human
cagaagugcaauuuaaauuagg

SEQ ID NO: 892030 - RNA, 22 nt, Human
auuuaauuugugucuuuagcug

SEQ ID NO: 892031 - RNA, 22 nt, Human
agggaacauuugcacuguuggu

SEQ ID NO: 892032 - RNA, 22 nt, Human
gaagaggacuguggcauccuag

SEQ ID NO: 892033 - RNA, 22 nt, Human
agcucugcaggcacagcugagg

SEQ ID NO: 892034 - RNA, 22 nt, Human
ucaguguggaaaauccuuuggc

SEQ ID NO: 892035 - RNA, 22 nt, Human
aacacuagucuagaccagacca

SEQ ID NO: 892036 - RNA, 22 nt, Human
auggaucagaaucccgggaggg

SEQ ID NO: 892037 - RNA, 22 nt, Human
uaauuacaaagcaagcacaggg

SEQ ID NO: 892038 - RNA, 22 nt, Human
gcaguucacccaagugcagaga

SEQ ID NO: 892039 - RNA, 22 nt, Human
ggcaauauggugaaaccccauc

SEQ ID NO: 892040 - RNA, 22 nt, Human
ggcagugcaaggcuggcacagu

SEQ ID NO: 892041 - RNA, 22 nt, Human
aaaugcauugguuucuacuugu

SEQ ID NO: 892042 - RNA, 18 nt, Human
uacagauuauagauacau

SEQ ID NO: 892043 - RNA, 22 nt, Human
uccagaggggcagcccugugcu

SEQ ID NO: 892044 - RNA, 20 nt, Human
agaaacagcacaauucuguu

SEQ ID NO: 892045 - RNA, 22 nt, Human
ugucagugucuaugaagaauuu

SEQ ID NO: 892046 - RNA, 22 nt, Human
uuuccuuugggcacccgagcuc

SEQ ID NO: 892047 - RNA, 21 nt, Human
ggccuaggggcagauggugcu

SEQ ID NO: 892048 - RNA, 22 nt, Human
ggcuguguuccaagugucagga

SEQ ID NO: 892049 - RNA, 22 nt, Human
agaacaguuuguuggagacugu

SEQ ID NO: 892050 - RNA, 22 nt, Human
ccacuggagacuggucucugug

SEQ ID NO: 892051 - RNA, 22 nt, Human
aagaggaguagaugugguuggu

SEQ ID NO: 892052 - RNA, 22 nt, Human
cugcaucucaggagacgggucu

SEQ ID NO: 892053 - RNA, 22 nt, Human
auuugccuuucgaaucaacagg

SEQ ID NO: 892054 - RNA, 22 nt, Human
gcaggaagaggcucgaagcccc

SEQ ID NO: 892055 - RNA, 20 nt, Human
cagcccugugaccuggcccu

SEQ ID NO: 892056 - RNA, 22 nt, Human
aaagcaggguccaaggagaugu

SEQ ID NO: 892057 - RNA, 22 nt, Human
cauaacaguggcuucagcaagu

SEQ ID NO: 892058 - RNA, 22 nt, Human
guuugcugccaccaccgccaca

SEQ ID NO: 892059 - RNA, 22 nt, Human
cagauuugccacuuacucguug

SEQ ID NO: 892060 - RNA, 22 nt, Human
uagcagcacuauuuguuguagu

SEQ ID NO: 892061 - RNA, 22 nt, Human
ucccaggaauccguccucuaga

SEQ ID NO: 892062 - RNA, 22 nt, Human
agcacagugcugggcacacagu

SEQ ID NO: 892063 - RNA, 22 nt, Human
caggaugguggcaugaucagaa

SEQ ID NO: 892064 - RNA, 22 nt, Human
uguuuugcuucucuguuuccca

SEQ ID NO: 892065 - RNA, 22 nt, Human
uaagcaaugcuguaguucaguc

SEQ ID NO: 892066 - RNA, 23 nt, Human
uuuauagcagcaugauuuauaau

SEQ ID NO: 892067 - RNA, 22 nt, Human
gggugagagucaggcagagauu

SEQ ID NO: 892068 - RNA, 22 nt, Human
gcucacaguacagugcuggcuc

SEQ ID NO: 892069 - RNA, 19 nt, Human
ugcagaggguaggaaggcc

SEQ ID NO: 892070 - RNA, 21 nt, Human
aauacagugaagaauuucuuu

SEQ ID NO: 892071 - RNA, 22 nt, Human
gcaaugcaaucuuuauuauauu

SEQ ID NO: 892072 - RNA, 22 nt, Human
uguggccagcagguggcugugu

SEQ ID NO: 892073 - RNA, 22 nt, Human
cuggugcuggagccuagucccu

SEQ ID NO: 892074 - RNA, 22 nt, Human
aaaagagucuuaggcagucaua

SEQ ID NO: 892075 - RNA, 22 nt, Human
agcuacuacuaccaaacuaaag

SEQ ID NO: 892076 - RNA, 22 nt, Human
aaaggcucuauuguuuucauau

SEQ ID NO: 892077 - RNA, 19 nt, Human
uggucccauacugcuggcc

SEQ ID NO: 892078 - RNA, 22 nt, Human
ucacagugggacuuuuaucgcu

SEQ ID NO: 892079 - RNA, 22 nt, Human
cacacaugguagcagguacaag

SEQ ID NO: 892080 - RNA, 22 nt, Human
augcaauaguaauucuagucug

SEQ ID NO: 892081 - RNA, 22 nt, Human
cggcccuggcggaggcgggaga

SEQ ID NO: 892082 - RNA, 22 nt, Human
aaagcuuuguaaauaaacaggu

SEQ ID NO: 892083 - RNA, 22 nt, Human
cuucuagcuauaguguuuucuu

SEQ ID NO: 892084 - RNA, 17 nt, Human
ugacccuguuggguguu

SEQ ID NO: 892085 - RNA, 22 nt, Human
ccagggugggaggcugaaggcg

SEQ ID NO: 892086 - RNA, 22 nt, Human
uaacacugaaaaugaugcaugu

SEQ ID NO: 892087 - RNA, 22 nt, Human
gcccuguguauccccugugcuu

SEQ ID NO: 892088 - RNA, 22 nt, Human
uuuuccucuguauuugaaaugc

SEQ ID NO: 892089 - RNA, 22 nt, Human
cagaaccugaacgugaggugga

SEQ ID NO: 892090 - RNA, 22 nt, Human
acaugagaagcugcaacaugac

SEQ ID NO: 892091 - RNA, 22 nt, Human
cauugaaacagauguacccaug

SEQ ID NO: 892092 - RNA, 17 nt, Human
ggagccaggagcccacc

SEQ ID NO: 892093 - RNA, 22 nt, Human
ugugcuuacuuugaauuauaua

SEQ ID NO: 892094 - RNA, 22 nt, Human
cauuaacaaugacugcuugacu

SEQ ID NO: 892095 - RNA, 22 nt, Human
uugcaaguuccuuaugagaauc

SEQ ID NO: 892096 - RNA, 22 nt, Human
cagauacauuaaaaugaugauu

SEQ ID NO: 892097 - RNA, 22 nt, Human
cucagccaugucaugccuaccu

SEQ ID NO: 892098 - RNA, 22 nt, Human
cagaaauguacugacaugcagu

SEQ ID NO: 892099 - RNA, 20 nt, Human
auacaaucaugaggaaaaag

SEQ ID NO: 892100 - RNA, 22 nt, Human
gcugggcucaccaggccacuag

SEQ ID NO: 892101 - RNA, 22 nt, Human
ccaggccuucugaggacacucu

SEQ ID NO: 892102 - RNA, 22 nt, Human
augggaguuggguaaggaucau

SEQ ID NO: 892103 - RNA, 23 nt, Human
gcccaugcuguugggcccgagca

SEQ ID NO: 892104 - RNA, 22 nt, Human
agaguggcaccuuaccugagac

SEQ ID NO: 892105 - RNA, 22 nt, Human
ucucucugaguugagcaggagu

SEQ ID NO: 892106 - RNA, 22 nt, Human
caggccugacccugagcuucac

SEQ ID NO: 892107 - RNA, 21 nt, Human
agaggaagugauuggucuggc

SEQ ID NO: 892108 - RNA, 22 nt, Human
ugaguccuaaagcugugcccuu

SEQ ID NO: 892109 - RNA, 20 nt, Human
aggucugaaugucagggcug

SEQ ID NO: 892110 - RNA, 22 nt, Human
aaaaaaucagaucuuugguuaa

SEQ ID NO: 892111 - RNA, 22 nt, Human
uucagagguagagaggaucuug

SEQ ID NO: 892112 - RNA, 22 nt, Human
ggagggagucagcugauuagaa

SEQ ID NO: 892113 - RNA, 22 nt, Human
ucuggcuccacucugugcaugc

SEQ ID NO: 892114 - RNA, 20 nt, Human
uuuugauagcaaagacggua

SEQ ID NO: 892115 - RNA, 22 nt, Human
aaggaggaauaaagagguggug

SEQ ID NO: 892116 - RNA, 22 nt, Human
uggcauggcaacccugcaggga

SEQ ID NO: 892117 - RNA, 22 nt, Human
cccacaggcccugcugccuuga

SEQ ID NO: 892118 - RNA, 20 nt, Human
uaacagggcccuagaaagag

SEQ ID NO: 892119 - RNA, 22 nt, Human
ugacaagcuuuacagaauugaa

SEQ ID NO: 892120 - RNA, 22 nt, Human
auacuacaaucauaauuguaca

SEQ ID NO: 892121 - RNA, 22 nt, Human
caggguaguaauuuaauacaag

SEQ ID NO: 892122 - RNA, 21 nt, Human
acuggaagugggucaggaagu

SEQ ID NO: 892123 - RNA, 22 nt, Human
uauuuucuggacagucuugcuu

SEQ ID NO: 892124 - RNA, 22 nt, Human
gcccaggaguugaagggcugac

SEQ ID NO: 892125 - RNA, 22 nt, Human
augagguaguauuagaaggaga

SEQ ID NO: 892126 - RNA, 22 nt, Human
guuuuccuucucagccauugcc

SEQ ID NO: 892127 - RNA, 22 nt, Human
ccagucuguacuuugcucuguu

SEQ ID NO: 892128 - RNA, 22 nt, Human
uugagaacucuguauguccagc

SEQ ID NO: 892129 - RNA, 22 nt, Human
acauugaagcugugaaaucaaa

SEQ ID NO: 892130 - RNA, 22 nt, Human
auucauuccaggucagucagac

SEQ ID NO: 892131 - RNA, 22 nt, Human
uaaagcagugugguuguguccc

SEQ ID NO: 892132 - RNA, 22 nt, Human
aggucacuuccugucuggauaa

SEQ ID NO: 892133 - RNA, 22 nt, Human
uuuguuuacaaaaauaagcagu

SEQ ID NO: 892134 - RNA, 22 nt, Human
gaauacaugauuaaaguuugau

SEQ ID NO: 892135 - RNA, 22 nt, Human
gcaggaguaugcagcuaugguu

SEQ ID NO: 892136 - RNA, 22 nt, Human
cccagccucuguuugcuccucu

SEQ ID NO: 892137 - RNA, 23 nt, Human
agcagugaguaaacagauaggau

SEQ ID NO: 892138 - RNA, 19 nt, Human
cagugcccgacgcaggucu

SEQ ID NO: 892139 - RNA, 22 nt, Human
gcucugaguaaaugaaagcauu

SEQ ID NO: 892140 - RNA, 22 nt, Human
agcccugggcuguagauaagca

SEQ ID NO: 892141 - RNA, 22 nt, Human
augcaaauaaagcaacuauaca

SEQ ID NO: 892142 - RNA, 22 nt, Human
ucugugcagaaucaaggagcuu

SEQ ID NO: 892143 - RNA, 22 nt, Human
ccugucuaucaagacaucuuca

SEQ ID NO: 892144 - RNA, 22 nt, Human
acagaugaugugcacagauaga

SEQ ID NO: 892145 - RNA, 22 nt, Human
gugggcagcaccagggaagugu

SEQ ID NO: 892146 - RNA, 22 nt, Human
ucaggcugcuggccagcaggcu

SEQ ID NO: 892147 - RNA, 22 nt, Human
aaaaagacuuccaacucaggag

SEQ ID NO: 892148 - RNA, 23 nt, Human
gccucagagaaacagcugcacac

SEQ ID NO: 892149 - RNA, 22 nt, Human
gagcuccucccaggguagcacu

SEQ ID NO: 892150 - RNA, 22 nt, Human
ugggcugaguggcagccagagu

SEQ ID NO: 892151 - RNA, 22 nt, Human
ggcuuggaaacuagagugugca

SEQ ID NO: 892152 - RNA, 22 nt, Human
ggcagcaugugugguccgcugg

SEQ ID NO: 892153 - RNA, 22 nt, Human
aaaucucuggucacagaacuua

SEQ ID NO: 892154 - RNA, 22 nt, Human
acagaagauaaugcugccuugg

SEQ ID NO: 892155 - RNA, 22 nt, Human
uuugaugaugaugauaaaguuu

SEQ ID NO: 892156 - RNA, 22 nt, Human
uucuucuuuccuauaauuaauu

SEQ ID NO: 892157 - RNA, 22 nt, Human
aggacagcagugcuggcacuug

SEQ ID NO: 892158 - RNA, 22 nt, Human
uccagccugguugcgggcaucc

SEQ ID NO: 892159 - RNA, 22 nt, Human
acauggagcucaaacaugagug

SEQ ID NO: 892160 - RNA, 22 nt, Human
agucuuacaugagaaagaaccu

SEQ ID NO: 892161 - RNA, 22 nt, Human
caguuuauaugucagagcugua

SEQ ID NO: 892162 - RNA, 22 nt, Human
ugugugaauucugagcaguuua

SEQ ID NO: 892163 - RNA, 22 nt, Human
uugucugacuucuuuaguuacu

SEQ ID NO: 892164 - RNA, 22 nt, Human
gacagccagugcgauggauuca

SEQ ID NO: 892165 - RNA, 22 nt, Human
cuggcagcagagcucaacauag

SEQ ID NO: 892166 - RNA, 22 nt, Human
cccaccagccaucugagagugu

SEQ ID NO: 892167 - RNA, 22 nt, Human
aagcaggcucacgccaggcagu

SEQ ID NO: 892168 - RNA, 22 nt, Human
gggcaggugaccucuuguccug

SEQ ID NO: 892169 - RNA, 22 nt, Human
aggcaggcccugggccaucccg

SEQ ID NO: 892170 - RNA, 22 nt, Human
agccuaggagguuggggcugca

SEQ ID NO: 892171 - RNA, 22 nt, Human
auggccagccacuccugauggc

SEQ ID NO: 892172 - RNA, 22 nt, Human
aaggaucuuucuuuuuaccauu

SEQ ID NO: 892173 - RNA, 22 nt, Human
auauacaguuuuacaggguuuc

SEQ ID NO: 892174 - RNA, 19 nt, Human
ucauaaggagagaggaaau

SEQ ID NO: 892175 - RNA, 22 nt, Human
gagggguccugccuuggcugga

SEQ ID NO: 892176 - RNA, 23 nt, Human
acaagauagggauaaaaagauaa

SEQ ID NO: 892177 - RNA, 22 nt, Human
agguauauguucauguaugugu

SEQ ID NO: 892178 - RNA, 22 nt, Human
auuuacauuccauggugguuac

SEQ ID NO: 892179 - RNA, 22 nt, Human
caggauggagggagggcuguua

SEQ ID NO: 892180 - RNA, 22 nt, Human
uuagugguacucagggagggaa

SEQ ID NO: 892181 - RNA, 22 nt, Human
uugcuacaugguuucaaagcug

SEQ ID NO: 892182 - RNA, 22 nt, Human
ugcuguguggaugugaagaauc

SEQ ID NO: 892183 - RNA, 22 nt, Human
uccauguugagaaugcuauaau

SEQ ID NO: 892184 - RNA, 22 nt, Human
ucugggcuggugcucaugaauu

SEQ ID NO: 892185 - RNA, 22 nt, Human
ggaaugaauuuccagcuggguc

SEQ ID NO: 892186 - RNA, 22 nt, Human
aggaagaaaacuaauuagaugg

SEQ ID NO: 892187 - RNA, 22 nt, Human
uuuauuucuuaguuugccacag

SEQ ID NO: 892188 - RNA, 22 nt, Human
gacuuuauccugccugaccacg

SEQ ID NO: 892189 - RNA, 22 nt, Human
uagaaagcccuguguucacugc

SEQ ID NO: 892190 - RNA, 22 nt, Human
uuacacagaugguuaguagagg

SEQ ID NO: 892191 - RNA, 22 nt, Human
ccaggagcaggagcugcagcug

SEQ ID NO: 892192 - RNA, 22 nt, Human
cagaacugggcagggagcagag

SEQ ID NO: 892193 - RNA, 22 nt, Human
cauauuuauucuucugccagug

SEQ ID NO: 892194 - RNA, 22 nt, Human
agacagggagggagcgcggcug

SEQ ID NO: 892195 - RNA, 22 nt, Human
gaaaaguacacagcccaaacau

SEQ ID NO: 892196 - RNA, 22 nt, Human
ucugaggccccagcccugcaca

SEQ ID NO: 892197 - RNA, 22 nt, Human
uggcccugacacgugguacugg

SEQ ID NO: 892198 - RNA, 22 nt, Human
ugugacaggaacuauguggaug

SEQ ID NO: 892199 - RNA, 22 nt, Human
cagauagaaugcaagaccucuc

SEQ ID NO: 892200 - RNA, 22 nt, Human
cagauaaauagacuuggucaga

SEQ ID NO: 892201 - RNA, 22 nt, Human
uuccuguggcugucacuccugg

SEQ ID NO: 892202 - RNA, 22 nt, Human
ugaaauuuaggugcagauaaau

SEQ ID NO: 892203 - RNA, 20 nt, Human
acucuggggcucauuagggg

SEQ ID NO: 892204 - RNA, 22 nt, Human
cagugggguuucugugggugcu

SEQ ID NO: 892205 - RNA, 22 nt, Human
ccaggagcgcgugaacaggcug

SEQ ID NO: 892206 - RNA, 22 nt, Human
uagaacaugugaaaauauagcc

SEQ ID NO: 892207 - RNA, 22 nt, Human
augugugccugagugauggacu

SEQ ID NO: 892208 - RNA, 22 nt, Human
aaacacuucuuaggucuuaagu

SEQ ID NO: 892209 - RNA, 22 nt, Human
cuccccacauuucucccugucu

SEQ ID NO: 892210 - RNA, 22 nt, Human
uggcucagcgguggcagcagac

SEQ ID NO: 892211 - RNA, 22 nt, Human
cucuggaguggguggccgggag

SEQ ID NO: 892212 - RNA, 18 nt, Human
ugguccaguucagauaua

SEQ ID NO: 892213 - RNA, 23 nt, Human
cagcccugaaaucgaggugacac

SEQ ID NO: 892214 - RNA, 22 nt, Human
uuagcauuguacauuugugcuu

SEQ ID NO: 892215 - RNA, 22 nt, Human
acuuggcaggucaggggauauu

SEQ ID NO: 892216 - RNA, 22 nt, Human
aaggagaaggguaaucaacaca

SEQ ID NO: 892217 - RNA, 22 nt, Human
agugggguccucaguaugguuc

SEQ ID NO: 892218 - RNA, 22 nt, Human
ccccagccuuccaugggaauug

SEQ ID NO: 892219 - RNA, 22 nt, Human
ucugauaauggacuucucaucu

SEQ ID NO: 892220 - RNA, 22 nt, Human
uaagaacauaaauucauacggg

SEQ ID NO: 892221 - RNA, 22 nt, Human
ugagaaauucgacauauauuua

SEQ ID NO: 892222 - RNA, 22 nt, Human
uagcaaagagaaaaauuaugcu

SEQ ID NO: 892223 - RNA, 20 nt, Human
agucacaugcauacacaagu

SEQ ID NO: 892224 - RNA, 22 nt, Human
uauuuggauagacagggagaug

SEQ ID NO: 892225 - RNA, 22 nt, Human
caggagcaaggagcagugggau

SEQ ID NO: 892226 - RNA, 22 nt, Human
aagagggguggucugugaggau

SEQ ID NO: 892227 - RNA, 22 nt, Human
acagaagaccagagagcuaacu

SEQ ID NO: 892228 - RNA, 20 nt, Human
uggcuccucuuggcuguggc

SEQ ID NO: 892229 - RNA, 20 nt, Human
ggggggcuucagggccugug

SEQ ID NO: 892230 - RNA, 22 nt, Human
agaaauacugugagagcagccu

SEQ ID NO: 892231 - RNA, 22 nt, Human
uacaguaaugugucccugcagg

SEQ ID NO: 892232 - RNA, 22 nt, Human
gucuucuuuaaccuacuaaagc

SEQ ID NO: 892233 - RNA, 22 nt, Human
ugauuuacaauuguaaaaguuu

SEQ ID NO: 892234 - RNA, 22 nt, Human
ucccaggccacacuuggggaac

SEQ ID NO: 892235 - RNA, 22 nt, Human
aauguauaaaguguuaauaacu

SEQ ID NO: 892236 - RNA, 22 nt, Human
gcuccagggacccaagagaaaa

SEQ ID NO: 892237 - RNA, 22 nt, Human
cacagguucaaauucaggucgc

SEQ ID NO: 892238 - RNA, 22 nt, Human
uacauucauaugugugcauaca

SEQ ID NO: 892239 - RNA, 22 nt, Human
guacacaggcagcccagugcug

SEQ ID NO: 892240 - RNA, 22 nt, Human
uuacaacacuacuuauccuuga

SEQ ID NO: 892241 - RNA, 22 nt, Human
acuuuggacaauuuauuacugu

SEQ ID NO: 892242 - RNA, 22 nt, Human
ggcagcugagcauggcuaccuu

SEQ ID NO: 892243 - RNA, 22 nt, Human
caguuuuaugaaugcuuauuag

SEQ ID NO: 892244 - RNA, 22 nt, Human
aucauuuuuaagagacucuucu

SEQ ID NO: 892245 - RNA, 22 nt, Human
caaggcaggucugaggagguug

SEQ ID NO: 892246 - RNA, 22 nt, Human
uggccuggcccugaggcccugu

SEQ ID NO: 892247 - RNA, 22 nt, Human
uaaagguuuauucaacaaaaua

SEQ ID NO: 892248 - RNA, 22 nt, Human
aaggaggaauucugaguucaug

SEQ ID NO: 892249 - RNA, 17 nt, Human
aagacaagacaaaugca

SEQ ID NO: 892250 - RNA, 22 nt, Human
cugagcagcucccugagugguc

SEQ ID NO: 892251 - RNA, 22 nt, Human
uggucagacaaaggagaauguu

SEQ ID NO: 892252 - RNA, 22 nt, Human
uucuggagggcaugcugcugcc

SEQ ID NO: 892253 - RNA, 20 nt, Human
uccagcugucuuucagagac

SEQ ID NO: 892254 - RNA, 22 nt, Human
uuuacagugagagcuuagugag

SEQ ID NO: 892255 - RNA, 22 nt, Human
aguguguacauaauuguacgcc

SEQ ID NO: 892256 - RNA, 22 nt, Human
uuguacuaugucuaagucacug

SEQ ID NO: 892257 - RNA, 22 nt, Human
ugcuuuauaucucucuucuuag

SEQ ID NO: 892258 - RNA, 22 nt, Human
auguuacagggagagaaggcca

SEQ ID NO: 892259 - RNA, 22 nt, Human
gcugcuggaagcaugcgaugaa

SEQ ID NO: 892260 - RNA, 22 nt, Human
cagacacacacccuggccuagc

SEQ ID NO: 892261 - RNA, 22 nt, Human
auacugauacggaagaaaaaag

SEQ ID NO: 892262 - RNA, 22 nt, Human
auuagcaaucugaaaauugcgg

SEQ ID NO: 892263 - RNA, 22 nt, Human
aaaguuuacagugcacaugggu

SEQ ID NO: 892264 - RNA, 22 nt, Human
agaggccaggcugcagagggau

SEQ ID NO: 892265 - RNA, 22 nt, Human
aagauacauaaagguagagucu

SEQ ID NO: 892266 - RNA, 22 nt, Human
agagcacaaauuuuaaggaggc

SEQ ID NO: 892267 - RNA, 22 nt, Human
gaugcacagugacccugccagu

SEQ ID NO: 892268 - RNA, 22 nt, Human
uuaauaaaguaugaauuggaaa

SEQ ID NO: 892269 - RNA, 22 nt, Human
agugcacuuuugggggauguua

SEQ ID NO: 892270 - RNA, 22 nt, Human
ggcugggcugcugggucagagc

SEQ ID NO: 892271 - RNA, 22 nt, Human
agcaaggcuucagagcugucug

SEQ ID NO: 892272 - RNA, 22 nt, Human
ugagccagugugguaaagcuga

SEQ ID NO: 892273 - RNA, 22 nt, Human
cugcucuggggaagccagaugu

SEQ ID NO: 892274 - RNA, 22 nt, Human
ucuccagguggggucaccuuuu

SEQ ID NO: 892275 - RNA, 22 nt, Human
gcaugugucccucagucugugc

SEQ ID NO: 892276 - RNA, 22 nt, Human
uuggucagcuaauaaggacagg

SEQ ID NO: 892277 - RNA, 22 nt, Human
cacaggcagccuuguagaagaa

SEQ ID NO: 892278 - RNA, 22 nt, Human
auucacaacaaaaggauaugag

SEQ ID NO: 892279 - RNA, 22 nt, Human
acagaaauucugggacagaaaa

SEQ ID NO: 892280 - RNA, 19 nt, Human
gugucugccuuugugccac

SEQ ID NO: 892281 - RNA, 22 nt, Human
ucagacauguuuuaagacuuau

SEQ ID NO: 892282 - RNA, 22 nt, Human
accacuuugguauuucaauuuu

SEQ ID NO: 892283 - RNA, 22 nt, Human
uuuguauuacaaagucacagua

SEQ ID NO: 892284 - RNA, 22 nt, Human
cagccugcucucagauguugag

SEQ ID NO: 892285 - RNA, 22 nt, Human
cacaguuuaugaucucagugaa

SEQ ID NO: 892286 - RNA, 18 nt, Human
ucugggcuucccgaggcu

SEQ ID NO: 892287 - RNA, 22 nt, Human
gggcagcagcaggaggucucug

SEQ ID NO: 892288 - RNA, 22 nt, Human
ggccuagggcuuggucauggca

SEQ ID NO: 892289 - RNA, 22 nt, Human
ucuguuauacagucuguggcac

SEQ ID NO: 892290 - RNA, 21 nt, Human
gacaggugauucagagcaggg

SEQ ID NO: 892291 - RNA, 22 nt, Human
auagcaaucaguguauuugaaa

SEQ ID NO: 892292 - RNA, 22 nt, Human
gggcugcuguagagaacauguu

SEQ ID NO: 892293 - RNA, 22 nt, Human
agagcaacgaggugauacuaga

SEQ ID NO: 892294 - RNA, 22 nt, Human
aaggcauaggacaaaucaguga

SEQ ID NO: 892295 - RNA, 22 nt, Human
agcugaaacuucccauuaauug

SEQ ID NO: 892296 - RNA, 22 nt, Human
ggccaauuccaggagccggcgg

SEQ ID NO: 892297 - RNA, 22 nt, Human
acuaaagucaucaaagaacuuu

SEQ ID NO: 892298 - RNA, 22 nt, Human
agaguuuagggcugagagcuug

SEQ ID NO: 892299 - RNA, 22 nt, Human
acucacucuuucaauugaaaga

SEQ ID NO: 892300 - RNA, 22 nt, Human
aaggacaggcuaaccugacauu

SEQ ID NO: 892301 - RNA, 22 nt, Human
agggacagaugaaugacugagu

SEQ ID NO: 892302 - RNA, 22 nt, Human
gggacugggagauccuccuggc

SEQ ID NO: 892303 - RNA, 23 nt, Human
aaugaacugagaaucuguacagu

SEQ ID NO: 892304 - RNA, 20 nt, Human
acaauauguagaugaauagc

SEQ ID NO: 892305 - RNA, 22 nt, Human
aacaguaauggcauugccauga

SEQ ID NO: 892306 - RNA, 22 nt, Human
aucaacauuccaaugugguaga

SEQ ID NO: 892307 - RNA, 22 nt, Human
ggcacagcuacuugcucacucu

SEQ ID NO: 892308 - RNA, 18 nt, Human
uggcugcuggaguagggu

SEQ ID NO: 892309 - RNA, 22 nt, Human
caucacagguccugaugacauu

SEQ ID NO: 892310 - RNA, 22 nt, Human
agucuguguauauucacugccc

SEQ ID NO: 892311 - RNA, 22 nt, Human
gcucacagcccaggccagcgug

SEQ ID NO: 892312 - RNA, 22 nt, Human
agccgagcucugagcagggccu

SEQ ID NO: 892313 - RNA, 22 nt, Human
uucuucuucaagugcugcauuc

SEQ ID NO: 892314 - RNA, 22 nt, Human
cuaugacacaggccauuauaua

SEQ ID NO: 892315 - RNA, 18 nt, Human
gcaggugccacugcuguu

SEQ ID NO: 892316 - RNA, 22 nt, Human
cuuauuuguacuaauaaaucug

SEQ ID NO: 892317 - RNA, 22 nt, Human
aaucuucuuucuuaacaguaca

SEQ ID NO: 892318 - RNA, 22 nt, Human
cuggaagguggauggcgaggcc

SEQ ID NO: 892319 - RNA, 22 nt, Human
aggcuggucccagggagggaau

SEQ ID NO: 892320 - RNA, 22 nt, Human
aaugucuuaaagucguguuaca

SEQ ID NO: 892321 - RNA, 22 nt, Human
uuucaacauaccucaguguaug

SEQ ID NO: 892322 - RNA, 21 nt, Human
agcucacaguucuguccuguc

SEQ ID NO: 892323 - RNA, 22 nt, Human
uaacaguauccccauuugcaag

SEQ ID NO: 892324 - RNA, 22 nt, Human
ggcuucauggaguucuacacca

SEQ ID NO: 892325 - RNA, 18 nt, Human
agggagagaccgcggguc

SEQ ID NO: 892326 - RNA, 22 nt, Human
aaacaucugacuugcuuuuuca

SEQ ID NO: 892327 - RNA, 20 nt, Human
uucuucucuaguuaucuuca

SEQ ID NO: 892328 - RNA, 22 nt, Human
auacugaugaugugaagaaaca

SEQ ID NO: 892329 - RNA, 20 nt, Human
aacauugcuucaauguaacc

SEQ ID NO: 892330 - RNA, 22 nt, Human
gcugcagccuuugggaaggaca

SEQ ID NO: 892331 - RNA, 22 nt, Human
aucagugcuaaagcaaaugccc

SEQ ID NO: 892332 - RNA, 22 nt, Human
aacauucagcugaugggucaua

SEQ ID NO: 892333 - RNA, 22 nt, Human
uugcuaaaaauggaauuauagg

SEQ ID NO: 892334 - RNA, 22 nt, Human
uguccucuguuaggggauagcg

SEQ ID NO: 892335 - RNA, 22 nt, Human
cuucucagaggccagaagcuau

SEQ ID NO: 892336 - RNA, 22 nt, Human
cagagcugggcauggugaaagg

SEQ ID NO: 892337 - RNA, 22 nt, Human
aacauguaaccagcauucaucu

SEQ ID NO: 892338 - RNA, 22 nt, Human
uaacacugguuaucccugugca

SEQ ID NO: 892339 - RNA, 22 nt, Human
aaaacuguaggaauugggugcc

SEQ ID NO: 892340 - RNA, 22 nt, Human
caucacauguaggcagcaucac

SEQ ID NO: 892341 - RNA, 22 nt, Human
aguugcauguccaaggggguag

SEQ ID NO: 892342 - RNA, 21 nt, Human
gugcacaguccugcacacagg

SEQ ID NO: 892343 - RNA, 19 nt, Human
agccuggcuuugcucugcu

SEQ ID NO: 892344 - RNA, 22 nt, Human
aaugcuuuagcagugauuagug

SEQ ID NO: 892345 - RNA, 17 nt, Human
uagcagcaguaauugug

SEQ ID NO: 892346 - RNA, 22 nt, Human
gacuuugguucagggcucagag

SEQ ID NO: 892347 - RNA, 17 nt, Human
ucaggcugugccuggua

SEQ ID NO: 892348 - RNA, 20 nt, Human
agcaugcagccagagccaac

SEQ ID NO: 892349 - RNA, 22 nt, Human
aguagaaaguugcaggaggaau

SEQ ID NO: 892350 - RNA, 22 nt, Human
ugcacgugugagcauucacaug

SEQ ID NO: 892351 - RNA, 22 nt, Human
auaacaugagccagauugaaag

SEQ ID NO: 892352 - RNA, 22 nt, Human
uuauucuucuucucuugccagg

SEQ ID NO: 892353 - RNA, 22 nt, Human
ucagaagaaagauguuauuacu

SEQ ID NO: 892354 - RNA, 22 nt, Human
cauguaucuuaauugcuuugga

SEQ ID NO: 892355 - RNA, 22 nt, Human
uaauggcagagucaugcuuucu

SEQ ID NO: 892356 - RNA, 22 nt, Human
cagcuacaguuccacugagcau

SEQ ID NO: 892357 - RNA, 22 nt, Human
ucacauuugcaauugcauuguu

SEQ ID NO: 892358 - RNA, 19 nt, Human
ucagugugacuuggucagu

SEQ ID NO: 892359 - RNA, 22 nt, Human
uucaaagauuagcauacgcaau

SEQ ID NO: 892360 - RNA, 22 nt, Human
ggucucugacuuagagauggau

SEQ ID NO: 892361 - RNA, 22 nt, Human
uuucaggacucaaaacgauaau

SEQ ID NO: 892362 - RNA, 22 nt, Human
ucugugucagcagcacucagcc

SEQ ID NO: 892363 - RNA, 22 nt, Human
gggaaaggaucagugggaggcu

SEQ ID NO: 892364 - RNA, 22 nt, Human
caugacagaugcaaaggauugg

SEQ ID NO: 892365 - RNA, 22 nt, Human
ccuggucaccccucucucugca

SEQ ID NO: 892366 - RNA, 22 nt, Human
agcuccugcuugacagaagagg

SEQ ID NO: 892367 - RNA, 21 nt, Human
uuccaggauugcuuauuuuua

SEQ ID NO: 892368 - RNA, 23 nt, Human
cuacaagagcaagcauggacaag

SEQ ID NO: 892369 - RNA, 22 nt, Human
cacaguauucacugggcagauu

SEQ ID NO: 892370 - RNA, 22 nt, Human
acacauaugccauuacagcaaa

SEQ ID NO: 892371 - RNA, 22 nt, Human
ucucugagacaguagccucugc

SEQ ID NO: 892372 - RNA, 22 nt, Human
acauuguagacuuuucauaugu

SEQ ID NO: 892373 - RNA, 22 nt, Human
auuuucuauucugcugguuuag

SEQ ID NO: 892374 - RNA, 22 nt, Human
ggcucaggcuggagugcagugg

SEQ ID NO: 892375 - RNA, 22 nt, Human
aaugguuuucuagaacaugaaa

SEQ ID NO: 892376 - RNA, 22 nt, Human
ucaugucucuaugugccuauua

SEQ ID NO: 892377 - RNA, 22 nt, Human
cacgguuagccacaggcuggaa

SEQ ID NO: 892378 - RNA, 22 nt, Human
uguguacaaacuaacaacauau

SEQ ID NO: 892379 - RNA, 22 nt, Human
uguuuguaaagcagagccagua

SEQ ID NO: 892380 - RNA, 22 nt, Human
agcuuucagucucugaaggaac

SEQ ID NO: 892381 - RNA, 22 nt, Human
auggggaagagccagugagcug

SEQ ID NO: 892382 - RNA, 22 nt, Human
uucuaccauugggaaaacagcc

SEQ ID NO: 892383 - RNA, 22 nt, Human
agcaacagcaacgacauuucuc

SEQ ID NO: 892384 - RNA, 17 nt, Human
ccaggugggaggugggg

SEQ ID NO: 892385 - RNA, 22 nt, Human
agugaauuuaaaacacugagga

SEQ ID NO: 892386 - RNA, 22 nt, Human
aguugacauccauaacaggaag

SEQ ID NO: 892387 - RNA, 22 nt, Human
auguuacaaauccuacagguag

SEQ ID NO: 892388 - RNA, 22 nt, Human
uugugucccccuuugagagcca

SEQ ID NO: 892389 - RNA, 21 nt, Human
agucuuaggcacagcuguguc

SEQ ID NO: 892390 - RNA, 22 nt, Human
uacuguuuucuuuauaguacag

SEQ ID NO: 892391 - RNA, 22 nt, Human
gagggcuggggcuuaggcuuag

SEQ ID NO: 892392 - RNA, 22 nt, Human
aggagcugggagaaggacuaaa

SEQ ID NO: 892393 - RNA, 22 nt, Human
ucaguccuccucucauagagag

SEQ ID NO: 892394 - RNA, 22 nt, Human
uuuuccuuucaucaggacaaag

SEQ ID NO: 892395 - RNA, 22 nt, Human
auguucuuuggaauuuaugaaa

SEQ ID NO: 892396 - RNA, 22 nt, Human
auguagaguagaauaguacaac

SEQ ID NO: 892397 - RNA, 22 nt, Human
ucuuuuccuugaugguuaaaua

SEQ ID NO: 892398 - RNA, 22 nt, Human
agcaucuugaaauauaaaguca

SEQ ID NO: 892399 - RNA, 22 nt, Human
acacaucucaggggacacucuc

SEQ ID NO: 892400 - RNA, 23 nt, Human
uucauuuaggaguucauaagagc

SEQ ID NO: 892401 - RNA, 22 nt, Human
ucugagcacaauuacuuacauc

SEQ ID NO: 892402 - RNA, 22 nt, Human
ggcaagggacggccgugagaca

SEQ ID NO: 892403 - RNA, 22 nt, Human
gcucugugagccacuugaugua

SEQ ID NO: 892404 - RNA, 22 nt, Human
uacaguuacgcugagaaacgaa

SEQ ID NO: 892405 - RNA, 22 nt, Human
caaaagaagcucuuggggcuag

SEQ ID NO: 892406 - RNA, 22 nt, Human
agcagagcuuuuuggacucaga

SEQ ID NO: 892407 - RNA, 22 nt, Human
uuagcagcaucccuggccugua

SEQ ID NO: 892408 - RNA, 22 nt, Human
gugucuuagaaagacugaaugc

SEQ ID NO: 892409 - RNA, 22 nt, Human
cagauuuggggucuccuguuag

SEQ ID NO: 892410 - RNA, 22 nt, Human
cuugugaaaugccagauaaucu

SEQ ID NO: 892411 - RNA, 22 nt, Human
ugacucacaguggagaaagagg

SEQ ID NO: 892412 - RNA, 22 nt, Human
ccaggagcuggcauguggagag

SEQ ID NO: 892413 - RNA, 22 nt, Human
cuguggcugcguaggucuggca

SEQ ID NO: 892414 - RNA, 23 nt, Human
ucuagaaaaugaaagaaugcagu

SEQ ID NO: 892415 - RNA, 22 nt, Human
uuggaggaggcauuggaggauu

SEQ ID NO: 892416 - RNA, 22 nt, Human
ucuugaaagcaugagauggaca

SEQ ID NO: 892417 - RNA, 22 nt, Human
uuucaguuagcugagacccagg

SEQ ID NO: 892418 - RNA, 22 nt, Human
uugcagggaaauagaaauaaac

SEQ ID NO: 892419 - RNA, 22 nt, Human
ucacaacucacagccaccggug

SEQ ID NO: 892420 - RNA, 22 nt, Human
uggcuucuuugugacagcucuu

SEQ ID NO: 892421 - RNA, 22 nt, Human
uuguuuaaaauguagcaagaaa

SEQ ID NO: 892422 - RNA, 22 nt, Human
ucuagaaacaugacauugaucu

SEQ ID NO: 892423 - RNA, 22 nt, Human
uucuagaagugucuaugucugu

SEQ ID NO: 892424 - RNA, 22 nt, Human
gagauggaaaacugcugguagu

SEQ ID NO: 892425 - RNA, 22 nt, Human
uuguuacacauaauaacauuuu

SEQ ID NO: 892426 - RNA, 22 nt, Human
gaugugugcuuuucgcaguguc

SEQ ID NO: 892427 - RNA, 22 nt, Human
acaguuaagcaguaugaucaca

SEQ ID NO: 892428 - RNA, 20 nt, Human
cuuaacaauggcucugauga

SEQ ID NO: 892429 - RNA, 20 nt, Human
gaacauuuggccauacugag

SEQ ID NO: 892430 - RNA, 22 nt, Human
ucacaaagugaagugugucaug

SEQ ID NO: 892431 - RNA, 22 nt, Human
ugagaaaauccagaggcuaguu

SEQ ID NO: 892432 - RNA, 22 nt, Human
uugcuaaaggauuuuguauuua

SEQ ID NO: 892433 - RNA, 22 nt, Human
ugaaggccagcagagugaaggc

SEQ ID NO: 892434 - RNA, 22 nt, Human
cugacucccaaagaggacgcgu

SEQ ID NO: 892435 - RNA, 22 nt, Human
uuccaggauggcaauaaugaau

SEQ ID NO: 892436 - RNA, 22 nt, Human
uggcaguuggaaaaacgguuug

SEQ ID NO: 892437 - RNA, 22 nt, Human
gcagaagcugggagaagggauu

SEQ ID NO: 892438 - RNA, 22 nt, Human
acagauggugagccgcugaugu

SEQ ID NO: 892439 - RNA, 22 nt, Human
augaguuaggggccugagugga

SEQ ID NO: 892440 - RNA, 22 nt, Human
cacagaggaaaugacuuucuua

SEQ ID NO: 892441 - RNA, 22 nt, Human
uuauuuaaugugaucugaagag

SEQ ID NO: 892442 - RNA, 22 nt, Human
ugccacaggcaaucccugcacg

SEQ ID NO: 892443 - RNA, 22 nt, Human
uuucagaguugucuucuugacc

SEQ ID NO: 892444 - RNA, 22 nt, Human
agcagcauagaugcuauccgag

SEQ ID NO: 892445 - RNA, 22 nt, Human
gcccauggcuucccuaggcaca

SEQ ID NO: 892446 - RNA, 22 nt, Human
guggugcauccuugaguaagcu

SEQ ID NO: 892447 - RNA, 19 nt, Human
auucuucagcagugagacc

SEQ ID NO: 892448 - RNA, 22 nt, Human
agcuccugggccaucacaacca

SEQ ID NO: 892449 - RNA, 22 nt, Human
ugccugggacucuguuaucuug

SEQ ID NO: 892450 - RNA, 22 nt, Human
auguuauugaugccugaggcuu

SEQ ID NO: 892451 - RNA, 22 nt, Human
ucuguuuuggucaccuuuauau

SEQ ID NO: 892452 - RNA, 18 nt, Human
agcuggggccucuggucc

SEQ ID NO: 892453 - RNA, 22 nt, Human
cuggagagaauguucauugcag

SEQ ID NO: 892454 - RNA, 22 nt, Human
uguuuguagagacagcugaugc

SEQ ID NO: 892455 - RNA, 18 nt, Human
uuccauaauguauguaac

SEQ ID NO: 892456 - RNA, 21 nt, Human
gccacugcacuccagccuggg

SEQ ID NO: 892457 - RNA, 21 nt, Human
cacauuugaaccucacagcaa

SEQ ID NO: 892458 - RNA, 19 nt, Human
cucuggcuuccaaagcauc

SEQ ID NO: 892459 - RNA, 22 nt, Human
gugcuucucugcucuacccggc

SEQ ID NO: 892460 - RNA, 22 nt, Human
acuccagggcuccaucccuugu

SEQ ID NO: 892461 - RNA, 22 nt, Human
ggaaucuagaaagggagcaagg

SEQ ID NO: 892462 - RNA, 22 nt, Human
uucugcugccuacuccugggga

SEQ ID NO: 892463 - RNA, 22 nt, Human
cuggcuuuaccucacuggggcu

SEQ ID NO: 892464 - RNA, 22 nt, Human
uaaaugcucagaccuuauucca

SEQ ID NO: 892465 - RNA, 22 nt, Human
guuuauuauucaacuucauguu

SEQ ID NO: 892466 - RNA, 20 nt, Human
agguccugguucucugggau

SEQ ID NO: 892467 - RNA, 23 nt, Human
agacagaggcugaggcuggccgc

SEQ ID NO: 892468 - RNA, 22 nt, Human
agaggccuccgaaaggugggcu

SEQ ID NO: 892469 - RNA, 22 nt, Human
ccugaggaccagcacccaucug

SEQ ID NO: 892470 - RNA, 22 nt, Human
caagaaaugggauuugacugcc

SEQ ID NO: 892471 - RNA, 18 nt, Human
uccugcagcuucuaugua

SEQ ID NO: 892472 - RNA, 22 nt, Human
gucccagggagguucagggcuu

SEQ ID NO: 892473 - RNA, 22 nt, Human
agaggccaaagaaucuacaaga

SEQ ID NO: 892474 - RNA, 20 nt, Human
uaguugccaaaaugcccugc

SEQ ID NO: 892475 - RNA, 22 nt, Human
ccugggcagccugcucaaggac

SEQ ID NO: 892476 - RNA, 22 nt, Human
cagauuccaguuuguggcuccc

SEQ ID NO: 892477 - RNA, 22 nt, Human
uucuagaaggcaggcugggcca

SEQ ID NO: 892478 - RNA, 21 nt, Human
uguguuuuaaugauauucugu

SEQ ID NO: 892479 - RNA, 22 nt, Human
caaaauuagggagugagcugga

SEQ ID NO: 892480 - RNA, 22 nt, Human
guggcagcagaggggugguaug

SEQ ID NO: 892481 - RNA, 22 nt, Human
agauuugucuuggucucaucug

SEQ ID NO: 892482 - RNA, 22 nt, Human
aggcccagacucagcggggcgg

SEQ ID NO: 892483 - RNA, 19 nt, Human
gcacacauacacccuuugg

SEQ ID NO: 892484 - RNA, 22 nt, Human
acaggcagugauuuccucuggu

SEQ ID NO: 892485 - RNA, 22 nt, Human
uuguuuccagcaaauaguccau

SEQ ID NO: 892486 - RNA, 22 nt, Human
uccaggccgcaggggcagcccc

SEQ ID NO: 892487 - RNA, 22 nt, Human
augccuccgcaugugccuuuga

SEQ ID NO: 892488 - RNA, 22 nt, Human
gacagacaugggacuucauacu

SEQ ID NO: 892489 - RNA, 22 nt, Human
auacagaacucucaguuguaua

SEQ ID NO: 892490 - RNA, 22 nt, Human
uuacagaguucgcaccuggugg

SEQ ID NO: 892491 - RNA, 22 nt, Human
uucuuuuccuacacagcgauuu

SEQ ID NO: 892492 - RNA, 22 nt, Human
caccugccccagucuuggagcu

SEQ ID NO: 892493 - RNA, 22 nt, Human
uguuagaaauuauuaguaauau

SEQ ID NO: 892494 - RNA, 22 nt, Human
uuaucuuguagagauauuuucg

SEQ ID NO: 892495 - RNA, 22 nt, Human
ugaagccaucaggaagccagca

SEQ ID NO: 892496 - RNA, 22 nt, Human
gaaaugaaacaggcuuuuaagg

SEQ ID NO: 892497 - RNA, 22 nt, Human
agcauguucaucuucuguuggu

SEQ ID NO: 892498 - RNA, 22 nt, Human
auguauguuucauaucuucauu

SEQ ID NO: 892499 - RNA, 23 nt, Human
agaaaaacaggauuguguuccua

SEQ ID NO: 892500 - RNA, 22 nt, Human
cagggcccaagacacaaugagg

SEQ ID NO: 892501 - RNA, 22 nt, Human
agaguuuguguccuuuaucagg

SEQ ID NO: 892502 - RNA, 22 nt, Human
ucucagggagggcgagucagcg

SEQ ID NO: 892503 - RNA, 22 nt, Human
aauuaccaggauuuuucaguau

SEQ ID NO: 892504 - RNA, 22 nt, Human
agucacaggguacacaaggauu

SEQ ID NO: 892505 - RNA, 22 nt, Human
aggggcugccuggcuuggcacu

SEQ ID NO: 892506 - RNA, 22 nt, Human
uuuuauugucuguauugccuau

SEQ ID NO: 892507 - RNA, 22 nt, Human
acaaugugggcaugagaaacca

SEQ ID NO: 892508 - RNA, 22 nt, Human
uguacaaaguuaaaccuauaua

SEQ ID NO: 892509 - RNA, 22 nt, Human
ggaggcuugaugaucuuggaua

SEQ ID NO: 892510 - RNA, 21 nt, Human
ucuuuucucagcuuugugguu

SEQ ID NO: 892511 - RNA, 22 nt, Human
gcugucucauacaaggcccugc

SEQ ID NO: 892512 - RNA, 18 nt, Human
auacagagaccucaagga

SEQ ID NO: 892513 - RNA, 23 nt, Human
cgcccagccucagugaccugggc

SEQ ID NO: 892514 - RNA, 22 nt, Human
ucagggccgccggggaucucgc

SEQ ID NO: 892515 - RNA, 22 nt, Human
agcugcaguaugaggcuggugg

SEQ ID NO: 892516 - RNA, 23 nt, Human
ggagcugcuguugggggagcugc

SEQ ID NO: 892517 - RNA, 22 nt, Human
gcagguggucacucauccccag

SEQ ID NO: 892518 - RNA, 22 nt, Human
uuuucagugggcaaugauguga

SEQ ID NO: 892519 - RNA, 22 nt, Human
acaacauucuuaaauacacuga

SEQ ID NO: 892520 - RNA, 22 nt, Human
acacugagcuuccaagaugggg

SEQ ID NO: 892521 - RNA, 22 nt, Human
ugagcuguguccugggggcagu

SEQ ID NO: 892522 - RNA, 22 nt, Human
ccuuuggcauuuugaggaugcg

SEQ ID NO: 892523 - RNA, 22 nt, Human
ggcaggugcuugucgaaggccu

SEQ ID NO: 892524 - RNA, 22 nt, Human
uggaagaggccagaaaguggga

SEQ ID NO: 892525 - RNA, 22 nt, Human
gaaacauaguugagacacugcu

SEQ ID NO: 892526 - RNA, 22 nt, Human
gcugccuucuggaggaagugaa

SEQ ID NO: 892527 - RNA, 23 nt, Human
cguuuuuuccucagauguucugg

SEQ ID NO: 892528 - RNA, 20 nt, Human
augucaggaagggagucagg

SEQ ID NO: 892529 - RNA, 22 nt, Human
acagcuggagcccuauggcugg

SEQ ID NO: 892530 - RNA, 20 nt, Human
cugauguucgugcuuccugg

SEQ ID NO: 892531 - RNA, 22 nt, Human
guguuuauacagcaaagagcau

SEQ ID NO: 892532 - RNA, 22 nt, Human
aggcugaggcaagaggaucacu

SEQ ID NO: 892533 - RNA, 22 nt, Human
augaacaaugacuacauauuga

SEQ ID NO: 892534 - RNA, 22 nt, Human
acauuucuauagugcaucuguu

SEQ ID NO: 892535 - RNA, 22 nt, Human
gcagcauugcacuuuuguucuu

SEQ ID NO: 892536 - RNA, 22 nt, Human
cauuaaauuccuuguucucaaa

SEQ ID NO: 892537 - RNA, 22 nt, Human
acagaacauauugcuucucuca

SEQ ID NO: 892538 - RNA, 22 nt, Human
cuguaaacuucuggaggucaag

SEQ ID NO: 892539 - RNA, 22 nt, Human
ggaggagacccugugucaguuu

SEQ ID NO: 892540 - RNA, 22 nt, Human
cucuggcuuguuaaugcauauu

SEQ ID NO: 892541 - RNA, 22 nt, Human
uacaucaaggaacaccugguau

SEQ ID NO: 892542 - RNA, 22 nt, Human
aauuucacagugaacuuugagg

SEQ ID NO: 892543 - RNA, 22 nt, Human
aaagguuuuucagcagggagau

SEQ ID NO: 892544 - RNA, 22 nt, Human
ugaguuauugcagcuuccuccu

SEQ ID NO: 892545 - RNA, 22 nt, Human
aaaagaugaaauggugucuugg

SEQ ID NO: 892546 - RNA, 22 nt, Human
augugucuuggaguuuuaaugu

SEQ ID NO: 892547 - RNA, 22 nt, Human
auaagauauaaauccacagagu

SEQ ID NO: 892548 - RNA, 22 nt, Human
gugcauaugguuacagcaccgc

SEQ ID NO: 892549 - RNA, 22 nt, Human
ugcagcugcucauucucucagu

SEQ ID NO: 892550 - RNA, 22 nt, Human
acagauuuugguauuugcaaug

SEQ ID NO: 892551 - RNA, 22 nt, Human
gcuccuggcauccugcuuuuaa

SEQ ID NO: 892552 - RNA, 22 nt, Human
aggccaggccuuucuccauucc

SEQ ID NO: 892553 - RNA, 22 nt, Human
aaacaguacucgauuuuuguag

SEQ ID NO: 892554 - RNA, 22 nt, Human
uggacuuuuuaacugauaggag

SEQ ID NO: 892555 - RNA, 22 nt, Human
aguggcugcuaugaucaggaca

SEQ ID NO: 892556 - RNA, 22 nt, Human
cauuuacagugagaguuuuuac

SEQ ID NO: 892557 - RNA, 22 nt, Human
agcaggugguaggcagucagca

SEQ ID NO: 892558 - RNA, 20 nt, Human
agccucugcccuucccacug

SEQ ID NO: 892559 - RNA, 22 nt, Human
gaggugggagggcagucccuaa

SEQ ID NO: 892560 - RNA, 22 nt, Human
accuugaaagcugguuguuagg

SEQ ID NO: 892561 - RNA, 22 nt, Human
uaacaugucccugauucuuugu

SEQ ID NO: 892562 - RNA, 22 nt, Human
acaugucuaaguacucaacaaa

SEQ ID NO: 892563 - RNA, 22 nt, Human
ugcauuucuuuugaguauaugc

SEQ ID NO: 892564 - RNA, 21 nt, Human
ugauuuccagaaaauuggccc

SEQ ID NO: 892565 - RNA, 22 nt, Human
ucacacauucuagguauguuga

SEQ ID NO: 892566 - RNA, 22 nt, Human
aguuuucuucauuuuguggcca

SEQ ID NO: 892567 - RNA, 22 nt, Human
uuccauauuggaaggcacaggc

SEQ ID NO: 892568 - RNA, 22 nt, Human
ggacagaggguugacagaguau

SEQ ID NO: 892569 - RNA, 22 nt, Human
cuggaguuagaguagacacuga

SEQ ID NO: 892570 - RNA, 22 nt, Human
gcuccagcuccggcuccgaagc

SEQ ID NO: 892571 - RNA, 22 nt, Human
aaaaaucacuuuuauaggcagc

SEQ ID NO: 892572 - RNA, 22 nt, Human
gugggagcugcggaggccuggg

SEQ ID NO: 892573 - RNA, 22 nt, Human
aucuggcuuacgaagcacuggu

SEQ ID NO: 892574 - RNA, 22 nt, Human
cagguuagcaacaugguuagag

SEQ ID NO: 892575 - RNA, 22 nt, Human
augucuguuuauccuucaagau

SEQ ID NO: 892576 - RNA, 22 nt, Human
aacuccucacugccucuggcac

SEQ ID NO: 892577 - RNA, 22 nt, Human
uuagcuauaguaugucugcuuu

SEQ ID NO: 892578 - RNA, 22 nt, Human
cuuugaagauggcaaauuuaga

SEQ ID NO: 892579 - RNA, 22 nt, Human
cuguggcuucugcuugggccuc

SEQ ID NO: 892580 - RNA, 22 nt, Human
auguucauagcaucgguauuca

SEQ ID NO: 892581 - RNA, 22 nt, Human
cugcaucauuuucagacaaugg

SEQ ID NO: 892582 - RNA, 22 nt, Human
gggagguagcaagccugcagcu

SEQ ID NO: 892583 - RNA, 22 nt, Human
cagcagccuggagggggccacg

SEQ ID NO: 892584 - RNA, 23 nt, Human
uggacgccgacuuuggaggcgcu

SEQ ID NO: 892585 - RNA, 22 nt, Human
caguaauaaagcuaaguauuuc

SEQ ID NO: 892586 - RNA, 23 nt, Human
uggcuccaugaaaauuacgagga

SEQ ID NO: 892587 - RNA, 22 nt, Human
cuggucaccuccuucccagcua

SEQ ID NO: 892588 - RNA, 22 nt, Human
gucacacagggccuccaaauca

SEQ ID NO: 892589 - RNA, 22 nt, Human
auguuugcuuaauuggagaaau

SEQ ID NO: 892590 - RNA, 22 nt, Human
agaauuucaaauggaaguuuua

SEQ ID NO: 892591 - RNA, 22 nt, Human
aaagagaaaaagaucccggcuc

SEQ ID NO: 892592 - RNA, 22 nt, Human
uucaccagagguuagaauauuu

SEQ ID NO: 892593 - RNA, 22 nt, Human
augcauauguacuugcauaugu

SEQ ID NO: 892594 - RNA, 21 nt, Human
aguucuauagucuucacagcc

SEQ ID NO: 892595 - RNA, 22 nt, Human
augggagugugcuugaggaguu

SEQ ID NO: 892596 - RNA, 22 nt, Human
agaggcccucucucuccugaug

SEQ ID NO: 892597 - RNA, 22 nt, Human
aaaaugacauuccagugauauu

SEQ ID NO: 892598 - RNA, 22 nt, Human
uagcauggggagcagaaaguca

SEQ ID NO: 892599 - RNA, 22 nt, Human
gcugccugaaauguugccuagc

SEQ ID NO: 892600 - RNA, 22 nt, Human
gagguggcagaggccuggaccu

SEQ ID NO: 892601 - RNA, 22 nt, Human
aagaacaugaacacaauguuua

SEQ ID NO: 892602 - RNA, 22 nt, Human
auucuauuuuuuaagaaguagu

SEQ ID NO: 892603 - RNA, 19 nt, Human
ugacagcaugaauuaggac

SEQ ID NO: 892604 - RNA, 22 nt, Human
uggcagcuguguccagguagaa

SEQ ID NO: 892605 - RNA, 22 nt, Human
aggaaucugugguuuuaacagg

SEQ ID NO: 892606 - RNA, 22 nt, Human
agcccugcacaggucuguggcu

SEQ ID NO: 892607 - RNA, 22 nt, Human
cagcucugcugggaggaugcag

SEQ ID NO: 892608 - RNA, 22 nt, Human
acauuuugcccuuauuugcuga

SEQ ID NO: 892609 - RNA, 22 nt, Human
uacagcacggugcauuuacuac

SEQ ID NO: 892610 - RNA, 22 nt, Human
ugguugcauuaacugagagggg

SEQ ID NO: 892611 - RNA, 22 nt, Human
aucuuucaguuucauaccaauu

SEQ ID NO: 892612 - RNA, 22 nt, Human
gaugauaagauggaguugaauu

SEQ ID NO: 892613 - RNA, 22 nt, Human
cugccaggcagcagagggagaa

SEQ ID NO: 892614 - RNA, 22 nt, Human
gagacaggauuuaaccaaagcu

SEQ ID NO: 892615 - RNA, 23 nt, Human
auuugguguugguucugccaccc

SEQ ID NO: 892616 - RNA, 22 nt, Human
agagcuguuaauuuugcacugg

SEQ ID NO: 892617 - RNA, 22 nt, Human
agccuggcuaaauucucccaug

SEQ ID NO: 892618 - RNA, 22 nt, Human
agcagggacuacgugaaaguga

SEQ ID NO: 892619 - RNA, 17 nt, Human
cagcucugcagacuucc

SEQ ID NO: 892620 - RNA, 22 nt, Human
cagagaaagacuugcccuuagu

SEQ ID NO: 892621 - RNA, 22 nt, Human
auaucaguaucuauguauuugu

SEQ ID NO: 892622 - RNA, 19 nt, Human
agcaggccacagggccagc

SEQ ID NO: 892623 - RNA, 22 nt, Human
ugcaggcugaggcuggcucaac

SEQ ID NO: 892624 - RNA, 22 nt, Human
ccucugccugcacaucauccug

SEQ ID NO: 892625 - RNA, 22 nt, Human
aguauacaguaaugacauaucu

SEQ ID NO: 892626 - RNA, 22 nt, Human
cugcccuguccuucccgccggc

SEQ ID NO: 892627 - RNA, 22 nt, Human
ccugcuguagggccccuggggc

SEQ ID NO: 892628 - RNA, 22 nt, Human
augagauagacuaugucauaca

SEQ ID NO: 892629 - RNA, 22 nt, Human
gaagaagucauucugucuuuca

SEQ ID NO: 892630 - RNA, 22 nt, Human
agagcugaaaaagcugacccgg

SEQ ID NO: 892631 - RNA, 22 nt, Human
gcccugugccagucacgcugug

SEQ ID NO: 892632 - RNA, 22 nt, Human
auuugcaaagucguaucuguga

SEQ ID NO: 892633 - RNA, 22 nt, Human
aagagcauauauguauguuugu

SEQ ID NO: 892634 - RNA, 22 nt, Human
acuggcaguagagggagcgcau

SEQ ID NO: 892635 - RNA, 22 nt, Human
ccugcugggacgugugguugcc

SEQ ID NO: 892636 - RNA, 22 nt, Human
uggaacaaggguucauuuaaau

SEQ ID NO: 892637 - RNA, 22 nt, Human
uggcucagcauucacuggucuu

SEQ ID NO: 892638 - RNA, 22 nt, Human
acaaucauuggcuucauuacaa

SEQ ID NO: 892639 - RNA, 22 nt, Human
ugggaggucucuugcggccuag

SEQ ID NO: 892640 - RNA, 22 nt, Human
auuucauagauuguaaaucccu

SEQ ID NO: 892641 - RNA, 19 nt, Human
ugggccugcaucugggucu

SEQ ID NO: 892642 - RNA, 18 nt, Human
uccagcagcauaguuucc

SEQ ID NO: 892643 - RNA, 22 nt, Human
ucuuuguaacugucuauugaga

SEQ ID NO: 892644 - RNA, 22 nt, Human
aaaugcuagaacauuuuaaagg

SEQ ID NO: 892645 - RNA, 22 nt, Human
gcagaggagcaagcuggacacc

SEQ ID NO: 892646 - RNA, 22 nt, Human
acauaauggacaauaaugcauc

SEQ ID NO: 892647 - RNA, 22 nt, Human
uaguuuuagcagcaaugggaug

SEQ ID NO: 892648 - RNA, 22 nt, Human
uggaauguuuccccagccugca

SEQ ID NO: 892649 - RNA, 22 nt, Human
ugaguuauugagaaauaacugc

SEQ ID NO: 892650 - RNA, 22 nt, Human
auuccuugcucucaucaaccuu

SEQ ID NO: 892651 - RNA, 22 nt, Human
cugaggcucugagaaagccaaa

SEQ ID NO: 892652 - RNA, 23 nt, Human
uguaggcuaagucccauaaauca

SEQ ID NO: 892653 - RNA, 22 nt, Human
uuccuucuagcccaaguauugg

SEQ ID NO: 892654 - RNA, 22 nt, Human
caaaaguaauggcgguuuuuac

SEQ ID NO: 892655 - RNA, 22 nt, Human
agcuuuggggguagguauagag

SEQ ID NO: 892656 - RNA, 22 nt, Human
aagucuaggacaggaagucuau

SEQ ID NO: 892657 - RNA, 22 nt, Human
agcagggcuuugcagacuuggg

SEQ ID NO: 892658 - RNA, 22 nt, Human
cuauccaaggaguuuuugaaau

SEQ ID NO: 892659 - RNA, 22 nt, Human
gcugucuguggugucagcugac

SEQ ID NO: 892660 - RNA, 22 nt, Human
agccaggcucaaggccugcucc

SEQ ID NO: 892661 - RNA, 22 nt, Human
auggaacaggcucagagaugcu

SEQ ID NO: 892662 - RNA, 22 nt, Human
ugacucugauugccuuagcuug

SEQ ID NO: 892663 - RNA, 22 nt, Human
ugagcaguaacagcucacaggg

SEQ ID NO: 892664 - RNA, 22 nt, Human
agauacuacaugaaugggaauu

SEQ ID NO: 892665 - RNA, 22 nt, Human
gcagaacaacguaggaguggag

SEQ ID NO: 892666 - RNA, 22 nt, Human
uagauuucuaacagugugcuug

SEQ ID NO: 892667 - RNA, 22 nt, Human
augacauugaauauguuaacua

SEQ ID NO: 892668 - RNA, 22 nt, Human
uggcauccagccaugugauuuu

SEQ ID NO: 892669 - RNA, 22 nt, Human
gagguuccccauuguacuggcu

SEQ ID NO: 892670 - RNA, 22 nt, Human
cuuggauuugggcccuuaaauu

SEQ ID NO: 892671 - RNA, 22 nt, Human
cucagcucccuccacccagacc

SEQ ID NO: 892672 - RNA, 22 nt, Human
uuagaaacaaaauaguuauuug

SEQ ID NO: 892673 - RNA, 22 nt, Human
aaaucuuucccuuuacuaucca

SEQ ID NO: 892674 - RNA, 16 nt, Human
aggaggggaauuagga

SEQ ID NO: 892675 - RNA, 22 nt, Human
agaagccauagucugggaggca

SEQ ID NO: 892676 - RNA, 22 nt, Human
caucuuuguaacuuccacauaa

SEQ ID NO: 892677 - RNA, 22 nt, Human
uggagaagauuggucaccauuc

SEQ ID NO: 892678 - RNA, 22 nt, Human
cagugauuuuaaacuauggaug

SEQ ID NO: 892679 - RNA, 22 nt, Human
uggcuaagcuggggaggccugg

SEQ ID NO: 892680 - RNA, 21 nt, Human
uuuagcaagaguauagugcau

SEQ ID NO: 892681 - RNA, 22 nt, Human
gucagaggaauggaugagugau

SEQ ID NO: 892682 - RNA, 22 nt, Human
aggaggaggcuggaguacaccc

SEQ ID NO: 892683 - RNA, 22 nt, Human
uuauuccacagcucagaauuuu

SEQ ID NO: 892684 - RNA, 22 nt, Human
ucaacaguugcacuggagaggu

SEQ ID NO: 892685 - RNA, 22 nt, Human
gacccagugacucgucucugug

SEQ ID NO: 892686 - RNA, 23 nt, Human
caucuagcauccagugaguagug

SEQ ID NO: 892687 - RNA, 22 nt, Human
cacugcagccacauagaugacg

SEQ ID NO: 892688 - RNA, 22 nt, Human
cucucugugguggcugucccau

SEQ ID NO: 892689 - RNA, 18 nt, Human
ucuguccuuccauucuuc

SEQ ID NO: 892690 - RNA, 20 nt, Human
cauuuagaaauuggcaugga

SEQ ID NO: 892691 - RNA, 22 nt, Human
cacaguuucuauaggucagaau

SEQ ID NO: 892692 - RNA, 22 nt, Human
aaggcugccucugccagaggag

SEQ ID NO: 892693 - RNA, 22 nt, Human
ucaguggauuggaugagaucug

SEQ ID NO: 892694 - RNA, 22 nt, Human
gaaauauugggacucagagcuu

SEQ ID NO: 892695 - RNA, 22 nt, Human
agaaacuacuuggaggaaagau

SEQ ID NO: 892696 - RNA, 22 nt, Human
guuccacaaaauguacccaguu

SEQ ID NO: 892697 - RNA, 22 nt, Human
uccuaggguuggagacagugac

SEQ ID NO: 892698 - RNA, 22 nt, Human
gucaaauaauuuucucaauagu

SEQ ID NO: 892699 - RNA, 22 nt, Human
cuggacagaaagggcugcugug

SEQ ID NO: 892700 - RNA, 22 nt, Human
cugggcuagaaggaccaggaug

SEQ ID NO: 892701 - RNA, 22 nt, Human
uugcaggggaaggagcagagcu

SEQ ID NO: 892702 - RNA, 22 nt, Human
agggcuccgggcaggcgaugga

SEQ ID NO: 892703 - RNA, 22 nt, Human
uagcugugcccgccacccaacg

SEQ ID NO: 892704 - RNA, 22 nt, Human
cacccagugaaggagcaagagg

SEQ ID NO: 892705 - RNA, 22 nt, Human
gucaauauagguuucaaacaug

SEQ ID NO: 892706 - RNA, 22 nt, Human
gacaagacagcuugcagacaac

SEQ ID NO: 892707 - RNA, 22 nt, Human
cagaaauagacaauggcagugg

SEQ ID NO: 892708 - RNA, 22 nt, Human
accucuggccuucaggcaucau

SEQ ID NO: 892709 - RNA, 22 nt, Human
uuucaugauuaacuuagugaau

SEQ ID NO: 892710 - RNA, 22 nt, Human
aggcaggcucuggguaugugca

SEQ ID NO: 892711 - RNA, 22 nt, Human
cagcucuuuuucacacaacaug

SEQ ID NO: 892712 - RNA, 22 nt, Human
aagguacaggguauuagauuau

SEQ ID NO: 892713 - RNA, 20 nt, Human
aauguucaaaggugauggca

SEQ ID NO: 892714 - RNA, 22 nt, Human
acuguuucugccacaauagccc

SEQ ID NO: 892715 - RNA, 22 nt, Human
cuggcagcgcagcaugaagucg

SEQ ID NO: 892716 - RNA, 22 nt, Human
agagcugagcaccaagcauggu

SEQ ID NO: 892717 - RNA, 22 nt, Human
ucugucuccucagaugacucca

SEQ ID NO: 892718 - RNA, 22 nt, Human
ucuuccuuguaagggcuuuaga

SEQ ID NO: 892719 - RNA, 22 nt, Human
uaagguuuggcugucucuuggu

SEQ ID NO: 892720 - RNA, 22 nt, Human
auuggccauuugcauguauuau

SEQ ID NO: 892721 - RNA, 21 nt, Human
guguuuccuguuuauggcuug

SEQ ID NO: 892722 - RNA, 22 nt, Human
aacugcaaagccaaucucagga

SEQ ID NO: 892723 - RNA, 20 nt, Human
aucaggaagagagacugacc

SEQ ID NO: 892724 - RNA, 22 nt, Human
aagcuguggcuuggaggaaaca

SEQ ID NO: 892725 - RNA, 23 nt, Human
uccaggagcaugcuggcuggcga

SEQ ID NO: 892726 - RNA, 22 nt, Human
cauggcaggaggcugcuggcag

SEQ ID NO: 892727 - RNA, 22 nt, Human
cuuugaaaccugcucugcagaa

SEQ ID NO: 892728 - RNA, 22 nt, Human
uaagugagaaagacauuaacug

SEQ ID NO: 892729 - RNA, 22 nt, Human
uucagugccgugcugggucgcu

SEQ ID NO: 892730 - RNA, 20 nt, Human
cuggcccaggaugauggcgc

SEQ ID NO: 892731 - RNA, 22 nt, Human
auuaaagaaacccagcauguga

SEQ ID NO: 892732 - RNA, 22 nt, Human
ucugggccugucucagagcugg

SEQ ID NO: 892733 - RNA, 22 nt, Human
aagcagccaccucaucuccacu

SEQ ID NO: 892734 - RNA, 23 nt, Human
agcuccagggaacaggcaguagg

SEQ ID NO: 892735 - RNA, 22 nt, Human
ucugaggcauuuaauuaugacc

SEQ ID NO: 892736 - RNA, 22 nt, Human
cacagauaaggauguuaauuuu

SEQ ID NO: 892737 - RNA, 22 nt, Human
gcugagagaucaaggcaggauu

SEQ ID NO: 892738 - RNA, 22 nt, Human
uguggugugucucacaaaugca

SEQ ID NO: 892739 - RNA, 22 nt, Human
uggagccuccucacacuguggc

SEQ ID NO: 892740 - RNA, 20 nt, Human
agggcugagaagggacuagc

SEQ ID NO: 892741 - RNA, 22 nt, Human
cugcucuggcuguguacuucag

SEQ ID NO: 892742 - RNA, 22 nt, Human
acucauuuuauaacacuguagu

SEQ ID NO: 892743 - RNA, 22 nt, Human
gcaagcaaauuauuuauaggca

SEQ ID NO: 892744 - RNA, 22 nt, Human
ccuuuacaucugacuucuuuca

SEQ ID NO: 892745 - RNA, 23 nt, Human
uuguauuuuuaguagagacaggg

SEQ ID NO: 892746 - RNA, 22 nt, Human
guggggguuucauuaagacaau

SEQ ID NO: 892747 - RNA, 22 nt, Human
ugguuuuagaguauauucaggg

SEQ ID NO: 892748 - RNA, 22 nt, Human
gcauuucagaagcaugcccucu

SEQ ID NO: 892749 - RNA, 22 nt, Human
ccaggagcaccaggccugugcc

SEQ ID NO: 892750 - RNA, 22 nt, Human
ugugcacauaaaacaguacuag

SEQ ID NO: 892751 - RNA, 22 nt, Human
cagcugccccgcuggcugacca

SEQ ID NO: 892752 - RNA, 22 nt, Human
uggccccauuuuacagaugaaa

SEQ ID NO: 892753 - RNA, 22 nt, Human
uagaggguuauuaggacagaag

SEQ ID NO: 892754 - RNA, 17 nt, Human
cugaaauauuaugauaa

SEQ ID NO: 892755 - RNA, 22 nt, Human
uauuccuggucccuaccacaga

SEQ ID NO: 892756 - RNA, 23 nt, Human
uuucagaagugguccuaggaagc

SEQ ID NO: 892757 - RNA, 22 nt, Human
uguuuucagucauauagcaggu

SEQ ID NO: 892758 - RNA, 16 nt, Human
gccuggaguggcaggg

SEQ ID NO: 892759 - RNA, 22 nt, Human
uggcagugccccuugaccagug

SEQ ID NO: 892760 - RNA, 22 nt, Human
auugagaaucugagagccuagg

SEQ ID NO: 892761 - RNA, 22 nt, Human
gacauugaaaauaauguguaga

SEQ ID NO: 892762 - RNA, 17 nt, Human
cauuuguugaucaguug

SEQ ID NO: 892763 - RNA, 22 nt, Human
auucuaucaagcugucuucuuu

SEQ ID NO: 892764 - RNA, 22 nt, Human
gcuggagccuucugcucuguug

SEQ ID NO: 892765 - RNA, 22 nt, Human
cuguccauguuaagccccuugc

SEQ ID NO: 892766 - RNA, 22 nt, Human
uucacauucucacaagaggaaa

SEQ ID NO: 892767 - RNA, 22 nt, Human
auguauuucuauguagugaaga

SEQ ID NO: 892768 - RNA, 22 nt, Human
ugucugaacgaaguagguccac

SEQ ID NO: 892769 - RNA, 22 nt, Human
cagcacaggcaggggaacuaua

SEQ ID NO: 892770 - RNA, 22 nt, Human
gcugugcagucuuuggugugcc

SEQ ID NO: 892771 - RNA, 22 nt, Human
gaagccccaaacccucgccauc

SEQ ID NO: 892772 - RNA, 17 nt, Human
uugaacugcugagucag

SEQ ID NO: 892773 - RNA, 22 nt, Human
ucuaaguaaaauuugucauuuc

SEQ ID NO: 892774 - RNA, 22 nt, Human
gaaaaguaaacacuagggguca

SEQ ID NO: 892775 - RNA, 22 nt, Human
uggcagguggagacagcagagc

SEQ ID NO: 892776 - RNA, 22 nt, Human
gcccuagcgccagcucagcacc

SEQ ID NO: 892777 - RNA, 22 nt, Human
cugggcuguucugccccugggu

SEQ ID NO: 892778 - RNA, 23 nt, Human
ggagcuggacccuuacaccuuuc

SEQ ID NO: 892779 - RNA, 22 nt, Human
cugcucucuuucagagacaggu

SEQ ID NO: 892780 - RNA, 22 nt, Human
agggcuccaggggaccaucagu

SEQ ID NO: 892781 - RNA, 22 nt, Human
aacaacagugagugcugggagg

SEQ ID NO: 892782 - RNA, 22 nt, Human
uaucacuacaccuggcuaauua

SEQ ID NO: 892783 - RNA, 22 nt, Human
caggaggcaggugcauuuugag

SEQ ID NO: 892784 - RNA, 22 nt, Human
aaaguuacacaucuaguaagug

SEQ ID NO: 892785 - RNA, 21 nt, Human
gucuuuuuaauugcgauuucc

SEQ ID NO: 892786 - RNA, 22 nt, Human
aauuggcaagcaaguuauccag

SEQ ID NO: 892787 - RNA, 22 nt, Human
ugggcacagagucccaucugcc

SEQ ID NO: 892788 - RNA, 22 nt, Human
ccaggcugggcuacaaguugag

SEQ ID NO: 892789 - RNA, 22 nt, Human
cagcuggggcagccacgugcgg

SEQ ID NO: 892790 - RNA, 22 nt, Human
aggugagguuugggagguguca

SEQ ID NO: 892791 - RNA, 22 nt, Human
ugcccagccccuaucccuggga

SEQ ID NO: 892792 - RNA, 22 nt, Human
cauucaucuaucaaaugguacc

SEQ ID NO: 892793 - RNA, 22 nt, Human
auguuucaccaguuuuauaaga

SEQ ID NO: 892794 - RNA, 22 nt, Human
cugugucuguggaauagcgaau

SEQ ID NO: 892795 - RNA, 22 nt, Human
ugauuuccaauaaggagaaugu

SEQ ID NO: 892796 - RNA, 22 nt, Human
ugaccugacaugaauuaaaaac

SEQ ID NO: 892797 - RNA, 22 nt, Human
gauagaaagaauauagauucca

SEQ ID NO: 892798 - RNA, 18 nt, Human
acauuucuaugcuucugg

SEQ ID NO: 892799 - RNA, 22 nt, Human
ucucaaugacuccuauuuacau

SEQ ID NO: 892800 - RNA, 22 nt, Human
cugcucugaagccaggauucug

SEQ ID NO: 892801 - RNA, 22 nt, Human
uggcacaguccugggugccugc

SEQ ID NO: 892802 - RNA, 22 nt, Human
acugcaggagacacagcugcug

SEQ ID NO: 892803 - RNA, 22 nt, Human
caggaagcacagugaggagacc

SEQ ID NO: 892804 - RNA, 22 nt, Human
uuuauucagcagcagcaguggu

SEQ ID NO: 892805 - RNA, 22 nt, Human
ucucucacuggugccucuguug

SEQ ID NO: 892806 - RNA, 23 nt, Human
uucaaaacuggaaaaucagaugc

SEQ ID NO: 892807 - RNA, 22 nt, Human
gcuggaguuaggugggcuugaa

SEQ ID NO: 892808 - RNA, 22 nt, Human
ugaggcccuagggcaugggaga

SEQ ID NO: 892809 - RNA, 22 nt, Human
ugcauuauaacugaauguuguu

SEQ ID NO: 892810 - RNA, 22 nt, Human
aacuagaaccugcauuuuaaca

SEQ ID NO: 892811 - RNA, 22 nt, Human
aaauaaguuagcagauuccagu

SEQ ID NO: 892812 - RNA, 23 nt, Human
aggcuccacaugggcacuuugca

SEQ ID NO: 892813 - RNA, 22 nt, Human
auuugccuugugaauuggauau

SEQ ID NO: 892814 - RNA, 22 nt, Human
augucuguccccuagcccugau

SEQ ID NO: 892815 - RNA, 22 nt, Human
caggaggacauacuggcucaca

SEQ ID NO: 892816 - RNA, 19 nt, Human
ccaggaccuuuccaggguc

SEQ ID NO: 892817 - RNA, 22 nt, Human
aaagauggcccaugaucucuug

SEQ ID NO: 892818 - RNA, 22 nt, Human
cugcccuggucccauggcugau

SEQ ID NO: 892819 - RNA, 22 nt, Human
gccgagcacagugcagcugccu

SEQ ID NO: 892820 - RNA, 22 nt, Human
gucugggaguuuggugcugccg

SEQ ID NO: 892821 - RNA, 22 nt, Human
gaguuuccaaaucccugaaggg

SEQ ID NO: 892822 - RNA, 22 nt, Human
aauuuauggccuucgucuugau

SEQ ID NO: 892823 - RNA, 22 nt, Human
cuggcucuaagugucagcuccc

SEQ ID NO: 892824 - RNA, 22 nt, Human
ugggagcagccaacauggccuu

SEQ ID NO: 892825 - RNA, 22 nt, Human
acugcacacacagaauuuaggg

SEQ ID NO: 892826 - RNA, 21 nt, Human
gauuuuaaagagacugccaca

SEQ ID NO: 892827 - RNA, 22 nt, Human
auacagcuuucuuucacaugag

SEQ ID NO: 892828 - RNA, 20 nt, Human
aaguuuucuccaaauacagu

SEQ ID NO: 892829 - RNA, 22 nt, Human
cagauacagcuagcuccguggc

SEQ ID NO: 892830 - RNA, 19 nt, Human
ggcauccagaacuaccagu

SEQ ID NO: 892831 - RNA, 22 nt, Human
auguacaucuuuauaacaagcu

SEQ ID NO: 892832 - RNA, 22 nt, Human
cagcagcuuugccaagucagcc

SEQ ID NO: 892833 - RNA, 21 nt, Human
ugggggagaauugguugcuuu

SEQ ID NO: 892834 - RNA, 22 nt, Human
agagugguacuucuuuuucuuc

SEQ ID NO: 892835 - RNA, 22 nt, Human
ugagaaccaccuggaggugacu

SEQ ID NO: 892836 - RNA, 22 nt, Human
agcagcuucagaggcgggcgca

SEQ ID NO: 892837 - RNA, 22 nt, Human
ucacagugcaggaucaguuaau

SEQ ID NO: 892838 - RNA, 22 nt, Human
aacacauaggcagagcaugaca

SEQ ID NO: 892839 - RNA, 22 nt, Human
ugacagcagccaccucucaccc

SEQ ID NO: 892840 - RNA, 22 nt, Human
agcuguggcagcagccguggca

SEQ ID NO: 892841 - RNA, 22 nt, Human
ucauucaauguaagcauauaua

SEQ ID NO: 892842 - RNA, 22 nt, Human
caugggcaccuuaaaaugaggc

SEQ ID NO: 892843 - RNA, 22 nt, Human
cagaauguauucucauaaagcc

SEQ ID NO: 892844 - RNA, 20 nt, Human
cacauuaaggaaaacaacug

SEQ ID NO: 892845 - RNA, 22 nt, Human
uuucuguuguauggcuucugca

SEQ ID NO: 892846 - RNA, 22 nt, Human
uggcuucauuauuguuuuuccu

SEQ ID NO: 892847 - RNA, 22 nt, Human
ugucuugauuagaaugaugggc

SEQ ID NO: 892848 - RNA, 22 nt, Human
cccuggagggauuucucaauca

SEQ ID NO: 892849 - RNA, 22 nt, Human
aaggguuaguuggauuauuuau

SEQ ID NO: 892850 - RNA, 22 nt, Human
caggcaugggccaugggaagug

SEQ ID NO: 892851 - RNA, 20 nt, Human
ugccuuagagauaaaggcuu

SEQ ID NO: 892852 - RNA, 22 nt, Human
ugggaagcauuaaugauagggg

SEQ ID NO: 892853 - RNA, 23 nt, Human
acaaaugcccauacaucuaguuc

SEQ ID NO: 892854 - RNA, 22 nt, Human
cugccuguauugucugcuuggg

SEQ ID NO: 892855 - RNA, 22 nt, Human
agggccucgggcucaguggguc

SEQ ID NO: 892856 - RNA, 22 nt, Human
ucuuggaaucuccauagaguga

SEQ ID NO: 892857 - RNA, 17 nt, Human
gaaaguuucucucucuu

SEQ ID NO: 892858 - RNA, 22 nt, Human
ugcugcacucaccaacagauaa

SEQ ID NO: 892859 - RNA, 22 nt, Human
gcauuuauauucuguucggaua

SEQ ID NO: 892860 - RNA, 22 nt, Human
cugcuuuagugugguguuagag

SEQ ID NO: 892861 - RNA, 22 nt, Human
agauuuuauagauaauuuccca

SEQ ID NO: 892862 - RNA, 22 nt, Human
uaacuugauaaguauucucugc

SEQ ID NO: 892863 - RNA, 22 nt, Human
uugcagggccuuggcuucuucc

SEQ ID NO: 892864 - RNA, 22 nt, Human
ugugugugcacgugcgcgcgag

SEQ ID NO: 892865 - RNA, 21 nt, Human
ugcaggaaagugcugcgaccc

SEQ ID NO: 892866 - RNA, 22 nt, Human
gcagaaccauaaauucagguaa

SEQ ID NO: 892867 - RNA, 22 nt, Human
agcagacagguaggaggauaaa

SEQ ID NO: 892868 - RNA, 18 nt, Human
cauuagcaccacguagag

SEQ ID NO: 892869 - RNA, 23 nt, Human
guuuuacaggugagaaaauggag

SEQ ID NO: 892870 - RNA, 22 nt, Human
ugugugaggauuccugguucuu

SEQ ID NO: 892871 - RNA, 21 nt, Human
cacuggaauuuucugugacau

SEQ ID NO: 892872 - RNA, 22 nt, Human
ccagcuggaagagugcagaacu

SEQ ID NO: 892873 - RNA, 22 nt, Human
gaaauauacauugcaggaagag

SEQ ID NO: 892874 - RNA, 22 nt, Human
gaaucauagaacauuaauagaa

SEQ ID NO: 892875 - RNA, 20 nt, Human
agcaucuugcaucuucaagu

SEQ ID NO: 892876 - RNA, 22 nt, Human
caaugucaaggagaccaaaacg

SEQ ID NO: 892877 - RNA, 22 nt, Human
agggccagagucuguguagaua

SEQ ID NO: 892878 - RNA, 22 nt, Human
cagggugagccucuggagcccu

SEQ ID NO: 892879 - RNA, 22 nt, Human
augcugugauuguagaaauauu

SEQ ID NO: 892880 - RNA, 22 nt, Human
caucaucuggcuuuuagaaaaa

SEQ ID NO: 892881 - RNA, 22 nt, Human
uggcaugggcaaaccagggaaa

SEQ ID NO: 892882 - RNA, 22 nt, Human
ucauugaagcccuugacaagcc

SEQ ID NO: 892883 - RNA, 22 nt, Human
gcucuggcuacuccacccuguu

SEQ ID NO: 892884 - RNA, 22 nt, Human
uauuuauuggacaguguugcug

SEQ ID NO: 892885 - RNA, 22 nt, Human
cagcugccacuugcucucggcu

SEQ ID NO: 892886 - RNA, 22 nt, Human
uuugcacacacaauaacaaaug

SEQ ID NO: 892887 - RNA, 22 nt, Human
cacgugagaccuugcagaggug

SEQ ID NO: 892888 - RNA, 17 nt, Human
gacagcugggcgcacgc

SEQ ID NO: 892889 - RNA, 22 nt, Human
uguguacaggccuugcuagacu

SEQ ID NO: 892890 - RNA, 22 nt, Human
gaggcagcugggcuggugguuu

SEQ ID NO: 892891 - RNA, 22 nt, Human
agaggcugggaaggguccccgg

SEQ ID NO: 892892 - RNA, 21 nt, Human
acagcagggcuggcaugacag

SEQ ID NO: 892893 - RNA, 22 nt, Human
uuauauauauguagaggucacg

SEQ ID NO: 892894 - RNA, 22 nt, Human
cugccuuccaaccccagacucc

SEQ ID NO: 892895 - RNA, 22 nt, Human
gcuggcugaggucuagcucuuu

SEQ ID NO: 892896 - RNA, 22 nt, Human
auuuuuuauauaccaagguggg

SEQ ID NO: 892897 - RNA, 20 nt, Human
auucacaaagccaguguugc

SEQ ID NO: 892898 - RNA, 19 nt, Human
uccaguguagcuggucauu

SEQ ID NO: 892899 - RNA, 22 nt, Human
aaaacacugccugcuugacuga

SEQ ID NO: 892900 - RNA, 22 nt, Human
uugacacaggaaaguuguaacu

SEQ ID NO: 892901 - RNA, 22 nt, Human
ucauaaaguucuaagaauugua

SEQ ID NO: 892902 - RNA, 22 nt, Human
uagaaauucaaugcucugagua

SEQ ID NO: 892903 - RNA, 22 nt, Human
cacagugacagcuauacagaga

SEQ ID NO: 892904 - RNA, 22 nt, Human
cucuggcuucuaccuugcaguu

SEQ ID NO: 892905 - RNA, 22 nt, Human
uggaaugccgggccaggcuccg

SEQ ID NO: 892906 - RNA, 20 nt, Human
caagccaggcccugcugcug

SEQ ID NO: 892907 - RNA, 22 nt, Human
aaauggaauguguuuauaauuc

SEQ ID NO: 892908 - RNA, 22 nt, Human
uuuucauugagcaccugaguaa

SEQ ID NO: 892909 - RNA, 22 nt, Human
agggcuugcagaaaugagaaau

SEQ ID NO: 892910 - RNA, 22 nt, Human
auuguauacaagcuuaauuguu

SEQ ID NO: 892911 - RNA, 21 nt, Human
uagaucaugguauucuuuggc

SEQ ID NO: 892912 - RNA, 22 nt, Human
ucugaggguuguagagagggac

SEQ ID NO: 892913 - RNA, 22 nt, Human
uugaaauauggauugaccuuga

SEQ ID NO: 892914 - RNA, 22 nt, Human
uaauuuuaugacaguguauuuu

SEQ ID NO: 892915 - RNA, 22 nt, Human
aaaccuauauagucuuagaagc

SEQ ID NO: 892916 - RNA, 22 nt, Human
gagguauuggccauugucuguu

SEQ ID NO: 892917 - RNA, 22 nt, Human
cugaggccuguguuggggcagu

SEQ ID NO: 892918 - RNA, 22 nt, Human
uccagccuccuauuuacccuaa

SEQ ID NO: 892919 - RNA, 22 nt, Human
ugggggagccuucacaguagcu

SEQ ID NO: 892920 - RNA, 21 nt, Human
aagccagcccacagugguuug

SEQ ID NO: 892921 - RNA, 22 nt, Human
cagcagccugccuugggagcuu

SEQ ID NO: 892922 - RNA, 22 nt, Human
cuggcucucugagauauugagu

SEQ ID NO: 892923 - RNA, 22 nt, Human
cuugaagaaauggagacaggau

SEQ ID NO: 892924 - RNA, 22 nt, Human
uguucauucaacaugucaucua

SEQ ID NO: 892925 - RNA, 22 nt, Human
uauaggaaauaggucuucugug

SEQ ID NO: 892926 - RNA, 22 nt, Human
aaacaugcauucaagaaaaucu

SEQ ID NO: 892927 - RNA, 22 nt, Human
uacagaggggacauggaagaca

SEQ ID NO: 892928 - RNA, 22 nt, Human
aguccacagagucucuccugaa

SEQ ID NO: 892929 - RNA, 22 nt, Human
ugcuuuauucagucucugccau

SEQ ID NO: 892930 - RNA, 22 nt, Human
augcuuaaugaggguauauaug

SEQ ID NO: 892931 - RNA, 22 nt, Human
agcagggccucuggcacugguc

SEQ ID NO: 892932 - RNA, 22 nt, Human
ugugucugcacugaguccucac

SEQ ID NO: 892933 - RNA, 22 nt, Human
uucaacauuuaucaguuuauca

SEQ ID NO: 892934 - RNA, 22 nt, Human
auucugugauaguugauccuua

SEQ ID NO: 892935 - RNA, 18 nt, Human
uagcaaagauguggauug

SEQ ID NO: 892936 - RNA, 22 nt, Human
ugauuugauucuucuuggagua

SEQ ID NO: 892937 - RNA, 22 nt, Human
gaucuagaaggcaaauauagug

SEQ ID NO: 892938 - RNA, 22 nt, Human
gcaugcuacagcccaacuguga

SEQ ID NO: 892939 - RNA, 22 nt, Human
ugaacaguuucaagaaaacuuu

SEQ ID NO: 892940 - RNA, 22 nt, Human
cagcagcuaaggcauguuccug

SEQ ID NO: 892941 - RNA, 22 nt, Human
uguuuucauuugauguaacaaa

SEQ ID NO: 892942 - RNA, 19 nt, Human
uccucaggggcucacagac

SEQ ID NO: 892943 - RNA, 22 nt, Human
agacacagaaguugcuguuggg

SEQ ID NO: 892944 - RNA, 22 nt, Human
uuaguguuagggccuguuaccu

SEQ ID NO: 892945 - RNA, 23 nt, Human
aggcagugucucuuauccugucc

SEQ ID NO: 892946 - RNA, 22 nt, Human
agucuucacucuucacuacuau

SEQ ID NO: 892947 - RNA, 22 nt, Human
cauuugucaucacugagcugcc

SEQ ID NO: 892948 - RNA, 22 nt, Human
ugcuuagacgucaaguacagcc

SEQ ID NO: 892949 - RNA, 22 nt, Human
uggaauguuaaaccucaaugau

SEQ ID NO: 892950 - RNA, 22 nt, Human
ggccucagaccggagcuggcca

SEQ ID NO: 892951 - RNA, 22 nt, Human
uuccaccaggagauauuucaaa

SEQ ID NO: 892952 - RNA, 22 nt, Human
ccauucuguauaaaugcuagaa

SEQ ID NO: 892953 - RNA, 22 nt, Human
ucccaagauuauugagggaggg

SEQ ID NO: 892954 - RNA, 22 nt, Human
uaguaaguagcuaauauuuacu

SEQ ID NO: 892955 - RNA, 22 nt, Human
augaaagaugauuuaaaguacu

SEQ ID NO: 892956 - RNA, 22 nt, Human
uuaaaacagcgugaaucuggca

SEQ ID NO: 892957 - RNA, 22 nt, Human
aagggcugcaauccaaaacacu

SEQ ID NO: 892958 - RNA, 22 nt, Human
caaaucauggcucuagcuuaca

SEQ ID NO: 892959 - RNA, 22 nt, Human
auucuuuagccagcagguauau

SEQ ID NO: 892960 - RNA, 22 nt, Human
uugcuguuuaaugaugucuuau

SEQ ID NO: 892961 - RNA, 22 nt, Human
gugggcaggguugcuuucuccg

SEQ ID NO: 892962 - RNA, 22 nt, Human
ucaggaaggcuucacacgagug

SEQ ID NO: 892963 - RNA, 22 nt, Human
gcccugugauggagacuagagg

SEQ ID NO: 892964 - RNA, 22 nt, Human
ucagcucugcacuccacugugg

SEQ ID NO: 892965 - RNA, 22 nt, Human
auggauaagucaaagaguaucc

SEQ ID NO: 892966 - RNA, 22 nt, Human
agacagcaugagccugcugaug

SEQ ID NO: 892967 - RNA, 22 nt, Human
ccagcccuguaaggaugaggca

SEQ ID NO: 892968 - RNA, 22 nt, Human
aaguccaguuuuuccagguggu

SEQ ID NO: 892969 - RNA, 22 nt, Human
acagggcucgucgggcccucgg

SEQ ID NO: 892970 - RNA, 22 nt, Human
acaguguguuggaggagacugu

SEQ ID NO: 892971 - RNA, 22 nt, Human
uccuggggcugcaaggccuguc

SEQ ID NO: 892972 - RNA, 22 nt, Human
agcagggguggaagguagcuuu

SEQ ID NO: 892973 - RNA, 22 nt, Human
gacccuggcuggagcuggccug

SEQ ID NO: 892974 - RNA, 22 nt, Human
aacaaauguaaaaugcagaugc

SEQ ID NO: 892975 - RNA, 22 nt, Human
gccaggcugaggcucuggaaga

SEQ ID NO: 892976 - RNA, 22 nt, Human
aauaucuuggcccaacuccaga

SEQ ID NO: 892977 - RNA, 22 nt, Human
caaauagugaaacagauggggg

SEQ ID NO: 892978 - RNA, 22 nt, Human
gucuaugauauuuuguuauagc

SEQ ID NO: 892979 - RNA, 22 nt, Human
ucugcaggauggaugcucagaa

SEQ ID NO: 892980 - RNA, 22 nt, Human
auguuccucacuauuuuggccc

SEQ ID NO: 892981 - RNA, 18 nt, Human
ucuguguucugucauugc

SEQ ID NO: 892982 - RNA, 22 nt, Human
cuggggaacaauuugccacacu

SEQ ID NO: 892983 - RNA, 22 nt, Human
aggaguuauggcagaaucaaau

SEQ ID NO: 892984 - RNA, 22 nt, Human
guucauguggaaauuuaaaaca

SEQ ID NO: 892985 - RNA, 22 nt, Human
agggaggugguuccccagugga

SEQ ID NO: 892986 - RNA, 22 nt, Human
auaucaaacgaaguuauuuuaa

SEQ ID NO: 892987 - RNA, 22 nt, Human
uuucaguuuaugucuugaauua

SEQ ID NO: 892988 - RNA, 22 nt, Human
ucagggaagaaaugggacuuua

SEQ ID NO: 892989 - RNA, 22 nt, Human
aguguuuuucaggagcagaaca

SEQ ID NO: 892990 - RNA, 22 nt, Human
gcacauaacugaccacaucuaa

SEQ ID NO: 892991 - RNA, 22 nt, Human
uaauccuuuaugguuuuccucc

SEQ ID NO: 892992 - RNA, 22 nt, Human
aacaugcugccuuucuacgagu

SEQ ID NO: 892993 - RNA, 20 nt, Human
ucugcagcacuugacaaugu

SEQ ID NO: 892994 - RNA, 22 nt, Human
cugcaagguauauguuaucaua

SEQ ID NO: 892995 - RNA, 22 nt, Human
aauccacgagcaguagguaauu

SEQ ID NO: 892996 - RNA, 22 nt, Human
uuugacagagcucuuagucucu

SEQ ID NO: 892997 - RNA, 22 nt, Human
ccauuaaagcaccacuguaaua

SEQ ID NO: 892998 - RNA, 22 nt, Human
gaggaauguuauuaaaggagcu

SEQ ID NO: 892999 - RNA, 22 nt, Human
gaggaggggacaguacuugugc

SEQ ID NO: 893000 - RNA, 20 nt, Human
agagaugggguaucaccgua

SEQ ID NO: 893001 - RNA, 22 nt, Human
guuuacuuagaugcucaugcag

SEQ ID NO: 893002 - RNA, 22 nt, Human
gaggccacagcuaucagggaca

SEQ ID NO: 893003 - RNA, 22 nt, Human
aaaaugagacacaugugacucc

SEQ ID NO: 893004 - RNA, 19 nt, Human
agucuuucccacucgucuu

SEQ ID NO: 893005 - RNA, 22 nt, Human
acuagaaauuacucagaauaaa

SEQ ID NO: 893006 - RNA, 18 nt, Human
ccugucugggguccccac

SEQ ID NO: 893007 - RNA, 22 nt, Human
uagaaacuagauugauagcgga

SEQ ID NO: 893008 - RNA, 22 nt, Human
agaagggcuacacgggcucucc

SEQ ID NO: 893009 - RNA, 22 nt, Human
ccuggcugcuauagcagcaugu

SEQ ID NO: 893010 - RNA, 22 nt, Human
gaguuauauccugagucauauu

SEQ ID NO: 893011 - RNA, 22 nt, Human
uaucuagaaauuucuuuuguug

SEQ ID NO: 893012 - RNA, 22 nt, Human
cauacagagaaggauaauaaag

SEQ ID NO: 893013 - RNA, 22 nt, Human
agcugugguucugggcagcgac

SEQ ID NO: 893014 - RNA, 22 nt, Human
gauaaacaugggagaaaggaau

SEQ ID NO: 893015 - RNA, 22 nt, Human
aagcaauaaauaauuuuuagua

SEQ ID NO: 893016 - RNA, 19 nt, Human
cuguggacucuagaucaug

SEQ ID NO: 893017 - RNA, 22 nt, Human
gagcucuguguagccugagggu

SEQ ID NO: 893018 - RNA, 22 nt, Human
ggacacaguggaagacagcuug

SEQ ID NO: 893019 - RNA, 22 nt, Human
agugcugaagacuggcuaggga

SEQ ID NO: 893020 - RNA, 22 nt, Human
auguccuuuuauuuaaagcagg

SEQ ID NO: 893021 - RNA, 21 nt, Human
acugcacaaguugcuuugcuu

SEQ ID NO: 893022 - RNA, 22 nt, Human
gaggcucaccuagggagcacug

SEQ ID NO: 893023 - RNA, 22 nt, Human
acacugugacaaaggcuguucu

SEQ ID NO: 893024 - RNA, 19 nt, Human
acagaagcauagaaaagga

SEQ ID NO: 893025 - RNA, 22 nt, Human
ggucaacagagguaaugguaac

SEQ ID NO: 893026 - RNA, 22 nt, Human
uuugaaaauuuaagugcuacac

SEQ ID NO: 893027 - RNA, 22 nt, Human
cagagugaacagugggaugugc

SEQ ID NO: 893028 - RNA, 22 nt, Human
uuggaagacaaugcugauucuc

SEQ ID NO: 893029 - RNA, 22 nt, Human
aaguuugacagaaguuucuaau

SEQ ID NO: 893030 - RNA, 23 nt, Human
uugucugugcuuuuccaguugcu

SEQ ID NO: 893031 - RNA, 22 nt, Human
agagacaggguuuugucguguu

SEQ ID NO: 893032 - RNA, 22 nt, Human
ugugggcaggagcacaagucag

SEQ ID NO: 893033 - RNA, 22 nt, Human
acccaguuccuaagcauccaug

SEQ ID NO: 893034 - RNA, 19 nt, Human
uucuggagguuacccugag

SEQ ID NO: 893035 - RNA, 21 nt, Human
gcaggaugcaucuuggugucu

SEQ ID NO: 893036 - RNA, 22 nt, Human
cugcugggccuggucucugagg

SEQ ID NO: 893037 - RNA, 22 nt, Human
aaagucugaaagaugcuaacau

SEQ ID NO: 893038 - RNA, 22 nt, Human
uauguguaaucauaucugauac

SEQ ID NO: 893039 - RNA, 22 nt, Human
caauauauaaugaguacuuucc

SEQ ID NO: 893040 - RNA, 22 nt, Human
aagugucuaacugguuacuucu

SEQ ID NO: 893041 - RNA, 22 nt, Human
aagagguggguuggacagauac

SEQ ID NO: 893042 - RNA, 22 nt, Human
cugcaucaggccaauuaagaau

SEQ ID NO: 893043 - RNA, 18 nt, Human
ucuggaacaacuucaugu

SEQ ID NO: 893044 - RNA, 22 nt, Human
ucaggcuguauaucuugcacuc

SEQ ID NO: 893045 - RNA, 22 nt, Human
aguagcaauguuugagaagcac

SEQ ID NO: 893046 - RNA, 22 nt, Human
cucugugccucaguuuucuucu

SEQ ID NO: 893047 - RNA, 18 nt, Human
cuucuuguuugauuuggg

SEQ ID NO: 893048 - RNA, 22 nt, Human
gaaaugcauggaucuuggcaga

SEQ ID NO: 893049 - RNA, 19 nt, Human
ugugucagauuugcuccuu

SEQ ID NO: 893050 - RNA, 22 nt, Human
ucaaguuaggugguuguuagga

SEQ ID NO: 893051 - RNA, 22 nt, Human
cggcuucaguaauuccaugucc

SEQ ID NO: 893052 - RNA, 22 nt, Human
auggccaguguuucccucaguu

SEQ ID NO: 893053 - RNA, 22 nt, Human
ugaacaaacugcauucuucacu

SEQ ID NO: 893054 - RNA, 22 nt, Human
acagcagcauccuauuucacuc

SEQ ID NO: 893055 - RNA, 22 nt, Human
agcccucugcaaacaccugaua

SEQ ID NO: 893056 - RNA, 22 nt, Human
gccuggguaggagacaaaaggu

SEQ ID NO: 893057 - RNA, 22 nt, Human
uuuggaauguuaggugucucau

SEQ ID NO: 893058 - RNA, 22 nt, Human
aggcuggcgacaucuggcgggc

SEQ ID NO: 893059 - RNA, 22 nt, Human
uguuccuguacugcuguggcuu

SEQ ID NO: 893060 - RNA, 22 nt, Human
auuucucaguaggugcacagug

SEQ ID NO: 893061 - RNA, 22 nt, Human
uaucagugcucccagcuuagca

SEQ ID NO: 893062 - RNA, 22 nt, Human
acccauuuguccagcaaagaua

SEQ ID NO: 893063 - RNA, 22 nt, Human
gcuccucugucaaaugagagug

SEQ ID NO: 893064 - RNA, 23 nt, Human
uuuuccuguggagacaugacugg

SEQ ID NO: 893065 - RNA, 22 nt, Human
cuguggcuucuagguccccgau

SEQ ID NO: 893066 - RNA, 22 nt, Human
gcaagaguuuuuucucucuuga

SEQ ID NO: 893067 - RNA, 22 nt, Human
gaaggaagucauuagugcagac

SEQ ID NO: 893068 - RNA, 22 nt, Human
ugaaagaaacagguauauuggg

SEQ ID NO: 893069 - RNA, 23 nt, Human
uugggcucaguggcaggaagagu

SEQ ID NO: 893070 - RNA, 22 nt, Human
ucugcguggcgugguucugugc

SEQ ID NO: 893071 - RNA, 22 nt, Human
ucucaggaauagaguggcagca

SEQ ID NO: 893072 - RNA, 22 nt, Human
cccagcucccauguucuccaau

SEQ ID NO: 893073 - RNA, 22 nt, Human
aaguguuaggguaaaguuggua

SEQ ID NO: 893074 - RNA, 22 nt, Human
uuacuuuaagggugucuuauua

SEQ ID NO: 893075 - RNA, 22 nt, Human
cuccucuggguccugguggcca

SEQ ID NO: 893076 - RNA, 22 nt, Human
acagguuugucugauguaauga

SEQ ID NO: 893077 - RNA, 22 nt, Human
ugucuagggcgagaauguguag

SEQ ID NO: 893078 - RNA, 23 nt, Human
augcucuauuugggauaugacag

SEQ ID NO: 893079 - RNA, 22 nt, Human
aaguggagucccuacaaccagc

SEQ ID NO: 893080 - RNA, 19 nt, Human
ccacuuugcuucucugggu

SEQ ID NO: 893081 - RNA, 22 nt, Human
ggaggaaaugaaaggaggguuu

SEQ ID NO: 893082 - RNA, 20 nt, Human
ggaagccagcauccuugagg

SEQ ID NO: 893083 - RNA, 22 nt, Human
uccccaaaauacauggacgugu

SEQ ID NO: 893084 - RNA, 22 nt, Human
gcacacauucuagccuuuugug

SEQ ID NO: 893085 - RNA, 22 nt, Human
gucauccagacuuugccucugc

SEQ ID NO: 893086 - RNA, 23 nt, Human
auaagccuuuucuuucugcccca

SEQ ID NO: 893087 - RNA, 22 nt, Human
auguauuuuaagauuugccuca

SEQ ID NO: 893088 - RNA, 22 nt, Human
uuuaugcucauccaaggaaggu

SEQ ID NO: 893089 - RNA, 22 nt, Human
ucaagcaaacucugagaaauaa

SEQ ID NO: 893090 - RNA, 22 nt, Human
aauguacaaaagucagccaacu

SEQ ID NO: 893091 - RNA, 22 nt, Human
gagaaucucuuugacaagcaga

SEQ ID NO: 893092 - RNA, 22 nt, Human
aauccuuacugaaugagaaaaa

SEQ ID NO: 893093 - RNA, 22 nt, Human
aaugguaucaccucacagaauu

SEQ ID NO: 893094 - RNA, 22 nt, Human
uaagugaugucuugguuaauga

SEQ ID NO: 893095 - RNA, 22 nt, Human
uagagguguuguugauauagaa

SEQ ID NO: 893096 - RNA, 22 nt, Human
auucuuuauugcugaugguuau

SEQ ID NO: 893097 - RNA, 22 nt, Human
aguuuuaaaugauggugguggu

SEQ ID NO: 893098 - RNA, 22 nt, Human
caaagugcugggauuagugcug

SEQ ID NO: 893099 - RNA, 22 nt, Human
gccagggggucagcaggcacuu

SEQ ID NO: 893100 - RNA, 22 nt, Human
cuccucuuuacccgcauggucu

SEQ ID NO: 893101 - RNA, 22 nt, Human
acaggcauugggauggagguug

SEQ ID NO: 893102 - RNA, 22 nt, Human
cuuucauaaaggaaaugaugag

SEQ ID NO: 893103 - RNA, 22 nt, Human
aacuuucuagagaugaguucgg

SEQ ID NO: 893104 - RNA, 19 nt, Human
uucuggaaacccagguaau

SEQ ID NO: 893105 - RNA, 22 nt, Human
cugaggcuggggaagggaagug

SEQ ID NO: 893106 - RNA, 22 nt, Human
aaugucauauuaguuugugccu

SEQ ID NO: 893107 - RNA, 22 nt, Human
aguuuagaauucauuuugccca

SEQ ID NO: 893108 - RNA, 22 nt, Human
auugucacuuaaaagugcaugu

SEQ ID NO: 893109 - RNA, 22 nt, Human
acagccugcugccugcuucuug

SEQ ID NO: 893110 - RNA, 22 nt, Human
agugucaaaugugugccaagcu

SEQ ID NO: 893111 - RNA, 22 nt, Human
uauaaaauucucaguuuggggu

SEQ ID NO: 893112 - RNA, 22 nt, Human
gccuggcaggggccugggagug

SEQ ID NO: 893113 - RNA, 22 nt, Human
acaacuguuagacacuucuaag

SEQ ID NO: 893114 - RNA, 22 nt, Human
gaaacuuucaugaauauaagau

SEQ ID NO: 893115 - RNA, 22 nt, Human
agucagugaaugguguaugcua

SEQ ID NO: 893116 - RNA, 22 nt, Human
gggcuaaguggaucagucagga

SEQ ID NO: 893117 - RNA, 22 nt, Human
ucuggcccugcugcugugagca

SEQ ID NO: 893118 - RNA, 22 nt, Human
uggguggaauaaaucaguucug

SEQ ID NO: 893119 - RNA, 22 nt, Human
ugggccuggagcccuggagagu

SEQ ID NO: 893120 - RNA, 22 nt, Human
agcuaaugauacaugcuccaca

SEQ ID NO: 893121 - RNA, 22 nt, Human
uggcuggagcauuccuugucuu

SEQ ID NO: 893122 - RNA, 22 nt, Human
caucagugguaacugaaugguu

SEQ ID NO: 893123 - RNA, 22 nt, Human
gugaggacuaguggguuugugc

SEQ ID NO: 893124 - RNA, 22 nt, Human
uuuaucugaccucacuucuuaa

SEQ ID NO: 893125 - RNA, 22 nt, Human
aagugauucuagucaugauucu

SEQ ID NO: 893126 - RNA, 22 nt, Human
ggcuagggagacagagggcaug

SEQ ID NO: 893127 - RNA, 19 nt, Human
uaacaaagucugaagucag

SEQ ID NO: 893128 - RNA, 22 nt, Human
gucacuuugaagcuguuuuuag

SEQ ID NO: 893129 - RNA, 22 nt, Human
acaguuuauaaaaauaaugagg

SEQ ID NO: 893130 - RNA, 22 nt, Human
uguugauuaguguuuagacuua

SEQ ID NO: 893131 - RNA, 22 nt, Human
gaagaagguggcccagggguag

SEQ ID NO: 893132 - RNA, 22 nt, Human
ggacaggccgccucgguggggg

SEQ ID NO: 893133 - RNA, 22 nt, Human
uuucucucuggcccugauuguc

SEQ ID NO: 893134 - RNA, 22 nt, Human
cugagaggugcugguggcugca

SEQ ID NO: 893135 - RNA, 22 nt, Human
uaaauguguguagccaucugug

SEQ ID NO: 893136 - RNA, 22 nt, Human
gaggcuggucagcccuaagauc

SEQ ID NO: 893137 - RNA, 22 nt, Human
uagcaacaauggaaguaacuuc

SEQ ID NO: 893138 - RNA, 22 nt, Human
aggaagaguguuaccuaugggu

SEQ ID NO: 893139 - RNA, 22 nt, Human
uuaacauuugugaagcauuuag

SEQ ID NO: 893140 - RNA, 22 nt, Human
uaguuuaauggucaacuaauga

SEQ ID NO: 893141 - RNA, 19 nt, Human
ugcagggcugcgccugggg

SEQ ID NO: 893142 - RNA, 22 nt, Human
agggcugaagggaggugcucau

SEQ ID NO: 893143 - RNA, 22 nt, Human
acaauuccugagaauacuuguu

SEQ ID NO: 893144 - RNA, 22 nt, Human
cucuuuguaaagaagugguagg

SEQ ID NO: 893145 - RNA, 22 nt, Human
uuaacaaucauaggaccauuua

SEQ ID NO: 893146 - RNA, 22 nt, Human
ucuguauaaggacaaacauuua

SEQ ID NO: 893147 - RNA, 22 nt, Human
ggagugaaguggcgcgaucucg

SEQ ID NO: 893148 - RNA, 22 nt, Human
uccaggagucuagccucaggcc

SEQ ID NO: 893149 - RNA, 22 nt, Human
agacuacauaugccacaugaag

SEQ ID NO: 893150 - RNA, 22 nt, Human
uacacauguuuggcaaguaugu

SEQ ID NO: 893151 - RNA, 22 nt, Human
ucuuauaccccuaaacugcagc

SEQ ID NO: 893152 - RNA, 22 nt, Human
ccuccugggagagcacggaggg

SEQ ID NO: 893153 - RNA, 22 nt, Human
aagggcagcugacagaugcuua

SEQ ID NO: 893154 - RNA, 19 nt, Human
ggccaccucucuucccagg

SEQ ID NO: 893155 - RNA, 22 nt, Human
uuagagaauuccaaaugacuac

SEQ ID NO: 893156 - RNA, 22 nt, Human
uggcucagagagggagugugga

SEQ ID NO: 893157 - RNA, 23 nt, Human
uggagaauguguuuacuucgugu

SEQ ID NO: 893158 - RNA, 22 nt, Human
cagcaguggaacuacccaggga

SEQ ID NO: 893159 - RNA, 22 nt, Human
ugaaacugaaagguauuuauag

SEQ ID NO: 893160 - RNA, 22 nt, Human
acaguggggucuuaauagaaca

SEQ ID NO: 893161 - RNA, 22 nt, Human
aaaccuauuggcaagaauaaua

SEQ ID NO: 893162 - RNA, 22 nt, Human
aguuucuucauccaaaaaaugg

SEQ ID NO: 893163 - RNA, 22 nt, Human
ugagcagggacuuuggagucug

SEQ ID NO: 893164 - RNA, 17 nt, Human
gcacugagccacaguuu

SEQ ID NO: 893165 - RNA, 22 nt, Human
cucugugugcuggugggguccu

SEQ ID NO: 893166 - RNA, 22 nt, Human
ugggacuugccucgagggcugc

SEQ ID NO: 893167 - RNA, 22 nt, Human
aaagugcagcugaaaacauccu

SEQ ID NO: 893168 - RNA, 22 nt, Human
uagcucugugcucuggaucugu

SEQ ID NO: 893169 - RNA, 22 nt, Human
ccugaucaaagaggucagcauu

SEQ ID NO: 893170 - RNA, 22 nt, Human
aauguuucauuuaguugucucc

SEQ ID NO: 893171 - RNA, 22 nt, Human
ccagugcugaaugaggaggucu

SEQ ID NO: 893172 - RNA, 22 nt, Human
ggccugcucuguuuagaggggg

SEQ ID NO: 893173 - RNA, 22 nt, Human
auuccacagaggacuccgauug

SEQ ID NO: 893174 - RNA, 22 nt, Human
agcguggauguggggcgcggcu

SEQ ID NO: 893175 - RNA, 22 nt, Human
cuccucucaaaaguagguugac

SEQ ID NO: 893176 - RNA, 22 nt, Human
uagaauacaguuuaagaacuac

SEQ ID NO: 893177 - RNA, 22 nt, Human
ucaguguguacacugagcauuu

SEQ ID NO: 893178 - RNA, 22 nt, Human
cuugccagcacuuggccagcug

SEQ ID NO: 893179 - RNA, 22 nt, Human
ucaucuugcugccauugcuuua

SEQ ID NO: 893180 - RNA, 22 nt, Human
uauaggaaugacgucauuuccu

SEQ ID NO: 893181 - RNA, 22 nt, Human
auaguucuagaccuauaguucu

SEQ ID NO: 893182 - RNA, 22 nt, Human
caggcuccucacucaugcuccc

SEQ ID NO: 893183 - RNA, 21 nt, Human
guucugaguuagaguuggcca

SEQ ID NO: 893184 - RNA, 22 nt, Human
ugcaggcucucugcugccagau

SEQ ID NO: 893185 - RNA, 23 nt, Human
agagcuuuccaguuucuugguga

SEQ ID NO: 893186 - RNA, 22 nt, Human
acugccugagcuauuggaaaag

SEQ ID NO: 893187 - RNA, 22 nt, Human
auguuucuaguuguaugucacu

SEQ ID NO: 893188 - RNA, 22 nt, Human
aggagcuggccacuaggaugca

SEQ ID NO: 893189 - RNA, 22 nt, Human
uccugagaaggcacagcuugca

SEQ ID NO: 893190 - RNA, 19 nt, Human
agggaaggauucugucauu

SEQ ID NO: 893191 - RNA, 19 nt, Human
uuucuguuugcuucugguu

SEQ ID NO: 893192 - RNA, 19 nt, Human
cccaggagucuggcugguu

SEQ ID NO: 893193 - RNA, 23 nt, Human
gagcuuagucuacucagacaucc

SEQ ID NO: 893194 - RNA, 22 nt, Human
ucuuuuaagccucuggcauagg

SEQ ID NO: 893195 - RNA, 22 nt, Human
agaauuuguaaaagauaagaca

SEQ ID NO: 893196 - RNA, 22 nt, Human
acaucuuugcucuuauagagcu

SEQ ID NO: 893197 - RNA, 18 nt, Human
ucauuauuguuucuggag

SEQ ID NO: 893198 - RNA, 22 nt, Human
aguggcugacaacuggguuaac

SEQ ID NO: 893199 - RNA, 22 nt, Human
ugcugcaguguuugcugaaguu

SEQ ID NO: 893200 - RNA, 18 nt, Human
cagaagcaggcagugcag

SEQ ID NO: 893201 - RNA, 22 nt, Human
uccccaggacuaaguugcaauc

SEQ ID NO: 893202 - RNA, 22 nt, Human
ggcuggaggagaauggguguga

SEQ ID NO: 893203 - RNA, 18 nt, Human
cugagugaugauggggug

SEQ ID NO: 893204 - RNA, 22 nt, Human
guauacauagaugaugaacaag

SEQ ID NO: 893205 - RNA, 22 nt, Human
uuagaaccaccuggagagcuuu

SEQ ID NO: 893206 - RNA, 22 nt, Human
cucucugguacauagaguuugg

SEQ ID NO: 893207 - RNA, 22 nt, Human
uuguauuucuuccggucucauu

SEQ ID NO: 893208 - RNA, 23 nt, Human
uuguccugccgaucucugagaau

SEQ ID NO: 893209 - RNA, 22 nt, Human
acuugucuggcagaucaugcaa

SEQ ID NO: 893210 - RNA, 22 nt, Human
ggcaggcucagcagccaaggag

SEQ ID NO: 893211 - RNA, 22 nt, Human
acauagcauguuuggacacaug

SEQ ID NO: 893212 - RNA, 22 nt, Human
ccuguguggccgcacugcuccc

SEQ ID NO: 893213 - RNA, 22 nt, Human
uacaacagaaguguuuauuuag

SEQ ID NO: 893214 - RNA, 22 nt, Human
ggcagccuugagggaggccugg

SEQ ID NO: 893215 - RNA, 22 nt, Human
cagcccagccuugucucuuuau

SEQ ID NO: 893216 - RNA, 22 nt, Human
uccaaauauagaugaguuguaa

SEQ ID NO: 893217 - RNA, 22 nt, Human
aauggcuuugacauuuucaaau

SEQ ID NO: 893218 - RNA, 22 nt, Human
guacacagagugguggaagaaa

SEQ ID NO: 893219 - RNA, 22 nt, Human
uucugugguugaaaggagagau

SEQ ID NO: 893220 - RNA, 22 nt, Human
uuuccaagcugucuuggcccac

SEQ ID NO: 893221 - RNA, 22 nt, Human
uucucaggaacucagugucagc

SEQ ID NO: 893222 - RNA, 22 nt, Human
uugcacagaguggauauucagu

SEQ ID NO: 893223 - RNA, 22 nt, Human
acauauaagggaucagugacag

SEQ ID NO: 893224 - RNA, 22 nt, Human
guguuuccucacuucucugacu

SEQ ID NO: 893225 - RNA, 22 nt, Human
aaggcauggcaggguuuacaca

SEQ ID NO: 893226 - RNA, 22 nt, Human
cacauugaaccauauauuagug

SEQ ID NO: 893227 - RNA, 22 nt, Human
cagucccagacauaguaaggga

SEQ ID NO: 893228 - RNA, 22 nt, Human
cagggcaguaacgggaacaucu

SEQ ID NO: 893229 - RNA, 22 nt, Human
gacaauaaaaugaucuuacagu

SEQ ID NO: 893230 - RNA, 22 nt, Human
agucugaguuaguggaaaugua

SEQ ID NO: 893231 - RNA, 22 nt, Human
uuuucugacucuauugagguau

SEQ ID NO: 893232 - RNA, 20 nt, Human
agggucugcuggguaggaca

SEQ ID NO: 893233 - RNA, 22 nt, Human
aucaucaugcccacuugagacu

SEQ ID NO: 893234 - RNA, 22 nt, Human
ucucauuugugugcaauucaga

SEQ ID NO: 893235 - RNA, 22 nt, Human
uggaauaacucaccaaggucau

SEQ ID NO: 893236 - RNA, 22 nt, Human
gcggagggcgagcccgcggagc

SEQ ID NO: 893237 - RNA, 22 nt, Human
ggaaucuuuuucauaagccuca

SEQ ID NO: 893238 - RNA, 22 nt, Human
cugugguggcacagcgggcugg

SEQ ID NO: 893239 - RNA, 22 nt, Human
cagcaagaggguaagguugaag

SEQ ID NO: 893240 - RNA, 22 nt, Human
ucuuaugcauauucauaacaca

SEQ ID NO: 893241 - RNA, 22 nt, Human
guuuggugguagcauuggcuau

SEQ ID NO: 893242 - RNA, 22 nt, Human
ggcgggugcacagacccuuccc

SEQ ID NO: 893243 - RNA, 22 nt, Human
aaugcaaagcaagcagagauuu

SEQ ID NO: 893244 - RNA, 17 nt, Human
uggcccuagacuccagc

SEQ ID NO: 893245 - RNA, 22 nt, Human
ucagcacugucuuuuauuugaa

SEQ ID NO: 893246 - RNA, 22 nt, Human
gaggccacauuacuuggugggu

SEQ ID NO: 893247 - RNA, 22 nt, Human
ucacauaaauuauacaauuuca

SEQ ID NO: 893248 - RNA, 22 nt, Human
uucacaguauagguuuccagcg

SEQ ID NO: 893249 - RNA, 22 nt, Human
cuuguaauagauaggaucaaau

SEQ ID NO: 893250 - RNA, 22 nt, Human
cugcccugcccaggccuugggc

SEQ ID NO: 893251 - RNA, 22 nt, Human
caguggaaacuaugcugcugga

SEQ ID NO: 893252 - RNA, 22 nt, Human
cugaaucauggucauuaguuua

SEQ ID NO: 893253 - RNA, 22 nt, Human
cagcucauuccucaaucuagga

SEQ ID NO: 893254 - RNA, 22 nt, Human
cugggcuggcgcauccgacacg

SEQ ID NO: 893255 - RNA, 22 nt, Human
aguauaugugcacauaugcaug

SEQ ID NO: 893256 - RNA, 22 nt, Human
cugagccagcgggcucacuuuu

SEQ ID NO: 893257 - RNA, 22 nt, Human
cagggauggccuggcgggccac

SEQ ID NO: 893258 - RNA, 22 nt, Human
cugagguagcugugaauguucu

SEQ ID NO: 893259 - RNA, 22 nt, Human
cucuuccuacagucugcuaugc

SEQ ID NO: 893260 - RNA, 22 nt, Human
uggaaugaucugauguauuuua

SEQ ID NO: 893261 - RNA, 22 nt, Human
ugcauuuguucagugaaauguu

SEQ ID NO: 893262 - RNA, 22 nt, Human
cucccugggcagauguggcucu

SEQ ID NO: 893263 - RNA, 22 nt, Human
caaauagacucuagaauuuauu

SEQ ID NO: 893264 - RNA, 22 nt, Human
uacaguaaccuuauuugucauu

SEQ ID NO: 893265 - RNA, 22 nt, Human
guaguggagucuccuguccugg

SEQ ID NO: 893266 - RNA, 22 nt, Human
caaaaaacacagaugucugugu

SEQ ID NO: 893267 - RNA, 18 nt, Human
cagcugcaggcucaggac

SEQ ID NO: 893268 - RNA, 22 nt, Human
gagggugucugcguaacuggca

SEQ ID NO: 893269 - RNA, 22 nt, Human
aaugcuuucucagaguccuuca

SEQ ID NO: 893270 - RNA, 22 nt, Human
ugucaaacugugacuucuaaug

SEQ ID NO: 893271 - RNA, 22 nt, Human
agagccacuccaggacucaggg

SEQ ID NO: 893272 - RNA, 22 nt, Human
auacagauugcuauacuuacaa

SEQ ID NO: 893273 - RNA, 22 nt, Human
cacaugcauaaggauaauuacu

SEQ ID NO: 893274 - RNA, 22 nt, Human
acagggggucccauggccugga

SEQ ID NO: 893275 - RNA, 22 nt, Human
gguggacuguguuggaguugac

SEQ ID NO: 893276 - RNA, 22 nt, Human
ucuguggcugugcugggccaga

SEQ ID NO: 893277 - RNA, 22 nt, Human
uuuaaaugcagacguugauuca

SEQ ID NO: 893278 - RNA, 22 nt, Human
ucucaugcuguagugcacuaac

SEQ ID NO: 893279 - RNA, 22 nt, Human
cuaccuucaaguuccucccucu

SEQ ID NO: 893280 - RNA, 18 nt, Human
agcaugagagaggcugug

SEQ ID NO: 893281 - RNA, 19 nt, Human
gcuugcugcuagguaggga

SEQ ID NO: 893282 - RNA, 22 nt, Human
cuuuccuuaauaagcagguaua

SEQ ID NO: 893283 - RNA, 22 nt, Human
ucuacauuuucuuuauguacau

SEQ ID NO: 893284 - RNA, 22 nt, Human
cugcauguuuucuuaauuguga

SEQ ID NO: 893285 - RNA, 22 nt, Human
auggcagcagcuuuagcugugg

SEQ ID NO: 893286 - RNA, 22 nt, Human
aagaccauuuaauggagaaaga

SEQ ID NO: 893287 - RNA, 22 nt, Human
gucuucaauugcauuugauggg

SEQ ID NO: 893288 - RNA, 22 nt, Human
ugguccagucguuccuuuccuu

SEQ ID NO: 893289 - RNA, 22 nt, Human
gugaagcauaacugaaggauuu

SEQ ID NO: 893290 - RNA, 22 nt, Human
acaguucagacaaguguuccau

SEQ ID NO: 893291 - RNA, 22 nt, Human
ugccacagcagugcuuugacag

SEQ ID NO: 893292 - RNA, 22 nt, Human
aaauguucauuucucacucaca

SEQ ID NO: 893293 - RNA, 18 nt, Human
uugugaaauauuggaguc

SEQ ID NO: 893294 - RNA, 22 nt, Human
aagaaucugacauaauuuccug

SEQ ID NO: 893295 - RNA, 22 nt, Human
uauuguacauuucaaaauugcu

SEQ ID NO: 893296 - RNA, 22 nt, Human
cucuggaguucuucaagcuacu

SEQ ID NO: 893297 - RNA, 22 nt, Human
ccuggcagguagcauugaggag

SEQ ID NO: 893298 - RNA, 22 nt, Human
ggaggccaucagggagggcauu

SEQ ID NO: 893299 - RNA, 23 nt, Human
cccaggcuacaaauuaugcucug

SEQ ID NO: 893300 - RNA, 22 nt, Human
ggcagguggauuuucuacucua

SEQ ID NO: 893301 - RNA, 22 nt, Human
ccugguggcuucuggguggacg

SEQ ID NO: 893302 - RNA, 19 nt, Human
gccugggaugggcagaacu

SEQ ID NO: 893303 - RNA, 22 nt, Human
aguguggaccuucacacagaga

SEQ ID NO: 893304 - RNA, 22 nt, Human
acaaagaucuugcuuuccuacu

SEQ ID NO: 893305 - RNA, 22 nt, Human
caguguuucugugcccaguggg

SEQ ID NO: 893306 - RNA, 22 nt, Human
aaaagggacuacucucagcucc

SEQ ID NO: 893307 - RNA, 22 nt, Human
guguccagagaacugugggagc

SEQ ID NO: 893308 - RNA, 21 nt, Human
acaggagaccgccuggcaguc

SEQ ID NO: 893309 - RNA, 19 nt, Human
uucauaacuuuuauauccu

SEQ ID NO: 893310 - RNA, 22 nt, Human
ucuaguuuugguaugagaugca

SEQ ID NO: 893311 - RNA, 22 nt, Human
gucuuccuaauuugcuauuagg

SEQ ID NO: 893312 - RNA, 22 nt, Human
auugugaauugagaguacuucu

SEQ ID NO: 893313 - RNA, 22 nt, Human
acagguguugacucacaggccc

SEQ ID NO: 893314 - RNA, 23 nt, Human
ucuuuacagcagcaggauuugga

SEQ ID NO: 893315 - RNA, 22 nt, Human
ccugucaguugcugucagggau

SEQ ID NO: 893316 - RNA, 22 nt, Human
ucucacacuucuguguugcaca

SEQ ID NO: 893317 - RNA, 22 nt, Human
ucuaguucuagaucccugagga

SEQ ID NO: 893318 - RNA, 22 nt, Human
gcaucuuuagccucuccguggc

SEQ ID NO: 893319 - RNA, 22 nt, Human
caggcugggcugguguuagagu

SEQ ID NO: 893320 - RNA, 22 nt, Human
caguauuuuuaagcugcuuugu

SEQ ID NO: 893321 - RNA, 22 nt, Human
acaauguaggcugaaaaagcuu

SEQ ID NO: 893322 - RNA, 22 nt, Human
aaucagaggaagucaacggauc

SEQ ID NO: 893323 - RNA, 22 nt, Human
aacugaaaucaaucagugauuc

SEQ ID NO: 893324 - RNA, 22 nt, Human
uuugaaaggaaguuaauacuuu

SEQ ID NO: 893325 - RNA, 22 nt, Human
gccagagccacuuuugggugau

SEQ ID NO: 893326 - RNA, 22 nt, Human
guaggcagaccaguggaugggu

SEQ ID NO: 893327 - RNA, 22 nt, Human
uagugucuucaggagauaugag

SEQ ID NO: 893328 - RNA, 22 nt, Human
aucuucaauugaaaacuagccu

SEQ ID NO: 893329 - RNA, 22 nt, Human
aacauaucauaggaugucauug

SEQ ID NO: 893330 - RNA, 22 nt, Human
cacuccagccauuuguccccag

SEQ ID NO: 893331 - RNA, 22 nt, Human
uuugcacacauucuuagaaaug

SEQ ID NO: 893332 - RNA, 22 nt, Human
gcuccaggccacggcuucuugg

SEQ ID NO: 893333 - RNA, 23 nt, Human
aggaagcuaaguguggcugcgga

SEQ ID NO: 893334 - RNA, 22 nt, Human
auuaaauuagcaaacugugaaa

SEQ ID NO: 893335 - RNA, 22 nt, Human
agcagcaggauuuucguuggga

SEQ ID NO: 893336 - RNA, 22 nt, Human
uucuccucagcaaggcagcuuu

SEQ ID NO: 893337 - RNA, 22 nt, Human
aaggcagccgugugacugcaug

SEQ ID NO: 893338 - RNA, 22 nt, Human
gauaaugugccgauaauuucua

SEQ ID NO: 893339 - RNA, 22 nt, Human
cugcaggcauuuauucaugcaa

SEQ ID NO: 893340 - RNA, 22 nt, Human
guggccagugggaaugggcuca

SEQ ID NO: 893341 - RNA, 22 nt, Human
aauauguuuauaagauaucuuc

SEQ ID NO: 893342 - RNA, 23 nt, Human
ggggaaguggcagugagugaggc

SEQ ID NO: 893343 - RNA, 22 nt, Human
ccgggccucgggacaccgggua

SEQ ID NO: 893344 - RNA, 22 nt, Human
aucauucaucuuauugccaguc

SEQ ID NO: 893345 - RNA, 18 nt, Human
ugagcaggggcugaccuu

SEQ ID NO: 893346 - RNA, 22 nt, Human
aauaccuugcuguagccacgca

SEQ ID NO: 893347 - RNA, 22 nt, Human
acguagauuccuccaugcgcag

SEQ ID NO: 893348 - RNA, 22 nt, Human
caauccaucaauuacacaggcu

SEQ ID NO: 893349 - RNA, 21 nt, Human
ugcagcugacacugguaugcc

SEQ ID NO: 893350 - RNA, 22 nt, Human
uaguaacaacaacuagcauuuu

SEQ ID NO: 893351 - RNA, 22 nt, Human
gaaggggacuggcagcugcaga

SEQ ID NO: 893352 - RNA, 22 nt, Human
ucacaaagagaauugugggugu

SEQ ID NO: 893353 - RNA, 22 nt, Human
agacucugugcuccuugcuuuc

SEQ ID NO: 893354 - RNA, 22 nt, Human
uuacacaaguucuuuaaccuau

SEQ ID NO: 893355 - RNA, 21 nt, Human
uguaacaaguucccuagguga

SEQ ID NO: 893356 - RNA, 22 nt, Human
aaucauaauucaaauaagcuua

SEQ ID NO: 893357 - RNA, 21 nt, Human
aggggaaguagaguuuugauu

SEQ ID NO: 893358 - RNA, 21 nt, Human
aggcucccagaaaugggcauc

SEQ ID NO: 893359 - RNA, 22 nt, Human
agaccaggucuuuauggcucca

SEQ ID NO: 893360 - RNA, 22 nt, Human
ggcuggaagguagaagaugagg

SEQ ID NO: 893361 - RNA, 19 nt, Human
aggugugggggcugcagac

SEQ ID NO: 893362 - RNA, 22 nt, Human
cguauacaugaagacauugcug

SEQ ID NO: 893363 - RNA, 20 nt, Human
auguaugcaaaugucuucca

SEQ ID NO: 893364 - RNA, 22 nt, Human
uaggaauguuuuuaucaacuua

SEQ ID NO: 893365 - RNA, 23 nt, Human
gaaauguuucuugauuaauccua

SEQ ID NO: 893366 - RNA, 22 nt, Human
gcacagagacaguccugagauc

SEQ ID NO: 893367 - RNA, 17 nt, Human
auacaaagccauaaacc

SEQ ID NO: 893368 - RNA, 22 nt, Human
gaagugugaaggugauguggag

SEQ ID NO: 893369 - RNA, 22 nt, Human
gccuggcugccggccuuggcaa

SEQ ID NO: 893370 - RNA, 22 nt, Human
cugggccacuuccucaggggaa

SEQ ID NO: 893371 - RNA, 22 nt, Human
uaugucuuacuacagcaauuaa

SEQ ID NO: 893372 - RNA, 22 nt, Human
ugcagcugugccugaaaaguac

SEQ ID NO: 893373 - RNA, 22 nt, Human
agugccuuggcugugaugggga

SEQ ID NO: 893374 - RNA, 22 nt, Human
acacagguuaaaauaauuggga

SEQ ID NO: 893375 - RNA, 22 nt, Human
acaaaugccauauauaaauucu

SEQ ID NO: 893376 - RNA, 22 nt, Human
cauguacaugccuacuaucaau

SEQ ID NO: 893377 - RNA, 22 nt, Human
uuccaaaguuaguuauuagaaa

SEQ ID NO: 893378 - RNA, 22 nt, Human
gacaacaauaauguggagcuga

SEQ ID NO: 893379 - RNA, 22 nt, Human
cucucagcaggaaagcaugcaa

SEQ ID NO: 893380 - RNA, 22 nt, Human
gggcuccaaggaggccagccug

SEQ ID NO: 893381 - RNA, 22 nt, Human
uccaggcucagcacuugcuacu

SEQ ID NO: 893382 - RNA, 22 nt, Human
aggaagugacuagguaacccaa

SEQ ID NO: 893383 - RNA, 22 nt, Human
ggagaggguagggguccugccc

SEQ ID NO: 893384 - RNA, 22 nt, Human
cucaggauccaucuccugcccu

SEQ ID NO: 893385 - RNA, 22 nt, Human
agguugggaugagugggugagc

SEQ ID NO: 893386 - RNA, 22 nt, Human
aguuuucuuucaucuaucagca

SEQ ID NO: 893387 - RNA, 21 nt, Human
uucugggaaaugagcuggggc

SEQ ID NO: 893388 - RNA, 22 nt, Human
uaucauuuuacugugacauuuu

SEQ ID NO: 893389 - RNA, 22 nt, Human
gggcagaggcucuggcccaucc

SEQ ID NO: 893390 - RNA, 22 nt, Human
ugcaguguucagugaucucucc

SEQ ID NO: 893391 - RNA, 22 nt, Human
cccugcuagaaccuccaacaug

SEQ ID NO: 893392 - RNA, 22 nt, Human
caaagugcuaggauuacaggcc

SEQ ID NO: 893393 - RNA, 22 nt, Human
ggagugacucacagcugggaca

SEQ ID NO: 893394 - RNA, 22 nt, Human
aggcuguguuuaagugguaaug

SEQ ID NO: 893395 - RNA, 22 nt, Human
gggcccuggacguggcggcaga

SEQ ID NO: 893396 - RNA, 22 nt, Human
aaacaggcacauaguaacauuu

SEQ ID NO: 893397 - RNA, 22 nt, Human
gaggcuggugguuaguuccauu

SEQ ID NO: 893398 - RNA, 22 nt, Human
aacugcaaaaaugguagucuua

SEQ ID NO: 893399 - RNA, 22 nt, Human
agagggaaauccaggagugcuu

SEQ ID NO: 893400 - RNA, 22 nt, Human
ugcuggcaggcaccuccugggg

SEQ ID NO: 893401 - RNA, 17 nt, Human
uccagccuccucugcug

SEQ ID NO: 893402 - RNA, 22 nt, Human
uggugguuaugcgcuuuguggg

SEQ ID NO: 893403 - RNA, 22 nt, Human
ggccagcuuauuagcucagagg

SEQ ID NO: 893404 - RNA, 22 nt, Human
uaaaguucagugcaugaaugug

SEQ ID NO: 893405 - RNA, 22 nt, Human
uaacuuugaagggaauuuuacu

SEQ ID NO: 893406 - RNA, 22 nt, Human
agggcagagacaugcuuccuga

SEQ ID NO: 893407 - RNA, 22 nt, Human
ugucaugaguuauuucauagga

SEQ ID NO: 893408 - RNA, 18 nt, Human
gggcucuggcaucugggu

SEQ ID NO: 893409 - RNA, 22 nt, Human
ucuucacacacaguccucuuuc

SEQ ID NO: 893410 - RNA, 22 nt, Human
ucagcuggcaguucagaggcug

SEQ ID NO: 893411 - RNA, 22 nt, Human
gcagcccaauggacugagacag

SEQ ID NO: 893412 - RNA, 22 nt, Human
auggcuggugauacuggaguga

SEQ ID NO: 893413 - RNA, 22 nt, Human
gaaagugcuaggaaguguuaga

SEQ ID NO: 893414 - RNA, 21 nt, Human
agcaggcaaaggugaagucuu

SEQ ID NO: 893415 - RNA, 22 nt, Human
ucccaggaaugucugaaaguga

SEQ ID NO: 893416 - RNA, 22 nt, Human
gagcugcaugcaacuguuuaaa

SEQ ID NO: 893417 - RNA, 22 nt, Human
ugcauggauauauacccuaggc

SEQ ID NO: 893418 - RNA, 22 nt, Human
acuccugggugcugaccagcgu

SEQ ID NO: 893419 - RNA, 22 nt, Human
aaucuagauucggaucaaaggg

SEQ ID NO: 893420 - RNA, 22 nt, Human
ggcacagcucaggucccagcuc

SEQ ID NO: 893421 - RNA, 22 nt, Human
aacuacaauauguauguaugua

SEQ ID NO: 893422 - RNA, 22 nt, Human
cuuuaugaaccuguucagcuug

SEQ ID NO: 893423 - RNA, 23 nt, Human
ucagaagugggauacaaagcuga

SEQ ID NO: 893424 - RNA, 22 nt, Human
aagcauuuuguuuuaagaauga

SEQ ID NO: 893425 - RNA, 22 nt, Human
aaagugucuuacccagggagaa

SEQ ID NO: 893426 - RNA, 22 nt, Human
caguccuguguuaaacaagagc

SEQ ID NO: 893427 - RNA, 22 nt, Human
uuggaaaugcauuuguuauuau

SEQ ID NO: 893428 - RNA, 22 nt, Human
cauuuguuuagaagucuuuaua

SEQ ID NO: 893429 - RNA, 22 nt, Human
gcugcccugugguccagcaggu

SEQ ID NO: 893430 - RNA, 21 nt, Human
uuaauuuauucaugauagcua

SEQ ID NO: 893431 - RNA, 22 nt, Human
cuggaaagcugcaggacccaga

SEQ ID NO: 893432 - RNA, 20 nt, Human
ucuguuauugcauguacaua

SEQ ID NO: 893433 - RNA, 22 nt, Human
gaggagcaugggaaggcucugg

SEQ ID NO: 893434 - RNA, 22 nt, Human
ggaagggaaaauucauucggcu

SEQ ID NO: 893435 - RNA, 22 nt, Human
cuggguggaaagugcugagaau

SEQ ID NO: 893436 - RNA, 23 nt, Human
ucucugagccauagcagucccaa

SEQ ID NO: 893437 - RNA, 20 nt, Human
auacaaagagauugauguau

SEQ ID NO: 893438 - RNA, 22 nt, Human
aaauauuagggagaacagggac

SEQ ID NO: 893439 - RNA, 22 nt, Human
ugcaucaugcggaacuggcuuu

SEQ ID NO: 893440 - RNA, 22 nt, Human
uuauuaauaaaguggcauagcc

SEQ ID NO: 893441 - RNA, 22 nt, Human
augcuguguauuuuacucuuuc

SEQ ID NO: 893442 - RNA, 22 nt, Human
agaagccagauuguagugggac

SEQ ID NO: 893443 - RNA, 22 nt, Human
gacccuuucacagcugcugggg

SEQ ID NO: 893444 - RNA, 22 nt, Human
ugcaggccaggguagggacuag

SEQ ID NO: 893445 - RNA, 22 nt, Human
uucccagugaggaagcaaugca

SEQ ID NO: 893446 - RNA, 22 nt, Human
gcucacugccugggcaacaaga

SEQ ID NO: 893447 - RNA, 22 nt, Human
agcagcucaaagccugcaagga

SEQ ID NO: 893448 - RNA, 22 nt, Human
ccagaugguauaguagggagag

SEQ ID NO: 893449 - RNA, 22 nt, Human
guggggagcagccuuagccccu

SEQ ID NO: 893450 - RNA, 22 nt, Human
uuggcuucuuauaaugcaauag

SEQ ID NO: 893451 - RNA, 22 nt, Human
uuaguucucaugaauuuuaagu

SEQ ID NO: 893452 - RNA, 22 nt, Human
cagagccccccuucugaucaca

SEQ ID NO: 893453 - RNA, 22 nt, Human
augugcaggauccaggcuccua

SEQ ID NO: 893454 - RNA, 22 nt, Human
aacuacuaccaguaguaguagu

SEQ ID NO: 893455 - RNA, 22 nt, Human
ugucucccaggugugcccagug

SEQ ID NO: 893456 - RNA, 22 nt, Human
gggcuccaaaaucuaugucuuc

SEQ ID NO: 893457 - RNA, 22 nt, Human
uagacuuugauauuguacaccc

SEQ ID NO: 893458 - RNA, 22 nt, Human
ugagaagcaguuucaguaagaa

SEQ ID NO: 893459 - RNA, 22 nt, Human
aagcagggugucuugacccaug

SEQ ID NO: 893460 - RNA, 17 nt, Human
uuuuggugaguuguuuc

SEQ ID NO: 893461 - RNA, 22 nt, Human
uaucagauaaucuuuuacaagc

SEQ ID NO: 893462 - RNA, 20 nt, Human
agcacauuaaacauacuccu

SEQ ID NO: 893463 - RNA, 22 nt, Human
cugggacccccacugcguagcu

SEQ ID NO: 893464 - RNA, 22 nt, Human
ggcaggcacugugcuaggcgcu

SEQ ID NO: 893465 - RNA, 22 nt, Human
ggagaaagucagcuccaagcag

SEQ ID NO: 893466 - RNA, 22 nt, Human
ugcuucaugagguaguggcagu

SEQ ID NO: 893467 - RNA, 22 nt, Human
gcugucagcgcccaaggagcuc

SEQ ID NO: 893468 - RNA, 22 nt, Human
uggguacuccuauuaguucagu

SEQ ID NO: 893469 - RNA, 22 nt, Human
agagggccauaggugcauaguu

SEQ ID NO: 893470 - RNA, 22 nt, Human
gcaaagaaaugucagugagagg

SEQ ID NO: 893471 - RNA, 22 nt, Human
acagaaguggcuucaaagagca

SEQ ID NO: 893472 - RNA, 22 nt, Human
cagaggccccauuggcugugcg

SEQ ID NO: 893473 - RNA, 22 nt, Human
guucucucucuugccugggugg

SEQ ID NO: 893474 - RNA, 22 nt, Human
aguguacaucagaacauaucaa

SEQ ID NO: 893475 - RNA, 22 nt, Human
uggaauaaagcagcuuuaguuc

SEQ ID NO: 893476 - RNA, 22 nt, Human
agagaaggguagcccauucucc

SEQ ID NO: 893477 - RNA, 22 nt, Human
caagaauuaagaauuuugaugu

SEQ ID NO: 893478 - RNA, 20 nt, Human
cagugcuuccuccuuucuuu

SEQ ID NO: 893479 - RNA, 22 nt, Human
ucagggcaagauugguuaauaa

SEQ ID NO: 893480 - RNA, 22 nt, Human
agaaauuauuagugaauagucu

SEQ ID NO: 893481 - RNA, 22 nt, Human
auaacugagagcaaucuuucuu

SEQ ID NO: 893482 - RNA, 22 nt, Human
augaacaauaaaauagaucaca

SEQ ID NO: 893483 - RNA, 22 nt, Human
gcuguuuccccuucacaguggc

SEQ ID NO: 893484 - RNA, 22 nt, Human
ccagcuccgggaguugcugcug

SEQ ID NO: 893485 - RNA, 22 nt, Human
uuuacuaaguacuuguaucccu

SEQ ID NO: 893486 - RNA, 22 nt, Human
gcugucuugcucacucuugcag

SEQ ID NO: 893487 - RNA, 22 nt, Human
cugcugauucuuaaaugugguu

SEQ ID NO: 893488 - RNA, 22 nt, Human
ggagcugucuguagggcacagg

SEQ ID NO: 893489 - RNA, 22 nt, Human
ggaggcugcugccucacguggg

SEQ ID NO: 893490 - RNA, 22 nt, Human
cccugcagcuuuugcauaguca

SEQ ID NO: 893491 - RNA, 21 nt, Human
gagcauggcuuacaucagcag

SEQ ID NO: 893492 - RNA, 21 nt, Human
cacaccaggcaugucuugagc

SEQ ID NO: 893493 - RNA, 22 nt, Human
ggcagcugugaagugccucaca

SEQ ID NO: 893494 - RNA, 18 nt, Human
uggagcugagugcugugc

SEQ ID NO: 893495 - RNA, 17 nt, Human
acuccuggucugaaggg

SEQ ID NO: 893496 - RNA, 22 nt, Human
agccagagauugagaugcaggc

SEQ ID NO: 893497 - RNA, 20 nt, Human
ucacagaaacaaauagagaa

SEQ ID NO: 893498 - RNA, 23 nt, Human
uggaucaauaagccugacugugu

SEQ ID NO: 893499 - RNA, 22 nt, Human
gaguggcuauugauccgugaug

SEQ ID NO: 893500 - RNA, 22 nt, Human
agaacauggauugucaaaggua

SEQ ID NO: 893501 - RNA, 18 nt, Human
acuauugagguauucuug

SEQ ID NO: 893502 - RNA, 22 nt, Human
uggcuucucccuccccaucuag

SEQ ID NO: 893503 - RNA, 22 nt, Human
augugucuuauuugauuccaca

SEQ ID NO: 893504 - RNA, 22 nt, Human
gcuguucugcgucccaggcugg

SEQ ID NO: 893505 - RNA, 22 nt, Human
agugcgugggcaggcauggaag

SEQ ID NO: 893506 - RNA, 17 nt, Human
caggaaaauaugaguga

SEQ ID NO: 893507 - RNA, 22 nt, Human
augcuguuaagaaucucuuccu

SEQ ID NO: 893508 - RNA, 22 nt, Human
aggccagcuuccagaggggcag

SEQ ID NO: 893509 - RNA, 22 nt, Human
cagaaagaccugggcucaagag

SEQ ID NO: 893510 - RNA, 22 nt, Human
uguggucuccugucuuggccuu

SEQ ID NO: 893511 - RNA, 22 nt, Human
uucauauauaugcacuacguac

SEQ ID NO: 893512 - RNA, 22 nt, Human
cuggagcaggcuugucccagcu

SEQ ID NO: 893513 - RNA, 22 nt, Human
uaucacauaguguuuaguaaau

SEQ ID NO: 893514 - RNA, 22 nt, Human
cucugacagguggcauuaucuc

SEQ ID NO: 893515 - RNA, 22 nt, Human
gagccccaggacagcucuaguu

SEQ ID NO: 893516 - RNA, 19 nt, Human
agcagccaucgaccaugga

SEQ ID NO: 893517 - RNA, 22 nt, Human
agcagcauauugugucuucaua

SEQ ID NO: 893518 - RNA, 22 nt, Human
agagaaaugggguaaucuuuca

SEQ ID NO: 893519 - RNA, 22 nt, Human
uggcaagcucguuugggucaga

SEQ ID NO: 893520 - RNA, 22 nt, Human
ugcuggcugucccuaccuggcu

SEQ ID NO: 893521 - RNA, 22 nt, Human
caaaaugaugugauuuuauugu

SEQ ID NO: 893522 - RNA, 22 nt, Human
gugugcugcccaacucgcagau

SEQ ID NO: 893523 - RNA, 22 nt, Human
cuucuagggcaucaugacaaau

SEQ ID NO: 893524 - RNA, 22 nt, Human
cucugggugucuuaggagcuca

SEQ ID NO: 893525 - RNA, 22 nt, Human
uucuaggaugcugaugagaccc

SEQ ID NO: 893526 - RNA, 22 nt, Human
cucugggcaggacgccaggccu

SEQ ID NO: 893527 - RNA, 22 nt, Human
agguucuccuuaucaaugaaga

SEQ ID NO: 893528 - RNA, 22 nt, Human
gagcuuuaagggauaaaaugau

SEQ ID NO: 893529 - RNA, 21 nt, Human
ugguuaaaguugugucauccc

SEQ ID NO: 893530 - RNA, 22 nt, Human
uggagaagucaaagugaacagg

SEQ ID NO: 893531 - RNA, 21 nt, Human
ucccacagcgccagcuccugu

SEQ ID NO: 893532 - RNA, 21 nt, Human
ugcaauuuagacuugaacauu

SEQ ID NO: 893533 - RNA, 22 nt, Human
gggcugacucaaccuugcaaag

SEQ ID NO: 893534 - RNA, 20 nt, Human
aagagaggaaguuauacuag

SEQ ID NO: 893535 - RNA, 22 nt, Human
cuuucccugcuuagaaggauuu

SEQ ID NO: 893536 - RNA, 22 nt, Human
uuaugugagguucagcuuuauc

SEQ ID NO: 893537 - RNA, 22 nt, Human
uugcaggguacauucuuagaau

SEQ ID NO: 893538 - RNA, 22 nt, Human
gcagaggaggacccaggaauua

SEQ ID NO: 893539 - RNA, 22 nt, Human
agcgugaaggcgggcagucggc

SEQ ID NO: 893540 - RNA, 22 nt, Human
auuuugauaaucauguuagaga

SEQ ID NO: 893541 - RNA, 22 nt, Human
ggccagcuguaagcugcugaau

SEQ ID NO: 893542 - RNA, 22 nt, Human
caggacaguauaggcuuuagga

SEQ ID NO: 893543 - RNA, 22 nt, Human
uccaaauacauuuacuguauuu

SEQ ID NO: 893544 - RNA, 22 nt, Human
uuucuugagcuaggaaccuggg

SEQ ID NO: 893545 - RNA, 22 nt, Human
agggcugcuuugcuaaauaugg

SEQ ID NO: 893546 - RNA, 22 nt, Human
uagaaaagaagucuggccggga

SEQ ID NO: 893547 - RNA, 22 nt, Human
auucauguuagcccacauguag

SEQ ID NO: 893548 - RNA, 22 nt, Human
gcauccagguagagcuugcggg

SEQ ID NO: 893549 - RNA, 22 nt, Human
cuggcccaggagagcaggcauu

SEQ ID NO: 893550 - RNA, 22 nt, Human
ucugugccucaucugguucagg

SEQ ID NO: 893551 - RNA, 22 nt, Human
uucuagaaugauaugagguacu

SEQ ID NO: 893552 - RNA, 22 nt, Human
cugagagaugauauagcuuaau

SEQ ID NO: 893553 - RNA, 22 nt, Human
ugugucuuacauaauuacaugu

SEQ ID NO: 893554 - RNA, 22 nt, Human
gaugcugccagucaaucccaag

SEQ ID NO: 893555 - RNA, 22 nt, Human
acugaaauacugcucuuggauu

SEQ ID NO: 893556 - RNA, 22 nt, Human
ugcagaauuauggugcuggcuu

SEQ ID NO: 893557 - RNA, 22 nt, Human
aagguuuaaggucuauaaaugu

SEQ ID NO: 893558 - RNA, 22 nt, Human
gguggcauucagaagagcuggc

SEQ ID NO: 893559 - RNA, 22 nt, Human
ccaucccuucaccacagcagua

SEQ ID NO: 893560 - RNA, 22 nt, Human
gaggaggcuaagugggcucugg

SEQ ID NO: 893561 - RNA, 22 nt, Human
ucagaacaguucuuaauauugc

SEQ ID NO: 893562 - RNA, 22 nt, Human
acauugaauguaugugaugaaa

SEQ ID NO: 893563 - RNA, 22 nt, Human
auuaauauugguucauuagcug

SEQ ID NO: 893564 - RNA, 22 nt, Human
aaguuguaacagaaauuuaaug

SEQ ID NO: 893565 - RNA, 22 nt, Human
uaagaauagucccuagaugugu

SEQ ID NO: 893566 - RNA, 22 nt, Human
agggcugacagugaggagucaa

SEQ ID NO: 893567 - RNA, 16 nt, Human
guaacauucuguagcc

SEQ ID NO: 893568 - RNA, 22 nt, Human
ugcauggaguaauugaugcuug

SEQ ID NO: 893569 - RNA, 22 nt, Human
aacucaguucuuuccacaaugc

SEQ ID NO: 893570 - RNA, 22 nt, Human
cucucuggucccagauuccaga

SEQ ID NO: 893571 - RNA, 22 nt, Human
aacacuuaaggagagaucaaau

SEQ ID NO: 893572 - RNA, 22 nt, Human
aaugugugaacacuaaugcaac

SEQ ID NO: 893573 - RNA, 22 nt, Human
guuuuacaagguuaaucagcag

SEQ ID NO: 893574 - RNA, 22 nt, Human
uuaauucuuccggacugugaaa

SEQ ID NO: 893575 - RNA, 19 nt, Human
uucuaaguuuugcuugcug

SEQ ID NO: 893576 - RNA, 23 nt, Human
cuuguuauaagaagacugucugg

SEQ ID NO: 893577 - RNA, 20 nt, Human
uaguauuugcauaaggauag

SEQ ID NO: 893578 - RNA, 22 nt, Human
aagcaaaggcaggagcuuguga

SEQ ID NO: 893579 - RNA, 17 nt, Human
uauguguguuugcagca

SEQ ID NO: 893580 - RNA, 22 nt, Human
gaacaacucuucuugagagaug

SEQ ID NO: 893581 - RNA, 20 nt, Human
uuaucugucaaucugucuca

SEQ ID NO: 893582 - RNA, 22 nt, Human
guguccaucagcagccacugug

SEQ ID NO: 893583 - RNA, 22 nt, Human
aucuaagaggaugguuggaaau

SEQ ID NO: 893584 - RNA, 22 nt, Human
cugccuggaugaauggcgccuu

SEQ ID NO: 893585 - RNA, 22 nt, Human
cacagguuugacaaggauaaaa

SEQ ID NO: 893586 - RNA, 22 nt, Human
aguguauucagaauguagcaaa

SEQ ID NO: 893587 - RNA, 22 nt, Human
cagaggcauuacugaaaaggug

SEQ ID NO: 893588 - RNA, 20 nt, Human
agcaggaaaagugccagucu

SEQ ID NO: 893589 - RNA, 22 nt, Human
agacucugaagucauugcauga

SEQ ID NO: 893590 - RNA, 22 nt, Human
agcucuggcuaagcugauaaau

SEQ ID NO: 893591 - RNA, 22 nt, Human
augcuacaggagccccacuuag

SEQ ID NO: 893592 - RNA, 22 nt, Human
aggaggaaaaaggccacagcaa

SEQ ID NO: 893593 - RNA, 22 nt, Human
ggaaucuucagccaugccaaga

SEQ ID NO: 893594 - RNA, 22 nt, Human
augcuuuaaacuauaaauccac

SEQ ID NO: 893595 - RNA, 19 nt, Human
aaucuagaaauauguguuc

SEQ ID NO: 893596 - RNA, 22 nt, Human
aggcaggcucaaugcccagucu

SEQ ID NO: 893597 - RNA, 22 nt, Human
uccugcuuaacauauggucaag

SEQ ID NO: 893598 - RNA, 22 nt, Human
cuugaaaaauaugccuugcuuc

SEQ ID NO: 893599 - RNA, 22 nt, Human
ucuguguuuugugccuacugcu

SEQ ID NO: 893600 - RNA, 15 nt, Human
agcugccugggugcu

SEQ ID NO: 893601 - RNA, 22 nt, Human
cugggaugugaggagcgccucu

SEQ ID NO: 893602 - RNA, 22 nt, Human
uggagcagagaugggagcccaa

SEQ ID NO: 893603 - RNA, 22 nt, Human
gccaccuuccaaaauaaucaca

SEQ ID NO: 893604 - RNA, 22 nt, Human
uugugucuggauuucagcuuuc

SEQ ID NO: 893605 - RNA, 22 nt, Human
uuuucuuauagagcuuaaaguu

SEQ ID NO: 893606 - RNA, 22 nt, Human
guguaacuugcuggaaaaacua

SEQ ID NO: 893607 - RNA, 22 nt, Human
caggccucccggugcacacuga

SEQ ID NO: 893608 - RNA, 22 nt, Human
cugguguccagcauguguggaa

SEQ ID NO: 893609 - RNA, 22 nt, Human
ucccaggacccaggcauucaca

SEQ ID NO: 893610 - RNA, 20 nt, Human
caguuuaacuuugagcaguu

SEQ ID NO: 893611 - RNA, 22 nt, Human
gcacauguugcuaguuacuugc

SEQ ID NO: 893612 - RNA, 22 nt, Human
ccucugggugggaggccgggcg

SEQ ID NO: 893613 - RNA, 22 nt, Human
gugcaugugcauccauguguac

SEQ ID NO: 893614 - RNA, 22 nt, Human
aauugcauaaauuucauagcau

SEQ ID NO: 893615 - RNA, 22 nt, Human
gaggaggcuaucagcaaucagg

SEQ ID NO: 893616 - RNA, 22 nt, Human
ucagcugcaguuucacaagcac

SEQ ID NO: 893617 - RNA, 22 nt, Human
auugucauuccagucauuguua

SEQ ID NO: 893618 - RNA, 22 nt, Human
cuucugggcauggcagagccug

SEQ ID NO: 893619 - RNA, 22 nt, Human
cugagagaguaaaguagaauua

SEQ ID NO: 893620 - RNA, 22 nt, Human
ugagccaguucuucagauccau

SEQ ID NO: 893621 - RNA, 21 nt, Human
ucugugccucaacccucaucu

SEQ ID NO: 893622 - RNA, 22 nt, Human
agggccagcuagagcccucgcc

SEQ ID NO: 893623 - RNA, 22 nt, Human
uugggcagugauuaguucauga

SEQ ID NO: 893624 - RNA, 22 nt, Human
caggccacaaguuggguucaag

SEQ ID NO: 893625 - RNA, 22 nt, Human
cuauuuggccaagcugcccaca

SEQ ID NO: 893626 - RNA, 22 nt, Human
agguuucugcacugucacuggu

SEQ ID NO: 893627 - RNA, 22 nt, Human
ucuagaauucccuuuugacaau

SEQ ID NO: 893628 - RNA, 22 nt, Human
aaagccagaauucguccagccu

SEQ ID NO: 893629 - RNA, 22 nt, Human
ugccuucucuucccugggagcu

SEQ ID NO: 893630 - RNA, 22 nt, Human
uaaugugugucaucaguagagu

SEQ ID NO: 893631 - RNA, 23 nt, Human
ucucccucaugccuaggccuggg

SEQ ID NO: 893632 - RNA, 22 nt, Human
ggccagaggaccucucauagcc

SEQ ID NO: 893633 - RNA, 22 nt, Human
uagcaaggcuuccaaugaacag

SEQ ID NO: 893634 - RNA, 22 nt, Human
ugugaggccucugcaggagcag

SEQ ID NO: 893635 - RNA, 22 nt, Human
cuccuuggguucuuucgguucc

SEQ ID NO: 893636 - RNA, 22 nt, Human
uuucaaagacagccauauuugu

SEQ ID NO: 893637 - RNA, 22 nt, Human
uacagaguguuauuacagaauc

SEQ ID NO: 893638 - RNA, 22 nt, Human
uucucuagugcaaauuguuuga

SEQ ID NO: 893639 - RNA, 22 nt, Human
ucucugugaguggaaggcaccc

SEQ ID NO: 893640 - RNA, 22 nt, Human
gcucucucccuaggcaagugag

SEQ ID NO: 893641 - RNA, 20 nt, Human
caagcccucuuuagccugcc

SEQ ID NO: 893642 - RNA, 22 nt, Human
gagaggaguaggcugauggugc

SEQ ID NO: 893643 - RNA, 18 nt, Human
uaggcugggggcuguagu

SEQ ID NO: 893644 - RNA, 22 nt, Human
acaagcgagcggcuucuggccg

SEQ ID NO: 893645 - RNA, 22 nt, Human
ucucuguaagcugccuucucgu

SEQ ID NO: 893646 - RNA, 22 nt, Human
gggaguccaaauugguacaaua

SEQ ID NO: 893647 - RNA, 22 nt, Human
agggcagaaaucgauuacaccu

SEQ ID NO: 893648 - RNA, 22 nt, Human
uagcaggguccaaugugaggca

SEQ ID NO: 893649 - RNA, 22 nt, Human
aagcuucuuagaaugcaugugc

SEQ ID NO: 893650 - RNA, 22 nt, Human
cucuuagaaagaaacacacugg

SEQ ID NO: 893651 - RNA, 22 nt, Human
uucagugugccuaagucaguug

SEQ ID NO: 893652 - RNA, 19 nt, Human
ccaggccuggcgucuccgc

SEQ ID NO: 893653 - RNA, 22 nt, Human
acacagccccacggugagcaaa

SEQ ID NO: 893654 - RNA, 17 nt, Human
auuuacauugucaccga

SEQ ID NO: 893655 - RNA, 21 nt, Human
uccuugcuauuuuccucagcu

SEQ ID NO: 893656 - RNA, 22 nt, Human
uagggcaguuucauguuaucuu

SEQ ID NO: 893657 - RNA, 20 nt, Human
agaaauacaugcaugcauga

SEQ ID NO: 893658 - RNA, 22 nt, Human
uugaaaggguuaaagugguaaa

SEQ ID NO: 893659 - RNA, 22 nt, Human
ccaggaguuugaggcugcagug

SEQ ID NO: 893660 - RNA, 22 nt, Human
acugugccuucuuauugggucc

SEQ ID NO: 893661 - RNA, 22 nt, Human
caagauuuggcauucugaggag

SEQ ID NO: 893662 - RNA, 22 nt, Human
gcuuuaaauggcuugcccaagu

SEQ ID NO: 893663 - RNA, 22 nt, Human
agagccugcaucuagccucaga

SEQ ID NO: 893664 - RNA, 22 nt, Human
ugugcucuaccucagugucauu

SEQ ID NO: 893665 - RNA, 22 nt, Human
ugcugggcuucacccccacagu

SEQ ID NO: 893666 - RNA, 22 nt, Human
ccaugccccaccaggacgcugc

SEQ ID NO: 893667 - RNA, 22 nt, Human
uucagcacaguucaagauggua

SEQ ID NO: 893668 - RNA, 22 nt, Human
gcccagacauuuggccaaacau

SEQ ID NO: 893669 - RNA, 22 nt, Human
uuauuccagguacuugguuucu

SEQ ID NO: 893670 - RNA, 22 nt, Human
acuugggaggcugaaggacauu

SEQ ID NO: 893671 - RNA, 22 nt, Human
gagcagggagacaacucuggug

SEQ ID NO: 893672 - RNA, 22 nt, Human
uaauuuacagagauacagucag

SEQ ID NO: 893673 - RNA, 22 nt, Human
uucuagcacaagauaugaaagu

SEQ ID NO: 893674 - RNA, 22 nt, Human
uugcuuuaagguaucuggagaa

SEQ ID NO: 893675 - RNA, 22 nt, Human
agcauugaaccagauguuacau

SEQ ID NO: 893676 - RNA, 22 nt, Human
cuuucucuucacugucaugauc

SEQ ID NO: 893677 - RNA, 22 nt, Human
uuguuuaaugccucauacaucu

SEQ ID NO: 893678 - RNA, 22 nt, Human
uccaguuguuuguauuaacucu

SEQ ID NO: 893679 - RNA, 22 nt, Human
aguucucuuccacagccuccuc

SEQ ID NO: 893680 - RNA, 22 nt, Human
aaugcucuuugaauuugucaga

SEQ ID NO: 893681 - RNA, 22 nt, Human
gcagagugccgagauggaagcg

SEQ ID NO: 893682 - RNA, 22 nt, Human
ugcugcauuuaucuucucaaac

SEQ ID NO: 893683 - RNA, 22 nt, Human
uuucuagcugacaaaaauguuu

SEQ ID NO: 893684 - RNA, 22 nt, Human
aauaucuagccuuuagcagcuu

SEQ ID NO: 893685 - RNA, 19 nt, Human
auggaugccucaugccuca

SEQ ID NO: 893686 - RNA, 22 nt, Human
auacuguagaggcauagcuagu

SEQ ID NO: 893687 - RNA, 22 nt, Human
guaaauauucccucgguuccua

SEQ ID NO: 893688 - RNA, 19 nt, Human
acuugaaagcagagaguuu

SEQ ID NO: 893689 - RNA, 22 nt, Human
gugaaggcuacaagagaucaag

SEQ ID NO: 893690 - RNA, 22 nt, Human
augcuuuauuguuaggucaugu

SEQ ID NO: 893691 - RNA, 22 nt, Human
agacacccagugauugagacuu

SEQ ID NO: 893692 - RNA, 22 nt, Human
cugugcucugagcgugggguug

SEQ ID NO: 893693 - RNA, 22 nt, Human
gcuuccugaguacacccucauc

SEQ ID NO: 893694 - RNA, 22 nt, Human
uaacauuguuaugaaucagguc

SEQ ID NO: 893695 - RNA, 22 nt, Human
ugcuucuggggacaggcugccu

SEQ ID NO: 893696 - RNA, 22 nt, Human
caaaguuuuaguaaacauauau

SEQ ID NO: 893697 - RNA, 20 nt, Human
cagcucugggcaggucgagg

SEQ ID NO: 893698 - RNA, 22 nt, Human
aagcacauuguacauuugugcu

SEQ ID NO: 893699 - RNA, 22 nt, Human
gggcuucaggguacuuccuccu

SEQ ID NO: 893700 - RNA, 21 nt, Human
cacacagcugcccuuagguag

SEQ ID NO: 893701 - RNA, 22 nt, Human
cucuggagcauuucaccuacau

SEQ ID NO: 893702 - RNA, 22 nt, Human
ccaccuccaccuauugccagcc

SEQ ID NO: 893703 - RNA, 22 nt, Human
agcccaggagccuuuggagggu

SEQ ID NO: 893704 - RNA, 22 nt, Human
auacagcagugaauaagauaaa

SEQ ID NO: 893705 - RNA, 22 nt, Human
cacagauuuccuaagcaucaau

SEQ ID NO: 893706 - RNA, 22 nt, Human
uucuuucucacucuuuaggaag

SEQ ID NO: 893707 - RNA, 22 nt, Human
gagucugagaacugggcucagu

SEQ ID NO: 893708 - RNA, 22 nt, Human
aaugucaaagugcuuugcaaac

SEQ ID NO: 893709 - RNA, 22 nt, Human
ugccuaacuccaccaggcaggu

SEQ ID NO: 893710 - RNA, 22 nt, Human
ucauuccauuuccagcucugaa

SEQ ID NO: 893711 - RNA, 22 nt, Human
aaauuagugcaccagguugaag

SEQ ID NO: 893712 - RNA, 22 nt, Human
gcaguccauugacagaggucuu

SEQ ID NO: 893713 - RNA, 21 nt, Human
guauguauggauaaugagagg

SEQ ID NO: 893714 - RNA, 22 nt, Human
ccagcuggggaaguggggcaua

SEQ ID NO: 893715 - RNA, 22 nt, Human
aaaggaagugccacucuucuuc

SEQ ID NO: 893716 - RNA, 22 nt, Human
cucccuggaggugagcuggcac

SEQ ID NO: 893717 - RNA, 22 nt, Human
cccaggaguaagugacauuguu

SEQ ID NO: 893718 - RNA, 22 nt, Human
ugcagccacaugaccugggucu

SEQ ID NO: 893719 - RNA, 22 nt, Human
uuugcauuauauuuauagaaga

SEQ ID NO: 893720 - RNA, 22 nt, Human
ucucuccucuagucaggguggu

SEQ ID NO: 893721 - RNA, 22 nt, Human
ucagggcccagucugugcaucu

SEQ ID NO: 893722 - RNA, 22 nt, Human
cuuggucuagugagugagcaua

SEQ ID NO: 893723 - RNA, 22 nt, Human
uacaaaugaccauagccacuua

SEQ ID NO: 893724 - RNA, 22 nt, Human
gcugccuccugaaagcgcucug

SEQ ID NO: 893725 - RNA, 19 nt, Human
cugggagguguucagagaa

SEQ ID NO: 893726 - RNA, 22 nt, Human
ccacagggccuuuccugcuggc

SEQ ID NO: 893727 - RNA, 22 nt, Human
aggccaggggugagcacuucug

SEQ ID NO: 893728 - RNA, 19 nt, Human
gucuagaacauuguaggug

SEQ ID NO: 893729 - RNA, 22 nt, Human
uguacuugaacuugacuguaga

SEQ ID NO: 893730 - RNA, 22 nt, Human
cugucaguaggcucccaucauu

SEQ ID NO: 893731 - RNA, 22 nt, Human
gccuguuccuuaguggcuucac

SEQ ID NO: 893732 - RNA, 22 nt, Human
accaaaaagauauguugaagcc

SEQ ID NO: 893733 - RNA, 22 nt, Human
gcuccagcaccuagagcagguc

SEQ ID NO: 893734 - RNA, 22 nt, Human
agccgcaagaaguacagcagca

SEQ ID NO: 893735 - RNA, 22 nt, Human
acagauuuuugguaaauaauuu

SEQ ID NO: 893736 - RNA, 22 nt, Human
uauacacauuacaguuucagga

SEQ ID NO: 893737 - RNA, 22 nt, Human
uaauauguguuacugacuuuuu

SEQ ID NO: 893738 - RNA, 22 nt, Human
ucuuuuguagcuaacacauuca

SEQ ID NO: 893739 - RNA, 22 nt, Human
gagcagggcuuguccuccucau

SEQ ID NO: 893740 - RNA, 22 nt, Human
ggcugggaggaugacuugcuac

SEQ ID NO: 893741 - RNA, 22 nt, Human
cugggccuggacgggcagaucu

SEQ ID NO: 893742 - RNA, 22 nt, Human
uaaggaaacaacuuguauuuuu

SEQ ID NO: 893743 - RNA, 18 nt, Human
ugcaaauggcuguuugau

SEQ ID NO: 893744 - RNA, 22 nt, Human
gaacaaacagaagaggcggaac

SEQ ID NO: 893745 - RNA, 22 nt, Human
gccaggaggcugcuguguaggc

SEQ ID NO: 893746 - RNA, 22 nt, Human
agcuguggcaaccuugucagac

SEQ ID NO: 893747 - RNA, 20 nt, Human
uuaggaagucacaauuucag

SEQ ID NO: 893748 - RNA, 22 nt, Human
cagggccugucacgacgcucau

SEQ ID NO: 893749 - RNA, 22 nt, Human
uaacugaagcuggaagcgcugg

SEQ ID NO: 893750 - RNA, 22 nt, Human
aacaaaguacuuuucagugcuu

SEQ ID NO: 893751 - RNA, 22 nt, Human
gagagaagaaagccaugguccu

SEQ ID NO: 893752 - RNA, 22 nt, Human
gcugccugauuuacauagugaa

SEQ ID NO: 893753 - RNA, 22 nt, Human
ggaagccagagugcugggcagg

SEQ ID NO: 893754 - RNA, 22 nt, Human
uaucacaucaauguuuuaaaau

SEQ ID NO: 893755 - RNA, 22 nt, Human
aagcaauaggguaaucuacuca

SEQ ID NO: 893756 - RNA, 22 nt, Human
acuuggauauguucacuagacc

SEQ ID NO: 893757 - RNA, 22 nt, Human
gagccucguggcggccacugcg

SEQ ID NO: 893758 - RNA, 22 nt, Human
aauuuacacuucauuuggaggg

SEQ ID NO: 893759 - RNA, 22 nt, Human
augauauagagaguagauuaaa

SEQ ID NO: 893760 - RNA, 22 nt, Human
aggccucagcucagugugacag

SEQ ID NO: 893761 - RNA, 18 nt, Human
uuuauauggauagagacc

SEQ ID NO: 893762 - RNA, 22 nt, Human
gggcacaggagaaggaucuggc

SEQ ID NO: 893763 - RNA, 22 nt, Human
uuaauaaacaggugcagcugaa

SEQ ID NO: 893764 - RNA, 22 nt, Human
gucuagaaaaugccgagggaug

SEQ ID NO: 893765 - RNA, 22 nt, Human
acagaguaggugcugucgacug

SEQ ID NO: 893766 - RNA, 22 nt, Human
acagacaaguaguucagacaag

SEQ ID NO: 893767 - RNA, 22 nt, Human
gcuaggaggcccugcacgcuua

SEQ ID NO: 893768 - RNA, 22 nt, Human
cugggcagaguccggaagaugg

SEQ ID NO: 893769 - RNA, 22 nt, Human
cagcuccagccaccggggggug

SEQ ID NO: 893770 - RNA, 20 nt, Human
cccaggagugagcagcuuua

SEQ ID NO: 893771 - RNA, 22 nt, Human
ccugggccuggcgggucggcuc

SEQ ID NO: 893772 - RNA, 22 nt, Human
cuguccaugguccuuauuacca

SEQ ID NO: 893773 - RNA, 22 nt, Human
uuaauaauaaugagcccauuuu

SEQ ID NO: 893774 - RNA, 22 nt, Human
gcugcccuagaaguacagagag

SEQ ID NO: 893775 - RNA, 22 nt, Human
cuguggugggcccugggcuuca

SEQ ID NO: 893776 - RNA, 22 nt, Human
uggcccaguauguauaaucuua

SEQ ID NO: 893777 - RNA, 18 nt, Human
ggaugcugugugcuccuu

SEQ ID NO: 893778 - RNA, 22 nt, Human
agaacuuaauucagugacuuaa

SEQ ID NO: 893779 - RNA, 17 nt, Human
cagacaggcugucaccc

SEQ ID NO: 893780 - RNA, 22 nt, Human
cugguauugaguuguugcuucc

SEQ ID NO: 893781 - RNA, 22 nt, Human
cagcaauaaugucuacaaaucu

SEQ ID NO: 893782 - RNA, 23 nt, Human
uagaaucuguauuucugcaguuc

SEQ ID NO: 893783 - RNA, 22 nt, Human
cuacagagaacucagcugcccu

SEQ ID NO: 893784 - RNA, 22 nt, Human
gaccacagacuggaaagagggc

SEQ ID NO: 893785 - RNA, 22 nt, Human
cuugccaaugguacaaacgauu

SEQ ID NO: 893786 - RNA, 23 nt, Human
aggaggaaaaguuaucugcugag

SEQ ID NO: 893787 - RNA, 22 nt, Human
agagcugguuuacucaggaauu

SEQ ID NO: 893788 - RNA, 22 nt, Human
augcaagaaacagagacgcuga

SEQ ID NO: 893789 - RNA, 22 nt, Human
ugaaacaaguuuaagggaucua

SEQ ID NO: 893790 - RNA, 22 nt, Human
gaggccuguagucauggaugua

SEQ ID NO: 893791 - RNA, 22 nt, Human
uucuuuuagucauucagggaag

SEQ ID NO: 893792 - RNA, 22 nt, Human
cugggcacauuuugacuagugu

SEQ ID NO: 893793 - RNA, 22 nt, Human
acauuugacucuguucauauua

SEQ ID NO: 893794 - RNA, 22 nt, Human
ccagagucaggagcucauguga

SEQ ID NO: 893795 - RNA, 22 nt, Human
ugcaaugaauuacuucccaaac

SEQ ID NO: 893796 - RNA, 22 nt, Human
agggccaccagagcagggcagu

SEQ ID NO: 893797 - RNA, 22 nt, Human
gcgagggcacgcgguugaaggc

SEQ ID NO: 893798 - RNA, 22 nt, Human
acucucucugauggaacuuuag

SEQ ID NO: 893799 - RNA, 22 nt, Human
caggagauaaaagagaugcuuu

SEQ ID NO: 893800 - RNA, 22 nt, Human
cuguauauggcuuacuuuauau

SEQ ID NO: 893801 - RNA, 22 nt, Human
ucuggcucccagccugcucuca

SEQ ID NO: 893802 - RNA, 22 nt, Human
gguuuccaaagauagaguagua

SEQ ID NO: 893803 - RNA, 22 nt, Human
caugaaauugcuccuuuggugc

SEQ ID NO: 893804 - RNA, 22 nt, Human
uccuggaggcaaaugagcacau

SEQ ID NO: 893805 - RNA, 22 nt, Human
ccauuaaaauugugacauagga

SEQ ID NO: 893806 - RNA, 22 nt, Human
uagaggcacagucuauguagag

SEQ ID NO: 893807 - RNA, 22 nt, Human
uguccauggggaaggggaagug

SEQ ID NO: 893808 - RNA, 17 nt, Human
ugagacagggcaggccc

SEQ ID NO: 893809 - RNA, 22 nt, Human
agaacaauguuaaauuauuaag

SEQ ID NO: 893810 - RNA, 22 nt, Human
ccaaaggccaagcucagguaaa

SEQ ID NO: 893811 - RNA, 22 nt, Human
uauaagaagugaagaagaguua

SEQ ID NO: 893812 - RNA, 22 nt, Human
ugagggaguuggguguauagga

SEQ ID NO: 893813 - RNA, 22 nt, Human
uuccugugugaccgagacagug

SEQ ID NO: 893814 - RNA, 22 nt, Human
cccacagguggaagccucggaa

SEQ ID NO: 893815 - RNA, 22 nt, Human
aacaaugugauugaagcuagaa

SEQ ID NO: 893816 - RNA, 22 nt, Human
auguggcuuggcagggaauaug

SEQ ID NO: 893817 - RNA, 22 nt, Human
uccugcagccuugggcuggagc

SEQ ID NO: 893818 - RNA, 22 nt, Human
gaccauuugcuaguaaauugca

SEQ ID NO: 893819 - RNA, 22 nt, Human
acauguaaaaauuaagguaaga

SEQ ID NO: 893820 - RNA, 22 nt, Human
aauauguuccacuuaaagcugg

SEQ ID NO: 893821 - RNA, 21 nt, Human
caaaacuuaggugacuuagga

SEQ ID NO: 893822 - RNA, 22 nt, Human
augcacagaaaaauugcuuacu

SEQ ID NO: 893823 - RNA, 22 nt, Human
aauaucuucuaaggauagaacu

SEQ ID NO: 893824 - RNA, 22 nt, Human
cagaggacaauagaauggaaag

SEQ ID NO: 893825 - RNA, 22 nt, Human
agaagagccuggggaccauggc

SEQ ID NO: 893826 - RNA, 22 nt, Human
gaaagguuuaaguaggauuugu

SEQ ID NO: 893827 - RNA, 22 nt, Human
cagcuggcuccaccucugggcu

SEQ ID NO: 893828 - RNA, 19 nt, Human
uugucuuagcugcauaaga

SEQ ID NO: 893829 - RNA, 22 nt, Human
cacagcuuguuuagugacucac

SEQ ID NO: 893830 - RNA, 22 nt, Human
uauuuccacccucaguaaggaa

SEQ ID NO: 893831 - RNA, 22 nt, Human
ugucaacaacagcauuuucuau

SEQ ID NO: 893832 - RNA, 22 nt, Human
ucacaguacugugugacuugag

SEQ ID NO: 893833 - RNA, 22 nt, Human
cccaggagagaggggauaaagc

SEQ ID NO: 893834 - RNA, 22 nt, Human
ccucucccagggagagccugag

SEQ ID NO: 893835 - RNA, 22 nt, Human
ucuccucuauuucuguauguau

SEQ ID NO: 893836 - RNA, 22 nt, Human
ggugcugauuuguugcugagau

SEQ ID NO: 893837 - RNA, 22 nt, Human
cagacuguagaguuugagaagu

SEQ ID NO: 893838 - RNA, 22 nt, Human
caggggacacuccugcuugggc

SEQ ID NO: 893839 - RNA, 22 nt, Human
caggcucacuguaaggucagcu

SEQ ID NO: 893840 - RNA, 22 nt, Human
acccucugcaucagcuucuuua

SEQ ID NO: 893841 - RNA, 22 nt, Human
aggcucaggaggagcugccgga

SEQ ID NO: 893842 - RNA, 22 nt, Human
gcauuucauguaagucagacca

SEQ ID NO: 893843 - RNA, 22 nt, Human
ucaguccaggauugggagugac

SEQ ID NO: 893844 - RNA, 22 nt, Human
gagcugggacuuggaauccaca

SEQ ID NO: 893845 - RNA, 22 nt, Human
acacaucaugccaaguuucacc

SEQ ID NO: 893846 - RNA, 21 nt, Human
agacccugcauauguucagua

SEQ ID NO: 893847 - RNA, 22 nt, Human
auucauuuagguauucacuuac

SEQ ID NO: 893848 - RNA, 22 nt, Human
uuggaaauggcuguaguuauga

SEQ ID NO: 893849 - RNA, 22 nt, Human
aucucucugcccaggggcugug

SEQ ID NO: 893850 - RNA, 22 nt, Human
uaaaggcaugcaggugaaugua

SEQ ID NO: 893851 - RNA, 19 nt, Human
uggaccugugcccauggcu

SEQ ID NO: 893852 - RNA, 22 nt, Human
agucucuuucuaaauaagguca

SEQ ID NO: 893853 - RNA, 22 nt, Human
gcaggcuucaagcacagcuuuu

SEQ ID NO: 893854 - RNA, 23 nt, Human
ucagcuguucuuuucccugggac

SEQ ID NO: 893855 - RNA, 22 nt, Human
agauacauagcugugagcacac

SEQ ID NO: 893856 - RNA, 22 nt, Human
ggagguggcagagggacauucu

SEQ ID NO: 893857 - RNA, 22 nt, Human
aaguuuguguaguuuagcaucc

SEQ ID NO: 893858 - RNA, 23 nt, Human
cacauugaacacucucuuuccug

SEQ ID NO: 893859 - RNA, 22 nt, Human
gaacaaacagucaggacagucu

SEQ ID NO: 893860 - RNA, 22 nt, Human
agggcugaaacauaauccuucu

SEQ ID NO: 893861 - RNA, 22 nt, Human
agugccauguaguccagcagaa

SEQ ID NO: 893862 - RNA, 22 nt, Human
gcuaagaaaaauucauguauau

SEQ ID NO: 893863 - RNA, 22 nt, Human
uggggugggguuacucauucug

SEQ ID NO: 893864 - RNA, 22 nt, Human
acagaccaaaaaaggauauugg

SEQ ID NO: 893865 - RNA, 22 nt, Human
aaacacuagcaggaagcacuga

SEQ ID NO: 893866 - RNA, 22 nt, Human
aagagcuguaugccauaugauu

SEQ ID NO: 893867 - RNA, 22 nt, Human
ugagaggaacaggcaguagguu

SEQ ID NO: 893868 - RNA, 22 nt, Human
uugagguaucugucuuuaauug

SEQ ID NO: 893869 - RNA, 22 nt, Human
acauaugcucaucugcauuccc

SEQ ID NO: 893870 - RNA, 22 nt, Human
aacaauguccugugagaugaua

SEQ ID NO: 893871 - RNA, 22 nt, Human
cugggcugucccagggcggcag

SEQ ID NO: 893872 - RNA, 22 nt, Human
gcacuggugugaaacaguagau

SEQ ID NO: 893873 - RNA, 20 nt, Human
uaaugucaaagucacaaggu

SEQ ID NO: 893874 - RNA, 22 nt, Human
ugcuggcuuagauaucacugcc

SEQ ID NO: 893875 - RNA, 22 nt, Human
uguuaugagaaagacauuaggu

SEQ ID NO: 893876 - RNA, 22 nt, Human
uuugacagcauaauccuacacc

SEQ ID NO: 893877 - RNA, 22 nt, Human
accuaagaaauccagagauuuc

SEQ ID NO: 893878 - RNA, 22 nt, Human
uuaaaccauaguuuaacauaag

SEQ ID NO: 893879 - RNA, 22 nt, Human
ucacaggagggagagacaccca

SEQ ID NO: 893880 - RNA, 22 nt, Human
aaugaagauuauggugauuaag

SEQ ID NO: 893881 - RNA, 22 nt, Human
augugugugugcgcgcgcagga

SEQ ID NO: 893882 - RNA, 22 nt, Human
cucauuuacucaucugcaaaac

SEQ ID NO: 893883 - RNA, 22 nt, Human
agugugucgagggaggguccag

SEQ ID NO: 893884 - RNA, 19 nt, Human
ggaccagcuuucaggaggc

SEQ ID NO: 893885 - RNA, 22 nt, Human
agagcuggauggucaagauggc

SEQ ID NO: 893886 - RNA, 22 nt, Human
gcuuacaaacaacagaaauuaa

SEQ ID NO: 893887 - RNA, 22 nt, Human
acagggcagaaauguugcaucu

SEQ ID NO: 893888 - RNA, 21 nt, Human
ucagauucucucauuuugaug

SEQ ID NO: 893889 - RNA, 22 nt, Human
gcuacuaguacagcaaggacua

SEQ ID NO: 893890 - RNA, 22 nt, Human
caauuacauuuauugagcauuc

SEQ ID NO: 893891 - RNA, 22 nt, Human
uagacauuuaucuccaugugga

SEQ ID NO: 893892 - RNA, 22 nt, Human
agucuuagauuuuauuuugguc

SEQ ID NO: 893893 - RNA, 22 nt, Human
ugcacacaaguuggagaaugaa

SEQ ID NO: 893894 - RNA, 22 nt, Human
cagauucaaccuaagacaaucu

SEQ ID NO: 893895 - RNA, 22 nt, Human
ucuuucuacauuuuauaugcuu

SEQ ID NO: 893896 - RNA, 22 nt, Human
gccucugggggcucagaccugu

SEQ ID NO: 893897 - RNA, 22 nt, Human
ucccaaggauaagagagucuga

SEQ ID NO: 893898 - RNA, 22 nt, Human
augagaaaauucauuccaucca

SEQ ID NO: 893899 - RNA, 22 nt, Human
auguguuaaugucaaccagaaa

SEQ ID NO: 893900 - RNA, 22 nt, Human
gcaccugggacccagaggcacc

SEQ ID NO: 893901 - RNA, 22 nt, Human
cuuaauuacuguccaauaugca

SEQ ID NO: 893902 - RNA, 22 nt, Human
auauuaaauggauuuugggagc

SEQ ID NO: 893903 - RNA, 22 nt, Human
aaggaagguacucagugauucu

SEQ ID NO: 893904 - RNA, 22 nt, Human
ccugggcucgcgcacuucaccc

SEQ ID NO: 893905 - RNA, 22 nt, Human
guucaauuaaguuacaaauuua

SEQ ID NO: 893906 - RNA, 22 nt, Human
cuuuccaggaauccucacagcc

SEQ ID NO: 893907 - RNA, 22 nt, Human
ucucaaggacuuugggcacuaa

SEQ ID NO: 893908 - RNA, 22 nt, Human
cauaguuccuaccuaagcauaa

SEQ ID NO: 893909 - RNA, 22 nt, Human
ugccagagauuucacacugcua

SEQ ID NO: 893910 - RNA, 22 nt, Human
uagucacaugaucacaggaucg

SEQ ID NO: 893911 - RNA, 22 nt, Human
ccucugggcugccugcacgggu

SEQ ID NO: 893912 - RNA, 22 nt, Human
caauucuuucagcugcauuugu

SEQ ID NO: 893913 - RNA, 22 nt, Human
ggaggcugaggccccucacagg

SEQ ID NO: 893914 - RNA, 22 nt, Human
uggauaaaugugcagaugacau

SEQ ID NO: 893915 - RNA, 19 nt, Human
aggaaggcggcggcugccc

SEQ ID NO: 893916 - RNA, 20 nt, Human
gcugccagugccugaugcuu

SEQ ID NO: 893917 - RNA, 22 nt, Human
ugcauggagcugucugcauggu

SEQ ID NO: 893918 - RNA, 22 nt, Human
ggggauggaggcgugugguccu

SEQ ID NO: 893919 - RNA, 22 nt, Human
ucagaaucucuggaggcuuggc

SEQ ID NO: 893920 - RNA, 22 nt, Human
ucacugcuuaacucaagaucuc

SEQ ID NO: 893921 - RNA, 22 nt, Human
cucccauagcauuuuaaauagu

SEQ ID NO: 893922 - RNA, 22 nt, Human
uaaacagcuacugugucaaagg

SEQ ID NO: 893923 - RNA, 22 nt, Human
agcugaagcacugggauggaag

SEQ ID NO: 893924 - RNA, 22 nt, Human
aaaauuggacguagcuacucca

SEQ ID NO: 893925 - RNA, 21 nt, Human
gccugggaaaucugggaagcc

SEQ ID NO: 893926 - RNA, 18 nt, Human
gggcagcacagcagccuc

SEQ ID NO: 893927 - RNA, 22 nt, Human
acccagagcccuuagcacagac

SEQ ID NO: 893928 - RNA, 22 nt, Human
ugugagcugaagugacaggcug

SEQ ID NO: 893929 - RNA, 22 nt, Human
agggagcagcagccacaggaug

SEQ ID NO: 893930 - RNA, 22 nt, Human
ugaagggcaaccccaggcccag

SEQ ID NO: 893931 - RNA, 22 nt, Human
ucacaguacaugauucaguggu

SEQ ID NO: 893932 - RNA, 22 nt, Human
uccacagcacaaagccagugug

SEQ ID NO: 893933 - RNA, 22 nt, Human
agcagcagggcaugucuuacuc

SEQ ID NO: 893934 - RNA, 22 nt, Human
gaggcaggcacuguuaucagca

SEQ ID NO: 893935 - RNA, 22 nt, Human
ccuccuggagcauuggugagga

SEQ ID NO: 893936 - RNA, 22 nt, Human
guuauguaugagggaaugauua

SEQ ID NO: 893937 - RNA, 22 nt, Human
gucuagaaaucauguacuguga

SEQ ID NO: 893938 - RNA, 22 nt, Human
ggcagcuguggacgucgucauu

SEQ ID NO: 893939 - RNA, 22 nt, Human
uucaggaaucaaccaagucauu

SEQ ID NO: 893940 - RNA, 16 nt, Human
ugcagagagcauggug

SEQ ID NO: 893941 - RNA, 22 nt, Human
ggaaauauuuugucuaauuugu

SEQ ID NO: 893942 - RNA, 22 nt, Human
acaguggaagcaugaugcuauc

SEQ ID NO: 893943 - RNA, 21 nt, Human
uacauugaagaaugggaauga

SEQ ID NO: 893944 - RNA, 22 nt, Human
ugagcagaagauuggaacuuac

SEQ ID NO: 893945 - RNA, 22 nt, Human
uuagguaaggauggugacagua

SEQ ID NO: 893946 - RNA, 22 nt, Human
ggagugugggauggagcucagg

SEQ ID NO: 893947 - RNA, 22 nt, Human
aagcccagcugaaagcauuuuu

SEQ ID NO: 893948 - RNA, 22 nt, Human
guggggcuuccuggggcaaguu

SEQ ID NO: 893949 - RNA, 22 nt, Human
agacacagcaauaacuacuguu

SEQ ID NO: 893950 - RNA, 22 nt, Human
uugcacagggcuggaauguccu

SEQ ID NO: 893951 - RNA, 22 nt, Human
uggaacaacaugcuggaaaauu

SEQ ID NO: 893952 - RNA, 22 nt, Human
ggcagagcuuguuccuucuguu

SEQ ID NO: 893953 - RNA, 22 nt, Human
agaaagagcucgggauuaacag

SEQ ID NO: 893954 - RNA, 22 nt, Human
augggcucggcgcugcugggau

SEQ ID NO: 893955 - RNA, 22 nt, Human
gaucaguguuuugugcauucuu

SEQ ID NO: 893956 - RNA, 22 nt, Human
agauacaaguuaagagaaagga

SEQ ID NO: 893957 - RNA, 22 nt, Human
aggacaugugccuccagggcag

SEQ ID NO: 893958 - RNA, 23 nt, Human
agucuucauuguauuuccagacc

SEQ ID NO: 893959 - RNA, 22 nt, Human
agaggaggcagcuuaacucagu

SEQ ID NO: 893960 - RNA, 22 nt, Human
ucuugggaaauguuugcgagcu

SEQ ID NO: 893961 - RNA, 22 nt, Human
gcugucuugaugauuggaugcu

SEQ ID NO: 893962 - RNA, 22 nt, Human
gcuuuugugagcucucacuuug

SEQ ID NO: 893963 - RNA, 22 nt, Human
ugagcagaggccagcaccuggg

SEQ ID NO: 893964 - RNA, 22 nt, Human
uguggcgagaacauuggaccau

SEQ ID NO: 893965 - RNA, 22 nt, Human
ucugaaggaaaaggguagauau

SEQ ID NO: 893966 - RNA, 22 nt, Human
agugggaccggugcuauuccag

SEQ ID NO: 893967 - RNA, 22 nt, Human
cucagaaaggguugcugagggc

SEQ ID NO: 893968 - RNA, 22 nt, Human
guggcagagugcgguucugacc

SEQ ID NO: 893969 - RNA, 22 nt, Human
ggcuggcucagggcuugagaga

SEQ ID NO: 893970 - RNA, 22 nt, Human
aggcagcauucaggggugauga

SEQ ID NO: 893971 - RNA, 22 nt, Human
gaugaggcucaugcacccugcg

SEQ ID NO: 893972 - RNA, 22 nt, Human
aauaauuuuagcucagaguugu

SEQ ID NO: 893973 - RNA, 22 nt, Human
agugacuggugugaaguuaaau

SEQ ID NO: 893974 - RNA, 22 nt, Human
auucuucaguauguguggauug

SEQ ID NO: 893975 - RNA, 22 nt, Human
agguauaugaagaugaaauaac

SEQ ID NO: 893976 - RNA, 22 nt, Human
cauuugguguuaggcauguuaa

SEQ ID NO: 893977 - RNA, 21 nt, Human
aagagacauuucucaucagca

SEQ ID NO: 893978 - RNA, 22 nt, Human
gcacacauucggauucuuaacc

SEQ ID NO: 893979 - RNA, 22 nt, Human
gcuacuaggaagauuccaggau

SEQ ID NO: 893980 - RNA, 20 nt, Human
cagaggcaaggagacuugga

SEQ ID NO: 893981 - RNA, 22 nt, Human
gggcagugucggggcccaggga

SEQ ID NO: 893982 - RNA, 22 nt, Human
cucauacucccagccagcuguc

SEQ ID NO: 893983 - RNA, 22 nt, Human
agcauuuaugacuaauguaaaa

SEQ ID NO: 893984 - RNA, 22 nt, Human
ugguggggccagacuucagcuc

SEQ ID NO: 893985 - RNA, 22 nt, Human
uaggauuuuuuggauucuggau

SEQ ID NO: 893986 - RNA, 22 nt, Human
cuuaacaugggggguaagucug

SEQ ID NO: 893987 - RNA, 22 nt, Human
cccuggagggcagacagaugcc

SEQ ID NO: 893988 - RNA, 22 nt, Human
uguauguaugcaucuuuuaugu

SEQ ID NO: 893989 - RNA, 22 nt, Human
acacaugcucauaaauaaauag

SEQ ID NO: 893990 - RNA, 22 nt, Human
cugcugucccagccuccucaca

SEQ ID NO: 893991 - RNA, 21 nt, Human
ugagucucucagcuucaggua

SEQ ID NO: 893992 - RNA, 22 nt, Human
uuucuuccccacugcaggcucu

SEQ ID NO: 893993 - RNA, 22 nt, Human
uggauaugcccagggcacccua

SEQ ID NO: 893994 - RNA, 22 nt, Human
aggaagagcccgggugacauaa

SEQ ID NO: 893995 - RNA, 22 nt, Human
uacacauacauugcuuacaagg

SEQ ID NO: 893996 - RNA, 22 nt, Human
cuacauuucccagcugccuucc

SEQ ID NO: 893997 - RNA, 22 nt, Human
aauaacagagaaggguggcuuc

SEQ ID NO: 893998 - RNA, 22 nt, Human
ggggcccuuguggcugcaggcc

SEQ ID NO: 893999 - RNA, 22 nt, Human
uugaaauauuugggaguguuug

SEQ ID NO: 894000 - RNA, 22 nt, Human
aggaucuuauguaauaauuaug

SEQ ID NO: 894001 - RNA, 22 nt, Human
uccaucaccacagaggacagag

SEQ ID NO: 894002 - RNA, 22 nt, Human
aaacauguuuucugaauauuuu

SEQ ID NO: 894003 - RNA, 22 nt, Human
gagcugcaugcggaaaccuguu

SEQ ID NO: 894004 - RNA, 22 nt, Human
uuucauguuaguugguucuugg

SEQ ID NO: 894005 - RNA, 22 nt, Human
ucuguuccauguuuuguuccau

SEQ ID NO: 894006 - RNA, 22 nt, Human
ugcagagguuuccaggcaaguu

SEQ ID NO: 894007 - RNA, 22 nt, Human
acacuuaagcaugaaguauaaa

SEQ ID NO: 894008 - RNA, 22 nt, Human
cuucaguuaugugccaaggaca

SEQ ID NO: 894009 - RNA, 20 nt, Human
gaaucuuuccccaugcaaug

SEQ ID NO: 894010 - RNA, 22 nt, Human
aggccucauaguagaccugccc

SEQ ID NO: 894011 - RNA, 22 nt, Human
uaggaaaagcacaggauguucu

SEQ ID NO: 894012 - RNA, 22 nt, Human
uguucugggguugagagacaau

SEQ ID NO: 894013 - RNA, 22 nt, Human
uaaacagagugcuaguucacgg

SEQ ID NO: 894014 - RNA, 22 nt, Human
aagugaauguuugguagcagug

SEQ ID NO: 894015 - RNA, 22 nt, Human
aggggagaauuucaacucaggu

SEQ ID NO: 894016 - RNA, 22 nt, Human
augcaagaucacaccaaacacg

SEQ ID NO: 894017 - RNA, 22 nt, Human
uuuuaagugcaaucugaaugcg

SEQ ID NO: 894018 - RNA, 22 nt, Human
aaagcaguauaguggaagggcu

SEQ ID NO: 894019 - RNA, 22 nt, Human
gaaaaaugagcugaugucaggg

SEQ ID NO: 894020 - RNA, 22 nt, Human
ccugguguugugaaguagccgu

SEQ ID NO: 894021 - RNA, 22 nt, Human
ugcaagcaauccaggaaggcua

SEQ ID NO: 894022 - RNA, 22 nt, Human
uuguaaaguacuuagcacagca

SEQ ID NO: 894023 - RNA, 20 nt, Human
gcccacucuaauccacuguc

SEQ ID NO: 894024 - RNA, 22 nt, Human
ggaggccaggugggagucaucu

SEQ ID NO: 894025 - RNA, 22 nt, Human
uucagguguggccagaggagaa

SEQ ID NO: 894026 - RNA, 21 nt, Human
aaggucuguaaagugacagga

SEQ ID NO: 894027 - RNA, 18 nt, Human
gaagggagcuggaaugca

SEQ ID NO: 894028 - RNA, 23 nt, Human
acaaaugucuagagaggguguga

SEQ ID NO: 894029 - RNA, 22 nt, Human
gugacacugguuuagguaugua

SEQ ID NO: 894030 - RNA, 22 nt, Human
uugaagaguguccuuguaaaaa

SEQ ID NO: 894031 - RNA, 22 nt, Human
gcaagcaguuacccaggauucg

SEQ ID NO: 894032 - RNA, 22 nt, Human
auuggaacccuaggcaggcaga

SEQ ID NO: 894033 - RNA, 22 nt, Human
ccuguguccaguuccagguugu

SEQ ID NO: 894034 - RNA, 20 nt, Human
aggaagugauguuuuaucug

SEQ ID NO: 894035 - RNA, 22 nt, Human
ccuggacagggccaggccaugc

SEQ ID NO: 894036 - RNA, 19 nt, Human
ggcccaaguacugagugcc

SEQ ID NO: 894037 - RNA, 22 nt, Human
uucagcuagcaucucacuuggu

SEQ ID NO: 894038 - RNA, 22 nt, Human
ugccagcaguagcaguaggcca

SEQ ID NO: 894039 - RNA, 22 nt, Human
augcaguggcuucagugucagu

SEQ ID NO: 894040 - RNA, 22 nt, Human
gaaaccagcuagaggcagaggg

SEQ ID NO: 894041 - RNA, 22 nt, Human
uucuucaaggguaaaggcaacg

SEQ ID NO: 894042 - RNA, 22 nt, Human
uugggagauucauugagccaag

SEQ ID NO: 894043 - RNA, 22 nt, Human
cuugagcuaggaaggcugaggc

SEQ ID NO: 894044 - RNA, 22 nt, Human
uuuggcucugugucuucaccca

SEQ ID NO: 894045 - RNA, 21 nt, Human
uguguaaaguugaaauccugu

SEQ ID NO: 894046 - RNA, 22 nt, Human
accauacuugaaauggauagga

SEQ ID NO: 894047 - RNA, 22 nt, Human
uuuaaaaguuaucaucugucca

SEQ ID NO: 894048 - RNA, 22 nt, Human
ccuuagaucaggcugucuaggg

SEQ ID NO: 894049 - RNA, 23 nt, Human
gcagaggagcaagcuggacacca

SEQ ID NO: 894050 - RNA, 22 nt, Human
uucagaaaaagaccauugcaau

SEQ ID NO: 894051 - RNA, 23 nt, Human
agcugggaauuuucugaagcuuu

SEQ ID NO: 894052 - RNA, 22 nt, Human
uuuauucacuggggucugcccg

SEQ ID NO: 894053 - RNA, 22 nt, Human
agauguaccagguauuacagga

SEQ ID NO: 894054 - RNA, 22 nt, Human
ugaaagcagauagcucuguugu

SEQ ID NO: 894055 - RNA, 23 nt, Human
aaauaugucugagggcaaagaau

SEQ ID NO: 894056 - RNA, 22 nt, Human
uauuaacacguauaaaguguuu

SEQ ID NO: 894057 - RNA, 22 nt, Human
ugaguucuccaagagaagguau

SEQ ID NO: 894058 - RNA, 22 nt, Human
caggcccaugagggcagccaca

SEQ ID NO: 894059 - RNA, 22 nt, Human
guucauuuaggaaaggaagagu

SEQ ID NO: 894060 - RNA, 22 nt, Human
uagcaagauccuucccuggcgu

SEQ ID NO: 894061 - RNA, 22 nt, Human
gugugucuuucauuucaugagg

SEQ ID NO: 894062 - RNA, 22 nt, Human
cugggcuggagugcaauggcgc

SEQ ID NO: 894063 - RNA, 22 nt, Human
uuccaggaggcauucuuaguuu

SEQ ID NO: 894064 - RNA, 22 nt, Human
uauauucuuaccaguguaugua

SEQ ID NO: 894065 - RNA, 22 nt, Human
gugacagaguuuuagaucucau

SEQ ID NO: 894066 - RNA, 22 nt, Human
ucugcacacaauuuaucuuucu

SEQ ID NO: 894067 - RNA, 22 nt, Human
acagauauaaacuauaguagug

SEQ ID NO: 894068 - RNA, 22 nt, Human
aauucuaaauguaauuuagaau

SEQ ID NO: 894069 - RNA, 22 nt, Human
aaaucagaucuuacacaauugu

SEQ ID NO: 894070 - RNA, 22 nt, Human
uuuuccuuagcuucucugcgag

SEQ ID NO: 894071 - RNA, 22 nt, Human
agguggggccaaaugcuacagu

SEQ ID NO: 894072 - RNA, 22 nt, Human
cagagagggcggcccuggcuuc

SEQ ID NO: 894073 - RNA, 22 nt, Human
uacuuacauuagcaaacaaggu

SEQ ID NO: 894074 - RNA, 22 nt, Human
uuucugaacaaagccauuauca

SEQ ID NO: 894075 - RNA, 22 nt, Human
cacaguacuuaauucucuaaau

SEQ ID NO: 894076 - RNA, 22 nt, Human
acuaaauauuugagagguguag

SEQ ID NO: 894077 - RNA, 22 nt, Human
uuuauauguuuguacaauuaag

SEQ ID NO: 894078 - RNA, 22 nt, Human
cuucaaaugugauuuuaauaac

SEQ ID NO: 894079 - RNA, 22 nt, Human
cugcagccuccugggguacaug

SEQ ID NO: 894080 - RNA, 22 nt, Human
ccucaggauacaggagccacag

SEQ ID NO: 894081 - RNA, 22 nt, Human
uuaucuuagaggugauuguauu

SEQ ID NO: 894082 - RNA, 22 nt, Human
caaauggauacaggcaaacauu

SEQ ID NO: 894083 - RNA, 22 nt, Human
cauuugaauggcauuucacuuu

SEQ ID NO: 894084 - RNA, 22 nt, Human
cccuggauuuacaucauucuga

SEQ ID NO: 894085 - RNA, 22 nt, Human
ugcaggcuccaugaggacaggc

SEQ ID NO: 894086 - RNA, 22 nt, Human
aucucagaaacauaucuaaucc

SEQ ID NO: 894087 - RNA, 22 nt, Human
gaugucaucaggcuaagacacu

SEQ ID NO: 894088 - RNA, 22 nt, Human
auguaucagauaaagcaugugg

SEQ ID NO: 894089 - RNA, 22 nt, Human
auguucauguggcugcuggcag

SEQ ID NO: 894090 - RNA, 22 nt, Human
ccuuggcauguggcauguggcu

SEQ ID NO: 894091 - RNA, 22 nt, Human
guaaguuacucuugggcuauuu

SEQ ID NO: 894092 - RNA, 22 nt, Human
uuguauauauucuuaaagaugu

SEQ ID NO: 894093 - RNA, 22 nt, Human
aagaaaccaacccugccagcac

SEQ ID NO: 894094 - RNA, 22 nt, Human
gaguaacaaauacuucaguagu

SEQ ID NO: 894095 - RNA, 22 nt, Human
acaauuucugaucagugaauuu

SEQ ID NO: 894096 - RNA, 22 nt, Human
aguucucaucaugaagcauaag

SEQ ID NO: 894097 - RNA, 22 nt, Human
cacagaauuuucucuuuacaau

SEQ ID NO: 894098 - RNA, 22 nt, Human
uuuaaauuuagaagaaacacug

SEQ ID NO: 894099 - RNA, 22 nt, Human
ugaguccagaugggccagcagg

SEQ ID NO: 894100 - RNA, 22 nt, Human
uuguagaaaauuagaugcaugg

SEQ ID NO: 894101 - RNA, 22 nt, Human
gaaauguuggacacuugaaauu

SEQ ID NO: 894102 - RNA, 22 nt, Human
gggcggugccugucuccgaagc

SEQ ID NO: 894103 - RNA, 22 nt, Human
cagcagcucacucagguggcuc

SEQ ID NO: 894104 - RNA, 22 nt, Human
agagacccuggaguucuucacu

SEQ ID NO: 894105 - RNA, 22 nt, Human
acuucagaaaauguugaauguu

SEQ ID NO: 894106 - RNA, 19 nt, Human
ggucagcaguuuagggucu

SEQ ID NO: 894107 - RNA, 22 nt, Human
auucagaagcaaucacagugag

SEQ ID NO: 894108 - RNA, 22 nt, Human
gggcccugugauuucuugagga

SEQ ID NO: 894109 - RNA, 22 nt, Human
ggcagcucugaugaugcucugg

SEQ ID NO: 894110 - RNA, 22 nt, Human
cugggaaggggaagguccucuc

SEQ ID NO: 894111 - RNA, 22 nt, Human
uaguuuacucaucuauaaaaug

SEQ ID NO: 894112 - RNA, 22 nt, Human
cugagaaaggaccucaaacagg

SEQ ID NO: 894113 - RNA, 22 nt, Human
accaggagacaugaccaaugag

SEQ ID NO: 894114 - RNA, 22 nt, Human
agacaaggcaaggcggccagau

SEQ ID NO: 894115 - RNA, 22 nt, Human
ccuccugggacucauuagcacc

SEQ ID NO: 894116 - RNA, 22 nt, Human
acagggccacauguaaacagau

SEQ ID NO: 894117 - RNA, 22 nt, Human
aaagcugucaaggcaggaggcu

SEQ ID NO: 894118 - RNA, 22 nt, Human
caaauuuagguaacagucugua

SEQ ID NO: 894119 - RNA, 22 nt, Human
cccaggagguuggggcuacagu

SEQ ID NO: 894120 - RNA, 19 nt, Human
uguucagauaugucagcuu

SEQ ID NO: 894121 - RNA, 22 nt, Human
caaacauuugacuucucucagg

SEQ ID NO: 894122 - RNA, 22 nt, Human
aauguaacagcaacaacaaugg

SEQ ID NO: 894123 - RNA, 20 nt, Human
aaaugcuuuugacacauauu

SEQ ID NO: 894124 - RNA, 21 nt, Human
ugggaccuagcuuugcacagg

SEQ ID NO: 894125 - RNA, 22 nt, Human
guuuccagcuugggcccgggga

SEQ ID NO: 894126 - RNA, 22 nt, Human
gugagcagccucaccugagggu

SEQ ID NO: 894127 - RNA, 22 nt, Human
ucauacauguuguguucaaaug

SEQ ID NO: 894128 - RNA, 22 nt, Human
caguuacagagccaguuagaga

SEQ ID NO: 894129 - RNA, 22 nt, Human
acuuucuuggucccauguuuga

SEQ ID NO: 894130 - RNA, 22 nt, Human
gaaauguaggcauaauuauuuu

SEQ ID NO: 894131 - RNA, 22 nt, Human
uuucauaaucugucaagugggg

SEQ ID NO: 894132 - RNA, 21 nt, Human
uagagaugacgagcucuagca

SEQ ID NO: 894133 - RNA, 22 nt, Human
guaaacauuuucaucugugccc

SEQ ID NO: 894134 - RNA, 22 nt, Human
agggagaguagauaucaggugu

SEQ ID NO: 894135 - RNA, 22 nt, Human
cugucagaggcucucuguugcc

SEQ ID NO: 894136 - RNA, 22 nt, Human
cauaugaaauaugaguugaaca

SEQ ID NO: 894137 - RNA, 22 nt, Human
agggcugaugcaccauguagcc

SEQ ID NO: 894138 - RNA, 22 nt, Human
auguuuaaaggagucagagacu

SEQ ID NO: 894139 - RNA, 22 nt, Human
agaaaguuguuggaggaaauga

SEQ ID NO: 894140 - RNA, 22 nt, Human
aagguauuuagugugaaagcua

SEQ ID NO: 894141 - RNA, 22 nt, Human
gcagcugcagacccucagugcu

SEQ ID NO: 894142 - RNA, 22 nt, Human
uccugaauuguugagaagcagc

SEQ ID NO: 894143 - RNA, 19 nt, Human
accaggaguaucagagcug

SEQ ID NO: 894144 - RNA, 22 nt, Human
aggucagaugggagaugggaug

SEQ ID NO: 894145 - RNA, 22 nt, Human
gagcagcuguucugacuugucu

SEQ ID NO: 894146 - RNA, 22 nt, Human
augacagauagucuucauuugc

SEQ ID NO: 894147 - RNA, 22 nt, Human
ccucugggggcuuccuuacccu

SEQ ID NO: 894148 - RNA, 22 nt, Human
ucacaguguuggaaucagagcu

SEQ ID NO: 894149 - RNA, 22 nt, Human
cugagcagcaacccagagccuc

SEQ ID NO: 894150 - RNA, 22 nt, Human
caggagugagaugcgaucacuu

SEQ ID NO: 894151 - RNA, 22 nt, Human
caaauagauuguucaauccuga

SEQ ID NO: 894152 - RNA, 22 nt, Human
acccaggcuagaagugaauuau

SEQ ID NO: 894153 - RNA, 22 nt, Human
ucccucuguguugggcaugccu

SEQ ID NO: 894154 - RNA, 22 nt, Human
accuccuggcugcucauggaac

SEQ ID NO: 894155 - RNA, 22 nt, Human
ugugaucacaucugggcugaag

SEQ ID NO: 894156 - RNA, 22 nt, Human
cugucuguuucaaaagugguua

SEQ ID NO: 894157 - RNA, 22 nt, Human
aagucucuggcaaaugaucuug

SEQ ID NO: 894158 - RNA, 22 nt, Human
ugaaugcaagaaggaacaugaa

SEQ ID NO: 894159 - RNA, 22 nt, Human
ccugccuguacuagagacccag

SEQ ID NO: 894160 - RNA, 22 nt, Human
aaaaauaggucaaccguguaug

SEQ ID NO: 894161 - RNA, 22 nt, Human
aggcuccagcagccagaggaag

SEQ ID NO: 894162 - RNA, 22 nt, Human
cucccagggccaucgagucacu

SEQ ID NO: 894163 - RNA, 22 nt, Human
cagcucccuauggugaggcgac

SEQ ID NO: 894164 - RNA, 22 nt, Human
ccucugugacaaacaguccugg

SEQ ID NO: 894165 - RNA, 18 nt, Human
cugaggcccagagagggc

SEQ ID NO: 894166 - RNA, 21 nt, Human
ugacagcacaugcaaucggag

SEQ ID NO: 894167 - RNA, 22 nt, Human
uuuccuuugcccaauacauguc

SEQ ID NO: 894168 - RNA, 22 nt, Human
uagcaggcaucucagagauaau

SEQ ID NO: 894169 - RNA, 22 nt, Human
guuuuuaucuaauagcaguuau

SEQ ID NO: 894170 - RNA, 22 nt, Human
uccaggcuggacaugaggcggg

SEQ ID NO: 894171 - RNA, 22 nt, Human
acacaauuucauaaacaccaug

SEQ ID NO: 894172 - RNA, 20 nt, Human
aaccaguacccaaguaggaa

SEQ ID NO: 894173 - RNA, 22 nt, Human
caagguuuuggaagauuuucgu

SEQ ID NO: 894174 - RNA, 22 nt, Human
guucaguggggccuugggggac

SEQ ID NO: 894175 - RNA, 22 nt, Human
gccuggcaaggcccuguugacu

SEQ ID NO: 894176 - RNA, 22 nt, Human
gcccugagggguggugucugua

SEQ ID NO: 894177 - RNA, 22 nt, Human
auucaguguaguuauuaucuuu

SEQ ID NO: 894178 - RNA, 22 nt, Human
gcugaagguguguggagagagg

SEQ ID NO: 894179 - RNA, 22 nt, Human
ucucucuucaacccuuaacuag

SEQ ID NO: 894180 - RNA, 22 nt, Human
ggccuggccuccagaugugggc

SEQ ID NO: 894181 - RNA, 22 nt, Human
aaggccuugccgaaggaugcca

SEQ ID NO: 894182 - RNA, 22 nt, Human
gaucuuuagccaagacacacca

SEQ ID NO: 894183 - RNA, 19 nt, Human
gcaggguguugacuguccc

SEQ ID NO: 894184 - RNA, 22 nt, Human
ggcccugugguuuugcaaaguc

SEQ ID NO: 894185 - RNA, 22 nt, Human
uccauguuagguaaaggcacug

SEQ ID NO: 894186 - RNA, 22 nt, Human
guuauguacuuuuuaaaucuug

SEQ ID NO: 894187 - RNA, 22 nt, Human
uuuauacuucauaaugucuauu

SEQ ID NO: 894188 - RNA, 22 nt, Human
agggcccauagaucgucagcuu

SEQ ID NO: 894189 - RNA, 22 nt, Human
aaugcuuuaauugcauguagug

SEQ ID NO: 894190 - RNA, 22 nt, Human
cguaucaaagcaaaacauauuu

SEQ ID NO: 894191 - RNA, 21 nt, Human
agcagacagaugcacgcacac

SEQ ID NO: 894192 - RNA, 22 nt, Human
uagaaaauggccaagcaggacu

SEQ ID NO: 894193 - RNA, 23 nt, Human
acuugauuauuguugauagauuc

SEQ ID NO: 894194 - RNA, 22 nt, Human
accaguggaauuauucuguggu

SEQ ID NO: 894195 - RNA, 22 nt, Human
uguccuuuuggcugucuauggu

SEQ ID NO: 894196 - RNA, 22 nt, Human
auaaacaguagagaaagguggu

SEQ ID NO: 894197 - RNA, 22 nt, Human
cuccacagccccuccaguggca

SEQ ID NO: 894198 - RNA, 22 nt, Human
gcuuuccuggcccugucccugc

SEQ ID NO: 894199 - RNA, 22 nt, Human
ccuugcagacaucaguaguggc

SEQ ID NO: 894200 - RNA, 22 nt, Human
ggccauggaccccgagcugacc

SEQ ID NO: 894201 - RNA, 22 nt, Human
cccugagagcagggucuuucuc

SEQ ID NO: 894202 - RNA, 22 nt, Human
uuucuuuccaugagccuaugua

SEQ ID NO: 894203 - RNA, 22 nt, Human
cucauauauuucugcauucaau

SEQ ID NO: 894204 - RNA, 22 nt, Human
ucagagguuccggccauaacca

SEQ ID NO: 894205 - RNA, 22 nt, Human
ugagcugaguuuaaaagcugcu

SEQ ID NO: 894206 - RNA, 18 nt, Human
aacaguuuccagauucuc

SEQ ID NO: 894207 - RNA, 23 nt, Human
acagcuuccuacuuugcugcugc

SEQ ID NO: 894208 - RNA, 22 nt, Human
ugaacaguguaucuagaucaug

SEQ ID NO: 894209 - RNA, 22 nt, Human
acauucaaaaagcaucugucac

SEQ ID NO: 894210 - RNA, 22 nt, Human
uucuaguuaaaguauguauuag

SEQ ID NO: 894211 - RNA, 22 nt, Human
cuccaggauguuagacguccag

SEQ ID NO: 894212 - RNA, 22 nt, Human
gugcacuugaucuagacagauu

SEQ ID NO: 894213 - RNA, 22 nt, Human
aucagaaaaaugagaagagcug

SEQ ID NO: 894214 - RNA, 22 nt, Human
caaauccuggagccaugguaac

SEQ ID NO: 894215 - RNA, 22 nt, Human
acccucaggcagaauguauucu

SEQ ID NO: 894216 - RNA, 22 nt, Human
guacaggaccgcggcccccugg

SEQ ID NO: 894217 - RNA, 23 nt, Human
ucaucuguaaguaucuguggagu

SEQ ID NO: 894218 - RNA, 22 nt, Human
uauugcuuugugucauaagcaa

SEQ ID NO: 894219 - RNA, 22 nt, Human
auuggaaauacaguagaaaaau

SEQ ID NO: 894220 - RNA, 22 nt, Human
uagcuacacaucuaaacagcaa

SEQ ID NO: 894221 - RNA, 22 nt, Human
ccuugaaauguucucacugggg

SEQ ID NO: 894222 - RNA, 17 nt, Human
aguguggcccugguuaa

SEQ ID NO: 894223 - RNA, 22 nt, Human
agcaggcaggaggcuacuaagg

SEQ ID NO: 894224 - RNA, 22 nt, Human
agccagagggaaucuuugggga

SEQ ID NO: 894225 - RNA, 23 nt, Human
gucucuagaguguggagcaaaga

SEQ ID NO: 894226 - RNA, 22 nt, Human
guuaugaagucauucacaaaua

SEQ ID NO: 894227 - RNA, 22 nt, Human
gaaguucuagaacugugcccuu

SEQ ID NO: 894228 - RNA, 22 nt, Human
auccagagacuggggcugggau

SEQ ID NO: 894229 - RNA, 22 nt, Human
uucuaaaaccaauucugcuucu

SEQ ID NO: 894230 - RNA, 22 nt, Human
cccuugaaggcagggaguccug

SEQ ID NO: 894231 - RNA, 22 nt, Human
accaggaguagaauaucuguga

SEQ ID NO: 894232 - RNA, 23 nt, Human
uaggggcuggcguggagccugcg

SEQ ID NO: 894233 - RNA, 22 nt, Human
caaacuauuguucacaagacaa

SEQ ID NO: 894234 - RNA, 22 nt, Human
agcagcuuccugcucuucgccu

SEQ ID NO: 894235 - RNA, 22 nt, Human
cuaaagaagcuagcaaucuaua

SEQ ID NO: 894236 - RNA, 22 nt, Human
gaauaauauugacuuugcaggc

SEQ ID NO: 894237 - RNA, 22 nt, Human
ugagcugacacccaaucauacu

SEQ ID NO: 894238 - RNA, 22 nt, Human
aguuagaauagucagauuguag

SEQ ID NO: 894239 - RNA, 22 nt, Human
auacacauuugcuagagauggg

SEQ ID NO: 894240 - RNA, 22 nt, Human
uaacagaauccuguuauugcca

SEQ ID NO: 894241 - RNA, 22 nt, Human
ggccagcugugggauuuucugc

SEQ ID NO: 894242 - RNA, 22 nt, Human
gguggcacucauuaucaggugc

SEQ ID NO: 894243 - RNA, 22 nt, Human
gaggcugcggggaggagccugc

SEQ ID NO: 894244 - RNA, 22 nt, Human
cccaggaggcagagcuugcagu

SEQ ID NO: 894245 - RNA, 22 nt, Human
auugagaauugugaguuuggag

SEQ ID NO: 894246 - RNA, 22 nt, Human
aauaaaauggucaguuuucuca

SEQ ID NO: 894247 - RNA, 22 nt, Human
uggcccugccgcacuauccuca

SEQ ID NO: 894248 - RNA, 22 nt, Human
augugcaaggaguggcuguugu

SEQ ID NO: 894249 - RNA, 22 nt, Human
uguucccauggauaucugcaua

SEQ ID NO: 894250 - RNA, 22 nt, Human
aaagguucucuuguucauuauu

SEQ ID NO: 894251 - RNA, 22 nt, Human
gaacuguguuuguuucuagguc

SEQ ID NO: 894252 - RNA, 22 nt, Human
ugccacauggugcauuuccuag

SEQ ID NO: 894253 - RNA, 22 nt, Human
cccugagucaucauugcggaag

SEQ ID NO: 894254 - RNA, 22 nt, Human
auuugacagugaguuguggaug

SEQ ID NO: 894255 - RNA, 17 nt, Human
ugagagcagggcugggc

SEQ ID NO: 894256 - RNA, 22 nt, Human
gcagaggugaguuucucagcug

SEQ ID NO: 894257 - RNA, 22 nt, Human
cauucacagcaggucagcugaa

SEQ ID NO: 894258 - RNA, 22 nt, Human
cuugaugguggcagaagaguga

SEQ ID NO: 894259 - RNA, 22 nt, Human
cagaacaggucaugcuugcugu

SEQ ID NO: 894260 - RNA, 22 nt, Human
ggacagggcucuuggcacuccu

SEQ ID NO: 894261 - RNA, 22 nt, Human
aggucucccaagggccagggag

SEQ ID NO: 894262 - RNA, 22 nt, Human
cugcuguucagaggaccucacu

SEQ ID NO: 894263 - RNA, 22 nt, Human
auuccaaagcacaucagaacua

SEQ ID NO: 894264 - RNA, 22 nt, Human
uagaagcucaggaauaggcaua

SEQ ID NO: 894265 - RNA, 22 nt, Human
gggcugagaauucagcuuuccu

SEQ ID NO: 894266 - RNA, 20 nt, Human
gcuucaaagccauccuuuua

SEQ ID NO: 894267 - RNA, 22 nt, Human
gcugcagggaauguauggauuu

SEQ ID NO: 894268 - RNA, 22 nt, Human
gcagauggauguggacggcgcc

SEQ ID NO: 894269 - RNA, 22 nt, Human
uuacaaagugcugcaccauuuu

SEQ ID NO: 894270 - RNA, 22 nt, Human
uccaggcucccucaggaugcac

SEQ ID NO: 894271 - RNA, 22 nt, Human
aucaucuuaucugacucauuuu

SEQ ID NO: 894272 - RNA, 22 nt, Human
ggcuccuuaucucuccuaugcc

SEQ ID NO: 894273 - RNA, 22 nt, Human
auaaagcauuuccccugugugg

SEQ ID NO: 894274 - RNA, 22 nt, Human
ugaaccuuguuccugcccuccu

SEQ ID NO: 894275 - RNA, 22 nt, Human
augaaaugauugaaaucuuuac

SEQ ID NO: 894276 - RNA, 22 nt, Human
aaaggaggccacauggcuagga

SEQ ID NO: 894277 - RNA, 22 nt, Human
cugcccuggccacugugcccag

SEQ ID NO: 894278 - RNA, 22 nt, Human
agaggcggagcuugcagugagc

SEQ ID NO: 894279 - RNA, 22 nt, Human
ccugaaaugacuccagcugagu

SEQ ID NO: 894280 - RNA, 22 nt, Human
guggcccacacagacagcaucu

SEQ ID NO: 894281 - RNA, 18 nt, Human
acaguaaagaaaggaauu

SEQ ID NO: 894282 - RNA, 22 nt, Human
cugucugcuaugcuuguuguca

SEQ ID NO: 894283 - RNA, 22 nt, Human
aggcuaauauggcacaugaaca

SEQ ID NO: 894284 - RNA, 22 nt, Human
gccugccucaaaaucccaguuc

SEQ ID NO: 894285 - RNA, 22 nt, Human
cucugcugcuugccagucauug

SEQ ID NO: 894286 - RNA, 22 nt, Human
agcaagcuaccuagauagucua

SEQ ID NO: 894287 - RNA, 20 nt, Human
gggguugacccucuuggacu

SEQ ID NO: 894288 - RNA, 22 nt, Human
agaaucuucgguaacuggaaga

SEQ ID NO: 894289 - RNA, 22 nt, Human
uuucauugagacuauagacauc

SEQ ID NO: 894290 - RNA, 22 nt, Human
agugauuuggcggcagaguuag

SEQ ID NO: 894291 - RNA, 22 nt, Human
ggugugugguccucucacuuag

SEQ ID NO: 894292 - RNA, 19 nt, Human
cagggauggguagggacuc

SEQ ID NO: 894293 - RNA, 22 nt, Human
aaauuauucaaaaagcuguguu

SEQ ID NO: 894294 - RNA, 22 nt, Human
ucugacuuggcgcucuugucuu

SEQ ID NO: 894295 - RNA, 22 nt, Human
aucauucaaaugauuuggaggu

SEQ ID NO: 894296 - RNA, 22 nt, Human
acaugcauauacuuaaauaugu

SEQ ID NO: 894297 - RNA, 22 nt, Human
ucuuuccuagaggcugaugagu

SEQ ID NO: 894298 - RNA, 22 nt, Human
acauacauauguuuaaaugcau

SEQ ID NO: 894299 - RNA, 22 nt, Human
ggcagcaucacuugucuccagc

SEQ ID NO: 894300 - RNA, 22 nt, Human
aagcugcaaggaagugugccag

SEQ ID NO: 894301 - RNA, 20 nt, Human
aggccaggaaauguaguucu

SEQ ID NO: 894302 - RNA, 19 nt, Human
cuggccuguguccugugcu

SEQ ID NO: 894303 - RNA, 22 nt, Human
uaaucuguaauuuuugcaauag

SEQ ID NO: 894304 - RNA, 22 nt, Human
acaggcagugggccagauuugu

SEQ ID NO: 894305 - RNA, 22 nt, Human
gcucccaggcauggagguaauu

SEQ ID NO: 894306 - RNA, 22 nt, Human
gagcaagaguguuggacuuuga

SEQ ID NO: 894307 - RNA, 22 nt, Human
accagagggcaaaccccagugu

SEQ ID NO: 894308 - RNA, 22 nt, Human
gcugcagcagaaguucucagag

SEQ ID NO: 894309 - RNA, 22 nt, Human
cugagaaggaagccuccacucu

SEQ ID NO: 894310 - RNA, 22 nt, Human
agcaacaggaccauggagccca

SEQ ID NO: 894311 - RNA, 22 nt, Human
aggaagaggguggcagauaauc

SEQ ID NO: 894312 - RNA, 19 nt, Human
ucucuacacuacauuucua

SEQ ID NO: 894313 - RNA, 22 nt, Human
uccauuuuucaugacuccucaa

SEQ ID NO: 894314 - RNA, 22 nt, Human
agcacagagguggaaguguaua

SEQ ID NO: 894315 - RNA, 22 nt, Human
augauacauugcaaaauuuuaa

SEQ ID NO: 894316 - RNA, 22 nt, Human
acacaagggccuauaguguauu

SEQ ID NO: 894317 - RNA, 22 nt, Human
cugucugucccgucaccgcccc

SEQ ID NO: 894318 - RNA, 23 nt, Human
agcagucagggugguaagccauc

SEQ ID NO: 894319 - RNA, 19 nt, Human
cccagccaggucuugcauc

SEQ ID NO: 894320 - RNA, 22 nt, Human
uacacugagcaggaagaagugg

SEQ ID NO: 894321 - RNA, 18 nt, Human
agaacacuugguuagauc

SEQ ID NO: 894322 - RNA, 20 nt, Human
uaauuugauaucuauaaguu

SEQ ID NO: 894323 - RNA, 20 nt, Human
uucuaagguuuuggugcaca

SEQ ID NO: 894324 - RNA, 22 nt, Human
ucugugccuuuaagaagcucau

SEQ ID NO: 894325 - RNA, 22 nt, Human
ucccagccacagguguagcccu

SEQ ID NO: 894326 - RNA, 22 nt, Human
aaacugucauuggaugcauuug

SEQ ID NO: 894327 - RNA, 22 nt, Human
guacacaaauaauaaaguuaca

SEQ ID NO: 894328 - RNA, 22 nt, Human
ucauuucuaucuaugcagcuuc

SEQ ID NO: 894329 - RNA, 22 nt, Human
ucugccugcgcucacggggccg

SEQ ID NO: 894330 - RNA, 22 nt, Human
uuuuucaucugauugauaacuc

SEQ ID NO: 894331 - RNA, 22 nt, Human
auugagaaugaagggacauuuu

SEQ ID NO: 894332 - RNA, 22 nt, Human
acaaauuucauaggcaaauuuu

SEQ ID NO: 894333 - RNA, 22 nt, Human
gccagauuuacagauuugcccu

SEQ ID NO: 894334 - RNA, 19 nt, Human
uucagacagacuagguaua

SEQ ID NO: 894335 - RNA, 22 nt, Human
aagcagcauucagugaaaugug

SEQ ID NO: 894336 - RNA, 22 nt, Human
gauguucuagaagugugguguu

SEQ ID NO: 894337 - RNA, 21 nt, Human
agcaagaaucaggaaggcucu

SEQ ID NO: 894338 - RNA, 22 nt, Human
ccagaucacucaaccagagcuc

SEQ ID NO: 894339 - RNA, 22 nt, Human
ucucuuauuuugccuuugacaa

SEQ ID NO: 894340 - RNA, 22 nt, Human
uuggcucaugcuguuuugugca

SEQ ID NO: 894341 - RNA, 22 nt, Human
ccugccaggcuuugggcuucug

SEQ ID NO: 894342 - RNA, 22 nt, Human
agaaucuucagucuaauuccua

SEQ ID NO: 894343 - RNA, 22 nt, Human
aaugucaacacuugguauguca

SEQ ID NO: 894344 - RNA, 22 nt, Human
uuucucaaauugcaugaguagc

SEQ ID NO: 894345 - RNA, 22 nt, Human
ucucagaaaaacuuugagggua

SEQ ID NO: 894346 - RNA, 22 nt, Human
aauagaauuuguacuguguuuu

SEQ ID NO: 894347 - RNA, 22 nt, Human
acagaauuaaugaaaauuacaa

SEQ ID NO: 894348 - RNA, 15 nt, Human
agacagacaguggga

SEQ ID NO: 894349 - RNA, 22 nt, Human
uccuuggcucuuugauaaauac

SEQ ID NO: 894350 - RNA, 22 nt, Human
uaagacaauucuucagucacaa

SEQ ID NO: 894351 - RNA, 22 nt, Human
uaaugcaauuuagcaaaguuuu

SEQ ID NO: 894352 - RNA, 23 nt, Human
gaagccacacaaaggucgccaag

SEQ ID NO: 894353 - RNA, 22 nt, Human
ucagcuccucagagccucaguu

SEQ ID NO: 894354 - RNA, 22 nt, Human
gccacaggcuuaggagggaggu

SEQ ID NO: 894355 - RNA, 22 nt, Human
agagccagagaccuggguucac

SEQ ID NO: 894356 - RNA, 22 nt, Human
agugucaaugccaacaguauau

SEQ ID NO: 894357 - RNA, 22 nt, Human
gacaguacagguagaagucacu

SEQ ID NO: 894358 - RNA, 22 nt, Human
ugaggccagugacauauauuaa

SEQ ID NO: 894359 - RNA, 22 nt, Human
gaauauauuauucagcuuuuca

SEQ ID NO: 894360 - RNA, 22 nt, Human
ucccaauuaacagguaucaggc

SEQ ID NO: 894361 - RNA, 22 nt, Human
gcagcaugagcuauacaaagua

SEQ ID NO: 894362 - RNA, 22 nt, Human
gcaaacauguugugagauacca

SEQ ID NO: 894363 - RNA, 22 nt, Human
ucuguaggacagagaaaugggg

SEQ ID NO: 894364 - RNA, 22 nt, Human
ggcagcccuuucuggccagcuc

SEQ ID NO: 894365 - RNA, 22 nt, Human
caggaaaugaaagcuagcuaau

SEQ ID NO: 894366 - RNA, 22 nt, Human
uuaacauacaucaugaacaaug

SEQ ID NO: 894367 - RNA, 22 nt, Human
uguuggaugaccuuguaauuau

SEQ ID NO: 894368 - RNA, 22 nt, Human
cagagugaaaacugagcucaaa

SEQ ID NO: 894369 - RNA, 22 nt, Human
ucccaggcuggggccaggugac

SEQ ID NO: 894370 - RNA, 22 nt, Human
ugaggcccagccgcccugagag

SEQ ID NO: 894371 - RNA, 20 nt, Human
ggugcgaggccagagcagac

SEQ ID NO: 894372 - RNA, 21 nt, Human
gccugcaguuuugaagcccuu

SEQ ID NO: 894373 - RNA, 22 nt, Human
acuuuggggaacuuuucuccuc

SEQ ID NO: 894374 - RNA, 22 nt, Human
ccuuagaagaaaguuacuuuuu

SEQ ID NO: 894375 - RNA, 22 nt, Human
uuuguaaggcuaaauaauauuc

SEQ ID NO: 894376 - RNA, 22 nt, Human
gagguugggaugagggauacag

SEQ ID NO: 894377 - RNA, 22 nt, Human
gcugaaaugggcacugaaggcc

SEQ ID NO: 894378 - RNA, 22 nt, Human
ucacaugcuacugagccagacc

SEQ ID NO: 894379 - RNA, 22 nt, Human
gcugucuucacuuccugguuuc

SEQ ID NO: 894380 - RNA, 22 nt, Human
acugccuugaaagauuguugag

SEQ ID NO: 894381 - RNA, 22 nt, Human
cuggcucccgaagcccucagug

SEQ ID NO: 894382 - RNA, 22 nt, Human
ccuggccaguuuccaggcccug

SEQ ID NO: 894383 - RNA, 22 nt, Human
cagauggaacacagaaaggaga

SEQ ID NO: 894384 - RNA, 22 nt, Human
uuagagccccagaaaacagugg

SEQ ID NO: 894385 - RNA, 22 nt, Human
aaggggaguuagugauaaaacc

SEQ ID NO: 894386 - RNA, 22 nt, Human
ccagguggaaggucugugcucu

SEQ ID NO: 894387 - RNA, 22 nt, Human
gagacaggccaggugguacuua

SEQ ID NO: 894388 - RNA, 22 nt, Human
agcugcaauuaaagacugugaa

SEQ ID NO: 894389 - RNA, 22 nt, Human
gcccugcucauuucacguguuu

SEQ ID NO: 894390 - RNA, 21 nt, Human
cagcugcguguccucccaccc

SEQ ID NO: 894391 - RNA, 23 nt, Human
caauuucauaugauucuaccuaa

SEQ ID NO: 894392 - RNA, 22 nt, Human
agcagaugaaucccagauaaag

SEQ ID NO: 894393 - RNA, 22 nt, Human
ucagaggcaucauucauaguua

SEQ ID NO: 894394 - RNA, 22 nt, Human
ugcauaaagugccauaguauua

SEQ ID NO: 894395 - RNA, 22 nt, Human
gcaguccuggaggaagguguga

SEQ ID NO: 894396 - RNA, 19 nt, Human
cccaggggacccagcccua

SEQ ID NO: 894397 - RNA, 18 nt, Human
augucacagagggcugaa

SEQ ID NO: 894398 - RNA, 18 nt, Human
aggcuucuuggcucaguc

SEQ ID NO: 894399 - RNA, 22 nt, Human
uaguggagaggauguggagaaa

SEQ ID NO: 894400 - RNA, 22 nt, Human
gagggcugauguugccaccuca

SEQ ID NO: 894401 - RNA, 22 nt, Human
ucucucagaaagcccaugucug

SEQ ID NO: 894402 - RNA, 20 nt, Human
ggccagcugaugcacgaugc

SEQ ID NO: 894403 - RNA, 21 nt, Human
gcugucuccuccuugcaccag

SEQ ID NO: 894404 - RNA, 23 nt, Human
ccuggcugaccugaagguguagu

SEQ ID NO: 894405 - RNA, 22 nt, Human
gacuuuggcuuuuauucuaggu

SEQ ID NO: 894406 - RNA, 22 nt, Human
auggcccugaccuugaugaccu

SEQ ID NO: 894407 - RNA, 22 nt, Human
gcuggcagugugaaugacaagc

SEQ ID NO: 894408 - RNA, 22 nt, Human
gucuguaucagaggagugaaug

SEQ ID NO: 894409 - RNA, 22 nt, Human
ucuuaacuaucauuugaacacc

SEQ ID NO: 894410 - RNA, 22 nt, Human
uauuucucuucaaaauugaugu

SEQ ID NO: 894411 - RNA, 22 nt, Human
cagggccacugcaugagguuca

SEQ ID NO: 894412 - RNA, 23 nt, Human
cccuguagcccaggacaggcuuu

SEQ ID NO: 894413 - RNA, 22 nt, Human
uucuuagaagaaacaucuaaaa

SEQ ID NO: 894414 - RNA, 22 nt, Human
accaaaggcagagcugaacacu

SEQ ID NO: 894415 - RNA, 22 nt, Human
aaauaugagggugaugcccaga

SEQ ID NO: 894416 - RNA, 22 nt, Human
ccacaugguccucauuuacucu

SEQ ID NO: 894417 - RNA, 22 nt, Human
uuacaaaguuuaagguggcacu

SEQ ID NO: 894418 - RNA, 22 nt, Human
aagaaugugcuaaugaaaacuu

SEQ ID NO: 894419 - RNA, 22 nt, Human
uggagggauacaaagaugaaaa

SEQ ID NO: 894420 - RNA, 22 nt, Human
uccucaggcggugaggaggggc

SEQ ID NO: 894421 - RNA, 22 nt, Human
agagccuguacuuuucugugaa

SEQ ID NO: 894422 - RNA, 22 nt, Human
uggaauguaaaccucagguggg

SEQ ID NO: 894423 - RNA, 19 nt, Human
ugcuucagaaauagaaagc

SEQ ID NO: 894424 - RNA, 22 nt, Human
aggaggguuucaaugggaugag

SEQ ID NO: 894425 - RNA, 22 nt, Human
gucauagaggccuauauaauuu

SEQ ID NO: 894426 - RNA, 22 nt, Human
cacauugaacuugucugguggg

SEQ ID NO: 894427 - RNA, 22 nt, Human
ggcuacagcgggguggagacgg

SEQ ID NO: 894428 - RNA, 22 nt, Human
ucuuuggaugcguuacuuuuac

SEQ ID NO: 894429 - RNA, 20 nt, Human
ugucuucauuauggugcccu

SEQ ID NO: 894430 - RNA, 20 nt, Human
gcuugcuuugucugaugggc

SEQ ID NO: 894431 - RNA, 22 nt, Human
cccugcugaugccuugauuuug

SEQ ID NO: 894432 - RNA, 22 nt, Human
ccugaccagagugagggcuuag

SEQ ID NO: 894433 - RNA, 22 nt, Human
cgaaacaucuaugaucauuaau

SEQ ID NO: 894434 - RNA, 22 nt, Human
auucugagaaaugcauugucag

SEQ ID NO: 894435 - RNA, 22 nt, Human
cgcuggccauagccuccugugu

SEQ ID NO: 894436 - RNA, 22 nt, Human
acugucugcuggccccugguua

SEQ ID NO: 894437 - RNA, 22 nt, Human
gcagaugggagccccaggggag

SEQ ID NO: 894438 - RNA, 22 nt, Human
aaagcagggaugaggcuagagg

SEQ ID NO: 894439 - RNA, 22 nt, Human
gugcaggguccuaauuguuaag

SEQ ID NO: 894440 - RNA, 19 nt, Human
acagaaauguaagugagac

SEQ ID NO: 894441 - RNA, 20 nt, Human
ugccaggcugcacgccugcc

SEQ ID NO: 894442 - RNA, 21 nt, Human
cucuguguugaggguguugag

SEQ ID NO: 894443 - RNA, 22 nt, Human
cagguacacaggacaaaguacu

SEQ ID NO: 894444 - RNA, 22 nt, Human
ccagagguccccugccaggagg

SEQ ID NO: 894445 - RNA, 22 nt, Human
ccugaccauuugccacaugggu

SEQ ID NO: 894446 - RNA, 22 nt, Human
ggccugcuaaccugaaacggag

SEQ ID NO: 894447 - RNA, 22 nt, Human
ucaucaaagucaaagaaugacu

SEQ ID NO: 894448 - RNA, 22 nt, Human
cuugggcaggguauuguagaag

SEQ ID NO: 894449 - RNA, 22 nt, Human
aaagcaauggaugagaaucugu

SEQ ID NO: 894450 - RNA, 22 nt, Human
ucugaggcuucagacuguacug

SEQ ID NO: 894451 - RNA, 22 nt, Human
cuccagagguucucaucuggga

SEQ ID NO: 894452 - RNA, 22 nt, Human
aaguaaacagauaagaaaucug

SEQ ID NO: 894453 - RNA, 22 nt, Human
uccagaggcagcugcggucagg

SEQ ID NO: 894454 - RNA, 22 nt, Human
uccagaguacggaagagucauc

SEQ ID NO: 894455 - RNA, 22 nt, Human
ggcacagcgacuaccaucgaaa

SEQ ID NO: 894456 - RNA, 22 nt, Human
acccugauggccagauugugga

SEQ ID NO: 894457 - RNA, 22 nt, Human
uucaacauguucuacauaaggg

SEQ ID NO: 894458 - RNA, 22 nt, Human
cugcuggcaccgaugaaagaca

SEQ ID NO: 894459 - RNA, 18 nt, Human
uaucacugcugaacaaga

SEQ ID NO: 894460 - RNA, 22 nt, Human
ggaaggggagcuggaaagggua

SEQ ID NO: 894461 - RNA, 22 nt, Human
ugcuggcucaguuugcagacuc

SEQ ID NO: 894462 - RNA, 22 nt, Human
ggagagcugacaucaugauguu

SEQ ID NO: 894463 - RNA, 22 nt, Human
auuuuaauaagauccauuuggu

SEQ ID NO: 894464 - RNA, 22 nt, Human
gccacccugagcugggccaggg

SEQ ID NO: 894465 - RNA, 17 nt, Human
ggaagaaaaggaucauc

SEQ ID NO: 894466 - RNA, 22 nt, Human
ggcugccuccucgagacaggau

SEQ ID NO: 894467 - RNA, 22 nt, Human
aagcaacucccuccucauuuuu

SEQ ID NO: 894468 - RNA, 22 nt, Human
acagagccaaaaggacauagua

SEQ ID NO: 894469 - RNA, 22 nt, Human
guacaggccaccacugaauuuu

SEQ ID NO: 894470 - RNA, 22 nt, Human
cugggagcuuguuaggaaugca

SEQ ID NO: 894471 - RNA, 22 nt, Human
ucuguucuuaaagcauucuugc

SEQ ID NO: 894472 - RNA, 20 nt, Human
ugacaacaaaaugguaauuu

SEQ ID NO: 894473 - RNA, 22 nt, Human
uaaguucaaugaacucaguucu

SEQ ID NO: 894474 - RNA, 22 nt, Human
aagcugucaggagguuaccuuu

SEQ ID NO: 894475 - RNA, 22 nt, Human
ugcuucugcaggagcuccugau

SEQ ID NO: 894476 - RNA, 22 nt, Human
aauauccacuucaauacaggca

SEQ ID NO: 894477 - RNA, 22 nt, Human
ucuuugcagaacgaugaagaug

SEQ ID NO: 894478 - RNA, 14 nt, Human
gguuuccauuuuua

SEQ ID NO: 894479 - RNA, 23 nt, Human
aaugugcuguauucauuucugga

SEQ ID NO: 894480 - RNA, 23 nt, Human
ucccucaggccuuaucuccaucu

SEQ ID NO: 894481 - RNA, 22 nt, Human
aagugcaaaucuguggcugaaa

SEQ ID NO: 894482 - RNA, 22 nt, Human
ucuuuaaaguuggagcuugcaa

SEQ ID NO: 894483 - RNA, 22 nt, Human
guagggcucaguaaauacuuug

SEQ ID NO: 894484 - RNA, 22 nt, Human
gggaaccugccccaggccucug

SEQ ID NO: 894485 - RNA, 22 nt, Human
aagaggcagaaauaucgcugaa

SEQ ID NO: 894486 - RNA, 22 nt, Human
ucucccucuguaagaucagggg

SEQ ID NO: 894487 - RNA, 22 nt, Human
ccugcccuguguuuggggacua

SEQ ID NO: 894488 - RNA, 22 nt, Human
uuaguuaaaauucugcugacau

SEQ ID NO: 894489 - RNA, 22 nt, Human
uagcaagaugucacuccaaguu

SEQ ID NO: 894490 - RNA, 22 nt, Human
uggaauaaugaccacagaaaca

SEQ ID NO: 894491 - RNA, 22 nt, Human
uucacugcugggugauuggguu

SEQ ID NO: 894492 - RNA, 19 nt, Human
uucuccagccugaccugag

SEQ ID NO: 894493 - RNA, 22 nt, Human
ugugcaguuucuauguugucca

SEQ ID NO: 894494 - RNA, 22 nt, Human
uauuauaaaauuacuggcaggg

SEQ ID NO: 894495 - RNA, 22 nt, Human
gguggugggagagcuuucugga

SEQ ID NO: 894496 - RNA, 17 nt, Human
uggcaagaauggaaaug

SEQ ID NO: 894497 - RNA, 23 nt, Human
uccugaggguuucccagccuugg

SEQ ID NO: 894498 - RNA, 23 nt, Human
ucuauuacuuauuguacucugga

SEQ ID NO: 894499 - RNA, 22 nt, Human
gggaacuguguggugcucugau

SEQ ID NO: 894500 - RNA, 22 nt, Human
cccagcacuuugaauaugucac

SEQ ID NO: 894501 - RNA, 22 nt, Human
augcauaucuccuaucuccuca

SEQ ID NO: 894502 - RNA, 22 nt, Human
uccucugguuauacuugcaccc

SEQ ID NO: 894503 - RNA, 22 nt, Human
cugggacuuguagucucggcgc

SEQ ID NO: 894504 - RNA, 22 nt, Human
acuguccuggagcucacacucu

SEQ ID NO: 894505 - RNA, 22 nt, Human
gcuagggagacuugugucauca

SEQ ID NO: 894506 - RNA, 22 nt, Human
auguuggagucguaaggcaugg

SEQ ID NO: 894507 - RNA, 22 nt, Human
auaaaugugaaaugagcaguua

SEQ ID NO: 894508 - RNA, 21 nt, Human
agguggcugcauccucagaag

SEQ ID NO: 894509 - RNA, 22 nt, Human
gcauuuguacaaaaugcaguag

SEQ ID NO: 894510 - RNA, 22 nt, Human
agcagcaggugcuucuggaucu

SEQ ID NO: 894511 - RNA, 22 nt, Human
cuguggaaagagccuuuggagg

SEQ ID NO: 894512 - RNA, 22 nt, Human
acuccaggcaucugcuucugcu

SEQ ID NO: 894513 - RNA, 22 nt, Human
ucacucaguuuuuggccucugc

SEQ ID NO: 894514 - RNA, 22 nt, Human
aauucagauggaagauucuggc

SEQ ID NO: 894515 - RNA, 22 nt, Human
uuuucauuuuuguagaugcaag

SEQ ID NO: 894516 - RNA, 22 nt, Human
aggauuuguugaguuuuagugg

SEQ ID NO: 894517 - RNA, 20 nt, Human
ccagagcagccacugaaguu

SEQ ID NO: 894518 - RNA, 22 nt, Human
cagcauuuaaugcagugcuucc

SEQ ID NO: 894519 - RNA, 22 nt, Human
accugccuucucaaggacauga

SEQ ID NO: 894520 - RNA, 22 nt, Human
uacagcauugugucuucacuca

SEQ ID NO: 894521 - RNA, 22 nt, Human
cuagggcucgcaagggcuggag

SEQ ID NO: 894522 - RNA, 19 nt, Human
acagugcuucugagugagg

SEQ ID NO: 894523 - RNA, 22 nt, Human
guggccugucagaagccguggg

SEQ ID NO: 894524 - RNA, 18 nt, Human
agucauuuacuuuuguga

SEQ ID NO: 894525 - RNA, 22 nt, Human
uuuguucaccucaaggauggga

SEQ ID NO: 894526 - RNA, 22 nt, Human
gcagccagaagacucagaacaa

SEQ ID NO: 894527 - RNA, 20 nt, Human
gcucccugguagaaauguuu

SEQ ID NO: 894528 - RNA, 22 nt, Human
aaagucauccaaauuuuuaugu

SEQ ID NO: 894529 - RNA, 22 nt, Human
ggacagcauuccuaguuccaaa

SEQ ID NO: 894530 - RNA, 22 nt, Human
cccagaggguggagguugcagu

SEQ ID NO: 894531 - RNA, 22 nt, Human
cagagaaaaaauccugcucuca

SEQ ID NO: 894532 - RNA, 22 nt, Human
uguggcaguauaagagcuagaa

SEQ ID NO: 894533 - RNA, 19 nt, Human
agcuccuguucagcagcuc

SEQ ID NO: 894534 - RNA, 22 nt, Human
gagccugaugaaacaggcagac

SEQ ID NO: 894535 - RNA, 22 nt, Human
aggccagaacagcucugcacca

SEQ ID NO: 894536 - RNA, 22 nt, Human
uuuguacacaggucauucaggg

SEQ ID NO: 894537 - RNA, 22 nt, Human
uggcuuaucacauuguccaugg

SEQ ID NO: 894538 - RNA, 22 nt, Human
agggccuggaacuggagaccac

SEQ ID NO: 894539 - RNA, 19 nt, Human
uugaaagauuagcuuucua

SEQ ID NO: 894540 - RNA, 22 nt, Human
aaagccagguugugugcaggaa

SEQ ID NO: 894541 - RNA, 22 nt, Human
ggcucuccacuauggaugagaa

SEQ ID NO: 894542 - RNA, 22 nt, Human
ucacacagcuccuuuccuuagu

SEQ ID NO: 894543 - RNA, 22 nt, Human
cagagucaugggccgucaggca

SEQ ID NO: 894544 - RNA, 22 nt, Human
ugaauugcugccaucauauuuc

SEQ ID NO: 894545 - RNA, 22 nt, Human
cucugcugcccaggccugcuag

SEQ ID NO: 894546 - RNA, 22 nt, Human
aaagguuuauugauucugcucu

SEQ ID NO: 894547 - RNA, 18 nt, Human
ggacaggagacaugggug

SEQ ID NO: 894548 - RNA, 22 nt, Human
cagucacacaaguggacuuggg

SEQ ID NO: 894549 - RNA, 22 nt, Human
gucucuuuuauggugaguugau

SEQ ID NO: 894550 - RNA, 22 nt, Human
uccuuggaacauugauccaaac

SEQ ID NO: 894551 - RNA, 22 nt, Human
cagcucuacugggcaccauucg

SEQ ID NO: 894552 - RNA, 22 nt, Human
aagggaaauggccaggcagaga

SEQ ID NO: 894553 - RNA, 22 nt, Human
aaugcaaauguaagggugggau

SEQ ID NO: 894554 - RNA, 22 nt, Human
ucagcuucagaucagcuagaga

SEQ ID NO: 894555 - RNA, 22 nt, Human
aguuuucacacucaccaaaagg

SEQ ID NO: 894556 - RNA, 22 nt, Human
ugggacugagaauaugaugggg

SEQ ID NO: 894557 - RNA, 22 nt, Human
ucucuucuauuugagacuauuu

SEQ ID NO: 894558 - RNA, 22 nt, Human
ggagcugggguuggcaucuucc

SEQ ID NO: 894559 - RNA, 22 nt, Human
ugggccagaggcauggagcuau

SEQ ID NO: 894560 - RNA, 22 nt, Human
uauagcacacaguuuauaaaag

SEQ ID NO: 894561 - RNA, 22 nt, Human
uggcauggguggagagagcaca

SEQ ID NO: 894562 - RNA, 22 nt, Human
ccuucacacuuucacuuggaua

SEQ ID NO: 894563 - RNA, 22 nt, Human
aaagaacucagagaggauuuua

SEQ ID NO: 894564 - RNA, 22 nt, Human
aucuaaacccuacuuucuuucu

SEQ ID NO: 894565 - RNA, 22 nt, Human
guuauguaucuugauugggugg

SEQ ID NO: 894566 - RNA, 22 nt, Human
uacugaauuguaagaugaugcc

SEQ ID NO: 894567 - RNA, 22 nt, Human
aagcacauuuggaaaacaugga

SEQ ID NO: 894568 - RNA, 22 nt, Human
gugaaggccaguaggguccugg

SEQ ID NO: 894569 - RNA, 22 nt, Human
cccaggagaccugugaaaggac

SEQ ID NO: 894570 - RNA, 22 nt, Human
uuacagaaucuacucgugguga

SEQ ID NO: 894571 - RNA, 22 nt, Human
gacaguuuugcuaaaagguuga

SEQ ID NO: 894572 - RNA, 22 nt, Human
cuguccugagauaaagaugagg

SEQ ID NO: 894573 - RNA, 22 nt, Human
caggcugggaacgccacccgcu

SEQ ID NO: 894574 - RNA, 22 nt, Human
caucaucuugaaugacugugau

SEQ ID NO: 894575 - RNA, 17 nt, Human
aggugcagaggcagagc

SEQ ID NO: 894576 - RNA, 22 nt, Human
ggagguagucugagucauaggc

SEQ ID NO: 894577 - RNA, 22 nt, Human
gggagcugaauggcaauggaga

SEQ ID NO: 894578 - RNA, 22 nt, Human
uacaaaggaaacuucuuuuccc

SEQ ID NO: 894579 - RNA, 22 nt, Human
uaggccaaguugaucagacauc

SEQ ID NO: 894580 - RNA, 22 nt, Human
aguguuugcaucucauugauuu

SEQ ID NO: 894581 - RNA, 22 nt, Human
aaguuuguagcuggaugucugu

SEQ ID NO: 894582 - RNA, 22 nt, Human
acagaugaggaagagucagcca

SEQ ID NO: 894583 - RNA, 22 nt, Human
gcaggccagcugugcagauggg

SEQ ID NO: 894584 - RNA, 22 nt, Human
augcuuaaaaggcugcguuaga

SEQ ID NO: 894585 - RNA, 22 nt, Human
aagaaugaaggauuuagcuguu

SEQ ID NO: 894586 - RNA, 22 nt, Human
aaaaagauguccugaaguuuag

SEQ ID NO: 894587 - RNA, 22 nt, Human
ugagccuggcggaagcagcgug

SEQ ID NO: 894588 - RNA, 22 nt, Human
guccagcugaucuugacccagc

SEQ ID NO: 894589 - RNA, 22 nt, Human
uuuuuaucuuguaugugucucu

SEQ ID NO: 894590 - RNA, 22 nt, Human
acccagcuaacccuacccugga

SEQ ID NO: 894591 - RNA, 21 nt, Human
gugcucugggcagcagagggc

SEQ ID NO: 894592 - RNA, 22 nt, Human
gcauguggauauguuaggguga

SEQ ID NO: 894593 - RNA, 22 nt, Human
uugugguuaaccgcacauuuuu

SEQ ID NO: 894594 - RNA, 22 nt, Human
cuggcagcauggagccugugcu

SEQ ID NO: 894595 - RNA, 22 nt, Human
cuuuugauaguugcugagcagg

SEQ ID NO: 894596 - RNA, 20 nt, Human
ccagguggugccuggagagg

SEQ ID NO: 894597 - RNA, 22 nt, Human
uucuucuucauuucugacgaug

SEQ ID NO: 894598 - RNA, 22 nt, Human
ucugaaauggcgauggccguug

SEQ ID NO: 894599 - RNA, 22 nt, Human
cagugcuguugggcccagagag

SEQ ID NO: 894600 - RNA, 22 nt, Human
caacuacaggaaaagucauuca

SEQ ID NO: 894601 - RNA, 22 nt, Human
gcucaaagaccagacagaggag

SEQ ID NO: 894602 - RNA, 22 nt, Human
aagcuuagguacagaaguuaag

SEQ ID NO: 894603 - RNA, 22 nt, Human
ucuacagccauuuugagcagug

SEQ ID NO: 894604 - RNA, 22 nt, Human
ccugggcagugcuggaguugaa

SEQ ID NO: 894605 - RNA, 22 nt, Human
ugccaggguccugagggccuug

SEQ ID NO: 894606 - RNA, 22 nt, Human
agcagcugcuccacuugcuuaa

SEQ ID NO: 894607 - RNA, 22 nt, Human
aaugaguuauuuaauagaaagg

SEQ ID NO: 894608 - RNA, 22 nt, Human
aaguggacuaauacaaggacua

SEQ ID NO: 894609 - RNA, 22 nt, Human
uuugaacuaccucuccuuagca

SEQ ID NO: 894610 - RNA, 22 nt, Human
ugcuuuauuggaaccucauccu

SEQ ID NO: 894611 - RNA, 22 nt, Human
auccaaaggugacacagaauac

SEQ ID NO: 894612 - RNA, 22 nt, Human
auuaacaugaguuggagauagg

SEQ ID NO: 894613 - RNA, 22 nt, Human
aaguggagagcccuggaggucu

SEQ ID NO: 894614 - RNA, 22 nt, Human
ggagcuggagagcuagccuagg

SEQ ID NO: 894615 - RNA, 22 nt, Human
uuacauguucucauacacagag

SEQ ID NO: 894616 - RNA, 22 nt, Human
aacagucuuacagaaguagcca

SEQ ID NO: 894617 - RNA, 22 nt, Human
caagcuggaguuccucagagug

SEQ ID NO: 894618 - RNA, 22 nt, Human
uagcuuuaaaaaucaucaaagc

SEQ ID NO: 894619 - RNA, 22 nt, Human
ccaucucacucauguuucuaga

SEQ ID NO: 894620 - RNA, 22 nt, Human
gccuggcccagggcuccgcagg

SEQ ID NO: 894621 - RNA, 22 nt, Human
ccuuccuuucagggcuaugccu

SEQ ID NO: 894622 - RNA, 22 nt, Human
ucaauagcucaguguggaagcu

SEQ ID NO: 894623 - RNA, 22 nt, Human
auagaaucuuuguaaaacacuu

SEQ ID NO: 894624 - RNA, 16 nt, Human
ucauugaagacaguac

SEQ ID NO: 894625 - RNA, 22 nt, Human
ucugggucggaagccccaggga

SEQ ID NO: 894626 - RNA, 22 nt, Human
ggccuuccauugcucuuuucua

SEQ ID NO: 894627 - RNA, 22 nt, Human
uugacaaauacccauuagacca

SEQ ID NO: 894628 - RNA, 22 nt, Human
ggagaagggaacugaguuuuug

SEQ ID NO: 894629 - RNA, 22 nt, Human
auuucucacaaaguugcuuauc

SEQ ID NO: 894630 - RNA, 22 nt, Human
aguggcuggaauugcaggugcg

SEQ ID NO: 894631 - RNA, 23 nt, Human
agcuaacagaucgacaaaguaua

SEQ ID NO: 894632 - RNA, 22 nt, Human
uuuguucaaggaauaguaaaug

SEQ ID NO: 894633 - RNA, 19 nt, Human
cugggcugaggucugccuu

SEQ ID NO: 894634 - RNA, 22 nt, Human
cugggcaggauacuucauggga

SEQ ID NO: 894635 - RNA, 22 nt, Human
auacaacugcucucagauaagu

SEQ ID NO: 894636 - RNA, 22 nt, Human
cuggcuggaacgccgaggcggc

SEQ ID NO: 894637 - RNA, 22 nt, Human
cuguacagcaaguucaccuugg

SEQ ID NO: 894638 - RNA, 22 nt, Human
ucacagaaaucuguuuuuucua

SEQ ID NO: 894639 - RNA, 22 nt, Human
ugccagcuccgaggagcugcag

SEQ ID NO: 894640 - RNA, 22 nt, Human
gagccagagauccaggauggcu

SEQ ID NO: 894641 - RNA, 22 nt, Human
ucccacaggaaaguagacauug

SEQ ID NO: 894642 - RNA, 22 nt, Human
ccuguucuaaucuuggggcaga

SEQ ID NO: 894643 - RNA, 22 nt, Human
cuugggaaaccaaugggcuccu

SEQ ID NO: 894644 - RNA, 22 nt, Human
uggcagcauaaagcauuuagcu

SEQ ID NO: 894645 - RNA, 22 nt, Human
auuuccuucaguguuuaauacu

SEQ ID NO: 894646 - RNA, 22 nt, Human
cuguuauuuuccucugaacucu

SEQ ID NO: 894647 - RNA, 22 nt, Human
gacauuaauuucuuugguaauu

SEQ ID NO: 894648 - RNA, 22 nt, Human
gggauucaucaacuguuuuaca

SEQ ID NO: 894649 - RNA, 22 nt, Human
cagcuuccauaagagauggaga

SEQ ID NO: 894650 - RNA, 22 nt, Human
gacauucacaguuuccgauggu

SEQ ID NO: 894651 - RNA, 22 nt, Human
aggcucagucccggcccgcgcc

SEQ ID NO: 894652 - RNA, 22 nt, Human
gcugggaacacagccaugagag

SEQ ID NO: 894653 - RNA, 22 nt, Human
cagcucuuccucccaccggaca

SEQ ID NO: 894654 - RNA, 22 nt, Human
uagcuccuggugagccuacucu

SEQ ID NO: 894655 - RNA, 22 nt, Human
uggcucaguggcagccgcagcu

SEQ ID NO: 894656 - RNA, 22 nt, Human
gggcuuggcuggggccaccaga

SEQ ID NO: 894657 - RNA, 22 nt, Human
aacauuugcaugcuuuauuaga

SEQ ID NO: 894658 - RNA, 22 nt, Human
cccaggcucacuguccgcuucc

SEQ ID NO: 894659 - RNA, 22 nt, Human
ugcugaaguuacuagagacuau

SEQ ID NO: 894660 - RNA, 22 nt, Human
ucaaauuuuaacaugcauuaga

SEQ ID NO: 894661 - RNA, 22 nt, Human
acuuaaugguuccuaaaaugug

SEQ ID NO: 894662 - RNA, 22 nt, Human
acagccugcagccccaggucgc

SEQ ID NO: 894663 - RNA, 22 nt, Human
gcaggcuguagacaccaaacua

SEQ ID NO: 894664 - RNA, 22 nt, Human
accacagaggaauuugaagagg

SEQ ID NO: 894665 - RNA, 22 nt, Human
uguaaacugcuucucaccaagg

SEQ ID NO: 894666 - RNA, 22 nt, Human
uccaaauaguucuggaagacug

SEQ ID NO: 894667 - RNA, 22 nt, Human
gaaguuuagaguuuggaguccu

SEQ ID NO: 894668 - RNA, 22 nt, Human
cagugcaugcacacacauggua

SEQ ID NO: 894669 - RNA, 22 nt, Human
ccaggucuggaaccaccagggc

SEQ ID NO: 894670 - RNA, 22 nt, Human
aguggcaguagaugagcugguu

SEQ ID NO: 894671 - RNA, 22 nt, Human
uaguuuaugcugcugcagugag

SEQ ID NO: 894672 - RNA, 22 nt, Human
ggucugcccacuacucuccauu

SEQ ID NO: 894673 - RNA, 18 nt, Human
aggcuugggcccagcagc

SEQ ID NO: 894674 - RNA, 22 nt, Human
uccagaaacugcugagauaaga

SEQ ID NO: 894675 - RNA, 22 nt, Human
gcagcuuucuugcccuaaucuu

SEQ ID NO: 894676 - RNA, 19 nt, Human
ucacauucagccuugcuga

SEQ ID NO: 894677 - RNA, 22 nt, Human
ucuuuucuccagaccugggauc

SEQ ID NO: 894678 - RNA, 22 nt, Human
aaauguucuaaauuacauguga

SEQ ID NO: 894679 - RNA, 22 nt, Human
ugggacagguuggagagaagca

SEQ ID NO: 894680 - RNA, 18 nt, Human
gcugugugcaccugauaa

SEQ ID NO: 894681 - RNA, 22 nt, Human
ggggagaccaucugaaggugau

SEQ ID NO: 894682 - RNA, 22 nt, Human
gcuacaggagauaaaggccucu

SEQ ID NO: 894683 - RNA, 22 nt, Human
acugcagcaaagcccgugucuu

SEQ ID NO: 894684 - RNA, 22 nt, Human
aaacugaaguucuggaggggua

SEQ ID NO: 894685 - RNA, 22 nt, Human
auucuggguuuuugucuucugu

SEQ ID NO: 894686 - RNA, 22 nt, Human
uuuaacaugugaauuuuggaag

SEQ ID NO: 894687 - RNA, 22 nt, Human
uaaaaccauaaggcuggaagga

SEQ ID NO: 894688 - RNA, 23 nt, Human
ucucaugucuuuccuacaagcau

SEQ ID NO: 894689 - RNA, 22 nt, Human
uguguuaauuuucccuuucucu

SEQ ID NO: 894690 - RNA, 22 nt, Human
aaggcaaaagaggugucaucac

SEQ ID NO: 894691 - RNA, 22 nt, Human
uuagaaacucaacucugggaau

SEQ ID NO: 894692 - RNA, 22 nt, Human
uuaauuagagcugauguucaua

SEQ ID NO: 894693 - RNA, 22 nt, Human
cuuccuguuguauuugugagcc

SEQ ID NO: 894694 - RNA, 20 nt, Human
ccucuguguccugugucaua

SEQ ID NO: 894695 - RNA, 22 nt, Human
guccugugaugaguaccaggug

SEQ ID NO: 894696 - RNA, 22 nt, Human
cagagacaggaaucagcugcag

SEQ ID NO: 894697 - RNA, 22 nt, Human
uuccucuccucccaccagguga

SEQ ID NO: 894698 - RNA, 22 nt, Human
gcuuccugagaaacaaucugau

SEQ ID NO: 894699 - RNA, 21 nt, Human
uucuucaggccaaugcucauu

SEQ ID NO: 894700 - RNA, 22 nt, Human
gcaacuuaggaguuagagcaug

SEQ ID NO: 894701 - RNA, 22 nt, Human
ggaagcugguaauuguugggac

SEQ ID NO: 894702 - RNA, 22 nt, Human
ugggcuggcugaacuucaaccu

SEQ ID NO: 894703 - RNA, 22 nt, Human
aacacugaaaugucuuaagauu

SEQ ID NO: 894704 - RNA, 22 nt, Human
aaguaacaggugcuuaguuuau

SEQ ID NO: 894705 - RNA, 22 nt, Human
aucagcaggugcugguggagac

SEQ ID NO: 894706 - RNA, 20 nt, Human
acaggagaucugaggaaagg

SEQ ID NO: 894707 - RNA, 22 nt, Human
ccaggaggaugaggggcauaga

SEQ ID NO: 894708 - RNA, 22 nt, Human
cugcugccugauugcagaccuc

SEQ ID NO: 894709 - RNA, 22 nt, Human
cuguaaacuaggucauuuuuaa

SEQ ID NO: 894710 - RNA, 22 nt, Human
ggucacaccccaaguacauucg

SEQ ID NO: 894711 - RNA, 22 nt, Human
aaaugugucaguuucauucucu

SEQ ID NO: 894712 - RNA, 22 nt, Human
uuacaaagguaguuuugucuau

SEQ ID NO: 894713 - RNA, 21 nt, Human
cucugcagcccugcuuccagg

SEQ ID NO: 894714 - RNA, 19 nt, Human
uucaguuuccucaucugga

SEQ ID NO: 894715 - RNA, 22 nt, Human
caggaagcugagcugcacugca

SEQ ID NO: 894716 - RNA, 22 nt, Human
gugggagaaauuagcucuaguu

SEQ ID NO: 894717 - RNA, 22 nt, Human
ugccauauugcaaagugucugc

SEQ ID NO: 894718 - RNA, 22 nt, Human
agccccuguuuuuccagucaga

SEQ ID NO: 894719 - RNA, 22 nt, Human
uucuuaacuggaaaaugucaga

SEQ ID NO: 894720 - RNA, 22 nt, Human
uagucucuggagacucuagggg

SEQ ID NO: 894721 - RNA, 22 nt, Human
aucugccuccaaguccaugugu

SEQ ID NO: 894722 - RNA, 22 nt, Human
cuucaauaggaacugcauggca

SEQ ID NO: 894723 - RNA, 20 nt, Human
uggccaaguauccaacugga

SEQ ID NO: 894724 - RNA, 22 nt, Human
augugcuuuagguuuguuuaca

SEQ ID NO: 894725 - RNA, 22 nt, Human
uauguguauuuaguucuauaca

SEQ ID NO: 894726 - RNA, 22 nt, Human
ggcagcgagucgccaagucucg

SEQ ID NO: 894727 - RNA, 22 nt, Human
ugugcgugggcacacacauaug

SEQ ID NO: 894728 - RNA, 22 nt, Human
uguuguaaucauuuuaugaaaa

SEQ ID NO: 894729 - RNA, 22 nt, Human
ggcaguucucagccaaggcaau

SEQ ID NO: 894730 - RNA, 22 nt, Human
gucacagaucucuugagucaag

SEQ ID NO: 894731 - RNA, 22 nt, Human
uuuuauuggagugauaccaagc

SEQ ID NO: 894732 - RNA, 22 nt, Human
auaaaaguaggaccaacuuaca

SEQ ID NO: 894733 - RNA, 22 nt, Human
guggucuuuaaauuugugccug

SEQ ID NO: 894734 - RNA, 22 nt, Human
cagaggcuuggcauuaucaugc

SEQ ID NO: 894735 - RNA, 22 nt, Human
uccagcucuuguugcccacugc

SEQ ID NO: 894736 - RNA, 22 nt, Human
uuuggaauggaauagagauugc

SEQ ID NO: 894737 - RNA, 22 nt, Human
auuuuguuaaugucaccgugcu

SEQ ID NO: 894738 - RNA, 22 nt, Human
uuugauagggaaguaagaauga

SEQ ID NO: 894739 - RNA, 22 nt, Human
aagaugauaggacuugcuuaag

SEQ ID NO: 894740 - RNA, 22 nt, Human
gugcccaguccugccuugacag

SEQ ID NO: 894741 - RNA, 22 nt, Human
uuuagcauauccuauaaaacua

SEQ ID NO: 894742 - RNA, 23 nt, Human
uuuggcauguuaacuucacuuac

SEQ ID NO: 894743 - RNA, 22 nt, Human
caacauaugauuuuguauauaa

SEQ ID NO: 894744 - RNA, 22 nt, Human
uuccauugaguaccuggagaca

SEQ ID NO: 894745 - RNA, 22 nt, Human
caugcaauuuuugguucucuau

SEQ ID NO: 894746 - RNA, 22 nt, Human
auucuagccauuguauucuucc

SEQ ID NO: 894747 - RNA, 22 nt, Human
uggccagcugagauuuagcaca

SEQ ID NO: 894748 - RNA, 22 nt, Human
uuucugaagauacagcuuugcu

SEQ ID NO: 894749 - RNA, 22 nt, Human
uccaggaggacugagggggcug

SEQ ID NO: 894750 - RNA, 22 nt, Human
auucucaaacaagugguuugau

SEQ ID NO: 894751 - RNA, 22 nt, Human
uaccauuugagagagaacauaa

SEQ ID NO: 894752 - RNA, 20 nt, Human
ucaaagcaaagggagaugau

SEQ ID NO: 894753 - RNA, 22 nt, Human
aaucagaaucaguugacacagc

SEQ ID NO: 894754 - RNA, 22 nt, Human
gcugucuguucgagcguguguu

SEQ ID NO: 894755 - RNA, 22 nt, Human
ggccagcaguauauagcuaauu

SEQ ID NO: 894756 - RNA, 22 nt, Human
cacaauaaauguuugcugauga

SEQ ID NO: 894757 - RNA, 22 nt, Human
ugugcuucugcagagacuauuu

SEQ ID NO: 894758 - RNA, 22 nt, Human
aggcaaagagccagcaaaucug

SEQ ID NO: 894759 - RNA, 22 nt, Human
cauggcagcuuugggaggagga

SEQ ID NO: 894760 - RNA, 21 nt, Human
cagagagcuagaacuucauga

SEQ ID NO: 894761 - RNA, 22 nt, Human
cuugucagcacuuugccgaaaa

SEQ ID NO: 894762 - RNA, 22 nt, Human
ccagggaaggcucugccugcuu

SEQ ID NO: 894763 - RNA, 22 nt, Human
uguguuugaguccucacagugc

SEQ ID NO: 894764 - RNA, 23 nt, Human
agccuggcaccugcagaucggag

SEQ ID NO: 894765 - RNA, 22 nt, Human
acagcauucaauaaauaauaac

SEQ ID NO: 894766 - RNA, 22 nt, Human
agcacagaauggcuuggaagcc

SEQ ID NO: 894767 - RNA, 22 nt, Human
uuggaagaggaaaaugagccua

SEQ ID NO: 894768 - RNA, 22 nt, Human
uggaaacuaacaacagagcaga

SEQ ID NO: 894769 - RNA, 22 nt, Human
gaccacagguaugggcuuggca

SEQ ID NO: 894770 - RNA, 22 nt, Human
uccaggcauguggccaguacuc

SEQ ID NO: 894771 - RNA, 22 nt, Human
uuuucauuguuccucgagcauu

SEQ ID NO: 894772 - RNA, 22 nt, Human
cacaccagauggcagcguggga

SEQ ID NO: 894773 - RNA, 22 nt, Human
uggagcaggaaacaucuagagg

SEQ ID NO: 894774 - RNA, 22 nt, Human
gaacucuugcagugaaagcuua

SEQ ID NO: 894775 - RNA, 22 nt, Human
gcagaugaaguuuacaggaaac

SEQ ID NO: 894776 - RNA, 22 nt, Human
cagacagggaccucgcuccaga

SEQ ID NO: 894777 - RNA, 22 nt, Human
uuggagauguaaaauucagaga

SEQ ID NO: 894778 - RNA, 17 nt, Human
uggagcugcguguguuc

SEQ ID NO: 894779 - RNA, 22 nt, Human
gagugauuuaagcuauuuuuaa

SEQ ID NO: 894780 - RNA, 22 nt, Human
ucuauggggccucacaggcacu

SEQ ID NO: 894781 - RNA, 22 nt, Human
ccugccugcuuucugcuuugca

SEQ ID NO: 894782 - RNA, 22 nt, Human
cagcacugcugcuguacacaca

SEQ ID NO: 894783 - RNA, 22 nt, Human
uaaagauaagacaucaacugag

SEQ ID NO: 894784 - RNA, 22 nt, Human
cacaucuggguucucuucuuca

SEQ ID NO: 894785 - RNA, 22 nt, Human
accugggcauuuuggaugauua

SEQ ID NO: 894786 - RNA, 22 nt, Human
uccagcagguuggucaggugca

SEQ ID NO: 894787 - RNA, 22 nt, Human
uuacaagaucuuugaaggcaag

SEQ ID NO: 894788 - RNA, 22 nt, Human
cagcugagcaucacuagucugg

SEQ ID NO: 894789 - RNA, 22 nt, Human
gcagccacacuguuacagaaug

SEQ ID NO: 894790 - RNA, 22 nt, Human
ccugucuguauugguuugcuau

SEQ ID NO: 894791 - RNA, 22 nt, Human
ugccaccaggagaaccagugca

SEQ ID NO: 894792 - RNA, 22 nt, Human
gauagaaagagugguucuuuuu

SEQ ID NO: 894793 - RNA, 22 nt, Human
ucuuccagaaugcauucucuuu

SEQ ID NO: 894794 - RNA, 22 nt, Human
aaguucugggguaaugagaauu

SEQ ID NO: 894795 - RNA, 23 nt, Human
gcagagucaaguagucaugagug

SEQ ID NO: 894796 - RNA, 19 nt, Human
auggcuguguuccaguaaa

SEQ ID NO: 894797 - RNA, 22 nt, Human
gaucuguuauaaucucuuuuau

SEQ ID NO: 894798 - RNA, 22 nt, Human
augagguauucguaauauuucc

SEQ ID NO: 894799 - RNA, 22 nt, Human
agguuggccaagcugcuggccc

SEQ ID NO: 894800 - RNA, 22 nt, Human
cagggcagagccaggauuucaa

SEQ ID NO: 894801 - RNA, 22 nt, Human
uagaugaauuagcaauuaucuu

SEQ ID NO: 894802 - RNA, 22 nt, Human
agcagacauggcuuggaugugg

SEQ ID NO: 894803 - RNA, 22 nt, Human
aaguguuucuuggaauguugcg

SEQ ID NO: 894804 - RNA, 22 nt, Human
gacauucagguguucaaugcca

SEQ ID NO: 894805 - RNA, 19 nt, Human
ugcccaggccagguugggc

SEQ ID NO: 894806 - RNA, 22 nt, Human
uagcuguggagcagaggucucc

SEQ ID NO: 894807 - RNA, 22 nt, Human
cuguggcagggaagaggccaug

SEQ ID NO: 894808 - RNA, 22 nt, Human
cacagcuggugcacuagcucug

SEQ ID NO: 894809 - RNA, 22 nt, Human
augucagaaucuacauucuacu

SEQ ID NO: 894810 - RNA, 19 nt, Human
ugaaacaaacuuaaaagga

SEQ ID NO: 894811 - RNA, 22 nt, Human
agcucuaaauggaauuuugccu

SEQ ID NO: 894812 - RNA, 22 nt, Human
cagcuguucggggcuggcaugu

SEQ ID NO: 894813 - RNA, 22 nt, Human
ugagauaauacuucuuagcugg

SEQ ID NO: 894814 - RNA, 22 nt, Human
gcaggcguguuucacgugccag

SEQ ID NO: 894815 - RNA, 22 nt, Human
aaagucauugcuguuaucaaug

SEQ ID NO: 894816 - RNA, 22 nt, Human
cagugggcugugauggauucac

SEQ ID NO: 894817 - RNA, 21 nt, Human
ccauugagaccauggaggagu

SEQ ID NO: 894818 - RNA, 22 nt, Human
cuuugcaauagaggcacacaug

SEQ ID NO: 894819 - RNA, 22 nt, Human
uucagagguuagagcaguggga

SEQ ID NO: 894820 - RNA, 22 nt, Human
cuuuacaaauagggagggagug

SEQ ID NO: 894821 - RNA, 22 nt, Human
acccaggcuagggugcaguggc

SEQ ID NO: 894822 - RNA, 22 nt, Human
cagagacaaccugguagagaaa

SEQ ID NO: 894823 - RNA, 22 nt, Human
ucaggaagggugguccacaggg

SEQ ID NO: 894824 - RNA, 19 nt, Human
guuguaaauggagguuucu

SEQ ID NO: 894825 - RNA, 22 nt, Human
augucacaaaagucccauuaug

SEQ ID NO: 894826 - RNA, 22 nt, Human
auggcagggacuguggcccuug

SEQ ID NO: 894827 - RNA, 22 nt, Human
aggcucccaagcacugacccca

SEQ ID NO: 894828 - RNA, 22 nt, Human
caugucuuauauccugucuuca

SEQ ID NO: 894829 - RNA, 22 nt, Human
ucugcaggacugaggccuguuu

SEQ ID NO: 894830 - RNA, 22 nt, Human
uggaaauauacaaugugucucu

SEQ ID NO: 894831 - RNA, 22 nt, Human
uaccugcagcgggaauccauua

SEQ ID NO: 894832 - RNA, 22 nt, Human
cugggcacaaguggcccuggau

SEQ ID NO: 894833 - RNA, 22 nt, Human
augguugacccaugugaguuag

SEQ ID NO: 894834 - RNA, 22 nt, Human
uagccccagcuacucggaagcu

SEQ ID NO: 894835 - RNA, 22 nt, Human
uguguguguuccuccucagcua

SEQ ID NO: 894836 - RNA, 22 nt, Human
augcauauuuucuacuauaucg

SEQ ID NO: 894837 - RNA, 22 nt, Human
cacagggcagagaccugggugc

SEQ ID NO: 894838 - RNA, 19 nt, Human
ugucuuuggucugaguuuc

SEQ ID NO: 894839 - RNA, 22 nt, Human
accaggagucuagccuagucaa

SEQ ID NO: 894840 - RNA, 22 nt, Human
caauacaauuaccaguuaauca

SEQ ID NO: 894841 - RNA, 22 nt, Human
ugggugagccacaggaguuguc

SEQ ID NO: 894842 - RNA, 22 nt, Human
gcugcuccgucugagcucuggu

SEQ ID NO: 894843 - RNA, 22 nt, Human
auuuaaagugguagauuggcag

SEQ ID NO: 894844 - RNA, 22 nt, Human
auucuuuuguccuagcuugaua

SEQ ID NO: 894845 - RNA, 22 nt, Human
ugugcgcguguauauauguaua

SEQ ID NO: 894846 - RNA, 22 nt, Human
uugacaaaggaccuugcuauuu

SEQ ID NO: 894847 - RNA, 22 nt, Human
ucuuggcaguucuugugcuuuu

SEQ ID NO: 894848 - RNA, 22 nt, Human
guuaucuagaccaaaagccuaa

SEQ ID NO: 894849 - RNA, 22 nt, Human
uauguaaaaauucaucaggcug

SEQ ID NO: 894850 - RNA, 22 nt, Human
agagcuccgugccuggcugcca

SEQ ID NO: 894851 - RNA, 21 nt, Human
gugcugaggauacaguaguaa

SEQ ID NO: 894852 - RNA, 22 nt, Human
acagaugguacuaaacccauau

SEQ ID NO: 894853 - RNA, 22 nt, Human
augagauaauucauguggaaug

SEQ ID NO: 894854 - RNA, 19 nt, Human
cgcagagggcuucugagag

SEQ ID NO: 894855 - RNA, 22 nt, Human
uauguacacuuaaguuugagaa

SEQ ID NO: 894856 - RNA, 22 nt, Human
auuagcuucugugcauggacuu

SEQ ID NO: 894857 - RNA, 22 nt, Human
auacugaacauguuugcaguca

SEQ ID NO: 894858 - RNA, 22 nt, Human
ugcucccaggacucuugagcca

SEQ ID NO: 894859 - RNA, 22 nt, Human
aacaaucuccaagaccaaugug

SEQ ID NO: 894860 - RNA, 21 nt, Human
uuucccagcugaaaauaaaug

SEQ ID NO: 894861 - RNA, 22 nt, Human
cucugcaucagcuucauucugu

SEQ ID NO: 894862 - RNA, 22 nt, Human
uguaaaucacugaacuaaauga

SEQ ID NO: 894863 - RNA, 22 nt, Human
cugcugucaucuggcgcugugc

SEQ ID NO: 894864 - RNA, 22 nt, Human
ugacacuuugugacucugagaa

SEQ ID NO: 894865 - RNA, 22 nt, Human
uugcagggcaucgcguacuucu

SEQ ID NO: 894866 - RNA, 22 nt, Human
cuccagaaauuuggaugcagca

SEQ ID NO: 894867 - RNA, 22 nt, Human
acauauauuuucacacaugguu

SEQ ID NO: 894868 - RNA, 22 nt, Human
aucugucuauguggcuauguau

SEQ ID NO: 894869 - RNA, 22 nt, Human
ucacaaaggaugaugaauucug

SEQ ID NO: 894870 - RNA, 22 nt, Human
uggaggaaguggcuggccagaa

SEQ ID NO: 894871 - RNA, 22 nt, Human
aaaguagaggcauugaucaggu

SEQ ID NO: 894872 - RNA, 22 nt, Human
ccacagugagugucauacuugg

SEQ ID NO: 894873 - RNA, 22 nt, Human
uucuuagagaugguuaaaaaua

SEQ ID NO: 894874 - RNA, 22 nt, Human
auaagcuugauguaacuaacca

SEQ ID NO: 894875 - RNA, 22 nt, Human
augucuucuaagcucuaagcug

SEQ ID NO: 894876 - RNA, 18 nt, Human
ccauuucaugauuauuac

SEQ ID NO: 894877 - RNA, 22 nt, Human
aacagcaugcuggguaacauug

SEQ ID NO: 894878 - RNA, 20 nt, Human
gcuguucugaagcagaaggc

SEQ ID NO: 894879 - RNA, 22 nt, Human
ucugggaguuucugugggagcu

SEQ ID NO: 894880 - RNA, 22 nt, Human
agaaauggugagugagagcccc

SEQ ID NO: 894881 - RNA, 22 nt, Human
guucaugugguuuuuaaaggau

SEQ ID NO: 894882 - RNA, 23 nt, Human
ucucugggugggcugugucuaua

SEQ ID NO: 894883 - RNA, 22 nt, Human
cggucaggugcagcguuggcac

SEQ ID NO: 894884 - RNA, 22 nt, Human
ggugacacagggaccagagucu

SEQ ID NO: 894885 - RNA, 22 nt, Human
ccagaauuugaacucaggcaau

SEQ ID NO: 894886 - RNA, 22 nt, Human
cgccggcuugaggcaggcggca

SEQ ID NO: 894887 - RNA, 22 nt, Human
cugugcguugugaaauguuuag

SEQ ID NO: 894888 - RNA, 22 nt, Human
acauacuuagaguaaacaagua

SEQ ID NO: 894889 - RNA, 15 nt, Human
ggugucugcagugug

SEQ ID NO: 894890 - RNA, 22 nt, Human
uauuauuuuuauucgagggaaa

SEQ ID NO: 894891 - RNA, 22 nt, Human
uacagcaaugcuacaagaugac

SEQ ID NO: 894892 - RNA, 22 nt, Human
cccugcugcagagagcuuucca

SEQ ID NO: 894893 - RNA, 22 nt, Human
acacagugucuuagguaguguc

SEQ ID NO: 894894 - RNA, 22 nt, Human
ucuuggagauagggucuuaaug

SEQ ID NO: 894895 - RNA, 22 nt, Human
cauaagaaauaaugaugaugac

SEQ ID NO: 894896 - RNA, 21 nt, Human
cugagggccgcagcugggcuc

SEQ ID NO: 894897 - RNA, 22 nt, Human
guucuagaugacugagcagcug

SEQ ID NO: 894898 - RNA, 22 nt, Human
cagcugaguuuccaagucugcc

SEQ ID NO: 894899 - RNA, 22 nt, Human
ucugcugguuccgaauuaggcc

SEQ ID NO: 894900 - RNA, 22 nt, Human
guacaguaaucccguucuucug

SEQ ID NO: 894901 - RNA, 22 nt, Human
ucugggcugucuacagguuggc

SEQ ID NO: 894902 - RNA, 22 nt, Human
augaaugagaaagcugaaaucu

SEQ ID NO: 894903 - RNA, 22 nt, Human
ucucugucucccguguguccgg

SEQ ID NO: 894904 - RNA, 22 nt, Human
gcuguggcuuucuguuucuguu

SEQ ID NO: 894905 - RNA, 22 nt, Human
aacauguaccuacaaucagaau

SEQ ID NO: 894906 - RNA, 22 nt, Human
ggcucccaggagggccuggagg

SEQ ID NO: 894907 - RNA, 22 nt, Human
cacuucaaauaagcucuucuca

SEQ ID NO: 894908 - RNA, 22 nt, Human
ucacauaguggggcauuggaau

SEQ ID NO: 894909 - RNA, 22 nt, Human
ucacaaaucauuuuaucugugu

SEQ ID NO: 894910 - RNA, 22 nt, Human
agauugcuaaugaaguucuuga

SEQ ID NO: 894911 - RNA, 22 nt, Human
acacuagcuaaaugcugauuaa

SEQ ID NO: 894912 - RNA, 22 nt, Human
cacugaaauauuaauaucuuau

SEQ ID NO: 894913 - RNA, 22 nt, Human
gcacucuguuucuccugucagc

SEQ ID NO: 894914 - RNA, 22 nt, Human
ucuccaggugacucugauguau

SEQ ID NO: 894915 - RNA, 22 nt, Human
cuuccucaugugcaaugcaagc

SEQ ID NO: 894916 - RNA, 22 nt, Human
cuuuucaggcuacauuauggga

SEQ ID NO: 894917 - RNA, 22 nt, Human
uggcuucauucuccugugaaua

SEQ ID NO: 894918 - RNA, 20 nt, Human
guucacaggcuuccuuucag

SEQ ID NO: 894919 - RNA, 22 nt, Human
gcagaaagcuuagaggguuugc

SEQ ID NO: 894920 - RNA, 22 nt, Human
uacuagaaugccacuguuagug

SEQ ID NO: 894921 - RNA, 19 nt, Human
cuugugcaguucacgcuca

SEQ ID NO: 894922 - RNA, 22 nt, Human
gcagucuuuuucuucuagcuaa

SEQ ID NO: 894923 - RNA, 16 nt, Human
agcagccagcacugga

SEQ ID NO: 894924 - RNA, 22 nt, Human
cagaggcuaagaguguccaaag

SEQ ID NO: 894925 - RNA, 22 nt, Human
aggcagugcugugcccugaacc

SEQ ID NO: 894926 - RNA, 22 nt, Human
acagguagguuaaaauguguca

SEQ ID NO: 894927 - RNA, 22 nt, Human
cagcacugcuucgcagccaggg

SEQ ID NO: 894928 - RNA, 22 nt, Human
gaggcucugugaugugccaggc

SEQ ID NO: 894929 - RNA, 22 nt, Human
agcagaggaggauuuaguuagg

SEQ ID NO: 894930 - RNA, 22 nt, Human
ggucccaggaaucuguguucua

SEQ ID NO: 894931 - RNA, 17 nt, Human
uucaaugauuaaugcau

SEQ ID NO: 894932 - RNA, 22 nt, Human
cuagcagcucugauauuuacaa

SEQ ID NO: 894933 - RNA, 22 nt, Human
cccaggagaccuagaucuguuu

SEQ ID NO: 894934 - RNA, 22 nt, Human
uggcuucuagcaguguugauuu

SEQ ID NO: 894935 - RNA, 22 nt, Human
gucuccagaagccuagacagcc

SEQ ID NO: 894936 - RNA, 22 nt, Human
uaacugcaaccuccaucuugug

SEQ ID NO: 894937 - RNA, 22 nt, Human
uuuggcaaauucuugguaguau

SEQ ID NO: 894938 - RNA, 22 nt, Human
caaagaaugagugaguacauaa

SEQ ID NO: 894939 - RNA, 22 nt, Human
ggcuuuaugcacagcagauggu

SEQ ID NO: 894940 - RNA, 22 nt, Human
ucccuuugaucacuaacagaac

SEQ ID NO: 894941 - RNA, 22 nt, Human
ugagauggaaggugaggcagua

SEQ ID NO: 894942 - RNA, 22 nt, Human
cagaggccccagaacuagcucu

SEQ ID NO: 894943 - RNA, 22 nt, Human
auguuuuauuaccaacuuguac

SEQ ID NO: 894944 - RNA, 22 nt, Human
ggcuggcugcaugcccccuccu

SEQ ID NO: 894945 - RNA, 22 nt, Human
uuccucucucuugccagaaugu

SEQ ID NO: 894946 - RNA, 22 nt, Human
cuccagucuaguagagccugcu

SEQ ID NO: 894947 - RNA, 22 nt, Human
cucaaauauguggucagaaagc

SEQ ID NO: 894948 - RNA, 22 nt, Human
augucucuuuacucuuagaacc

SEQ ID NO: 894949 - RNA, 22 nt, Human
aacuuucagaauccuaugcauu

SEQ ID NO: 894950 - RNA, 22 nt, Human
ugggcaggggcccugcuuccgu

SEQ ID NO: 894951 - RNA, 22 nt, Human
uaccauuuacuugaaaauaaaa

SEQ ID NO: 894952 - RNA, 18 nt, Human
uguggcaggggugggaga

SEQ ID NO: 894953 - RNA, 22 nt, Human
uggaggaaaauuacuggggucu

SEQ ID NO: 894954 - RNA, 22 nt, Human
caggccuggggcuggcuuccag

SEQ ID NO: 894955 - RNA, 22 nt, Human
acaugcaggaaaaugcacagau

SEQ ID NO: 894956 - RNA, 22 nt, Human
uuagccagugaaauggagaaau

SEQ ID NO: 894957 - RNA, 22 nt, Human
uggcugcaagggcacggacccu

SEQ ID NO: 894958 - RNA, 22 nt, Human
gaggcuaugaggagugagguuu

SEQ ID NO: 894959 - RNA, 22 nt, Human
aggagccauggaggugaggcgg

SEQ ID NO: 894960 - RNA, 22 nt, Human
ugcaauuuggggaagaaagaga

SEQ ID NO: 894961 - RNA, 22 nt, Human
aacugaugcuagaagagacguu

SEQ ID NO: 894962 - RNA, 19 nt, Human
uagucuuuauucuuaauuu

SEQ ID NO: 894963 - RNA, 22 nt, Human
uacaaaguaauguauaauaucg

SEQ ID NO: 894964 - RNA, 22 nt, Human
aagaacuuccuaauauauuuuc

SEQ ID NO: 894965 - RNA, 22 nt, Human
caggacagcucaacaccuccuc

SEQ ID NO: 894966 - RNA, 22 nt, Human
gaguuuaaucauuguucuaucc

SEQ ID NO: 894967 - RNA, 22 nt, Human
ugcacacagcugggccuggcug

SEQ ID NO: 894968 - RNA, 21 nt, Human
gacaggggccauggguuucua

SEQ ID NO: 894969 - RNA, 21 nt, Human
auuuucucuggaugaugguca

SEQ ID NO: 894970 - RNA, 22 nt, Human
cacauauaugaaaugaggaauu

SEQ ID NO: 894971 - RNA, 22 nt, Human
gcauugaauccuaucaggcaaa

SEQ ID NO: 894972 - RNA, 22 nt, Human
ugucacaacagaggaacugaau

SEQ ID NO: 894973 - RNA, 22 nt, Human
gguaggaagauagagcaaaguu

SEQ ID NO: 894974 - RNA, 22 nt, Human
ugcagcuggaacuuagaggaga

SEQ ID NO: 894975 - RNA, 22 nt, Human
agugaagguuuacagggccccu

SEQ ID NO: 894976 - RNA, 21 nt, Human
aaagcaucacgaacauuuggg

SEQ ID NO: 894977 - RNA, 22 nt, Human
gcccaggggcagcgcauagugg

SEQ ID NO: 894978 - RNA, 22 nt, Human
guaaaguucuacuagaaucaac

SEQ ID NO: 894979 - RNA, 22 nt, Human
aacacuuuccguagguuuagua

SEQ ID NO: 894980 - RNA, 22 nt, Human
gauuuuucaguauaaaauauau

SEQ ID NO: 894981 - RNA, 22 nt, Human
caggccugggcuucggggcuga

SEQ ID NO: 894982 - RNA, 22 nt, Human
aaagguaacaguuauaaccagg

SEQ ID NO: 894983 - RNA, 22 nt, Human
ggugucccaggccagcugugug

SEQ ID NO: 894984 - RNA, 22 nt, Human
uggcuuuaggguuccuucuacc

SEQ ID NO: 894985 - RNA, 22 nt, Human
ggagucuggaguggggcccaag

SEQ ID NO: 894986 - RNA, 22 nt, Human
ucaacacaacagagaaaugcug

SEQ ID NO: 894987 - RNA, 19 nt, Human
auucuucucuuccugcugu

SEQ ID NO: 894988 - RNA, 22 nt, Human
ggggaaaggccauggcaagaac

SEQ ID NO: 894989 - RNA, 22 nt, Human
aagaauaacacuuagguuuugc

SEQ ID NO: 894990 - RNA, 22 nt, Human
acagagaugagucaacacagcu

SEQ ID NO: 894991 - RNA, 22 nt, Human
augcucugggcaggagcccugg

SEQ ID NO: 894992 - RNA, 22 nt, Human
caaguuaaauuugcauuucaga

SEQ ID NO: 894993 - RNA, 22 nt, Human
ucuuauuuuuuaaugacagaga

SEQ ID NO: 894994 - RNA, 18 nt, Human
acagggagggcgcugggg

SEQ ID NO: 894995 - RNA, 22 nt, Human
gaggccuggguuggaggugcau

SEQ ID NO: 894996 - RNA, 22 nt, Human
uaaggaaagugccaugauuucu

SEQ ID NO: 894997 - RNA, 22 nt, Human
agacuagagagauauaauaugg

SEQ ID NO: 894998 - RNA, 22 nt, Human
gaagagaagguguaggccaucc

SEQ ID NO: 894999 - RNA, 22 nt, Human
cugcccuguagcuguucuagca

SEQ ID NO: 895000 - RNA, 21 nt, Human
ggccagcugcauaugucacug

SEQ ID NO: 895001 - RNA, 22 nt, Human
uggcagcuuccugcucauagga

SEQ ID NO: 895002 - RNA, 20 nt, Human
cuguggugagcaggagagua

SEQ ID NO: 895003 - RNA, 20 nt, Human
aaacaagguugcucugagga

SEQ ID NO: 895004 - RNA, 23 nt, Human
gcaccccagaugugauuaguuag

SEQ ID NO: 895005 - RNA, 22 nt, Human
caagcucugggauagcagagag

SEQ ID NO: 895006 - RNA, 21 nt, Human
agugaagagugaaacacaugg

SEQ ID NO: 895007 - RNA, 22 nt, Human
aacauugaguucuacuuccauu

SEQ ID NO: 895008 - RNA, 22 nt, Human
aaaaguauccacagcucaggag

SEQ ID NO: 895009 - RNA, 22 nt, Human
aggcuucaccugcaccugagcu

SEQ ID NO: 895010 - RNA, 22 nt, Human
cauuagcaggcacuaagaaggu

SEQ ID NO: 895011 - RNA, 22 nt, Human
uugagucugugcccuaugcugu

SEQ ID NO: 895012 - RNA, 22 nt, Human
ucagggcugacugcuacucucc

SEQ ID NO: 895013 - RNA, 22 nt, Human
ugauuuccugugcgcccuuagg

SEQ ID NO: 895014 - RNA, 22 nt, Human
ucacagaaauaagauaguuauu

SEQ ID NO: 895015 - RNA, 22 nt, Human
ucagcagcagcucagcauguuu

SEQ ID NO: 895016 - RNA, 22 nt, Human
ugucugaauucaagaaauucaa

SEQ ID NO: 895017 - RNA, 22 nt, Human
aagaaucuguugauuccccacu

SEQ ID NO: 895018 - RNA, 19 nt, Human
augucuguugaauuucaua

SEQ ID NO: 895019 - RNA, 22 nt, Human
ucugucacaauuugcuuacucu

SEQ ID NO: 895020 - RNA, 22 nt, Human
aauucccacuauaugccaagca

SEQ ID NO: 895021 - RNA, 22 nt, Human
aaguaagugccuuuuauucuua

SEQ ID NO: 895022 - RNA, 22 nt, Human
ugccaggauauaagagugcgau

SEQ ID NO: 895023 - RNA, 22 nt, Human
gcugagagcggccagcugggaa

SEQ ID NO: 895024 - RNA, 22 nt, Human
agagccugcuguguaagucaca

SEQ ID NO: 895025 - RNA, 22 nt, Human
cacaggcuuuucugacauaggc

SEQ ID NO: 895026 - RNA, 22 nt, Human
agagagacgggggcugcugcuu

SEQ ID NO: 895027 - RNA, 22 nt, Human
caggcagagaacucauccguga

SEQ ID NO: 895028 - RNA, 22 nt, Human
aggaaacaugaaucugccuuga

SEQ ID NO: 895029 - RNA, 22 nt, Human
ugggaguagaugaggagugggc

SEQ ID NO: 895030 - RNA, 19 nt, Human
aucaggaacaaggcugauc

SEQ ID NO: 895031 - RNA, 22 nt, Human
cuggaaauuggagaugauguuu

SEQ ID NO: 895032 - RNA, 22 nt, Human
ucuggggaccauggcaucuaaa

SEQ ID NO: 895033 - RNA, 22 nt, Human
uggugcaguccaaagggagcag

SEQ ID NO: 895034 - RNA, 22 nt, Human
caagaucacacagguaacaagu

SEQ ID NO: 895035 - RNA, 22 nt, Human
aacaucuacagugagauguuag

SEQ ID NO: 895036 - RNA, 18 nt, Human
ccaauguuggccccaagg

SEQ ID NO: 895037 - RNA, 22 nt, Human
uaugaagaagacaaaugacacu

SEQ ID NO: 895038 - RNA, 22 nt, Human
uuaaauauuuucagcaggguca

SEQ ID NO: 895039 - RNA, 22 nt, Human
cagaaagcgggaugcagcaugu

SEQ ID NO: 895040 - RNA, 21 nt, Human
ucaguugccaaagugauguca

SEQ ID NO: 895041 - RNA, 22 nt, Human
auuuucagucuggcuggaccca

SEQ ID NO: 895042 - RNA, 22 nt, Human
uccuguguugauagagaugguu

SEQ ID NO: 895043 - RNA, 22 nt, Human
caguuccuaugggcaaaacaca

SEQ ID NO: 895044 - RNA, 22 nt, Human
cauuuugugcacacguggaguu

SEQ ID NO: 895045 - RNA, 22 nt, Human
aauggucacuauguaaggugau

SEQ ID NO: 895046 - RNA, 22 nt, Human
ucuaaucuacaaaaggaaauuc

SEQ ID NO: 895047 - RNA, 22 nt, Human
cauuaaaucuuccagaccucac

SEQ ID NO: 895048 - RNA, 22 nt, Human
uccaggggagugcuacgcacag

SEQ ID NO: 895049 - RNA, 22 nt, Human
uuugcacuuaacuuauuugaaa

SEQ ID NO: 895050 - RNA, 22 nt, Human
accaggcuuaauccuuugcuau

SEQ ID NO: 895051 - RNA, 22 nt, Human
ugagcagggagcugggcugagc

SEQ ID NO: 895052 - RNA, 22 nt, Human
uggcaccagggaacaagcauuu

SEQ ID NO: 895053 - RNA, 22 nt, Human
gggugguggccagcagugggca

SEQ ID NO: 895054 - RNA, 22 nt, Human
ucacugaaccagggaucucuag

SEQ ID NO: 895055 - RNA, 22 nt, Human
aaagcagaggugauaugacuua

SEQ ID NO: 895056 - RNA, 22 nt, Human
cuguauguuucuaugaauguga

SEQ ID NO: 895057 - RNA, 22 nt, Human
acauauuggcuuagcucuguga

SEQ ID NO: 895058 - RNA, 22 nt, Human
aagucaggacuuaugcuaccug

SEQ ID NO: 895059 - RNA, 22 nt, Human
aguggcaguaacauuccacaau

SEQ ID NO: 895060 - RNA, 22 nt, Human
gauauuuucauucggaugcuca

SEQ ID NO: 895061 - RNA, 22 nt, Human
cucugggcuucaagucagauuu

SEQ ID NO: 895062 - RNA, 22 nt, Human
aggcauggacauuucggcagcu

SEQ ID NO: 895063 - RNA, 22 nt, Human
uagacauuugucaagaaugacu

SEQ ID NO: 895064 - RNA, 22 nt, Human
aaaagagaauccuguacagaga

SEQ ID NO: 895065 - RNA, 22 nt, Human
uccagcaaagugauaggauuuc

SEQ ID NO: 895066 - RNA, 22 nt, Human
uuuuauguuccucuuuaugcga

SEQ ID NO: 895067 - RNA, 22 nt, Human
acagccagaucugagagaucuu

SEQ ID NO: 895068 - RNA, 19 nt, Human
aaccaggacaaggggcugg

SEQ ID NO: 895069 - RNA, 22 nt, Human
ucucugugcccaguaguucucu

SEQ ID NO: 895070 - RNA, 22 nt, Human
aagagggcucgauuuggcaaaa

SEQ ID NO: 895071 - RNA, 22 nt, Human
uucucuaauggugaugauuaga

SEQ ID NO: 895072 - RNA, 22 nt, Human
uccuggcacccuuggguuggag

SEQ ID NO: 895073 - RNA, 22 nt, Human
cagacaugauguaagcagaggc

SEQ ID NO: 895074 - RNA, 22 nt, Human
aaacauucaaagcaggaugugu

SEQ ID NO: 895075 - RNA, 22 nt, Human
uuccugggcugcagagagcacc

SEQ ID NO: 895076 - RNA, 22 nt, Human
aggcacaggaacaggaaaagag

SEQ ID NO: 895077 - RNA, 22 nt, Human
acacaguaguuugucauugcua

SEQ ID NO: 895078 - RNA, 22 nt, Human
ggccugagucccaccuggcugu

SEQ ID NO: 895079 - RNA, 22 nt, Human
aucagaagaaauggaugugacu

SEQ ID NO: 895080 - RNA, 22 nt, Human
aguggcuggacgacaaggguga

SEQ ID NO: 895081 - RNA, 22 nt, Human
uuuucuucuaccugcuguccaa

SEQ ID NO: 895082 - RNA, 22 nt, Human
acccuggacaucuugucauagc

SEQ ID NO: 895083 - RNA, 22 nt, Human
uacagaaagggaugauugaucu

SEQ ID NO: 895084 - RNA, 22 nt, Human
auucaaaguaauaaccagaacu

SEQ ID NO: 895085 - RNA, 22 nt, Human
caggugggagcggagacugauu

SEQ ID NO: 895086 - RNA, 22 nt, Human
ugaugacaauguugcugcaaua

SEQ ID NO: 895087 - RNA, 21 nt, Human
ugcacagggcccaggagagcc

SEQ ID NO: 895088 - RNA, 22 nt, Human
aguacaaguagaaugcuacaag

SEQ ID NO: 895089 - RNA, 18 nt, Human
ggugccaagucugggauc

SEQ ID NO: 895090 - RNA, 22 nt, Human
ucugaagaacugucuagagaac

SEQ ID NO: 895091 - RNA, 22 nt, Human
agagaugaaaaguggagacugg

SEQ ID NO: 895092 - RNA, 22 nt, Human
aagacauugucauuuuauaauu

SEQ ID NO: 895093 - RNA, 22 nt, Human
caguucuaauuaauaggaguaa

SEQ ID NO: 895094 - RNA, 22 nt, Human
ugggacugcucuugcugggguc

SEQ ID NO: 895095 - RNA, 22 nt, Human
guggcagaaacuggcagaggag

SEQ ID NO: 895096 - RNA, 22 nt, Human
gucuacaaagcauauaaaagag

SEQ ID NO: 895097 - RNA, 22 nt, Human
ugccaggcuuuggucaaaggcu

SEQ ID NO: 895098 - RNA, 22 nt, Human
caacuucacugugccucuaguu

SEQ ID NO: 895099 - RNA, 22 nt, Human
aagucuuacagacaagcugaag

SEQ ID NO: 895100 - RNA, 22 nt, Human
gccugggagauuaauuaggaag

SEQ ID NO: 895101 - RNA, 22 nt, Human
cacagcugaaguagccaugugg

SEQ ID NO: 895102 - RNA, 22 nt, Human
caucauuuuauuaaccaagaaa

SEQ ID NO: 895103 - RNA, 22 nt, Human
aagcuuuucucuguauuaccug

SEQ ID NO: 895104 - RNA, 22 nt, Human
gcagagaaggauugaaaccaga

SEQ ID NO: 895105 - RNA, 22 nt, Human
uucagugccuguccacagcuuc

SEQ ID NO: 895106 - RNA, 22 nt, Human
aaaguucuuucucuuauuuggu

SEQ ID NO: 895107 - RNA, 19 nt, Human
uugagcagugcuuagcacc

SEQ ID NO: 895108 - RNA, 22 nt, Human
uugaaagaggcaaaguuugauc

SEQ ID NO: 895109 - RNA, 22 nt, Human
gguguccucaugauuuucuaga

SEQ ID NO: 895110 - RNA, 22 nt, Human
cccugccucugaagcugcucag

SEQ ID NO: 895111 - RNA, 22 nt, Human
uaagaugucauccacauagagu

SEQ ID NO: 895112 - RNA, 22 nt, Human
uggcugcagugcuugagauguc

SEQ ID NO: 895113 - RNA, 22 nt, Human
ggccaccugggaucucauccug

SEQ ID NO: 895114 - RNA, 19 nt, Human
gcucaacagcucggguccu

SEQ ID NO: 895115 - RNA, 22 nt, Human
aucgaugcugacuucuuguuau

SEQ ID NO: 895116 - RNA, 22 nt, Human
uagcccagagucccaauuccag

SEQ ID NO: 895117 - RNA, 22 nt, Human
uccuggguagagaccugaugaa

SEQ ID NO: 895118 - RNA, 22 nt, Human
agacagacagagaauuuaaaua

SEQ ID NO: 895119 - RNA, 22 nt, Human
caggcacuguguuaggcacugu

SEQ ID NO: 895120 - RNA, 22 nt, Human
aauagaauuuaaaugcaguggc

SEQ ID NO: 895121 - RNA, 22 nt, Human
uggacaggggcugcuguuguca

SEQ ID NO: 895122 - RNA, 22 nt, Human
aucauucaagugcucuaaaaug

SEQ ID NO: 895123 - RNA, 22 nt, Human
cuggcucugagcccaccuccag

SEQ ID NO: 895124 - RNA, 22 nt, Human
uuuguuuaucaaggucuagcau

SEQ ID NO: 895125 - RNA, 22 nt, Human
ucuacaguagaaagaucccagu

SEQ ID NO: 895126 - RNA, 22 nt, Human
gccuguucugcccugagagccu

SEQ ID NO: 895127 - RNA, 22 nt, Human
aguugaaauuaagagagaguuu

SEQ ID NO: 895128 - RNA, 22 nt, Human
aggccuggcuuugguuugcuga

SEQ ID NO: 895129 - RNA, 22 nt, Human
ggugaccucaccuggucccacc

SEQ ID NO: 895130 - RNA, 22 nt, Human
aagaaguuaaauaaauggacca

SEQ ID NO: 895131 - RNA, 22 nt, Human
guuucacaugaaacuuggggaa

SEQ ID NO: 895132 - RNA, 22 nt, Human
uaggcauuauuuuaccacgguc

SEQ ID NO: 895133 - RNA, 22 nt, Human
ggccugggcccacugucaagag

SEQ ID NO: 895134 - RNA, 22 nt, Human
ucuguucuuccuacauucacau

SEQ ID NO: 895135 - RNA, 22 nt, Human
uuauagaacgguucugugcaaa

SEQ ID NO: 895136 - RNA, 22 nt, Human
acccagagugucugucucaguc

SEQ ID NO: 895137 - RNA, 22 nt, Human
ggcuucuggugggagcaugacu

SEQ ID NO: 895138 - RNA, 22 nt, Human
uuauuaauacaugcaccugcau

SEQ ID NO: 895139 - RNA, 22 nt, Human
cuuccuugcggccccugccuag

SEQ ID NO: 895140 - RNA, 22 nt, Human
cagagggacaguaugaugaaag

SEQ ID NO: 895141 - RNA, 22 nt, Human
agguuucugcaauguguguaca

SEQ ID NO: 895142 - RNA, 22 nt, Human
acaguauauauagucuaaaagc

SEQ ID NO: 895143 - RNA, 22 nt, Human
ucuucagagauguaacauaugg

SEQ ID NO: 895144 - RNA, 22 nt, Human
acaguaccugcucucaagcaaa

SEQ ID NO: 895145 - RNA, 22 nt, Human
uccaccaugauuuagcacuggc

SEQ ID NO: 895146 - RNA, 22 nt, Human
gcagaggucucuucaaaauaau

SEQ ID NO: 895147 - RNA, 22 nt, Human
auccauuuccuccacuauaaag

SEQ ID NO: 895148 - RNA, 22 nt, Human
gaauaaucauaucgucucacau

SEQ ID NO: 895149 - RNA, 22 nt, Human
gggagagaauuauugccagacc

SEQ ID NO: 895150 - RNA, 22 nt, Human
cauugaaaauguugcaggcugu

SEQ ID NO: 895151 - RNA, 21 nt, Human
cacauugaauacagagaugga

SEQ ID NO: 895152 - RNA, 22 nt, Human
ugagcuccggcauauggaauua

SEQ ID NO: 895153 - RNA, 22 nt, Human
ugaugugauagaaagguagugg

SEQ ID NO: 895154 - RNA, 20 nt, Human
auccaucagagaaaauaaag

SEQ ID NO: 895155 - RNA, 22 nt, Human
uuagacaucagugcuucucagc

SEQ ID NO: 895156 - RNA, 22 nt, Human
acaggaaccaggcaggucgauu

SEQ ID NO: 895157 - RNA, 22 nt, Human
uucuuguuuauuaagauauaaa

SEQ ID NO: 895158 - RNA, 19 nt, Human
uggcagggagaguuugaag

SEQ ID NO: 895159 - RNA, 22 nt, Human
uaggcucagggcugggugacgg

SEQ ID NO: 895160 - RNA, 22 nt, Human
aagaggcuuucagugaacuugu

SEQ ID NO: 895161 - RNA, 21 nt, Human
acagagccgggcacaaagcug

SEQ ID NO: 895162 - RNA, 22 nt, Human
agcaggcaguguagagccuuca

SEQ ID NO: 895163 - RNA, 22 nt, Human
uuuuggaugagcccagauuucu

SEQ ID NO: 895164 - RNA, 22 nt, Human
uuuaccaaaguacucugaggca

SEQ ID NO: 895165 - RNA, 22 nt, Human
uucuucugaaacauaaucaaua

SEQ ID NO: 895166 - RNA, 22 nt, Human
acagggcaaccucugggagacu

SEQ ID NO: 895167 - RNA, 22 nt, Human
caguuucuguuuuaaauagcag

SEQ ID NO: 895168 - RNA, 22 nt, Human
acaaacugaauggguuuucugu

SEQ ID NO: 895169 - RNA, 19 nt, Human
ccaggccugcgggcguugg

SEQ ID NO: 895170 - RNA, 22 nt, Human
gggccacggaaggaccaguggg

SEQ ID NO: 895171 - RNA, 22 nt, Human
caguggaugucucauaguguga

SEQ ID NO: 895172 - RNA, 22 nt, Human
gugcuggcuggggcaucaggca

SEQ ID NO: 895173 - RNA, 18 nt, Human
agauuuugagaaauacaa

SEQ ID NO: 895174 - RNA, 22 nt, Human
aaugaaugaaccacauauaaca

SEQ ID NO: 895175 - RNA, 22 nt, Human
gcaccacaucaaugaggggagc

SEQ ID NO: 895176 - RNA, 22 nt, Human
uuuccucuaaacgcauuugcuu

SEQ ID NO: 895177 - RNA, 22 nt, Human
ggccugagcagacagcaugaug

SEQ ID NO: 895178 - RNA, 22 nt, Human
ugcugcagaucagcugaguccu

SEQ ID NO: 895179 - RNA, 22 nt, Human
cugcuguguugccagugucacc

SEQ ID NO: 895180 - RNA, 22 nt, Human
aauauguucaaaauagaucacu

SEQ ID NO: 895181 - RNA, 22 nt, Human
ugaaaucuccucuuuauauauc

SEQ ID NO: 895182 - RNA, 22 nt, Human
auguauguuuucaguuguauua

SEQ ID NO: 895183 - RNA, 22 nt, Human
uccgaggccaaagcugugaaua

SEQ ID NO: 895184 - RNA, 22 nt, Human
uccauaggaucugcuucauacu

SEQ ID NO: 895185 - RNA, 22 nt, Human
cagcuacagaggccacauggcu

SEQ ID NO: 895186 - RNA, 22 nt, Human
aacaugcaugaagaaguuauau

SEQ ID NO: 895187 - RNA, 22 nt, Human
caauagauguuuuugcuuacca

SEQ ID NO: 895188 - RNA, 20 nt, Human
caccuggauaugacccagcu

SEQ ID NO: 895189 - RNA, 19 nt, Human
gccucugcuggggacaggc

SEQ ID NO: 895190 - RNA, 23 nt, Human
ccagccucugggucuucauccag

SEQ ID NO: 895191 - RNA, 22 nt, Human
ggaggagagagguugcaaacac

SEQ ID NO: 895192 - RNA, 22 nt, Human
agacaauuucaaaguaauauua

SEQ ID NO: 895193 - RNA, 22 nt, Human
uacagauaaaaaugcuguucuu

SEQ ID NO: 895194 - RNA, 22 nt, Human
acagguggacacagcagcaguc

SEQ ID NO: 895195 - RNA, 22 nt, Human
ccagaacagaccugccugaccu

SEQ ID NO: 895196 - RNA, 22 nt, Human
uguacacaauucuuaacauaca

SEQ ID NO: 895197 - RNA, 22 nt, Human
ucaugcugaguccuggcuuugu

SEQ ID NO: 895198 - RNA, 22 nt, Human
gacaggaaacaagaaggcagga

SEQ ID NO: 895199 - RNA, 22 nt, Human
uaugcauauguguucauuggag

SEQ ID NO: 895200 - RNA, 22 nt, Human
ugggagcagcagggagaugcgg

SEQ ID NO: 895201 - RNA, 22 nt, Human
gagacacacccaagguuaugag

SEQ ID NO: 895202 - RNA, 22 nt, Human
agacagacuguguuugaauccu

SEQ ID NO: 895203 - RNA, 22 nt, Human
gcaggggaguccacucuaugca

SEQ ID NO: 895204 - RNA, 22 nt, Human
cccuugggugccagccacaagu

SEQ ID NO: 895205 - RNA, 22 nt, Human
acauguuuugugccuugacuag

SEQ ID NO: 895206 - RNA, 19 nt, Human
ugucuuaauuaacucagag

SEQ ID NO: 895207 - RNA, 22 nt, Human
uuuccugagccagaguuucauu

SEQ ID NO: 895208 - RNA, 20 nt, Human
aggcagcugggaaaugaggg

SEQ ID NO: 895209 - RNA, 22 nt, Human
ugggagagagaauucccagugg

SEQ ID NO: 895210 - RNA, 22 nt, Human
acccuggguucccgcagcacca

SEQ ID NO: 895211 - RNA, 22 nt, Human
cacacagacagcucucugaaga

SEQ ID NO: 895212 - RNA, 19 nt, Human
cugaggugaggggcaucau

SEQ ID NO: 895213 - RNA, 22 nt, Human
uauuugguggcugauuaucuuu

SEQ ID NO: 895214 - RNA, 23 nt, Human
auagaccauugucucacacuuca

SEQ ID NO: 895215 - RNA, 22 nt, Human
gagcuccagggaacagcagcua

SEQ ID NO: 895216 - RNA, 22 nt, Human
aaauagcacagcagcugaggcu

SEQ ID NO: 895217 - RNA, 22 nt, Human
aauucugaggagggaagaggaa

SEQ ID NO: 895218 - RNA, 22 nt, Human
uacuuguuaaaauauuagcuau

SEQ ID NO: 895219 - RNA, 22 nt, Human
gagcagcugguaggugaaccca

SEQ ID NO: 895220 - RNA, 22 nt, Human
aaaguacugaugccaucagcac

SEQ ID NO: 895221 - RNA, 19 nt, Human
ccacagagcaugcugaggc

SEQ ID NO: 895222 - RNA, 22 nt, Human
cccagagcucagugugcaaggu

SEQ ID NO: 895223 - RNA, 22 nt, Human
cuucuucuuuugugggugguaa

SEQ ID NO: 895224 - RNA, 22 nt, Human
cgucuucacauccuucccaugg

SEQ ID NO: 895225 - RNA, 19 nt, Human
cucuuacagaauagacaca

SEQ ID NO: 895226 - RNA, 22 nt, Human
gcaugucuguaauuacagagcc

SEQ ID NO: 895227 - RNA, 22 nt, Human
uggcuccuuuccagccugguuu

SEQ ID NO: 895228 - RNA, 22 nt, Human
ggccuuaggcucaacaggcaga

SEQ ID NO: 895229 - RNA, 22 nt, Human
ucagggcacugucaccugauau

SEQ ID NO: 895230 - RNA, 22 nt, Human
cacugccuucaccugcccuauc

SEQ ID NO: 895231 - RNA, 22 nt, Human
cuugucugcuauaaaaauccag

SEQ ID NO: 895232 - RNA, 22 nt, Human
aagacagagacucugcaacagg

SEQ ID NO: 895233 - RNA, 22 nt, Human
acagcagacagucggcuuccug

SEQ ID NO: 895234 - RNA, 22 nt, Human
gaggacucugcaggcugcuccu

SEQ ID NO: 895235 - RNA, 22 nt, Human
ugucuccauagaagagacugca

SEQ ID NO: 895236 - RNA, 22 nt, Human
aaaggagacuucagaucuccuu

SEQ ID NO: 895237 - RNA, 22 nt, Human
uaaacuguggaauguucucuuu

SEQ ID NO: 895238 - RNA, 22 nt, Human
guggcaggagagacacagccau

SEQ ID NO: 895239 - RNA, 22 nt, Human
gauuuguuucaaguuagcaucu

SEQ ID NO: 895240 - RNA, 22 nt, Human
ccaggagcuggagggugcagug

SEQ ID NO: 895241 - RNA, 22 nt, Human
augcuuuacccacaccaggaug

SEQ ID NO: 895242 - RNA, 22 nt, Human
aauccacacaucuggcauguga

SEQ ID NO: 895243 - RNA, 22 nt, Human
gggggcugaggcuguucugagg

SEQ ID NO: 895244 - RNA, 22 nt, Human
agagcuuuuacuuacauucuau

SEQ ID NO: 895245 - RNA, 22 nt, Human
ggcaaggggucaggcugagaca

SEQ ID NO: 895246 - RNA, 22 nt, Human
ccaggcaacggagcccacugcc

SEQ ID NO: 895247 - RNA, 22 nt, Human
cccaagaucuuucgugcacuaa

SEQ ID NO: 895248 - RNA, 22 nt, Human
aagcaauacaaguggucauuga

SEQ ID NO: 895249 - RNA, 22 nt, Human
agguauuugucucagauugggu

SEQ ID NO: 895250 - RNA, 22 nt, Human
ucacaguauuggggguggagga

SEQ ID NO: 895251 - RNA, 22 nt, Human
gugcuucuccguucugcagcac

SEQ ID NO: 895252 - RNA, 22 nt, Human
cccaggagagaggccaguuggc

SEQ ID NO: 895253 - RNA, 22 nt, Human
gggccaagggugcguggcagga

SEQ ID NO: 895254 - RNA, 20 nt, Human
ugcagggcucugcuucucuc

SEQ ID NO: 895255 - RNA, 22 nt, Human
cccagacauaacagcagagagg

SEQ ID NO: 895256 - RNA, 22 nt, Human
ggugagacuuuagaagagccag

SEQ ID NO: 895257 - RNA, 22 nt, Human
agaaguuugguccuuuucaagg

SEQ ID NO: 895258 - RNA, 22 nt, Human
auguuuuuaaauagacuuacag

SEQ ID NO: 895259 - RNA, 22 nt, Human
cauaauuucuguaucagcacca

SEQ ID NO: 895260 - RNA, 22 nt, Human
ugaggccauggucuucccaguc

SEQ ID NO: 895261 - RNA, 22 nt, Human
ucauguguguuucauguaugga

SEQ ID NO: 895262 - RNA, 22 nt, Human
uugauuugauuguaauggcucu

SEQ ID NO: 895263 - RNA, 22 nt, Human
aucgaggagaguugguuuguuu

SEQ ID NO: 895264 - RNA, 22 nt, Human
cgucaucacggcaagcaucucc

SEQ ID NO: 895265 - RNA, 22 nt, Human
agcaagauuuaaacccagguca

SEQ ID NO: 895266 - RNA, 23 nt, Human
accaggagaaaagcuuugcggga

SEQ ID NO: 895267 - RNA, 22 nt, Human
uucagugugaagcuucugaaag

SEQ ID NO: 895268 - RNA, 22 nt, Human
agaacaaugcguauuuuacucc

SEQ ID NO: 895269 - RNA, 22 nt, Human
aaaucagaugcuuccuaguugg

SEQ ID NO: 895270 - RNA, 22 nt, Human
gugucauggaaaauugcaaugg

SEQ ID NO: 895271 - RNA, 22 nt, Human
aucuaagaguuaacaucaagaa

SEQ ID NO: 895272 - RNA, 22 nt, Human
acaguguacuccuuuaccggag

SEQ ID NO: 895273 - RNA, 22 nt, Human
ucaggugaccugagccacuaug

SEQ ID NO: 895274 - RNA, 22 nt, Human
cagagaggauggauuccauagc

SEQ ID NO: 895275 - RNA, 22 nt, Human
aaacaggcuuuuaagucaauag

SEQ ID NO: 895276 - RNA, 22 nt, Human
cccugccuugggguccacaccg

SEQ ID NO: 895277 - RNA, 22 nt, Human
cugaagggucuggggcugugcc

SEQ ID NO: 895278 - RNA, 22 nt, Human
ggagcugcucagagccaguccc

SEQ ID NO: 895279 - RNA, 22 nt, Human
uaaucuguuaauauuuguaucc

SEQ ID NO: 895280 - RNA, 22 nt, Human
accacugcccauggugaaaacu

SEQ ID NO: 895281 - RNA, 22 nt, Human
gccccuucuucuggagauucaa

SEQ ID NO: 895282 - RNA, 22 nt, Human
aaucuuaaagaauauucuacca

SEQ ID NO: 895283 - RNA, 22 nt, Human
gauucaaaaguuugagcuccaa

SEQ ID NO: 895284 - RNA, 21 nt, Human
gacucuggggucagcucaacc

SEQ ID NO: 895285 - RNA, 22 nt, Human
caggccucuauggucagcugag

SEQ ID NO: 895286 - RNA, 22 nt, Human
caguuuuauacacugcagcucc

SEQ ID NO: 895287 - RNA, 22 nt, Human
auuagcuaggaaauuuuguguc

SEQ ID NO: 895288 - RNA, 22 nt, Human
agaauucuuggugguuagaaua

SEQ ID NO: 895289 - RNA, 22 nt, Human
ugccacagaggugaagcccacu

SEQ ID NO: 895290 - RNA, 22 nt, Human
aguguauuugccuauaaaaaug

SEQ ID NO: 895291 - RNA, 21 nt, Human
agaggucauugggcugguucu

SEQ ID NO: 895292 - RNA, 22 nt, Human
gucugaggcgaggccugagaac

SEQ ID NO: 895293 - RNA, 21 nt, Human
agacagcagauagucgaaagg

SEQ ID NO: 895294 - RNA, 22 nt, Human
ugguaagggguggaaccagagc

SEQ ID NO: 895295 - RNA, 22 nt, Human
aggcaggagugacccugacagg

SEQ ID NO: 895296 - RNA, 22 nt, Human
aggaaaaaccuguuaaugguag

SEQ ID NO: 895297 - RNA, 22 nt, Human
caggaagagaacauggaggcug

SEQ ID NO: 895298 - RNA, 22 nt, Human
aucuauuuuaaauggcaguaaa

SEQ ID NO: 895299 - RNA, 19 nt, Human
gccaggagggcucuggcug

SEQ ID NO: 895300 - RNA, 22 nt, Human
ccugccuguaagauggguacaa

SEQ ID NO: 895301 - RNA, 22 nt, Human
agcagggcugcagugugucuuu

SEQ ID NO: 895302 - RNA, 22 nt, Human
ugacacccucuccuggagagag

SEQ ID NO: 895303 - RNA, 22 nt, Human
ucugccugaaauucacauguaa

SEQ ID NO: 895304 - RNA, 22 nt, Human
guauacaauacacaaugcucug

SEQ ID NO: 895305 - RNA, 22 nt, Human
agggccagcugcagaauuagca

SEQ ID NO: 895306 - RNA, 22 nt, Human
ccugaggacagugugaccaugg

SEQ ID NO: 895307 - RNA, 22 nt, Human
cuucuucagaggccagccucug

SEQ ID NO: 895308 - RNA, 22 nt, Human
ugcaccuuuuagaagucauuuu

SEQ ID NO: 895309 - RNA, 22 nt, Human
ugcagaaauaacucauauugca

SEQ ID NO: 895310 - RNA, 22 nt, Human
aagaacaacugcuuuaaaagca

SEQ ID NO: 895311 - RNA, 22 nt, Human
ucuaagaucuacuauacaugug

SEQ ID NO: 895312 - RNA, 22 nt, Human
aguuguaaauucauagcuuaua

SEQ ID NO: 895313 - RNA, 22 nt, Human
ugcacaggugguccaucugcac

SEQ ID NO: 895314 - RNA, 22 nt, Human
aaauguuccauuauuguguaau

SEQ ID NO: 895315 - RNA, 22 nt, Human
agagacagacacaucgggcugc

SEQ ID NO: 895316 - RNA, 22 nt, Human
cuucuaggucuugauugaaugu

SEQ ID NO: 895317 - RNA, 22 nt, Human
acagcucugagauauuacuauu

SEQ ID NO: 895318 - RNA, 22 nt, Human
ugucuucagaauuaagaguaug

SEQ ID NO: 895319 - RNA, 22 nt, Human
uaaaugaaaggguuuaauuuau

SEQ ID NO: 895320 - RNA, 22 nt, Human
uucugcucugacuugcaaggaa

SEQ ID NO: 895321 - RNA, 22 nt, Human
cgcaggcaagagaguacaguua

SEQ ID NO: 895322 - RNA, 22 nt, Human
guuaacaagaauuacucuggaa

SEQ ID NO: 895323 - RNA, 23 nt, Human
uggcagcagaucuuaaagugacc

SEQ ID NO: 895324 - RNA, 22 nt, Human
augcaccccagaagcugcagug

SEQ ID NO: 895325 - RNA, 22 nt, Human
aucuauacccaucaugauuuaa

SEQ ID NO: 895326 - RNA, 22 nt, Human
ugccagcucccuuuucuccucc

SEQ ID NO: 895327 - RNA, 22 nt, Human
cagacauccagguacgagcuuu

SEQ ID NO: 895328 - RNA, 22 nt, Human
gguggcagggagugucccuggg

SEQ ID NO: 895329 - RNA, 23 nt, Human
cucugggcgggcaggucagccuc

SEQ ID NO: 895330 - RNA, 22 nt, Human
gaugacacuugugagaaaucaa

SEQ ID NO: 895331 - RNA, 22 nt, Human
acaagaauguagauuaguuaag

SEQ ID NO: 895332 - RNA, 23 nt, Human
auggggcucaacacuuaguagcu

SEQ ID NO: 895333 - RNA, 22 nt, Human
ugcuguguaaaaggugauugaa

SEQ ID NO: 895334 - RNA, 22 nt, Human
gcauggcuuccaaaagugcuaa

SEQ ID NO: 895335 - RNA, 22 nt, Human
cagggcuggauccuccagacuc

SEQ ID NO: 895336 - RNA, 22 nt, Human
cucaggauggaagccuacagga

SEQ ID NO: 895337 - RNA, 22 nt, Human
aguuggcagucugcaaccugga

SEQ ID NO: 895338 - RNA, 22 nt, Human
agcagugaugcaugacagccua

SEQ ID NO: 895339 - RNA, 22 nt, Human
agaaauacuaggaauauucaua

SEQ ID NO: 895340 - RNA, 20 nt, Human
agcuacaaugcgaagcuggc

SEQ ID NO: 895341 - RNA, 22 nt, Human
ccugggucuguauugguaggua

SEQ ID NO: 895342 - RNA, 22 nt, Human
acaggcugggcgcuuccugcgg

SEQ ID NO: 895343 - RNA, 18 nt, Human
uugauaaacaauuucauu

SEQ ID NO: 895344 - RNA, 22 nt, Human
acucagaaccauuuacucugag

SEQ ID NO: 895345 - RNA, 22 nt, Human
cugaggagugggugggcaguga

SEQ ID NO: 895346 - RNA, 22 nt, Human
ugacaaauucauauuucagagg

SEQ ID NO: 895347 - RNA, 22 nt, Human
ucacauacugaaaguccaguga

SEQ ID NO: 895348 - RNA, 22 nt, Human
auaacagacuuagaguuacaag

SEQ ID NO: 895349 - RNA, 22 nt, Human
uuagaagcacuaauuacucaca

SEQ ID NO: 895350 - RNA, 22 nt, Human
ggucacacaccaggaccugcag

SEQ ID NO: 895351 - RNA, 22 nt, Human
uagguacuuaagaucucagcua

SEQ ID NO: 895352 - RNA, 22 nt, Human
cagagcacugcuuggaggauuu

SEQ ID NO: 895353 - RNA, 22 nt, Human
uggcccagcacuccaaguaggg

SEQ ID NO: 895354 - RNA, 22 nt, Human
ucucuguguucccuguuuucuc

SEQ ID NO: 895355 - RNA, 22 nt, Human
auuguacaugcagugagucauc

SEQ ID NO: 895356 - RNA, 22 nt, Human
agucuucuuucauuuacucagu

SEQ ID NO: 895357 - RNA, 23 nt, Human
cugauuugagcagaauaaaauag

SEQ ID NO: 895358 - RNA, 20 nt, Human
ucuccagaugcagaugacau

SEQ ID NO: 895359 - RNA, 22 nt, Human
cacauuucauuggcuuacguaa

SEQ ID NO: 895360 - RNA, 22 nt, Human
cagaaugaguagcaucuucacc

SEQ ID NO: 895361 - RNA, 22 nt, Human
ucagggccugagcuuuuaauua

SEQ ID NO: 895362 - RNA, 22 nt, Human
ugcaagaaagguggggccaggc

SEQ ID NO: 895363 - RNA, 22 nt, Human
uagaacaugggauagaguuuuu

SEQ ID NO: 895364 - RNA, 22 nt, Human
uuaucguaucucuuggucuuca

SEQ ID NO: 895365 - RNA, 22 nt, Human
ccuccaggcugguuaucagcug

SEQ ID NO: 895366 - RNA, 22 nt, Human
uuucugaaaucucuuuugagga

SEQ ID NO: 895367 - RNA, 22 nt, Human
ucuguccaguggcucucaggga

SEQ ID NO: 895368 - RNA, 22 nt, Human
aagccuugauucacucugugga

SEQ ID NO: 895369 - RNA, 22 nt, Human
auauuaagaugcuauugguuuu

SEQ ID NO: 895370 - RNA, 22 nt, Human
aauuccucuaucuuucuucaag

SEQ ID NO: 895371 - RNA, 22 nt, Human
caggaaauuggcuauuugggau

SEQ ID NO: 895372 - RNA, 22 nt, Human
uaguacagagacacuggaggaa

SEQ ID NO: 895373 - RNA, 22 nt, Human
gcucugagauugagccuuuggu

SEQ ID NO: 895374 - RNA, 22 nt, Human
acaucauuguccguugucauga

SEQ ID NO: 895375 - RNA, 20 nt, Human
agaggcuuucuuguagucag

SEQ ID NO: 895376 - RNA, 23 nt, Human
aggagaagagauuuccacaugca

SEQ ID NO: 895377 - RNA, 22 nt, Human
augcacagauccuggcacuuag

SEQ ID NO: 895378 - RNA, 22 nt, Human
gcugcugucucaugcgaugcgg

SEQ ID NO: 895379 - RNA, 21 nt, Human
gucacacaggccuggagcuga

SEQ ID NO: 895380 - RNA, 22 nt, Human
ucugagagcaaggcauuagcag

SEQ ID NO: 895381 - RNA, 22 nt, Human
uuuacagcuagacauaccugag

SEQ ID NO: 895382 - RNA, 17 nt, Human
ugcuggaggcgggguau

SEQ ID NO: 895383 - RNA, 22 nt, Human
cuggagggagauucaaaggagg

SEQ ID NO: 895384 - RNA, 22 nt, Human
gcuccaggguggaugacaauuc

SEQ ID NO: 895385 - RNA, 22 nt, Human
acugggcaccaucaugagaugg

SEQ ID NO: 895386 - RNA, 22 nt, Human
aagauucuuugaggauuuuacu

SEQ ID NO: 895387 - RNA, 22 nt, Human
gucuuauuaaauugaacccuca

SEQ ID NO: 895388 - RNA, 22 nt, Human
cagaaaggcacccacugggucu

SEQ ID NO: 895389 - RNA, 22 nt, Human
ucugugugcccaccugacaccu

SEQ ID NO: 895390 - RNA, 22 nt, Human
uggugagaccuuguuccuuaug

SEQ ID NO: 895391 - RNA, 22 nt, Human
gccugucugcagggcugucauu

SEQ ID NO: 895392 - RNA, 22 nt, Human
agaggcuuggccucaguucugu

SEQ ID NO: 895393 - RNA, 22 nt, Human
ggaagacaagcaguggcugagc

SEQ ID NO: 895394 - RNA, 22 nt, Human
acacauguuuccaaaagcaccc

SEQ ID NO: 895395 - RNA, 20 nt, Human
gcaaaauaggcucuguuggu

SEQ ID NO: 895396 - RNA, 22 nt, Human
uaucuacaggugucagguaaga

SEQ ID NO: 895397 - RNA, 20 nt, Human
aguccaaagccuguuuacuu

SEQ ID NO: 895398 - RNA, 22 nt, Human
cugugugugcuacaggcuucca

SEQ ID NO: 895399 - RNA, 22 nt, Human
caaacucucccacucacucuga

SEQ ID NO: 895400 - RNA, 22 nt, Human
agaggaagccauugcuuacuga

SEQ ID NO: 895401 - RNA, 22 nt, Human
auguuuuacccuuugcacaaac

SEQ ID NO: 895402 - RNA, 22 nt, Human
ugaggccucugugccauccagg

SEQ ID NO: 895403 - RNA, 22 nt, Human
gucugcccucacgccagcuggg

SEQ ID NO: 895404 - RNA, 22 nt, Human
cauaaucagauguguacauaag

SEQ ID NO: 895405 - RNA, 22 nt, Human
cuccugcaugcucacauaugcc

SEQ ID NO: 895406 - RNA, 22 nt, Human
ucuuccugcuuggugugucugg

SEQ ID NO: 895407 - RNA, 22 nt, Human
ucuagaaaaccaauauuacaug

SEQ ID NO: 895408 - RNA, 22 nt, Human
aaccaacauaggaaugcagaga

SEQ ID NO: 895409 - RNA, 22 nt, Human
gagugaggcuggaaucauggcu

SEQ ID NO: 895410 - RNA, 22 nt, Human
agaaagacaaaaugcaguggcu

SEQ ID NO: 895411 - RNA, 22 nt, Human
caggaaaaugucaauggaaagc

SEQ ID NO: 895412 - RNA, 22 nt, Human
cagcucucacacuuagcuucua

SEQ ID NO: 895413 - RNA, 22 nt, Human
ugcaucuggccuuugcuggcua

SEQ ID NO: 895414 - RNA, 22 nt, Human
gcaggccugucuugcucgcccu

SEQ ID NO: 895415 - RNA, 20 nt, Human
gccucagucacauggccuac

SEQ ID NO: 895416 - RNA, 22 nt, Human
aaaggucuugucuugacagagu

SEQ ID NO: 895417 - RNA, 22 nt, Human
ugcuucucagccugucuggaaa

SEQ ID NO: 895418 - RNA, 18 nt, Human
gaaaggagagacaguagg

SEQ ID NO: 895419 - RNA, 22 nt, Human
uagaaccaccuucuccuuuacc

SEQ ID NO: 895420 - RNA, 22 nt, Human
ugccacagagacuuucauugua

SEQ ID NO: 895421 - RNA, 19 nt, Human
uuggaaggagccagagugg

SEQ ID NO: 895422 - RNA, 20 nt, Human
ugcacacacccuguccucca

SEQ ID NO: 895423 - RNA, 22 nt, Human
aaauaacuugguuucaucagag

SEQ ID NO: 895424 - RNA, 22 nt, Human
aacaguggggaaaagaguuggu

SEQ ID NO: 895425 - RNA, 22 nt, Human
agucagagaaaacagcccugug

SEQ ID NO: 895426 - RNA, 22 nt, Human
cagcauaggauguggagccagg

SEQ ID NO: 895427 - RNA, 22 nt, Human
augcuguccacucuugguguuu

SEQ ID NO: 895428 - RNA, 22 nt, Human
acaugcaucuccaggcucauuu

SEQ ID NO: 895429 - RNA, 19 nt, Human
ccugaguguuucagagaca

SEQ ID NO: 895430 - RNA, 22 nt, Human
auguaguauuuggaaauguaaa

SEQ ID NO: 895431 - RNA, 22 nt, Human
uuauuuccacaaugugguaggg

SEQ ID NO: 895432 - RNA, 22 nt, Human
ugcacaguuggcuacaucgugg

SEQ ID NO: 895433 - RNA, 22 nt, Human
cucagcuacgcuuucaccagcu

SEQ ID NO: 895434 - RNA, 22 nt, Human
ucugggaacauuuugagggcaa

SEQ ID NO: 895435 - RNA, 22 nt, Human
gcgggccaccuuggagagcgcu

SEQ ID NO: 895436 - RNA, 22 nt, Human
gaagccuugaacugcaaacccc

SEQ ID NO: 895437 - RNA, 22 nt, Human
ggagggggaagaagcuaaagac

SEQ ID NO: 895438 - RNA, 22 nt, Human
cuauuuaagaauaaaaggggca

SEQ ID NO: 895439 - RNA, 22 nt, Human
uucuuacaaguauuccaggucc

SEQ ID NO: 895440 - RNA, 22 nt, Human
cucuuuggucgcaucauccauu

SEQ ID NO: 895441 - RNA, 22 nt, Human
gccaccuccuuauuccaccugu

SEQ ID NO: 895442 - RNA, 20 nt, Human
ccucugccuuucuagucuga

SEQ ID NO: 895443 - RNA, 22 nt, Human
acagggccaauguuagcauuga

SEQ ID NO: 895444 - RNA, 22 nt, Human
acucucccacguucgacucuaa

SEQ ID NO: 895445 - RNA, 22 nt, Human
cagggcucccuugcaaggaggg

SEQ ID NO: 895446 - RNA, 19 nt, Human
ggagaagcccaggaauccu

SEQ ID NO: 895447 - RNA, 22 nt, Human
ugcccauguuucucuguauccc

SEQ ID NO: 895448 - RNA, 22 nt, Human
cugugucuuccucugcccaggc

SEQ ID NO: 895449 - RNA, 23 nt, Human
uugaaagauugcuaaguaaaaau

SEQ ID NO: 895450 - RNA, 22 nt, Human
ucaggaaauuaaacacuugaaa

SEQ ID NO: 895451 - RNA, 22 nt, Human
cuguccagugcagagaacagag

SEQ ID NO: 895452 - RNA, 22 nt, Human
ugcucacaauuaucagaaguau

SEQ ID NO: 895453 - RNA, 18 nt, Human
aagaaguuggccaaagag

SEQ ID NO: 895454 - RNA, 22 nt, Human
uucucauaaauccugagaccua

SEQ ID NO: 895455 - RNA, 22 nt, Human
cagaggaugaucuggccucucu

SEQ ID NO: 895456 - RNA, 22 nt, Human
uuagcauuucaguacacauguu

SEQ ID NO: 895457 - RNA, 22 nt, Human
guauucuugaguggcaacuagg

SEQ ID NO: 895458 - RNA, 22 nt, Human
gcuggcagacugggggcagaac

SEQ ID NO: 895459 - RNA, 22 nt, Human
uagcagcgacuaaugaauaagu

SEQ ID NO: 895460 - RNA, 22 nt, Human
agagaccaagggaauagucuca

SEQ ID NO: 895461 - RNA, 22 nt, Human
gcagcagaguuugggagauggu

SEQ ID NO: 895462 - RNA, 22 nt, Human
agucagcagugaaagcacagcc

SEQ ID NO: 895463 - RNA, 22 nt, Human
uuccugggcucuggcuggccua

SEQ ID NO: 895464 - RNA, 22 nt, Human
ucuggaagcuggaguccaggaa

SEQ ID NO: 895465 - RNA, 22 nt, Human
aaggccaggacaccaggggacu

SEQ ID NO: 895466 - RNA, 22 nt, Human
aguguucauuuauucauucacu

SEQ ID NO: 895467 - RNA, 21 nt, Human
ucuugaaaaguuagauucucu

SEQ ID NO: 895468 - RNA, 22 nt, Human
aacaaauguguuuuguaauuaa

SEQ ID NO: 895469 - RNA, 21 nt, Human
aguaucauaaugaauaguucu

SEQ ID NO: 895470 - RNA, 22 nt, Human
gucuccuggaaauaugcccaua

SEQ ID NO: 895471 - RNA, 22 nt, Human
augcacaauuaggauauagcuu

SEQ ID NO: 895472 - RNA, 22 nt, Human
uuuugcugcauugaagucagau

SEQ ID NO: 895473 - RNA, 22 nt, Human
acucacugcacuuugaaaugug

SEQ ID NO: 895474 - RNA, 22 nt, Human
ucucccagugucuggcagucag

SEQ ID NO: 895475 - RNA, 22 nt, Human
uguuuaaauagaacauacugca

SEQ ID NO: 895476 - RNA, 22 nt, Human
ugacauuucuuguugauauaaa

SEQ ID NO: 895477 - RNA, 22 nt, Human
uccauucaauucuaaagcccuu

SEQ ID NO: 895478 - RNA, 22 nt, Human
uuuucaguugugcucucuaguu

SEQ ID NO: 895479 - RNA, 22 nt, Human
aaguuuauguucuuugaaggca

SEQ ID NO: 895480 - RNA, 22 nt, Human
ggugcugguucaggguggcugu

SEQ ID NO: 895481 - RNA, 22 nt, Human
uggggagaagcaauagacucua

SEQ ID NO: 895482 - RNA, 22 nt, Human
ugggugugccauauuccauuuc

SEQ ID NO: 895483 - RNA, 22 nt, Human
cucuucuuuaguccagaccauc

SEQ ID NO: 895484 - RNA, 22 nt, Human
uagcaacagcaauagugguauu

SEQ ID NO: 895485 - RNA, 22 nt, Human
cugcugacucuuccuggaguga

SEQ ID NO: 895486 - RNA, 22 nt, Human
gaaagcuuccauuuuguacauu

SEQ ID NO: 895487 - RNA, 22 nt, Human
ucugcagagauucugggcugag

SEQ ID NO: 895488 - RNA, 18 nt, Human
ggcagccuggacaugcuc

SEQ ID NO: 895489 - RNA, 22 nt, Human
ggcuagaacuuuacacuuugca

SEQ ID NO: 895490 - RNA, 22 nt, Human
aauguuuuacagaucccauuag

SEQ ID NO: 895491 - RNA, 22 nt, Human
aaaugcucugcaucugauagac

SEQ ID NO: 895492 - RNA, 22 nt, Human
cacagagauggucuggcaggug

SEQ ID NO: 895493 - RNA, 22 nt, Human
ugggugcaggucuugugccagg

SEQ ID NO: 895494 - RNA, 22 nt, Human
gagaaagacguaggcugggagg

SEQ ID NO: 895495 - RNA, 22 nt, Human
aauucuguuacuaaugugaugu

SEQ ID NO: 895496 - RNA, 22 nt, Human
aauucacaauguguagucaugc

SEQ ID NO: 895497 - RNA, 20 nt, Human
gcaaggcuccaaggggugug

SEQ ID NO: 895498 - RNA, 22 nt, Human
acucaucuuugaauuuucagua

SEQ ID NO: 895499 - RNA, 22 nt, Human
aggcuggcuucccaagcguccu

SEQ ID NO: 895500 - RNA, 20 nt, Human
ggccugagcauggcuggcag

SEQ ID NO: 895501 - RNA, 22 nt, Human
gucuuguuggaguucuugcagc

SEQ ID NO: 895502 - RNA, 22 nt, Human
gggcaguguggucgugccuuug

SEQ ID NO: 895503 - RNA, 22 nt, Human
cagaucuguuugccagaucagc

SEQ ID NO: 895504 - RNA, 22 nt, Human
auccugggcaagucaauguccc

SEQ ID NO: 895505 - RNA, 22 nt, Human
ucagggagccuggacuucaagg

SEQ ID NO: 895506 - RNA, 22 nt, Human
guacaguagagccagguucagu

SEQ ID NO: 895507 - RNA, 23 nt, Human
accaacaagccucuggagagugg

SEQ ID NO: 895508 - RNA, 22 nt, Human
ugagcugucugaauggugagga

SEQ ID NO: 895509 - RNA, 22 nt, Human
ugccuuggugcuucuucaugug

SEQ ID NO: 895510 - RNA, 22 nt, Human
uuucuguuuagcauaaaguggc

SEQ ID NO: 895511 - RNA, 22 nt, Human
agaagucugguugcaaagcgcu

SEQ ID NO: 895512 - RNA, 22 nt, Human
ggcccagagcucccuggcaccu

SEQ ID NO: 895513 - RNA, 22 nt, Human
ucucagaaaagagcuucagaaa

SEQ ID NO: 895514 - RNA, 20 nt, Human
ugcuugucaugcacucaggc

SEQ ID NO: 895515 - RNA, 22 nt, Human
aagcagagagcagaauuaaguu

SEQ ID NO: 895516 - RNA, 22 nt, Human
uguagcaguuuuucauuaucca

SEQ ID NO: 895517 - RNA, 22 nt, Human
aaggcugagguagggccuaaaa

SEQ ID NO: 895518 - RNA, 18 nt, Human
ccucugccauagccagca

SEQ ID NO: 895519 - RNA, 22 nt, Human
uggacaguaggaagaguguggg

SEQ ID NO: 895520 - RNA, 22 nt, Human
ccuuuaugucacucuggagagc

SEQ ID NO: 895521 - RNA, 22 nt, Human
uucuuucccaguagaugugaaa

SEQ ID NO: 895522 - RNA, 22 nt, Human
ccuagcagggaagcagugagga

SEQ ID NO: 895523 - RNA, 22 nt, Human
agcuggcagucggccuugaugc

SEQ ID NO: 895524 - RNA, 22 nt, Human
aacauuagauuuguuuuucuag

SEQ ID NO: 895525 - RNA, 22 nt, Human
gaccaucuguuuaaagcagugu

SEQ ID NO: 895526 - RNA, 22 nt, Human
guacagagaagguuacauauga

SEQ ID NO: 895527 - RNA, 22 nt, Human
ggaggaagcccucggugcccca

SEQ ID NO: 895528 - RNA, 22 nt, Human
uguuaaacucguagguuaggcu

SEQ ID NO: 895529 - RNA, 19 nt, Human
agcugggcugucacaguga

SEQ ID NO: 895530 - RNA, 22 nt, Human
acagggcuuagaacuuggccuc

SEQ ID NO: 895531 - RNA, 22 nt, Human
gaggcuguguuucagugaggcc

SEQ ID NO: 895532 - RNA, 22 nt, Human
uuauucagcagggacuuccuuu

SEQ ID NO: 895533 - RNA, 22 nt, Human
caagcccuuccgggaacaguug

SEQ ID NO: 895534 - RNA, 22 nt, Human
ucaaacauaucugauuuuccau

SEQ ID NO: 895535 - RNA, 22 nt, Human
ucugugcucuucucaguaucac

SEQ ID NO: 895536 - RNA, 22 nt, Human
aauucugagaacaaaagguacu

SEQ ID NO: 895537 - RNA, 22 nt, Human
uugccauuccaggguauuaggg

SEQ ID NO: 895538 - RNA, 22 nt, Human
cagaacagggcccaaggggucg

SEQ ID NO: 895539 - RNA, 22 nt, Human
auugaucaugcagaugcuucac

SEQ ID NO: 895540 - RNA, 22 nt, Human
uucagaaaggcugugccagcca

SEQ ID NO: 895541 - RNA, 22 nt, Human
gccucagcucccagcccaggcu

SEQ ID NO: 895542 - RNA, 22 nt, Human
gauauuuacauuaagcacauug

SEQ ID NO: 895543 - RNA, 22 nt, Human
aaagacuaaacaaccaauaucu

SEQ ID NO: 895544 - RNA, 22 nt, Human
aacuuaaacccacucauguaga

SEQ ID NO: 895545 - RNA, 23 nt, Human
ugcauccucauuuuucacacgag

SEQ ID NO: 895546 - RNA, 22 nt, Human
gcugcagacugggaggcaggug

SEQ ID NO: 895547 - RNA, 22 nt, Human
aggucucacuuuguggaaguga

SEQ ID NO: 895548 - RNA, 22 nt, Human
gcugcagagugaugaagugggg

SEQ ID NO: 895549 - RNA, 23 nt, Human
cuaggcaggauuguaggcgggua

SEQ ID NO: 895550 - RNA, 22 nt, Human
ggcuuggagucauacugagaau

SEQ ID NO: 895551 - RNA, 22 nt, Human
gacagcaacacaugcuuagugc

SEQ ID NO: 895552 - RNA, 22 nt, Human
uuggcagcauuccagccaagca

SEQ ID NO: 895553 - RNA, 22 nt, Human
cucaggaggaugacugccuugg

SEQ ID NO: 895554 - RNA, 22 nt, Human
cucuucuugccugaugaggcag

SEQ ID NO: 895555 - RNA, 20 nt, Human
aguuugugugucuaugcgcu

SEQ ID NO: 895556 - RNA, 22 nt, Human
cuggcuggucaugucaugagcc

SEQ ID NO: 895557 - RNA, 22 nt, Human
cugagcagccccaccagccauu

SEQ ID NO: 895558 - RNA, 22 nt, Human
acagagaaaguuccucucaggc

SEQ ID NO: 895559 - RNA, 22 nt, Human
agggugacuuugggcaaguuac

SEQ ID NO: 895560 - RNA, 22 nt, Human
cccagcucuggaagguggggga

SEQ ID NO: 895561 - RNA, 22 nt, Human
uguggucagcuacuggucaucu

SEQ ID NO: 895562 - RNA, 22 nt, Human
aagauucugucaguuaggagga

SEQ ID NO: 895563 - RNA, 21 nt, Human
gaaaauacaaugagcuugacc

SEQ ID NO: 895564 - RNA, 22 nt, Human
ugcagaaaccaauucaaguaag

SEQ ID NO: 895565 - RNA, 22 nt, Human
ggguggccuucauagcucaggg

SEQ ID NO: 895566 - RNA, 22 nt, Human
aagagcuggauugugcugcaga

SEQ ID NO: 895567 - RNA, 22 nt, Human
cugucuguuaucucaccagucc

SEQ ID NO: 895568 - RNA, 19 nt, Human
ugcugcuguccuugcaggg

SEQ ID NO: 895569 - RNA, 22 nt, Human
agcaucagccucuguccuggag

SEQ ID NO: 895570 - RNA, 22 nt, Human
cucucugggguuccagacgugg

SEQ ID NO: 895571 - RNA, 22 nt, Human
uuugcaaagugcuugcagagua

SEQ ID NO: 895572 - RNA, 22 nt, Human
agaagugagugugacucagcag

SEQ ID NO: 895573 - RNA, 22 nt, Human
accucccucgccguccacucug

SEQ ID NO: 895574 - RNA, 22 nt, Human
cagcagcauugcucuggauucc

SEQ ID NO: 895575 - RNA, 22 nt, Human
aaggcugcuuuuaacaugcaua

SEQ ID NO: 895576 - RNA, 22 nt, Human
ggugaaauauuuuugauauguu

SEQ ID NO: 895577 - RNA, 22 nt, Human
aaauaucauuuauaacuuuuaa

SEQ ID NO: 895578 - RNA, 22 nt, Human
uggcacugucaccaaugcuguc

SEQ ID NO: 895579 - RNA, 22 nt, Human
auacagaagccuguauuucugg

SEQ ID NO: 895580 - RNA, 21 nt, Human
ucacaugcuuauuccuggaau

SEQ ID NO: 895581 - RNA, 22 nt, Human
auagauguuuuaguaauacugu

SEQ ID NO: 895582 - RNA, 22 nt, Human
acugugcuggcaaugacucagg

SEQ ID NO: 895583 - RNA, 22 nt, Human
gcaggcaggagcccaacugccu

SEQ ID NO: 895584 - RNA, 22 nt, Human
agaugcugucacacacacuguu

SEQ ID NO: 895585 - RNA, 22 nt, Human
agccuccacagaugcaaagggc

SEQ ID NO: 895586 - RNA, 19 nt, Human
uagauaaggcauuuaaucu

SEQ ID NO: 895587 - RNA, 22 nt, Human
ggccaguccccuaauccagggc

SEQ ID NO: 895588 - RNA, 22 nt, Human
guccauccagggucaccaugac

SEQ ID NO: 895589 - RNA, 22 nt, Human
uuuguacauccuaauucugagu

SEQ ID NO: 895590 - RNA, 22 nt, Human
aguuuugacuaagauggcuugg

SEQ ID NO: 895591 - RNA, 22 nt, Human
acacacaugguauuguucagaa

SEQ ID NO: 895592 - RNA, 22 nt, Human
aguaaguaccuccacuugauug

SEQ ID NO: 895593 - RNA, 22 nt, Human
agaauccuggagaagcuguacc

SEQ ID NO: 895594 - RNA, 22 nt, Human
ucuugcaugauauucuguauuu

SEQ ID NO: 895595 - RNA, 22 nt, Human
ggcugcccucgucuacugccca

SEQ ID NO: 895596 - RNA, 22 nt, Human
ucacaguauucaugaacaugga

SEQ ID NO: 895597 - RNA, 22 nt, Human
aaaguucuuagauuaaucacug

SEQ ID NO: 895598 - RNA, 22 nt, Human
ucucaguguuguucugcagaug

SEQ ID NO: 895599 - RNA, 22 nt, Human
uggucuaagagccuaacugcug

SEQ ID NO: 895600 - RNA, 22 nt, Human
ccauggcuuucuuucauuguaa

SEQ ID NO: 895601 - RNA, 23 nt, Human
auuuacagcugugugagcaaguu

SEQ ID NO: 895602 - RNA, 22 nt, Human
uacagaauagaauagggacagg

SEQ ID NO: 895603 - RNA, 22 nt, Human
uccuuggugcuggagcucagac

SEQ ID NO: 895604 - RNA, 22 nt, Human
gugagaaauggaacuucauacg

SEQ ID NO: 895605 - RNA, 22 nt, Human
uggcacagaaaaaugcuccauu

SEQ ID NO: 895606 - RNA, 22 nt, Human
ccuguguccuuggcagauaucc

SEQ ID NO: 895607 - RNA, 22 nt, Human
ugccuuuaaaaaggaagucauu

SEQ ID NO: 895608 - RNA, 22 nt, Human
ucucaugaugccuaugcagggu

SEQ ID NO: 895609 - RNA, 22 nt, Human
aaaugauguuauaagaccagga

SEQ ID NO: 895610 - RNA, 21 nt, Human
uccugugaggaccugucagug

SEQ ID NO: 895611 - RNA, 22 nt, Human
aagcaauguguuaaugaaugag

SEQ ID NO: 895612 - RNA, 22 nt, Human
cacauacuuguguguacauaug

SEQ ID NO: 895613 - RNA, 22 nt, Human
gaaaaucugcuuauauuauuuu

SEQ ID NO: 895614 - RNA, 21 nt, Human
auuuccaaggguaccuaagau

SEQ ID NO: 895615 - RNA, 22 nt, Human
aguuggcgggacauguggaaag

SEQ ID NO: 895616 - RNA, 22 nt, Human
ggugcugaucuaaauuuaggac

SEQ ID NO: 895617 - RNA, 22 nt, Human
aggaaguggauaaaauagcuuu

SEQ ID NO: 895618 - RNA, 22 nt, Human
aggcagcuuaagcccuggccca

SEQ ID NO: 895619 - RNA, 20 nt, Human
cuguuccugucccaugaagc

SEQ ID NO: 895620 - RNA, 22 nt, Human
gcucccaccaggcagaccuacc

SEQ ID NO: 895621 - RNA, 22 nt, Human
cucuguaccuuaaaagggcuuu

SEQ ID NO: 895622 - RNA, 22 nt, Human
ucuggaaggaagagcugagucc

SEQ ID NO: 895623 - RNA, 22 nt, Human
auguuucccuucugauuuggga

SEQ ID NO: 895624 - RNA, 22 nt, Human
ggucacccaugaucacaucacc

SEQ ID NO: 895625 - RNA, 22 nt, Human
uucucuaagccuuaguuucuuc

SEQ ID NO: 895626 - RNA, 22 nt, Human
cucugggcuuaccugcuuccug

SEQ ID NO: 895627 - RNA, 22 nt, Human
aguuuccagcacagggcaagcu

SEQ ID NO: 895628 - RNA, 22 nt, Human
gagcaguaggagaacccugagc

SEQ ID NO: 895629 - RNA, 22 nt, Human
caaacucuguaggacaguucaa

SEQ ID NO: 895630 - RNA, 22 nt, Human
gacauugacaguccuccuuaua

SEQ ID NO: 895631 - RNA, 22 nt, Human
gcucuguguucccuccaggcuc

SEQ ID NO: 895632 - RNA, 22 nt, Human
ucugaaucacagucauucagcu

SEQ ID NO: 895633 - RNA, 22 nt, Human
ggaggaaauccuuaguaaggca

SEQ ID NO: 895634 - RNA, 22 nt, Human
guguaugugccuuacauuuuau

SEQ ID NO: 895635 - RNA, 20 nt, Human
cuaagaggaggacuagguuu

SEQ ID NO: 895636 - RNA, 22 nt, Human
aaucuuuuucacaagaaagcac

SEQ ID NO: 895637 - RNA, 22 nt, Human
aaucagugguucccagcccagg

SEQ ID NO: 895638 - RNA, 22 nt, Human
aagaauuaucugaaagcugugu

SEQ ID NO: 895639 - RNA, 22 nt, Human
agagugauccuaauugauuugg

SEQ ID NO: 895640 - RNA, 22 nt, Human
auggcagggcacagcucuaguu

SEQ ID NO: 895641 - RNA, 22 nt, Human
ccugagggcgccgagcucccag

SEQ ID NO: 895642 - RNA, 17 nt, Human
ccagagcuacugagacu

SEQ ID NO: 895643 - RNA, 22 nt, Human
ucuuuggcugccugaagcccaa

SEQ ID NO: 895644 - RNA, 18 nt, Human
ggccugaggauuucagca

SEQ ID NO: 895645 - RNA, 22 nt, Human
gaaguucugaaauaaaauccug

SEQ ID NO: 895646 - RNA, 22 nt, Human
gcucucuugguggcuguccugg

SEQ ID NO: 895647 - RNA, 22 nt, Human
ucuucagauaaagggagaguau

SEQ ID NO: 895648 - RNA, 22 nt, Human
uucugccaaagaaguaaaugga

SEQ ID NO: 895649 - RNA, 22 nt, Human
gcaggugggagccgcugccuga

SEQ ID NO: 895650 - RNA, 22 nt, Human
cagacaaagcggaaacuguuua

SEQ ID NO: 895651 - RNA, 22 nt, Human
cuuucagguucuauaggaagcc

SEQ ID NO: 895652 - RNA, 22 nt, Human
ucaggcaggacaauuauuuagg

SEQ ID NO: 895653 - RNA, 22 nt, Human
uuugguuuagggucauuuaaca

SEQ ID NO: 895654 - RNA, 22 nt, Human
uugacacaaacagugauguagu

SEQ ID NO: 895655 - RNA, 22 nt, Human
uugugugucuucuucacugccc

SEQ ID NO: 895656 - RNA, 22 nt, Human
cacagugaauuucaaguguugu

SEQ ID NO: 895657 - RNA, 17 nt, Human
agcuccuggggucuuua

SEQ ID NO: 895658 - RNA, 22 nt, Human
uaaaugucuguuaacaugaaug

SEQ ID NO: 895659 - RNA, 22 nt, Human
uggcuuccagaacugagcaaca

SEQ ID NO: 895660 - RNA, 22 nt, Human
ucucaacagugaaauguguuug

SEQ ID NO: 895661 - RNA, 21 nt, Human
gaaggagaaagcaagugcugc

SEQ ID NO: 895662 - RNA, 22 nt, Human
gacaugaaccuaccauaaugau

SEQ ID NO: 895663 - RNA, 22 nt, Human
ccuuuuauacucagugauauca

SEQ ID NO: 895664 - RNA, 22 nt, Human
auggcccagaaguuuggaaagg

SEQ ID NO: 895665 - RNA, 22 nt, Human
gacaaggugauaauagcuucug

SEQ ID NO: 895666 - RNA, 22 nt, Human
uaucuguagucucaugguuccu

SEQ ID NO: 895667 - RNA, 22 nt, Human
cugcugagccuggugcgggaug

SEQ ID NO: 895668 - RNA, 22 nt, Human
gugggagaagcccuguucguag

SEQ ID NO: 895669 - RNA, 22 nt, Human
ugagcagcuucugucugaaggc

SEQ ID NO: 895670 - RNA, 20 nt, Human
auucuacaagaauaagcaug

SEQ ID NO: 895671 - RNA, 22 nt, Human
gaagucagucaucuccugucuc

SEQ ID NO: 895672 - RNA, 22 nt, Human
ugucaaaaccagcaauuuuguu

SEQ ID NO: 895673 - RNA, 22 nt, Human
aggcaggcuagucgcuugagcc

SEQ ID NO: 895674 - RNA, 22 nt, Human
uucuuacaucuauaaaguuggg

SEQ ID NO: 895675 - RNA, 18 nt, Human
cacagugacuucugauac

SEQ ID NO: 895676 - RNA, 19 nt, Human
ccugccugagcugucccuc

SEQ ID NO: 895677 - RNA, 22 nt, Human
ggaggggagauguuugggcuca

SEQ ID NO: 895678 - RNA, 22 nt, Human
agacacagucugucuggaggag

SEQ ID NO: 895679 - RNA, 22 nt, Human
guggcagcugugggacacuggu

SEQ ID NO: 895680 - RNA, 22 nt, Human
gaaauauuacaguggaggggau

SEQ ID NO: 895681 - RNA, 22 nt, Human
agaaggccaauagggugcacug

SEQ ID NO: 895682 - RNA, 22 nt, Human
uucacagugcucacaguucagu

SEQ ID NO: 895683 - RNA, 22 nt, Human
gaaaauuucugccacaugugug

SEQ ID NO: 895684 - RNA, 22 nt, Human
ucagccuccuaauuuccuguga

SEQ ID NO: 895685 - RNA, 22 nt, Human
cagaggccauauuucuucacuc

SEQ ID NO: 895686 - RNA, 22 nt, Human
augggagugugguuagagaccu

SEQ ID NO: 895687 - RNA, 22 nt, Human
ucaaguuucucucagauuaugg

SEQ ID NO: 895688 - RNA, 22 nt, Human
uuggcccagggucagcggcgcu

SEQ ID NO: 895689 - RNA, 22 nt, Human
aaaugugcuugugaucagcugu

SEQ ID NO: 895690 - RNA, 22 nt, Human
gaaugucuucaaaacuagacug

SEQ ID NO: 895691 - RNA, 22 nt, Human
acagauguaaucuauucacauu

SEQ ID NO: 895692 - RNA, 22 nt, Human
uugggcagguguggcucuccuu

SEQ ID NO: 895693 - RNA, 22 nt, Human
uacauauagacaguuacucuag

SEQ ID NO: 895694 - RNA, 22 nt, Human
agccaggccuuagggagaggca

SEQ ID NO: 895695 - RNA, 22 nt, Human
gcuuccuccagggaggggccug

SEQ ID NO: 895696 - RNA, 22 nt, Human
guggcuugaccaucccugcuac

SEQ ID NO: 895697 - RNA, 22 nt, Human
gggcugagugucccaggccgaa

SEQ ID NO: 895698 - RNA, 22 nt, Human
gcagucagacaggaggagcucc

SEQ ID NO: 895699 - RNA, 22 nt, Human
uuucuaagugugauuuuagauu

SEQ ID NO: 895700 - RNA, 22 nt, Human
acauagcauaaagaaugacucu

SEQ ID NO: 895701 - RNA, 22 nt, Human
aaaauagccucacauaauugcu

SEQ ID NO: 895702 - RNA, 22 nt, Human
ggagcagccuguguagacgggg

SEQ ID NO: 895703 - RNA, 22 nt, Human
uggcucuuggugcuaguuucug

SEQ ID NO: 895704 - RNA, 22 nt, Human
uacaguauggaaaauguauagu

SEQ ID NO: 895705 - RNA, 22 nt, Human
uugcucugucagggccucaguc

SEQ ID NO: 895706 - RNA, 20 nt, Human
aaagucccuuagugggagca

SEQ ID NO: 895707 - RNA, 19 nt, Human
gcucugagaggggcauggg

SEQ ID NO: 895708 - RNA, 23 nt, Human
cauaugaaaguagacacuuucca

SEQ ID NO: 895709 - RNA, 22 nt, Human
uccuggaacauggauaaagaau

SEQ ID NO: 895710 - RNA, 19 nt, Human
uuugcugguucaggaaaga

SEQ ID NO: 895711 - RNA, 22 nt, Human
uggcgaggccaggccagggccu

SEQ ID NO: 895712 - RNA, 22 nt, Human
ccacagaauucugucuccagga

SEQ ID NO: 895713 - RNA, 22 nt, Human
uaaguaauuugugcagagauac

SEQ ID NO: 895714 - RNA, 22 nt, Human
gaaguuacucucguuaaauaug

SEQ ID NO: 895715 - RNA, 21 nt, Human
gagaaucuguuuucuugucuu

SEQ ID NO: 895716 - RNA, 22 nt, Human
agagaauacaaagaagauaugu

SEQ ID NO: 895717 - RNA, 22 nt, Human
cccagaggaggaucucggcccg

SEQ ID NO: 895718 - RNA, 22 nt, Human
aacaaugccugaugaccuccug

SEQ ID NO: 895719 - RNA, 23 nt, Human
uaaagacagccuucaggauucug

SEQ ID NO: 895720 - RNA, 22 nt, Human
aaaaugaacagaacaaugggga

SEQ ID NO: 895721 - RNA, 19 nt, Human
ucagugugugggagguggu

SEQ ID NO: 895722 - RNA, 22 nt, Human
uuuaauacuauggggaugaaca

SEQ ID NO: 895723 - RNA, 22 nt, Human
uguuuuguagcuaauagcuauu

SEQ ID NO: 895724 - RNA, 22 nt, Human
cacacugauaggcuugacaggc

SEQ ID NO: 895725 - RNA, 22 nt, Human
agcuccugucucaagggagccu

SEQ ID NO: 895726 - RNA, 22 nt, Human
ugccaccccucugcacccucag

SEQ ID NO: 895727 - RNA, 22 nt, Human
gccuggggccagcuugggcuga

SEQ ID NO: 895728 - RNA, 22 nt, Human
auggaguucugccagcgcugcu

SEQ ID NO: 895729 - RNA, 20 nt, Human
gcuucucagggcuucucuga

SEQ ID NO: 895730 - RNA, 22 nt, Human
cagaucuguaguaaaagaucuc

SEQ ID NO: 895731 - RNA, 22 nt, Human
aaggucuguucuaggugagggu

SEQ ID NO: 895732 - RNA, 22 nt, Human
uuuucucuacaaaauaaccagc

SEQ ID NO: 895733 - RNA, 23 nt, Human
cugcccugaucuugaucuauugu

SEQ ID NO: 895734 - RNA, 22 nt, Human
ugaggcagcaauugauuauuca

SEQ ID NO: 895735 - RNA, 22 nt, Human
gugauaaaauagaaacaguggu

SEQ ID NO: 895736 - RNA, 21 nt, Human
agagaagggacucuuccaguc

SEQ ID NO: 895737 - RNA, 22 nt, Human
cuugcugcucuggagucaugcc

SEQ ID NO: 895738 - RNA, 22 nt, Human
cuugcucauuaaguagcucaca

SEQ ID NO: 895739 - RNA, 23 nt, Human
ugaaggcccuggagccacgaggc

SEQ ID NO: 895740 - RNA, 22 nt, Human
aggaacaacugauucagucaac

SEQ ID NO: 895741 - RNA, 20 nt, Human
agcuggccuguccuaggccu

SEQ ID NO: 895742 - RNA, 22 nt, Human
uacagaaguugguuuuaguuua

SEQ ID NO: 895743 - RNA, 22 nt, Human
ccccaggacacauggaccaagu

SEQ ID NO: 895744 - RNA, 23 nt, Human
agcuguuucauuauuacaacacc

SEQ ID NO: 895745 - RNA, 21 nt, Human
cuuaacauuuuaaaugaaagg

SEQ ID NO: 895746 - RNA, 22 nt, Human
aguuacacauaaacauuaaagg

SEQ ID NO: 895747 - RNA, 22 nt, Human
auuugcuucuagucaguuccau

SEQ ID NO: 895748 - RNA, 22 nt, Human
uauacacaggaaucugugaaaa

SEQ ID NO: 895749 - RNA, 22 nt, Human
uuauuuccuaaaucucuuuguu

SEQ ID NO: 895750 - RNA, 22 nt, Human
cauuugcaagagauaaauguuu

SEQ ID NO: 895751 - RNA, 22 nt, Human
acuagaaugcaagcuccacaag

SEQ ID NO: 895752 - RNA, 21 nt, Human
aucuuuagccauccaaucaga

SEQ ID NO: 895753 - RNA, 22 nt, Human
caggucugcaggcuggagucca

SEQ ID NO: 895754 - RNA, 22 nt, Human
cugcagcuccccugagaucaag

SEQ ID NO: 895755 - RNA, 22 nt, Human
ggucucagcuggaguccuuggu

SEQ ID NO: 895756 - RNA, 22 nt, Human
cugggucuccggcagccucggg

SEQ ID NO: 895757 - RNA, 23 nt, Human
agcaauaagaagggauacaugug

SEQ ID NO: 895758 - RNA, 19 nt, Human
gaaugggaaugggaaagcu

SEQ ID NO: 895759 - RNA, 22 nt, Human
ugacaaagcaugauggugacag

SEQ ID NO: 895760 - RNA, 22 nt, Human
ugcagggcuaagucagagccug

SEQ ID NO: 895761 - RNA, 22 nt, Human
gacagcugaaaaauguaaggua

SEQ ID NO: 895762 - RNA, 23 nt, Human
ucaaacagguuucagagcaucuu

SEQ ID NO: 895763 - RNA, 22 nt, Human
uagcuguguagacacucagagc

SEQ ID NO: 895764 - RNA, 21 nt, Human
agcuggugucagagcucuggg

SEQ ID NO: 895765 - RNA, 22 nt, Human
auaugaaguuacagguaagaaa

SEQ ID NO: 895766 - RNA, 22 nt, Human
ggagcagcacugauuagcgguu

SEQ ID NO: 895767 - RNA, 22 nt, Human
cagagcccagggccuacguccc

SEQ ID NO: 895768 - RNA, 22 nt, Human
cugggccuugaucacacaggug

SEQ ID NO: 895769 - RNA, 22 nt, Human
ugcugcagcggcauggucuuug

SEQ ID NO: 895770 - RNA, 21 nt, Human
cugaggcagcacagcuaguca

SEQ ID NO: 895771 - RNA, 22 nt, Human
gccaggaggcuuaacuggacag

SEQ ID NO: 895772 - RNA, 22 nt, Human
cucaguguuaaauauaagguau

SEQ ID NO: 895773 - RNA, 22 nt, Human
uucauuugccaucaguguaaug

SEQ ID NO: 895774 - RNA, 22 nt, Human
guaaaauugcaauuacuuuugc

SEQ ID NO: 895775 - RNA, 22 nt, Human
caagagcauuuaguuagcuggu

SEQ ID NO: 895776 - RNA, 22 nt, Human
gucuccagcccacucuagauau

SEQ ID NO: 895777 - RNA, 22 nt, Human
ugccugcucugugccacaguug

SEQ ID NO: 895778 - RNA, 22 nt, Human
ugugguccucucaacugaaggu

SEQ ID NO: 895779 - RNA, 19 nt, Human
cuuauuucugguuuugggu

SEQ ID NO: 895780 - RNA, 22 nt, Human
gaaaaggaaauuuauagagauc

SEQ ID NO: 895781 - RNA, 22 nt, Human
ccccaccagcacccucucuauc

SEQ ID NO: 895782 - RNA, 22 nt, Human
agaaaggaggaagaaugaccuc

SEQ ID NO: 895783 - RNA, 18 nt, Human
ucaugucacugugcuccc

SEQ ID NO: 895784 - RNA, 21 nt, Human
aagggagauaggaaucaggcc

SEQ ID NO: 895785 - RNA, 22 nt, Human
uagaacaggaauaagggaaaua

SEQ ID NO: 895786 - RNA, 22 nt, Human
gacauuuacugaauacugauua

SEQ ID NO: 895787 - RNA, 22 nt, Human
acccagaggugucuagcaagcu

SEQ ID NO: 895788 - RNA, 22 nt, Human
caggugaaucacuugaguccag

SEQ ID NO: 895789 - RNA, 22 nt, Human
acaggcuucagauguauuaacu

SEQ ID NO: 895790 - RNA, 22 nt, Human
cagcauuuucuuaauguaggug

SEQ ID NO: 895791 - RNA, 22 nt, Human
gaccuucuguuggaggcauuua

SEQ ID NO: 895792 - RNA, 22 nt, Human
cuccuguugcacuaguuccuga

SEQ ID NO: 895793 - RNA, 22 nt, Human
gcuggccaguguggugaccacc

SEQ ID NO: 895794 - RNA, 22 nt, Human
aaacuucauggauaauauaaag

SEQ ID NO: 895795 - RNA, 22 nt, Human
auuuguucauggguuguuaugc

SEQ ID NO: 895796 - RNA, 20 nt, Human
cauugcauauuucauugagg

SEQ ID NO: 895797 - RNA, 22 nt, Human
cuccagcucuuaacugcggaag

SEQ ID NO: 895798 - RNA, 22 nt, Human
cuaaucugugaaauagguauga

SEQ ID NO: 895799 - RNA, 22 nt, Human
ggcaggcuugauauggggggac

SEQ ID NO: 895800 - RNA, 22 nt, Human
gcuuggcuccuggcucacaggu

SEQ ID NO: 895801 - RNA, 22 nt, Human
cugaaagggagaacaccaagag

SEQ ID NO: 895802 - RNA, 22 nt, Human
cauacauuuugcauauuuacca

SEQ ID NO: 895803 - RNA, 22 nt, Human
gccuuagccugcacuuccuguu

SEQ ID NO: 895804 - RNA, 22 nt, Human
gauucacaacugcccugaaggg

SEQ ID NO: 895805 - RNA, 22 nt, Human
agauguaaacucucaugucauu

SEQ ID NO: 895806 - RNA, 22 nt, Human
uuuguguuuaugaaguuauucu

SEQ ID NO: 895807 - RNA, 22 nt, Human
cagaaacuguuuguuaauauuu

SEQ ID NO: 895808 - RNA, 22 nt, Human
caaauguuugcaucacagggca

SEQ ID NO: 895809 - RNA, 22 nt, Human
guggccaggcguccgcgcggcu

SEQ ID NO: 895810 - RNA, 22 nt, Human
ggcugcugggaauaugccagcu

SEQ ID NO: 895811 - RNA, 22 nt, Human
agcagggcaaagucaggcuaac

SEQ ID NO: 895812 - RNA, 20 nt, Human
gaaauguaucucuugauucu

SEQ ID NO: 895813 - RNA, 22 nt, Human
aguggaaggucaggggacagug

SEQ ID NO: 895814 - RNA, 22 nt, Human
aaauugcacaauauagacauga

SEQ ID NO: 895815 - RNA, 22 nt, Human
cuaggcuggagugcauuggcgu

SEQ ID NO: 895816 - RNA, 22 nt, Human
agccucugcacgggcacgggug

SEQ ID NO: 895817 - RNA, 23 nt, Human
ucugucaccuauggcugcucuuc

SEQ ID NO: 895818 - RNA, 23 nt, Human
ugggaaugacaucuagagcagag

SEQ ID NO: 895819 - RNA, 22 nt, Human
cugggaggauacacaagaucag

SEQ ID NO: 895820 - RNA, 22 nt, Human
ucaggccuuucuucagagcuuc

SEQ ID NO: 895821 - RNA, 22 nt, Human
uauuugaaaguguacaaaaacu

SEQ ID NO: 895822 - RNA, 22 nt, Human
cugugcccaccuggcucugagg

SEQ ID NO: 895823 - RNA, 22 nt, Human
uuacaagauaaccugaugcugu

SEQ ID NO: 895824 - RNA, 22 nt, Human
acuaggaggcauauaaaacauu

SEQ ID NO: 895825 - RNA, 22 nt, Human
acagacagggcaccugccuccu

SEQ ID NO: 895826 - RNA, 22 nt, Human
cuucaaauacaaguagauuaug

SEQ ID NO: 895827 - RNA, 22 nt, Human
uacacuaaaucuucaucuuuua

SEQ ID NO: 895828 - RNA, 22 nt, Human
ucaagacagauggguaacuugg

SEQ ID NO: 895829 - RNA, 22 nt, Human
guaugucuauaguuuuuaaaua

SEQ ID NO: 895830 - RNA, 22 nt, Human
gggcuucucugggaguccuggu

SEQ ID NO: 895831 - RNA, 22 nt, Human
uuaaaauuauggcccauuugga

SEQ ID NO: 895832 - RNA, 22 nt, Human
gccuggccgcuccgagcuccgc

SEQ ID NO: 895833 - RNA, 22 nt, Human
uuuagacacacuuuguauauuu

SEQ ID NO: 895834 - RNA, 20 nt, Human
aaugaaguuauuaaugaugu

SEQ ID NO: 895835 - RNA, 22 nt, Human
uuuuuuaucuaugguaguacca

SEQ ID NO: 895836 - RNA, 22 nt, Human
cacucagcccacccauguuugu

SEQ ID NO: 895837 - RNA, 20 nt, Human
acacaugucaagcuaaaggc

SEQ ID NO: 895838 - RNA, 22 nt, Human
ugcaaaaacugcaauugcuuuu

SEQ ID NO: 895839 - RNA, 22 nt, Human
caucuuuauuuauauagacagg

SEQ ID NO: 895840 - RNA, 22 nt, Human
aagggagcuuaggagaucaggc

SEQ ID NO: 895841 - RNA, 22 nt, Human
gggcuggcaucaguugccgaga

SEQ ID NO: 895842 - RNA, 22 nt, Human
cuuucaugcaguugacaaggug

SEQ ID NO: 895843 - RNA, 22 nt, Human
cuggcuggccauguagagauga

SEQ ID NO: 895844 - RNA, 22 nt, Human
caugcagcaggaucucauuccc

SEQ ID NO: 895845 - RNA, 22 nt, Human
cagguauuaauaaauggagagu

SEQ ID NO: 895846 - RNA, 19 nt, Human
cccaggaggcggagguugc

SEQ ID NO: 895847 - RNA, 22 nt, Human
uuugugucgucacugucuucuc

SEQ ID NO: 895848 - RNA, 22 nt, Human
agaaauguggaggaacagggcu

SEQ ID NO: 895849 - RNA, 22 nt, Human
aaauaacagucagggacaacau

SEQ ID NO: 895850 - RNA, 19 nt, Human
aggcagcauucuggggcuu

SEQ ID NO: 895851 - RNA, 22 nt, Human
ggguagggugacuuaggcuggc

SEQ ID NO: 895852 - RNA, 22 nt, Human
aagcugccaaugguaagcugcu

SEQ ID NO: 895853 - RNA, 22 nt, Human
aagcacagggacuuuaggaaua

SEQ ID NO: 895854 - RNA, 22 nt, Human
ugccaggcaacugcccagccau

SEQ ID NO: 895855 - RNA, 22 nt, Human
acuguucuucccauuuauauug

SEQ ID NO: 895856 - RNA, 21 nt, Human
gcuuucuguggacucugcacc

SEQ ID NO: 895857 - RNA, 22 nt, Human
cuguacauaugucuccagagug

SEQ ID NO: 895858 - RNA, 22 nt, Human
cuggaaugaagcuauguacauu

SEQ ID NO: 895859 - RNA, 23 nt, Human
acucagugaagcaaacagauagu

SEQ ID NO: 895860 - RNA, 22 nt, Human
cugccugcugacauucuuuaua

SEQ ID NO: 895861 - RNA, 22 nt, Human
gggcaagcacagcgagcgugcg

SEQ ID NO: 895862 - RNA, 22 nt, Human
acacaguaggccaccaugucau

SEQ ID NO: 895863 - RNA, 22 nt, Human
aaauacuguagauaauagaguu

SEQ ID NO: 895864 - RNA, 22 nt, Human
uauugcauauuguacuugaaug

SEQ ID NO: 895865 - RNA, 22 nt, Human
uggcauccucucuucugagugc

SEQ ID NO: 895866 - RNA, 22 nt, Human
aucuagacaucugaaacauuua

SEQ ID NO: 895867 - RNA, 22 nt, Human
aggaggugcuagagaagauguu

SEQ ID NO: 895868 - RNA, 22 nt, Human
aaguuuggaaugauagagaccu

SEQ ID NO: 895869 - RNA, 22 nt, Human
gucucagagagcuacucucuua

SEQ ID NO: 895870 - RNA, 20 nt, Human
uuuggagagaaagaaguagu

SEQ ID NO: 895871 - RNA, 22 nt, Human
ucacaagagcuggacugucuuu

SEQ ID NO: 895872 - RNA, 23 nt, Human
cccugcaucugucccucaccagu

SEQ ID NO: 895873 - RNA, 22 nt, Human
aucucaacaucccuauggagug

SEQ ID NO: 895874 - RNA, 22 nt, Human
ugcaguuuccuuucuagucuuu

SEQ ID NO: 895875 - RNA, 22 nt, Human
agcuggcaauguaagucccugg

SEQ ID NO: 895876 - RNA, 22 nt, Human
ggcuccagguacguaugggagg

SEQ ID NO: 895877 - RNA, 22 nt, Human
agauguuucaguaauuuaucuu

SEQ ID NO: 895878 - RNA, 22 nt, Human
aggccggcgcuucccaggaggc

SEQ ID NO: 895879 - RNA, 22 nt, Human
gcagcagcaagaagguuggacu

SEQ ID NO: 895880 - RNA, 22 nt, Human
ccagcacugcucucagacugag

SEQ ID NO: 895881 - RNA, 22 nt, Human
ugugaaauguggauguuaauag

SEQ ID NO: 895882 - RNA, 22 nt, Human
ugaggccaacuagggagaugga

SEQ ID NO: 895883 - RNA, 22 nt, Human
ucuuuguggcgggcuuaaauac

SEQ ID NO: 895884 - RNA, 22 nt, Human
ucaguuagauugccuccuuaga

SEQ ID NO: 895885 - RNA, 22 nt, Human
aggcaauacacagcauuucaca

SEQ ID NO: 895886 - RNA, 22 nt, Human
auuugcuucuugcuuccagcac

SEQ ID NO: 895887 - RNA, 22 nt, Human
cacaaguuugggucacucagcu

SEQ ID NO: 895888 - RNA, 22 nt, Human
auuauaugugggauagaauuua

SEQ ID NO: 895889 - RNA, 22 nt, Human
cuauacacuuuuugaaaauaga

SEQ ID NO: 895890 - RNA, 22 nt, Human
gcaccaugacagugaggagaac

SEQ ID NO: 895891 - RNA, 22 nt, Human
aagccgaggccacacagcagga

SEQ ID NO: 895892 - RNA, 22 nt, Human
cuucucugacagucuguuucac

SEQ ID NO: 895893 - RNA, 22 nt, Human
uugggcuggauaagucuuuguu

SEQ ID NO: 895894 - RNA, 22 nt, Human
acucuugaacugauuaagaaug

SEQ ID NO: 895895 - RNA, 23 nt, Human
ugagcugggccugcaggggucuc

SEQ ID NO: 895896 - RNA, 22 nt, Human
uauguuaagugggauaaucaaa

SEQ ID NO: 895897 - RNA, 22 nt, Human
cuccacagcucaggcucagagu

SEQ ID NO: 895898 - RNA, 23 nt, Human
cugugcccggggcuccaccugau

SEQ ID NO: 895899 - RNA, 23 nt, Human
uggaccugaaccagugccucugu

SEQ ID NO: 895900 - RNA, 22 nt, Human
aaguccagugcuuuagauucca

SEQ ID NO: 895901 - RNA, 22 nt, Human
ggguggugggcacagaaucugg

SEQ ID NO: 895902 - RNA, 22 nt, Human
cagaggaaguuccuugaugaga

SEQ ID NO: 895903 - RNA, 22 nt, Human
cuguggcuuuggggcggaggac

SEQ ID NO: 895904 - RNA, 22 nt, Human
gccuggagggauagaaugcaag

SEQ ID NO: 895905 - RNA, 22 nt, Human
uaggcugagguugaugccaggg

SEQ ID NO: 895906 - RNA, 22 nt, Human
caagugucuauaucagugcuug

SEQ ID NO: 895907 - RNA, 22 nt, Human
uacaggaagucucaguacagua

SEQ ID NO: 895908 - RNA, 22 nt, Human
agggcuuuaaugauuauuuucu

SEQ ID NO: 895909 - RNA, 22 nt, Human
cacagaacauuuuuagaugcag

SEQ ID NO: 895910 - RNA, 22 nt, Human
uuuauuaauguagcauccaugg

SEQ ID NO: 895911 - RNA, 19 nt, Human
ccugugagaggacaggugu

SEQ ID NO: 895912 - RNA, 22 nt, Human
cuggcacaugugagccacauca

SEQ ID NO: 895913 - RNA, 22 nt, Human
gaggcagaaguugcagugagca

SEQ ID NO: 895914 - RNA, 22 nt, Human
uugaaacauucuccuauugauu

SEQ ID NO: 895915 - RNA, 22 nt, Human
ucagaagcuaaauuugauauuu

SEQ ID NO: 895916 - RNA, 22 nt, Human
gccuagggaugacaaauauucu

SEQ ID NO: 895917 - RNA, 22 nt, Human
cucuuuuaauugucauaacaac

SEQ ID NO: 895918 - RNA, 22 nt, Human
auugcaggcaaagugcuguguc

SEQ ID NO: 895919 - RNA, 20 nt, Human
uggaaccuaggcagagcugg

SEQ ID NO: 895920 - RNA, 22 nt, Human
gggcagugucgaggucuggucc

SEQ ID NO: 895921 - RNA, 22 nt, Human
agcucugacugaagagaugcaa

SEQ ID NO: 895922 - RNA, 22 nt, Human
agagaauacaggguaacaggaa

SEQ ID NO: 895923 - RNA, 22 nt, Human
ggugcugagugagcuagaggcu

SEQ ID NO: 895924 - RNA, 22 nt, Human
gcucccaccuccagccugaguu

SEQ ID NO: 895925 - RNA, 22 nt, Human
gugaggagcucuuugacucacg

SEQ ID NO: 895926 - RNA, 22 nt, Human
acagauguggaguuugcaugau

SEQ ID NO: 895927 - RNA, 22 nt, Human
ggggcacacuuuugguagauau

SEQ ID NO: 895928 - RNA, 22 nt, Human
aaagugcacuagaauccagauu

SEQ ID NO: 895929 - RNA, 22 nt, Human
uuacagaggcuuccagggccca

SEQ ID NO: 895930 - RNA, 22 nt, Human
auaaaaugucuccacugggcuc

SEQ ID NO: 895931 - RNA, 21 nt, Human
gggugcuguggucaugcagga

SEQ ID NO: 895932 - RNA, 22 nt, Human
auguaucagaaauagcauuggc

SEQ ID NO: 895933 - RNA, 22 nt, Human
ggaggcucuugagaggggagua

SEQ ID NO: 895934 - RNA, 22 nt, Human
cacuccagccucagugacagag

SEQ ID NO: 895935 - RNA, 22 nt, Human
cuggcagcucugagucccuucu

SEQ ID NO: 895936 - RNA, 22 nt, Human
uggcaauauaaucaucugcucu

SEQ ID NO: 895937 - RNA, 22 nt, Human
uggcagcagcaaauggcauauc

SEQ ID NO: 895938 - RNA, 22 nt, Human
uggcucagauaauucaaggggc

SEQ ID NO: 895939 - RNA, 22 nt, Human
auggacagugugaagcagauag

SEQ ID NO: 895940 - RNA, 22 nt, Human
uaguucuacagaugguuuguaa

SEQ ID NO: 895941 - RNA, 22 nt, Human
ggcuagggacuccuccucaggg

SEQ ID NO: 895942 - RNA, 22 nt, Human
uuccuauggccagagucaaaga

SEQ ID NO: 895943 - RNA, 22 nt, Human
gcaguccucauccuuuagcagu

SEQ ID NO: 895944 - RNA, 22 nt, Human
auauacaaagggcaaccucgcu

SEQ ID NO: 895945 - RNA, 22 nt, Human
uuaacaugucuugacuucaucu

SEQ ID NO: 895946 - RNA, 22 nt, Human
ucugcuuuuucauugacugaaa

SEQ ID NO: 895947 - RNA, 22 nt, Human
auuacagaaagcaauauugagu

SEQ ID NO: 895948 - RNA, 22 nt, Human
agaccaugggcucugaagagca

SEQ ID NO: 895949 - RNA, 22 nt, Human
ugucagugaguuaguugcaagu

SEQ ID NO: 895950 - RNA, 22 nt, Human
ugauuuccaaaaggcuucuaag

SEQ ID NO: 895951 - RNA, 22 nt, Human
gcugcaggagauuuugagaguc

SEQ ID NO: 895952 - RNA, 22 nt, Human
cagaggcccagugagagggcug

SEQ ID NO: 895953 - RNA, 19 nt, Human
uuaacagucaccaaggaga

SEQ ID NO: 895954 - RNA, 22 nt, Human
aaggcagcagugcacgacugau

SEQ ID NO: 895955 - RNA, 22 nt, Human
gagaagggcuugggagucaaca

SEQ ID NO: 895956 - RNA, 22 nt, Human
ugagauggaguucugcucuugu

SEQ ID NO: 895957 - RNA, 22 nt, Human
ggcugagccuggagcaucuggu

SEQ ID NO: 895958 - RNA, 22 nt, Human
aguccuguugguuccagaggug

SEQ ID NO: 895959 - RNA, 22 nt, Human
agaggaugguugaggaagaccu

SEQ ID NO: 895960 - RNA, 22 nt, Human
gcuuauuuucaccuucucucag

SEQ ID NO: 895961 - RNA, 22 nt, Human
cauuucuaccaaaugugacugg

SEQ ID NO: 895962 - RNA, 22 nt, Human
agucacaucgauuauaaaauuu

SEQ ID NO: 895963 - RNA, 22 nt, Human
agaggggguguuccagaagcau

SEQ ID NO: 895964 - RNA, 22 nt, Human
acaaagugaaaagcaucgaauu

SEQ ID NO: 895965 - RNA, 22 nt, Human
cuuuacuguuuggugcucuauu

SEQ ID NO: 895966 - RNA, 22 nt, Human
acuccagaggcagcugugcuga

SEQ ID NO: 895967 - RNA, 22 nt, Human
cacauuuaucucucuccgguga

SEQ ID NO: 895968 - RNA, 22 nt, Human
uggaguccccgagaggccugca

SEQ ID NO: 895969 - RNA, 22 nt, Human
ucuauucugauaaaugcaugga

SEQ ID NO: 895970 - RNA, 22 nt, Human
cuggagugaagucuggcagcuu

SEQ ID NO: 895971 - RNA, 22 nt, Human
auccaugauuaguaggauaaag

SEQ ID NO: 895972 - RNA, 22 nt, Human
ugacauuucgguguaugugaug

SEQ ID NO: 895973 - RNA, 22 nt, Human
uuucagagguaugcugcuuauc

SEQ ID NO: 895974 - RNA, 22 nt, Human
cugggcuacguguugacagcau

SEQ ID NO: 895975 - RNA, 22 nt, Human
cuguggcuggccugucugacau

SEQ ID NO: 895976 - RNA, 22 nt, Human
cugaggccguuggugggccuua

SEQ ID NO: 895977 - RNA, 22 nt, Human
aggauguggucuguuuucugag

SEQ ID NO: 895978 - RNA, 22 nt, Human
acaaauugccuagucuagcauc

SEQ ID NO: 895979 - RNA, 23 nt, Human
ucauaagugcucaguuacuguua

SEQ ID NO: 895980 - RNA, 22 nt, Human
acauguguggacaugaaucuac

SEQ ID NO: 895981 - RNA, 22 nt, Human
cccugaggaaaggguggagggc

SEQ ID NO: 895982 - RNA, 22 nt, Human
cuccucccucuuugccacacau

SEQ ID NO: 895983 - RNA, 22 nt, Human
cucccaggacuggcucuaacug

SEQ ID NO: 895984 - RNA, 22 nt, Human
aagaaucucucaagugugacaa

SEQ ID NO: 895985 - RNA, 22 nt, Human
uccuuucccuuuccauccuggc

SEQ ID NO: 895986 - RNA, 22 nt, Human
ucuucagagacucugagccccu

SEQ ID NO: 895987 - RNA, 22 nt, Human
gugcagggcuggcaccggaggc

SEQ ID NO: 895988 - RNA, 22 nt, Human
acagguuuagcucuuaguaguc

SEQ ID NO: 895989 - RNA, 22 nt, Human
cugucuguacugagaguucugu

SEQ ID NO: 895990 - RNA, 22 nt, Human
uacaguagaaugcggugccagu

SEQ ID NO: 895991 - RNA, 22 nt, Human
ucaggagaaagccaauuagagu

SEQ ID NO: 895992 - RNA, 22 nt, Human
agaguggcaguaaaauagagca

SEQ ID NO: 895993 - RNA, 20 nt, Human
agacccuguguccuguggcc

SEQ ID NO: 895994 - RNA, 22 nt, Human
agcccauguggcugaggcuucu

SEQ ID NO: 895995 - RNA, 22 nt, Human
ucaggagauguaaccuuagcug

SEQ ID NO: 895996 - RNA, 22 nt, Human
cucugccagccaaagucaucac

SEQ ID NO: 895997 - RNA, 22 nt, Human
caagaagccgagcuacaggcuc

SEQ ID NO: 895998 - RNA, 18 nt, Human
agguauaugaaucucuuu

SEQ ID NO: 895999 - RNA, 22 nt, Human
ccuuuuuucuaugccaacucug

SEQ ID NO: 896000 - RNA, 22 nt, Human
uugagguaguucuauugugagu

SEQ ID NO: 896001 - RNA, 22 nt, Human
uuuauaauuaucucuacucuua

SEQ ID NO: 896002 - RNA, 22 nt, Human
cagcccaguaccaagcaguugg

SEQ ID NO: 896003 - RNA, 22 nt, Human
caguuuuaugucgaauguauac

SEQ ID NO: 896004 - RNA, 22 nt, Human
ggaggggccggcugccugccac

SEQ ID NO: 896005 - RNA, 22 nt, Human
aauuaagucacacaccuaaacc

SEQ ID NO: 896006 - RNA, 22 nt, Human
agucaucaccaguacagugugc

SEQ ID NO: 896007 - RNA, 22 nt, Human
uccuuggugcaaaugauuuaau

SEQ ID NO: 896008 - RNA, 22 nt, Human
cauuccaaguauauacaugaua

SEQ ID NO: 896009 - RNA, 22 nt, Human
ccaggcuccucaugaucuuguu

SEQ ID NO: 896010 - RNA, 22 nt, Human
gagaauaaaucuaaaguuucuu

SEQ ID NO: 896011 - RNA, 22 nt, Human
ugaagguggggcuuaggaaucu

SEQ ID NO: 896012 - RNA, 22 nt, Human
caggcagccugagggaucuggg

SEQ ID NO: 896013 - RNA, 22 nt, Human
ugggagagaauucuggugacug

SEQ ID NO: 896014 - RNA, 22 nt, Human
uuuauugcccuguaguacagga

SEQ ID NO: 896015 - RNA, 22 nt, Human
ugugagcacuauggcuaggcuc

SEQ ID NO: 896016 - RNA, 18 nt, Human
uggcagugagguaggcau

SEQ ID NO: 896017 - RNA, 22 nt, Human
cagugucaggaucaguauauuu

SEQ ID NO: 896018 - RNA, 22 nt, Human
ugcccagccuaaacuuggcaag

SEQ ID NO: 896019 - RNA, 22 nt, Human
uuggcagaaauguggcugggag

SEQ ID NO: 896020 - RNA, 22 nt, Human
uuuauugucuaugaacugcuug

SEQ ID NO: 896021 - RNA, 22 nt, Human
gcagaugccagaucaugcaggg

SEQ ID NO: 896022 - RNA, 22 nt, Human
guuauccauagaauaagucauc

SEQ ID NO: 896023 - RNA, 22 nt, Human
guggccagagauuaaauagagu

SEQ ID NO: 896024 - RNA, 22 nt, Human
agccaagaagugaguaauagua

SEQ ID NO: 896025 - RNA, 22 nt, Human
cagauuaagugcucaacagugu

SEQ ID NO: 896026 - RNA, 22 nt, Human
gauaauaagcacagcaggaugu

SEQ ID NO: 896027 - RNA, 22 nt, Human
guccauggcauuuccgucacau

SEQ ID NO: 896028 - RNA, 18 nt, Human
auucaggggcugaaugug

SEQ ID NO: 896029 - RNA, 22 nt, Human
cuuccaaaauuuauauguugaa

SEQ ID NO: 896030 - RNA, 22 nt, Human
uucuuuuccuguggcucaucca

SEQ ID NO: 896031 - RNA, 22 nt, Human
ugaauuuaucaaagauucuuaa

SEQ ID NO: 896032 - RNA, 22 nt, Human
acacauucuuuaaaugucuguu

SEQ ID NO: 896033 - RNA, 22 nt, Human
uaauauauaccuuuguuaggaa

SEQ ID NO: 896034 - RNA, 22 nt, Human
agagguugggucugaggugaga

SEQ ID NO: 896035 - RNA, 22 nt, Human
uuacaaaguucugaguucaaac

SEQ ID NO: 896036 - RNA, 22 nt, Human
aauuugauucccugcaccuguu

SEQ ID NO: 896037 - RNA, 22 nt, Human
agccaguguuaagugacugguu

SEQ ID NO: 896038 - RNA, 22 nt, Human
ggcucagguuaccagucccucc

SEQ ID NO: 896039 - RNA, 22 nt, Human
agaauuuuugauuaucuacucg

SEQ ID NO: 896040 - RNA, 22 nt, Human
aggagaccuuuugagugugaga

SEQ ID NO: 896041 - RNA, 23 nt, Human
auguuaagaagguaguuaggaua

SEQ ID NO: 896042 - RNA, 22 nt, Human
cccuaggaauucuauggccaag

SEQ ID NO: 896043 - RNA, 22 nt, Human
gggcacugaaugccaagcuagg

SEQ ID NO: 896044 - RNA, 22 nt, Human
aagcccagaugugagaacugag

SEQ ID NO: 896045 - RNA, 21 nt, Human
guauugcagaguuaugugcuc

SEQ ID NO: 896046 - RNA, 22 nt, Human
caucaguguuggcuucucagag

SEQ ID NO: 896047 - RNA, 22 nt, Human
ugcuucugacugggucaguuga

SEQ ID NO: 896048 - RNA, 22 nt, Human
gggaacagagugccagacugac

SEQ ID NO: 896049 - RNA, 22 nt, Human
gccuggcuucccuuggagcauu

SEQ ID NO: 896050 - RNA, 15 nt, Human
cagguuaguuuccag

SEQ ID NO: 896051 - RNA, 22 nt, Human
ugaggugguucaagagccuugu

SEQ ID NO: 896052 - RNA, 22 nt, Human
gaaggaagugcucauacuaguu

SEQ ID NO: 896053 - RNA, 22 nt, Human
ucgugaggcucugcaucgcaca

SEQ ID NO: 896054 - RNA, 22 nt, Human
gguuuauugaaggccaccccac

SEQ ID NO: 896055 - RNA, 22 nt, Human
ccagggaaauuaaugaguuaau

SEQ ID NO: 896056 - RNA, 20 nt, Human
gaugaaaucacugggcagcc

SEQ ID NO: 896057 - RNA, 22 nt, Human
ucccugaggaagggguguggug

SEQ ID NO: 896058 - RNA, 22 nt, Human
ucuuugcucuuacacaguuagu

SEQ ID NO: 896059 - RNA, 22 nt, Human
acaguucuuaaaacuugaauua

SEQ ID NO: 896060 - RNA, 22 nt, Human
ugagccaggcacugcuccugga

SEQ ID NO: 896061 - RNA, 22 nt, Human
ggcugccuugacccuggcuccg

SEQ ID NO: 896062 - RNA, 22 nt, Human
aaggauacuuuuagagccugag

SEQ ID NO: 896063 - RNA, 22 nt, Human
gguuuauuguuaauaaguuuga

SEQ ID NO: 896064 - RNA, 22 nt, Human
gcagaggcucuuuaaugcuuag

SEQ ID NO: 896065 - RNA, 22 nt, Human
uacaucuaucuagaugcucaga

SEQ ID NO: 896066 - RNA, 20 nt, Human
ugagguaucaauucaaggca

SEQ ID NO: 896067 - RNA, 22 nt, Human
gcccugaguugagccuuccaaa

SEQ ID NO: 896068 - RNA, 22 nt, Human
agugugagcuaauagcagagcc

SEQ ID NO: 896069 - RNA, 22 nt, Human
uuuacuuugugucaagucaaga

SEQ ID NO: 896070 - RNA, 22 nt, Human
aaagcaaugggucuaagguaaa

SEQ ID NO: 896071 - RNA, 19 nt, Human
aguguuucaugugcuuuua

SEQ ID NO: 896072 - RNA, 20 nt, Human
augaguuuaaacauucagag

SEQ ID NO: 896073 - RNA, 22 nt, Human
uaggaauccagaucuagacugu

SEQ ID NO: 896074 - RNA, 22 nt, Human
cugcuggggucagagcacuggg

SEQ ID NO: 896075 - RNA, 22 nt, Human
aguuuccucauguuaauaugga

SEQ ID NO: 896076 - RNA, 22 nt, Human
cugugcauguguucucugguaa

SEQ ID NO: 896077 - RNA, 22 nt, Human
aaguguuuggggaucauuuuaa

SEQ ID NO: 896078 - RNA, 22 nt, Human
ugucuuuagccacuugccucuu

SEQ ID NO: 896079 - RNA, 22 nt, Human
agggccaggcucccaugucagg

SEQ ID NO: 896080 - RNA, 22 nt, Human
gccacugcacuccagcccaggc

SEQ ID NO: 896081 - RNA, 22 nt, Human
uggagcugguaaacagugacau

SEQ ID NO: 896082 - RNA, 22 nt, Human
cagagggcucggcggccgcucc

SEQ ID NO: 896083 - RNA, 22 nt, Human
cagcuggccugaucccuguggc

SEQ ID NO: 896084 - RNA, 22 nt, Human
augcaacagcugggaauaugua

SEQ ID NO: 896085 - RNA, 22 nt, Human
cccagugucugggccugcaggg

SEQ ID NO: 896086 - RNA, 22 nt, Human
uucuuuuaauuucugucugcag

SEQ ID NO: 896087 - RNA, 22 nt, Human
ucaauacagaaaggauauuuug

SEQ ID NO: 896088 - RNA, 22 nt, Human
ggagcagcacugccacacagag

SEQ ID NO: 896089 - RNA, 19 nt, Human
ucuccagcuuugggcuuuu

SEQ ID NO: 896090 - RNA, 22 nt, Human
aggagcugaaacuucucauaug

SEQ ID NO: 896091 - RNA, 22 nt, Human
ucaacauugagucccugggucu

SEQ ID NO: 896092 - RNA, 22 nt, Human
guggggguggaaaggcaaguug

SEQ ID NO: 896093 - RNA, 22 nt, Human
aaagugcugagacagacuggga

SEQ ID NO: 896094 - RNA, 22 nt, Human
ugccaaauuuucucagagaugc

SEQ ID NO: 896095 - RNA, 22 nt, Human
auuauuguuuuaauaguagaga

SEQ ID NO: 896096 - RNA, 22 nt, Human
cagcaugguggagcugcucuuu

SEQ ID NO: 896097 - RNA, 22 nt, Human
ucugggaaggcucugcagauau

SEQ ID NO: 896098 - RNA, 22 nt, Human
ugcaauuuuuuagcacaaggag

SEQ ID NO: 896099 - RNA, 22 nt, Human
agucugggcugucugcaggagu

SEQ ID NO: 896100 - RNA, 22 nt, Human
cugugggagggaaggcgcggcc

SEQ ID NO: 896101 - RNA, 18 nt, Human
cucauguguggucccagc

SEQ ID NO: 896102 - RNA, 22 nt, Human
agacaagacuaggcaguuguug

SEQ ID NO: 896103 - RNA, 22 nt, Human
ugucucugggugauucaguccu

SEQ ID NO: 896104 - RNA, 20 nt, Human
cccagggguuguggugagga

SEQ ID NO: 896105 - RNA, 22 nt, Human
ugucugucaucagggauauccu

SEQ ID NO: 896106 - RNA, 22 nt, Human
gccugggagugcacagugaggu

SEQ ID NO: 896107 - RNA, 22 nt, Human
aagcagcugaaggauucagggu

SEQ ID NO: 896108 - RNA, 22 nt, Human
uuuguagcagcaugauuuauaa

SEQ ID NO: 896109 - RNA, 22 nt, Human
aagccaggcugcacuugcuggg

SEQ ID NO: 896110 - RNA, 22 nt, Human
ugaaagcugcccaguggaauua

SEQ ID NO: 896111 - RNA, 22 nt, Human
cuuguauacaguguacacauug

SEQ ID NO: 896112 - RNA, 22 nt, Human
cagcacauaguagguauucacu

SEQ ID NO: 896113 - RNA, 22 nt, Human
uccaggccuuugcacauguugu

SEQ ID NO: 896114 - RNA, 22 nt, Human
ccaacacagauguguuaguguu

SEQ ID NO: 896115 - RNA, 22 nt, Human
uugauaaaaugauaucuucuuu

SEQ ID NO: 896116 - RNA, 22 nt, Human
cguauuuagaaggcugcugaaa

SEQ ID NO: 896117 - RNA, 22 nt, Human
acauuucuuuucaucucuauau

SEQ ID NO: 896118 - RNA, 22 nt, Human
ugucccaggccucauguugcca

SEQ ID NO: 896119 - RNA, 22 nt, Human
cagguguugggagaagagauaa

SEQ ID NO: 896120 - RNA, 21 nt, Human
ucuaagccuugcagauggguu

SEQ ID NO: 896121 - RNA, 21 nt, Human
uuuauucucagauacagggag

SEQ ID NO: 896122 - RNA, 19 nt, Human
aguuuuuggaaauccugcu

SEQ ID NO: 896123 - RNA, 22 nt, Human
uaacuagaauggcuauuuugag

SEQ ID NO: 896124 - RNA, 22 nt, Human
guuagcaaugaaaucuggaugc

SEQ ID NO: 896125 - RNA, 22 nt, Human
cacccaggcuagagugcagugg

SEQ ID NO: 896126 - RNA, 18 nt, Human
aguaaauguuaaauauug

SEQ ID NO: 896127 - RNA, 22 nt, Human
aaguuugucgaaauuaucagca

SEQ ID NO: 896128 - RNA, 22 nt, Human
acagacaucaucaacaucuucc

SEQ ID NO: 896129 - RNA, 22 nt, Human
cacauguacagaagcaggcugg

SEQ ID NO: 896130 - RNA, 22 nt, Human
gagaaguucuaauuggcucuuu

SEQ ID NO: 896131 - RNA, 22 nt, Human
auacacaucuauuuaagagaca

SEQ ID NO: 896132 - RNA, 22 nt, Human
cugucaccuguucacugcagca

SEQ ID NO: 896133 - RNA, 22 nt, Human
uuuucacaaggguccaacuagu

SEQ ID NO: 896134 - RNA, 22 nt, Human
aacacaugccuuaagaauaagu

SEQ ID NO: 896135 - RNA, 22 nt, Human
uguuucugucuguuuucuacau

SEQ ID NO: 896136 - RNA, 22 nt, Human
aaaaaccauugucuucagucuc

SEQ ID NO: 896137 - RNA, 22 nt, Human
ccucuguggcccugacucucuu

SEQ ID NO: 896138 - RNA, 22 nt, Human
ugucaguucagugauuacaaaa

SEQ ID NO: 896139 - RNA, 22 nt, Human
gcacaggucaggagaugagauu

SEQ ID NO: 896140 - RNA, 22 nt, Human
aaucaagaguuguguaauauuu

SEQ ID NO: 896141 - RNA, 22 nt, Human
auuuugaaaagcauuugaguaa

SEQ ID NO: 896142 - RNA, 22 nt, Human
cacugaaaucgaaaaauguagg

SEQ ID NO: 896143 - RNA, 22 nt, Human
caggaagaaagaggugaggugu

SEQ ID NO: 896144 - RNA, 23 nt, Human
gcucaucaggcuuagagucaagg

SEQ ID NO: 896145 - RNA, 22 nt, Human
guccugagcauuaagcaauugu

SEQ ID NO: 896146 - RNA, 22 nt, Human
aaauggcuacaagaugugcucu

SEQ ID NO: 896147 - RNA, 22 nt, Human
uaugcaaaugacugguauguuu

SEQ ID NO: 896148 - RNA, 22 nt, Human
agaaaaacacaaucgggccucc

SEQ ID NO: 896149 - RNA, 22 nt, Human
aaaggagacagucuuaccugga

SEQ ID NO: 896150 - RNA, 22 nt, Human
cagacuggcugaaggccgagug

SEQ ID NO: 896151 - RNA, 22 nt, Human
ucaggcuuccaacaaugauguu

SEQ ID NO: 896152 - RNA, 22 nt, Human
auggcagauggcuggagcaggu

SEQ ID NO: 896153 - RNA, 22 nt, Human
cuggggcugcagcgaucuucau

SEQ ID NO: 896154 - RNA, 22 nt, Human
gcauuacuucuuucauagguca

SEQ ID NO: 896155 - RNA, 22 nt, Human
uacacauauguccauuaaucag

SEQ ID NO: 896156 - RNA, 22 nt, Human
ugagaauuuuuugucaugcauu

SEQ ID NO: 896157 - RNA, 22 nt, Human
ucacacuuuccauggcuguuaa

SEQ ID NO: 896158 - RNA, 19 nt, Human
auucuuguuaagugucauc

SEQ ID NO: 896159 - RNA, 22 nt, Human
agcugccucccugugcuugucc

SEQ ID NO: 896160 - RNA, 22 nt, Human
caguuauaagacuaagcuauuc

SEQ ID NO: 896161 - RNA, 23 nt, Human
uucuucucaauuaguugauucag

SEQ ID NO: 896162 - RNA, 17 nt, Human
uggucuggaagaacuga

SEQ ID NO: 896163 - RNA, 22 nt, Human
guauuucccugaguucugugag

SEQ ID NO: 896164 - RNA, 22 nt, Human
agcuggaacuggguuuguugga

SEQ ID NO: 896165 - RNA, 22 nt, Human
uggcccugcuggacacgccugc

SEQ ID NO: 896166 - RNA, 19 nt, Human
aggacccuuauccuggcuu

SEQ ID NO: 896167 - RNA, 22 nt, Human
gguagcaucuuuggauguuauu

SEQ ID NO: 896168 - RNA, 22 nt, Human
ugagggucauuuggaaguggaa

SEQ ID NO: 896169 - RNA, 22 nt, Human
uaacaaggcaauuugugauccu

SEQ ID NO: 896170 - RNA, 20 nt, Human
ccugccuguguuugugauga

SEQ ID NO: 896171 - RNA, 22 nt, Human
agguauggcauaaaucacaggg

SEQ ID NO: 896172 - RNA, 22 nt, Human
auacauguuugcuggauaaaca

SEQ ID NO: 896173 - RNA, 22 nt, Human
uggagcugagaaguggagcucu

SEQ ID NO: 896174 - RNA, 22 nt, Human
ugcugaagggaaggucuugaau

SEQ ID NO: 896175 - RNA, 22 nt, Human
cuugucagccaauuguggauuu

SEQ ID NO: 896176 - RNA, 16 nt, Human
gggagggaguuggugg

SEQ ID NO: 896177 - RNA, 22 nt, Human
agaggcucuugcccuucccaca

SEQ ID NO: 896178 - RNA, 22 nt, Human
cagaaucuucuuaauuggcaca

SEQ ID NO: 896179 - RNA, 22 nt, Human
aucacugagcuucagugcuggc

SEQ ID NO: 896180 - RNA, 22 nt, Human
aggugagaaaacgaggguugca

SEQ ID NO: 896181 - RNA, 22 nt, Human
acagggugaaugugacauuauc

SEQ ID NO: 896182 - RNA, 22 nt, Human
cagggccucgaagccucugggc

SEQ ID NO: 896183 - RNA, 22 nt, Human
ggagggcucccugggaguggau

SEQ ID NO: 896184 - RNA, 22 nt, Human
aaagacuuggcuuaugauuugc

SEQ ID NO: 896185 - RNA, 22 nt, Human
uauuuaguuaucuuucauaaaa

SEQ ID NO: 896186 - RNA, 22 nt, Human
ggucuccuugggaaagcaggaa

SEQ ID NO: 896187 - RNA, 20 nt, Human
uaaagacauaagcuacuauc

SEQ ID NO: 896188 - RNA, 22 nt, Human
aucuuuggugcaugauacuuug

SEQ ID NO: 896189 - RNA, 22 nt, Human
cuaaggaaaaggauauauaugu

SEQ ID NO: 896190 - RNA, 22 nt, Human
gagggugucucacgugaaagua

SEQ ID NO: 896191 - RNA, 22 nt, Human
gucacaggguccccauauggag

SEQ ID NO: 896192 - RNA, 17 nt, Human
agacucugucccaugua

SEQ ID NO: 896193 - RNA, 22 nt, Human
agggaccuugauggguuuggga

SEQ ID NO: 896194 - RNA, 22 nt, Human
auugaauagaugcauuauacua

SEQ ID NO: 896195 - RNA, 22 nt, Human
ggccuuggggaggauggugucc

SEQ ID NO: 896196 - RNA, 22 nt, Human
aaaguucucuaugguguaaaaa

SEQ ID NO: 896197 - RNA, 22 nt, Human
uguucuaggcaaaagcugauuu

SEQ ID NO: 896198 - RNA, 22 nt, Human
guuccacaaagauugucucucu

SEQ ID NO: 896199 - RNA, 22 nt, Human
cuagaagcaacuagaucuguuu

SEQ ID NO: 896200 - RNA, 22 nt, Human
cuggcuuuuuucccauuaugca

SEQ ID NO: 896201 - RNA, 22 nt, Human
uugcagggauuaccuuauuuuu

SEQ ID NO: 896202 - RNA, 22 nt, Human
uguaucuucaguuugucuuucc

SEQ ID NO: 896203 - RNA, 22 nt, Human
uggcuacagaauuggcccuguu

SEQ ID NO: 896204 - RNA, 22 nt, Human
augcaucacuugaggucaggag

SEQ ID NO: 896205 - RNA, 22 nt, Human
uucagcuugcuuagucuccuuc

SEQ ID NO: 896206 - RNA, 22 nt, Human
acacccagauuaugcacacaaa

SEQ ID NO: 896207 - RNA, 22 nt, Human
acagagguggaccucagcaggc

SEQ ID NO: 896208 - RNA, 22 nt, Human
ccccacccucgcuccauuucgg

SEQ ID NO: 896209 - RNA, 22 nt, Human
uagcgagguguuucuaggacug

SEQ ID NO: 896210 - RNA, 22 nt, Human
guguccagggccguguugucuu

SEQ ID NO: 896211 - RNA, 22 nt, Human
uaaacagaaagcagauguacuu

SEQ ID NO: 896212 - RNA, 20 nt, Human
uccuuuggccuuagagcugu

SEQ ID NO: 896213 - RNA, 22 nt, Human
auuccuuguauaucuacaugca

SEQ ID NO: 896214 - RNA, 22 nt, Human
uuguauuuggguaguauagaga

SEQ ID NO: 896215 - RNA, 19 nt, Human
aagcauuagccaaagcauu

SEQ ID NO: 896216 - RNA, 23 nt, Human
ucuacccacacugcucuagaagg

SEQ ID NO: 896217 - RNA, 22 nt, Human
gcacaauaauucuuguuuugcu

SEQ ID NO: 896218 - RNA, 22 nt, Human
auggaaauggagugugcuugcu

SEQ ID NO: 896219 - RNA, 22 nt, Human
uauuagcaaccaagagccucua

SEQ ID NO: 896220 - RNA, 22 nt, Human
aaggaaaugugccugacacugc

SEQ ID NO: 896221 - RNA, 21 nt, Human
auguggccauuguaguccacg

SEQ ID NO: 896222 - RNA, 22 nt, Human
uguguacaucucuucucacauu

SEQ ID NO: 896223 - RNA, 22 nt, Human
guucauguuugagaacaaggag

SEQ ID NO: 896224 - RNA, 22 nt, Human
aaauagcauuguauuuagcuga

SEQ ID NO: 896225 - RNA, 22 nt, Human
cuccugggaggaugcggacccg

SEQ ID NO: 896226 - RNA, 22 nt, Human
cuuauuaauggaauccuaauga

SEQ ID NO: 896227 - RNA, 22 nt, Human
cagggcaguuugugccuaugag

SEQ ID NO: 896228 - RNA, 22 nt, Human
caauucaaguugaguacagcuu

SEQ ID NO: 896229 - RNA, 22 nt, Human
uacaacagaccuagaugaauga

SEQ ID NO: 896230 - RNA, 22 nt, Human
ggcccaguguaccccaggcagu

SEQ ID NO: 896231 - RNA, 22 nt, Human
aaucauaauuuugugaauguag

SEQ ID NO: 896232 - RNA, 22 nt, Human
ccaucccuccuccaccagcuag

SEQ ID NO: 896233 - RNA, 22 nt, Human
aaaagagcuugguugauuuugc

SEQ ID NO: 896234 - RNA, 22 nt, Human
uggcuucuaaaguuucuuuuag

SEQ ID NO: 896235 - RNA, 22 nt, Human
cagcaggcccaggugcugguga

SEQ ID NO: 896236 - RNA, 22 nt, Human
cacaugcaccagaaaucaacau

SEQ ID NO: 896237 - RNA, 22 nt, Human
cugccuucuuucaaggguaagc

SEQ ID NO: 896238 - RNA, 22 nt, Human
uccagccaggauggcccaggga

SEQ ID NO: 896239 - RNA, 22 nt, Human
acaggcagcacuaaucucuggu

SEQ ID NO: 896240 - RNA, 22 nt, Human
ugccagggcugcuacuggcuga

SEQ ID NO: 896241 - RNA, 22 nt, Human
agccaggcagggcucucgcucu

SEQ ID NO: 896242 - RNA, 22 nt, Human
uaaguaauugcagcaauuugcc

SEQ ID NO: 896243 - RNA, 22 nt, Human
agaaagcaucuccauuguaggu

SEQ ID NO: 896244 - RNA, 22 nt, Human
uuggcagcagaguguggugcuc

SEQ ID NO: 896245 - RNA, 22 nt, Human
uuggaagagagccacaguuaau

SEQ ID NO: 896246 - RNA, 23 nt, Human
gcuucugccauuugcuagcugug

SEQ ID NO: 896247 - RNA, 22 nt, Human
agggcagcuagcuguagaaaga

SEQ ID NO: 896248 - RNA, 22 nt, Human
agggacuggcucucugagcagg

SEQ ID NO: 896249 - RNA, 22 nt, Human
gcaggcugccaccuucugaguu

SEQ ID NO: 896250 - RNA, 22 nt, Human
caauuugcccuguuaaauuuuc

SEQ ID NO: 896251 - RNA, 21 nt, Human
uccaagccuucaacacauuca

SEQ ID NO: 896252 - RNA, 22 nt, Human
caugacaccuaccauauuaagu

SEQ ID NO: 896253 - RNA, 22 nt, Human
aggugaaugcucacauucuaau

SEQ ID NO: 896254 - RNA, 22 nt, Human
ucagccagggcucuggccucag

SEQ ID NO: 896255 - RNA, 22 nt, Human
gaggccaggguaccaucaacau

SEQ ID NO: 896256 - RNA, 22 nt, Human
acaugacagugacuuuauaaga

SEQ ID NO: 896257 - RNA, 22 nt, Human
ggaugggcugaaagguagcccc

SEQ ID NO: 896258 - RNA, 22 nt, Human
aaaacauaaacugacagcccau

SEQ ID NO: 896259 - RNA, 22 nt, Human
guaauaauacuagucagccuug

SEQ ID NO: 896260 - RNA, 23 nt, Human
gggagccauggguggucauggag

SEQ ID NO: 896261 - RNA, 22 nt, Human
ugucugagcgagaaaguagugu

SEQ ID NO: 896262 - RNA, 22 nt, Human
ccccaggcagggccuaacagag

SEQ ID NO: 896263 - RNA, 22 nt, Human
ucauuuguaccauuuuuuaaga

SEQ ID NO: 896264 - RNA, 22 nt, Human
cucugggcugaauggcugaacc

SEQ ID NO: 896265 - RNA, 22 nt, Human
agcugccuccauggucaaagau

SEQ ID NO: 896266 - RNA, 22 nt, Human
ugaaaucaugaacaagguaggu

SEQ ID NO: 896267 - RNA, 22 nt, Human
cauuagcagucauuacugugcu

SEQ ID NO: 896268 - RNA, 22 nt, Human
agucccaguucgguucuuccuc

SEQ ID NO: 896269 - RNA, 22 nt, Human
cacaggagagcugggaggugcc

SEQ ID NO: 896270 - RNA, 22 nt, Human
ggugaagggccuuaggagacag

SEQ ID NO: 896271 - RNA, 22 nt, Human
gagcugccggcccacaguacua

SEQ ID NO: 896272 - RNA, 22 nt, Human
cagggagaaaucuccaggaggu

SEQ ID NO: 896273 - RNA, 22 nt, Human
gaaguuuagaagugacagguuu

SEQ ID NO: 896274 - RNA, 22 nt, Human
ggaggccucaucuugccccgug

SEQ ID NO: 896275 - RNA, 22 nt, Human
agaccugguuuaucaccagcau

SEQ ID NO: 896276 - RNA, 22 nt, Human
aucagaaugcagccagcaguua

SEQ ID NO: 896277 - RNA, 22 nt, Human
uaaggcaagagcagggucuuug

SEQ ID NO: 896278 - RNA, 22 nt, Human
agugucugaucaguugacuaga

SEQ ID NO: 896279 - RNA, 22 nt, Human
uguuuacagggugauuuuaccu

SEQ ID NO: 896280 - RNA, 22 nt, Human
cagucaggcugcgcuucucuga

SEQ ID NO: 896281 - RNA, 22 nt, Human
agcccugggcagccaaggaagc

SEQ ID NO: 896282 - RNA, 22 nt, Human
uuguuuccauaauuaaguguga

SEQ ID NO: 896283 - RNA, 21 nt, Human
acagugugcuucucucccucc

SEQ ID NO: 896284 - RNA, 22 nt, Human
uuaacauuguccuuagcagauu

SEQ ID NO: 896285 - RNA, 22 nt, Human
cucugcugaucucagcugggcu

SEQ ID NO: 896286 - RNA, 17 nt, Human
cagcucugcaucuuccu

SEQ ID NO: 896287 - RNA, 22 nt, Human
ugcacuacugugauacacagcc

SEQ ID NO: 896288 - RNA, 22 nt, Human
uaacaaugguuuugcugauaau

SEQ ID NO: 896289 - RNA, 22 nt, Human
ggaaggaaauuggggcaguugu

SEQ ID NO: 896290 - RNA, 19 nt, Human
gaguauuuuccaacuuggu

SEQ ID NO: 896291 - RNA, 21 nt, Human
aggcaguugagcauguuauga

SEQ ID NO: 896292 - RNA, 22 nt, Human
cuuuccccaagcaccacagugc

SEQ ID NO: 896293 - RNA, 22 nt, Human
ugcauacauaaagugcuaucau

SEQ ID NO: 896294 - RNA, 22 nt, Human
cuccuggaggauagugacuggg

SEQ ID NO: 896295 - RNA, 19 nt, Human
ggcagcaagcucugaaggc

SEQ ID NO: 896296 - RNA, 20 nt, Human
gccagcugcccuuccacccu

SEQ ID NO: 896297 - RNA, 22 nt, Human
cugcagggaacugaggcccaga

SEQ ID NO: 896298 - RNA, 23 nt, Human
agcagcagcaauuaaguggauau

SEQ ID NO: 896299 - RNA, 22 nt, Human
agucaggauaugccuugugggc

SEQ ID NO: 896300 - RNA, 22 nt, Human
cuccagugcugucaucccuucc

SEQ ID NO: 896301 - RNA, 20 nt, Human
agcaaaaugcaagauuuuca

SEQ ID NO: 896302 - RNA, 22 nt, Human
guuauauaagacaaaucagagu

SEQ ID NO: 896303 - RNA, 22 nt, Human
ccugcugagacccugagguggg

SEQ ID NO: 896304 - RNA, 22 nt, Human
gcugcuguuccggcuacagccc

SEQ ID NO: 896305 - RNA, 22 nt, Human
gcugugauguggagggugcuga

SEQ ID NO: 896306 - RNA, 22 nt, Human
accugagacuugggaugggaau

SEQ ID NO: 896307 - RNA, 22 nt, Human
aggggcucaagcaguguggucu

SEQ ID NO: 896308 - RNA, 22 nt, Human
gggccuggggacaccaccauga

SEQ ID NO: 896309 - RNA, 18 nt, Human
uagaaucuguuauugccu

SEQ ID NO: 896310 - RNA, 22 nt, Human
cuuagaugaagucacagaaccc

SEQ ID NO: 896311 - RNA, 22 nt, Human
uuugucuuguguccuuaggacc

SEQ ID NO: 896312 - RNA, 22 nt, Human
acauacaugggauuaaaaaauu

SEQ ID NO: 896313 - RNA, 22 nt, Human
acaguacauaauccugagucug

SEQ ID NO: 896314 - RNA, 22 nt, Human
aggcaaaucucaguuggccucu

SEQ ID NO: 896315 - RNA, 22 nt, Human
ugaacuuacaaauuaaaagacu

SEQ ID NO: 896316 - RNA, 22 nt, Human
ugcucagggacaauggagaggg

SEQ ID NO: 896317 - RNA, 22 nt, Human
ccugugucuuccccacuggugu

SEQ ID NO: 896318 - RNA, 22 nt, Human
aacaaugucucauccuaugugg

SEQ ID NO: 896319 - RNA, 22 nt, Human
uguaaauucuauacacuuaaaa

SEQ ID NO: 896320 - RNA, 22 nt, Human
ccaagggcgccuccguuccccc

SEQ ID NO: 896321 - RNA, 22 nt, Human
aggcuggcggugacugcucuga

SEQ ID NO: 896322 - RNA, 20 nt, Human
aggcugccuaaggcucugca

SEQ ID NO: 896323 - RNA, 22 nt, Human
ugacucaguacaucuggaguug

SEQ ID NO: 896324 - RNA, 22 nt, Human
aggagacauggaauagugaggc

SEQ ID NO: 896325 - RNA, 22 nt, Human
aaggcagccuuuugaguugauu

SEQ ID NO: 896326 - RNA, 22 nt, Human
agugugcuguuuccagaagggc

SEQ ID NO: 896327 - RNA, 22 nt, Human
uucagaaaaaacuucaauaagu

SEQ ID NO: 896328 - RNA, 22 nt, Human
uuuuggaaucugggaaaacagu

SEQ ID NO: 896329 - RNA, 22 nt, Human
ccagcugucuugagaggaggca

SEQ ID NO: 896330 - RNA, 22 nt, Human
aaaugugaguuauagcaauaga

SEQ ID NO: 896331 - RNA, 22 nt, Human
uccaaaacagaacucugugaau

SEQ ID NO: 896332 - RNA, 22 nt, Human
ccauugaaccccucuaggccac

SEQ ID NO: 896333 - RNA, 22 nt, Human
aaagagacugguggcauuuugc

SEQ ID NO: 896334 - RNA, 22 nt, Human
acagugaaugcccaagaaaagu

SEQ ID NO: 896335 - RNA, 22 nt, Human
aauagauucaugguuaagagca

SEQ ID NO: 896336 - RNA, 22 nt, Human
gcagggcagcugaagcuaggug

SEQ ID NO: 896337 - RNA, 22 nt, Human
ugccucugugggcagagcugcc

SEQ ID NO: 896338 - RNA, 22 nt, Human
gagagaagggacuucuacacuu

SEQ ID NO: 896339 - RNA, 22 nt, Human
uuuaauuuuccugguaggccug

SEQ ID NO: 896340 - RNA, 22 nt, Human
ggaagcggcccugagcgcaggg

SEQ ID NO: 896341 - RNA, 22 nt, Human
gucuucuggaagagagccagcu

SEQ ID NO: 896342 - RNA, 22 nt, Human
gguggggagucaggcauucuug

SEQ ID NO: 896343 - RNA, 22 nt, Human
cuugagaaaggaacaggaagcu

SEQ ID NO: 896344 - RNA, 22 nt, Human
uguuaaaccaguuuugcaucau

SEQ ID NO: 896345 - RNA, 22 nt, Human
guauucuugguuaucaaaauac

SEQ ID NO: 896346 - RNA, 22 nt, Human
uaaaguucuuagaacaaggccu

SEQ ID NO: 896347 - RNA, 22 nt, Human
gagcuguuuuuuaaaguuagga

SEQ ID NO: 896348 - RNA, 22 nt, Human
caacucagacuggauuaaauaa

SEQ ID NO: 896349 - RNA, 22 nt, Human
gccauauauauuuugcacuagg

SEQ ID NO: 896350 - RNA, 22 nt, Human
auggaaauacacaagagguuuc

SEQ ID NO: 896351 - RNA, 22 nt, Human
ucagcaaggcugcauucucauc

SEQ ID NO: 896352 - RNA, 22 nt, Human
cuuuucaaacgcugaugucagu

SEQ ID NO: 896353 - RNA, 22 nt, Human
ccccuuccuuccucagacagcc

SEQ ID NO: 896354 - RNA, 22 nt, Human
gguccuuugaaagggguguguc

SEQ ID NO: 896355 - RNA, 22 nt, Human
gcagccacagaggagggaugca

SEQ ID NO: 896356 - RNA, 22 nt, Human
ggcaggcuuucagcaucaaguc

SEQ ID NO: 896357 - RNA, 22 nt, Human
agagaagcauucuucucagggc

SEQ ID NO: 896358 - RNA, 23 nt, Human
auguauguuucugcaucuucaac

SEQ ID NO: 896359 - RNA, 22 nt, Human
acguguguuggucagggggccc

SEQ ID NO: 896360 - RNA, 22 nt, Human
uauugaaauucuucauguccuc

SEQ ID NO: 896361 - RNA, 22 nt, Human
uuuaacagauaguuucuucugu

SEQ ID NO: 896362 - RNA, 21 nt, Human
uuggccuuugucucagacacu

SEQ ID NO: 896363 - RNA, 22 nt, Human
ggaggugggaguuuaguucuug

SEQ ID NO: 896364 - RNA, 22 nt, Human
uuguggggaggauuugaugaga

SEQ ID NO: 896365 - RNA, 22 nt, Human
gggcaguggguggcugcagccu

SEQ ID NO: 896366 - RNA, 18 nt, Human
gguggcggggauggaggu

SEQ ID NO: 896367 - RNA, 22 nt, Human
auuucuuccucugucaguaacu

SEQ ID NO: 896368 - RNA, 22 nt, Human
gcccugcuguuuagagagcuac

SEQ ID NO: 896369 - RNA, 18 nt, Human
auugcacaccagccuggg

SEQ ID NO: 896370 - RNA, 22 nt, Human
gaagagcuauguccagggagca

SEQ ID NO: 896371 - RNA, 22 nt, Human
uaaauguuuagucuuauuuggg

SEQ ID NO: 896372 - RNA, 22 nt, Human
cuggagccggaccagggacggu

SEQ ID NO: 896373 - RNA, 22 nt, Human
ucugagcugggggccuggcaug

SEQ ID NO: 896374 - RNA, 22 nt, Human
cucuucucugcagccuuugaag

SEQ ID NO: 896375 - RNA, 21 nt, Human
ugagguaguguuugucaaguu

SEQ ID NO: 896376 - RNA, 22 nt, Human
aucauccuagaaggaagcuagg

SEQ ID NO: 896377 - RNA, 22 nt, Human
agacuauuuugugauaacuaau

SEQ ID NO: 896378 - RNA, 22 nt, Human
ucuucauggucugguucuccag

SEQ ID NO: 896379 - RNA, 22 nt, Human
uauauucaaugauuaguaucag

SEQ ID NO: 896380 - RNA, 23 nt, Human
auuugacagagcauagcauuucu

SEQ ID NO: 896381 - RNA, 22 nt, Human
ccaaacugggccagucagcugu

SEQ ID NO: 896382 - RNA, 22 nt, Human
uccugggcuuaagugauccucc

SEQ ID NO: 896383 - RNA, 22 nt, Human
gaggacaggagacucacuguuu

SEQ ID NO: 896384 - RNA, 22 nt, Human
uaugcagagcaugacuguacca

SEQ ID NO: 896385 - RNA, 22 nt, Human
cagaguggcgacccccucagcu

SEQ ID NO: 896386 - RNA, 19 nt, Human
ccuggccagacuucugccc

SEQ ID NO: 896387 - RNA, 22 nt, Human
ccaguguuuacaguugaacaaa

SEQ ID NO: 896388 - RNA, 22 nt, Human
uuugauuuacuggauauucuca

SEQ ID NO: 896389 - RNA, 22 nt, Human
gaggccuggugcuguguccaca

SEQ ID NO: 896390 - RNA, 22 nt, Human
cucuuuggagaagcacguauua

SEQ ID NO: 896391 - RNA, 22 nt, Human
gagagacagcagaacgugcagc

SEQ ID NO: 896392 - RNA, 22 nt, Human
acuuuguaauaacuccugaguu

SEQ ID NO: 896393 - RNA, 23 nt, Human
acagcacccaugucaucuggcuc

SEQ ID NO: 896394 - RNA, 21 nt, Human
ggugacacguggccccgcucu

SEQ ID NO: 896395 - RNA, 22 nt, Human
agguggcagaugggggugcucg

SEQ ID NO: 896396 - RNA, 19 nt, Human
aggcuucaggccacaugcu

SEQ ID NO: 896397 - RNA, 23 nt, Human
ugggaagauauguauguucaagg

SEQ ID NO: 896398 - RNA, 22 nt, Human
aagcagcuuccccaaagugccu

SEQ ID NO: 896399 - RNA, 22 nt, Human
uuuuaauucaaagugaauagug

SEQ ID NO: 896400 - RNA, 22 nt, Human
uuucauuggcucccugaugaau

SEQ ID NO: 896401 - RNA, 22 nt, Human
ugagaggcgcucacucucaggu

SEQ ID NO: 896402 - RNA, 22 nt, Human
aaguaacuaaagauauccauuu

SEQ ID NO: 896403 - RNA, 22 nt, Human
agucuauuuugcuuauucuaug

SEQ ID NO: 896404 - RNA, 22 nt, Human
caguguuucugaguuccagcuc

SEQ ID NO: 896405 - RNA, 22 nt, Human
aauaauaagauacuaagggagu

SEQ ID NO: 896406 - RNA, 22 nt, Human
uuacacagugguuaagucuggg

SEQ ID NO: 896407 - RNA, 22 nt, Human
gggaaggagccugcuugcuaga

SEQ ID NO: 896408 - RNA, 22 nt, Human
ccacaggggucucuguagcuga

SEQ ID NO: 896409 - RNA, 22 nt, Human
ugacauugugugcauuuaaagu

SEQ ID NO: 896410 - RNA, 22 nt, Human
ggcgguggcgugaagguggcug

SEQ ID NO: 896411 - RNA, 22 nt, Human
ucauagaaugaguuaaugaacu

SEQ ID NO: 896412 - RNA, 21 nt, Human
uacagaaugcgcuucagucug

SEQ ID NO: 896413 - RNA, 20 nt, Human
accaggccccgggcccugca

SEQ ID NO: 896414 - RNA, 22 nt, Human
gcccugcugcuggcagaggcgc

SEQ ID NO: 896415 - RNA, 23 nt, Human
uguagcaucucuuauuucucagc

SEQ ID NO: 896416 - RNA, 22 nt, Human
acaauagacccaugacacauac

SEQ ID NO: 896417 - RNA, 22 nt, Human
agaggccagcagugccuaucug

SEQ ID NO: 896418 - RNA, 22 nt, Human
gggcuaagcucgcccagggcca

SEQ ID NO: 896419 - RNA, 22 nt, Human
guccuggggaauacagaagccg

SEQ ID NO: 896420 - RNA, 22 nt, Human
gggauuacagaugugagccauu

SEQ ID NO: 896421 - RNA, 22 nt, Human
gccaggucucauaaaugcagcu

SEQ ID NO: 896422 - RNA, 22 nt, Human
ggcagaagguugaaguaauuug

SEQ ID NO: 896423 - RNA, 22 nt, Human
uggccugcuuucuuagguguuc

SEQ ID NO: 896424 - RNA, 22 nt, Human
agaaauaugcugauuagaugaa

SEQ ID NO: 896425 - RNA, 23 nt, Human
aggauguaggauguauggcagag

SEQ ID NO: 896426 - RNA, 22 nt, Human
gcucuguguccacagcuggaaa

SEQ ID NO: 896427 - RNA, 22 nt, Human
gcacagggagcaggucucuggu

SEQ ID NO: 896428 - RNA, 22 nt, Human
aggggccauuguucugcccgcu

SEQ ID NO: 896429 - RNA, 21 nt, Human
cuaagcaaggagcagggguag

SEQ ID NO: 896430 - RNA, 22 nt, Human
cacagcaaagacacucucaacu

SEQ ID NO: 896431 - RNA, 22 nt, Human
gguggggccagggcuccaaccu

SEQ ID NO: 896432 - RNA, 22 nt, Human
aacgcccgugguugccaaggua

SEQ ID NO: 896433 - RNA, 22 nt, Human
uuugaaguccaucuggcccagu

SEQ ID NO: 896434 - RNA, 22 nt, Human
ccaggacccugcaaacccuguu

SEQ ID NO: 896435 - RNA, 22 nt, Human
guguagcuuuggagugggaggc

SEQ ID NO: 896436 - RNA, 22 nt, Human
cacauuguagagauuagaaaga

SEQ ID NO: 896437 - RNA, 22 nt, Human
uuucacaaugcaauccuacuuc

SEQ ID NO: 896438 - RNA, 22 nt, Human
ccuuugggugaauuccucucuu

SEQ ID NO: 896439 - RNA, 22 nt, Human
gccaggagggaaaggacaauuu

SEQ ID NO: 896440 - RNA, 22 nt, Human
aacuuuucauuccaaaggugcu

SEQ ID NO: 896441 - RNA, 22 nt, Human
accagggcacaggagucugaag

SEQ ID NO: 896442 - RNA, 22 nt, Human
aaauuaguacauugcaaagucc

SEQ ID NO: 896443 - RNA, 23 nt, Human
ucucugaguuguacuuucccuug

SEQ ID NO: 896444 - RNA, 22 nt, Human
aaugucaaguagccaaugcuuc

SEQ ID NO: 896445 - RNA, 17 nt, Human
uguacaacaguaccuuc

SEQ ID NO: 896446 - RNA, 22 nt, Human
uucuucaggauacgucauccag

SEQ ID NO: 896447 - RNA, 19 nt, Human
agcgguucucaaagucagg

SEQ ID NO: 896448 - RNA, 22 nt, Human
ugucccauggacacaacuucuu

SEQ ID NO: 896449 - RNA, 22 nt, Human
aaugcacauauauuuccuuauu

SEQ ID NO: 896450 - RNA, 22 nt, Human
aaacccauggcugauaucacua

SEQ ID NO: 896451 - RNA, 22 nt, Human
gggcuccagaguccauguucuu

SEQ ID NO: 896452 - RNA, 22 nt, Human
aggccagcgcugcuagcucccg

SEQ ID NO: 896453 - RNA, 22 nt, Human
agagucagaaccaagaugaggc

SEQ ID NO: 896454 - RNA, 22 nt, Human
cauuagaacuaagauguccagg

SEQ ID NO: 896455 - RNA, 21 nt, Human
agggucaggaaccaggguacc

SEQ ID NO: 896456 - RNA, 22 nt, Human
ggcucuggcggcucuuucaaua

SEQ ID NO: 896457 - RNA, 23 nt, Human
agcuagcauaaugucuggcuccu

SEQ ID NO: 896458 - RNA, 17 nt, Human
agcaccuguccaguccc

SEQ ID NO: 896459 - RNA, 22 nt, Human
gccaggcuccccggaucccugg

SEQ ID NO: 896460 - RNA, 22 nt, Human
cuucacuuuaagccaaucauga

SEQ ID NO: 896461 - RNA, 22 nt, Human
uaaguuuauagauaaaugccua

SEQ ID NO: 896462 - RNA, 22 nt, Human
uaaguucaccaguuguaauaag

SEQ ID NO: 896463 - RNA, 22 nt, Human
agcagcagaagggagacccagg

SEQ ID NO: 896464 - RNA, 22 nt, Human
gucaggcccuggcagccgugac

SEQ ID NO: 896465 - RNA, 22 nt, Human
uucacagauguauuggaacucc

SEQ ID NO: 896466 - RNA, 22 nt, Human
uacaaaggcgguuuuucugggc

SEQ ID NO: 896467 - RNA, 22 nt, Human
aggcuucagaugaccuuagcau

SEQ ID NO: 896468 - RNA, 22 nt, Human
ccacacagggggaugaguuauu

SEQ ID NO: 896469 - RNA, 21 nt, Human
uucuacaggaugaaugaaaac

SEQ ID NO: 896470 - RNA, 22 nt, Human
uggaauguaaacucugugaggg

SEQ ID NO: 896471 - RNA, 22 nt, Human
guggcacagagauggggcauga

SEQ ID NO: 896472 - RNA, 20 nt, Human
agaagcauucaaagaaaacu

SEQ ID NO: 896473 - RNA, 20 nt, Human
aagcuggaagaccagcauug

SEQ ID NO: 896474 - RNA, 22 nt, Human
cucaaggaaagucuggagaaga

SEQ ID NO: 896475 - RNA, 22 nt, Human
ugagacaguaauuguauaguuu

SEQ ID NO: 896476 - RNA, 22 nt, Human
cuucccuucugcagaucuuugg

SEQ ID NO: 896477 - RNA, 22 nt, Human
ugcuuaaacauccagacaguau

SEQ ID NO: 896478 - RNA, 23 nt, Human
uguaccaggaguuucagcagacu

SEQ ID NO: 896479 - RNA, 22 nt, Human
agggcuggagccacagcuggga

SEQ ID NO: 896480 - RNA, 22 nt, Human
aggcugagucgggaggaucacu

SEQ ID NO: 896481 - RNA, 22 nt, Human
ugaggcaggagaauggcgggaa

SEQ ID NO: 896482 - RNA, 22 nt, Human
cuuuuuacucuguugucucagc

SEQ ID NO: 896483 - RNA, 22 nt, Human
uguauacauacauaugugugug

SEQ ID NO: 896484 - RNA, 19 nt, Human
uuucuaauguguuuuucuu

SEQ ID NO: 896485 - RNA, 22 nt, Human
gaaugaaucuguaagugacaag

SEQ ID NO: 896486 - RNA, 22 nt, Human
augaauauugaaugucuuauga

SEQ ID NO: 896487 - RNA, 22 nt, Human
aggcuccauaccaucuccggag

SEQ ID NO: 896488 - RNA, 22 nt, Human
uaggggugaggccaggcaucag

SEQ ID NO: 896489 - RNA, 22 nt, Human
agcuuuggaugaucuuugauac

SEQ ID NO: 896490 - RNA, 22 nt, Human
uuaugguaauuaaaacauguau

SEQ ID NO: 896491 - RNA, 22 nt, Human
uauguggccuuuuaugucugac

SEQ ID NO: 896492 - RNA, 20 nt, Human
cagguccagcacgugcacgg

SEQ ID NO: 896493 - RNA, 22 nt, Human
gggcucagcugggcgugcuggu

SEQ ID NO: 896494 - RNA, 22 nt, Human
auauguuucaguauucaaguca

SEQ ID NO: 896495 - RNA, 23 nt, Human
uucuggaagauuuacuugagaca

SEQ ID NO: 896496 - RNA, 22 nt, Human
agggcugacaguaaaaguauga

SEQ ID NO: 896497 - RNA, 22 nt, Human
cuucaugaggccggcuuuaucc

SEQ ID NO: 896498 - RNA, 22 nt, Human
uguuaauauacuaaaauccacu

SEQ ID NO: 896499 - RNA, 22 nt, Human
uuauucuuuucuccagaauccc

SEQ ID NO: 896500 - RNA, 22 nt, Human
caggccagcuuccugacauccu

SEQ ID NO: 896501 - RNA, 22 nt, Human
acugggccggugcagaguaguu

SEQ ID NO: 896502 - RNA, 22 nt, Human
uucagaaaugucagccaucaga

SEQ ID NO: 896503 - RNA, 22 nt, Human
uucugggagagaaagggccuug

SEQ ID NO: 896504 - RNA, 22 nt, Human
uauuggauuucugaaagaugag

SEQ ID NO: 896505 - RNA, 22 nt, Human
ucaucacauguguagucauccc

SEQ ID NO: 896506 - RNA, 22 nt, Human
ucuguggcaaacacagugacca

SEQ ID NO: 896507 - RNA, 22 nt, Human
cugugccaggcccagcugacuu

SEQ ID NO: 896508 - RNA, 22 nt, Human
cugagcugggaguagagacucu

SEQ ID NO: 896509 - RNA, 22 nt, Human
auuuagaacuuuguuugccaau

SEQ ID NO: 896510 - RNA, 23 nt, Human
agccucuuuucuccugcccugca

SEQ ID NO: 896511 - RNA, 22 nt, Human
guacaaguucuacucuauaaau

SEQ ID NO: 896512 - RNA, 22 nt, Human
ugggagcaggaagcaggaagua

SEQ ID NO: 896513 - RNA, 22 nt, Human
caggcagcucuaauggaaagug

SEQ ID NO: 896514 - RNA, 22 nt, Human
ccugagaaauagcaucauuuuu

SEQ ID NO: 896515 - RNA, 22 nt, Human
uggagccugagucagcggaggc

SEQ ID NO: 896516 - RNA, 22 nt, Human
gcaugggaggacagucugggcu

SEQ ID NO: 896517 - RNA, 22 nt, Human
aagauucuagaggaacuucuua

SEQ ID NO: 896518 - RNA, 22 nt, Human
auuccacagugccuuccgugaa

SEQ ID NO: 896519 - RNA, 20 nt, Human
gaaaauaggccagccaggua

SEQ ID NO: 896520 - RNA, 21 nt, Human
aacauuaguaauuugacuuuu

SEQ ID NO: 896521 - RNA, 22 nt, Human
uagcagggucucaggagucagg

SEQ ID NO: 896522 - RNA, 22 nt, Human
aacaaugauauagggauuggca

SEQ ID NO: 896523 - RNA, 22 nt, Human
uagcagaaccagcagucaauuu

SEQ ID NO: 896524 - RNA, 22 nt, Human
caggaguggugugagggacucc

SEQ ID NO: 896525 - RNA, 22 nt, Human
agggcugccugacuccagagcc

SEQ ID NO: 896526 - RNA, 22 nt, Human
aaaguuuguuauaugauaagga

SEQ ID NO: 896527 - RNA, 22 nt, Human
agauuacagaagaauaaguaga

SEQ ID NO: 896528 - RNA, 22 nt, Human
uccucugcuccaucuuuacugu

SEQ ID NO: 896529 - RNA, 22 nt, Human
uagauacucagaaaugcuuuca

SEQ ID NO: 896530 - RNA, 21 nt, Human
uacuacagucucuuuaucagu

SEQ ID NO: 896531 - RNA, 22 nt, Human
gaugaaaaauugcugugucaua

SEQ ID NO: 896532 - RNA, 20 nt, Human
acagagaucagcugaugggc

SEQ ID NO: 896533 - RNA, 22 nt, Human
aguccauacauugagaauaaca

SEQ ID NO: 896534 - RNA, 22 nt, Human
ugauuugaaaccuuuggcaaga

SEQ ID NO: 896535 - RNA, 22 nt, Human
uucagagaaacugagguuuaga

SEQ ID NO: 896536 - RNA, 22 nt, Human
ugucucuuggauugcuugcucu

SEQ ID NO: 896537 - RNA, 22 nt, Human
aguuuucuguucuacaauuuga

SEQ ID NO: 896538 - RNA, 22 nt, Human
ccuggcugcauuuugcuggaug

SEQ ID NO: 896539 - RNA, 22 nt, Human
ucucugagaaguuccuuuguga

SEQ ID NO: 896540 - RNA, 22 nt, Human
ucuguugcaaugugcaugguga

SEQ ID NO: 896541 - RNA, 22 nt, Human
gaacaaacugggucccaaugau

SEQ ID NO: 896542 - RNA, 22 nt, Human
cuggggacucauucagagcaua

SEQ ID NO: 896543 - RNA, 22 nt, Human
uauaauuuuaagugguaaauua

SEQ ID NO: 896544 - RNA, 22 nt, Human
gcagaggguccugugccagcag

SEQ ID NO: 896545 - RNA, 22 nt, Human
acaguggaauggugggccugca

SEQ ID NO: 896546 - RNA, 22 nt, Human
ggaauguugucauuuacauuau

SEQ ID NO: 896547 - RNA, 22 nt, Human
ucuuuggcaucagggccagcua

SEQ ID NO: 896548 - RNA, 22 nt, Human
aacaugcauguuauuuaucagu

SEQ ID NO: 896549 - RNA, 22 nt, Human
agcuuacaguucaaugacaaag

SEQ ID NO: 896550 - RNA, 22 nt, Human
uccuuggagguguucaucugcc

SEQ ID NO: 896551 - RNA, 22 nt, Human
aggccagcucuacccuuggacu

SEQ ID NO: 896552 - RNA, 22 nt, Human
uuugugcaauuuauguacuaua

SEQ ID NO: 896553 - RNA, 22 nt, Human
acagaaguuucaaguaagaagu

SEQ ID NO: 896554 - RNA, 22 nt, Human
ugagcagcccuuccuccggcca

SEQ ID NO: 896555 - RNA, 22 nt, Human
ggcaagguacucuagagcacau

SEQ ID NO: 896556 - RNA, 22 nt, Human
gaggcagcugggauacaaggga

SEQ ID NO: 896557 - RNA, 22 nt, Human
aauauuugaacagucacugagu

SEQ ID NO: 896558 - RNA, 22 nt, Human
gaaauguauaagcuggucuuuu

SEQ ID NO: 896559 - RNA, 22 nt, Human
acaggccuagggucaauuuccu

SEQ ID NO: 896560 - RNA, 22 nt, Human
uuuaauacagaacuugucaggg

SEQ ID NO: 896561 - RNA, 22 nt, Human
gguucuagugacacugaauuga

SEQ ID NO: 896562 - RNA, 22 nt, Human
aaagacauuagcuuagauguca

SEQ ID NO: 896563 - RNA, 22 nt, Human
caggcacaaauuucuagauaag

SEQ ID NO: 896564 - RNA, 22 nt, Human
uacaaugacucucaguuuggcu

SEQ ID NO: 896565 - RNA, 21 nt, Human
ugggccucaaguggguggcag

SEQ ID NO: 896566 - RNA, 22 nt, Human
aagacucaaggaacaacacagu

SEQ ID NO: 896567 - RNA, 22 nt, Human
acagggcuuuuaaucaguaguu

SEQ ID NO: 896568 - RNA, 22 nt, Human
auaugaauuuggcuggaaaggu

SEQ ID NO: 896569 - RNA, 22 nt, Human
gccucuccucuuaauaccauua

SEQ ID NO: 896570 - RNA, 22 nt, Human
auucuacaaaagaacuggaucu

SEQ ID NO: 896571 - RNA, 18 nt, Human
ucugagguggacgaggag

SEQ ID NO: 896572 - RNA, 22 nt, Human
ugggccccagcacgucugggga

SEQ ID NO: 896573 - RNA, 22 nt, Human
uccuggagaagaggggcuugga

SEQ ID NO: 896574 - RNA, 22 nt, Human
uccugcagagacagaggccuca

SEQ ID NO: 896575 - RNA, 22 nt, Human
cagagccacuuggagaugagaa

SEQ ID NO: 896576 - RNA, 22 nt, Human
uaaaagacccucuagaguccca

SEQ ID NO: 896577 - RNA, 22 nt, Human
uggcugaggucuggggcuucug

SEQ ID NO: 896578 - RNA, 22 nt, Human
ugucauauagaauguucuauga

SEQ ID NO: 896579 - RNA, 22 nt, Human
ggacaaaggguggagccucuga

SEQ ID NO: 896580 - RNA, 22 nt, Human
ccagggaagucacauugucuag

SEQ ID NO: 896581 - RNA, 19 nt, Human
aucuuuagggauguggcuu

SEQ ID NO: 896582 - RNA, 22 nt, Human
gcaauauaaccaguugucaugc

SEQ ID NO: 896583 - RNA, 22 nt, Human
gccaggcucuuccauuuggguc

SEQ ID NO: 896584 - RNA, 22 nt, Human
gaggcuucuggaaagccuggca

SEQ ID NO: 896585 - RNA, 22 nt, Human
gccaccagguuagauccagccu

SEQ ID NO: 896586 - RNA, 22 nt, Human
caggaagcuggguuuccauaca

SEQ ID NO: 896587 - RNA, 22 nt, Human
cuggggucucaauucuagcggg

SEQ ID NO: 896588 - RNA, 22 nt, Human
aucugguucuucuuaggcauca

SEQ ID NO: 896589 - RNA, 22 nt, Human
ugaaacuuauaagaauaugaau

SEQ ID NO: 896590 - RNA, 22 nt, Human
gccucucucuacccaguaugau

SEQ ID NO: 896591 - RNA, 18 nt, Human
uuaguauaacugccugug

SEQ ID NO: 896592 - RNA, 22 nt, Human
cacaugcaguuuuccagcaguc

SEQ ID NO: 896593 - RNA, 22 nt, Human
ucgaacucauagucguagcugu

SEQ ID NO: 896594 - RNA, 22 nt, Human
gaggcuggagauauuccaaucu

SEQ ID NO: 896595 - RNA, 22 nt, Human
gagaccuuaagagaugucagcu

SEQ ID NO: 896596 - RNA, 22 nt, Human
ugcugcagggauuucagagaca

SEQ ID NO: 896597 - RNA, 22 nt, Human
gcccagcccugaggucacagcu

SEQ ID NO: 896598 - RNA, 22 nt, Human
ggcagcaguggcugcuauuguc

SEQ ID NO: 896599 - RNA, 22 nt, Human
cucuggcaauugcugcugacuc

SEQ ID NO: 896600 - RNA, 22 nt, Human
cagaaacaggcaacgugugcac

SEQ ID NO: 896601 - RNA, 21 nt, Human
gcagcaaaugacaacagugag

SEQ ID NO: 896602 - RNA, 22 nt, Human
ugaugguaaacaaagacauuua

SEQ ID NO: 896603 - RNA, 22 nt, Human
cuguuuccccaugcccugacuc

SEQ ID NO: 896604 - RNA, 22 nt, Human
gcagagcagugcuugcccagcg

SEQ ID NO: 896605 - RNA, 22 nt, Human
cuggcagcuuagcacucugguu

SEQ ID NO: 896606 - RNA, 22 nt, Human
augacagaaggccucccugaca

SEQ ID NO: 896607 - RNA, 22 nt, Human
ccagcucugcauguuucccuug

SEQ ID NO: 896608 - RNA, 22 nt, Human
uacaguuacugcauuucuaaua

SEQ ID NO: 896609 - RNA, 22 nt, Human
uccaggagaaggccauccagcg

SEQ ID NO: 896610 - RNA, 22 nt, Human
aauuaucagauauaaaacugca

SEQ ID NO: 896611 - RNA, 22 nt, Human
gcccugucggaacugcgaccuc

SEQ ID NO: 896612 - RNA, 22 nt, Human
auccaaaccuggacaugagugg

SEQ ID NO: 896613 - RNA, 22 nt, Human
gcuggagccauuggcuuggccu

SEQ ID NO: 896614 - RNA, 17 nt, Human
gauggggcugacaucag

SEQ ID NO: 896615 - RNA, 22 nt, Human
ugaaacggaauguucuuuaucg

SEQ ID NO: 896616 - RNA, 22 nt, Human
ugcagggaugcuagagguaaga

SEQ ID NO: 896617 - RNA, 22 nt, Human
ugcuuuuugcacccuuugccgu

SEQ ID NO: 896618 - RNA, 22 nt, Human
uauucacauuaauaagucuuca

SEQ ID NO: 896619 - RNA, 22 nt, Human
ccagguguagcacugcucacag

SEQ ID NO: 896620 - RNA, 22 nt, Human
cagagguuugaucgaguagguc

SEQ ID NO: 896621 - RNA, 22 nt, Human
ccccagcugcauacuugccaag

SEQ ID NO: 896622 - RNA, 22 nt, Human
cagggugccucugcucccacca

SEQ ID NO: 896623 - RNA, 22 nt, Human
aauuuaguguaaagcuacugga

SEQ ID NO: 896624 - RNA, 22 nt, Human
guagaaaugguguguuucuucu

SEQ ID NO: 896625 - RNA, 23 nt, Human
agcuucauuauuuuccaugaucu

SEQ ID NO: 896626 - RNA, 22 nt, Human
ccaggaagggcucuuuaaagac

SEQ ID NO: 896627 - RNA, 22 nt, Human
aaugcaagucaaugcuauaccc

SEQ ID NO: 896628 - RNA, 22 nt, Human
aacaguuacccuuaagaucuuu

SEQ ID NO: 896629 - RNA, 22 nt, Human
gaaggcuggcuuucugagagca

SEQ ID NO: 896630 - RNA, 22 nt, Human
cagugcuguuaauaaacacaaa

SEQ ID NO: 896631 - RNA, 22 nt, Human
ugggagagugcucaaugugcaa

SEQ ID NO: 896632 - RNA, 22 nt, Human
uggcucuguuguaaagaaauuu

SEQ ID NO: 896633 - RNA, 22 nt, Human
uuacccagggaccaagagaaac

SEQ ID NO: 896634 - RNA, 22 nt, Human
acuucuuuucaaaucaugcaaa

SEQ ID NO: 896635 - RNA, 22 nt, Human
ccuggcaguggugaagaagagg

SEQ ID NO: 896636 - RNA, 22 nt, Human
acaguguuuggcaaugcaugca

SEQ ID NO: 896637 - RNA, 22 nt, Human
cuuaggaguucacuugaauagu

SEQ ID NO: 896638 - RNA, 22 nt, Human
gaagcgcggcgucggcgugggu

SEQ ID NO: 896639 - RNA, 22 nt, Human
ugcucacagcccagaacauaau

SEQ ID NO: 896640 - RNA, 22 nt, Human
ucuaggccguaggauacagagc

SEQ ID NO: 896641 - RNA, 22 nt, Human
auucuacagaugaaagcggcug

SEQ ID NO: 896642 - RNA, 22 nt, Human
uccaggccuugacaggucaguu

SEQ ID NO: 896643 - RNA, 22 nt, Human
cugcccucuagaggaggacuga

SEQ ID NO: 896644 - RNA, 22 nt, Human
ccagaaaacucuacaugcuugu

SEQ ID NO: 896645 - RNA, 22 nt, Human
uucuuuguuugauaaguaugcu

SEQ ID NO: 896646 - RNA, 22 nt, Human
agacaucucccaugcauuuuua

SEQ ID NO: 896647 - RNA, 22 nt, Human
uagcagugguuccuacguguug

SEQ ID NO: 896648 - RNA, 22 nt, Human
cuggcuccaucuuugcuuccug

SEQ ID NO: 896649 - RNA, 22 nt, Human
uucuaagaaugcuuugcaaaau

SEQ ID NO: 896650 - RNA, 22 nt, Human
ccuggagcacucucccuggcug

SEQ ID NO: 896651 - RNA, 22 nt, Human
gagaggcucagggacuugcuga

SEQ ID NO: 896652 - RNA, 22 nt, Human
caguacaauuuuacaaaggacg

SEQ ID NO: 896653 - RNA, 22 nt, Human
ggcugcagauagccagccacca

SEQ ID NO: 896654 - RNA, 22 nt, Human
gacaggcagaccugugcccugg

SEQ ID NO: 896655 - RNA, 22 nt, Human
ccucuggcaacuucacagccca

SEQ ID NO: 896656 - RNA, 22 nt, Human
cagguauucauagaauucagag

SEQ ID NO: 896657 - RNA, 22 nt, Human
aggucagcugugugugcaugag

SEQ ID NO: 896658 - RNA, 22 nt, Human
caggccuuucuggggaagugag

SEQ ID NO: 896659 - RNA, 22 nt, Human
cucuggagucaggcagcccugg

SEQ ID NO: 896660 - RNA, 16 nt, Human
uucuagaaaagaaggu

SEQ ID NO: 896661 - RNA, 22 nt, Human
auguauucaagccacauacauu

SEQ ID NO: 896662 - RNA, 22 nt, Human
uguuuucuggguggaagguacu

SEQ ID NO: 896663 - RNA, 22 nt, Human
ucugguccugaagucaacuuca

SEQ ID NO: 896664 - RNA, 22 nt, Human
agcaggccucaugcaccagcua

SEQ ID NO: 896665 - RNA, 22 nt, Human
agggcucaagaaaguguaccuc

SEQ ID NO: 896666 - RNA, 22 nt, Human
aauaugaugccaaauugcuaca

SEQ ID NO: 896667 - RNA, 22 nt, Human
aaacacauuuuaggaaaaucua

SEQ ID NO: 896668 - RNA, 22 nt, Human
ucagagaaguaagguggggugc

SEQ ID NO: 896669 - RNA, 22 nt, Human
gcuguggcaauguuuauaauua

SEQ ID NO: 896670 - RNA, 22 nt, Human
cacauguuuggcaugucaccaa

SEQ ID NO: 896671 - RNA, 22 nt, Human
caucaucucucccccaggccug

SEQ ID NO: 896672 - RNA, 22 nt, Human
gggaaggcagugucugguugaa

SEQ ID NO: 896673 - RNA, 20 nt, Human
ucauaugugguuguauacaa

SEQ ID NO: 896674 - RNA, 22 nt, Human
aacucaaagaugcaugacgcuu

SEQ ID NO: 896675 - RNA, 22 nt, Human
guuccacauuuguaaaaugagg

SEQ ID NO: 896676 - RNA, 22 nt, Human
uuggccagacacuaccccccuu

SEQ ID NO: 896677 - RNA, 22 nt, Human
caggaggcagaggaugcccagu

SEQ ID NO: 896678 - RNA, 22 nt, Human
uaugcgugccucugucugucug

SEQ ID NO: 896679 - RNA, 22 nt, Human
aguggacccggaacagaggccc

SEQ ID NO: 896680 - RNA, 22 nt, Human
uagaggcuccuguguguagguu

SEQ ID NO: 896681 - RNA, 22 nt, Human
agcagcagggucauugcucuuu

SEQ ID NO: 896682 - RNA, 22 nt, Human
gguacauuuuucugucacuuug

SEQ ID NO: 896683 - RNA, 22 nt, Human
uguuuacacaauagucucucuc

SEQ ID NO: 896684 - RNA, 22 nt, Human
cagguucuuaaguaacagcaca

SEQ ID NO: 896685 - RNA, 22 nt, Human
ucagccagggcagagcagguga

SEQ ID NO: 896686 - RNA, 22 nt, Human
aggcagccuuuagacagucugc

SEQ ID NO: 896687 - RNA, 22 nt, Human
uuaacugugacaguuucucaga

SEQ ID NO: 896688 - RNA, 22 nt, Human
uuaaagcaaccaucaauuugga

SEQ ID NO: 896689 - RNA, 22 nt, Human
ucuuuuguggaugaagaaaugg

SEQ ID NO: 896690 - RNA, 22 nt, Human
agccccccaagggccuucucuu

SEQ ID NO: 896691 - RNA, 20 nt, Human
agaaaaaguguggaaauuuc

SEQ ID NO: 896692 - RNA, 22 nt, Human
auggcagcaguuuggagucuuu

SEQ ID NO: 896693 - RNA, 22 nt, Human
uucuuugggcucagagagggag

SEQ ID NO: 896694 - RNA, 22 nt, Human
ucauggcuaaccaaggccugau

SEQ ID NO: 896695 - RNA, 22 nt, Human
gacacuguuauggugagguaag

SEQ ID NO: 896696 - RNA, 23 nt, Human
cccaggucaaaauucacaggccu

SEQ ID NO: 896697 - RNA, 22 nt, Human
uuuggaauguaguuuaaucauc

SEQ ID NO: 896698 - RNA, 21 nt, Human
cucagagcaguucagagggau

SEQ ID NO: 896699 - RNA, 22 nt, Human
gaguggggaaagccaggacaga

SEQ ID NO: 896700 - RNA, 22 nt, Human
gcagaggagugauuaugccgug

SEQ ID NO: 896701 - RNA, 22 nt, Human
uuccuucuuguaaugaucugcc

SEQ ID NO: 896702 - RNA, 22 nt, Human
cugcccuguggcucugagucau

SEQ ID NO: 896703 - RNA, 22 nt, Human
augugcuuucuuuguuucauaa

SEQ ID NO: 896704 - RNA, 22 nt, Human
cuuuacaaacuauaaagugcgg

SEQ ID NO: 896705 - RNA, 22 nt, Human
agaggacagcccccuugucugg

SEQ ID NO: 896706 - RNA, 22 nt, Human
cagguucuauacugaauaauuu

SEQ ID NO: 896707 - RNA, 22 nt, Human
cagcucccagaacugaccaugu

SEQ ID NO: 896708 - RNA, 22 nt, Human
uccagaccauggauggcugcaa

SEQ ID NO: 896709 - RNA, 22 nt, Human
ggaacacagugccuuacaaacu

SEQ ID NO: 896710 - RNA, 22 nt, Human
uccugagcaacacagcuaagug

SEQ ID NO: 896711 - RNA, 22 nt, Human
aagaaagccaaaguucauaccu

SEQ ID NO: 896712 - RNA, 22 nt, Human
gagggccaaagagcaagagccu

SEQ ID NO: 896713 - RNA, 22 nt, Human
uguuggcagugcuacagucagu

SEQ ID NO: 896714 - RNA, 22 nt, Human
ccugccuggaucagccauccug

SEQ ID NO: 896715 - RNA, 22 nt, Human
auaaagcuauuuuuaauucugu

SEQ ID NO: 896716 - RNA, 22 nt, Human
acagaauuuacacaucucuaaa

SEQ ID NO: 896717 - RNA, 22 nt, Human
uagucagagucuucucuguugu

SEQ ID NO: 896718 - RNA, 22 nt, Human
agcugcugcgccucacccuggc

SEQ ID NO: 896719 - RNA, 22 nt, Human
augcaucuaugacuuagacauu

SEQ ID NO: 896720 - RNA, 21 nt, Human
ugggaccuauuucaacuggau

SEQ ID NO: 896721 - RNA, 22 nt, Human
agguuucuccuuuaaagcaugg

SEQ ID NO: 896722 - RNA, 22 nt, Human
ugcagaaauucagaaagcauaa

SEQ ID NO: 896723 - RNA, 22 nt, Human
acaguguuacuugauaguguau

SEQ ID NO: 896724 - RNA, 22 nt, Human
aggagggauagaaaaauacuug

SEQ ID NO: 896725 - RNA, 22 nt, Human
uggccuuggagaggcacggccc

SEQ ID NO: 896726 - RNA, 22 nt, Human
aauuuggggagguucagacucu

SEQ ID NO: 896727 - RNA, 22 nt, Human
agagauguucauucagcauguu

SEQ ID NO: 896728 - RNA, 22 nt, Human
cccguguggaugcgcuggugcu

SEQ ID NO: 896729 - RNA, 22 nt, Human
ugggaaaguaauugucauccuu

SEQ ID NO: 896730 - RNA, 22 nt, Human
ugcugugacccaaaaaagaccu

SEQ ID NO: 896731 - RNA, 16 nt, Human
ggcaccagugaacaca

SEQ ID NO: 896732 - RNA, 22 nt, Human
acaguuugagaaccacuagccu

SEQ ID NO: 896733 - RNA, 22 nt, Human
aagauacaucaaagcaaauugg

SEQ ID NO: 896734 - RNA, 22 nt, Human
gcugcccucugugacccggccc

SEQ ID NO: 896735 - RNA, 19 nt, Human
gccuuuguuccuuuugucu

SEQ ID NO: 896736 - RNA, 22 nt, Human
ucuugcuguguauugcaucucc

SEQ ID NO: 896737 - RNA, 22 nt, Human
cgugucugggauagcagaagua

SEQ ID NO: 896738 - RNA, 22 nt, Human
ugcccugggaacacagaugcca

SEQ ID NO: 896739 - RNA, 22 nt, Human
gcagagcagaggugcagguugg

SEQ ID NO: 896740 - RNA, 22 nt, Human
cugagaggugacagcgugcugg

SEQ ID NO: 896741 - RNA, 21 nt, Human
uugcuguuuucccaaugcagu

SEQ ID NO: 896742 - RNA, 22 nt, Human
agggggugggaagucuagaauc

SEQ ID NO: 896743 - RNA, 22 nt, Human
gaucuccaucugcagugucugg

SEQ ID NO: 896744 - RNA, 22 nt, Human
aaggugaaacuggaagcuggcc

SEQ ID NO: 896745 - RNA, 22 nt, Human
ccaagguuagaaaagguacuuu

SEQ ID NO: 896746 - RNA, 22 nt, Human
gaggcuggaauauuagaaaugu

SEQ ID NO: 896747 - RNA, 22 nt, Human
uacuuuaauauaugugaaguuc

SEQ ID NO: 896748 - RNA, 22 nt, Human
uggucucuucuuccaagauggc

SEQ ID NO: 896749 - RNA, 22 nt, Human
ucauuuauagcuaaccuugaau

SEQ ID NO: 896750 - RNA, 18 nt, Human
uggccuggagacaacucu

SEQ ID NO: 896751 - RNA, 22 nt, Human
cuucuaggcuucucagggggca

SEQ ID NO: 896752 - RNA, 22 nt, Human
uuuacagauguggaaagugagc

SEQ ID NO: 896753 - RNA, 22 nt, Human
auaguguugauagcaguggagu

SEQ ID NO: 896754 - RNA, 22 nt, Human
aaaguacucgaggaggaggagc

SEQ ID NO: 896755 - RNA, 22 nt, Human
ggauguucugggguucucuugu

SEQ ID NO: 896756 - RNA, 22 nt, Human
aaagguuuuauguuuuccacuu

SEQ ID NO: 896757 - RNA, 22 nt, Human
gagcuguuaagagggagugaca

SEQ ID NO: 896758 - RNA, 22 nt, Human
ugguauuuaauauaugagaguu

SEQ ID NO: 896759 - RNA, 20 nt, Human
uuggcagcaguuccaaguga

SEQ ID NO: 896760 - RNA, 22 nt, Human
aggcuucagggcuuuugagggu

SEQ ID NO: 896761 - RNA, 22 nt, Human
acagaagugucuuuuucauuca

SEQ ID NO: 896762 - RNA, 22 nt, Human
gggaugaggaucaaucagggag

SEQ ID NO: 896763 - RNA, 22 nt, Human
agccagcaucccuucagucucc

SEQ ID NO: 896764 - RNA, 22 nt, Human
auguaucaauuaucugucugca

SEQ ID NO: 896765 - RNA, 22 nt, Human
ccucacugucacuuauaguggu

SEQ ID NO: 896766 - RNA, 22 nt, Human
guucuagguauaguaagaaauu

SEQ ID NO: 896767 - RNA, 22 nt, Human
aaugagaacugggaguuggugg

SEQ ID NO: 896768 - RNA, 22 nt, Human
uaucuagaguccugcugagaac

SEQ ID NO: 896769 - RNA, 22 nt, Human
uuuuacaccucagaugagcaga

SEQ ID NO: 896770 - RNA, 23 nt, Human
uccagacucuaaagcccuccaca

SEQ ID NO: 896771 - RNA, 22 nt, Human
auagaagauagcuuuuguuucu

SEQ ID NO: 896772 - RNA, 22 nt, Human
agcucagaaccuccucauccca

SEQ ID NO: 896773 - RNA, 19 nt, Human
agggucaggacaaggacuu

SEQ ID NO: 896774 - RNA, 22 nt, Human
uucuuaagaggaacauuuuugu

SEQ ID NO: 896775 - RNA, 19 nt, Human
gcaggcaguggcauucgga

SEQ ID NO: 896776 - RNA, 22 nt, Human
gccagcagguggagagaucaag

SEQ ID NO: 896777 - RNA, 22 nt, Human
aaucucacucaaagaauucucu

SEQ ID NO: 896778 - RNA, 22 nt, Human
aaaugcaaggcacauuccuuuu

SEQ ID NO: 896779 - RNA, 16 nt, Human
ugcuccagaggaccca

SEQ ID NO: 896780 - RNA, 22 nt, Human
uucuuucccagaagauauguuu

SEQ ID NO: 896781 - RNA, 22 nt, Human
ucacccagauuacauccuguca

SEQ ID NO: 896782 - RNA, 22 nt, Human
uaguccaucuugaauucaguga

SEQ ID NO: 896783 - RNA, 22 nt, Human
ggcaggguccacaccugggaaa

SEQ ID NO: 896784 - RNA, 23 nt, Human
gagcugaguguagggagacuagg

SEQ ID NO: 896785 - RNA, 22 nt, Human
uuacagaaaagggcuuuaagag

SEQ ID NO: 896786 - RNA, 22 nt, Human
ugacacuugagagggacacgga

SEQ ID NO: 896787 - RNA, 22 nt, Human
gcuggccuuugaggaagcugcg

SEQ ID NO: 896788 - RNA, 22 nt, Human
acuagcagaaacugaucauggc

SEQ ID NO: 896789 - RNA, 22 nt, Human
gcagcagcccagggcucucaga

SEQ ID NO: 896790 - RNA, 22 nt, Human
acaaaugaaucauacauaaugu

SEQ ID NO: 896791 - RNA, 23 nt, Human
cugugucuaugcagccauaucca

SEQ ID NO: 896792 - RNA, 22 nt, Human
gcuuuggaaauaagaggcuaaa

SEQ ID NO: 896793 - RNA, 22 nt, Human
cagccuggagccacagcccagg

SEQ ID NO: 896794 - RNA, 22 nt, Human
aggugccagugcuguggucccc

SEQ ID NO: 896795 - RNA, 19 nt, Human
gggcuuggggcugaagccu

SEQ ID NO: 896796 - RNA, 22 nt, Human
gaaugaguagaguauaaacaaa

SEQ ID NO: 896797 - RNA, 22 nt, Human
ucuaauaaauaaaugcucuagg

SEQ ID NO: 896798 - RNA, 22 nt, Human
cagcuccccaugguuccugaag

SEQ ID NO: 896799 - RNA, 22 nt, Human
gaaaaggccacuccuaggagcu

SEQ ID NO: 896800 - RNA, 22 nt, Human
aaaugccaaggagagacuguua

SEQ ID NO: 896801 - RNA, 22 nt, Human
aggaaaggauuggcuucucugu

SEQ ID NO: 896802 - RNA, 22 nt, Human
uagaaagagcauaguauuauaa

SEQ ID NO: 896803 - RNA, 22 nt, Human
aguucaagcaaugcuggaagaa

SEQ ID NO: 896804 - RNA, 22 nt, Human
acugaacaccauuuauaacauu

SEQ ID NO: 896805 - RNA, 22 nt, Human
caaaggcaggucauggccacuu

SEQ ID NO: 896806 - RNA, 22 nt, Human
ucauguuugagacuaauuuuuc

SEQ ID NO: 896807 - RNA, 22 nt, Human
cagcacaauuuucaggagucca

SEQ ID NO: 896808 - RNA, 22 nt, Human
caaacuuuuccuggaaaagauu

SEQ ID NO: 896809 - RNA, 22 nt, Human
uuccaauugcagaucagauaca

SEQ ID NO: 896810 - RNA, 22 nt, Human
caucaugaagaugagaaagcau

SEQ ID NO: 896811 - RNA, 22 nt, Human
cuuggaauugaugauuuucaua

SEQ ID NO: 896812 - RNA, 22 nt, Human
uaggcagaaaggaaggcaaguu

SEQ ID NO: 896813 - RNA, 22 nt, Human
aaaugcagaucccugaaucuca

SEQ ID NO: 896814 - RNA, 22 nt, Human
cugccuggaaugccagcuucuc

SEQ ID NO: 896815 - RNA, 22 nt, Human
aacaaugaccacacaauguacu

SEQ ID NO: 896816 - RNA, 22 nt, Human
aggaagugcuaagagaacauca

SEQ ID NO: 896817 - RNA, 22 nt, Human
acauuauaguugcuacagagua

SEQ ID NO: 896818 - RNA, 22 nt, Human
gugggcagaacauuuguaggcu

SEQ ID NO: 896819 - RNA, 22 nt, Human
ucaaaucuuugaccacuuaugu

SEQ ID NO: 896820 - RNA, 22 nt, Human
aaacuguugugguuuaucauua

SEQ ID NO: 896821 - RNA, 22 nt, Human
gcccagaguggccacuuggcuc

SEQ ID NO: 896822 - RNA, 22 nt, Human
acucugcuugggccauaucugg

SEQ ID NO: 896823 - RNA, 22 nt, Human
cugcccugccuggccagugugg

SEQ ID NO: 896824 - RNA, 22 nt, Human
uuuccagagcugagaaggcuug

SEQ ID NO: 896825 - RNA, 22 nt, Human
agcagaagugccuuagcaauca

SEQ ID NO: 896826 - RNA, 22 nt, Human
gaggccagugaaauguuauaaa

SEQ ID NO: 896827 - RNA, 22 nt, Human
uggcugaggcuuuucuuaaaga

SEQ ID NO: 896828 - RNA, 22 nt, Human
acagaaaaguuuacuuuugcuc

SEQ ID NO: 896829 - RNA, 22 nt, Human
gaggcagcaucuauggugggaa

SEQ ID NO: 896830 - RNA, 22 nt, Human
ugggcuccggcggccucaggcu

SEQ ID NO: 896831 - RNA, 20 nt, Human
ugccaugguaacagagugug

SEQ ID NO: 896832 - RNA, 18 nt, Human
ugcagcaagugcuaaaua

SEQ ID NO: 896833 - RNA, 22 nt, Human
cugcccugugaggguccuuggg

SEQ ID NO: 896834 - RNA, 22 nt, Human
acugggcagggaaggagaccga

SEQ ID NO: 896835 - RNA, 22 nt, Human
uguucccacaccagccucagcc

SEQ ID NO: 896836 - RNA, 20 nt, Human
uacuuaggcuuguuuuggcc

SEQ ID NO: 896837 - RNA, 22 nt, Human
agguggcuguauucagcuguaa

SEQ ID NO: 896838 - RNA, 22 nt, Human
agagagggcauagaaaaaggga

SEQ ID NO: 896839 - RNA, 22 nt, Human
agaaauguuuauggcugccuau

SEQ ID NO: 896840 - RNA, 22 nt, Human
aggcuaucagauagaaugaagg

SEQ ID NO: 896841 - RNA, 22 nt, Human
ugugugcacaaagaguacaugg

SEQ ID NO: 896842 - RNA, 21 nt, Human
agccagcuaucacacagcauu

SEQ ID NO: 896843 - RNA, 22 nt, Human
cccagcagccagaaugaggagc

SEQ ID NO: 896844 - RNA, 22 nt, Human
gcugaaguuuugcagagaguaa

SEQ ID NO: 896845 - RNA, 22 nt, Human
agcugcccuuaauaggcauuca

SEQ ID NO: 896846 - RNA, 22 nt, Human
uacaaagccugguagauaucug

SEQ ID NO: 896847 - RNA, 22 nt, Human
ccagggccaagagaccucgagg

SEQ ID NO: 896848 - RNA, 22 nt, Human
auguucuuggauguuguguaua

SEQ ID NO: 896849 - RNA, 22 nt, Human
uauuuaugucucugcagagaau

SEQ ID NO: 896850 - RNA, 22 nt, Human
uccauaagcagguucuuccuga

SEQ ID NO: 896851 - RNA, 22 nt, Human
uggugucaagcagaacugugaa

SEQ ID NO: 896852 - RNA, 22 nt, Human
agcagagcuauucuugugcaau

SEQ ID NO: 896853 - RNA, 22 nt, Human
cagagagcuugcccuuguauau

SEQ ID NO: 896854 - RNA, 22 nt, Human
guuuacaacaucuuguccuuca

SEQ ID NO: 896855 - RNA, 22 nt, Human
uacauacagccaaguaugaagu

SEQ ID NO: 896856 - RNA, 22 nt, Human
ccagggcugccuggccgugugu

SEQ ID NO: 896857 - RNA, 22 nt, Human
aagagauugguuauaagagauu

SEQ ID NO: 896858 - RNA, 22 nt, Human
guauuuccauuagugugugcac

SEQ ID NO: 896859 - RNA, 22 nt, Human
ugaguucuccaagagaagguaa

SEQ ID NO: 896860 - RNA, 22 nt, Human
cugccucaugcugccugcagcc

SEQ ID NO: 896861 - RNA, 22 nt, Human
ucccaggaugugcgugccgccg

SEQ ID NO: 896862 - RNA, 22 nt, Human
cuuucagucuuuacaagguugc

SEQ ID NO: 896863 - RNA, 22 nt, Human
agggggcccuugcaggugagcg

SEQ ID NO: 896864 - RNA, 22 nt, Human
acauaugauauugaggaucuca

SEQ ID NO: 896865 - RNA, 22 nt, Human
aauaggcaguuggauaugcaag

SEQ ID NO: 896866 - RNA, 22 nt, Human
ugguggagggaacuauuuccag

SEQ ID NO: 896867 - RNA, 22 nt, Human
gcagaggcauuucugacgcugc

SEQ ID NO: 896868 - RNA, 22 nt, Human
aggggaagauuauacuuuugaa

SEQ ID NO: 896869 - RNA, 22 nt, Human
ucagggccaucuuuugccucaa

SEQ ID NO: 896870 - RNA, 22 nt, Human
caagugagccuccucuuuuuaa

SEQ ID NO: 896871 - RNA, 22 nt, Human
gcugcuuucuguuaggaauugg

SEQ ID NO: 896872 - RNA, 22 nt, Human
uugagaaccacugaguuagaua

SEQ ID NO: 896873 - RNA, 22 nt, Human
cccuggcuuggcacucuccacu

SEQ ID NO: 896874 - RNA, 19 nt, Human
aggccugggguuuugcacu

SEQ ID NO: 896875 - RNA, 22 nt, Human
aggagggagcuuaagccaggca

SEQ ID NO: 896876 - RNA, 22 nt, Human
ugcaggcugggaagagggacaa

SEQ ID NO: 896877 - RNA, 22 nt, Human
cucugccaccaugcuuccugac

SEQ ID NO: 896878 - RNA, 22 nt, Human
caagaagaggugauugguaagu

SEQ ID NO: 896879 - RNA, 22 nt, Human
cugggagcgcagcaggcacaac

SEQ ID NO: 896880 - RNA, 22 nt, Human
gucugugugcacagcgagugcc

SEQ ID NO: 896881 - RNA, 22 nt, Human
uuccucuccucacaugagucac

SEQ ID NO: 896882 - RNA, 22 nt, Human
gagcuuaaaacauagccagacu

SEQ ID NO: 896883 - RNA, 22 nt, Human
gaaaggagggcucacaaaagug

SEQ ID NO: 896884 - RNA, 22 nt, Human
uuuaguuauuguuacaguauga

SEQ ID NO: 896885 - RNA, 22 nt, Human
uuucuccuugugucuccuuuga

SEQ ID NO: 896886 - RNA, 22 nt, Human
uucugggacauugcagguauuc

SEQ ID NO: 896887 - RNA, 22 nt, Human
uuggcagcaagaggcucuucug

SEQ ID NO: 896888 - RNA, 22 nt, Human
cuccuggaucuuagccagauuc

SEQ ID NO: 896889 - RNA, 22 nt, Human
uggguaagguacuguagaucug

SEQ ID NO: 896890 - RNA, 22 nt, Human
uggcagaauuucuagcagauuc

SEQ ID NO: 896891 - RNA, 22 nt, Human
aaguacauuuuuaacuuacagc

SEQ ID NO: 896892 - RNA, 22 nt, Human
uaguuuaugauuuuuuggaagg

SEQ ID NO: 896893 - RNA, 22 nt, Human
gugugcgccgacacagccaggu

SEQ ID NO: 896894 - RNA, 22 nt, Human
uuuucuguaagaggacuuuaau

SEQ ID NO: 896895 - RNA, 22 nt, Human
cuucuucuucccccuucagggg

SEQ ID NO: 896896 - RNA, 22 nt, Human
gcuuuauguaaguccaaaggca

SEQ ID NO: 896897 - RNA, 22 nt, Human
guuuugugaggcacccacaggu

SEQ ID NO: 896898 - RNA, 22 nt, Human
gccuggugugcgccgcgcagcu

SEQ ID NO: 896899 - RNA, 22 nt, Human
uuauauuucugguagccuucag

SEQ ID NO: 896900 - RNA, 22 nt, Human
uucugucacuuaggaggucaua

SEQ ID NO: 896901 - RNA, 22 nt, Human
auuugacauugacacaccuaug

SEQ ID NO: 896902 - RNA, 22 nt, Human
ccuggagcuuuuccaguugaca

SEQ ID NO: 896903 - RNA, 22 nt, Human
uuguuuauguguugucuauggc

SEQ ID NO: 896904 - RNA, 22 nt, Human
caucuuaauaaaucuccucccu

SEQ ID NO: 896905 - RNA, 22 nt, Human
gccaggcaggccacgcuguguu

SEQ ID NO: 896906 - RNA, 22 nt, Human
cuggcuguuucaggcagugucc

SEQ ID NO: 896907 - RNA, 22 nt, Human
ccagagucccuguucucggccu

SEQ ID NO: 896908 - RNA, 22 nt, Human
ugaagcaggcauugacugauga

SEQ ID NO: 896909 - RNA, 22 nt, Human
agcaaagaaggguucuucauua

SEQ ID NO: 896910 - RNA, 22 nt, Human
ucagugcaaucaagguauguuu

SEQ ID NO: 896911 - RNA, 22 nt, Human
gagccuccuccuggugugccga

SEQ ID NO: 896912 - RNA, 22 nt, Human
aaggaaggaauugaucaugcgc

SEQ ID NO: 896913 - RNA, 19 nt, Human
uaugugugcauuugugcau

SEQ ID NO: 896914 - RNA, 22 nt, Human
ucuuuugugaggacaagguacg

SEQ ID NO: 896915 - RNA, 22 nt, Human
aaggcuccacccucauggaugc

SEQ ID NO: 896916 - RNA, 22 nt, Human
ugcagaggagcuggaaggcugg

SEQ ID NO: 896917 - RNA, 22 nt, Human
augcaaaaguaguugcaguuuu

SEQ ID NO: 896918 - RNA, 22 nt, Human
caggaacaauguaagucucauu

SEQ ID NO: 896919 - RNA, 21 nt, Human
acuagcaaaagccuauuaucc

SEQ ID NO: 896920 - RNA, 22 nt, Human
ggugaggggcaccucugcccgg

SEQ ID NO: 896921 - RNA, 22 nt, Human
aaacugcaugaagcugauuuua

SEQ ID NO: 896922 - RNA, 22 nt, Human
acuaaaaacuacugccaauagc

SEQ ID NO: 896923 - RNA, 22 nt, Human
aacaggcuaguuuuaaagcaua

SEQ ID NO: 896924 - RNA, 22 nt, Human
agccacaaaggcuugccucgga

SEQ ID NO: 896925 - RNA, 22 nt, Human
ccaggagaugggagcaucuaaa

SEQ ID NO: 896926 - RNA, 22 nt, Human
gacaugaauguuauacuuuauu

SEQ ID NO: 896927 - RNA, 22 nt, Human
acagaacaacaagguggaccag

SEQ ID NO: 896928 - RNA, 22 nt, Human
gggagcaggagccugccugcca

SEQ ID NO: 896929 - RNA, 22 nt, Human
augagcagguuuaagagaggcc

SEQ ID NO: 896930 - RNA, 22 nt, Human
uggcugagccacuuguucagau

SEQ ID NO: 896931 - RNA, 22 nt, Human
ugccuacuaguacuauuuugug

SEQ ID NO: 896932 - RNA, 22 nt, Human
uuccuucuggagcccggggagc

SEQ ID NO: 896933 - RNA, 22 nt, Human
caaauguuuuuauucuacaaca

SEQ ID NO: 896934 - RNA, 22 nt, Human
ccagagggaagaggaagcgcug

SEQ ID NO: 896935 - RNA, 22 nt, Human
acugugauguuugugaucaucu

SEQ ID NO: 896936 - RNA, 22 nt, Human
guauuccuaagucaugacaaau

SEQ ID NO: 896937 - RNA, 23 nt, Human
ucucucuggcaaauuucacauau

SEQ ID NO: 896938 - RNA, 20 nt, Human
auucagaauaggcauguaaa

SEQ ID NO: 896939 - RNA, 22 nt, Human
gugaggcagggaaagaggauaa

SEQ ID NO: 896940 - RNA, 22 nt, Human
uguguuuguuagacuaauguua

SEQ ID NO: 896941 - RNA, 22 nt, Human
aggguggaagauggcacuaucu

SEQ ID NO: 896942 - RNA, 22 nt, Human
aaaccugauagauuuucagaau

SEQ ID NO: 896943 - RNA, 22 nt, Human
auauauuugagaauauucauga

SEQ ID NO: 896944 - RNA, 21 nt, Human
acauggauauaggacugaauu

SEQ ID NO: 896945 - RNA, 22 nt, Human
acacuaaaugagucuacaguac

SEQ ID NO: 896946 - RNA, 22 nt, Human
ucagugcuccuaaagugaaugc

SEQ ID NO: 896947 - RNA, 22 nt, Human
uaagcauuaugguaaagaagua

SEQ ID NO: 896948 - RNA, 22 nt, Human
ugaauaaauugagagcgaaugu

SEQ ID NO: 896949 - RNA, 22 nt, Human
aaugcuuaauucaauacugugu

SEQ ID NO: 896950 - RNA, 22 nt, Human
ucuuuccagaggaauuuuuaga

SEQ ID NO: 896951 - RNA, 22 nt, Human
acagguuugcagcuuguuaccu

SEQ ID NO: 896952 - RNA, 22 nt, Human
ugggugguugcugaggcuccuu

SEQ ID NO: 896953 - RNA, 22 nt, Human
cucuaaauccaaauaagugucc

SEQ ID NO: 896954 - RNA, 22 nt, Human
cagggggugguccaggcugcgc

SEQ ID NO: 896955 - RNA, 22 nt, Human
uuuguacuggaagaacaugcaa

SEQ ID NO: 896956 - RNA, 22 nt, Human
acucuguagaguauaccaaugu

SEQ ID NO: 896957 - RNA, 22 nt, Human
aaggaugcagggacccaaggcu

SEQ ID NO: 896958 - RNA, 22 nt, Human
aucagagugggucuggcaugag

SEQ ID NO: 896959 - RNA, 22 nt, Human
guguaaacacccuuacuguggc

SEQ ID NO: 896960 - RNA, 22 nt, Human
auguuacauaguccuuauuugu

SEQ ID NO: 896961 - RNA, 21 nt, Human
cuguccaaauuucauaacuuu

SEQ ID NO: 896962 - RNA, 22 nt, Human
aucuucuucaaggaucuggagc

SEQ ID NO: 896963 - RNA, 22 nt, Human
cugcagcuaaggaaugugguug

SEQ ID NO: 896964 - RNA, 22 nt, Human
gcagugaacauaacacagaagg

SEQ ID NO: 896965 - RNA, 22 nt, Human
cagcaauccaagcuuucuuuaa

SEQ ID NO: 896966 - RNA, 22 nt, Human
uaaguuuagagagaauggggac

SEQ ID NO: 896967 - RNA, 22 nt, Human
acagugauuucauccuucuggg

SEQ ID NO: 896968 - RNA, 22 nt, Human
guucucauaguggaaaauaggu

SEQ ID NO: 896969 - RNA, 23 nt, Human
acuuaaaugguucuuuaucucag

SEQ ID NO: 896970 - RNA, 17 nt, Human
acagagguuauacagac

SEQ ID NO: 896971 - RNA, 22 nt, Human
cuugagggacucuaugacuuag

SEQ ID NO: 896972 - RNA, 22 nt, Human
uaaaggcaaauguguguuugug

SEQ ID NO: 896973 - RNA, 22 nt, Human
ugguauuugucauucgaguucu

SEQ ID NO: 896974 - RNA, 22 nt, Human
gugugcagcagagacaggacuc

SEQ ID NO: 896975 - RNA, 19 nt, Human
cagaguccuugaccagucc

SEQ ID NO: 896976 - RNA, 22 nt, Human
aagcagaggaccgacggaggga

SEQ ID NO: 896977 - RNA, 22 nt, Human
ggugaggggagagugaaagaaa

SEQ ID NO: 896978 - RNA, 22 nt, Human
gacacaguuuuucucacggugg

SEQ ID NO: 896979 - RNA, 22 nt, Human
guucacaauggcuuuaccuaag

SEQ ID NO: 896980 - RNA, 19 nt, Human
acacauuugcacaauccac

SEQ ID NO: 896981 - RNA, 22 nt, Human
aggccacaguugaggccagcaa

SEQ ID NO: 896982 - RNA, 22 nt, Human
aggccucaguucuugccaggug

SEQ ID NO: 896983 - RNA, 22 nt, Human
aguaacaggauccaaagaaugu

SEQ ID NO: 896984 - RNA, 22 nt, Human
ugaggugguuacuguggugcuc

SEQ ID NO: 896985 - RNA, 22 nt, Human
ugcagggaaucuguggcuggac

SEQ ID NO: 896986 - RNA, 22 nt, Human
guuuauuauacaacaaaagcua

SEQ ID NO: 896987 - RNA, 22 nt, Human
aggcuggagugugcaguggcgc

SEQ ID NO: 896988 - RNA, 22 nt, Human
ggcagcagcaagguuggagcug

SEQ ID NO: 896989 - RNA, 22 nt, Human
uuauuccaccuccauuuuccua

SEQ ID NO: 896990 - RNA, 22 nt, Human
guacauuuuacuuuguuugaau

SEQ ID NO: 896991 - RNA, 22 nt, Human
agugggugggugucugacaguu

SEQ ID NO: 896992 - RNA, 23 nt, Human
uucaaagcuuaagcucuuuccac

SEQ ID NO: 896993 - RNA, 22 nt, Human
gagcuccaccaccuucaggcag

SEQ ID NO: 896994 - RNA, 22 nt, Human
ucucuggguucucacucagcac

SEQ ID NO: 896995 - RNA, 22 nt, Human
ucuaugucucgacccaagacaa

SEQ ID NO: 896996 - RNA, 22 nt, Human
caguuucucucauacauauuug

SEQ ID NO: 896997 - RNA, 22 nt, Human
ucaggccccaucccagacuuau

SEQ ID NO: 896998 - RNA, 22 nt, Human
ucuggggaugagugaugucgua

SEQ ID NO: 896999 - RNA, 22 nt, Human
aggcuuauuuuaggucucucuu

SEQ ID NO: 897000 - RNA, 22 nt, Human
auauacacauuugcuuaugugu

SEQ ID NO: 897001 - RNA, 22 nt, Human
guaacaaaggauaacuugguuu

SEQ ID NO: 897002 - RNA, 22 nt, Human
cagaggagugggccguuauggu

SEQ ID NO: 897003 - RNA, 22 nt, Human
gcaggcagagaaggaacauuua

SEQ ID NO: 897004 - RNA, 22 nt, Human
gcugggaggaauuuggggaaua

SEQ ID NO: 897005 - RNA, 22 nt, Human
caagugaagauauacagaaaau

SEQ ID NO: 897006 - RNA, 22 nt, Human
gagcugggagcugggauuugga

SEQ ID NO: 897007 - RNA, 22 nt, Human
uuuuaauugcaauuaugguccc

SEQ ID NO: 897008 - RNA, 22 nt, Human
agagcuguuuggacaucugagu

SEQ ID NO: 897009 - RNA, 22 nt, Human
gggacaauggaggccucucucc

SEQ ID NO: 897010 - RNA, 22 nt, Human
cugagcagcguggggagcuggc

SEQ ID NO: 897011 - RNA, 22 nt, Human
ucaccacugaacagaccuuugg

SEQ ID NO: 897012 - RNA, 22 nt, Human
ggcagcaaggccucgggugagc

SEQ ID NO: 897013 - RNA, 22 nt, Human
aguuccuauacugggucagucc

SEQ ID NO: 897014 - RNA, 23 nt, Human
aacauacuguuuaauauucacag

SEQ ID NO: 897015 - RNA, 22 nt, Human
ucuccaggugaaacuugcaggg

SEQ ID NO: 897016 - RNA, 22 nt, Human
uuugugugggggaaacaaggua

SEQ ID NO: 897017 - RNA, 22 nt, Human
uucuggaaccagccugccuggg

SEQ ID NO: 897018 - RNA, 22 nt, Human
augcucuugaggcuaaagacau

SEQ ID NO: 897019 - RNA, 22 nt, Human
ucauuuugggguuugucaucuu

SEQ ID NO: 897020 - RNA, 22 nt, Human
cauuucugauuacagaauacua

SEQ ID NO: 897021 - RNA, 22 nt, Human
cuggcccugccuaauguacuug

SEQ ID NO: 897022 - RNA, 22 nt, Human
aggagaguucacacuggucaga

SEQ ID NO: 897023 - RNA, 22 nt, Human
gucuagaauaucuagaaagauc

SEQ ID NO: 897024 - RNA, 22 nt, Human
uugcuguuuuacaucugguggg

SEQ ID NO: 897025 - RNA, 22 nt, Human
ucaaacauguuagcagucugug

SEQ ID NO: 897026 - RNA, 22 nt, Human
uuucucauggaacaucguuuag

SEQ ID NO: 897027 - RNA, 22 nt, Human
aggcugugggaguugagagucu

SEQ ID NO: 897028 - RNA, 22 nt, Human
ccugugugaagguuaggcaggu

SEQ ID NO: 897029 - RNA, 22 nt, Human
ucuucagaaaauuaucacuugu

SEQ ID NO: 897030 - RNA, 16 nt, Human
uuuuggugacccugga

SEQ ID NO: 897031 - RNA, 22 nt, Human
cuggggugugcucagagcaggg

SEQ ID NO: 897032 - RNA, 22 nt, Human
aaugaacauauaaagagaucuu

SEQ ID NO: 897033 - RNA, 22 nt, Human
agaaacugaauuauuucugagg

SEQ ID NO: 897034 - RNA, 22 nt, Human
gugggcuggacccuccugcucc

SEQ ID NO: 897035 - RNA, 22 nt, Human
gucaucuuaaggacugcuauag

SEQ ID NO: 897036 - RNA, 22 nt, Human
ggcugccuaacccuuaaguguc

SEQ ID NO: 897037 - RNA, 22 nt, Human
acaguacagcuaaugucauuag

SEQ ID NO: 897038 - RNA, 22 nt, Human
ccagcugguuuauauuccccac

SEQ ID NO: 897039 - RNA, 22 nt, Human
cuguggucaccaggcuggggcc

SEQ ID NO: 897040 - RNA, 22 nt, Human
cugauuucucaguucuaggaag

SEQ ID NO: 897041 - RNA, 18 nt, Human
cauuccccaucucugagc

SEQ ID NO: 897042 - RNA, 22 nt, Human
aguuuuaugcaguguucugaua

SEQ ID NO: 897043 - RNA, 19 nt, Human
uggcagacacaccuucuuc

SEQ ID NO: 897044 - RNA, 22 nt, Human
acuacagaagucuuauuagaga

SEQ ID NO: 897045 - RNA, 22 nt, Human
gggcucaggucagggcaucagc

SEQ ID NO: 897046 - RNA, 22 nt, Human
gccccaggugguaaaccuaaga

SEQ ID NO: 897047 - RNA, 22 nt, Human
ccagcccuccuccaucagagga

SEQ ID NO: 897048 - RNA, 22 nt, Human
uuggcagcugcacagacuccau

SEQ ID NO: 897049 - RNA, 22 nt, Human
gagcuccuggauugcuccuagg

SEQ ID NO: 897050 - RNA, 18 nt, Human
ccucugccuuuguagagc

SEQ ID NO: 897051 - RNA, 19 nt, Human
ucugguucauuucugcugu

SEQ ID NO: 897052 - RNA, 22 nt, Human
gaaagcugaaccaggaaccaug

SEQ ID NO: 897053 - RNA, 18 nt, Human
ccacagcagaguucuuac

SEQ ID NO: 897054 - RNA, 22 nt, Human
uuuacacugacagcacauaagg

SEQ ID NO: 897055 - RNA, 22 nt, Human
ugugugugacucauacuagaac

SEQ ID NO: 897056 - RNA, 22 nt, Human
caucuguagcuccaugacaauu

SEQ ID NO: 897057 - RNA, 22 nt, Human
aagaggcuagccggcucacuaa

SEQ ID NO: 897058 - RNA, 22 nt, Human
gguugguaacucccugugcagu

SEQ ID NO: 897059 - RNA, 22 nt, Human
ccccagaaggggacagagggua

SEQ ID NO: 897060 - RNA, 22 nt, Human
gacauuaauggcaaauuaauua

SEQ ID NO: 897061 - RNA, 22 nt, Human
ugucaguucucacuuacauaaa

SEQ ID NO: 897062 - RNA, 22 nt, Human
acaguauaaacuccuaaaagcc

SEQ ID NO: 897063 - RNA, 22 nt, Human
uuuacagaucuguugauuuguu

SEQ ID NO: 897064 - RNA, 22 nt, Human
cauaacauccuugcuacuuuga

SEQ ID NO: 897065 - RNA, 22 nt, Human
ucugccacuuuugcuuacuggg

SEQ ID NO: 897066 - RNA, 22 nt, Human
ggacacaaaagugaauaaaaua

SEQ ID NO: 897067 - RNA, 22 nt, Human
cugggaggcggagguuguagug

SEQ ID NO: 897068 - RNA, 21 nt, Human
cugugcuuuuuaagugugaug

SEQ ID NO: 897069 - RNA, 22 nt, Human
ugacaaagugaggucuucagua

SEQ ID NO: 897070 - RNA, 22 nt, Human
gaggaaagaaccccagucaaua

SEQ ID NO: 897071 - RNA, 22 nt, Human
gaaacucucgcauccugggaac

SEQ ID NO: 897072 - RNA, 22 nt, Human
aaauggaagaagugcaauacug

SEQ ID NO: 897073 - RNA, 22 nt, Human
cacaggagauugaucuauuggu

SEQ ID NO: 897074 - RNA, 22 nt, Human
caucaacagugucagaugaugc

SEQ ID NO: 897075 - RNA, 22 nt, Human
aaacaugagcauuucuguuuaa

SEQ ID NO: 897076 - RNA, 22 nt, Human
uguuuuuaucucuguguacaac

SEQ ID NO: 897077 - RNA, 22 nt, Human
acaggaagugggaagaaacagg

SEQ ID NO: 897078 - RNA, 22 nt, Human
uaacaucuaagggagagaaagu

SEQ ID NO: 897079 - RNA, 22 nt, Human
uuugacaggaauucucucuagg

SEQ ID NO: 897080 - RNA, 22 nt, Human
uuaccacaaaacaguuagaagu

SEQ ID NO: 897081 - RNA, 22 nt, Human
cccagcccaucucaaaggucua

SEQ ID NO: 897082 - RNA, 23 nt, Human
agcugaggcugugggugucagag

SEQ ID NO: 897083 - RNA, 22 nt, Human
cugggccucauccccagaguuu

SEQ ID NO: 897084 - RNA, 21 nt, Human
uucuugguuacgcuguagugc

SEQ ID NO: 897085 - RNA, 22 nt, Human
aggccaggacacuuaaguaaga

SEQ ID NO: 897086 - RNA, 22 nt, Human
ccaggcauccauugcuuccucu

SEQ ID NO: 897087 - RNA, 22 nt, Human
agggucaccugcuugccagggc

SEQ ID NO: 897088 - RNA, 22 nt, Human
aaauauuugucugaggcgguug

SEQ ID NO: 897089 - RNA, 22 nt, Human
aagcaguuacuauuuacuauua

SEQ ID NO: 897090 - RNA, 22 nt, Human
uucccagaggcaaagucuggau

SEQ ID NO: 897091 - RNA, 23 nt, Human
uucauacagaaacaucacuucau

SEQ ID NO: 897092 - RNA, 22 nt, Human
gaagcagcuggugagauggagc

SEQ ID NO: 897093 - RNA, 22 nt, Human
uugcuucuaaguauaaauauga

SEQ ID NO: 897094 - RNA, 22 nt, Human
caucuagaaaaaagaccuguug

SEQ ID NO: 897095 - RNA, 22 nt, Human
gucuagggcuccucagugacaa

SEQ ID NO: 897096 - RNA, 22 nt, Human
ccaugcugacccugugcaggca

SEQ ID NO: 897097 - RNA, 22 nt, Human
gccgaagacgcugggcgugggc

SEQ ID NO: 897098 - RNA, 22 nt, Human
cagggagccccaauuccaugcc

SEQ ID NO: 897099 - RNA, 22 nt, Human
ucuucagugaauggcaagaucu

SEQ ID NO: 897100 - RNA, 22 nt, Human
ugaagguggcauaggagagaug

SEQ ID NO: 897101 - RNA, 22 nt, Human
gcucccugcauuucccacccuu

SEQ ID NO: 897102 - RNA, 22 nt, Human
uggcuccuaaucggcuucuuuc

SEQ ID NO: 897103 - RNA, 22 nt, Human
gaaaguucguccuguggcuucu

SEQ ID NO: 897104 - RNA, 22 nt, Human
aagccagcauuuucccauuccu

SEQ ID NO: 897105 - RNA, 22 nt, Human
uagcaaauguaaaaugccuaca

SEQ ID NO: 897106 - RNA, 22 nt, Human
gcaagcaguuguggcuucugag

SEQ ID NO: 897107 - RNA, 22 nt, Human
uggccugcagcucucagggaag

SEQ ID NO: 897108 - RNA, 22 nt, Human
aguugugagaaacagaaugagc

SEQ ID NO: 897109 - RNA, 22 nt, Human
gccaggcuccaggcccuccuga

SEQ ID NO: 897110 - RNA, 22 nt, Human
aagggccauugcugagagcagu

SEQ ID NO: 897111 - RNA, 22 nt, Human
gagccacaguggauugauucca

SEQ ID NO: 897112 - RNA, 17 nt, Human
acugucuuuuacacccu

SEQ ID NO: 897113 - RNA, 22 nt, Human
uggaggccgaauuagagcguug

SEQ ID NO: 897114 - RNA, 22 nt, Human
ucuucauguauuugacaaccau

SEQ ID NO: 897115 - RNA, 22 nt, Human
ugccaaauugcccuauaaauga

SEQ ID NO: 897116 - RNA, 22 nt, Human
agaggccagcacugcagggaag

SEQ ID NO: 897117 - RNA, 22 nt, Human
ccauggcuucuuucucugccag

SEQ ID NO: 897118 - RNA, 22 nt, Human
cggaagagggacagcgccagcc

SEQ ID NO: 897119 - RNA, 22 nt, Human
caggggccuguccuggcuucug

SEQ ID NO: 897120 - RNA, 22 nt, Human
ugcauaaacagauacuucaugu

SEQ ID NO: 897121 - RNA, 22 nt, Human
gaaggcucuggggauugagaua

SEQ ID NO: 897122 - RNA, 22 nt, Human
gcccacauuuuuggcuuagagg

SEQ ID NO: 897123 - RNA, 22 nt, Human
cugaagagacuggagggggcau

SEQ ID NO: 897124 - RNA, 22 nt, Human
caggacacagaauaaggcaguu

SEQ ID NO: 897125 - RNA, 17 nt, Human
cgugugcuugugugcac

SEQ ID NO: 897126 - RNA, 19 nt, Human
aagcagcccuggcaagagc

SEQ ID NO: 897127 - RNA, 22 nt, Human
agcucuggggccugucccacau

SEQ ID NO: 897128 - RNA, 22 nt, Human
uauuuugagguauuuuugagcu

SEQ ID NO: 897129 - RNA, 22 nt, Human
acaacacauguguauaugugug

SEQ ID NO: 897130 - RNA, 22 nt, Human
uccugccacugcacauauacuu

SEQ ID NO: 897131 - RNA, 22 nt, Human
uggucagugugacauuuuuuaa

SEQ ID NO: 897132 - RNA, 22 nt, Human
auuccauuguguaaggauaucg

SEQ ID NO: 897133 - RNA, 22 nt, Human
ugcagugccucggcagugcagc

SEQ ID NO: 897134 - RNA, 22 nt, Human
agggugugcuguugggucuuuc

SEQ ID NO: 897135 - RNA, 22 nt, Human
ucacugcaaucucugccuucca

SEQ ID NO: 897136 - RNA, 22 nt, Human
gggcauggggcggaccugguuc

SEQ ID NO: 897137 - RNA, 22 nt, Human
aagcuauacaaugcacaaauga

SEQ ID NO: 897138 - RNA, 22 nt, Human
caaaugauccuugcaagcugug

SEQ ID NO: 897139 - RNA, 22 nt, Human
cuuggcugggaacugugauuca

SEQ ID NO: 897140 - RNA, 22 nt, Human
uagacaaaagggggcagauaug

SEQ ID NO: 897141 - RNA, 22 nt, Human
auauauacuuugacacauucug

SEQ ID NO: 897142 - RNA, 22 nt, Human
ggggccagcuucgcgugcucuu

SEQ ID NO: 897143 - RNA, 22 nt, Human
gguggcugcuuccucaagagga

SEQ ID NO: 897144 - RNA, 22 nt, Human
gcuggccagugucccagggauc

SEQ ID NO: 897145 - RNA, 21 nt, Human
acacaaaccuccucagccugg

SEQ ID NO: 897146 - RNA, 22 nt, Human
ggcagcaacucggagagaagag

SEQ ID NO: 897147 - RNA, 22 nt, Human
augagagcucuaugaucuguuu

SEQ ID NO: 897148 - RNA, 22 nt, Human
aauguguauaagggagagcuaa

SEQ ID NO: 897149 - RNA, 18 nt, Human
guguccuuugcaagaaac

SEQ ID NO: 897150 - RNA, 22 nt, Human
cauguauauuucuguaugugca

SEQ ID NO: 897151 - RNA, 22 nt, Human
augcuggauugagagcaagggg

SEQ ID NO: 897152 - RNA, 22 nt, Human
accuccccgggagcagccuccu

SEQ ID NO: 897153 - RNA, 20 nt, Human
ccacccugcuaagaauacac

SEQ ID NO: 897154 - RNA, 22 nt, Human
aaauauaauuucugccucaaua

SEQ ID NO: 897155 - RNA, 22 nt, Human
uggguucagaucccagcucugu

SEQ ID NO: 897156 - RNA, 22 nt, Human
auuuaucaacauguaccauugg

SEQ ID NO: 897157 - RNA, 22 nt, Human
aucaagaguauugacaagacca

SEQ ID NO: 897158 - RNA, 22 nt, Human
auucugggaacuuugucucuca

SEQ ID NO: 897159 - RNA, 22 nt, Human
gugugcgcuggugcuuggucaa

SEQ ID NO: 897160 - RNA, 22 nt, Human
gugcccagugcaggcccgcagg

SEQ ID NO: 897161 - RNA, 22 nt, Human
acagcuguguuuuauaaucagc

SEQ ID NO: 897162 - RNA, 22 nt, Human
auuuggaauagcuguagaaaua

SEQ ID NO: 897163 - RNA, 22 nt, Human
uccuagaauaaucuuugacugc

SEQ ID NO: 897164 - RNA, 22 nt, Human
uuaccaagcucugcauguuaag

SEQ ID NO: 897165 - RNA, 22 nt, Human
ggcaccaggggauguaaugucc

SEQ ID NO: 897166 - RNA, 22 nt, Human
aucaucuuaaaucuagaaugug

SEQ ID NO: 897167 - RNA, 22 nt, Human
ccugugucaucagcuguggcua

SEQ ID NO: 897168 - RNA, 22 nt, Human
gggagagaugcugauugccaau

SEQ ID NO: 897169 - RNA, 22 nt, Human
ccugugcugggugugagggaca

SEQ ID NO: 897170 - RNA, 22 nt, Human
augcauaugugugcacacgugu

SEQ ID NO: 897171 - RNA, 22 nt, Human
ccugaaacaguccuugcccuca

SEQ ID NO: 897172 - RNA, 22 nt, Human
ugcagcugcuggcccaggugcu

SEQ ID NO: 897173 - RNA, 22 nt, Human
auucaugaccccaugguugauu

SEQ ID NO: 897174 - RNA, 19 nt, Human
cuuauuagagugagagcuu

SEQ ID NO: 897175 - RNA, 22 nt, Human
cagccuuucuguuuccuaaggu

SEQ ID NO: 897176 - RNA, 22 nt, Human
uguugcuacucucccugggagg

SEQ ID NO: 897177 - RNA, 22 nt, Human
gagaacuugaacuuuuccucug

SEQ ID NO: 897178 - RNA, 22 nt, Human
aaauuauuacaagcuaguuggc

SEQ ID NO: 897179 - RNA, 22 nt, Human
agguuuaugaguuuggaagggg

SEQ ID NO: 897180 - RNA, 22 nt, Human
uagcucuuaagucugugauaga

SEQ ID NO: 897181 - RNA, 22 nt, Human
agcugcagcccuccugcauggc

SEQ ID NO: 897182 - RNA, 22 nt, Human
uuucaaauggaucccucagccu

SEQ ID NO: 897183 - RNA, 22 nt, Human
cauucaaacauuaauuuauuca

SEQ ID NO: 897184 - RNA, 22 nt, Human
caugcucuagauucucucuaau

SEQ ID NO: 897185 - RNA, 22 nt, Human
aggcccugcaggaguggggaca

SEQ ID NO: 897186 - RNA, 23 nt, Human
uuuaacuuuccaauaauucauug

SEQ ID NO: 897187 - RNA, 22 nt, Human
aagaauguggcauuuauuuaua

SEQ ID NO: 897188 - RNA, 22 nt, Human
auuggcuccuucuaacaugucu

SEQ ID NO: 897189 - RNA, 22 nt, Human
uguaaguaguaauggaaggaca

SEQ ID NO: 897190 - RNA, 22 nt, Human
gucuggccauuugcccauugug

SEQ ID NO: 897191 - RNA, 22 nt, Human
gaacagaguugaaacaaggcug

SEQ ID NO: 897192 - RNA, 22 nt, Human
agagauaauuagguuaaaugag

SEQ ID NO: 897193 - RNA, 22 nt, Human
gcccaggcuagcguagagugca

SEQ ID NO: 897194 - RNA, 22 nt, Human
cugcccaccgugugcacgugcg

SEQ ID NO: 897195 - RNA, 22 nt, Human
cugcacaggggaugagggcagu

SEQ ID NO: 897196 - RNA, 22 nt, Human
ggaaagaggauaguggguaggu

SEQ ID NO: 897197 - RNA, 22 nt, Human
ugggaagggucaacagcuggaa

SEQ ID NO: 897198 - RNA, 19 nt, Human
ggccuggauuuagggcucc

SEQ ID NO: 897199 - RNA, 22 nt, Human
uaaagacaauuucgagcuguag

SEQ ID NO: 897200 - RNA, 22 nt, Human
agagcagauggagcuggaagag

SEQ ID NO: 897201 - RNA, 22 nt, Human
aggucugaguauggccugagaa

SEQ ID NO: 897202 - RNA, 22 nt, Human
cagcaggucccacugagggccc

SEQ ID NO: 897203 - RNA, 22 nt, Human
uguacaggagaacaaugagaaa

SEQ ID NO: 897204 - RNA, 22 nt, Human
cagagccucaucauccacucca

SEQ ID NO: 897205 - RNA, 22 nt, Human
aaggcuggaguacagugcagug

SEQ ID NO: 897206 - RNA, 22 nt, Human
ccugagugaauucccucacugu

SEQ ID NO: 897207 - RNA, 22 nt, Human
uccaucuacggcuauaccaccc

SEQ ID NO: 897208 - RNA, 22 nt, Human
ugaaaugccuaugaagucagga

SEQ ID NO: 897209 - RNA, 22 nt, Human
ggaggcggagcuugcagugagc

SEQ ID NO: 897210 - RNA, 20 nt, Human
uucagaggugaaguuguggu

SEQ ID NO: 897211 - RNA, 23 nt, Human
aaguuaguuucaauaaagcaauu

SEQ ID NO: 897212 - RNA, 22 nt, Human
gcucuaggaggugugcuuagaa

SEQ ID NO: 897213 - RNA, 21 nt, Human
ugggugggcagagucucuuca

SEQ ID NO: 897214 - RNA, 22 nt, Human
caggcccugcacagugguccug

SEQ ID NO: 897215 - RNA, 22 nt, Human
uguagaggaggaaacugaggcu

SEQ ID NO: 897216 - RNA, 20 nt, Human
aacacacugguggcaucagg

SEQ ID NO: 897217 - RNA, 22 nt, Human
gggcccaguacccucugccaag

SEQ ID NO: 897218 - RNA, 22 nt, Human
cuuuuugucucuguccugauga

SEQ ID NO: 897219 - RNA, 19 nt, Human
acugccugcagguguuggg

SEQ ID NO: 897220 - RNA, 22 nt, Human
augacaguucuacacuuaaucu

SEQ ID NO: 897221 - RNA, 22 nt, Human
uaaagcagcguggguggggcag

SEQ ID NO: 897222 - RNA, 22 nt, Human
uggggaaaagcguuaggaguuc

SEQ ID NO: 897223 - RNA, 22 nt, Human
aguguuguaugggaugacugcu

SEQ ID NO: 897224 - RNA, 23 nt, Human
uagagcaguagaucaccauggga

SEQ ID NO: 897225 - RNA, 22 nt, Human
ggugcugacucugucgugagca

SEQ ID NO: 897226 - RNA, 22 nt, Human
cuggugcacauucgcucucaua

SEQ ID NO: 897227 - RNA, 22 nt, Human
acaguacaggacgaguuuuccu

SEQ ID NO: 897228 - RNA, 18 nt, Human
gcagggacacagggucac

SEQ ID NO: 897229 - RNA, 19 nt, Human
ugcugcaggaugcugcugg

SEQ ID NO: 897230 - RNA, 22 nt, Human
uaaugcaacgugagauaauuaa

SEQ ID NO: 897231 - RNA, 22 nt, Human
cuccugggaugacucuuucuuu

SEQ ID NO: 897232 - RNA, 22 nt, Human
aggcaauaagccucaacugucu

SEQ ID NO: 897233 - RNA, 22 nt, Human
aacuguuacauaguuauagauc

SEQ ID NO: 897234 - RNA, 22 nt, Human
auaauuuacuaagcucuaccuu

SEQ ID NO: 897235 - RNA, 22 nt, Human
ggcugcaugccucaguguaaga

SEQ ID NO: 897236 - RNA, 22 nt, Human
ucuugcccucaacaagagcaug

SEQ ID NO: 897237 - RNA, 17 nt, Human
uggggaagcucagauuu

SEQ ID NO: 897238 - RNA, 22 nt, Human
ugugcagcucuagagccaagcc

SEQ ID NO: 897239 - RNA, 22 nt, Human
uuauuauaaugagggauaaaaa

SEQ ID NO: 897240 - RNA, 22 nt, Human
cagcuucuguuucuagccccug

SEQ ID NO: 897241 - RNA, 23 nt, Human
cuggcucuguagguggcauccuu

SEQ ID NO: 897242 - RNA, 20 nt, Human
ucacauccucucccaacaug

SEQ ID NO: 897243 - RNA, 22 nt, Human
cagaaacuuucuuuacugagca

SEQ ID NO: 897244 - RNA, 22 nt, Human
uggccagugccugccagugcag

SEQ ID NO: 897245 - RNA, 22 nt, Human
ugucuauuaauuccacauaaaa

SEQ ID NO: 897246 - RNA, 22 nt, Human
aaagaacaauguggaaucuccu

SEQ ID NO: 897247 - RNA, 22 nt, Human
cuugcaguuuagguccucugug

SEQ ID NO: 897248 - RNA, 22 nt, Human
ucagagcccugcuccuccccaa

SEQ ID NO: 897249 - RNA, 22 nt, Human
aaaaggaggcaaacagccuaga

SEQ ID NO: 897250 - RNA, 22 nt, Human
auguucagcauucuauaaauau

SEQ ID NO: 897251 - RNA, 22 nt, Human
uuuguacuaugguuuuucacua

SEQ ID NO: 897252 - RNA, 18 nt, Human
ccugaagccugugucuuu

SEQ ID NO: 897253 - RNA, 22 nt, Human
cagggccagcccacuagcgagg

SEQ ID NO: 897254 - RNA, 22 nt, Human
ccucaggccugccagagcccca

SEQ ID NO: 897255 - RNA, 22 nt, Human
aaugcuaaaacacagauuuuug

SEQ ID NO: 897256 - RNA, 20 nt, Human
ggccacagggugcuggugga

SEQ ID NO: 897257 - RNA, 22 nt, Human
gaggagucuaguuuauggcuuc

SEQ ID NO: 897258 - RNA, 22 nt, Human
augaguaagaccauaauuuuug

SEQ ID NO: 897259 - RNA, 22 nt, Human
gcagacacuuuuauucugcaua

SEQ ID NO: 897260 - RNA, 22 nt, Human
ucagcugccccgggcacugccc

SEQ ID NO: 897261 - RNA, 23 nt, Human
auccucucuccaucccacugugc

SEQ ID NO: 897262 - RNA, 18 nt, Human
gcaguaggcgcgcaggac

SEQ ID NO: 897263 - RNA, 22 nt, Human
ggcuucaguggccagagaugau

SEQ ID NO: 897264 - RNA, 22 nt, Human
agcuggcuuuaugguuggcuaa

SEQ ID NO: 897265 - RNA, 22 nt, Human
acagggcucccagcaggucugu

SEQ ID NO: 897266 - RNA, 22 nt, Human
aaacaaguuuguagacuagcca

SEQ ID NO: 897267 - RNA, 22 nt, Human
aauguucagaggacaauauaaa

SEQ ID NO: 897268 - RNA, 19 nt, Human
guuuuuaguuucugaacug

SEQ ID NO: 897269 - RNA, 20 nt, Human
gucagugucuucaguaguga

SEQ ID NO: 897270 - RNA, 22 nt, Human
uagaaagacuguccagauuuca

SEQ ID NO: 897271 - RNA, 22 nt, Human
accaugcacagcuguucuauua

SEQ ID NO: 897272 - RNA, 22 nt, Human
caggcugggcagccuccccggc

SEQ ID NO: 897273 - RNA, 22 nt, Human
caccaggugcuggaggacauca

SEQ ID NO: 897274 - RNA, 22 nt, Human
agcagguuguuuuguggccagg

SEQ ID NO: 897275 - RNA, 22 nt, Human
augaccagacucucaguggggu

SEQ ID NO: 897276 - RNA, 22 nt, Human
aucacaguggcuaccucuggau

SEQ ID NO: 897277 - RNA, 18 nt, Human
ggucugagaucguuuuuc

SEQ ID NO: 897278 - RNA, 22 nt, Human
ccagaggugguggugucuagaa

SEQ ID NO: 897279 - RNA, 22 nt, Human
aauaacuucauguaacauuuaa

SEQ ID NO: 897280 - RNA, 22 nt, Human
ggcagcagggucuagauugaug

SEQ ID NO: 897281 - RNA, 23 nt, Human
ugagacacucauucauggaguau

SEQ ID NO: 897282 - RNA, 22 nt, Human
uggcaggcauccggcaccuucu

SEQ ID NO: 897283 - RNA, 22 nt, Human
uugccacacaaguaaagaaaca

SEQ ID NO: 897284 - RNA, 22 nt, Human
cugagggcccugaagcuuggca

SEQ ID NO: 897285 - RNA, 23 nt, Human
agcuccagaacauagcacaggaa

SEQ ID NO: 897286 - RNA, 22 nt, Human
aggccugggacgggagccguga

SEQ ID NO: 897287 - RNA, 22 nt, Human
auguauacgugcaggucacagg

SEQ ID NO: 897288 - RNA, 22 nt, Human
gcugaagcugacacauagugcu

SEQ ID NO: 897289 - RNA, 22 nt, Human
acaaaucuguuuuauagacuuu

SEQ ID NO: 897290 - RNA, 23 nt, Human
agaggcaggaguggcuugcccgg

SEQ ID NO: 897291 - RNA, 22 nt, Human
gagagcugugguuugaccaggc

SEQ ID NO: 897292 - RNA, 22 nt, Human
ugagguaggagggugaucagca

SEQ ID NO: 897293 - RNA, 22 nt, Human
aaaggcaugcugcugaaugaug

SEQ ID NO: 897294 - RNA, 20 nt, Human
gagggcaggcacccauuuca

SEQ ID NO: 897295 - RNA, 22 nt, Human
auuucucaguuccuacuguuua

SEQ ID NO: 897296 - RNA, 22 nt, Human
aagaguuuccaugcucugugcu

SEQ ID NO: 897297 - RNA, 21 nt, Human
acacugcaggugaagugcacu

SEQ ID NO: 897298 - RNA, 22 nt, Human
gcugguaggaagugcuccugcc

SEQ ID NO: 897299 - RNA, 22 nt, Human
caggagacaaguuagcagcuga

SEQ ID NO: 897300 - RNA, 22 nt, Human
gaggcacaguguuuggucagug

SEQ ID NO: 897301 - RNA, 22 nt, Human
cuagggcacuaggacucaugug

SEQ ID NO: 897302 - RNA, 22 nt, Human
ccagcccugaacccugcugcau

SEQ ID NO: 897303 - RNA, 22 nt, Human
ugcacuggggucccagcgcacg

SEQ ID NO: 897304 - RNA, 21 nt, Human
ccccugggagcccugucagua

SEQ ID NO: 897305 - RNA, 22 nt, Human
ugugggaaaugggaguggaaga

SEQ ID NO: 897306 - RNA, 22 nt, Human
ugcagcugggucugcccuggcu

SEQ ID NO: 897307 - RNA, 22 nt, Human
uggcaggaucuuugagagugaa

SEQ ID NO: 897308 - RNA, 22 nt, Human
auggcagacgaggcagcagggg

SEQ ID NO: 897309 - RNA, 22 nt, Human
aacagggcuuuggaagucuccg

SEQ ID NO: 897310 - RNA, 22 nt, Human
aguacaauuuaaugaagauagc

SEQ ID NO: 897311 - RNA, 22 nt, Human
ccuggugucuguuuacagcagc

SEQ ID NO: 897312 - RNA, 22 nt, Human
aagcuggaacaucuugaggaag

SEQ ID NO: 897313 - RNA, 22 nt, Human
cugcagcuggagcaucuucuca

SEQ ID NO: 897314 - RNA, 22 nt, Human
gggagcagccugccucccaccu

SEQ ID NO: 897315 - RNA, 22 nt, Human
gugcccaguugaggccaggacu

SEQ ID NO: 897316 - RNA, 22 nt, Human
guguuccauguuugagguaguu

SEQ ID NO: 897317 - RNA, 22 nt, Human
gcccaggagccuggagaugugu

SEQ ID NO: 897318 - RNA, 22 nt, Human
acuuguaaacaaaucuaaugua

SEQ ID NO: 897319 - RNA, 22 nt, Human
ucaagacauauuaaaugugcga

SEQ ID NO: 897320 - RNA, 22 nt, Human
ccucagaggugaacaucagugc

SEQ ID NO: 897321 - RNA, 21 nt, Human
caccaacaccugggauagguc

SEQ ID NO: 897322 - RNA, 22 nt, Human
gaagcccauuuguacagcacau

SEQ ID NO: 897323 - RNA, 22 nt, Human
uauaugcaaugaggugggagua

SEQ ID NO: 897324 - RNA, 22 nt, Human
aggaguggaauuacuggguucu

SEQ ID NO: 897325 - RNA, 22 nt, Human
gcccagguuggagagcaguggc

SEQ ID NO: 897326 - RNA, 22 nt, Human
ucauugaauuucacagcuuuau

SEQ ID NO: 897327 - RNA, 22 nt, Human
aagcaguguucccagcuggccc

SEQ ID NO: 897328 - RNA, 22 nt, Human
augacuucguuuucucucugca

SEQ ID NO: 897329 - RNA, 22 nt, Human
ugggaugauagguaaguaauua

SEQ ID NO: 897330 - RNA, 22 nt, Human
agcucugggaguaguuccaccu

SEQ ID NO: 897331 - RNA, 22 nt, Human
augcauauuucuugggcuuacc

SEQ ID NO: 897332 - RNA, 22 nt, Human
cuuacacacuagaugguaggug

SEQ ID NO: 897333 - RNA, 22 nt, Human
gccuggcucgggcacucgccag

SEQ ID NO: 897334 - RNA, 18 nt, Human
gucaccuggaucagauua

SEQ ID NO: 897335 - RNA, 22 nt, Human
cacugaaacagguauugcuggu

SEQ ID NO: 897336 - RNA, 22 nt, Human
guuauuguuuauccugcacccc

SEQ ID NO: 897337 - RNA, 22 nt, Human
gggcuccaggcaggcaggaaau

SEQ ID NO: 897338 - RNA, 22 nt, Human
cccagagggcugaggauaugaa

SEQ ID NO: 897339 - RNA, 22 nt, Human
agggaaguggucugggaacuug

SEQ ID NO: 897340 - RNA, 22 nt, Human
auauuauucuagcucuugugug

SEQ ID NO: 897341 - RNA, 22 nt, Human
uggcucaguuugggggauugaa

SEQ ID NO: 897342 - RNA, 22 nt, Human
ugaaauaggaaacagauguuuc

SEQ ID NO: 897343 - RNA, 22 nt, Human
ugacauuuuuauaagagucaaa

SEQ ID NO: 897344 - RNA, 22 nt, Human
ucacaguuaugggccuugguca

SEQ ID NO: 897345 - RNA, 22 nt, Human
ucugucuguaguuuuacaugau

SEQ ID NO: 897346 - RNA, 19 nt, Human
cagcugcaccgugaccauc

SEQ ID NO: 897347 - RNA, 23 nt, Human
gaagucagcccuacagagagcag

SEQ ID NO: 897348 - RNA, 21 nt, Human
ggccuuggcgggggccgaauu

SEQ ID NO: 897349 - RNA, 22 nt, Human
cuggaaagacagagggcauggg

SEQ ID NO: 897350 - RNA, 22 nt, Human
aauguaaacagcaagagaaggg

SEQ ID NO: 897351 - RNA, 22 nt, Human
auauaauaguuucauaaaggcu

SEQ ID NO: 897352 - RNA, 22 nt, Human
gauguguguuuauacauauauu

SEQ ID NO: 897353 - RNA, 22 nt, Human
auacaagaucacuccagaaaau

SEQ ID NO: 897354 - RNA, 22 nt, Human
ccuggcuucucugcauuguucu

SEQ ID NO: 897355 - RNA, 22 nt, Human
uacuauaaagucuuaaugaguc

SEQ ID NO: 897356 - RNA, 22 nt, Human
ggcuuuaugcagggauagaaau

SEQ ID NO: 897357 - RNA, 22 nt, Human
ugauuuccaguugcugggugcu

SEQ ID NO: 897358 - RNA, 19 nt, Human
ugaaguccuaaccuccagu

SEQ ID NO: 897359 - RNA, 23 nt, Human
agacaaacuuccuucacugcacc

SEQ ID NO: 897360 - RNA, 22 nt, Human
cuggaaugcggagaguuggaga

SEQ ID NO: 897361 - RNA, 22 nt, Human
ugcuuuaucugugagaaccuga

SEQ ID NO: 897362 - RNA, 22 nt, Human
ugggcugcacuccauuuucugc

SEQ ID NO: 897363 - RNA, 22 nt, Human
gaacacaucacauuuuacagug

SEQ ID NO: 897364 - RNA, 22 nt, Human
auggcucugagaaccugagcua

SEQ ID NO: 897365 - RNA, 22 nt, Human
cagguguuucaaaugugaaacu

SEQ ID NO: 897366 - RNA, 21 nt, Human
ugucugcugaaggcuggucac

SEQ ID NO: 897367 - RNA, 22 nt, Human
guauucaaggauuuuguucuac

SEQ ID NO: 897368 - RNA, 22 nt, Human
cccagagaauuccacauagagg

SEQ ID NO: 897369 - RNA, 22 nt, Human
auccugaguucucagagucucc

SEQ ID NO: 897370 - RNA, 22 nt, Human
auacacaggugcuaggucaaua

SEQ ID NO: 897371 - RNA, 22 nt, Human
uguccuggaucaugccucugaa

SEQ ID NO: 897372 - RNA, 22 nt, Human
ccuuccccagugauucucucag

SEQ ID NO: 897373 - RNA, 22 nt, Human
accacaggggaggaaugaugcc

SEQ ID NO: 897374 - RNA, 22 nt, Human
ugcagcugaaaggacugaauga

SEQ ID NO: 897375 - RNA, 22 nt, Human
cacccaguaagcaugaggcccu

SEQ ID NO: 897376 - RNA, 22 nt, Human
aaguaacuuauuugcaaacagg

SEQ ID NO: 897377 - RNA, 22 nt, Human
uguucugccagcacuucucagc

SEQ ID NO: 897378 - RNA, 22 nt, Human
aguaucaaagggcaugugguua

SEQ ID NO: 897379 - RNA, 23 nt, Human
aguucagcucaguucagugagca

SEQ ID NO: 897380 - RNA, 23 nt, Human
uucauucaaaaggaaaagucaug

SEQ ID NO: 897381 - RNA, 22 nt, Human
ucaaacugcuaccuuuuaugug

SEQ ID NO: 897382 - RNA, 22 nt, Human
aagauuuauuagaugcuuaccu

SEQ ID NO: 897383 - RNA, 22 nt, Human
aagaggacuugugaagauguac

SEQ ID NO: 897384 - RNA, 22 nt, Human
guggcagagcaggagacaggac

SEQ ID NO: 897385 - RNA, 22 nt, Human
gaggcuccuugaaagggggacu

SEQ ID NO: 897386 - RNA, 22 nt, Human
caagggcagcagccucaagcgg

SEQ ID NO: 897387 - RNA, 22 nt, Human
ggcugcacgccucucagcuugc

SEQ ID NO: 897388 - RNA, 22 nt, Human
ugccaaauuagaguucccaggc

SEQ ID NO: 897389 - RNA, 22 nt, Human
auuuucaguguaaauguuuuau

SEQ ID NO: 897390 - RNA, 22 nt, Human
caggccuuaaggacucggagaa

SEQ ID NO: 897391 - RNA, 22 nt, Human
guugcugauuaacacuuugagu

SEQ ID NO: 897392 - RNA, 22 nt, Human
aaagauugaaagagaauuuguc

SEQ ID NO: 897393 - RNA, 22 nt, Human
auacacuggccuuugcagagcc

SEQ ID NO: 897394 - RNA, 22 nt, Human
ucaucugucccaggcuuuuuuc

SEQ ID NO: 897395 - RNA, 22 nt, Human
cagcaacugugccugacacaca

SEQ ID NO: 897396 - RNA, 22 nt, Human
gugcugagcacaaggcccagag

SEQ ID NO: 897397 - RNA, 22 nt, Human
ggcacagauagaucaagugucu

SEQ ID NO: 897398 - RNA, 22 nt, Human
aucauuaacccuugaugcuggg

SEQ ID NO: 897399 - RNA, 22 nt, Human
augcaggggcagcagagccugg

SEQ ID NO: 897400 - RNA, 22 nt, Human
guucugaggcaaaggcagcagc

SEQ ID NO: 897401 - RNA, 22 nt, Human
agggguggccugccuuacuccc

SEQ ID NO: 897402 - RNA, 22 nt, Human
ucugcuuugcugccuccugauc

SEQ ID NO: 897403 - RNA, 22 nt, Human
caagauuuguauugggccucug

SEQ ID NO: 897404 - RNA, 22 nt, Human
gccagagagagucccugggccu

SEQ ID NO: 897405 - RNA, 22 nt, Human
uuaaguagauucaguguuaagg

SEQ ID NO: 897406 - RNA, 22 nt, Human
guggccaggacauugccaggca

SEQ ID NO: 897407 - RNA, 22 nt, Human
uucuggaggagaaagggugggc

SEQ ID NO: 897408 - RNA, 20 nt, Human
ggccaccugcuucagacccc

SEQ ID NO: 897409 - RNA, 22 nt, Human
cugcugugcaggugccuaugau

SEQ ID NO: 897410 - RNA, 18 nt, Human
gugggguguugugaggau

SEQ ID NO: 897411 - RNA, 22 nt, Human
uguccagugauucucaugagcc

SEQ ID NO: 897412 - RNA, 22 nt, Human
uaaauguauaggcacuaaaccu

SEQ ID NO: 897413 - RNA, 22 nt, Human
uguaaaauaauucuccauguuu

SEQ ID NO: 897414 - RNA, 22 nt, Human
ugacagugacagccaaaggcuu

SEQ ID NO: 897415 - RNA, 22 nt, Human
uacaacaugugguccuuuauga

SEQ ID NO: 897416 - RNA, 22 nt, Human
guagaaccuucuuuacuagagu

SEQ ID NO: 897417 - RNA, 22 nt, Human
agaaacuaaagccaagggcucu

SEQ ID NO: 897418 - RNA, 22 nt, Human
uuuauucacuucagugccaaag

SEQ ID NO: 897419 - RNA, 22 nt, Human
cuagagaauugucuugagaguu

SEQ ID NO: 897420 - RNA, 22 nt, Human
auuuaguaaguacuuguugaau

SEQ ID NO: 897421 - RNA, 22 nt, Human
gaauccuugguuuuaagcaaua

SEQ ID NO: 897422 - RNA, 22 nt, Human
aagcaauaaucccaaagugcug

SEQ ID NO: 897423 - RNA, 22 nt, Human
caaguuaguauugguuuuggga

SEQ ID NO: 897424 - RNA, 22 nt, Human
ccaggugcaaacucccagcagg

SEQ ID NO: 897425 - RNA, 22 nt, Human
cacagcuguauccaggagaucc

SEQ ID NO: 897426 - RNA, 22 nt, Human
agagcugggugguggugacuca

SEQ ID NO: 897427 - RNA, 22 nt, Human
uggcauguggcagcugguucag

SEQ ID NO: 897428 - RNA, 22 nt, Human
agaaagggcuauuuugagguag

SEQ ID NO: 897429 - RNA, 22 nt, Human
augguauucucuaacucagcuu

SEQ ID NO: 897430 - RNA, 22 nt, Human
ucuagagauuggacuuccuaga

SEQ ID NO: 897431 - RNA, 20 nt, Human
ccaguccaccugagacaugu

SEQ ID NO: 897432 - RNA, 20 nt, Human
ccugggcucaaagcauccuc

SEQ ID NO: 897433 - RNA, 22 nt, Human
cccagggagagcgcggaggcgg

SEQ ID NO: 897434 - RNA, 23 nt, Human
uggcucucucagugcugcagagg

SEQ ID NO: 897435 - RNA, 21 nt, Human
ggaaagaaggcaaggcucagg

SEQ ID NO: 897436 - RNA, 22 nt, Human
uuuacagacaacuuaauagggg

SEQ ID NO: 897437 - RNA, 21 nt, Human
agcagaggcugccuggugacu

SEQ ID NO: 897438 - RNA, 22 nt, Human
cuuacuugaaauuccaagcagg

SEQ ID NO: 897439 - RNA, 22 nt, Human
agcugccauccuguucagcacc

SEQ ID NO: 897440 - RNA, 22 nt, Human
gagcugggcgagccggggaagu

SEQ ID NO: 897441 - RNA, 22 nt, Human
acagugcaggucucaacaauua

SEQ ID NO: 897442 - RNA, 22 nt, Human
ucgcuuuaauggucuucacagc

SEQ ID NO: 897443 - RNA, 22 nt, Human
gaaaaugugucaucccuacugu

SEQ ID NO: 897444 - RNA, 22 nt, Human
cugcgugguaggacucaguucu

SEQ ID NO: 897445 - RNA, 22 nt, Human
ugguccagaugccuuggcuuua

SEQ ID NO: 897446 - RNA, 22 nt, Human
gaggacauaguggacuaggguu

SEQ ID NO: 897447 - RNA, 22 nt, Human
gaacuugggagaagggagugug

SEQ ID NO: 897448 - RNA, 22 nt, Human
ggcucugguggcaauugacugg

SEQ ID NO: 897449 - RNA, 22 nt, Human
ugcuggcuccucgaggcuucgu

SEQ ID NO: 897450 - RNA, 22 nt, Human
cuucuggaggacacuggcccca

SEQ ID NO: 897451 - RNA, 22 nt, Human
uuuccuuugaggguccuacacu

SEQ ID NO: 897452 - RNA, 22 nt, Human
uaucuguuuauuguuacuguca

SEQ ID NO: 897453 - RNA, 22 nt, Human
acacuagaugccaauagcaccc

SEQ ID NO: 897454 - RNA, 22 nt, Human
auuacaaaagaagggagaaggu

SEQ ID NO: 897455 - RNA, 22 nt, Human
cuuuagaaaucuggauguauuu

SEQ ID NO: 897456 - RNA, 22 nt, Human
guccugguagcuggcuugguca

SEQ ID NO: 897457 - RNA, 22 nt, Human
uggcuggcgccgggcuagccac

SEQ ID NO: 897458 - RNA, 22 nt, Human
gaaaugguaaacauuuuaaugg

SEQ ID NO: 897459 - RNA, 22 nt, Human
cucucuggacuugaguaucagc

SEQ ID NO: 897460 - RNA, 22 nt, Human
cccaggagcuucucucugccuc

SEQ ID NO: 897461 - RNA, 22 nt, Human
caggcugcagcagcaguggccc

SEQ ID NO: 897462 - RNA, 22 nt, Human
ccagggagcggggcugggucuc

SEQ ID NO: 897463 - RNA, 21 nt, Human
gucugugaucuuacugcugug

SEQ ID NO: 897464 - RNA, 23 nt, Human
uguauacacccugugcaucuggg

SEQ ID NO: 897465 - RNA, 22 nt, Human
uaucuagauauuuggauaaaug

SEQ ID NO: 897466 - RNA, 22 nt, Human
uccugugugggcaggaugagaa

SEQ ID NO: 897467 - RNA, 22 nt, Human
agcauccacucacugggagagg

SEQ ID NO: 897468 - RNA, 22 nt, Human
caucacaguuugucagaaauca

SEQ ID NO: 897469 - RNA, 22 nt, Human
gcagugaauuuaacacucagau

SEQ ID NO: 897470 - RNA, 22 nt, Human
aaacgguugcucauaguuacau

SEQ ID NO: 897471 - RNA, 22 nt, Human
uaacaguagccuuauguggucu

SEQ ID NO: 897472 - RNA, 22 nt, Human
aagacugaauuugcauaguugg

SEQ ID NO: 897473 - RNA, 22 nt, Human
uuaaauaguaggucuauuuugg

SEQ ID NO: 897474 - RNA, 23 nt, Human
aguacauuugacccaaauaagcu

SEQ ID NO: 897475 - RNA, 22 nt, Human
aggggaggcagcgauaaaccug

SEQ ID NO: 897476 - RNA, 22 nt, Human
acaucucaugaaugauaaauca

SEQ ID NO: 897477 - RNA, 22 nt, Human
uuuucugugcccugcuagcugg

SEQ ID NO: 897478 - RNA, 23 nt, Human
uuggaagggaagagcauuugaga

SEQ ID NO: 897479 - RNA, 22 nt, Human
cacugaaggcuaggauuagaug

SEQ ID NO: 897480 - RNA, 22 nt, Human
auguuucauuuagauaucaggc

SEQ ID NO: 897481 - RNA, 22 nt, Human
guggcagaggcugugaggaugc

SEQ ID NO: 897482 - RNA, 22 nt, Human
gacagggcgcccagccuguuuc

SEQ ID NO: 897483 - RNA, 22 nt, Human
gcccacucuggagccuguuccc

SEQ ID NO: 897484 - RNA, 22 nt, Human
ccagggcauguaacuaauggug

SEQ ID NO: 897485 - RNA, 22 nt, Human
ggucucagcaguugcuuugacu

SEQ ID NO: 897486 - RNA, 19 nt, Human
ggugugugcuggggccugu

SEQ ID NO: 897487 - RNA, 22 nt, Human
auuauuuguguccacagaauac

SEQ ID NO: 897488 - RNA, 22 nt, Human
ggucagagaugaggucuaaagu

SEQ ID NO: 897489 - RNA, 17 nt, Human
ugagcuucaaucaggug

SEQ ID NO: 897490 - RNA, 22 nt, Human
auuucaaguguugagcucauaa

SEQ ID NO: 897491 - RNA, 22 nt, Human
cccucucucaggcugacagccu

SEQ ID NO: 897492 - RNA, 22 nt, Human
ccccuuccaggaagcagaaucg

SEQ ID NO: 897493 - RNA, 22 nt, Human
augggcagacagggagcucacg

SEQ ID NO: 897494 - RNA, 22 nt, Human
aguaaaaauaugcuuguggcua

SEQ ID NO: 897495 - RNA, 22 nt, Human
augguuuaaagaguaugacuuu

SEQ ID NO: 897496 - RNA, 22 nt, Human
ugaaaucaauugcaauguuuau

SEQ ID NO: 897497 - RNA, 22 nt, Human
aaguaaauguuggagcucaaau

SEQ ID NO: 897498 - RNA, 22 nt, Human
ucagggaaauucaagggagauu

SEQ ID NO: 897499 - RNA, 22 nt, Human
ccuucuugagguagcacauucu

SEQ ID NO: 897500 - RNA, 22 nt, Human
uaucacaggugugauuuacauu

SEQ ID NO: 897501 - RNA, 22 nt, Human
uauguugcaccaaccuaauaau

SEQ ID NO: 897502 - RNA, 22 nt, Human
aaggaagauauaucaagcuuaa

SEQ ID NO: 897503 - RNA, 22 nt, Human
guauccacaauaaagcccuuug

SEQ ID NO: 897504 - RNA, 18 nt, Human
auuucucuggggugauuc

SEQ ID NO: 897505 - RNA, 22 nt, Human
agauaauuaugucaauuucuug

SEQ ID NO: 897506 - RNA, 22 nt, Human
uggccagguugggcuuugcagc

SEQ ID NO: 897507 - RNA, 22 nt, Human
cuaaaauguuuggggcagaacc

SEQ ID NO: 897508 - RNA, 22 nt, Human
gcagaagcacaggugacgggcc

SEQ ID NO: 897509 - RNA, 22 nt, Human
ggcauuuagauugaauuucugu

SEQ ID NO: 897510 - RNA, 22 nt, Human
ggcuauggcaaagaacucagau

SEQ ID NO: 897511 - RNA, 22 nt, Human
aggauaauaauaaucucguuua

SEQ ID NO: 897512 - RNA, 22 nt, Human
auuauuaaaauguguuucucuu

SEQ ID NO: 897513 - RNA, 21 nt, Human
uuccuggggacuuccguggga

SEQ ID NO: 897514 - RNA, 22 nt, Human
cuacauguagguuuccuuaauu

SEQ ID NO: 897515 - RNA, 22 nt, Human
aaugccuuauaggcugaaaauu

SEQ ID NO: 897516 - RNA, 22 nt, Human
gcacaguugauuuaugcuggug

SEQ ID NO: 897517 - RNA, 22 nt, Human
gcagggccagugcagagaggaa

SEQ ID NO: 897518 - RNA, 22 nt, Human
aaaucuaggccgggugcggugg

SEQ ID NO: 897519 - RNA, 22 nt, Human
cugucaccugccagcauaccca

SEQ ID NO: 897520 - RNA, 21 nt, Human
gacaaacauuucauagcuuua

SEQ ID NO: 897521 - RNA, 22 nt, Human
ucuuuucuucuuaaugguuaau

SEQ ID NO: 897522 - RNA, 22 nt, Human
ucaaaacacuauuaccuuuaau

SEQ ID NO: 897523 - RNA, 23 nt, Human
aagccuuguggaggcucucauuu

SEQ ID NO: 897524 - RNA, 22 nt, Human
agucuccacacuggcagaugcc

SEQ ID NO: 897525 - RNA, 22 nt, Human
agugucugcagugaugucucuu

SEQ ID NO: 897526 - RNA, 22 nt, Human
agaagccauugaagcagaccuc

SEQ ID NO: 897527 - RNA, 22 nt, Human
gcuucugucuuagcuaccuccc

SEQ ID NO: 897528 - RNA, 22 nt, Human
uguguacacaaguauauauaca

SEQ ID NO: 897529 - RNA, 20 nt, Human
uccuaagaggauggccacgu

SEQ ID NO: 897530 - RNA, 22 nt, Human
uauaguuucaugagcuuuuuaa

SEQ ID NO: 897531 - RNA, 22 nt, Human
ucaaagacagacaucagucaaa

SEQ ID NO: 897532 - RNA, 22 nt, Human
gacauucagccaauuacuuucu

SEQ ID NO: 897533 - RNA, 23 nt, Human
cauuucaacgaauuuuccuucug

SEQ ID NO: 897534 - RNA, 22 nt, Human
caggguggugaauagcuauagu

SEQ ID NO: 897535 - RNA, 21 nt, Human
uguguguaugcacacacaugc

SEQ ID NO: 897536 - RNA, 22 nt, Human
aggcccagggcugcucucugaa

SEQ ID NO: 897537 - RNA, 22 nt, Human
aucucagaucuacagaucuaca

SEQ ID NO: 897538 - RNA, 22 nt, Human
uuucuucccaagcaguuucaga

SEQ ID NO: 897539 - RNA, 22 nt, Human
auacagugagaauaauucuuag

SEQ ID NO: 897540 - RNA, 22 nt, Human
gcugaggaagucagguggccca

SEQ ID NO: 897541 - RNA, 23 nt, Human
uuuggcugggcugugggcacacc

SEQ ID NO: 897542 - RNA, 22 nt, Human
uccugcuuccuugucuuuagac

SEQ ID NO: 897543 - RNA, 22 nt, Human
ucacauucauggugcuaauaaa

SEQ ID NO: 897544 - RNA, 22 nt, Human
cuggggccagugaggaggcuuu

SEQ ID NO: 897545 - RNA, 22 nt, Human
gaccugggguaagcuuggcaac

SEQ ID NO: 897546 - RNA, 20 nt, Human
ucuuaaauccccagggccau

SEQ ID NO: 897547 - RNA, 22 nt, Human
ugggguggauagaaagugaugu

SEQ ID NO: 897548 - RNA, 22 nt, Human
gucauaaaauuuguggauuaga

SEQ ID NO: 897549 - RNA, 22 nt, Human
uacaaaggagacucuguauuua

SEQ ID NO: 897550 - RNA, 22 nt, Human
aucacuguguauguauaugcag

SEQ ID NO: 897551 - RNA, 22 nt, Human
uguguauacgaguaugaauaug

SEQ ID NO: 897552 - RNA, 22 nt, Human
auggccaguguugagaucaggc

SEQ ID NO: 897553 - RNA, 22 nt, Human
caaugaaaauuuaaguugcagc

SEQ ID NO: 897554 - RNA, 22 nt, Human
cacaagagagugcgcguugcaa

SEQ ID NO: 897555 - RNA, 22 nt, Human
cuguacagaagcuagagcaaau

SEQ ID NO: 897556 - RNA, 19 nt, Human
agcauuaggcaaauuuuga

SEQ ID NO: 897557 - RNA, 22 nt, Human
aaugucacucuguuuccucugc

SEQ ID NO: 897558 - RNA, 22 nt, Human
ugcguugcgcuccugcagcagg

SEQ ID NO: 897559 - RNA, 22 nt, Human
ucagggcaggcgagcagcugcu

SEQ ID NO: 897560 - RNA, 22 nt, Human
ccuggagcucacugggagccgg

SEQ ID NO: 897561 - RNA, 22 nt, Human
auauuaguguagguagcuaaua

SEQ ID NO: 897562 - RNA, 22 nt, Human
cccugugcacacacuucacucu

SEQ ID NO: 897563 - RNA, 22 nt, Human
uugugugcugagggccugcugu

SEQ ID NO: 897564 - RNA, 22 nt, Human
ccuuuuguacacuuacuauaua

SEQ ID NO: 897565 - RNA, 21 nt, Human
auuucauggugcuuuuaagaa

SEQ ID NO: 897566 - RNA, 22 nt, Human
aauacagagaauguuauuugga

SEQ ID NO: 897567 - RNA, 22 nt, Human
auguccaggaagucuuaacuca

SEQ ID NO: 897568 - RNA, 18 nt, Human
ugucucugaauuccagug

SEQ ID NO: 897569 - RNA, 22 nt, Human
ccaggcugcuuagccuuaucuu

SEQ ID NO: 897570 - RNA, 17 nt, Human
accaccucucaccagca

SEQ ID NO: 897571 - RNA, 22 nt, Human
gaggguggcuccucccugggcc

SEQ ID NO: 897572 - RNA, 22 nt, Human
agggccuggacuaauuggaucc

SEQ ID NO: 897573 - RNA, 22 nt, Human
acacagauuucacuggaauaga

SEQ ID NO: 897574 - RNA, 20 nt, Human
uguauuucaugcauuccugg

SEQ ID NO: 897575 - RNA, 22 nt, Human
uuuuccuauaugcaaagaaugc

SEQ ID NO: 897576 - RNA, 22 nt, Human
agagcccuugcccucagucacc

SEQ ID NO: 897577 - RNA, 22 nt, Human
gugagcuguuuuggacccaucu

SEQ ID NO: 897578 - RNA, 22 nt, Human
guggggaguguucugugauugg

SEQ ID NO: 897579 - RNA, 22 nt, Human
gcuaaucaauguuaaggcugug

SEQ ID NO: 897580 - RNA, 23 nt, Human
uagcuguggcguaaggcucagcu

SEQ ID NO: 897581 - RNA, 22 nt, Human
uuacaugaugauuucauaaaca

SEQ ID NO: 897582 - RNA, 22 nt, Human
aggccaggcaacauucugaagu

SEQ ID NO: 897583 - RNA, 22 nt, Human
agcuuguucaaaugcagaauac

SEQ ID NO: 897584 - RNA, 22 nt, Human
uggcuggcuggaccacaccugc

SEQ ID NO: 897585 - RNA, 22 nt, Human
gggcuggagagucccacguggg

SEQ ID NO: 897586 - RNA, 22 nt, Human
ggcaggugcccagagagcacga

SEQ ID NO: 897587 - RNA, 22 nt, Human
gacacagauaucucugagauua

SEQ ID NO: 897588 - RNA, 22 nt, Human
cugaagagaaagggagcucuuc

SEQ ID NO: 897589 - RNA, 22 nt, Human
cucuggaguaagagcuaugaaa

SEQ ID NO: 897590 - RNA, 22 nt, Human
gaaggcacugaacuccuucugg

SEQ ID NO: 897591 - RNA, 22 nt, Human
aaaggacaugucaauaucaggc

SEQ ID NO: 897592 - RNA, 22 nt, Human
aggcuccuucacagcacucgcc

SEQ ID NO: 897593 - RNA, 22 nt, Human
caggcuuggagggcaguggcau

SEQ ID NO: 897594 - RNA, 22 nt, Human
cagaaaaggaagagcuauguaa

SEQ ID NO: 897595 - RNA, 22 nt, Human
ugaaacacuuucaauuacauau

SEQ ID NO: 897596 - RNA, 22 nt, Human
uauucacaguugauuuacaguu

SEQ ID NO: 897597 - RNA, 22 nt, Human
aggcacuguacuagguacaggg

SEQ ID NO: 897598 - RNA, 22 nt, Human
ugcaaacagaaaguuuauugug

SEQ ID NO: 897599 - RNA, 21 nt, Human
ugaggccugccagucucagaa

SEQ ID NO: 897600 - RNA, 22 nt, Human
ccagaagaacuuaauucaaaac

SEQ ID NO: 897601 - RNA, 22 nt, Human
gcaccugggcaaggauucagag

SEQ ID NO: 897602 - RNA, 22 nt, Human
acaauauaguccaugagcaugc

SEQ ID NO: 897603 - RNA, 22 nt, Human
guucaauuuagaaagcacaguu

SEQ ID NO: 897604 - RNA, 22 nt, Human
gcuucugugagugcagaugcug

SEQ ID NO: 897605 - RNA, 22 nt, Human
aguucuuauuuuggaacugagg

SEQ ID NO: 897606 - RNA, 21 nt, Human
ucacaguuggccaggcauuua

SEQ ID NO: 897607 - RNA, 23 nt, Human
ccugucaacaaggccccacugua

SEQ ID NO: 897608 - RNA, 22 nt, Human
uuacaauugagucuauuguaug

SEQ ID NO: 897609 - RNA, 22 nt, Human
ugcagaagaccuuccagggcug

SEQ ID NO: 897610 - RNA, 22 nt, Human
auguuucuaaaacuugcauggc

SEQ ID NO: 897611 - RNA, 22 nt, Human
acaggcaggagcuccccauucc

SEQ ID NO: 897612 - RNA, 22 nt, Human
cauuucuacagcuucuucagaa

SEQ ID NO: 897613 - RNA, 22 nt, Human
ggcugugcugagggggaagccc

SEQ ID NO: 897614 - RNA, 22 nt, Human
uuacgaucauuucuaaaauaaa

SEQ ID NO: 897615 - RNA, 22 nt, Human
cagcaggccaugcugcuuuuca

SEQ ID NO: 897616 - RNA, 22 nt, Human
guuuccauggcucuguuaaugg

SEQ ID NO: 897617 - RNA, 22 nt, Human
aacaugcucuggauugcuguga

SEQ ID NO: 897618 - RNA, 22 nt, Human
ugaggaagaacaagaauuuaga

SEQ ID NO: 897619 - RNA, 22 nt, Human
aauguucagucucaagagugau

SEQ ID NO: 897620 - RNA, 22 nt, Human
uugcauagugcugagguucggg

SEQ ID NO: 897621 - RNA, 22 nt, Human
ggggaguguuuucaugggcuug

SEQ ID NO: 897622 - RNA, 22 nt, Human
ugauggagcaugugugcuuccu

SEQ ID NO: 897623 - RNA, 22 nt, Human
uaggcagagaggccauaagaau

SEQ ID NO: 897624 - RNA, 22 nt, Human
acagaguauuggaaaggcagug

SEQ ID NO: 897625 - RNA, 22 nt, Human
acauuuaaugauccuacuguga

SEQ ID NO: 897626 - RNA, 22 nt, Human
cuguugugaauuuaguuaccaa

SEQ ID NO: 897627 - RNA, 22 nt, Human
acagcaggcaugaagaaauguu

SEQ ID NO: 897628 - RNA, 22 nt, Human
acaagauagcuuagaagauuca

SEQ ID NO: 897629 - RNA, 22 nt, Human
agcagaacauuuucagggcugu

SEQ ID NO: 897630 - RNA, 22 nt, Human
agcagcauggagaaaccguuca

SEQ ID NO: 897631 - RNA, 22 nt, Human
ugugccuucucaguccugcuca

SEQ ID NO: 897632 - RNA, 22 nt, Human
cuucugggcauucagcugcaca

SEQ ID NO: 897633 - RNA, 22 nt, Human
auuaauaaaauaccacuuuguu

SEQ ID NO: 897634 - RNA, 22 nt, Human
gggcagcucugcccaucagagg

SEQ ID NO: 897635 - RNA, 22 nt, Human
uuccaaaggaauggggagcuau

SEQ ID NO: 897636 - RNA, 22 nt, Human
aagugucugauggagcgaaaug

SEQ ID NO: 897637 - RNA, 22 nt, Human
ugagcagagcaguaacaggagc

SEQ ID NO: 897638 - RNA, 21 nt, Human
gacaggcaaggagucacuuag

SEQ ID NO: 897639 - RNA, 22 nt, Human
uuccggaagguucucuagaauu

SEQ ID NO: 897640 - RNA, 22 nt, Human
cuauugaauuaacuauuaaagu

SEQ ID NO: 897641 - RNA, 22 nt, Human
aaaugguaaugucuuucuguuu

SEQ ID NO: 897642 - RNA, 22 nt, Human
ugcugcagucacacggcuaucu

SEQ ID NO: 897643 - RNA, 22 nt, Human
uuucaaguggggacauuugaga

SEQ ID NO: 897644 - RNA, 22 nt, Human
gcauuuuugaucccacuaggau

SEQ ID NO: 897645 - RNA, 22 nt, Human
ggagggccaucuugggugugau

SEQ ID NO: 897646 - RNA, 22 nt, Human
uccaggguguguuuacuggggu

SEQ ID NO: 897647 - RNA, 22 nt, Human
ucccacagaugcuguccagagu

SEQ ID NO: 897648 - RNA, 20 nt, Human
cugccuggaggccucuaccu

SEQ ID NO: 897649 - RNA, 22 nt, Human
aguuuggggcaagaggacagau

SEQ ID NO: 897650 - RNA, 22 nt, Human
agccaggcgcaguggcuuaugc

SEQ ID NO: 897651 - RNA, 22 nt, Human
gguccaggaucaaggcaucacc

SEQ ID NO: 897652 - RNA, 22 nt, Human
ccuuuguucuguguaucuuugu

SEQ ID NO: 897653 - RNA, 22 nt, Human
gcuuuuguggcugucuucauug

SEQ ID NO: 897654 - RNA, 22 nt, Human
uaagaaugacuaccaaacugga

SEQ ID NO: 897655 - RNA, 22 nt, Human
uaaaucaagaauaucagcuugu

SEQ ID NO: 897656 - RNA, 19 nt, Human
cuccacagggauugugauu

SEQ ID NO: 897657 - RNA, 20 nt, Human
uauuucugggcaaccauuua

SEQ ID NO: 897658 - RNA, 18 nt, Human
uggagcaggaagccuggc

SEQ ID NO: 897659 - RNA, 22 nt, Human
ugaaugaguggauucugaguag

SEQ ID NO: 897660 - RNA, 22 nt, Human
uccagcagagguugauaauacc

SEQ ID NO: 897661 - RNA, 22 nt, Human
aaggccaaagacaccuacacag

SEQ ID NO: 897662 - RNA, 22 nt, Human
gcuucugcgccuagccucaggu

SEQ ID NO: 897663 - RNA, 22 nt, Human
gccuuucacagagauuuaaaaa

SEQ ID NO: 897664 - RNA, 22 nt, Human
ucuuaacaagcuccucagugcu

SEQ ID NO: 897665 - RNA, 18 nt, Human
auaucugugggauggaga

SEQ ID NO: 897666 - RNA, 22 nt, Human
guggaagcaacccuggcaggag

SEQ ID NO: 897667 - RNA, 22 nt, Human
gaaacaugucugacaauuuacc

SEQ ID NO: 897668 - RNA, 22 nt, Human
ccagugugccaauuuacagcug

SEQ ID NO: 897669 - RNA, 22 nt, Human
ccuuaccugauugcuggcaucc

SEQ ID NO: 897670 - RNA, 22 nt, Human
cagccagcugaauguaccauga

SEQ ID NO: 897671 - RNA, 22 nt, Human
caacaguucaguugagcucaac

SEQ ID NO: 897672 - RNA, 22 nt, Human
caggcagcuagauuuauaacaa

SEQ ID NO: 897673 - RNA, 22 nt, Human
uggcagauuuucucuggaggag

SEQ ID NO: 897674 - RNA, 21 nt, Human
ugaggccaauagccccuggac

SEQ ID NO: 897675 - RNA, 22 nt, Human
agcugcucgaagccgguggccc

SEQ ID NO: 897676 - RNA, 22 nt, Human
uguaaacauaccagagccaagu

SEQ ID NO: 897677 - RNA, 22 nt, Human
acuuccccgaagcuggaaauag

SEQ ID NO: 897678 - RNA, 20 nt, Human
ucauacacaugagcaugcag

SEQ ID NO: 897679 - RNA, 22 nt, Human
ucugcccuggggucagccucca

SEQ ID NO: 897680 - RNA, 22 nt, Human
aaaauugugaagguuucugaaa

SEQ ID NO: 897681 - RNA, 21 nt, Human
aggcagcuggaaggccuggcu

SEQ ID NO: 897682 - RNA, 22 nt, Human
ggcuucuccagguacugagcau

SEQ ID NO: 897683 - RNA, 22 nt, Human
ucugaagcacugcaaugcuuua

SEQ ID NO: 897684 - RNA, 22 nt, Human
gucagcaauucaagagcucuua

SEQ ID NO: 897685 - RNA, 22 nt, Human
aaugggcuuucuuggacaggag

SEQ ID NO: 897686 - RNA, 20 nt, Human
cacaggccuugugagcagac

SEQ ID NO: 897687 - RNA, 22 nt, Human
agauguuuaaaaagaugacucu

SEQ ID NO: 897688 - RNA, 22 nt, Human
ccuuccaagugcuugccgcuuu

SEQ ID NO: 897689 - RNA, 22 nt, Human
cacuuacacuucugaaagccua

SEQ ID NO: 897690 - RNA, 22 nt, Human
ugcagggcuccuggcuccaauc

SEQ ID NO: 897691 - RNA, 22 nt, Human
aacauaucuacggauacgauua

SEQ ID NO: 897692 - RNA, 18 nt, Human
uggcucugcagccagaug

SEQ ID NO: 897693 - RNA, 22 nt, Human
gggguaggcaggugaucugauc

SEQ ID NO: 897694 - RNA, 22 nt, Human
acauuucuuccuaauuaucccu

SEQ ID NO: 897695 - RNA, 22 nt, Human
uaacauuucggugacaguggga

SEQ ID NO: 897696 - RNA, 22 nt, Human
aacaaggcaagucugugagcau

SEQ ID NO: 897697 - RNA, 22 nt, Human
ucuagaacuccaguuaggcaau

SEQ ID NO: 897698 - RNA, 20 nt, Human
augaggccagcagggcucag

SEQ ID NO: 897699 - RNA, 18 nt, Human
uguagcuggaggccaggc

SEQ ID NO: 897700 - RNA, 22 nt, Human
ccucugcgcccuugaucagcca

SEQ ID NO: 897701 - RNA, 22 nt, Human
gaccagggucacucacagggcu

SEQ ID NO: 897702 - RNA, 22 nt, Human
agugggcugguggcagggagaa

SEQ ID NO: 897703 - RNA, 22 nt, Human
uguaacuguggucuagggacug

SEQ ID NO: 897704 - RNA, 22 nt, Human
ucccagccaggcucuaccacuu

SEQ ID NO: 897705 - RNA, 22 nt, Human
ccagggugugagaaggaaguag

SEQ ID NO: 897706 - RNA, 22 nt, Human
ugcaggguagacaggugagguc

SEQ ID NO: 897707 - RNA, 22 nt, Human
ugcugccaugcagagcaacaga

SEQ ID NO: 897708 - RNA, 19 nt, Human
agcaacaccguuuauuucc

SEQ ID NO: 897709 - RNA, 22 nt, Human
guaugugucuuagaacuuggga

SEQ ID NO: 897710 - RNA, 21 nt, Human
uucuagaaaaguaugggacug

SEQ ID NO: 897711 - RNA, 22 nt, Human
gagaaacacuguuaguuuauua

SEQ ID NO: 897712 - RNA, 22 nt, Human
uuacauguacugguuugacuua

SEQ ID NO: 897713 - RNA, 22 nt, Human
ccagaggugaacaggaggcugu

SEQ ID NO: 897714 - RNA, 17 nt, Human
ucuuuccugccaugcuc

SEQ ID NO: 897715 - RNA, 19 nt, Human
ugucagugauacaugcuuu

SEQ ID NO: 897716 - RNA, 17 nt, Human
gauuuccugaaguucuu

SEQ ID NO: 897717 - RNA, 22 nt, Human
gcugccuccaaucugugccccg

SEQ ID NO: 897718 - RNA, 22 nt, Human
aguguauuugucuggcuucucc

SEQ ID NO: 897719 - RNA, 22 nt, Human
aagacagugugucaggcaggug

SEQ ID NO: 897720 - RNA, 22 nt, Human
acagcaaucugagagacauagu

SEQ ID NO: 897721 - RNA, 23 nt, Human
cagaggguuccauggagcauggu

SEQ ID NO: 897722 - RNA, 22 nt, Human
ugcuacauaccacgaugcagua

SEQ ID NO: 897723 - RNA, 22 nt, Human
gcuuuuauugucuuuacgacga

SEQ ID NO: 897724 - RNA, 19 nt, Human
augagguagcagcuggugc

SEQ ID NO: 897725 - RNA, 22 nt, Human
ucucuggcagacaccucccuga

SEQ ID NO: 897726 - RNA, 22 nt, Human
cacacaucaaccuagacauugu

SEQ ID NO: 897727 - RNA, 22 nt, Human
ucauuucccuccuacaaagagg

SEQ ID NO: 897728 - RNA, 22 nt, Human
gccaggagaaugcuagcagagg

SEQ ID NO: 897729 - RNA, 22 nt, Human
gcuccucucccagagcugcagg

SEQ ID NO: 897730 - RNA, 22 nt, Human
uaaucauauggguaauccaaug

SEQ ID NO: 897731 - RNA, 22 nt, Human
acagugcagggcgggaagaagg

SEQ ID NO: 897732 - RNA, 22 nt, Human
cacagagaacugugggagugug

SEQ ID NO: 897733 - RNA, 22 nt, Human
aggcuacauguugggguggaag

SEQ ID NO: 897734 - RNA, 22 nt, Human
ugaaaggaaaguacagugaugc

SEQ ID NO: 897735 - RNA, 22 nt, Human
ucaagaaacuguagcaaugggu

SEQ ID NO: 897736 - RNA, 22 nt, Human
uauguccugcuacucucucaug

SEQ ID NO: 897737 - RNA, 22 nt, Human
gugagcaggauaggggcucccu

SEQ ID NO: 897738 - RNA, 22 nt, Human
gcucaugggcccagagcagccc

SEQ ID NO: 897739 - RNA, 22 nt, Human
uugcucuaguggccccugaaug

SEQ ID NO: 897740 - RNA, 22 nt, Human
augcagaauugcuaaguaucug

SEQ ID NO: 897741 - RNA, 22 nt, Human
uucacagugcugcaccuggcuu

SEQ ID NO: 897742 - RNA, 22 nt, Human
ucccaggaugaagacaguguug

SEQ ID NO: 897743 - RNA, 22 nt, Human
agguauauauucugguccuuau

SEQ ID NO: 897744 - RNA, 22 nt, Human
caggaggaaacuggauucacuu

SEQ ID NO: 897745 - RNA, 22 nt, Human
uggaauguugauaaacauaggc

SEQ ID NO: 897746 - RNA, 22 nt, Human
aggguggcugugaagugcuugg

SEQ ID NO: 897747 - RNA, 22 nt, Human
ugcagcagaauauggcugcagg

SEQ ID NO: 897748 - RNA, 22 nt, Human
cagccucuugcacuuugaaggc

SEQ ID NO: 897749 - RNA, 19 nt, Human
cugucugcggggccuguuc

SEQ ID NO: 897750 - RNA, 22 nt, Human
cagaaugggaaggacugcaguu

SEQ ID NO: 897751 - RNA, 23 nt, Human
ucagaugaggaaugcauacuaau

SEQ ID NO: 897752 - RNA, 22 nt, Human
cuuuuuacaaagccugucuucu

SEQ ID NO: 897753 - RNA, 22 nt, Human
gaagcugugcugggggaucugu

SEQ ID NO: 897754 - RNA, 22 nt, Human
ugcuggcugcagugcugucaaa

SEQ ID NO: 897755 - RNA, 22 nt, Human
cacucugaugguuucuguucaa

SEQ ID NO: 897756 - RNA, 22 nt, Human
ggcagcagggcugucucccuac

SEQ ID NO: 897757 - RNA, 22 nt, Human
ggguuggcagcaccagaggagg

SEQ ID NO: 897758 - RNA, 22 nt, Human
auacauguaacugcauuguaau

SEQ ID NO: 897759 - RNA, 22 nt, Human
ccaggcccccgagcagaagaca

SEQ ID NO: 897760 - RNA, 22 nt, Human
agugugugcaugcauucgugca

SEQ ID NO: 897761 - RNA, 22 nt, Human
uggcagaguucgcuccuauuca

SEQ ID NO: 897762 - RNA, 22 nt, Human
cugugucuuuccuacuuugugg

SEQ ID NO: 897763 - RNA, 22 nt, Human
cugcugagagcugaaggcugua

SEQ ID NO: 897764 - RNA, 22 nt, Human
auguucuacagauggaaagggg

SEQ ID NO: 897765 - RNA, 22 nt, Human
aaauacucucaauaaagaaagu

SEQ ID NO: 897766 - RNA, 22 nt, Human
gugcacacucuuggggcacuuu

SEQ ID NO: 897767 - RNA, 22 nt, Human
gcagggcagagggagaaucucu

SEQ ID NO: 897768 - RNA, 22 nt, Human
agguggcuucuggccaggugug

SEQ ID NO: 897769 - RNA, 22 nt, Human
cucugggaagggcugagcacug

SEQ ID NO: 897770 - RNA, 19 nt, Human
gcuuuggagggagguucua

SEQ ID NO: 897771 - RNA, 22 nt, Human
ucagaagcagauauuucaaaau

SEQ ID NO: 897772 - RNA, 22 nt, Human
uuuguacucucagaauucagaa

SEQ ID NO: 897773 - RNA, 22 nt, Human
aaaguucuuuuucuauaaaucc

SEQ ID NO: 897774 - RNA, 22 nt, Human
gaauauauuggugaaaauaguu

SEQ ID NO: 897775 - RNA, 22 nt, Human
ccauucauguuuuugaacuaug

SEQ ID NO: 897776 - RNA, 22 nt, Human
gagugcuguaucugagaaagca

SEQ ID NO: 897777 - RNA, 21 nt, Human
agaugcaguuugcaggugggu

SEQ ID NO: 897778 - RNA, 22 nt, Human
aggcaaauagauaguccauaca

SEQ ID NO: 897779 - RNA, 22 nt, Human
gugacuguuguuugcuacgugc

SEQ ID NO: 897780 - RNA, 22 nt, Human
ugggcaagucacuucugucuuu

SEQ ID NO: 897781 - RNA, 22 nt, Human
aacugcaaguggggcuugucau

SEQ ID NO: 897782 - RNA, 22 nt, Human
ugagaggagugauuguaaaauu

SEQ ID NO: 897783 - RNA, 22 nt, Human
aaggcuucuuaugcaauuguuu

SEQ ID NO: 897784 - RNA, 22 nt, Human
acaggccuauguuccauugcag

SEQ ID NO: 897785 - RNA, 17 nt, Human
uuucuggaaugggcaaa

SEQ ID NO: 897786 - RNA, 22 nt, Human
acugaggcuagauugcuguucu

SEQ ID NO: 897787 - RNA, 22 nt, Human
ggccccagcagacccuccucug

SEQ ID NO: 897788 - RNA, 22 nt, Human
ggugugggcccugaugucagca

SEQ ID NO: 897789 - RNA, 22 nt, Human
ggagauggcuggcagguagaug

SEQ ID NO: 897790 - RNA, 22 nt, Human
gcggcgccuaagccccgaccuc

SEQ ID NO: 897791 - RNA, 22 nt, Human
auggcauuugaaucugucuuuu

SEQ ID NO: 897792 - RNA, 22 nt, Human
aauaaacuuccacuguguuuuu

SEQ ID NO: 897793 - RNA, 22 nt, Human
gauaugaaguggcauugugaag

SEQ ID NO: 897794 - RNA, 23 nt, Human
agcuucaucuugcugugucucag

SEQ ID NO: 897795 - RNA, 22 nt, Human
uggagccagcaggacucagagg

SEQ ID NO: 897796 - RNA, 22 nt, Human
uguggccaccagagcugcuauu

SEQ ID NO: 897797 - RNA, 21 nt, Human
guucaugucagcauuaaggga

SEQ ID NO: 897798 - RNA, 22 nt, Human
cuagaaauucugauucaguagg

SEQ ID NO: 897799 - RNA, 18 nt, Human
auguacauguacucacac

SEQ ID NO: 897800 - RNA, 22 nt, Human
acaucuguugauugauguuaca

SEQ ID NO: 897801 - RNA, 22 nt, Human
aaagguuuucugacccuuagua

SEQ ID NO: 897802 - RNA, 22 nt, Human
uggcugagaccuucccaaauuc

SEQ ID NO: 897803 - RNA, 22 nt, Human
ucacuucuucagcuuuccuuga

SEQ ID NO: 897804 - RNA, 22 nt, Human
uucacagggccacuggcaggag

SEQ ID NO: 897805 - RNA, 22 nt, Human
ucagaaaagguagcugugacaa

SEQ ID NO: 897806 - RNA, 22 nt, Human
gaaaaugagccucagcuacauu

SEQ ID NO: 897807 - RNA, 22 nt, Human
aauaauacuucguaaaguuguu

SEQ ID NO: 897808 - RNA, 22 nt, Human
gcauucuuguuuuuccuacccu

SEQ ID NO: 897809 - RNA, 22 nt, Human
ugcucauuggcgaucugaggga

SEQ ID NO: 897810 - RNA, 22 nt, Human
agcugcagguggacccguaccg

SEQ ID NO: 897811 - RNA, 22 nt, Human
cuacaguagaguaggccucuga

SEQ ID NO: 897812 - RNA, 22 nt, Human
gcguggguccaagaaucuguga

SEQ ID NO: 897813 - RNA, 22 nt, Human
aaugucagccugaaagcuauuc

SEQ ID NO: 897814 - RNA, 22 nt, Human
gcccuguuauccagaugaggau

SEQ ID NO: 897815 - RNA, 22 nt, Human
uuguacaaguauuaugugaaca

SEQ ID NO: 897816 - RNA, 22 nt, Human
aauaaaucaauccuauugguag

SEQ ID NO: 897817 - RNA, 22 nt, Human
uuaguauuaggaucauauuuga

SEQ ID NO: 897818 - RNA, 22 nt, Human
uccucacaagcaagcacaggua

SEQ ID NO: 897819 - RNA, 22 nt, Human
gccagaggggcucgaaggcgcg

SEQ ID NO: 897820 - RNA, 22 nt, Human
augggcaggcaagguggcgagu

SEQ ID NO: 897821 - RNA, 23 nt, Human
uggagguuuuacugaguugagga

SEQ ID NO: 897822 - RNA, 22 nt, Human
agggcucccgugaggugacugc

SEQ ID NO: 897823 - RNA, 22 nt, Human
uaacacauaagcugagaccaug

SEQ ID NO: 897824 - RNA, 21 nt, Human
gcagccacagccaccaagcua

SEQ ID NO: 897825 - RNA, 19 nt, Human
uuuugaaguaugagacagg

SEQ ID NO: 897826 - RNA, 22 nt, Human
uuucucucagccuguagaaacu

SEQ ID NO: 897827 - RNA, 22 nt, Human
ccugcuggcggggacccaguga

SEQ ID NO: 897828 - RNA, 22 nt, Human
agcugaggcucugagagggaag

SEQ ID NO: 897829 - RNA, 20 nt, Human
uggaauaaguuaaguuguuu

SEQ ID NO: 897830 - RNA, 22 nt, Human
uucuucuguuggcagagcauac

SEQ ID NO: 897831 - RNA, 22 nt, Human
aucauuuugugacaaugccugu

SEQ ID NO: 897832 - RNA, 22 nt, Human
acccugcccucuccagcucagg

SEQ ID NO: 897833 - RNA, 21 nt, Human
gcaaaugaguuaacuaacuca

SEQ ID NO: 897834 - RNA, 22 nt, Human
acuccagguaggcacauugaca

SEQ ID NO: 897835 - RNA, 22 nt, Human
gaggcucccuuuagguccagau

SEQ ID NO: 897836 - RNA, 21 nt, Human
aguuuuauauuauaagcuaaa

SEQ ID NO: 897837 - RNA, 22 nt, Human
agcaggcauagaguagcacuca

SEQ ID NO: 897838 - RNA, 22 nt, Human
aucucagagaaauuugaaugca

SEQ ID NO: 897839 - RNA, 22 nt, Human
aaaucagacacagugaaaguua

SEQ ID NO: 897840 - RNA, 22 nt, Human
agcuggcaaggcuuuagauuca

SEQ ID NO: 897841 - RNA, 22 nt, Human
ucucccaggucauacacagaga

SEQ ID NO: 897842 - RNA, 22 nt, Human
uuccucuuucucugugcuaugu

SEQ ID NO: 897843 - RNA, 22 nt, Human
ucuggagcuuguuucagauggu

SEQ ID NO: 897844 - RNA, 22 nt, Human
cagcccuggaacagcugacuca

SEQ ID NO: 897845 - RNA, 22 nt, Human
cacaaauguaguagcuuaaaac

SEQ ID NO: 897846 - RNA, 22 nt, Human
ugcagcaaauggggcccguccu

SEQ ID NO: 897847 - RNA, 22 nt, Human
caaaguaauuacgguuuuggcc

SEQ ID NO: 897848 - RNA, 22 nt, Human
ugggaaagccagcagugucacc

SEQ ID NO: 897849 - RNA, 22 nt, Human
gcccaggaggucaaguagcuau

SEQ ID NO: 897850 - RNA, 22 nt, Human
cuguaccucagcuuugcuccca

SEQ ID NO: 897851 - RNA, 22 nt, Human
aaacaaacauagguuugaaagu

SEQ ID NO: 897852 - RNA, 22 nt, Human
uauaccaaaauaucagaaaggg

SEQ ID NO: 897853 - RNA, 22 nt, Human
uagaaacucucacgagugaaac

SEQ ID NO: 897854 - RNA, 22 nt, Human
agcuuugguugaggggagugug

SEQ ID NO: 897855 - RNA, 22 nt, Human
gugugucagguacugugcuagg

SEQ ID NO: 897856 - RNA, 22 nt, Human
caauuucauggauaaaagaugu

SEQ ID NO: 897857 - RNA, 23 nt, Human
agcuuuggugaugugacagauaa

SEQ ID NO: 897858 - RNA, 22 nt, Human
ucuucacauggaacaugaagcu

SEQ ID NO: 897859 - RNA, 22 nt, Human
ccaaggcuguggggcugugcag

SEQ ID NO: 897860 - RNA, 21 nt, Human
cagaggcagguccugggacgg

SEQ ID NO: 897861 - RNA, 21 nt, Human
guggcccugguguggcugcac

SEQ ID NO: 897862 - RNA, 22 nt, Human
aagcauuuuagauaaagcauca

SEQ ID NO: 897863 - RNA, 22 nt, Human
aagacauugcaugauaaugcug

SEQ ID NO: 897864 - RNA, 22 nt, Human
cuaguucuagaucccugaggaa

SEQ ID NO: 897865 - RNA, 22 nt, Human
aucuggugacacgaggagcugg

SEQ ID NO: 897866 - RNA, 22 nt, Human
agaggccagcccaggccaccga

SEQ ID NO: 897867 - RNA, 22 nt, Human
aagccuugcucuugaaaaaguu

SEQ ID NO: 897868 - RNA, 22 nt, Human
uuuucugaaguuuaagacauuu

SEQ ID NO: 897869 - RNA, 22 nt, Human
uggugcugccaggcuccugcca

SEQ ID NO: 897870 - RNA, 22 nt, Human
gagugugggucucagcuuuaag

SEQ ID NO: 897871 - RNA, 18 nt, Human
gcugaaauucuaaacaaa

SEQ ID NO: 897872 - RNA, 22 nt, Human
cuguauguuuucuccuuugguu

SEQ ID NO: 897873 - RNA, 22 nt, Human
cacagagaauucccauauguga

SEQ ID NO: 897874 - RNA, 21 nt, Human
ucugagagcaacugcccuuua

SEQ ID NO: 897875 - RNA, 22 nt, Human
uuauguaaguggagucauauag

SEQ ID NO: 897876 - RNA, 22 nt, Human
gggcagagagcuggaacuccuu

SEQ ID NO: 897877 - RNA, 23 nt, Human
caaaaugguuuaaaaguggcaua

SEQ ID NO: 897878 - RNA, 22 nt, Human
aaaaguacuauuuuaacaaagu

SEQ ID NO: 897879 - RNA, 22 nt, Human
acagacagacagagaacuauuc

SEQ ID NO: 897880 - RNA, 22 nt, Human
gccagcuggcugcaggucccag

SEQ ID NO: 897881 - RNA, 22 nt, Human
agaaaauuagauuuuacugugu

SEQ ID NO: 897882 - RNA, 22 nt, Human
uagcacaggucuuguugccauu

SEQ ID NO: 897883 - RNA, 22 nt, Human
ccaggacacugcuucacagcag

SEQ ID NO: 897884 - RNA, 22 nt, Human
uauaacacucagaaagaaucau

SEQ ID NO: 897885 - RNA, 22 nt, Human
auguacauucuaaguaugugua

SEQ ID NO: 897886 - RNA, 22 nt, Human
gggcccuggccgaaucccucug

SEQ ID NO: 897887 - RNA, 22 nt, Human
aagaauaaauuaagauacuuag

SEQ ID NO: 897888 - RNA, 22 nt, Human
agugucuuucauauccuccauc

SEQ ID NO: 897889 - RNA, 22 nt, Human
ugugucuggauagguaauggau

SEQ ID NO: 897890 - RNA, 22 nt, Human
uucccagaaugaauggauggag

SEQ ID NO: 897891 - RNA, 22 nt, Human
uuuccauauuuaaucaaaauaa

SEQ ID NO: 897892 - RNA, 22 nt, Human
augcauuuuugaguaugaauga

SEQ ID NO: 897893 - RNA, 20 nt, Human
aaacauucauguacaaguga

SEQ ID NO: 897894 - RNA, 22 nt, Human
agcugcaggaaguagaagcgga

SEQ ID NO: 897895 - RNA, 22 nt, Human
ugcuuccagcucucuguaaggu

SEQ ID NO: 897896 - RNA, 23 nt, Human
agcccugcugagacccagcuccc

SEQ ID NO: 897897 - RNA, 22 nt, Human
gaguuuauucaggaaauagcca

SEQ ID NO: 897898 - RNA, 22 nt, Human
gaaguuguaagccugggaaggu

SEQ ID NO: 897899 - RNA, 22 nt, Human
cgugggaguggugggugcucag

SEQ ID NO: 897900 - RNA, 22 nt, Human
uccuucuuucccccuagucauu

SEQ ID NO: 897901 - RNA, 22 nt, Human
cucuggucagugaauuccuagu

SEQ ID NO: 897902 - RNA, 22 nt, Human
caggcccugcacuaggcccugg

SEQ ID NO: 897903 - RNA, 22 nt, Human
ugucaccuugaugauggccuag

SEQ ID NO: 897904 - RNA, 22 nt, Human
gacaaaugaagucacugaccuu

SEQ ID NO: 897905 - RNA, 22 nt, Human
gggcaggucugggucagccuga

SEQ ID NO: 897906 - RNA, 22 nt, Human
ugggcagaucuuugguggcuag

SEQ ID NO: 897907 - RNA, 22 nt, Human
uauuugucacugcacuugaaau

SEQ ID NO: 897908 - RNA, 22 nt, Human
cagauaacugaaauaucauacc

SEQ ID NO: 897909 - RNA, 22 nt, Human
uuguauauaaagcccccacugu

SEQ ID NO: 897910 - RNA, 21 nt, Human
cuggaggcagguggugccagg

SEQ ID NO: 897911 - RNA, 22 nt, Human
caggucuguuuccaucagugcu

SEQ ID NO: 897912 - RNA, 23 nt, Human
guccuauuuuuugaaauacugag

SEQ ID NO: 897913 - RNA, 22 nt, Human
gggcuucuggcuacuguaugag

SEQ ID NO: 897914 - RNA, 21 nt, Human
guaucacauuugcaugcuuau

SEQ ID NO: 897915 - RNA, 22 nt, Human
gcccaggaguucaaggcugcag

SEQ ID NO: 897916 - RNA, 22 nt, Human
ucuggagagaucuuccacaaca

SEQ ID NO: 897917 - RNA, 22 nt, Human
uaguaaauuaaaauauugacuu

SEQ ID NO: 897918 - RNA, 22 nt, Human
ucccagcuuagauuugcucauu

SEQ ID NO: 897919 - RNA, 22 nt, Human
uccaggagacacaagguacaua

SEQ ID NO: 897920 - RNA, 22 nt, Human
uaauaccuugaucucucuuguc

SEQ ID NO: 897921 - RNA, 22 nt, Human
uggcccgaccucugcucaugca

SEQ ID NO: 897922 - RNA, 22 nt, Human
acauguuugccugcaggcuuag

SEQ ID NO: 897923 - RNA, 22 nt, Human
guguguggcaaacugggccugc

SEQ ID NO: 897924 - RNA, 22 nt, Human
uccuggccucacaguccugggu

SEQ ID NO: 897925 - RNA, 22 nt, Human
auuagcaaguuguuauccuuug

SEQ ID NO: 897926 - RNA, 22 nt, Human
ccagugugaccaucuguuagcu

SEQ ID NO: 897927 - RNA, 22 nt, Human
guaacaaacgguuccaagaugc

SEQ ID NO: 897928 - RNA, 22 nt, Human
uaguugaagagaugaaugacca

SEQ ID NO: 897929 - RNA, 22 nt, Human
ucugcacagauucucugagaau

SEQ ID NO: 897930 - RNA, 22 nt, Human
uuucuauuuuaaaggcauaugg

SEQ ID NO: 897931 - RNA, 21 nt, Human
uguccaagguaugcacugggg

SEQ ID NO: 897932 - RNA, 22 nt, Human
ugagcagauggaggcuucugca

SEQ ID NO: 897933 - RNA, 22 nt, Human
ccuagggucaguguggcaggag

SEQ ID NO: 897934 - RNA, 22 nt, Human
uugguuuauuucuuccuaugag

SEQ ID NO: 897935 - RNA, 22 nt, Human
acauguaaaaggaacaugcaug

SEQ ID NO: 897936 - RNA, 22 nt, Human
aguuacauauaagaagacagac

SEQ ID NO: 897937 - RNA, 22 nt, Human
acagauaauacauugugcuaca

SEQ ID NO: 897938 - RNA, 21 nt, Human
uccaguugagacugaagaucu

SEQ ID NO: 897939 - RNA, 22 nt, Human
ccagagguccugugaugcugca

SEQ ID NO: 897940 - RNA, 21 nt, Human
aggucccagguuugggcagca

SEQ ID NO: 897941 - RNA, 18 nt, Human
uuucuuucugccuggggc

SEQ ID NO: 897942 - RNA, 17 nt, Human
cugcuggcuggggcuug

SEQ ID NO: 897943 - RNA, 22 nt, Human
cacauucaucaguguuguacug

SEQ ID NO: 897944 - RNA, 22 nt, Human
uaauauacuucccauaguuuga

SEQ ID NO: 897945 - RNA, 22 nt, Human
uugagaacuagcauggucuauc

SEQ ID NO: 897946 - RNA, 23 nt, Human
ucggugggcguggaggccgaggc

SEQ ID NO: 897947 - RNA, 22 nt, Human
uggaaucuguauguauguauaa

SEQ ID NO: 897948 - RNA, 22 nt, Human
uuauuagagugcuuugagaaag

SEQ ID NO: 897949 - RNA, 22 nt, Human
cagcagcagauucagcgucugg

SEQ ID NO: 897950 - RNA, 22 nt, Human
uucaacaaggcugucaaaaguu

SEQ ID NO: 897951 - RNA, 22 nt, Human
uuuuaaaggcuguaugaccaag

SEQ ID NO: 897952 - RNA, 22 nt, Human
acagcagagacacucaggaggc

SEQ ID NO: 897953 - RNA, 19 nt, Human
uggggaugcugaugaccaa

SEQ ID NO: 897954 - RNA, 22 nt, Human
ggagguggcagggaacauaauu

SEQ ID NO: 897955 - RNA, 22 nt, Human
uguauuaugauuguuguucaug

SEQ ID NO: 897956 - RNA, 22 nt, Human
ugacccuucugguuccuaccaa

SEQ ID NO: 897957 - RNA, 23 nt, Human
acaucagaguuaguucaaucagg

SEQ ID NO: 897958 - RNA, 22 nt, Human
ggcucagggaaugaggaagaau

SEQ ID NO: 897959 - RNA, 22 nt, Human
caggccaagccuccccagcucc

SEQ ID NO: 897960 - RNA, 22 nt, Human
cauuucuaagaaggcugcacau

SEQ ID NO: 897961 - RNA, 22 nt, Human
agcuucugcccguguuugcucu

SEQ ID NO: 897962 - RNA, 22 nt, Human
uuucuguauuuugucauaaccu

SEQ ID NO: 897963 - RNA, 22 nt, Human
uagaaucaagcaguagagcaga

SEQ ID NO: 897964 - RNA, 22 nt, Human
aaaguucuagaguugcaagaga

SEQ ID NO: 897965 - RNA, 22 nt, Human
cauggcuggccagugggagugg

SEQ ID NO: 897966 - RNA, 22 nt, Human
cccaggcacucuuggucauuuu

SEQ ID NO: 897967 - RNA, 18 nt, Human
aaggcacaggagaacauu

SEQ ID NO: 897968 - RNA, 22 nt, Human
ucuccaggcccacugauuuaua

SEQ ID NO: 897969 - RNA, 22 nt, Human
gccaguggucacugaggaagaa

SEQ ID NO: 897970 - RNA, 21 nt, Human
aguuuccucaucugcauagga

SEQ ID NO: 897971 - RNA, 22 nt, Human
ugcugaggcagaugucugugac

SEQ ID NO: 897972 - RNA, 22 nt, Human
ggcuucccuuuccgagaggaga

SEQ ID NO: 897973 - RNA, 22 nt, Human
ggagccagagcacuggggagcc

SEQ ID NO: 897974 - RNA, 22 nt, Human
ugcagcagcagggaggaggcuc

SEQ ID NO: 897975 - RNA, 18 nt, Human
uggagcugagggcaaugc

SEQ ID NO: 897976 - RNA, 23 nt, Human
gcccugcuccuggcugggaggga

SEQ ID NO: 897977 - RNA, 21 nt, Human
ucuagaagagguugagaauau

SEQ ID NO: 897978 - RNA, 22 nt, Human
uggagcugagagccaggcuggc

SEQ ID NO: 897979 - RNA, 22 nt, Human
ggcagcauuuagagcacagugu

SEQ ID NO: 897980 - RNA, 22 nt, Human
ccaagggaaaccgagaggcugg

SEQ ID NO: 897981 - RNA, 22 nt, Human
agggcagccaugagccuucagg

SEQ ID NO: 897982 - RNA, 22 nt, Human
acuaaaugcugcauaaaugcuu

SEQ ID NO: 897983 - RNA, 22 nt, Human
auguuguguuugacuguuaccc

SEQ ID NO: 897984 - RNA, 22 nt, Human
ugcugcaggcaauagaaaaccu

SEQ ID NO: 897985 - RNA, 22 nt, Human
ugggucagauugagccccuggu

SEQ ID NO: 897986 - RNA, 22 nt, Human
ugcaggaggauuuuguggagcu

SEQ ID NO: 897987 - RNA, 22 nt, Human
agccuggagcuugaguuaugag

SEQ ID NO: 897988 - RNA, 22 nt, Human
aaauguacgggaguagaauuag

SEQ ID NO: 897989 - RNA, 22 nt, Human
ucccagauucuucugugugggc

SEQ ID NO: 897990 - RNA, 18 nt, Human
ccaggccaugaaccucug

SEQ ID NO: 897991 - RNA, 22 nt, Human
aaaguuuuauucaagcauuagu

SEQ ID NO: 897992 - RNA, 22 nt, Human
ucaggaagucucaauuagcuac

SEQ ID NO: 897993 - RNA, 22 nt, Human
ucauugaacgaagagcuccauu

SEQ ID NO: 897994 - RNA, 22 nt, Human
agggcagcagcuccuccuagcu

SEQ ID NO: 897995 - RNA, 22 nt, Human
uauacaguaucuuuugaaggca

SEQ ID NO: 897996 - RNA, 22 nt, Human
cuguggcugaguuccuuauguu

SEQ ID NO: 897997 - RNA, 22 nt, Human
gccuggcuccuaaggacuggcu

SEQ ID NO: 897998 - RNA, 22 nt, Human
agcagggguaacagaaggaaag

SEQ ID NO: 897999 - RNA, 22 nt, Human
agucugucugucacuucugcag

SEQ ID NO: 898000 - RNA, 22 nt, Human
cauggaggccaggaaacagccu

SEQ ID NO: 898001 - RNA, 22 nt, Human
uggcagcaauagaaauauaauc

SEQ ID NO: 898002 - RNA, 22 nt, Human
caggcccauucuaggcuugcua

SEQ ID NO: 898003 - RNA, 22 nt, Human
gacccaggguuucugcacaggg

SEQ ID NO: 898004 - RNA, 22 nt, Human
uaaagugaaguucagaauggcu

SEQ ID NO: 898005 - RNA, 22 nt, Human
uaggaaguaaacuuucuucagc

SEQ ID NO: 898006 - RNA, 22 nt, Human
ucugucugguccaggaagaugu

SEQ ID NO: 898007 - RNA, 22 nt, Human
aucuaacugggcuauuuuauug

SEQ ID NO: 898008 - RNA, 22 nt, Human
uccaggcuugagaccaggcucu

SEQ ID NO: 898009 - RNA, 22 nt, Human
auaaagcuauuccucucuuuuu

SEQ ID NO: 898010 - RNA, 21 nt, Human
acagccaggaacaugaggggc

SEQ ID NO: 898011 - RNA, 22 nt, Human
gggccuggggugacguaccccu

SEQ ID NO: 898012 - RNA, 22 nt, Human
uuagcaaaccuggacuacagau

SEQ ID NO: 898013 - RNA, 22 nt, Human
agacaaauggaguaugagcaac

SEQ ID NO: 898014 - RNA, 22 nt, Human
acagaaauucaaacuggaauuu

SEQ ID NO: 898015 - RNA, 22 nt, Human
ucucucugcagcccgggacacu

SEQ ID NO: 898016 - RNA, 22 nt, Human
ucacaggcuggucuccgaggac

SEQ ID NO: 898017 - RNA, 22 nt, Human
acauuuaccuaguuaagucaau

SEQ ID NO: 898018 - RNA, 22 nt, Human
cacuacagaaucaaauacgggc

SEQ ID NO: 898019 - RNA, 22 nt, Human
acaaccaugucaguucaaacca

SEQ ID NO: 898020 - RNA, 22 nt, Human
uaagacacaaauaucuuuuaca

SEQ ID NO: 898021 - RNA, 22 nt, Human
augccuuauuguaaucuuucca

SEQ ID NO: 898022 - RNA, 22 nt, Human
caggucuccagcucagggucca

SEQ ID NO: 898023 - RNA, 22 nt, Human
ugugcacauucuaggacuagua

SEQ ID NO: 898024 - RNA, 22 nt, Human
uaauguuuagaagcagacagcu

SEQ ID NO: 898025 - RNA, 22 nt, Human
cuucagaaauaacaacaauuac

SEQ ID NO: 898026 - RNA, 22 nt, Human
uuaggaauuuauuccauuguug

SEQ ID NO: 898027 - RNA, 22 nt, Human
uuucauguuuauggaaaaugag

SEQ ID NO: 898028 - RNA, 18 nt, Human
ccacccagggggagagga

SEQ ID NO: 898029 - RNA, 21 nt, Human
ugcuggccaugugcugggcau

SEQ ID NO: 898030 - RNA, 22 nt, Human
gcaccuuauuuaaaugauguuu

SEQ ID NO: 898031 - RNA, 22 nt, Human
gaacaacuuugaaacaugaaga

SEQ ID NO: 898032 - RNA, 22 nt, Human
auaguaacuggcauguuuauga

SEQ ID NO: 898033 - RNA, 22 nt, Human
uguccugggaaugggaugcagu

SEQ ID NO: 898034 - RNA, 23 nt, Human
gucagugcuuuaguucaggaugg

SEQ ID NO: 898035 - RNA, 22 nt, Human
aucuagaaagccaggggccugc

SEQ ID NO: 898036 - RNA, 22 nt, Human
ucagcaggguuugacuucuaau

SEQ ID NO: 898037 - RNA, 22 nt, Human
acagggaaggcauccgcgaaug

SEQ ID NO: 898038 - RNA, 22 nt, Human
ggguggaggagaacaggcccca

SEQ ID NO: 898039 - RNA, 22 nt, Human
ugacuaauuauguuacuaauca

SEQ ID NO: 898040 - RNA, 20 nt, Human
ugugaggagcauggccgcug

SEQ ID NO: 898041 - RNA, 22 nt, Human
ggaaggggccuugagcaaacug

SEQ ID NO: 898042 - RNA, 22 nt, Human
auuggaaaugcuacaaguuaga

SEQ ID NO: 898043 - RNA, 22 nt, Human
gcagaggugugggaggggccac

SEQ ID NO: 898044 - RNA, 22 nt, Human
guguacaggaugacuguacuua

SEQ ID NO: 898045 - RNA, 22 nt, Human
ugggaguugggugggagacuuc

SEQ ID NO: 898046 - RNA, 22 nt, Human
aaaaguaauugugguuuuugcu

SEQ ID NO: 898047 - RNA, 22 nt, Human
gcccuguggacccaggaacucu

SEQ ID NO: 898048 - RNA, 22 nt, Human
aguuuucucacaucaaaaauga

SEQ ID NO: 898049 - RNA, 18 nt, Human
ggcuccgacgggccgugc

SEQ ID NO: 898050 - RNA, 22 nt, Human
uucaacaaacuguucacgaaug

SEQ ID NO: 898051 - RNA, 22 nt, Human
cuuuguucugcacacacagaca

SEQ ID NO: 898052 - RNA, 22 nt, Human
aaguuuuccuguguccaagaug

SEQ ID NO: 898053 - RNA, 23 nt, Human
ggccuggcccagggcccugauga

SEQ ID NO: 898054 - RNA, 22 nt, Human
ggcagccuccagggcacuggug

SEQ ID NO: 898055 - RNA, 18 nt, Human
ugaacuuuggugucucuc

SEQ ID NO: 898056 - RNA, 22 nt, Human
auucucaaagccagagucaacg

SEQ ID NO: 898057 - RNA, 21 nt, Human
cggagcugggcagggcauccc

SEQ ID NO: 898058 - RNA, 22 nt, Human
uuuaaaaggcagcuucuuuugu

SEQ ID NO: 898059 - RNA, 22 nt, Human
ucccugggguaucgcugaggca

SEQ ID NO: 898060 - RNA, 23 nt, Human
gggggcgugucauggagggccac

SEQ ID NO: 898061 - RNA, 22 nt, Human
uauugucugcaaagguuuauaa

SEQ ID NO: 898062 - RNA, 22 nt, Human
uaaaaucaccaaaagcaggugg

SEQ ID NO: 898063 - RNA, 20 nt, Human
ugugccuggcuuuguccuga

SEQ ID NO: 898064 - RNA, 22 nt, Human
ugauuucuuccuugucauuaga

SEQ ID NO: 898065 - RNA, 22 nt, Human
ccagagggcccuggucucagcu

SEQ ID NO: 898066 - RNA, 22 nt, Human
ccuuuauacuaaggcauacaau

SEQ ID NO: 898067 - RNA, 22 nt, Human
uggcugagugauauuugcaaag

SEQ ID NO: 898068 - RNA, 20 nt, Human
cugugcuccggguuccugga

SEQ ID NO: 898069 - RNA, 22 nt, Human
gagaauuacuguuuuuauaaca

SEQ ID NO: 898070 - RNA, 22 nt, Human
gcuucugcaggguccucgcugu

SEQ ID NO: 898071 - RNA, 22 nt, Human
caggcagaggaggccuucuccu

SEQ ID NO: 898072 - RNA, 18 nt, Human
auauguuaauuagguagg

SEQ ID NO: 898073 - RNA, 22 nt, Human
gagucuaaguagaaugugaaaa

SEQ ID NO: 898074 - RNA, 19 nt, Human
agcuaagacaagggacauc

SEQ ID NO: 898075 - RNA, 20 nt, Human
gggagaagggcugaugagag

SEQ ID NO: 898076 - RNA, 23 nt, Human
ugcaggguguuccugccuuugcu

SEQ ID NO: 898077 - RNA, 22 nt, Human
gucuugucaguguuggcagcuu

SEQ ID NO: 898078 - RNA, 22 nt, Human
uuuuaugagugucccucugugg

SEQ ID NO: 898079 - RNA, 22 nt, Human
uuggaaggcccugccuagcagg

SEQ ID NO: 898080 - RNA, 22 nt, Human
ucugaagagucuugcaagaaag

SEQ ID NO: 898081 - RNA, 22 nt, Human
gaaguucugggauuuccacagu

SEQ ID NO: 898082 - RNA, 20 nt, Human
guauaagauuucacacauua

SEQ ID NO: 898083 - RNA, 22 nt, Human
uuuguaacuuuagaauugaucc

SEQ ID NO: 898084 - RNA, 22 nt, Human
ggcuggcuuggugagcugucac

SEQ ID NO: 898085 - RNA, 22 nt, Human
agcuggugauggccuaagaagg

SEQ ID NO: 898086 - RNA, 22 nt, Human
cuggggcaucugacagauaaau

SEQ ID NO: 898087 - RNA, 21 nt, Human
cugcucuggggaccggcugug

SEQ ID NO: 898088 - RNA, 22 nt, Human
aaggcaaauguguucuuuuagu

SEQ ID NO: 898089 - RNA, 22 nt, Human
uguuuaaguucugcuccuuauu

SEQ ID NO: 898090 - RNA, 22 nt, Human
uggccagugucggaggccagga

SEQ ID NO: 898091 - RNA, 22 nt, Human
agguauucagaugaagugcuga

SEQ ID NO: 898092 - RNA, 22 nt, Human
ucucuguguccugaaaugaagg

SEQ ID NO: 898093 - RNA, 22 nt, Human
ccugaguggcaggguuugggcu

SEQ ID NO: 898094 - RNA, 22 nt, Human
gaaguucuuagucucauuugca

SEQ ID NO: 898095 - RNA, 22 nt, Human
uauuagcacaaagcaagguauu

SEQ ID NO: 898096 - RNA, 22 nt, Human
auucugucuaagcuggcuacgu

SEQ ID NO: 898097 - RNA, 23 nt, Human
cuucacaaucaaaaucaguucug

SEQ ID NO: 898098 - RNA, 22 nt, Human
uccugggcugcagggaagagca

SEQ ID NO: 898099 - RNA, 22 nt, Human
ugaaauguauauugccagugua

SEQ ID NO: 898100 - RNA, 22 nt, Human
agcccucugcuguucuagucuc

SEQ ID NO: 898101 - RNA, 22 nt, Human
ggacuggccggcgcugaggccc

SEQ ID NO: 898102 - RNA, 22 nt, Human
aguuuacacuuuugauucuuau

SEQ ID NO: 898103 - RNA, 19 nt, Human
cuuccuggaggagagccuc

SEQ ID NO: 898104 - RNA, 22 nt, Human
uaaggcuuuggucaccauggag

SEQ ID NO: 898105 - RNA, 22 nt, Human
ggcagaggaagcuggaaguggg

SEQ ID NO: 898106 - RNA, 22 nt, Human
augacagacagaagggauuuuu

SEQ ID NO: 898107 - RNA, 22 nt, Human
cuccagauuccguuuauucagg

SEQ ID NO: 898108 - RNA, 19 nt, Human
aaaaggagagaucagaguu

SEQ ID NO: 898109 - RNA, 22 nt, Human
ggcucuagagcugugcacacau

SEQ ID NO: 898110 - RNA, 22 nt, Human
uaaacuacccaugacaguuuca

SEQ ID NO: 898111 - RNA, 22 nt, Human
uagaagcagcaggaguaaaggc

SEQ ID NO: 898112 - RNA, 22 nt, Human
ccagggcugcugugggacucca

SEQ ID NO: 898113 - RNA, 22 nt, Human
agugucuggugagggcucucuc

SEQ ID NO: 898114 - RNA, 22 nt, Human
auggcagcuuugaauuucuuga

SEQ ID NO: 898115 - RNA, 22 nt, Human
cccuucuaguccauucuucaca

SEQ ID NO: 898116 - RNA, 22 nt, Human
cuuggggcagcccaggcugagc

SEQ ID NO: 898117 - RNA, 19 nt, Human
ugaagagcugucaaaagug

SEQ ID NO: 898118 - RNA, 20 nt, Human
aaauccaguguguauuuuac

SEQ ID NO: 898119 - RNA, 22 nt, Human
ugacaauugugggcaguuugug

SEQ ID NO: 898120 - RNA, 22 nt, Human
cuucacuugcucaucaugcuau

SEQ ID NO: 898121 - RNA, 22 nt, Human
uccuuuuugguccaaggugacc

SEQ ID NO: 898122 - RNA, 22 nt, Human
cccagaggcugaguugggagca

SEQ ID NO: 898123 - RNA, 22 nt, Human
uagaaaugucgucuccacauuu

SEQ ID NO: 898124 - RNA, 22 nt, Human
gcaccaggaggcccuucucauc

SEQ ID NO: 898125 - RNA, 22 nt, Human
ggcaagaaccucaauuaccuuu

SEQ ID NO: 898126 - RNA, 22 nt, Human
ucucacaguaugaauuguucac

SEQ ID NO: 898127 - RNA, 22 nt, Human
gagggcaggggucuugcacggu

SEQ ID NO: 898128 - RNA, 22 nt, Human
uccaggaguuugaccugugggc

SEQ ID NO: 898129 - RNA, 22 nt, Human
uuaaagagaacucaaugaauga

SEQ ID NO: 898130 - RNA, 22 nt, Human
ugugucuguguauacacggcau

SEQ ID NO: 898131 - RNA, 22 nt, Human
ugucucugcugcaccuucuggg

SEQ ID NO: 898132 - RNA, 22 nt, Human
gaaggcaacaccaggaugcacu

SEQ ID NO: 898133 - RNA, 22 nt, Human
auuaauugggaacuuguugaaa

SEQ ID NO: 898134 - RNA, 22 nt, Human
gugucagauguccagggcagca

SEQ ID NO: 898135 - RNA, 22 nt, Human
cuucuuaaauauuuggcugacu

SEQ ID NO: 898136 - RNA, 22 nt, Human
gaggccacaguccugaggcauc

SEQ ID NO: 898137 - RNA, 22 nt, Human
ucauuuacuucuaugacaacau

SEQ ID NO: 898138 - RNA, 22 nt, Human
ggaagcagccugaagccaaggg

SEQ ID NO: 898139 - RNA, 22 nt, Human
caggcuggaguacaauugugug

SEQ ID NO: 898140 - RNA, 22 nt, Human
uuggcagauuugucaguaagcu

SEQ ID NO: 898141 - RNA, 22 nt, Human
aaugaacuguguuaacugaaua

SEQ ID NO: 898142 - RNA, 22 nt, Human
aaagaugugccuguuucauagu

SEQ ID NO: 898143 - RNA, 22 nt, Human
ggaaucagaugaggggcagagc

SEQ ID NO: 898144 - RNA, 22 nt, Human
aagugcuuuacaaaugucuguu

SEQ ID NO: 898145 - RNA, 22 nt, Human
auauucuuauccuuuucucugu

SEQ ID NO: 898146 - RNA, 22 nt, Human
ccaguaauggaaauagcaguuc

SEQ ID NO: 898147 - RNA, 22 nt, Human
gccucagguaaaacuugaguuu

SEQ ID NO: 898148 - RNA, 22 nt, Human
gggcgcaucaccugaggucagg

SEQ ID NO: 898149 - RNA, 22 nt, Human
acuggcuuggcaggaggaagau

SEQ ID NO: 898150 - RNA, 22 nt, Human
uuucagaaacgauuaugaacac

SEQ ID NO: 898151 - RNA, 22 nt, Human
caaauguuaagacaggaucaag

SEQ ID NO: 898152 - RNA, 22 nt, Human
agaaaauuuaaagagacacaca

SEQ ID NO: 898153 - RNA, 22 nt, Human
cugagcuguggaauaaacacug

SEQ ID NO: 898154 - RNA, 22 nt, Human
agggcuggcaucucuaaugcug

SEQ ID NO: 898155 - RNA, 22 nt, Human
uuagcauuucauuucaagagga

SEQ ID NO: 898156 - RNA, 22 nt, Human
ucuauagaucaguaaauaucuc

SEQ ID NO: 898157 - RNA, 22 nt, Human
cacauuuccuuggccuuuaauu

SEQ ID NO: 898158 - RNA, 22 nt, Human
uuacacauugcagaucaaaaug

SEQ ID NO: 898159 - RNA, 22 nt, Human
uuuucuucggugcuggguugau

SEQ ID NO: 898160 - RNA, 22 nt, Human
ccuuuagaugaucucuuggaca

SEQ ID NO: 898161 - RNA, 22 nt, Human
uuggaaggagucaaccagcuga

SEQ ID NO: 898162 - RNA, 22 nt, Human
aggcauggguagaagagaagcc

SEQ ID NO: 898163 - RNA, 22 nt, Human
aguaaacaggcaugauaguguu

SEQ ID NO: 898164 - RNA, 22 nt, Human
gagcagcaucuccggcuuaaag

SEQ ID NO: 898165 - RNA, 22 nt, Human
uccuggguggcucugcccggcu

SEQ ID NO: 898166 - RNA, 22 nt, Human
cugugugccuccugugaucagg

SEQ ID NO: 898167 - RNA, 22 nt, Human
uuguuucaaauauuucagaaua

SEQ ID NO: 898168 - RNA, 22 nt, Human
aaaaccagacacuguuucuggg

SEQ ID NO: 898169 - RNA, 22 nt, Human
uaaugagucauuccugaaugcu

SEQ ID NO: 898170 - RNA, 22 nt, Human
agucuccacaacagcccugaua

SEQ ID NO: 898171 - RNA, 22 nt, Human
acuccugccacacagaugcugu

SEQ ID NO: 898172 - RNA, 23 nt, Human
acuuuucaauuagcuaugcuuaa

SEQ ID NO: 898173 - RNA, 22 nt, Human
uuacagauacauuucuuuuguu

SEQ ID NO: 898174 - RNA, 19 nt, Human
uaggcccuagcucugcagu

SEQ ID NO: 898175 - RNA, 22 nt, Human
ugggaaugcaaggaaagcuguu

SEQ ID NO: 898176 - RNA, 22 nt, Human
aaagaguuccaagucauuuuau

SEQ ID NO: 898177 - RNA, 22 nt, Human
uuuccuuuccaaaauucugccu

SEQ ID NO: 898178 - RNA, 22 nt, Human
cagacagacagccguggccacc

SEQ ID NO: 898179 - RNA, 22 nt, Human
aacacuguggucuuuucaguaa

SEQ ID NO: 898180 - RNA, 22 nt, Human
auucagugugagguuuucaagu

SEQ ID NO: 898181 - RNA, 22 nt, Human
uauguacaauuuguuguauguc

SEQ ID NO: 898182 - RNA, 22 nt, Human
cugggcagccucacacaauguu

SEQ ID NO: 898183 - RNA, 22 nt, Human
aaacucuaggacgaugggauag

SEQ ID NO: 898184 - RNA, 22 nt, Human
ucaguguguucaauuggauagg

SEQ ID NO: 898185 - RNA, 23 nt, Human
cccagcagagaugaggagggguc

SEQ ID NO: 898186 - RNA, 22 nt, Human
uggaaugucuugauauagaggu

SEQ ID NO: 898187 - RNA, 22 nt, Human
caagggaagaggacagggaccu

SEQ ID NO: 898188 - RNA, 22 nt, Human
aauguauuauacauaauuugug

SEQ ID NO: 898189 - RNA, 23 nt, Human
ccugcucaggcgugugcccugcu

SEQ ID NO: 898190 - RNA, 22 nt, Human
ccauaaucguguguuaaauaau

SEQ ID NO: 898191 - RNA, 22 nt, Human
auucagggaggaaaggggccuc

SEQ ID NO: 898192 - RNA, 22 nt, Human
ggcccugggaugcucagcagug

SEQ ID NO: 898193 - RNA, 22 nt, Human
uuauuuaaaagugguaagauuc

SEQ ID NO: 898194 - RNA, 22 nt, Human
auaauguaaggcucccuacagu

SEQ ID NO: 898195 - RNA, 22 nt, Human
aagauguaaaggcaauauaaag

SEQ ID NO: 898196 - RNA, 22 nt, Human
caugcucugcagcagaccugug

SEQ ID NO: 898197 - RNA, 22 nt, Human
uggaggaugagugugggcucug

SEQ ID NO: 898198 - RNA, 22 nt, Human
ccucuggcauagcaaguggccu

SEQ ID NO: 898199 - RNA, 22 nt, Human
ucucccacagccgugcuucaag

SEQ ID NO: 898200 - RNA, 22 nt, Human
agauguuuuguguauuucauca

SEQ ID NO: 898201 - RNA, 22 nt, Human
cuucucucugcauaggcauggg

SEQ ID NO: 898202 - RNA, 22 nt, Human
ggucagucucucccgaguguug

SEQ ID NO: 898203 - RNA, 22 nt, Human
guagaauauaugguuaguauug

SEQ ID NO: 898204 - RNA, 19 nt, Human
ugcacuugagauguuugua

SEQ ID NO: 898205 - RNA, 22 nt, Human
aaagcuggccucucaggcuuua

SEQ ID NO: 898206 - RNA, 19 nt, Human
uagcccagagccuggcuac

SEQ ID NO: 898207 - RNA, 22 nt, Human
cauguguugucucauuuaaucc

SEQ ID NO: 898208 - RNA, 22 nt, Human
cagggaugggauggagucaguu

SEQ ID NO: 898209 - RNA, 21 nt, Human
ugcauucuagcagcucugagg

SEQ ID NO: 898210 - RNA, 23 nt, Human
aaauggccaagguuaaaaauaca

SEQ ID NO: 898211 - RNA, 22 nt, Human
cccagccuuccacccuggacua

SEQ ID NO: 898212 - RNA, 22 nt, Human
ucuggcagagucagugcacaca

SEQ ID NO: 898213 - RNA, 22 nt, Human
caaauagacuucaaucucuuga

SEQ ID NO: 898214 - RNA, 22 nt, Human
gucucauaugauauaaaugcag

SEQ ID NO: 898215 - RNA, 22 nt, Human
gucaacuuuaagaugaucuuuu

SEQ ID NO: 898216 - RNA, 22 nt, Human
aaacaguuacgagcgcagaccu

SEQ ID NO: 898217 - RNA, 23 nt, Human
uguaaaagcauuugucagccugg

SEQ ID NO: 898218 - RNA, 22 nt, Human
ggcagcaacacgagugagcuaa

SEQ ID NO: 898219 - RNA, 22 nt, Human
ccagagccuaagaucugauccu

SEQ ID NO: 898220 - RNA, 22 nt, Human
gugugcagugagcaaaagaucu

SEQ ID NO: 898221 - RNA, 22 nt, Human
gcuuccaguccucagaggcugg

SEQ ID NO: 898222 - RNA, 22 nt, Human
gggaagugugguuucuuuacag

SEQ ID NO: 898223 - RNA, 22 nt, Human
agucacagaaacccaggugugg

SEQ ID NO: 898224 - RNA, 22 nt, Human
gacagugauuaguuacuauaaa

SEQ ID NO: 898225 - RNA, 22 nt, Human
gugucaaugagguuuauuuuug

SEQ ID NO: 898226 - RNA, 22 nt, Human
aagggaggggauguaagccugg

SEQ ID NO: 898227 - RNA, 22 nt, Human
agaagccuguugagagggccgu

SEQ ID NO: 898228 - RNA, 22 nt, Human
uggacaggcuccuagggguucc

SEQ ID NO: 898229 - RNA, 22 nt, Human
uaucuugccuuuaacugcucau

SEQ ID NO: 898230 - RNA, 18 nt, Human
aggcaggugcuaauauuu

SEQ ID NO: 898231 - RNA, 22 nt, Human
gucuucugcaacugcaccugcc

SEQ ID NO: 898232 - RNA, 22 nt, Human
caaacugaacacgaaagucuuu

SEQ ID NO: 898233 - RNA, 22 nt, Human
uauccaaaggaacaaucacagc

SEQ ID NO: 898234 - RNA, 22 nt, Human
ugggaagaggcgggaggcuguu

SEQ ID NO: 898235 - RNA, 21 nt, Human
auguaggguuugccuucucua

SEQ ID NO: 898236 - RNA, 22 nt, Human
ucaaagaucagaugguuguagg

SEQ ID NO: 898237 - RNA, 22 nt, Human
uugguguacaucuccccuucau

SEQ ID NO: 898238 - RNA, 22 nt, Human
uugguccugcagaggggucugg

SEQ ID NO: 898239 - RNA, 22 nt, Human
augcuacacuauuugcugagca

SEQ ID NO: 898240 - RNA, 22 nt, Human
augaaacugggauaacuauagc

SEQ ID NO: 898241 - RNA, 22 nt, Human
cagugaaguguggacgucacca

SEQ ID NO: 898242 - RNA, 22 nt, Human
ucagccucucugaguccagacc

SEQ ID NO: 898243 - RNA, 22 nt, Human
guguccaggggguaucccagcu

SEQ ID NO: 898244 - RNA, 22 nt, Human
ggguccagcgacagcaggcuca

SEQ ID NO: 898245 - RNA, 22 nt, Human
ucuauauuccagauacagauua

SEQ ID NO: 898246 - RNA, 22 nt, Human
cacacauauugucccuagugug

SEQ ID NO: 898247 - RNA, 22 nt, Human
aaauaaacugaagcacagagag

SEQ ID NO: 898248 - RNA, 17 nt, Human
ggcagcugugugcaugc

SEQ ID NO: 898249 - RNA, 22 nt, Human
agucaguggauuuaccaugcgu

SEQ ID NO: 898250 - RNA, 22 nt, Human
agucuguguaccuuuggccuuc

SEQ ID NO: 898251 - RNA, 22 nt, Human
aagcagcuucccuggcuccugg

SEQ ID NO: 898252 - RNA, 22 nt, Human
cuacugaguccuucagcugcca

SEQ ID NO: 898253 - RNA, 22 nt, Human
auacaucauuuaugaugugugu

SEQ ID NO: 898254 - RNA, 22 nt, Human
uagcagcaaaaugaccuucuaa

SEQ ID NO: 898255 - RNA, 22 nt, Human
guauuuuucauuccaagugaga

SEQ ID NO: 898256 - RNA, 22 nt, Human
agaaacagaagggaaagcuuuu

SEQ ID NO: 898257 - RNA, 22 nt, Human
auugacacaaugggauguaagg

SEQ ID NO: 898258 - RNA, 22 nt, Human
gcaggcucccuugcagagcagg

SEQ ID NO: 898259 - RNA, 22 nt, Human
gugugcauguggaagcauguau

SEQ ID NO: 898260 - RNA, 22 nt, Human
auaaaccuaugcuaagcugugg

SEQ ID NO: 898261 - RNA, 22 nt, Human
guuugccugccgacgcucucau

SEQ ID NO: 898262 - RNA, 22 nt, Human
gagacacaagaagacaugcaca

SEQ ID NO: 898263 - RNA, 22 nt, Human
gagccagguuggaggcugcagu

SEQ ID NO: 898264 - RNA, 22 nt, Human
ucaggcuguuccuguccaaaau

SEQ ID NO: 898265 - RNA, 22 nt, Human
ccaggcaggcgauggugcagug

SEQ ID NO: 898266 - RNA, 22 nt, Human
uuuuaccacugggugacaugga

SEQ ID NO: 898267 - RNA, 22 nt, Human
uaucucuuucauuuuagaguca

SEQ ID NO: 898268 - RNA, 22 nt, Human
uacaaguaaauuguagauacca

SEQ ID NO: 898269 - RNA, 22 nt, Human
aggcugcuucagcugcagggag

SEQ ID NO: 898270 - RNA, 18 nt, Human
gguggcaggucagaugcc

SEQ ID NO: 898271 - RNA, 22 nt, Human
aaggaguggggcauaucacaga

SEQ ID NO: 898272 - RNA, 22 nt, Human
cacagggaaccaaggcugggcc

SEQ ID NO: 898273 - RNA, 22 nt, Human
acuuucucaaaucagacuuuaa

SEQ ID NO: 898274 - RNA, 22 nt, Human
cucacugucuguacuagcugau

SEQ ID NO: 898275 - RNA, 22 nt, Human
uagacacaucaaguauaguuaa

SEQ ID NO: 898276 - RNA, 21 nt, Human
cucuucaguggugagcucuuc

SEQ ID NO: 898277 - RNA, 22 nt, Human
ucccuguggcuaagacaugaca

SEQ ID NO: 898278 - RNA, 22 nt, Human
aacauuugugaaguacuuagau

SEQ ID NO: 898279 - RNA, 22 nt, Human
ugacccugagagcugaauggcu

SEQ ID NO: 898280 - RNA, 22 nt, Human
ugucccaguuuugcagguuaga

SEQ ID NO: 898281 - RNA, 19 nt, Human
uacaagcuuaaaguaaugu

SEQ ID NO: 898282 - RNA, 22 nt, Human
ccuaccaguaggaggccagaga

SEQ ID NO: 898283 - RNA, 22 nt, Human
ucaaacuguuuacagugagaua

SEQ ID NO: 898284 - RNA, 22 nt, Human
ucugucacccaggcuggagugc

SEQ ID NO: 898285 - RNA, 22 nt, Human
ugcagggccagacuggguugga

SEQ ID NO: 898286 - RNA, 22 nt, Human
gaaaggaacuugugagugggag

SEQ ID NO: 898287 - RNA, 22 nt, Human
agaaucaauuagauucuaugag

SEQ ID NO: 898288 - RNA, 22 nt, Human
ugagagccuguguucaaaugcc

SEQ ID NO: 898289 - RNA, 22 nt, Human
uuauauaucuugauuuguucca

SEQ ID NO: 898290 - RNA, 22 nt, Human
aagcagccuggcaugaugcuuu

SEQ ID NO: 898291 - RNA, 19 nt, Human
agccacagaacuugcagga

SEQ ID NO: 898292 - RNA, 22 nt, Human
guuuaaauaauuaggggccugu

SEQ ID NO: 898293 - RNA, 22 nt, Human
aagaacauuuuguagaaugaca

SEQ ID NO: 898294 - RNA, 22 nt, Human
cugugucuucaauguacuggga

SEQ ID NO: 898295 - RNA, 22 nt, Human
agcaggcagccauuuggaaggc

SEQ ID NO: 898296 - RNA, 22 nt, Human
ucucaggagccacagcgggagu

SEQ ID NO: 898297 - RNA, 22 nt, Human
cccuuucuuccgugacuucugc

SEQ ID NO: 898298 - RNA, 22 nt, Human
cugaaggcuaaaauggacugaa

SEQ ID NO: 898299 - RNA, 21 nt, Human
acagaguaguugaaacagaga

SEQ ID NO: 898300 - RNA, 22 nt, Human
aaguuugaugaguuucuggagg

SEQ ID NO: 898301 - RNA, 22 nt, Human
ugacccuuggaguaggauguau

SEQ ID NO: 898302 - RNA, 22 nt, Human
auuuggucuguaauuacaugga

SEQ ID NO: 898303 - RNA, 22 nt, Human
ccagaggaguugaggcuuuggg

SEQ ID NO: 898304 - RNA, 22 nt, Human
ucucacacuauuuauucugcuu

SEQ ID NO: 898305 - RNA, 22 nt, Human
gcucugaggcugugaggugcug

SEQ ID NO: 898306 - RNA, 16 nt, Human
gaaggagauucagaaa

SEQ ID NO: 898307 - RNA, 22 nt, Human
gcccagcaaggaccaagggccg

SEQ ID NO: 898308 - RNA, 22 nt, Human
uuccagaggcuucagggaagaa

SEQ ID NO: 898309 - RNA, 22 nt, Human
acaguggaagaagcacugaacu

SEQ ID NO: 898310 - RNA, 22 nt, Human
aggggcuggaguucgagguuac

SEQ ID NO: 898311 - RNA, 22 nt, Human
aacuuugagucauugccucuuu

SEQ ID NO: 898312 - RNA, 22 nt, Human
acacauguacagauuaguauuu

SEQ ID NO: 898313 - RNA, 22 nt, Human
uucuaguugagggagacaaaua

SEQ ID NO: 898314 - RNA, 22 nt, Human
ccucuggguuaguuuagggagc

SEQ ID NO: 898315 - RNA, 22 nt, Human
gcuguucuguccccauggguaa

SEQ ID NO: 898316 - RNA, 22 nt, Human
uaaaguucuggugagagguaag

SEQ ID NO: 898317 - RNA, 22 nt, Human
gacagcaucuguguggcaggag

SEQ ID NO: 898318 - RNA, 22 nt, Human
ccggaaacuccuuugagagccu

SEQ ID NO: 898319 - RNA, 22 nt, Human
ccugcuucagggaugauggcac

SEQ ID NO: 898320 - RNA, 22 nt, Human
aggcucaggugccucauucaca

SEQ ID NO: 898321 - RNA, 22 nt, Human
aaaugugacagaugcaguacag

SEQ ID NO: 898322 - RNA, 22 nt, Human
agacacagguguaauuucugcu

SEQ ID NO: 898323 - RNA, 22 nt, Human
uucacagacauugcagacugaa

SEQ ID NO: 898324 - RNA, 17 nt, Human
cacuuuguugcuguggg

SEQ ID NO: 898325 - RNA, 22 nt, Human
aaaagcagagacucuggagcua

SEQ ID NO: 898326 - RNA, 22 nt, Human
gccagccugugcuuggccaggc

SEQ ID NO: 898327 - RNA, 22 nt, Human
uagagaaacagaaccaacaggg

SEQ ID NO: 898328 - RNA, 22 nt, Human
ggcauuuaauccaucugauuga

SEQ ID NO: 898329 - RNA, 22 nt, Human
uuuccuuuaugacaucaccacu

SEQ ID NO: 898330 - RNA, 22 nt, Human
ggaaaaggccacagggacacau

SEQ ID NO: 898331 - RNA, 22 nt, Human
agcuucuguucaucuuccaggc

SEQ ID NO: 898332 - RNA, 21 nt, Human
cccuucuuacucaagcucauu

SEQ ID NO: 898333 - RNA, 19 nt, Human
cugugcccuaugacuugua

SEQ ID NO: 898334 - RNA, 22 nt, Human
agucucuaggaucagacaccca

SEQ ID NO: 898335 - RNA, 22 nt, Human
agugcauaaaggaaaaacugaa

SEQ ID NO: 898336 - RNA, 22 nt, Human
agugcuuugagcguuugaaaag

SEQ ID NO: 898337 - RNA, 22 nt, Human
ucuguugcauaugcugcugggu

SEQ ID NO: 898338 - RNA, 22 nt, Human
agacuguagcuucugucuugag

SEQ ID NO: 898339 - RNA, 22 nt, Human
gugcucuaggaccuuagaagug

SEQ ID NO: 898340 - RNA, 22 nt, Human
guauauguaugcguauacacac

SEQ ID NO: 898341 - RNA, 22 nt, Human
uuucaggaucaaaugaaaucgu

SEQ ID NO: 898342 - RNA, 22 nt, Human
ucaaucaaagcacugggcuuug

SEQ ID NO: 898343 - RNA, 22 nt, Human
gaaauguuugggaggagucaac

SEQ ID NO: 898344 - RNA, 22 nt, Human
cagcuauuuguaggaaaacugu

SEQ ID NO: 898345 - RNA, 22 nt, Human
auacugaaggcauucagauaac

SEQ ID NO: 898346 - RNA, 22 nt, Human
uuuuguuguaauauaccuaucc

SEQ ID NO: 898347 - RNA, 22 nt, Human
cacaggaagagguauacaauuc

SEQ ID NO: 898348 - RNA, 22 nt, Human
uuggucuguguuacaucauuua

SEQ ID NO: 898349 - RNA, 22 nt, Human
agggacuauuuacccaucucac

SEQ ID NO: 898350 - RNA, 17 nt, Human
uguaacaacuccuauua

SEQ ID NO: 898351 - RNA, 22 nt, Human
ucauucuuuaccaaguugucac

SEQ ID NO: 898352 - RNA, 22 nt, Human
ucacaguucaacuaguucagau

SEQ ID NO: 898353 - RNA, 23 nt, Human
cucuccaccuucccacccaggga

SEQ ID NO: 898354 - RNA, 22 nt, Human
gaggcauuaaagggaaucuucu

SEQ ID NO: 898355 - RNA, 22 nt, Human
uuugaauaaucacugggcauua

SEQ ID NO: 898356 - RNA, 22 nt, Human
gaugcaaaccuuacauggaccu

SEQ ID NO: 898357 - RNA, 22 nt, Human
ucccagaacccugccagguccu

SEQ ID NO: 898358 - RNA, 22 nt, Human
agaaaguuuguuuuuauccaua

SEQ ID NO: 898359 - RNA, 22 nt, Human
ugcuagguaagaagggggcucc

SEQ ID NO: 898360 - RNA, 22 nt, Human
caaauacuuuuagccuauugag

SEQ ID NO: 898361 - RNA, 22 nt, Human
acagauggcacuuuuuaggacu

SEQ ID NO: 898362 - RNA, 17 nt, Human
ggcuucagggagcuggg

SEQ ID NO: 898363 - RNA, 22 nt, Human
agugcuuuccuucuugugacau

SEQ ID NO: 898364 - RNA, 22 nt, Human
uuacuuuggguccugcuuauaa

SEQ ID NO: 898365 - RNA, 22 nt, Human
cugugagggccagagucagggc

SEQ ID NO: 898366 - RNA, 18 nt, Human
aaacuguauuucuuucua

SEQ ID NO: 898367 - RNA, 22 nt, Human
acaggguggggauggugagcuu

SEQ ID NO: 898368 - RNA, 22 nt, Human
ucagucuccuuuccucuagaca

SEQ ID NO: 898369 - RNA, 22 nt, Human
gaggcccucuugccacaaugaa

SEQ ID NO: 898370 - RNA, 22 nt, Human
guuagcaaaauguuuuugaggc

SEQ ID NO: 898371 - RNA, 22 nt, Human
uucucucuguuauggauuuuac

SEQ ID NO: 898372 - RNA, 22 nt, Human
auuuggucuccauacugguuag

SEQ ID NO: 898373 - RNA, 22 nt, Human
agaugauauacuacauggcuuc

SEQ ID NO: 898374 - RNA, 22 nt, Human
ugaaacuuauucaguuucuacc

SEQ ID NO: 898375 - RNA, 22 nt, Human
cuguggcaggaagggacuagca

SEQ ID NO: 898376 - RNA, 22 nt, Human
uagcugccuaugugauaagaga

SEQ ID NO: 898377 - RNA, 23 nt, Human
uguaacuuugggcauguugcuuc

SEQ ID NO: 898378 - RNA, 22 nt, Human
uuacugaagguggauagugagu

SEQ ID NO: 898379 - RNA, 22 nt, Human
ugggaggagcccucugggaagg

SEQ ID NO: 898380 - RNA, 22 nt, Human
aacaggggugggugcuacugga

SEQ ID NO: 898381 - RNA, 22 nt, Human
aguuucacaugcauggaugugu

SEQ ID NO: 898382 - RNA, 22 nt, Human
cacaucauucaauggugauauu

SEQ ID NO: 898383 - RNA, 22 nt, Human
cugggaagauggugacagaauu

SEQ ID NO: 898384 - RNA, 22 nt, Human
acaggaaguuuggaaagccuca

SEQ ID NO: 898385 - RNA, 22 nt, Human
aggaagcucggagagggcaaau

SEQ ID NO: 898386 - RNA, 20 nt, Human
agcagauagcgggagaguuu

SEQ ID NO: 898387 - RNA, 22 nt, Human
uggcagucgaucauauucagca

SEQ ID NO: 898388 - RNA, 22 nt, Human
ugcaggcucacccuggagcuga

SEQ ID NO: 898389 - RNA, 22 nt, Human
ggcuuuauguuuuucauguggu

SEQ ID NO: 898390 - RNA, 22 nt, Human
gagacacaaacacauuuagagg

SEQ ID NO: 898391 - RNA, 17 nt, Human
aaacuggggucaggagc

SEQ ID NO: 898392 - RNA, 22 nt, Human
accucucugggccugcuuccug

SEQ ID NO: 898393 - RNA, 22 nt, Human
cacuuugauuugugaugugaga

SEQ ID NO: 898394 - RNA, 22 nt, Human
auuucucaucaagugccaacuc

SEQ ID NO: 898395 - RNA, 22 nt, Human
gcucagagggaacaaggggcug

SEQ ID NO: 898396 - RNA, 21 nt, Human
aaguagaagggagaaggguua

SEQ ID NO: 898397 - RNA, 22 nt, Human
ggcauuuaggaucuuuaguuga

SEQ ID NO: 898398 - RNA, 22 nt, Human
ucaagcagcagaucaagagcua

SEQ ID NO: 898399 - RNA, 22 nt, Human
uuggaauagauuuguuagaaaa

SEQ ID NO: 898400 - RNA, 22 nt, Human
cugcacagcuggccagggagag

SEQ ID NO: 898401 - RNA, 18 nt, Human
ccucaggggaccuggcag

SEQ ID NO: 898402 - RNA, 22 nt, Human
uuaaaaaccaucuuccuuuccu

SEQ ID NO: 898403 - RNA, 22 nt, Human
uacaaagcuacucgagggcagg

SEQ ID NO: 898404 - RNA, 19 nt, Human
gggaaauucacuugcuucc

SEQ ID NO: 898405 - RNA, 22 nt, Human
ugaaaaggaguccuuguuuuca

SEQ ID NO: 898406 - RNA, 22 nt, Human
ugagaaaacaguuuguaauaau

SEQ ID NO: 898407 - RNA, 22 nt, Human
ucagaaagguucuauguuuuac

SEQ ID NO: 898408 - RNA, 22 nt, Human
accaguggaugaaugcuggacc

SEQ ID NO: 898409 - RNA, 22 nt, Human
aacagugucugugguuaaaggu

SEQ ID NO: 898410 - RNA, 18 nt, Human
cagagcaguaugaauguu

SEQ ID NO: 898411 - RNA, 22 nt, Human
ugcuuauucuuuccacaauuca

SEQ ID NO: 898412 - RNA, 22 nt, Human
uuugcauaggauggacauuuua

SEQ ID NO: 898413 - RNA, 22 nt, Human
cucuuuaaaguaaaauuugucu

SEQ ID NO: 898414 - RNA, 21 nt, Human
agacacagggguugcuggggu

SEQ ID NO: 898415 - RNA, 22 nt, Human
acaaaggcauagugaauguuuu

SEQ ID NO: 898416 - RNA, 22 nt, Human
agccuggacagcuacggagaac

SEQ ID NO: 898417 - RNA, 22 nt, Human
cucaggaguaguucagcagcug

SEQ ID NO: 898418 - RNA, 22 nt, Human
aagacauuggcauugacuguaa

SEQ ID NO: 898419 - RNA, 22 nt, Human
ucugucacugagcucaggauuc

SEQ ID NO: 898420 - RNA, 22 nt, Human
uuguuggaaaugagaggcuagg

SEQ ID NO: 898421 - RNA, 22 nt, Human
guggcagcaaaugccuggacua

SEQ ID NO: 898422 - RNA, 22 nt, Human
uuucuggacagcaagaucaguu

SEQ ID NO: 898423 - RNA, 21 nt, Human
uucaaaguuugccuaaagauu

SEQ ID NO: 898424 - RNA, 22 nt, Human
cugcagcuuuggaaaccuguuu

SEQ ID NO: 898425 - RNA, 22 nt, Human
cucagagcacuuuugaaagcuc

SEQ ID NO: 898426 - RNA, 22 nt, Human
gggaggacgguccagggcaaag

SEQ ID NO: 898427 - RNA, 22 nt, Human
uaccugaaguaacaaugaauau

SEQ ID NO: 898428 - RNA, 22 nt, Human
cuguugauuagaauuucacauc

SEQ ID NO: 898429 - RNA, 17 nt, Human
ccucacagggaccagac

SEQ ID NO: 898430 - RNA, 22 nt, Human
uugcugauucaugauuugagaa

SEQ ID NO: 898431 - RNA, 19 nt, Human
acagggcagcaauaggaua

SEQ ID NO: 898432 - RNA, 22 nt, Human
aacuuuacacugcuuuacauga

SEQ ID NO: 898433 - RNA, 22 nt, Human
uuccugggggcagcagucuuga

SEQ ID NO: 898434 - RNA, 22 nt, Human
aucuagaaaaggugacuaaaau

SEQ ID NO: 898435 - RNA, 22 nt, Human
acauaacaugucaaucacccga

SEQ ID NO: 898436 - RNA, 22 nt, Human
ccaggcuggaaucaauauucug

SEQ ID NO: 898437 - RNA, 22 nt, Human
uuuuuccuagcgauuugucagc

SEQ ID NO: 898438 - RNA, 21 nt, Human
ugagcaggagucaugggaaug

SEQ ID NO: 898439 - RNA, 22 nt, Human
ccccaggagaaaucuuaaacua

SEQ ID NO: 898440 - RNA, 22 nt, Human
auacaaguuaaugagaaugaca

SEQ ID NO: 898441 - RNA, 22 nt, Human
gaggcugggaaguccaauauca

SEQ ID NO: 898442 - RNA, 22 nt, Human
uggcagaguaggauggcccugu

SEQ ID NO: 898443 - RNA, 21 nt, Human
acagauuuuauaucucugcug

SEQ ID NO: 898444 - RNA, 22 nt, Human
ugauuuccaugaagcugaaggc

SEQ ID NO: 898445 - RNA, 22 nt, Human
auaaagucaaggcauuuuauga

SEQ ID NO: 898446 - RNA, 22 nt, Human
guggauggcuaguugagaaggg

SEQ ID NO: 898447 - RNA, 22 nt, Human
gucugucuguuguugagaagca

SEQ ID NO: 898448 - RNA, 21 nt, Human
gauugaaaccauggcagugag

SEQ ID NO: 898449 - RNA, 22 nt, Human
cagccaggccuggugaccaaag

SEQ ID NO: 898450 - RNA, 22 nt, Human
ccagagccuggcaucugcauaa

SEQ ID NO: 898451 - RNA, 22 nt, Human
cagcugugagagugcauugaag

SEQ ID NO: 898452 - RNA, 22 nt, Human
uaucaacauuaauauuuucugg

SEQ ID NO: 898453 - RNA, 22 nt, Human
aggcugagugcuccccuagaug

SEQ ID NO: 898454 - RNA, 22 nt, Human
aguccagagaggaggcugugug

SEQ ID NO: 898455 - RNA, 22 nt, Human
uuaugaaguuccuguuacagug

SEQ ID NO: 898456 - RNA, 22 nt, Human
ugcauguaugugcucacaugug

SEQ ID NO: 898457 - RNA, 22 nt, Human
aaggcugaauucaaggguaggc

SEQ ID NO: 898458 - RNA, 22 nt, Human
aggccagcccucaccuguguuc

SEQ ID NO: 898459 - RNA, 22 nt, Human
ugcucuaucuuugcuugaggga

SEQ ID NO: 898460 - RNA, 22 nt, Human
uguuuuuccaugugcagaacaa

SEQ ID NO: 898461 - RNA, 22 nt, Human
ugcccugcagacccugcagugu

SEQ ID NO: 898462 - RNA, 22 nt, Human
uauaaagagucuaucugguggc

SEQ ID NO: 898463 - RNA, 22 nt, Human
uuagaacaucugugucuuuaug

SEQ ID NO: 898464 - RNA, 22 nt, Human
aaagaaucguguguaguuugaa

SEQ ID NO: 898465 - RNA, 22 nt, Human
uauacucuggaauuuuauucuu

SEQ ID NO: 898466 - RNA, 22 nt, Human
ggaaggaagugaccaggauauc

SEQ ID NO: 898467 - RNA, 22 nt, Human
guagacaaauuucuucucucaa

SEQ ID NO: 898468 - RNA, 22 nt, Human
caaagaugucauugguaagaca

SEQ ID NO: 898469 - RNA, 22 nt, Human
cgcuggcuuccuccuggggcca

SEQ ID NO: 898470 - RNA, 22 nt, Human
gaagcaucagcaauggcuggaa

SEQ ID NO: 898471 - RNA, 22 nt, Human
gcccucuggcacagagaugcag

SEQ ID NO: 898472 - RNA, 22 nt, Human
gaggccagaugucaugucuuau

SEQ ID NO: 898473 - RNA, 22 nt, Human
ugcccugucuaagcugucagua

SEQ ID NO: 898474 - RNA, 22 nt, Human
cagggcucgcugccagcuucag

SEQ ID NO: 898475 - RNA, 22 nt, Human
guccccagaaaggugaggcagg

SEQ ID NO: 898476 - RNA, 22 nt, Human
acgcccggucuccauaguuuuu

SEQ ID NO: 898477 - RNA, 22 nt, Human
ggugaggguaaauauaggcaaa

SEQ ID NO: 898478 - RNA, 22 nt, Human
auguagaggaguuucuggucug

SEQ ID NO: 898479 - RNA, 22 nt, Human
cuuuaugacugaguugucaauu

SEQ ID NO: 898480 - RNA, 22 nt, Human
uucaguguacagugaagggauu

SEQ ID NO: 898481 - RNA, 22 nt, Human
gauucuuaugagugaacuuuac

SEQ ID NO: 898482 - RNA, 22 nt, Human
gcugugucuguuuuacgucaag

SEQ ID NO: 898483 - RNA, 22 nt, Human
cuggcuuuaaaaugcuccugga

SEQ ID NO: 898484 - RNA, 18 nt, Human
agcccaggcaucgucugc

SEQ ID NO: 898485 - RNA, 22 nt, Human
cagggguggcugcagcagaggu

SEQ ID NO: 898486 - RNA, 22 nt, Human
cugcagagcuugucuggaugug

SEQ ID NO: 898487 - RNA, 22 nt, Human
ggcacugggcaccggcugaggg

SEQ ID NO: 898488 - RNA, 22 nt, Human
aggucucuaaaauagucaaacu

SEQ ID NO: 898489 - RNA, 22 nt, Human
cauuuagagaagauuacaagga

SEQ ID NO: 898490 - RNA, 22 nt, Human
cuauuuucugucucuauagagu

SEQ ID NO: 898491 - RNA, 22 nt, Human
gccuggguggagaggggugaca

SEQ ID NO: 898492 - RNA, 22 nt, Human
aaugucuugagaagagaaaucu

SEQ ID NO: 898493 - RNA, 22 nt, Human
cagcagcuucuguugaucagaa

SEQ ID NO: 898494 - RNA, 17 nt, Human
uugaaaaguaagcuccc

SEQ ID NO: 898495 - RNA, 22 nt, Human
auguccaguacuucuaaauggu

SEQ ID NO: 898496 - RNA, 22 nt, Human
augugucuugcggcaguuggua

SEQ ID NO: 898497 - RNA, 21 nt, Human
uuauggagaaggaaaguaagg

SEQ ID NO: 898498 - RNA, 20 nt, Human
gggaugagaguccuagcucu

SEQ ID NO: 898499 - RNA, 22 nt, Human
gcacaguuaaagggucauguga

SEQ ID NO: 898500 - RNA, 22 nt, Human
acaaagucucuaauaaucuucu

SEQ ID NO: 898501 - RNA, 22 nt, Human
ucauugacuugaagaaaacaau

SEQ ID NO: 898502 - RNA, 22 nt, Human
aagccagguguugugguaagag

SEQ ID NO: 898503 - RNA, 22 nt, Human
uggccugcucugacuuuggggg

SEQ ID NO: 898504 - RNA, 22 nt, Human
augugucucuaaaauuuaguaa

SEQ ID NO: 898505 - RNA, 22 nt, Human
uuucaaacuuaaauaccuuucc

SEQ ID NO: 898506 - RNA, 22 nt, Human
ucaaagcuuagauaauuucuuu

SEQ ID NO: 898507 - RNA, 22 nt, Human
agcugcagauucuaucuagaag

SEQ ID NO: 898508 - RNA, 16 nt, Human
agggagagaggaacau

SEQ ID NO: 898509 - RNA, 22 nt, Human
cuugggaggagaacaaagcucc

SEQ ID NO: 898510 - RNA, 19 nt, Human
ccugaccacacaggccuug

SEQ ID NO: 898511 - RNA, 22 nt, Human
aacucuuuguggacauuaaauu

SEQ ID NO: 898512 - RNA, 22 nt, Human
uuacauguuuacggauacacuu

SEQ ID NO: 898513 - RNA, 23 nt, Human
accuggcugcucaaccugcaggg

SEQ ID NO: 898514 - RNA, 22 nt, Human
gcugaaaugucuuuagcagugu

SEQ ID NO: 898515 - RNA, 22 nt, Human
uaaaaguuagcuaggacaaagu

SEQ ID NO: 898516 - RNA, 22 nt, Human
agacuguaauuuguggccuccu

SEQ ID NO: 898517 - RNA, 22 nt, Human
aucuuggacuacagaagagagg

SEQ ID NO: 898518 - RNA, 22 nt, Human
cuacagguaugugcaugacauc

SEQ ID NO: 898519 - RNA, 20 nt, Human
cagauaaacgggaaagaagc

SEQ ID NO: 898520 - RNA, 22 nt, Human
gaaaucuacuuagugucuggau

SEQ ID NO: 898521 - RNA, 22 nt, Human
cucugacauucugugacucuga

SEQ ID NO: 898522 - RNA, 22 nt, Human
cuuaggaacgcucugccuagug

SEQ ID NO: 898523 - RNA, 22 nt, Human
gguggcaggcccugagcauccc

SEQ ID NO: 898524 - RNA, 22 nt, Human
ucuagaauagauucugcugauc

SEQ ID NO: 898525 - RNA, 23 nt, Human
aaaggcaggccuaggacauauug

SEQ ID NO: 898526 - RNA, 22 nt, Human
uuucaucuuauuugucuacauc

SEQ ID NO: 898527 - RNA, 22 nt, Human
aagugcagagagcugacgaacu

SEQ ID NO: 898528 - RNA, 22 nt, Human
agaacucuauauucaugaacaa

SEQ ID NO: 898529 - RNA, 22 nt, Human
ugcauaaaauaugagaaaugua

SEQ ID NO: 898530 - RNA, 22 nt, Human
uguaaagaaauagcauuuguag

SEQ ID NO: 898531 - RNA, 22 nt, Human
guuauguaaucuaacacucagu

SEQ ID NO: 898532 - RNA, 22 nt, Human
ucugggcuugguuagggcuguu

SEQ ID NO: 898533 - RNA, 22 nt, Human
aagaggcuucagauccuucaga

SEQ ID NO: 898534 - RNA, 22 nt, Human
auucacacuuuacuucuuucca

SEQ ID NO: 898535 - RNA, 22 nt, Human
aggcucagagagcuguguccau

SEQ ID NO: 898536 - RNA, 22 nt, Human
cagagagagcaggaaaccuccg

SEQ ID NO: 898537 - RNA, 16 nt, Human
aggcagagauuuaccc

SEQ ID NO: 898538 - RNA, 22 nt, Human
gucuucuuugucaucuuagguu

SEQ ID NO: 898539 - RNA, 22 nt, Human
uagcccagcuuggccuauuucu

SEQ ID NO: 898540 - RNA, 22 nt, Human
cugcagaaaccuuuccugauuu

SEQ ID NO: 898541 - RNA, 22 nt, Human
ucugagagucuuucuucaagug

SEQ ID NO: 898542 - RNA, 22 nt, Human
gagcuuuucccgucuuucucgu

SEQ ID NO: 898543 - RNA, 20 nt, Human
caguaucugaagccacacaa

SEQ ID NO: 898544 - RNA, 22 nt, Human
ccaccccugggugcagggagcg

SEQ ID NO: 898545 - RNA, 22 nt, Human
uuucaguggcaucgauuacccu

SEQ ID NO: 898546 - RNA, 22 nt, Human
uccucaaaguuguauaaauauu

SEQ ID NO: 898547 - RNA, 22 nt, Human
acagaugaggaaacagggucag

SEQ ID NO: 898548 - RNA, 22 nt, Human
uuccaaacugccaauucagaag

SEQ ID NO: 898549 - RNA, 22 nt, Human
cucuggcaauggauuuuugagg

SEQ ID NO: 898550 - RNA, 22 nt, Human
aagauacagugaaagggcauug

SEQ ID NO: 898551 - RNA, 22 nt, Human
acucugggaauccucaccuucc

SEQ ID NO: 898552 - RNA, 22 nt, Human
acuccagggaggugagugugcg

SEQ ID NO: 898553 - RNA, 22 nt, Human
aaggacuggcauuaucuuaugu

SEQ ID NO: 898554 - RNA, 22 nt, Human
agguacauguuccagauacgua

SEQ ID NO: 898555 - RNA, 22 nt, Human
uaauuuuaacugugcuguuugg

SEQ ID NO: 898556 - RNA, 22 nt, Human
gaaagaaugcuauagugacuuc

SEQ ID NO: 898557 - RNA, 22 nt, Human
uggauauccuuguuaacuuucu

SEQ ID NO: 898558 - RNA, 22 nt, Human
uguccuuuaugaaaugguguuu

SEQ ID NO: 898559 - RNA, 22 nt, Human
gaagggggagcucuuccuaauu

SEQ ID NO: 898560 - RNA, 22 nt, Human
agccucugauggcucccaagga

SEQ ID NO: 898561 - RNA, 22 nt, Human
auccaucuugauguaauagcca

SEQ ID NO: 898562 - RNA, 22 nt, Human
ucugggcuugccugguugugca

SEQ ID NO: 898563 - RNA, 22 nt, Human
ggccccuggcaccaggcugauu

SEQ ID NO: 898564 - RNA, 18 nt, Human
acagaaauagcugugccu

SEQ ID NO: 898565 - RNA, 22 nt, Human
uuuccuuugggagcaugaauuu

SEQ ID NO: 898566 - RNA, 20 nt, Human
gugucaguaaauauuaugug

SEQ ID NO: 898567 - RNA, 22 nt, Human
acagaauugggguucuugggga

SEQ ID NO: 898568 - RNA, 22 nt, Human
auucacacauacucauguguga

SEQ ID NO: 898569 - RNA, 22 nt, Human
aucuacauguugauuuaaagaa

SEQ ID NO: 898570 - RNA, 22 nt, Human
ugcuaauguuucauuuuuagau

SEQ ID NO: 898571 - RNA, 22 nt, Human
ccaguggaaauguggucaggau

SEQ ID NO: 898572 - RNA, 22 nt, Human
cucuuuucaaaccuguuuaugg

SEQ ID NO: 898573 - RNA, 22 nt, Human
auggagcugugugaauauucau

SEQ ID NO: 898574 - RNA, 22 nt, Human
caaauguuuuuuaguauaagua

SEQ ID NO: 898575 - RNA, 22 nt, Human
gcucugagcucagcgucagagu

SEQ ID NO: 898576 - RNA, 22 nt, Human
agcaggcaagcgugaguucucu

SEQ ID NO: 898577 - RNA, 22 nt, Human
cugcauguuuacauuuuugaga

SEQ ID NO: 898578 - RNA, 22 nt, Human
ugcugugcaucauaguguuugg

SEQ ID NO: 898579 - RNA, 16 nt, Human
uaugugugugggagug

SEQ ID NO: 898580 - RNA, 22 nt, Human
ucucugcuaagauugugucuag

SEQ ID NO: 898581 - RNA, 18 nt, Human
cugucuuuuuucucucca

SEQ ID NO: 898582 - RNA, 19 nt, Human
uccagaagucccugagcgg

SEQ ID NO: 898583 - RNA, 22 nt, Human
uaugaaaauuuagcugaagcau

SEQ ID NO: 898584 - RNA, 22 nt, Human
agucacaugggauuagaaccca

SEQ ID NO: 898585 - RNA, 22 nt, Human
aaacugauaaaauaaguacauu

SEQ ID NO: 898586 - RNA, 22 nt, Human
aagcauuuuaguaaugaacuug

SEQ ID NO: 898587 - RNA, 22 nt, Human
augagguaaaguuuaagcuaag

SEQ ID NO: 898588 - RNA, 22 nt, Human
ggagaagggacagacucagcuu

SEQ ID NO: 898589 - RNA, 19 nt, Human
agggagguagcauuggaaa

SEQ ID NO: 898590 - RNA, 22 nt, Human
guggagggaaugaaucuucucu

SEQ ID NO: 898591 - RNA, 22 nt, Human
gguaucaaagaagggggugcca

SEQ ID NO: 898592 - RNA, 22 nt, Human
aauauuaauagaagggguucua

SEQ ID NO: 898593 - RNA, 22 nt, Human
auccuugguaagagaguuggau

SEQ ID NO: 898594 - RNA, 22 nt, Human
cacacaaauauucuggaggcaa

SEQ ID NO: 898595 - RNA, 21 nt, Human
cugcuuccucucuucauggca

SEQ ID NO: 898596 - RNA, 20 nt, Human
cagaccugcacccacuucga

SEQ ID NO: 898597 - RNA, 22 nt, Human
caagcucugcgggcuccaagau

SEQ ID NO: 898598 - RNA, 22 nt, Human
uuuauguuugcauuuucaaaga

SEQ ID NO: 898599 - RNA, 22 nt, Human
aguguguccaggaagcagaugg

SEQ ID NO: 898600 - RNA, 22 nt, Human
uuagaaaucugcugccaugcaa

SEQ ID NO: 898601 - RNA, 22 nt, Human
ucagaaagacgaaacagauggg

SEQ ID NO: 898602 - RNA, 22 nt, Human
aaguuuacauaagugaugauga

SEQ ID NO: 898603 - RNA, 22 nt, Human
gcugagcugaggcagggcuggg

SEQ ID NO: 898604 - RNA, 22 nt, Human
ggcugcaggcaggguauccacu

SEQ ID NO: 898605 - RNA, 22 nt, Human
ccugggcucacagccaaggcuc

SEQ ID NO: 898606 - RNA, 17 nt, Human
acacaucuuggcuuugc

SEQ ID NO: 898607 - RNA, 22 nt, Human
caaauuuaaguuagaaagcaau

SEQ ID NO: 898608 - RNA, 22 nt, Human
acagagguaggacaugagauau

SEQ ID NO: 898609 - RNA, 22 nt, Human
gaggggcugcccuggugucagg

SEQ ID NO: 898610 - RNA, 21 nt, Human
cagaggcugagagggcaaucu

SEQ ID NO: 898611 - RNA, 21 nt, Human
uuguuucccagagcucgcucc

SEQ ID NO: 898612 - RNA, 22 nt, Human
ugucauuuggugccaggaaaga

SEQ ID NO: 898613 - RNA, 22 nt, Human
cacagaggaaaggcaguuggua

SEQ ID NO: 898614 - RNA, 22 nt, Human
ugcuggcugccagguucccugu

SEQ ID NO: 898615 - RNA, 22 nt, Human
ccacuggaagaugcugagguca

SEQ ID NO: 898616 - RNA, 22 nt, Human
cagcaucucugggagaagcauc

SEQ ID NO: 898617 - RNA, 22 nt, Human
agagcucaagacgcucacagua

SEQ ID NO: 898618 - RNA, 22 nt, Human
acauucaaaauugugguuuaga

SEQ ID NO: 898619 - RNA, 22 nt, Human
acaugguauguauuuuaagaga

SEQ ID NO: 898620 - RNA, 22 nt, Human
gccaggcagauaugugagcuua

SEQ ID NO: 898621 - RNA, 21 nt, Human
aaaugcagucucugagaucug

SEQ ID NO: 898622 - RNA, 22 nt, Human
cuucagucgccuuggcaggggc

SEQ ID NO: 898623 - RNA, 22 nt, Human
aagaacauugacuaagaggggc

SEQ ID NO: 898624 - RNA, 22 nt, Human
acuguaaaaugagauauguaua

SEQ ID NO: 898625 - RNA, 22 nt, Human
agucccagcuacucaagaggcu

SEQ ID NO: 898626 - RNA, 22 nt, Human
cuaaacuucauauguugcuuua

SEQ ID NO: 898627 - RNA, 22 nt, Human
aaaugcugggaaccauuggauc

SEQ ID NO: 898628 - RNA, 22 nt, Human
caggagaggcuguacguuucuc

SEQ ID NO: 898629 - RNA, 22 nt, Human
acacauguuuacagucuucagu

SEQ ID NO: 898630 - RNA, 22 nt, Human
ggaggugaggccguagggugug

SEQ ID NO: 898631 - RNA, 22 nt, Human
ucccaggacaugggcucugcuc

SEQ ID NO: 898632 - RNA, 22 nt, Human
gcagcucacacagcaaguuuug

SEQ ID NO: 898633 - RNA, 22 nt, Human
ugaaaaaacaaguuggcccauu

SEQ ID NO: 898634 - RNA, 22 nt, Human
ugugucuuaaguuccaagacau

SEQ ID NO: 898635 - RNA, 22 nt, Human
cagugcugcucucuguaagaga

SEQ ID NO: 898636 - RNA, 22 nt, Human
ggcagggacaggauaggguuuu

SEQ ID NO: 898637 - RNA, 22 nt, Human
gccugaagaacagcugugagga

SEQ ID NO: 898638 - RNA, 22 nt, Human
uuacaaugaugaauaaauggca

SEQ ID NO: 898639 - RNA, 22 nt, Human
uggcagagaacacacaugauuc

SEQ ID NO: 898640 - RNA, 22 nt, Human
ccucccagugccuccagagcag

SEQ ID NO: 898641 - RNA, 22 nt, Human
cuguccaugcauguugucugcu

SEQ ID NO: 898642 - RNA, 22 nt, Human
gccuggagaaaggaagguggga

SEQ ID NO: 898643 - RNA, 22 nt, Human
gucuggggaagucagggcauca

SEQ ID NO: 898644 - RNA, 22 nt, Human
ugaggcaggacauggacaacug

SEQ ID NO: 898645 - RNA, 23 nt, Human
ggcugagaagucccaugauaggu

SEQ ID NO: 898646 - RNA, 22 nt, Human
gaggcccuccagcugucagcug

SEQ ID NO: 898647 - RNA, 22 nt, Human
agauacaucauuuauaccuuca

SEQ ID NO: 898648 - RNA, 22 nt, Human
caguguuuguugagaaaggcaa

SEQ ID NO: 898649 - RNA, 22 nt, Human
cuggccagguuuugaacaguug

SEQ ID NO: 898650 - RNA, 22 nt, Human
agaaaucuuugaaguguaaugu

SEQ ID NO: 898651 - RNA, 22 nt, Human
aaguucaaucagaugaaaaagc

SEQ ID NO: 898652 - RNA, 22 nt, Human
ggcggguggcgaggcuucucgg

SEQ ID NO: 898653 - RNA, 22 nt, Human
uauuggaauaguuaaggaagau

SEQ ID NO: 898654 - RNA, 22 nt, Human
agccugagugcuuaggacuguu

SEQ ID NO: 898655 - RNA, 22 nt, Human
aguggcuuccuucauaagcuuu

SEQ ID NO: 898656 - RNA, 18 nt, Human
uuuguccuguggcagcug

SEQ ID NO: 898657 - RNA, 22 nt, Human
ccagcucucuuugaagcauaaa

SEQ ID NO: 898658 - RNA, 22 nt, Human
uagcccagcucaaaugaccggu

SEQ ID NO: 898659 - RNA, 22 nt, Human
uggcuaugaggagcgcaggugu

SEQ ID NO: 898660 - RNA, 22 nt, Human
ugcuggagcccaggcggccuuu

SEQ ID NO: 898661 - RNA, 22 nt, Human
uagugccaccacugucuuuggc

SEQ ID NO: 898662 - RNA, 22 nt, Human
auauuuaacuggucccaauaua

SEQ ID NO: 898663 - RNA, 22 nt, Human
ucuuggacucaaaauugccuua

SEQ ID NO: 898664 - RNA, 22 nt, Human
gcuaaaguuuccgucuuucauu

SEQ ID NO: 898665 - RNA, 22 nt, Human
uggccagaguccagugagccuu

SEQ ID NO: 898666 - RNA, 22 nt, Human
acaacuguuggaggaacacagg

SEQ ID NO: 898667 - RNA, 22 nt, Human
ucaaagaagugcaaaccucauc

SEQ ID NO: 898668 - RNA, 22 nt, Human
accagagggagacuuccucuuc

SEQ ID NO: 898669 - RNA, 22 nt, Human
augaaaauucuaugcaggccag

SEQ ID NO: 898670 - RNA, 22 nt, Human
acccagagcugggcuuggcaaa

SEQ ID NO: 898671 - RNA, 20 nt, Human
cagcuuggaugagaggcuga

SEQ ID NO: 898672 - RNA, 22 nt, Human
aggugguguuugguuacaugag

SEQ ID NO: 898673 - RNA, 21 nt, Human
uccaggccaugguggggaggc

SEQ ID NO: 898674 - RNA, 22 nt, Human
uaagacugugagcucagagacu

SEQ ID NO: 898675 - RNA, 22 nt, Human
ugccugggguuggcaaacugcu

SEQ ID NO: 898676 - RNA, 21 nt, Human
guuuagaaguagucuggcuca

SEQ ID NO: 898677 - RNA, 22 nt, Human
agauugaauaaccaccuuuuuc

SEQ ID NO: 898678 - RNA, 22 nt, Human
ggcucugaacauggggaggagu

SEQ ID NO: 898679 - RNA, 22 nt, Human
gaagugcaaaaccacaugguaa

SEQ ID NO: 898680 - RNA, 22 nt, Human
uugaagagugcauuagcauauu

SEQ ID NO: 898681 - RNA, 22 nt, Human
aacuucugcagaaaagugcaug

SEQ ID NO: 898682 - RNA, 22 nt, Human
acugaaguccacacauguagga

SEQ ID NO: 898683 - RNA, 22 nt, Human
gaauguaauagucaguagaaca

SEQ ID NO: 898684 - RNA, 22 nt, Human
uccagcucaucugucuccauua

SEQ ID NO: 898685 - RNA, 22 nt, Human
uggugggagugagggcaugcca

SEQ ID NO: 898686 - RNA, 19 nt, Human
cauggcugccccauauagc

SEQ ID NO: 898687 - RNA, 21 nt, Human
agcuggcagugccuggaccuc

SEQ ID NO: 898688 - RNA, 22 nt, Human
gggcuggggcucaauaauuugu

SEQ ID NO: 898689 - RNA, 22 nt, Human
cuuucauaguuaaaauaguuug

SEQ ID NO: 898690 - RNA, 22 nt, Human
ugguacacauguccaaggucag

SEQ ID NO: 898691 - RNA, 22 nt, Human
gccacuguugcuccucaggaaa

SEQ ID NO: 898692 - RNA, 22 nt, Human
ggguggagccaguugacucugu

SEQ ID NO: 898693 - RNA, 22 nt, Human
acauuugacauuuaguaucagc

SEQ ID NO: 898694 - RNA, 20 nt, Human
auaauuauuuacuuuugugc

SEQ ID NO: 898695 - RNA, 21 nt, Human
ccugggagaucagcugccuuc

SEQ ID NO: 898696 - RNA, 22 nt, Human
uacaaauguauuuuauuuuggu

SEQ ID NO: 898697 - RNA, 22 nt, Human
aguccgccugcugccguggcag

SEQ ID NO: 898698 - RNA, 22 nt, Human
aucugaagggaaguggaaggca

SEQ ID NO: 898699 - RNA, 22 nt, Human
uugcagggcaucuaugucuggu

SEQ ID NO: 898700 - RNA, 20 nt, Human
ggugucagggccaugccugg

SEQ ID NO: 898701 - RNA, 22 nt, Human
aagcuuuaugacuuggagacag

SEQ ID NO: 898702 - RNA, 22 nt, Human
cagggaagaauaguuagcaaag

SEQ ID NO: 898703 - RNA, 22 nt, Human
agaacaaaauuagaggagugca

SEQ ID NO: 898704 - RNA, 22 nt, Human
uuggaacuuaacccugauaggu

SEQ ID NO: 898705 - RNA, 22 nt, Human
uuccaggcacaucccaacucca

SEQ ID NO: 898706 - RNA, 22 nt, Human
caggguggaacaggcaauacuu

SEQ ID NO: 898707 - RNA, 22 nt, Human
uugauguugcucuuaacaguau

SEQ ID NO: 898708 - RNA, 22 nt, Human
uucaaugcauauagauauagaa

SEQ ID NO: 898709 - RNA, 22 nt, Human
uuucacauucuucugaaucuac

SEQ ID NO: 898710 - RNA, 22 nt, Human
uucuggagcuaaaguccacucu

SEQ ID NO: 898711 - RNA, 22 nt, Human
acuugguugcaaaugaauuauu

SEQ ID NO: 898712 - RNA, 22 nt, Human
uauuguccauggcugcuuuggu

SEQ ID NO: 898713 - RNA, 21 nt, Human
acaguuuuaaggagcacaugg

SEQ ID NO: 898714 - RNA, 22 nt, Human
uuuguucaugccuauauucuca

SEQ ID NO: 898715 - RNA, 20 nt, Human
cugcaucugugacuugcaaa

SEQ ID NO: 898716 - RNA, 22 nt, Human
ccugccugggcucacuugccag

SEQ ID NO: 898717 - RNA, 22 nt, Human
caugucuuaggaaagcagagga

SEQ ID NO: 898718 - RNA, 22 nt, Human
guaggucagacauaagaggaca

SEQ ID NO: 898719 - RNA, 23 nt, Human
ugcaagaguuccaaacuguucaa

SEQ ID NO: 898720 - RNA, 22 nt, Human
ggcagcaaccaaccaggcauuu

SEQ ID NO: 898721 - RNA, 22 nt, Human
gugguuuugcuuuaugagugaa

SEQ ID NO: 898722 - RNA, 22 nt, Human
uagauuuugcauuucuaacaag

SEQ ID NO: 898723 - RNA, 22 nt, Human
gagcaauagaaagaauacugcu

SEQ ID NO: 898724 - RNA, 22 nt, Human
ucugggagaguagauaaaggaa

SEQ ID NO: 898725 - RNA, 23 nt, Human
ugagugugaaaauccuggagaug

SEQ ID NO: 898726 - RNA, 22 nt, Human
agagccugcagcugugaagaaa

SEQ ID NO: 898727 - RNA, 22 nt, Human
agaggccacaccagccucccgu

SEQ ID NO: 898728 - RNA, 22 nt, Human
uguuaaguugccaguguaugac

SEQ ID NO: 898729 - RNA, 22 nt, Human
uucuccccugacccugaugagg

SEQ ID NO: 898730 - RNA, 22 nt, Human
uaucacugaccuguaucaguug

SEQ ID NO: 898731 - RNA, 19 nt, Human
cauuuagaaguacauauua

SEQ ID NO: 898732 - RNA, 22 nt, Human
uaauacaaggcaggaagcagua

SEQ ID NO: 898733 - RNA, 22 nt, Human
ccugggaguggcacucacagca

SEQ ID NO: 898734 - RNA, 22 nt, Human
gcugaaggcccggaggacaggg

SEQ ID NO: 898735 - RNA, 22 nt, Human
gaagcuuugagagcagaagccc

SEQ ID NO: 898736 - RNA, 17 nt, Human
cagucgaggaggaccug

SEQ ID NO: 898737 - RNA, 22 nt, Human
uauggaauggcuauuuucuagg

SEQ ID NO: 898738 - RNA, 22 nt, Human
ugggcuggcugaggcauucacu

SEQ ID NO: 898739 - RNA, 22 nt, Human
cagugcccuuccaggacugcag

SEQ ID NO: 898740 - RNA, 22 nt, Human
gccacagcuuagaucacagccu

SEQ ID NO: 898741 - RNA, 22 nt, Human
acaugcaucucugggacacaug

SEQ ID NO: 898742 - RNA, 22 nt, Human
gauuaauagacacaaccaagcu

SEQ ID NO: 898743 - RNA, 22 nt, Human
aggccagguuccucaaucuuga

SEQ ID NO: 898744 - RNA, 23 nt, Human
agcagcuggggugcucuuuuguc

SEQ ID NO: 898745 - RNA, 19 nt, Human
gguuggagaagagcggccc

SEQ ID NO: 898746 - RNA, 22 nt, Human
cauuugauccucacaacaaucu

SEQ ID NO: 898747 - RNA, 22 nt, Human
uggagcauacuaacccacucug

SEQ ID NO: 898748 - RNA, 22 nt, Human
ugcugcaggccuuggcugggaa

SEQ ID NO: 898749 - RNA, 23 nt, Human
aagcugccuucgcaguuggucug

SEQ ID NO: 898750 - RNA, 22 nt, Human
ccucacccacuacacucaaggg

SEQ ID NO: 898751 - RNA, 22 nt, Human
uauucucagugcuauaaguaga

SEQ ID NO: 898752 - RNA, 22 nt, Human
cuauaacuggguauuagacuac

SEQ ID NO: 898753 - RNA, 22 nt, Human
gggcgggguggcucaugccugu

SEQ ID NO: 898754 - RNA, 22 nt, Human
acacaggacggcccuguggcuu

SEQ ID NO: 898755 - RNA, 22 nt, Human
uagaaagaacuucauguaaaac

SEQ ID NO: 898756 - RNA, 22 nt, Human
aggaggggcauagaaauguaau

SEQ ID NO: 898757 - RNA, 22 nt, Human
acugucuccucaucaugccugg

SEQ ID NO: 898758 - RNA, 22 nt, Human
acccaggaaaacauggugcaga

SEQ ID NO: 898759 - RNA, 22 nt, Human
auaugcauuaacauuguaggag

SEQ ID NO: 898760 - RNA, 22 nt, Human
ccucugagaccagcucugcacc

SEQ ID NO: 898761 - RNA, 22 nt, Human
acugaucugccuguauguagcu

SEQ ID NO: 898762 - RNA, 23 nt, Human
ucuggcucuaugugacagcucuc

SEQ ID NO: 898763 - RNA, 22 nt, Human
ccagagggcaaaaugaagcuua

SEQ ID NO: 898764 - RNA, 22 nt, Human
uccuuaacaagauggcauuugu

SEQ ID NO: 898765 - RNA, 22 nt, Human
aucuuacacuguuggguuucuc

SEQ ID NO: 898766 - RNA, 22 nt, Human
acagcucuuaggcagaaccaac

SEQ ID NO: 898767 - RNA, 22 nt, Human
gccccagccaaggugacacgaa

SEQ ID NO: 898768 - RNA, 22 nt, Human
cucugaaagcaaaacuagagaa

SEQ ID NO: 898769 - RNA, 22 nt, Human
aucuguggauaugaccuuccug

SEQ ID NO: 898770 - RNA, 21 nt, Human
ugcugcugaucgggguuggcu

SEQ ID NO: 898771 - RNA, 22 nt, Human
aggccagggucccacacucgca

SEQ ID NO: 898772 - RNA, 22 nt, Human
cugugugcugaaaugcagugag

SEQ ID NO: 898773 - RNA, 19 nt, Human
uauauauuuugggguugug

SEQ ID NO: 898774 - RNA, 22 nt, Human
gggaagagggagcuggaaugau

SEQ ID NO: 898775 - RNA, 20 nt, Human
aauugaagcagaggagaggc

SEQ ID NO: 898776 - RNA, 22 nt, Human
aaucuacauuucaguuuugccc

SEQ ID NO: 898777 - RNA, 22 nt, Human
ucuaaauucuuuccuggguuga

SEQ ID NO: 898778 - RNA, 22 nt, Human
uauaaagaaaugauuuccagaa

SEQ ID NO: 898779 - RNA, 22 nt, Human
auagaaaggucuuuggcagaca

SEQ ID NO: 898780 - RNA, 22 nt, Human
ugagacaggcuuccuucuuggg

SEQ ID NO: 898781 - RNA, 22 nt, Human
agccauuuugguaaugauaaca

SEQ ID NO: 898782 - RNA, 20 nt, Human
agguccacugaggcugccuc

SEQ ID NO: 898783 - RNA, 22 nt, Human
ugaucuuuucuauuuaugguag

SEQ ID NO: 898784 - RNA, 22 nt, Human
acuuucucaggaauucacagac

SEQ ID NO: 898785 - RNA, 22 nt, Human
gggaagaguaacuagcccaugu

SEQ ID NO: 898786 - RNA, 22 nt, Human
acacagggcaaugcuuugaccu

SEQ ID NO: 898787 - RNA, 22 nt, Human
uucucuugugccaaguuguugc

SEQ ID NO: 898788 - RNA, 22 nt, Human
gaaaguuucucacacaugcaga

SEQ ID NO: 898789 - RNA, 22 nt, Human
gaggcucagagagguccacaua

SEQ ID NO: 898790 - RNA, 22 nt, Human
gauuucaaaaguagauccauca

SEQ ID NO: 898791 - RNA, 22 nt, Human
gccagccacaagggaggcuugu

SEQ ID NO: 898792 - RNA, 22 nt, Human
ugacucugggguugaccagaug

SEQ ID NO: 898793 - RNA, 22 nt, Human
cauguauaguuggaacuacauc

SEQ ID NO: 898794 - RNA, 22 nt, Human
ggcucugguugaccaugauggc

SEQ ID NO: 898795 - RNA, 22 nt, Human
agaggaaacauagguuuuuaaa

SEQ ID NO: 898796 - RNA, 22 nt, Human
aaguacauguuguucaaaagcc

SEQ ID NO: 898797 - RNA, 22 nt, Human
uagcuguugcaauaaacaguuc

SEQ ID NO: 898798 - RNA, 22 nt, Human
gaggccacgugcuuauguuucu

SEQ ID NO: 898799 - RNA, 22 nt, Human
uuuguacauucaaaugucccau

SEQ ID NO: 898800 - RNA, 22 nt, Human
augggaugcauggcuguggcca

SEQ ID NO: 898801 - RNA, 22 nt, Human
agcagggccuggcacuccuggg

SEQ ID NO: 898802 - RNA, 22 nt, Human
cauuuuacgacauagggcaggc

SEQ ID NO: 898803 - RNA, 22 nt, Human
cagucacagugacaggaugugg

SEQ ID NO: 898804 - RNA, 22 nt, Human
ccacucugauuucaagggagau

SEQ ID NO: 898805 - RNA, 22 nt, Human
ucccagcagagccagcaagccg

SEQ ID NO: 898806 - RNA, 22 nt, Human
ugcuccagugagcuggccaucc

SEQ ID NO: 898807 - RNA, 23 nt, Human
agaaguggaauggccgugggguc

SEQ ID NO: 898808 - RNA, 22 nt, Human
uaguagcaacaagaaacaaaua

SEQ ID NO: 898809 - RNA, 20 nt, Human
ucugccacuaauuaggugau

SEQ ID NO: 898810 - RNA, 17 nt, Human
gcuuuggaaggguagac

SEQ ID NO: 898811 - RNA, 22 nt, Human
gguucuuuguauauaucacuuu

SEQ ID NO: 898812 - RNA, 22 nt, Human
ucacugauuaugaaaaugaagg

SEQ ID NO: 898813 - RNA, 22 nt, Human
acugggcuguaaagagaggcaa

SEQ ID NO: 898814 - RNA, 21 nt, Human
uucaguuucuuccucaucuau

SEQ ID NO: 898815 - RNA, 22 nt, Human
uuauuuguggcauccauguugg

SEQ ID NO: 898816 - RNA, 22 nt, Human
cacagccuccuucagagagcau

SEQ ID NO: 898817 - RNA, 22 nt, Human
cccaggcagccugcagggaagg

SEQ ID NO: 898818 - RNA, 22 nt, Human
cuggcucccucucccugaguca

SEQ ID NO: 898819 - RNA, 22 nt, Human
ugucauuuaaagcuuuccagau

SEQ ID NO: 898820 - RNA, 22 nt, Human
ugguggcagagcaagagcugga

SEQ ID NO: 898821 - RNA, 22 nt, Human
acauucacuauguccaaacucu

SEQ ID NO: 898822 - RNA, 22 nt, Human
uggcuccagauuuccugcugca

SEQ ID NO: 898823 - RNA, 22 nt, Human
ucuauucauucaauuuagcucu

SEQ ID NO: 898824 - RNA, 18 nt, Human
ugaggcugaauauggggc

SEQ ID NO: 898825 - RNA, 22 nt, Human
augugcaauuauuaagaagaga

SEQ ID NO: 898826 - RNA, 22 nt, Human
uugagaacaggaguguucuuuu

SEQ ID NO: 898827 - RNA, 22 nt, Human
ccaaagugcugagauuacaggu

SEQ ID NO: 898828 - RNA, 23 nt, Human
cugugggaagucggggagcgcgc

SEQ ID NO: 898829 - RNA, 22 nt, Human
accaaagcgagugauaugucau

SEQ ID NO: 898830 - RNA, 22 nt, Human
acagagaccaguuacagcgucc

SEQ ID NO: 898831 - RNA, 22 nt, Human
acaacuuucuggguuaucugau

SEQ ID NO: 898832 - RNA, 20 nt, Human
ugcaauguccauguuccagg

SEQ ID NO: 898833 - RNA, 22 nt, Human
aggccucacauugggcuucaag

SEQ ID NO: 898834 - RNA, 21 nt, Human
aaguaacaccacuccuggagu

SEQ ID NO: 898835 - RNA, 22 nt, Human
gacaugggaugagaugaagcau

SEQ ID NO: 898836 - RNA, 22 nt, Human
ugcuccauucucuagccagugc

SEQ ID NO: 898837 - RNA, 22 nt, Human
acuauauacacauuaucuuguu

SEQ ID NO: 898838 - RNA, 22 nt, Human
uccagccaaucagagcugaggc

SEQ ID NO: 898839 - RNA, 22 nt, Human
gaauuuacaaguugaauaacaa

SEQ ID NO: 898840 - RNA, 22 nt, Human
uggccugcucacagucagaugg

SEQ ID NO: 898841 - RNA, 22 nt, Human
ugccuuaauuuucuaagcugug

SEQ ID NO: 898842 - RNA, 22 nt, Human
uucugauacagucccaacacaa

SEQ ID NO: 898843 - RNA, 22 nt, Human
aaaugacaguucucucugagua

SEQ ID NO: 898844 - RNA, 22 nt, Human
agcccgcaucucgcuaaagaua

SEQ ID NO: 898845 - RNA, 22 nt, Human
acagagcaguucuggagcuggc

SEQ ID NO: 898846 - RNA, 22 nt, Human
cucacaggagaaagucaugguc

SEQ ID NO: 898847 - RNA, 22 nt, Human
ucuuugauuugacaauaucuug

SEQ ID NO: 898848 - RNA, 22 nt, Human
auauuacauaaacaugagugaa

SEQ ID NO: 898849 - RNA, 22 nt, Human
agacucugagacaugaaccauc

SEQ ID NO: 898850 - RNA, 22 nt, Human
agcacagacuggucccaggucu

SEQ ID NO: 898851 - RNA, 22 nt, Human
auguagaacagguuaaugacag

SEQ ID NO: 898852 - RNA, 22 nt, Human
gacugggaggguucagcugggu

SEQ ID NO: 898853 - RNA, 22 nt, Human
cuaaacaagggauuauaauuga

SEQ ID NO: 898854 - RNA, 22 nt, Human
uacaaacuaacaugucucaucc

SEQ ID NO: 898855 - RNA, 22 nt, Human
uacaaagucuuggguucuaggc

SEQ ID NO: 898856 - RNA, 20 nt, Human
caaagacaugcuaggggugg

SEQ ID NO: 898857 - RNA, 22 nt, Human
ucucugggugauggcagggcac

SEQ ID NO: 898858 - RNA, 22 nt, Human
uauacuguguuuucaccacugu

SEQ ID NO: 898859 - RNA, 22 nt, Human
uuguguuaaggugcaucuagug

SEQ ID NO: 898860 - RNA, 22 nt, Human
ugcauccuccuuuguccucuug

SEQ ID NO: 898861 - RNA, 22 nt, Human
aaauaguucagccacggugacu

SEQ ID NO: 898862 - RNA, 22 nt, Human
cacagaacugguuaauagcaga

SEQ ID NO: 898863 - RNA, 22 nt, Human
ucucacaccgucccuaaaccau

SEQ ID NO: 898864 - RNA, 22 nt, Human
ggugggaugccucuggagaagu

SEQ ID NO: 898865 - RNA, 22 nt, Human
ccacccagcagaggaggcaaga

SEQ ID NO: 898866 - RNA, 20 nt, Human
gggcccugggauucagagca

SEQ ID NO: 898867 - RNA, 22 nt, Human
ucuguacauuuggggaccccag

SEQ ID NO: 898868 - RNA, 22 nt, Human
auuguauaagucuauuuacaau

SEQ ID NO: 898869 - RNA, 22 nt, Human
gcagaaggucuggcacuucagg

SEQ ID NO: 898870 - RNA, 22 nt, Human
auggaaugcgguaguaugugca

SEQ ID NO: 898871 - RNA, 22 nt, Human
ucugaaagucugaaacaguguc

SEQ ID NO: 898872 - RNA, 22 nt, Human
ucaaacuggggaacuuauuuau

SEQ ID NO: 898873 - RNA, 22 nt, Human
acauggggcccaaagagagguc

SEQ ID NO: 898874 - RNA, 22 nt, Human
ugucauguagcauuuuaugucu

SEQ ID NO: 898875 - RNA, 22 nt, Human
uguuuuaagcucuagaagggga

SEQ ID NO: 898876 - RNA, 22 nt, Human
ggcagcugucucauucacaccu

SEQ ID NO: 898877 - RNA, 21 nt, Human
ucuuuaugacuugcccauuug

SEQ ID NO: 898878 - RNA, 22 nt, Human
uuuaggauaacuccaguuuucc

SEQ ID NO: 898879 - RNA, 22 nt, Human
ccaagaguucaagagugaacca

SEQ ID NO: 898880 - RNA, 22 nt, Human
agauaucuggaaaaaauguaug

SEQ ID NO: 898881 - RNA, 22 nt, Human
aucuuucaucucuauuauuuga

SEQ ID NO: 898882 - RNA, 22 nt, Human
agugucugcuuaucaguucuug

SEQ ID NO: 898883 - RNA, 22 nt, Human
ucauuuugugccuuaugaccgc

SEQ ID NO: 898884 - RNA, 22 nt, Human
uauguuuauacuuugauguacu

SEQ ID NO: 898885 - RNA, 22 nt, Human
aucacauucuuucaaagcaguc

SEQ ID NO: 898886 - RNA, 22 nt, Human
gacccuuuucagacucagguac

SEQ ID NO: 898887 - RNA, 18 nt, Human
uaaguguaauugacaauu

SEQ ID NO: 898888 - RNA, 22 nt, Human
gccccuguuguggcuuugucua

SEQ ID NO: 898889 - RNA, 22 nt, Human
aggcaagcccaggcacuuggag

SEQ ID NO: 898890 - RNA, 22 nt, Human
aacuuucucuggauggcuuccu

SEQ ID NO: 898891 - RNA, 22 nt, Human
ggcuggugaguucagagaaccc

SEQ ID NO: 898892 - RNA, 22 nt, Human
guuugaaaguucaacaggaaaa

SEQ ID NO: 898893 - RNA, 22 nt, Human
gauuuuauauggcauacugugg

SEQ ID NO: 898894 - RNA, 22 nt, Human
ggcagcaacucauuauuccugu

SEQ ID NO: 898895 - RNA, 22 nt, Human
uaacaauaguguuugcuaguca

SEQ ID NO: 898896 - RNA, 20 nt, Human
ucacaacuccaucauuuccc

SEQ ID NO: 898897 - RNA, 22 nt, Human
aagcugccuugcugaggagaaa

SEQ ID NO: 898898 - RNA, 17 nt, Human
gcagacugcgggucccc

SEQ ID NO: 898899 - RNA, 22 nt, Human
ucaggccuccagguuaccauuu

SEQ ID NO: 898900 - RNA, 22 nt, Human
ugggguagggaaaagaagucga

SEQ ID NO: 898901 - RNA, 23 nt, Human
uagagaaagccaccgagucucuc

SEQ ID NO: 898902 - RNA, 22 nt, Human
acagcagcuaaccccugggcca

SEQ ID NO: 898903 - RNA, 23 nt, Human
uuggaagccagacagcugugcag

SEQ ID NO: 898904 - RNA, 22 nt, Human
aacaauuaucauauacauugca

SEQ ID NO: 898905 - RNA, 22 nt, Human
ccaggucuaucaaguugggcuc

SEQ ID NO: 898906 - RNA, 22 nt, Human
agagcuguauccccuuaccagu

SEQ ID NO: 898907 - RNA, 22 nt, Human
ucccagagugugggcaucaagg

SEQ ID NO: 898908 - RNA, 22 nt, Human
ucacagaaguguguuucaggag

SEQ ID NO: 898909 - RNA, 22 nt, Human
gcaguaaguuaauagugcuggu

SEQ ID NO: 898910 - RNA, 22 nt, Human
uguaaagcuuugaguguuuauc

SEQ ID NO: 898911 - RNA, 22 nt, Human
cuggaaugggagucagacagag

SEQ ID NO: 898912 - RNA, 22 nt, Human
aggcucagucuguucaugcacu

SEQ ID NO: 898913 - RNA, 22 nt, Human
aggagagagguuuuaaaugggg

SEQ ID NO: 898914 - RNA, 22 nt, Human
agcuguguucugguugauucac

SEQ ID NO: 898915 - RNA, 22 nt, Human
ugugugaauagcaguggcuggu

SEQ ID NO: 898916 - RNA, 22 nt, Human
uaagcaaucuguaguuggaauc

SEQ ID NO: 898917 - RNA, 22 nt, Human
aaggaaucacuucuuuaaauga

SEQ ID NO: 898918 - RNA, 22 nt, Human
aggcagguguuaccucugguuu

SEQ ID NO: 898919 - RNA, 22 nt, Human
gauggacagccuggaaggaaag

SEQ ID NO: 898920 - RNA, 22 nt, Human
auacaaguucucauguguaucu

SEQ ID NO: 898921 - RNA, 22 nt, Human
agagggugaaugagauagaaaa

SEQ ID NO: 898922 - RNA, 22 nt, Human
aauuagaagggaguuauugaua

SEQ ID NO: 898923 - RNA, 22 nt, Human
ucccucucuugggcguggcuca

SEQ ID NO: 898924 - RNA, 22 nt, Human
ucagggccggggcuguggcgag

SEQ ID NO: 898925 - RNA, 22 nt, Human
agggaaguccaugggggcggug

SEQ ID NO: 898926 - RNA, 22 nt, Human
ggcacugcuuccugagccugag

SEQ ID NO: 898927 - RNA, 22 nt, Human
uugauggcuuuuuggcagagcu

SEQ ID NO: 898928 - RNA, 22 nt, Human
gaaggccaagaggcuccaagau

SEQ ID NO: 898929 - RNA, 22 nt, Human
caauagaaggcacagauaggua

SEQ ID NO: 898930 - RNA, 22 nt, Human
gagaagucauuugaccaccuag

SEQ ID NO: 898931 - RNA, 22 nt, Human
cauaauuauaaacgcaaguuca

SEQ ID NO: 898932 - RNA, 22 nt, Human
uaaaggaacagaggacucauuu

SEQ ID NO: 898933 - RNA, 22 nt, Human
ucucauucauccaaggauuuau

SEQ ID NO: 898934 - RNA, 22 nt, Human
caugcagggacuagagaacagg

SEQ ID NO: 898935 - RNA, 22 nt, Human
gacccagucacacuugugcuuu

SEQ ID NO: 898936 - RNA, 22 nt, Human
acccaggagagagcuauaaaau

SEQ ID NO: 898937 - RNA, 22 nt, Human
uugugcaagaauuggaaagcaa

SEQ ID NO: 898938 - RNA, 18 nt, Human
agggauguaugcuggugg

SEQ ID NO: 898939 - RNA, 22 nt, Human
ucugaaauaacugaugccagau

SEQ ID NO: 898940 - RNA, 22 nt, Human
uggaggcugugugcaugagacc

SEQ ID NO: 898941 - RNA, 19 nt, Human
cagaguuugcaggcagagg

SEQ ID NO: 898942 - RNA, 22 nt, Human
uaaagugcuuaugauaaccaag

SEQ ID NO: 898943 - RNA, 22 nt, Human
aaggcaguacuuuauguccaua

SEQ ID NO: 898944 - RNA, 22 nt, Human
cuaagaaggaggaaaagugcca

SEQ ID NO: 898945 - RNA, 22 nt, Human
uccaggcccauagacacuucuc

SEQ ID NO: 898946 - RNA, 22 nt, Human
cauuggaaaaugcaugcuuuuu

SEQ ID NO: 898947 - RNA, 22 nt, Human
ugagcaggacugaccggccuua

SEQ ID NO: 898948 - RNA, 22 nt, Human
ucccucugguccucgguggaga

SEQ ID NO: 898949 - RNA, 23 nt, Human
uuucauguuggcaugacugacuu

SEQ ID NO: 898950 - RNA, 22 nt, Human
uuaaaauagccagugccccucu

SEQ ID NO: 898951 - RNA, 22 nt, Human
ucucuugagcucaguucugaug

SEQ ID NO: 898952 - RNA, 22 nt, Human
ggagcacccugcucagccaagc

SEQ ID NO: 898953 - RNA, 22 nt, Human
cuuaaauuggaugaguuaaguu

SEQ ID NO: 898954 - RNA, 20 nt, Human
aggcugucauuucuggcagg

SEQ ID NO: 898955 - RNA, 22 nt, Human
ggguucagagucaggugugaua

SEQ ID NO: 898956 - RNA, 22 nt, Human
uugaaacauauacaaaguggug

SEQ ID NO: 898957 - RNA, 19 nt, Human
cccuaggggcuccugaggg

SEQ ID NO: 898958 - RNA, 22 nt, Human
auuuggucccuuguuguguccc

SEQ ID NO: 898959 - RNA, 22 nt, Human
cugcauaugagaauaggagaaa

SEQ ID NO: 898960 - RNA, 22 nt, Human
ugcuggagaagcuccugggacu

SEQ ID NO: 898961 - RNA, 22 nt, Human
augcagaaucuugagaaaaauu

SEQ ID NO: 898962 - RNA, 22 nt, Human
uucuaugccugagaagaagccg

SEQ ID NO: 898963 - RNA, 22 nt, Human
aggcuuuacugccucaggacuc

SEQ ID NO: 898964 - RNA, 22 nt, Human
uuagaaaggagcuuauuucuuu

SEQ ID NO: 898965 - RNA, 22 nt, Human
guaacauuuacaguuccuagag

SEQ ID NO: 898966 - RNA, 22 nt, Human
gaggaguggaguugcuggguug

SEQ ID NO: 898967 - RNA, 22 nt, Human
ccuggaggcucugggagggcag

SEQ ID NO: 898968 - RNA, 22 nt, Human
ugcuggcuuccugugcacagca

SEQ ID NO: 898969 - RNA, 22 nt, Human
acagagucauucacugaugaag

SEQ ID NO: 898970 - RNA, 22 nt, Human
cacccaggacaaaauauggaau

SEQ ID NO: 898971 - RNA, 22 nt, Human
gacagugugaacaucuaauagu

SEQ ID NO: 898972 - RNA, 22 nt, Human
uauacuacgcaccaaacaaagg

SEQ ID NO: 898973 - RNA, 22 nt, Human
gugcaaucuguugacuggacuu

SEQ ID NO: 898974 - RNA, 22 nt, Human
gcuggaccaggugugcacaggc

SEQ ID NO: 898975 - RNA, 23 nt, Human
ccacagcuauaggguagugcagu

SEQ ID NO: 898976 - RNA, 22 nt, Human
gauuuaguggcccuugguacac

SEQ ID NO: 898977 - RNA, 22 nt, Human
aauguacacugaaagccuauca

SEQ ID NO: 898978 - RNA, 22 nt, Human
cauuuguaagcauggcguugga

SEQ ID NO: 898979 - RNA, 22 nt, Human
guuuuacaaaugacggcauuca

SEQ ID NO: 898980 - RNA, 22 nt, Human
gccagcuguaucuuuggccagc

SEQ ID NO: 898981 - RNA, 18 nt, Human
caaagcaggugacagugu

SEQ ID NO: 898982 - RNA, 22 nt, Human
ccucucuguagcagcccccagu

SEQ ID NO: 898983 - RNA, 22 nt, Human
cccuguguaguuaacuuuccac

SEQ ID NO: 898984 - RNA, 22 nt, Human
aauguuguaaauauucuuugag

SEQ ID NO: 898985 - RNA, 22 nt, Human
acagaggccucguagguacaac

SEQ ID NO: 898986 - RNA, 22 nt, Human
acuuuuaaaugaguuucaguug

SEQ ID NO: 898987 - RNA, 22 nt, Human
cgcagcugcaaaggaaacauuu

SEQ ID NO: 898988 - RNA, 22 nt, Human
ucugggauuuuauagacaugcu

SEQ ID NO: 898989 - RNA, 22 nt, Human
agagcagccugugaugaugcac

SEQ ID NO: 898990 - RNA, 22 nt, Human
cacuuaaaucuguugagaaaaa

SEQ ID NO: 898991 - RNA, 22 nt, Human
ucauuucaguggcacagaagau

SEQ ID NO: 898992 - RNA, 22 nt, Human
ugucccagaucacaggagggga

SEQ ID NO: 898993 - RNA, 22 nt, Human
gcuggcucugaugggcuccagg

SEQ ID NO: 898994 - RNA, 22 nt, Human
gccaggaaguugggccagucua

SEQ ID NO: 898995 - RNA, 21 nt, Human
uguguucuucuaggucagcua

SEQ ID NO: 898996 - RNA, 22 nt, Human
auggcaguauuucaguacagag

SEQ ID NO: 898997 - RNA, 22 nt, Human
gcuucuacccacgagaugcaaa

SEQ ID NO: 898998 - RNA, 22 nt, Human
aaugaaacucgaaauaaucaca

SEQ ID NO: 898999 - RNA, 22 nt, Human
uguauuuaguccagucucucau

SEQ ID NO: 899000 - RNA, 22 nt, Human
uaagacaugguugaucuagugu

SEQ ID NO: 899001 - RNA, 22 nt, Human
aaguccuugaagaaacaguucu

SEQ ID NO: 899002 - RNA, 22 nt, Human
ucagaggucccuagcaggagug

SEQ ID NO: 899003 - RNA, 22 nt, Human
acagcagcaauagcagugacau

SEQ ID NO: 899004 - RNA, 22 nt, Human
agcuguuuuacugguuguauaa

SEQ ID NO: 899005 - RNA, 23 nt, Human
ggucccaguggagaggccucacc

SEQ ID NO: 899006 - RNA, 22 nt, Human
agacaucuugcacacauauacu

SEQ ID NO: 899007 - RNA, 22 nt, Human
acaaauggaacaaugaagacug

SEQ ID NO: 899008 - RNA, 22 nt, Human
ucuaaugaguuagauaauuuug

SEQ ID NO: 899009 - RNA, 22 nt, Human
agggucugacuccucuggcaag

SEQ ID NO: 899010 - RNA, 23 nt, Human
aggcuccacucccugggaugugg

SEQ ID NO: 899011 - RNA, 22 nt, Human
gucuuuggaggcacuguugagu

SEQ ID NO: 899012 - RNA, 22 nt, Human
ucccccucauuaccucauucaa

SEQ ID NO: 899013 - RNA, 22 nt, Human
caaguuuggauuaugaaaaagu

SEQ ID NO: 899014 - RNA, 21 nt, Human
uaucacaguagaauaggaucu

SEQ ID NO: 899015 - RNA, 22 nt, Human
uucuucucagggucccacaugg

SEQ ID NO: 899016 - RNA, 22 nt, Human
gcuucacagaaucaauaguugg

SEQ ID NO: 899017 - RNA, 22 nt, Human
uucugggggaauacagcuauga

SEQ ID NO: 899018 - RNA, 22 nt, Human
guucugaguccuccuuugaagg

SEQ ID NO: 899019 - RNA, 22 nt, Human
auuuccauguccaaaaauuagu

SEQ ID NO: 899020 - RNA, 22 nt, Human
aaacacugauggauauuuuucc

SEQ ID NO: 899021 - RNA, 22 nt, Human
caugggcucucugagcuccagg

SEQ ID NO: 899022 - RNA, 22 nt, Human
gguuaaggcuuuacagucaaac

SEQ ID NO: 899023 - RNA, 19 nt, Human
uucucuauuaugucuucuc

SEQ ID NO: 899024 - RNA, 22 nt, Human
aggagcugcauggauaccuggu

SEQ ID NO: 899025 - RNA, 22 nt, Human
uccaggccaauguagcaggccc

SEQ ID NO: 899026 - RNA, 22 nt, Human
cuggugcaggaaggagcuggca

SEQ ID NO: 899027 - RNA, 22 nt, Human
uggcucucagcucccagcagcc

SEQ ID NO: 899028 - RNA, 22 nt, Human
auucaaacaggccaauugaccu

SEQ ID NO: 899029 - RNA, 22 nt, Human
caggcuguggaucaggagccuu

SEQ ID NO: 899030 - RNA, 22 nt, Human
uguuucuuacguuuuuagaggc

SEQ ID NO: 899031 - RNA, 22 nt, Human
ccagaaggcggagauugcagug

SEQ ID NO: 899032 - RNA, 22 nt, Human
gaauauuuucaguacagauggu

SEQ ID NO: 899033 - RNA, 22 nt, Human
ugguccuggucaucugggcugg

SEQ ID NO: 899034 - RNA, 22 nt, Human
uuucuacaacacuucugaaucu

SEQ ID NO: 899035 - RNA, 22 nt, Human
cuggcccuggagggcugugcga

SEQ ID NO: 899036 - RNA, 22 nt, Human
uuugaaaccuaguuauaugacu

SEQ ID NO: 899037 - RNA, 22 nt, Human
uaaaggcucacuggcuuggggu

SEQ ID NO: 899038 - RNA, 22 nt, Human
gccucagggggagaggccagcu

SEQ ID NO: 899039 - RNA, 22 nt, Human
gcugccucccagagcccugcag

SEQ ID NO: 899040 - RNA, 22 nt, Human
ugcugcagcuaaggugaggugc

SEQ ID NO: 899041 - RNA, 22 nt, Human
uauauucaacaggcuaauguca

SEQ ID NO: 899042 - RNA, 22 nt, Human
gggacuggcacagggcugggag

SEQ ID NO: 899043 - RNA, 22 nt, Human
caggcagagcaacugguccaga

SEQ ID NO: 899044 - RNA, 22 nt, Human
cuucuaacauccuacaaugcaa

SEQ ID NO: 899045 - RNA, 17 nt, Human
accagccucuccugggg

SEQ ID NO: 899046 - RNA, 22 nt, Human
uauaggaaaggaguggucacaa

SEQ ID NO: 899047 - RNA, 22 nt, Human
gagggguccaggaggcacuuac

SEQ ID NO: 899048 - RNA, 22 nt, Human
cuucacaaaauauuucauuaua

SEQ ID NO: 899049 - RNA, 22 nt, Human
auuucaucucuggaacauaacu

SEQ ID NO: 899050 - RNA, 22 nt, Human
ucaggcccagagucacggaucc

SEQ ID NO: 899051 - RNA, 22 nt, Human
uuuauauauggcuggucuggau

SEQ ID NO: 899052 - RNA, 22 nt, Human
uucccauagugaccgaugcuga

SEQ ID NO: 899053 - RNA, 22 nt, Human
gcuggcugaaucuucugcaaua

SEQ ID NO: 899054 - RNA, 22 nt, Human
ucuaaaaaagucuguucacuug

SEQ ID NO: 899055 - RNA, 22 nt, Human
cuaacuuuuugauucuugggga

SEQ ID NO: 899056 - RNA, 22 nt, Human
aggccagcacgacagccgcagg

SEQ ID NO: 899057 - RNA, 22 nt, Human
ccugagucuguguuuuccuaag

SEQ ID NO: 899058 - RNA, 21 nt, Human
ccaggcagagcugugaguucu

SEQ ID NO: 899059 - RNA, 22 nt, Human
cucuggauugcugugagaugcu

SEQ ID NO: 899060 - RNA, 22 nt, Human
ggguacaguucuuccaguguca

SEQ ID NO: 899061 - RNA, 22 nt, Human
uauaagccauccagccuguggu

SEQ ID NO: 899062 - RNA, 22 nt, Human
gucuucuuuucagucugcuugu

SEQ ID NO: 899063 - RNA, 22 nt, Human
aaggcccucaugcgucagagcc

SEQ ID NO: 899064 - RNA, 23 nt, Human
uaugugugggucuacuagaaguc

SEQ ID NO: 899065 - RNA, 20 nt, Human
ucagugauuaucucugagug

SEQ ID NO: 899066 - RNA, 21 nt, Human
cauuugaucccucaucaggau

SEQ ID NO: 899067 - RNA, 22 nt, Human
uggcuccuuuccgggucuccag

SEQ ID NO: 899068 - RNA, 22 nt, Human
aggcuucagccuagagcuggag

SEQ ID NO: 899069 - RNA, 22 nt, Human
cuggccccuguggcuaaaauca

SEQ ID NO: 899070 - RNA, 22 nt, Human
ugacauuuaagccucugauuuc

SEQ ID NO: 899071 - RNA, 17 nt, Human
gagauggguggaucacc

SEQ ID NO: 899072 - RNA, 22 nt, Human
guguugaugacauuuuagaaac

SEQ ID NO: 899073 - RNA, 21 nt, Human
uggcacugcuuagcagguucc

SEQ ID NO: 899074 - RNA, 22 nt, Human
aggcugguaguauuuagucaca

SEQ ID NO: 899075 - RNA, 22 nt, Human
ccuccuguuguccugcuggggc

SEQ ID NO: 899076 - RNA, 22 nt, Human
gcagcuggcucagagagguggg

SEQ ID NO: 899077 - RNA, 22 nt, Human
uccuggaggcacucgcuggggc

SEQ ID NO: 899078 - RNA, 22 nt, Human
aagauguuuagauuuauacaau

SEQ ID NO: 899079 - RNA, 23 nt, Human
acacaaggguaacugccagccau

SEQ ID NO: 899080 - RNA, 22 nt, Human
cagggagaggccucuguugccc

SEQ ID NO: 899081 - RNA, 23 nt, Human
cccuggagcuagucugagcgggg

SEQ ID NO: 899082 - RNA, 22 nt, Human
acaggccauaaaggcaggcccu

SEQ ID NO: 899083 - RNA, 22 nt, Human
uccucagacuucccuuugugua

SEQ ID NO: 899084 - RNA, 22 nt, Human
caguugcagcugugacauugcg

SEQ ID NO: 899085 - RNA, 22 nt, Human
acagacauuuuaauuauuaaau

SEQ ID NO: 899086 - RNA, 22 nt, Human
aaggaagaugaaaguacugcua

SEQ ID NO: 899087 - RNA, 22 nt, Human
ggcagcuguuuguccuccuguu

SEQ ID NO: 899088 - RNA, 22 nt, Human
uggaaugugagaauaccguuuu

SEQ ID NO: 899089 - RNA, 22 nt, Human
cuuuggcagccucagcugcagg

SEQ ID NO: 899090 - RNA, 22 nt, Human
ccuggcaguuuugcccaggauu

SEQ ID NO: 899091 - RNA, 22 nt, Human
aaauaaguuaaacuagaaugau

SEQ ID NO: 899092 - RNA, 22 nt, Human
uaggcugggcauucuggccagg

SEQ ID NO: 899093 - RNA, 22 nt, Human
uaaucacugggcguuugguacu

SEQ ID NO: 899094 - RNA, 22 nt, Human
uccaauguguuuguggcaugga

SEQ ID NO: 899095 - RNA, 18 nt, Human
gugucuuauuacaguggg

SEQ ID NO: 899096 - RNA, 22 nt, Human
ugaauugccucuuauaugacca

SEQ ID NO: 899097 - RNA, 22 nt, Human
ugcagccaggaaauauuugcug

SEQ ID NO: 899098 - RNA, 22 nt, Human
aaagugcugugggcuguaagug

SEQ ID NO: 899099 - RNA, 22 nt, Human
ccuggcuuuagcugccuucccu

SEQ ID NO: 899100 - RNA, 22 nt, Human
agaacagguucaggguauaaaa

SEQ ID NO: 899101 - RNA, 22 nt, Human
ugcuuuauugcaucaguguggg

SEQ ID NO: 899102 - RNA, 20 nt, Human
ggccuuggguuucgccuguu

SEQ ID NO: 899103 - RNA, 22 nt, Human
uguccuggaguuauaaugccug

SEQ ID NO: 899104 - RNA, 22 nt, Human
uaaaauguguuucuguaugguu

SEQ ID NO: 899105 - RNA, 22 nt, Human
agagagaagcaaucaguggcca

SEQ ID NO: 899106 - RNA, 22 nt, Human
acacacaugcaugcuugccauu

SEQ ID NO: 899107 - RNA, 23 nt, Human
ucugaaagggaugcugggcagga

SEQ ID NO: 899108 - RNA, 22 nt, Human
agagguaugugucagugcuuau

SEQ ID NO: 899109 - RNA, 22 nt, Human
auucagugggugcucagcacaa

SEQ ID NO: 899110 - RNA, 22 nt, Human
acaguaacaaauggccugagga

SEQ ID NO: 899111 - RNA, 20 nt, Human
aggaaguauugucaugaagg

SEQ ID NO: 899112 - RNA, 22 nt, Human
cuguggcacauguggcaaggcc

SEQ ID NO: 899113 - RNA, 19 nt, Human
cguaccugacacagaacag

SEQ ID NO: 899114 - RNA, 22 nt, Human
augagcuagaaaaccaugugga

SEQ ID NO: 899115 - RNA, 22 nt, Human
cggggaggcuucggauuaaagc

SEQ ID NO: 899116 - RNA, 19 nt, Human
caaguucuggagauuaggg

SEQ ID NO: 899117 - RNA, 22 nt, Human
uccagaggugaacacccaggca

SEQ ID NO: 899118 - RNA, 22 nt, Human
guugaaaaugacuuuauaccau

SEQ ID NO: 899119 - RNA, 22 nt, Human
aaggcacauuccugaaaacaau

SEQ ID NO: 899120 - RNA, 22 nt, Human
uaggaagauaaacauuuguaug

SEQ ID NO: 899121 - RNA, 22 nt, Human
cuggagaguuggaagauggacu

SEQ ID NO: 899122 - RNA, 22 nt, Human
uuaggcaaauaaaauguuucca

SEQ ID NO: 899123 - RNA, 22 nt, Human
aauuucaaacuaauaggaacca

SEQ ID NO: 899124 - RNA, 22 nt, Human
ucuugaaacauaugaguaagug

SEQ ID NO: 899125 - RNA, 22 nt, Human
augggaggaaggaggcccuuga

SEQ ID NO: 899126 - RNA, 22 nt, Human
cacagggaggacaucaacagug

SEQ ID NO: 899127 - RNA, 22 nt, Human
cuccuucuccucgggaggccag

SEQ ID NO: 899128 - RNA, 22 nt, Human
uugcagaaaacaguuuucuugu

SEQ ID NO: 899129 - RNA, 22 nt, Human
aaaaugcugggaaaguuggaau

SEQ ID NO: 899130 - RNA, 22 nt, Human
cugggcacuugcucacagcucu

SEQ ID NO: 899131 - RNA, 22 nt, Human
ggcugcagagcugggugggccu

SEQ ID NO: 899132 - RNA, 22 nt, Human
gcagaagcuguucgaaggccgc

SEQ ID NO: 899133 - RNA, 22 nt, Human
uuugcugaauaaaugugugacu

SEQ ID NO: 899134 - RNA, 22 nt, Human
cuggagcucagcccagguucca

SEQ ID NO: 899135 - RNA, 22 nt, Human
uacauagagaaguuacagugga

SEQ ID NO: 899136 - RNA, 22 nt, Human
ugcccauuauucagccauuaaa

SEQ ID NO: 899137 - RNA, 22 nt, Human
cuguggaguccuggggaaugga

SEQ ID NO: 899138 - RNA, 22 nt, Human
uggcuacaagguggcuauucua

SEQ ID NO: 899139 - RNA, 19 nt, Human
caauuuggcagauucuccc

SEQ ID NO: 899140 - RNA, 21 nt, Human
cucugggccauuuucuuccac

SEQ ID NO: 899141 - RNA, 22 nt, Human
uguguauauaugugcacaugua

SEQ ID NO: 899142 - RNA, 22 nt, Human
ucuuucaaagcaaaaugaggcu

SEQ ID NO: 899143 - RNA, 22 nt, Human
uggcuccaugauaguucuuaca

SEQ ID NO: 899144 - RNA, 18 nt, Human
ugggaaugcucaaggccc

SEQ ID NO: 899145 - RNA, 20 nt, Human
cugagccaacucucuucuug

SEQ ID NO: 899146 - RNA, 22 nt, Human
ggcaggagcucagguugguucc

SEQ ID NO: 899147 - RNA, 21 nt, Human
uugauuuagcagaucuagcug

SEQ ID NO: 899148 - RNA, 22 nt, Human
guggaaugaauagauuugcauu

SEQ ID NO: 899149 - RNA, 22 nt, Human
ucccagccuccugacaguuuug

SEQ ID NO: 899150 - RNA, 22 nt, Human
ggcuuucagccaaaggacaacc

SEQ ID NO: 899151 - RNA, 22 nt, Human
caagucaagcaugcccuuauuu

SEQ ID NO: 899152 - RNA, 22 nt, Human
uggcagacuuuagggucuacau

SEQ ID NO: 899153 - RNA, 22 nt, Human
aggaaauaagggacaagacaaa

SEQ ID NO: 899154 - RNA, 22 nt, Human
aaguaaacucaguggucauuca

SEQ ID NO: 899155 - RNA, 22 nt, Human
uagccgggugugguggaacucc

SEQ ID NO: 899156 - RNA, 22 nt, Human
aacugaggaauaacugaguugc

SEQ ID NO: 899157 - RNA, 22 nt, Human
uauuacauccacuuuuauugca

SEQ ID NO: 899158 - RNA, 22 nt, Human
aaaagcuagucaaugauguauu

SEQ ID NO: 899159 - RNA, 22 nt, Human
gcugcagcucgccuuccggccu

SEQ ID NO: 899160 - RNA, 22 nt, Human
ugagccugguugcagugucugg

SEQ ID NO: 899161 - RNA, 21 nt, Human
ucucugugucuuuaagcugga

SEQ ID NO: 899162 - RNA, 22 nt, Human
augauaagccaugucgugguca

SEQ ID NO: 899163 - RNA, 22 nt, Human
cucuuauuccuacaguaacagg

SEQ ID NO: 899164 - RNA, 22 nt, Human
caagauauguguuguuagcucu

SEQ ID NO: 899165 - RNA, 21 nt, Human
uauuucuuugacucucucccu

SEQ ID NO: 899166 - RNA, 22 nt, Human
ugaaaauuguuguacuugauaa

SEQ ID NO: 899167 - RNA, 22 nt, Human
ucguucuugucaguuuauaaag

SEQ ID NO: 899168 - RNA, 22 nt, Human
agugauguugauuuuaccacuu

SEQ ID NO: 899169 - RNA, 21 nt, Human
guacacacagguggaugggcu

SEQ ID NO: 899170 - RNA, 22 nt, Human
ugucugagugauccaguuucuc

SEQ ID NO: 899171 - RNA, 22 nt, Human
aaagcuucuaggccuauugcuu

SEQ ID NO: 899172 - RNA, 22 nt, Human
cagggcagccaggccccguggg

SEQ ID NO: 899173 - RNA, 22 nt, Human
uggcuggagagggucccaugag

SEQ ID NO: 899174 - RNA, 22 nt, Human
ggcacagggggcugaggacuag

SEQ ID NO: 899175 - RNA, 22 nt, Human
agaagggaacucagagaugauu

SEQ ID NO: 899176 - RNA, 22 nt, Human
cuuucccuuagccccauucuau

SEQ ID NO: 899177 - RNA, 22 nt, Human
ccagcagacacacaggcguggg

SEQ ID NO: 899178 - RNA, 22 nt, Human
ccagcagagcauggggaggaag

SEQ ID NO: 899179 - RNA, 22 nt, Human
uuuaauauucugcauucuccuu

SEQ ID NO: 899180 - RNA, 22 nt, Human
uggcagaugugguuugagacag

SEQ ID NO: 899181 - RNA, 22 nt, Human
cccugacuugaucuuugacuug

SEQ ID NO: 899182 - RNA, 22 nt, Human
acaucuagaagaucugggagau

SEQ ID NO: 899183 - RNA, 23 nt, Human
gaggugugaauucugggugcugc

SEQ ID NO: 899184 - RNA, 22 nt, Human
aggagccaugagcaggaggcaa

SEQ ID NO: 899185 - RNA, 22 nt, Human
cuuaguuucuguugcguucugu

SEQ ID NO: 899186 - RNA, 22 nt, Human
gccuggagcuacuggacacuga

SEQ ID NO: 899187 - RNA, 23 nt, Human
agugcaugcuugacuuagcaagc

SEQ ID NO: 899188 - RNA, 22 nt, Human
aggcaguguucuucuaagggca

SEQ ID NO: 899189 - RNA, 22 nt, Human
uuguuaaaaugcauauucuggu

SEQ ID NO: 899190 - RNA, 22 nt, Human
uggcaaggaagagccuggugca

SEQ ID NO: 899191 - RNA, 22 nt, Human
agacagacacaugguaacagau

SEQ ID NO: 899192 - RNA, 22 nt, Human
aagagggagggcaaaggcacug

SEQ ID NO: 899193 - RNA, 22 nt, Human
gauuuacagaucuaagggucac

SEQ ID NO: 899194 - RNA, 22 nt, Human
uuuuaagaugcuaguauuucag

SEQ ID NO: 899195 - RNA, 22 nt, Human
uuugcauuuuagauuuaggccu

SEQ ID NO: 899196 - RNA, 22 nt, Human
uaugacaccauuuuggucagug

SEQ ID NO: 899197 - RNA, 22 nt, Human
ccuguuguuuacugcagugagu

SEQ ID NO: 899198 - RNA, 22 nt, Human
agaaaauaauuucuuggcuggu

SEQ ID NO: 899199 - RNA, 22 nt, Human
ggcuucaggggcccagucagca

SEQ ID NO: 899200 - RNA, 22 nt, Human
uagaaauaaaucugcagcuggg

SEQ ID NO: 899201 - RNA, 22 nt, Human
aaagguuuucaucacagcaaga

SEQ ID NO: 899202 - RNA, 22 nt, Human
cccugugcauuggaggguguuu

SEQ ID NO: 899203 - RNA, 22 nt, Human
cuggaacucaggaugguuagga

SEQ ID NO: 899204 - RNA, 22 nt, Human
cacucucucaggcuuuccuugu

SEQ ID NO: 899205 - RNA, 22 nt, Human
uugcacagaugcacaugguugc

SEQ ID NO: 899206 - RNA, 22 nt, Human
agagcagaggcauggccguggg

SEQ ID NO: 899207 - RNA, 20 nt, Human
ggaggucaaaugaugagaag

SEQ ID NO: 899208 - RNA, 22 nt, Human
cuaacauuuauugagcacuuag

SEQ ID NO: 899209 - RNA, 22 nt, Human
uggaaauuuauucaucauucau

SEQ ID NO: 899210 - RNA, 22 nt, Human
uucaguguggcccaugaagagg

SEQ ID NO: 899211 - RNA, 22 nt, Human
gccugagaaggauaggaagcga

SEQ ID NO: 899212 - RNA, 22 nt, Human
ggcucugggugugaccuugggu

SEQ ID NO: 899213 - RNA, 22 nt, Human
agaauauaguuaccaaauucug

SEQ ID NO: 899214 - RNA, 22 nt, Human
gagccagaaaagcugccugacu

SEQ ID NO: 899215 - RNA, 22 nt, Human
ugcacccucaucagucaaaugg

SEQ ID NO: 899216 - RNA, 22 nt, Human
uuuaucuucugcaguucuggcu

SEQ ID NO: 899217 - RNA, 22 nt, Human
ucagcccugaggacagaggcag

SEQ ID NO: 899218 - RNA, 22 nt, Human
cugcccugagggccuguguguu

SEQ ID NO: 899219 - RNA, 17 nt, Human
cagaaggaagcauggca

SEQ ID NO: 899220 - RNA, 22 nt, Human
cugaggcuucucuaguucagcu

SEQ ID NO: 899221 - RNA, 22 nt, Human
auguguuugguuauaugguauu

SEQ ID NO: 899222 - RNA, 22 nt, Human
uccaucauggcagcagcaguga

SEQ ID NO: 899223 - RNA, 22 nt, Human
ucaguccuccacacaggcaccc

SEQ ID NO: 899224 - RNA, 22 nt, Human
cagcugagaccagaaugcaggu

SEQ ID NO: 899225 - RNA, 22 nt, Human
uucuguuuuagaaauaaguagu

SEQ ID NO: 899226 - RNA, 22 nt, Human
auaaacaucuguuucucuucug

SEQ ID NO: 899227 - RNA, 22 nt, Human
augcguguuuguauacacacaa

SEQ ID NO: 899228 - RNA, 22 nt, Human
aagagcaggcugucaauggggc

SEQ ID NO: 899229 - RNA, 22 nt, Human
agucuucauuuguguucaagac

SEQ ID NO: 899230 - RNA, 21 nt, Human
agggaaagaaaaugagcuaau

SEQ ID NO: 899231 - RNA, 22 nt, Human
gagaggcugauccugcagagaa

SEQ ID NO: 899232 - RNA, 22 nt, Human
auuucuauaggaggacaguauu

SEQ ID NO: 899233 - RNA, 17 nt, Human
uuugauagaaucagagu

SEQ ID NO: 899234 - RNA, 22 nt, Human
uagaaguuaggaaauaggaaua

SEQ ID NO: 899235 - RNA, 22 nt, Human
cuuuacaauucaagggaacucu

SEQ ID NO: 899236 - RNA, 23 nt, Human
uggcuccaggagaagccagaagc

SEQ ID NO: 899237 - RNA, 22 nt, Human
augucugugugaucuuggauaa

SEQ ID NO: 899238 - RNA, 22 nt, Human
acugccuugauucaugcugaug

SEQ ID NO: 899239 - RNA, 22 nt, Human
uaggaaugauaauaguaaagag

SEQ ID NO: 899240 - RNA, 22 nt, Human
aaaguccaauuuuguucaggcu

SEQ ID NO: 899241 - RNA, 18 nt, Human
cucuguguuggugugaag

SEQ ID NO: 899242 - RNA, 22 nt, Human
uuucacagcuggguggcagagu

SEQ ID NO: 899243 - RNA, 22 nt, Human
gcuggcuccaaaagcaggggcu

SEQ ID NO: 899244 - RNA, 22 nt, Human
agcaacuguuacaagaacaaca

SEQ ID NO: 899245 - RNA, 22 nt, Human
ccuugcucaagcuagugacggg

SEQ ID NO: 899246 - RNA, 22 nt, Human
caauguuugugaucuacugacu

SEQ ID NO: 899247 - RNA, 22 nt, Human
uuuacaguuccaugugauaggc

SEQ ID NO: 899248 - RNA, 22 nt, Human
ccucacagggccaggccccuca

SEQ ID NO: 899249 - RNA, 22 nt, Human
uggccugguaccacauagauuu

SEQ ID NO: 899250 - RNA, 22 nt, Human
aaaucuguuucagguauauuug

SEQ ID NO: 899251 - RNA, 22 nt, Human
aggacagcccuugagagcacau

SEQ ID NO: 899252 - RNA, 23 nt, Human
aauucaaauucagugugacuagg

SEQ ID NO: 899253 - RNA, 23 nt, Human
acacauauauucagauacagaug

SEQ ID NO: 899254 - RNA, 22 nt, Human
aggaaagcucccaguagggcuc

SEQ ID NO: 899255 - RNA, 22 nt, Human
gucacacaauaguaaguggucc

SEQ ID NO: 899256 - RNA, 22 nt, Human
auuauuucagucagacacuggc

SEQ ID NO: 899257 - RNA, 22 nt, Human
gaggcugguucugaaguacugu

SEQ ID NO: 899258 - RNA, 22 nt, Human
cccaaggcugcagugagcauga

SEQ ID NO: 899259 - RNA, 21 nt, Human
ggagaaggacaauguugagua

SEQ ID NO: 899260 - RNA, 22 nt, Human
gacaaaacugagaucacacugu

SEQ ID NO: 899261 - RNA, 22 nt, Human
gaccuuuuuacuguguacgcug

SEQ ID NO: 899262 - RNA, 22 nt, Human
agugacuugacacuugugaggg

SEQ ID NO: 899263 - RNA, 20 nt, Human
aguggcugauggaaagaagc

SEQ ID NO: 899264 - RNA, 22 nt, Human
cagcauaggacaggguuucauc

SEQ ID NO: 899265 - RNA, 22 nt, Human
uuugaaaguucuucugacacua

SEQ ID NO: 899266 - RNA, 22 nt, Human
uccauuuucuaaguaucacuua

SEQ ID NO: 899267 - RNA, 22 nt, Human
ccacagcaccgcugccaguccc

SEQ ID NO: 899268 - RNA, 22 nt, Human
cagaguccccagcggcgcgggc

SEQ ID NO: 899269 - RNA, 22 nt, Human
agaaucaggaccuguggcuguc

SEQ ID NO: 899270 - RNA, 22 nt, Human
ugcaaaagaauauagauauugu

SEQ ID NO: 899271 - RNA, 22 nt, Human
aggcuuuaaguggccuacagcu

SEQ ID NO: 899272 - RNA, 22 nt, Human
ucugugugugccuguuaauauu

SEQ ID NO: 899273 - RNA, 22 nt, Human
cugcugugaguuuggaggucua

SEQ ID NO: 899274 - RNA, 22 nt, Human
gcagcauacagggagaguacuc

SEQ ID NO: 899275 - RNA, 22 nt, Human
aucaacagguauggaugagauu

SEQ ID NO: 899276 - RNA, 22 nt, Human
ugagccagccuugcagcugugc

SEQ ID NO: 899277 - RNA, 22 nt, Human
gggcucaggccuggccucucac

SEQ ID NO: 899278 - RNA, 22 nt, Human
ccaggaaagaggaagaacgcau

SEQ ID NO: 899279 - RNA, 22 nt, Human
acccaggcuggagugcaguguc

SEQ ID NO: 899280 - RNA, 22 nt, Human
ggccucugguucacagggagga

SEQ ID NO: 899281 - RNA, 22 nt, Human
aggcagggugaugauaaugauu

SEQ ID NO: 899282 - RNA, 22 nt, Human
aucugaagaaugaauggaauua

SEQ ID NO: 899283 - RNA, 21 nt, Human
uguuccuguucucuaggaucc

SEQ ID NO: 899284 - RNA, 20 nt, Human
ugcugcagacagggccauug

SEQ ID NO: 899285 - RNA, 22 nt, Human
agaaucauuagagagaaaacuu

SEQ ID NO: 899286 - RNA, 22 nt, Human
cauuuacacacagaggugugcu

SEQ ID NO: 899287 - RNA, 22 nt, Human
uuuagaagggcuggucagaaau

SEQ ID NO: 899288 - RNA, 22 nt, Human
acacuuggcucugagucacuac

SEQ ID NO: 899289 - RNA, 22 nt, Human
acccagggaccccgcugacgcc

SEQ ID NO: 899290 - RNA, 22 nt, Human
cacccaggcuggaaugcaaugg

SEQ ID NO: 899291 - RNA, 22 nt, Human
gguauuuacugagagccacucu

SEQ ID NO: 899292 - RNA, 22 nt, Human
ugacagguuguguagguggcca

SEQ ID NO: 899293 - RNA, 22 nt, Human
ucauugaagugacugaaagauu

SEQ ID NO: 899294 - RNA, 18 nt, Human
guucaagccaacaucaag

SEQ ID NO: 899295 - RNA, 22 nt, Human
uuuacagucuauguugaauuaa

SEQ ID NO: 899296 - RNA, 22 nt, Human
auaaauuaggaucugggguucc

SEQ ID NO: 899297 - RNA, 22 nt, Human
gcugggacaacaggugagcacc

SEQ ID NO: 899298 - RNA, 17 nt, Human
auguauauuaacucuga

SEQ ID NO: 899299 - RNA, 22 nt, Human
cagcagcugguugaauccuucu

SEQ ID NO: 899300 - RNA, 22 nt, Human
cugcucugacccuuucaccuuc

SEQ ID NO: 899301 - RNA, 22 nt, Human
gcucuguccagcgugcacagaa

SEQ ID NO: 899302 - RNA, 22 nt, Human
uggcugagagaagacggggaag

SEQ ID NO: 899303 - RNA, 22 nt, Human
uuauauaacucaggugggcuca

SEQ ID NO: 899304 - RNA, 22 nt, Human
ucaggcaggaucccagggaagg

SEQ ID NO: 899305 - RNA, 22 nt, Human
gaauuuuucuggaagcaauuau

SEQ ID NO: 899306 - RNA, 22 nt, Human
uuuaugacccaagaagauacca

SEQ ID NO: 899307 - RNA, 20 nt, Human
ccugucuccucuuaccuggc

SEQ ID NO: 899308 - RNA, 22 nt, Human
acagaaauauagaagguaggaa

SEQ ID NO: 899309 - RNA, 22 nt, Human
aauguccuaggcaugauuuugu

SEQ ID NO: 899310 - RNA, 22 nt, Human
caugcuggucagccaguggaug

SEQ ID NO: 899311 - RNA, 22 nt, Human
ccaggaagguguuuaacuagag

SEQ ID NO: 899312 - RNA, 22 nt, Human
ggcuccucucuggccgcucccg

SEQ ID NO: 899313 - RNA, 22 nt, Human
uuauuugaaaagaagguuacgu

SEQ ID NO: 899314 - RNA, 22 nt, Human
ggagaguggauuccagcuguau

SEQ ID NO: 899315 - RNA, 22 nt, Human
cagauggaggauaaaacaugca

SEQ ID NO: 899316 - RNA, 22 nt, Human
uucucugcucucacauacagaa

SEQ ID NO: 899317 - RNA, 22 nt, Human
cuuccugguuugaagcucgccg

SEQ ID NO: 899318 - RNA, 22 nt, Human
ccagugcucauucaaguccuua

SEQ ID NO: 899319 - RNA, 22 nt, Human
gagagcugggaaagccguggag

SEQ ID NO: 899320 - RNA, 22 nt, Human
guuauguauugggaaauccaag

SEQ ID NO: 899321 - RNA, 22 nt, Human
ugccaggcugucaauucaccca

SEQ ID NO: 899322 - RNA, 21 nt, Human
aucugaaagguuaguguugag

SEQ ID NO: 899323 - RNA, 23 nt, Human
uggagcugacagucagagggagg

SEQ ID NO: 899324 - RNA, 18 nt, Human
aggagaaagggaccaggg

SEQ ID NO: 899325 - RNA, 22 nt, Human
aaauauacggucccuaacaguc

SEQ ID NO: 899326 - RNA, 22 nt, Human
uggcagguuucguuaaaaaugg

SEQ ID NO: 899327 - RNA, 22 nt, Human
cuggagccccaggcugugcaga

SEQ ID NO: 899328 - RNA, 22 nt, Human
acucuuauucccucagaaauau

SEQ ID NO: 899329 - RNA, 22 nt, Human
cggcagggcuccaugcauuucu

SEQ ID NO: 899330 - RNA, 22 nt, Human
gagcaucuggcuagaggaguga

SEQ ID NO: 899331 - RNA, 22 nt, Human
acauagaguucaauuuucaguc

SEQ ID NO: 899332 - RNA, 22 nt, Human
gccaagaguuuccagcugcaag

SEQ ID NO: 899333 - RNA, 22 nt, Human
ugcagggucucugcaaaugagg

SEQ ID NO: 899334 - RNA, 22 nt, Human
agcagcugguucccgagggcgu

SEQ ID NO: 899335 - RNA, 21 nt, Human
cuguggaagggaacuagaggg

SEQ ID NO: 899336 - RNA, 22 nt, Human
agaaccuugaucuuggacuucu

SEQ ID NO: 899337 - RNA, 22 nt, Human
ccagucugugugccagccugcg

SEQ ID NO: 899338 - RNA, 21 nt, Human
aacugcaaaucuuagacugca

SEQ ID NO: 899339 - RNA, 19 nt, Human
gaagaaguuggaggaucuc

SEQ ID NO: 899340 - RNA, 22 nt, Human
uacagccaugguuaauuuaccu

SEQ ID NO: 899341 - RNA, 22 nt, Human
aggcccagugccauuaguuuug

SEQ ID NO: 899342 - RNA, 22 nt, Human
ccugugaaugcauuaaugagug

SEQ ID NO: 899343 - RNA, 22 nt, Human
agaguggcagcaagucagguag

SEQ ID NO: 899344 - RNA, 22 nt, Human
agccccugcuggguguagcuca

SEQ ID NO: 899345 - RNA, 22 nt, Human
gucucagaguccuacuuauucc

SEQ ID NO: 899346 - RNA, 22 nt, Human
ccagaggacuugggggcugaau

SEQ ID NO: 899347 - RNA, 22 nt, Human
acagagauguggaugagggauu

SEQ ID NO: 899348 - RNA, 22 nt, Human
uacaagaaacuacaugaaugca

SEQ ID NO: 899349 - RNA, 22 nt, Human
uccagggcagccgcgggugcgc

SEQ ID NO: 899350 - RNA, 22 nt, Human
aguuuucugauguguagugaga

SEQ ID NO: 899351 - RNA, 22 nt, Human
agcugugcugccaaguugcuga

SEQ ID NO: 899352 - RNA, 22 nt, Human
caaugaaauugagauccagaga

SEQ ID NO: 899353 - RNA, 21 nt, Human
uuucuaagugcuugguuuggg

SEQ ID NO: 899354 - RNA, 20 nt, Human
ucauggcagccacccacagg

SEQ ID NO: 899355 - RNA, 22 nt, Human
caugcacacugcaacaaggacu

SEQ ID NO: 899356 - RNA, 22 nt, Human
ucucugugagccagguccuagu

SEQ ID NO: 899357 - RNA, 22 nt, Human
uggucucuacggaggaaagcug

SEQ ID NO: 899358 - RNA, 22 nt, Human
aucuuagagagucguguuuugu

SEQ ID NO: 899359 - RNA, 22 nt, Human
ggcaggcauugcaacauguaca

SEQ ID NO: 899360 - RNA, 22 nt, Human
aaauaugacuagaaugccaggu

SEQ ID NO: 899361 - RNA, 22 nt, Human
gagcccaggaaguggaggcuga

SEQ ID NO: 899362 - RNA, 22 nt, Human
ugaggggauacgguacacauug

SEQ ID NO: 899363 - RNA, 22 nt, Human
aaacugaggcucccgagggugu

SEQ ID NO: 899364 - RNA, 22 nt, Human
gcuuuauggauuguaaacugca

SEQ ID NO: 899365 - RNA, 22 nt, Human
uaauuuugucacagugacaugc

SEQ ID NO: 899366 - RNA, 22 nt, Human
acgcaugguaaauccacugacu

SEQ ID NO: 899367 - RNA, 22 nt, Human
aacauacuuguacuaugcauau

SEQ ID NO: 899368 - RNA, 22 nt, Human
uacaggaagcacucaagaaaug

SEQ ID NO: 899369 - RNA, 22 nt, Human
ucacacagugagaaagugcgga

SEQ ID NO: 899370 - RNA, 17 nt, Human
aggagcuggggguggug

SEQ ID NO: 899371 - RNA, 22 nt, Human
uuguauuuuguuaugcuacugc

SEQ ID NO: 899372 - RNA, 22 nt, Human
acuuuacaagcuuauagccuag

SEQ ID NO: 899373 - RNA, 22 nt, Human
ggcauuuacauaaucuuauuua

SEQ ID NO: 899374 - RNA, 22 nt, Human
cagggagggacaauugucaccu

SEQ ID NO: 899375 - RNA, 22 nt, Human
gcggggggcagcagucgcucag

SEQ ID NO: 899376 - RNA, 22 nt, Human
gcuucucucaggagcaucagcc

SEQ ID NO: 899377 - RNA, 19 nt, Human
cccuggggguuucugguac

SEQ ID NO: 899378 - RNA, 20 nt, Human
ucuucagaugcuuuuggagu

SEQ ID NO: 899379 - RNA, 22 nt, Human
agaggccucuagggccccucag

SEQ ID NO: 899380 - RNA, 22 nt, Human
gacauugaacaaguuuccugac

SEQ ID NO: 899381 - RNA, 21 nt, Human
agcagaggcagaauguaugca

SEQ ID NO: 899382 - RNA, 22 nt, Human
auucacacuguauacacaggau

SEQ ID NO: 899383 - RNA, 22 nt, Human
aaugccucuuggaagaagacuu

SEQ ID NO: 899384 - RNA, 22 nt, Human
cucacacacgaagcccuuggcc

SEQ ID NO: 899385 - RNA, 22 nt, Human
ugugauuauauuguaguacauu

SEQ ID NO: 899386 - RNA, 22 nt, Human
cuggaaugcugguaaaauagca

SEQ ID NO: 899387 - RNA, 22 nt, Human
augguugaagaccaguggaaaa

SEQ ID NO: 899388 - RNA, 23 nt, Human
uaucagugugaugaggcugcugc

SEQ ID NO: 899389 - RNA, 22 nt, Human
gccagcaacuaggagcugaauu

SEQ ID NO: 899390 - RNA, 22 nt, Human
uacaaguauauucuagugauau

SEQ ID NO: 899391 - RNA, 22 nt, Human
auacauaggagaauaacuucag

SEQ ID NO: 899392 - RNA, 22 nt, Human
ggaccaggagcucagagcccuc

SEQ ID NO: 899393 - RNA, 22 nt, Human
uuaacagcuuugggucugauau

SEQ ID NO: 899394 - RNA, 22 nt, Human
ugcagcagagugggccugggug

SEQ ID NO: 899395 - RNA, 22 nt, Human
agccuggcuguaaccucauggu

SEQ ID NO: 899396 - RNA, 22 nt, Human
aguuacaaccaugacacaagca

SEQ ID NO: 899397 - RNA, 22 nt, Human
agaauucuccacgcucaggguc

SEQ ID NO: 899398 - RNA, 22 nt, Human
ugguaaggcccagcuggagucc

SEQ ID NO: 899399 - RNA, 22 nt, Human
auagcaaaggacaauagucagu

SEQ ID NO: 899400 - RNA, 22 nt, Human
ugggcugcacugcucuuuaucg

SEQ ID NO: 899401 - RNA, 22 nt, Human
aucagcaucuuuaacaauuacc

SEQ ID NO: 899402 - RNA, 22 nt, Human
aggcugaggaucccuguguucu

SEQ ID NO: 899403 - RNA, 22 nt, Human
aggcaagcugcagagaguccuu

SEQ ID NO: 899404 - RNA, 22 nt, Human
agcagccacagcagaucugagu

SEQ ID NO: 899405 - RNA, 20 nt, Human
cagguguacagugagcugag

SEQ ID NO: 899406 - RNA, 22 nt, Human
ucaggcagugguaaaugaguua

SEQ ID NO: 899407 - RNA, 22 nt, Human
uugcagcuguugcaaagucucu

SEQ ID NO: 899408 - RNA, 22 nt, Human
gcaagugauugucacgucccuu

SEQ ID NO: 899409 - RNA, 22 nt, Human
uucuugauuucaugcaguuaag

SEQ ID NO: 899410 - RNA, 22 nt, Human
agcugaggccugauuucgccgu

SEQ ID NO: 899411 - RNA, 22 nt, Human
gugauccuauaaagugagcaca

SEQ ID NO: 899412 - RNA, 21 nt, Human
acccuggguucuccauacccu

SEQ ID NO: 899413 - RNA, 22 nt, Human
ugcuuugaaagauaauacuguc

SEQ ID NO: 899414 - RNA, 22 nt, Human
uaaacaagcugucugauauucu

SEQ ID NO: 899415 - RNA, 22 nt, Human
ucuggccccggucuucacagcu

SEQ ID NO: 899416 - RNA, 22 nt, Human
ucucugcccaaguuucucaagu

SEQ ID NO: 899417 - RNA, 22 nt, Human
gagacugcugguaaagauggga

SEQ ID NO: 899418 - RNA, 22 nt, Human
uggggugccgacagggagggca

SEQ ID NO: 899419 - RNA, 22 nt, Human
agccucugguccucccucagcu

SEQ ID NO: 899420 - RNA, 22 nt, Human
cacagcugcccuacuccaugug

SEQ ID NO: 899421 - RNA, 22 nt, Human
ggcaugggguguauguggcacg

SEQ ID NO: 899422 - RNA, 22 nt, Human
agcugugggauuugggugugcc

SEQ ID NO: 899423 - RNA, 22 nt, Human
caaacugagcaucagaaaguuu

SEQ ID NO: 899424 - RNA, 22 nt, Human
cagggcuucgauggauggaugg

SEQ ID NO: 899425 - RNA, 22 nt, Human
acugugccacaauucaccaggg

SEQ ID NO: 899426 - RNA, 22 nt, Human
cugggagauaugaggaucugga

SEQ ID NO: 899427 - RNA, 22 nt, Human
acuccagggugacucugucuga

SEQ ID NO: 899428 - RNA, 21 nt, Human
aguggggucucuguggaggcc

SEQ ID NO: 899429 - RNA, 22 nt, Human
uaccugcacagccagccaugug

SEQ ID NO: 899430 - RNA, 22 nt, Human
uggcagagcaaaaagauagaau

SEQ ID NO: 899431 - RNA, 17 nt, Human
aagauuucauuagcuga

SEQ ID NO: 899432 - RNA, 22 nt, Human
agauacaaaggccuacagagca

SEQ ID NO: 899433 - RNA, 22 nt, Human
ggaagcaggaggcugggguaaa

SEQ ID NO: 899434 - RNA, 20 nt, Human
cacagaacaaauugcaggac

SEQ ID NO: 899435 - RNA, 20 nt, Human
agcuccagugcugacgcuuc

SEQ ID NO: 899436 - RNA, 21 nt, Human
aggaggagagcuuggccuacc

SEQ ID NO: 899437 - RNA, 22 nt, Human
uccugcagguggaugauucucu

SEQ ID NO: 899438 - RNA, 20 nt, Human
agguaaugggagaaaauguu

SEQ ID NO: 899439 - RNA, 22 nt, Human
aauaacuugaagaucucuucca

SEQ ID NO: 899440 - RNA, 22 nt, Human
uugcaguugcuguauuuaagga

SEQ ID NO: 899441 - RNA, 22 nt, Human
ucaccaguuaaaauaacaguaa

SEQ ID NO: 899442 - RNA, 22 nt, Human
gugcagauccugauugcaguuc

SEQ ID NO: 899443 - RNA, 22 nt, Human
auuggucugugagcuguugaca

SEQ ID NO: 899444 - RNA, 22 nt, Human
ugucuccucuguccugucagga

SEQ ID NO: 899445 - RNA, 19 nt, Human
ucaggcaguuauucacaaa

SEQ ID NO: 899446 - RNA, 22 nt, Human
gucacuuuuaagggccuuuucu

SEQ ID NO: 899447 - RNA, 22 nt, Human
agugucuguugaguuucaaaag

SEQ ID NO: 899448 - RNA, 22 nt, Human
gaggccuggcugggaggaggug

SEQ ID NO: 899449 - RNA, 22 nt, Human
uguauuuguuguuaaauggaga

SEQ ID NO: 899450 - RNA, 22 nt, Human
uucugggcucccacauauuuca

SEQ ID NO: 899451 - RNA, 22 nt, Human
caguugcacuagccacauuuca

SEQ ID NO: 899452 - RNA, 22 nt, Human
aaggaagaaucaucacguuggg

SEQ ID NO: 899453 - RNA, 22 nt, Human
caggaacagcaccaggagcuag

SEQ ID NO: 899454 - RNA, 22 nt, Human
uggcucagauuuuuguaggcuu

SEQ ID NO: 899455 - RNA, 22 nt, Human
ggaagaggcugagccagguccc

SEQ ID NO: 899456 - RNA, 22 nt, Human
agcagcagcucauucuuccugu

SEQ ID NO: 899457 - RNA, 22 nt, Human
agagacugcaaaucauaagaau

SEQ ID NO: 899458 - RNA, 21 nt, Human
gcucagcugcuugguuccugu

SEQ ID NO: 899459 - RNA, 22 nt, Human
cugccuguggucugugaucuaa

SEQ ID NO: 899460 - RNA, 22 nt, Human
gaggccaggagugcuguaaguu

SEQ ID NO: 899461 - RNA, 22 nt, Human
gcuggggugugguggauaagcu

SEQ ID NO: 899462 - RNA, 22 nt, Human
gcucaggccucggacacacaau

SEQ ID NO: 899463 - RNA, 22 nt, Human
gaggagcuugaggcuaggagcc

SEQ ID NO: 899464 - RNA, 22 nt, Human
ccuuggugcucugcugggaugg

SEQ ID NO: 899465 - RNA, 22 nt, Human
aucagcaaguccuguuaauucu

SEQ ID NO: 899466 - RNA, 22 nt, Human
agcugccuucccucucauuagg

SEQ ID NO: 899467 - RNA, 23 nt, Human
auguaucucauccaaggaagcuc

SEQ ID NO: 899468 - RNA, 21 nt, Human
gagauuuagaaggaucaauuu

SEQ ID NO: 899469 - RNA, 22 nt, Human
uuuucauggccaccgcaaguga

SEQ ID NO: 899470 - RNA, 22 nt, Human
ucauuucagaugcauuuagaau

SEQ ID NO: 899471 - RNA, 20 nt, Human
cccaaagcuucauaugagcc

SEQ ID NO: 899472 - RNA, 20 nt, Human
gcacaucugcuuuggauuuc

SEQ ID NO: 899473 - RNA, 20 nt, Human
aacugagaguucaggaggag

SEQ ID NO: 899474 - RNA, 22 nt, Human
ccuagaggcugcaaggagaggc

SEQ ID NO: 899475 - RNA, 22 nt, Human
uugcagggaaacaguuuaggaa

SEQ ID NO: 899476 - RNA, 22 nt, Human
agaauccuugacucaggcugag

SEQ ID NO: 899477 - RNA, 22 nt, Human
ugucagaugugucuccaagugc

SEQ ID NO: 899478 - RNA, 23 nt, Human
uucaaagaucuucugaaaucugu

SEQ ID NO: 899479 - RNA, 22 nt, Human
uuaucauaaguaauugaaauaa

SEQ ID NO: 899480 - RNA, 22 nt, Human
caacugaggucucagccaauua

SEQ ID NO: 899481 - RNA, 22 nt, Human
gggcuccaacuacaucagccuu

SEQ ID NO: 899482 - RNA, 22 nt, Human
gcagccuccgcacugcgagucc

SEQ ID NO: 899483 - RNA, 22 nt, Human
ugaggggaaggcaugauaaaua

SEQ ID NO: 899484 - RNA, 17 nt, Human
aagacagaagccaugag

SEQ ID NO: 899485 - RNA, 22 nt, Human
auugcuuaucuaucuuuaaguc

SEQ ID NO: 899486 - RNA, 22 nt, Human
uggcaggagacacauggcauag

SEQ ID NO: 899487 - RNA, 22 nt, Human
uaugcuuugaaaaugugcugaa

SEQ ID NO: 899488 - RNA, 21 nt, Human
ucaugugcugaggaugaugcc

SEQ ID NO: 899489 - RNA, 22 nt, Human
gaaagcugggaaauaaauauua

SEQ ID NO: 899490 - RNA, 22 nt, Human
uggcccugcuuaugucucucuu

SEQ ID NO: 899491 - RNA, 22 nt, Human
acauguguaagaugugauauau

SEQ ID NO: 899492 - RNA, 22 nt, Human
gcagggggauggaguugaaaug

SEQ ID NO: 899493 - RNA, 22 nt, Human
gaauacauguguguauagaggu

SEQ ID NO: 899494 - RNA, 22 nt, Human
aaugucuagacauguuaaugca

SEQ ID NO: 899495 - RNA, 22 nt, Human
cuggaagggagcacuguagaga

SEQ ID NO: 899496 - RNA, 22 nt, Human
agcuccuguggcagcucuucug

SEQ ID NO: 899497 - RNA, 22 nt, Human
aggcugcagugcagguaggauu

SEQ ID NO: 899498 - RNA, 22 nt, Human
ugauucaagccaccacauacug

SEQ ID NO: 899499 - RNA, 22 nt, Human
cugaaaaacgggauuuggcugg

SEQ ID NO: 899500 - RNA, 22 nt, Human
aauguguagauguugcauuccu

SEQ ID NO: 899501 - RNA, 22 nt, Human
ucuggcucuauaacuccuagcu

SEQ ID NO: 899502 - RNA, 22 nt, Human
uuuguucagcucucauugauua

SEQ ID NO: 899503 - RNA, 22 nt, Human
cuguacucaagguaaaccagga

SEQ ID NO: 899504 - RNA, 22 nt, Human
ugcacacauucuauggggcuga

SEQ ID NO: 899505 - RNA, 22 nt, Human
ugauucucaaagguagacuggg

SEQ ID NO: 899506 - RNA, 22 nt, Human
ccagaggcuggcaagggcuccu

SEQ ID NO: 899507 - RNA, 22 nt, Human
ucacacagguuugcaaugauuu

SEQ ID NO: 899508 - RNA, 22 nt, Human
cucugugcucccaugcuaguaa

SEQ ID NO: 899509 - RNA, 19 nt, Human
cccaggcuacauggagagg

SEQ ID NO: 899510 - RNA, 22 nt, Human
gucuggcuagagacacccuccc

SEQ ID NO: 899511 - RNA, 21 nt, Human
auacaagaagauggcagucug

SEQ ID NO: 899512 - RNA, 22 nt, Human
auggcccaggccuccuguggcu

SEQ ID NO: 899513 - RNA, 22 nt, Human
uggguccacuucugcacugugg

SEQ ID NO: 899514 - RNA, 21 nt, Human
accaggcuugugggagggagc

SEQ ID NO: 899515 - RNA, 22 nt, Human
auacaugugugagcgaagaugu

SEQ ID NO: 899516 - RNA, 22 nt, Human
uucugaggaggagcaaaaacuc

SEQ ID NO: 899517 - RNA, 22 nt, Human
ggcaccucugggcucuguuagg

SEQ ID NO: 899518 - RNA, 19 nt, Human
uguucuagcggcaccaggc

SEQ ID NO: 899519 - RNA, 22 nt, Human
gacuccagguguccaggccucc

SEQ ID NO: 899520 - RNA, 23 nt, Human
ugucuggggcgccagaagagaga

SEQ ID NO: 899521 - RNA, 22 nt, Human
auguccagaguaaagcacauuc

SEQ ID NO: 899522 - RNA, 22 nt, Human
caauguuugaguaggagcauaa

SEQ ID NO: 899523 - RNA, 17 nt, Human
aggcuggcucacaggga

SEQ ID NO: 899524 - RNA, 16 nt, Human
auucacaaggcaucgg

SEQ ID NO: 899525 - RNA, 21 nt, Human
augcauauuuuaaguuguguc

SEQ ID NO: 899526 - RNA, 22 nt, Human
guguuuccccuccuggagaagg

SEQ ID NO: 899527 - RNA, 22 nt, Human
augaaguucuagugagaaaugc

SEQ ID NO: 899528 - RNA, 22 nt, Human
guauuguagcuacaauagacgu

SEQ ID NO: 899529 - RNA, 22 nt, Human
ucaaaaauggucuuugagcugc

SEQ ID NO: 899530 - RNA, 23 nt, Human
ugggaccuguuugcccacagaug

SEQ ID NO: 899531 - RNA, 23 nt, Human
uggucucacuugguaagaugaag

SEQ ID NO: 899532 - RNA, 22 nt, Human
ggaagaggcugaggccaugcug

SEQ ID NO: 899533 - RNA, 22 nt, Human
ucuuugcugaguacaucuccaa

SEQ ID NO: 899534 - RNA, 22 nt, Human
ugucauauccuccuuaaaggug

SEQ ID NO: 899535 - RNA, 20 nt, Human
ggacagugagacauaucuca

SEQ ID NO: 899536 - RNA, 22 nt, Human
gcggcaggaagagcgcagcccc

SEQ ID NO: 899537 - RNA, 22 nt, Human
uguauauguguauuuuaugaca

SEQ ID NO: 899538 - RNA, 22 nt, Human
uuaauaacauuguguaucaccc

SEQ ID NO: 899539 - RNA, 23 nt, Human
cccagcagauuguaaagugucca

SEQ ID NO: 899540 - RNA, 23 nt, Human
gcaguguuugcuucaucuuaucc

SEQ ID NO: 899541 - RNA, 22 nt, Human
ugaugacaugugggcuguggcu

SEQ ID NO: 899542 - RNA, 22 nt, Human
auguccagggcuuuagcggggc

SEQ ID NO: 899543 - RNA, 22 nt, Human
ucaggaaggcaaauugcaugau

SEQ ID NO: 899544 - RNA, 22 nt, Human
ccuggcucgcugaccucagggg

SEQ ID NO: 899545 - RNA, 22 nt, Human
ggccccugcggacugccuagag

SEQ ID NO: 899546 - RNA, 22 nt, Human
uucugcagcccaacaguaguuu

SEQ ID NO: 899547 - RNA, 22 nt, Human
gugaggaugcagaugagggccu

SEQ ID NO: 899548 - RNA, 22 nt, Human
uggggaagacagcagacacugu

SEQ ID NO: 899549 - RNA, 22 nt, Human
uccaggagaaaacugacggugg

SEQ ID NO: 899550 - RNA, 22 nt, Human
uuucagugcuucuguuuaccgg

SEQ ID NO: 899551 - RNA, 22 nt, Human
ugacaacaucauuuuugugugg

SEQ ID NO: 899552 - RNA, 22 nt, Human
gccuggaggggccaggguggua

SEQ ID NO: 899553 - RNA, 23 nt, Human
gacagagugagaccuugucuuac

SEQ ID NO: 899554 - RNA, 22 nt, Human
ugcaaaaugacuucugaaaaga

SEQ ID NO: 899555 - RNA, 22 nt, Human
ugucauuuucauccuaaggagc

SEQ ID NO: 899556 - RNA, 22 nt, Human
agacagggucuugaucagagcu

SEQ ID NO: 899557 - RNA, 22 nt, Human
ccaaggugggcagaucacgagg

SEQ ID NO: 899558 - RNA, 22 nt, Human
cugagccaugggucuaagcacu

SEQ ID NO: 899559 - RNA, 22 nt, Human
cucugaaaguuagagaaaauag

SEQ ID NO: 899560 - RNA, 22 nt, Human
uuaaagcugagcccucagaagc

SEQ ID NO: 899561 - RNA, 22 nt, Human
cagcagaaaaugugggugauuu

SEQ ID NO: 899562 - RNA, 22 nt, Human
cugucccaggagcuguaagaca

SEQ ID NO: 899563 - RNA, 22 nt, Human
cagugccucuuaagugucaccc

SEQ ID NO: 899564 - RNA, 22 nt, Human
aaggcacaacacaagaggguga

SEQ ID NO: 899565 - RNA, 22 nt, Human
acauucuuucgaugucugauuu

SEQ ID NO: 899566 - RNA, 22 nt, Human
gauauaaauuaaucaagugcaa

SEQ ID NO: 899567 - RNA, 22 nt, Human
cagaggcauauaauugcugggg

SEQ ID NO: 899568 - RNA, 22 nt, Human
cugggaggcagucucucuagaa

SEQ ID NO: 899569 - RNA, 22 nt, Human
gggcugccugagcaucuccucc

SEQ ID NO: 899570 - RNA, 22 nt, Human
uuggaaaaacacgauagugguu

SEQ ID NO: 899571 - RNA, 22 nt, Human
cugugcaguaggucagggcugg

SEQ ID NO: 899572 - RNA, 22 nt, Human
acagugcuaucaauagcuagaa

SEQ ID NO: 899573 - RNA, 22 nt, Human
uuuacaccauuagaagcuacuu

SEQ ID NO: 899574 - RNA, 22 nt, Human
aaauguuuaaguguaggagcaa

SEQ ID NO: 899575 - RNA, 22 nt, Human
ugauucuagguccauuauuugc

SEQ ID NO: 899576 - RNA, 22 nt, Human
uagcugaugaauaauuauucuu

SEQ ID NO: 899577 - RNA, 22 nt, Human
uagcauuuuagcuguuuucucu

SEQ ID NO: 899578 - RNA, 23 nt, Human
ggcuggugcccuuggccagucgg

SEQ ID NO: 899579 - RNA, 22 nt, Human
ucugagccaauuucugugucca

SEQ ID NO: 899580 - RNA, 23 nt, Human
ucacacagcuggucagguacaga

SEQ ID NO: 899581 - RNA, 22 nt, Human
auuggucauaaauugagugauu

SEQ ID NO: 899582 - RNA, 22 nt, Human
uuuuaugugugaaaugcugucu

SEQ ID NO: 899583 - RNA, 22 nt, Human
gaggucaggggagaggcugaug

SEQ ID NO: 899584 - RNA, 22 nt, Human
ccuguccagggacugagggaga

SEQ ID NO: 899585 - RNA, 20 nt, Human
aguguacagacacuagaaau

SEQ ID NO: 899586 - RNA, 22 nt, Human
gcuggacuuagagguggaaaag

SEQ ID NO: 899587 - RNA, 22 nt, Human
ugugaggccuagacagccuggg

SEQ ID NO: 899588 - RNA, 23 nt, Human
aaauccugccucuuguauuuauc

SEQ ID NO: 899589 - RNA, 22 nt, Human
cuauuagcugaauaaugcauug

SEQ ID NO: 899590 - RNA, 23 nt, Human
uggcaucuuggcaucuugcugcu

SEQ ID NO: 899591 - RNA, 22 nt, Human
aggcugaggaucguacuuucca

SEQ ID NO: 899592 - RNA, 22 nt, Human
agccugggaauuuagaguucgg

SEQ ID NO: 899593 - RNA, 22 nt, Human
ugcagggccgcuggaggucaug

SEQ ID NO: 899594 - RNA, 22 nt, Human
agccaggauggucucgaucggc

SEQ ID NO: 899595 - RNA, 22 nt, Human
acagagaccuggccuugcuuug

SEQ ID NO: 899596 - RNA, 22 nt, Human
acugucaucuuguaagcaaugu

SEQ ID NO: 899597 - RNA, 23 nt, Human
aggcugcagaagaauagggucau

SEQ ID NO: 899598 - RNA, 21 nt, Human
gaacccagcagcagugcucug

SEQ ID NO: 899599 - RNA, 22 nt, Human
gggcgccgugggaaacagccgg

SEQ ID NO: 899600 - RNA, 22 nt, Human
uguguucaagauuaguucuagu

SEQ ID NO: 899601 - RNA, 22 nt, Human
ucagaggagcaaaagaggggau

SEQ ID NO: 899602 - RNA, 22 nt, Human
aauaggaagucacaucaaggga

SEQ ID NO: 899603 - RNA, 22 nt, Human
agaggcugagaaacccucuucu

SEQ ID NO: 899604 - RNA, 22 nt, Human
caccugcucccucaguuccagc

SEQ ID NO: 899605 - RNA, 22 nt, Human
acauauguuguaaacauuccaa

SEQ ID NO: 899606 - RNA, 22 nt, Human
cuagaaacgccuuuagcacaac

SEQ ID NO: 899607 - RNA, 22 nt, Human
guucucuggagucccugggccc

SEQ ID NO: 899608 - RNA, 22 nt, Human
cuaucuuucgauucuagcuuaa

SEQ ID NO: 899609 - RNA, 22 nt, Human
aggagggugggaagcaguuuua

SEQ ID NO: 899610 - RNA, 22 nt, Human
aaacucaaagucagaucagaga

SEQ ID NO: 899611 - RNA, 22 nt, Human
ugguaaaguugauuggugcucu

SEQ ID NO: 899612 - RNA, 22 nt, Human
ccaaggaguagagcaggaagcu

SEQ ID NO: 899613 - RNA, 22 nt, Human
aggagacagccaggggccugag

SEQ ID NO: 899614 - RNA, 22 nt, Human
ugcgauguaugcaguauuuguu

SEQ ID NO: 899615 - RNA, 22 nt, Human
agagcuggcugguagcccugau

SEQ ID NO: 899616 - RNA, 22 nt, Human
uagcaccacaaucaagauacag

SEQ ID NO: 899617 - RNA, 22 nt, Human
agugucugcuuugagucaggug

SEQ ID NO: 899618 - RNA, 21 nt, Human
uccagcucucauaguguucca

SEQ ID NO: 899619 - RNA, 22 nt, Human
gagcugaguguccuaggcaugg

SEQ ID NO: 899620 - RNA, 22 nt, Human
ggugguggucccgacuugggag

SEQ ID NO: 899621 - RNA, 22 nt, Human
uggaaauuaacuugguacauau

SEQ ID NO: 899622 - RNA, 22 nt, Human
agaagcagggcagggaaaagca

SEQ ID NO: 899623 - RNA, 22 nt, Human
gaggagaaugcgcaccacauau

SEQ ID NO: 899624 - RNA, 22 nt, Human
uugugucugggggagugacauc

SEQ ID NO: 899625 - RNA, 22 nt, Human
ucagaaccagcccagcagauga

SEQ ID NO: 899626 - RNA, 22 nt, Human
ugcuuuauggauuuguguccug

SEQ ID NO: 899627 - RNA, 22 nt, Human
aucugaaacucugacauugucu

SEQ ID NO: 899628 - RNA, 22 nt, Human
cauguacacacaaagggacaau

SEQ ID NO: 899629 - RNA, 22 nt, Human
gguggcacacuggggagcucgg

SEQ ID NO: 899630 - RNA, 22 nt, Human
aaucugcacccacugaaaaugc

SEQ ID NO: 899631 - RNA, 22 nt, Human
aguaauaauaguagccggcauu

SEQ ID NO: 899632 - RNA, 22 nt, Human
uuuguagagaauguuaagcacu

SEQ ID NO: 899633 - RNA, 22 nt, Human
agagcacaugguuccugugucc

SEQ ID NO: 899634 - RNA, 22 nt, Human
cugagcgcaugguugcugggga

SEQ ID NO: 899635 - RNA, 22 nt, Human
cagcccugagagaaccaucuau

SEQ ID NO: 899636 - RNA, 22 nt, Human
uugaaacauuaccuguauuucc

SEQ ID NO: 899637 - RNA, 22 nt, Human
uccuuuguucgggugugcuguc

SEQ ID NO: 899638 - RNA, 22 nt, Human
aguguauuaaguuaugaaguua

SEQ ID NO: 899639 - RNA, 22 nt, Human
aucaaugcucuguacccagaau

SEQ ID NO: 899640 - RNA, 22 nt, Human
cugccugugccaccgccucauu

SEQ ID NO: 899641 - RNA, 22 nt, Human
gcuuggcaggucugggauuguu

SEQ ID NO: 899642 - RNA, 23 nt, Human
cuucucagaagucugugccagga

SEQ ID NO: 899643 - RNA, 22 nt, Human
auauguuuuucacagguuuaag

SEQ ID NO: 899644 - RNA, 22 nt, Human
aucuugcugcuacaaagugccc

SEQ ID NO: 899645 - RNA, 22 nt, Human
uacguguguucguguaagcacu

SEQ ID NO: 899646 - RNA, 22 nt, Human
agcagagcccuuccauggccuu

SEQ ID NO: 899647 - RNA, 22 nt, Human
cccaggcagugugugcaugcgu

SEQ ID NO: 899648 - RNA, 22 nt, Human
acaugacuauaauuacuuaaau

SEQ ID NO: 899649 - RNA, 20 nt, Human
aaugggcuuugaugagugug

SEQ ID NO: 899650 - RNA, 21 nt, Human
gucaggcccauagcagugccu

SEQ ID NO: 899651 - RNA, 22 nt, Human
ugcugccuccuuccugccagga

SEQ ID NO: 899652 - RNA, 19 nt, Human
gcagguagagacagcagcc

SEQ ID NO: 899653 - RNA, 22 nt, Human
uccuggccgcuggccccugaga

SEQ ID NO: 899654 - RNA, 22 nt, Human
ucauuugugcaauguagaugaa

SEQ ID NO: 899655 - RNA, 22 nt, Human
cucugggaaagauugugcaggc

SEQ ID NO: 899656 - RNA, 22 nt, Human
gcccuugacaguggcagaagca

SEQ ID NO: 899657 - RNA, 22 nt, Human
uacucccaccauggcugauuuc

SEQ ID NO: 899658 - RNA, 22 nt, Human
ccaggagggugguuacucaauc

SEQ ID NO: 899659 - RNA, 22 nt, Human
ugucaggugacacacuaggagc

SEQ ID NO: 899660 - RNA, 22 nt, Human
cagggcucaucugugugaccag

SEQ ID NO: 899661 - RNA, 22 nt, Human
ugucucugguauuaggugaaaa

SEQ ID NO: 899662 - RNA, 22 nt, Human
ugcaaacuauugguagagaugg

SEQ ID NO: 899663 - RNA, 22 nt, Human
gugaauaacuuucuauguuaau

SEQ ID NO: 899664 - RNA, 19 nt, Human
acaaauuguccucaucaag

SEQ ID NO: 899665 - RNA, 22 nt, Human
agucagcauauauggaguaagg

SEQ ID NO: 899666 - RNA, 22 nt, Human
uuuacaauucucuaccaguguu

SEQ ID NO: 899667 - RNA, 22 nt, Human
aucacaguuuacaaaccugcug

SEQ ID NO: 899668 - RNA, 22 nt, Human
caucuuauaggcagaguucagu

SEQ ID NO: 899669 - RNA, 22 nt, Human
aagaaauuaaggaaugcaacga

SEQ ID NO: 899670 - RNA, 22 nt, Human
gggcagguuauuggaguaggga

SEQ ID NO: 899671 - RNA, 22 nt, Human
gcugaagugcuuuugaauuugg

SEQ ID NO: 899672 - RNA, 22 nt, Human
aucuuuggucuugagugcaucu

SEQ ID NO: 899673 - RNA, 22 nt, Human
gccccagguugccugucccagg

SEQ ID NO: 899674 - RNA, 22 nt, Human
uaguaugggaagaacuuuguag

SEQ ID NO: 899675 - RNA, 22 nt, Human
aggcugaggcagguggaucauu

SEQ ID NO: 899676 - RNA, 22 nt, Human
ucuucaugucaugguauauuga

SEQ ID NO: 899677 - RNA, 22 nt, Human
gggcucagcuccuuccuuccua

SEQ ID NO: 899678 - RNA, 22 nt, Human
ccagugcgcaggcgccaccugu

SEQ ID NO: 899679 - RNA, 22 nt, Human
ggucgucucagucugacugaag

SEQ ID NO: 899680 - RNA, 22 nt, Human
guccuuugaaggcaaaaggaga

SEQ ID NO: 899681 - RNA, 22 nt, Human
cacaggcaccccugacugcuca

SEQ ID NO: 899682 - RNA, 22 nt, Human
aauguguauacuggcaauuaag

SEQ ID NO: 899683 - RNA, 22 nt, Human
ccuggcagcgugccgagcugcg

SEQ ID NO: 899684 - RNA, 22 nt, Human
uguggggaggcugcagugcugc

SEQ ID NO: 899685 - RNA, 19 nt, Human
gagaaaccccgucuuuagg

SEQ ID NO: 899686 - RNA, 17 nt, Human
ucuucucuuccagucuu

SEQ ID NO: 899687 - RNA, 22 nt, Human
uccccagcucugugcuuccacu

SEQ ID NO: 899688 - RNA, 22 nt, Human
cuguccuccggccaccuacagu

SEQ ID NO: 899689 - RNA, 22 nt, Human
auacauuagcucauaugauuaa

SEQ ID NO: 899690 - RNA, 22 nt, Human
ucuaaauucaguuuauuuugau

SEQ ID NO: 899691 - RNA, 22 nt, Human
caggggaagaugccaagggaga

SEQ ID NO: 899692 - RNA, 22 nt, Human
gcaggggcugcugggaacucgg

SEQ ID NO: 899693 - RNA, 21 nt, Human
gggcucaguggaaaagagugu

SEQ ID NO: 899694 - RNA, 22 nt, Human
cacacagaugguaagggaggga

SEQ ID NO: 899695 - RNA, 22 nt, Human
ccagcuccccucagcagguaau

SEQ ID NO: 899696 - RNA, 22 nt, Human
caaagguuaugaaccacuugua

SEQ ID NO: 899697 - RNA, 22 nt, Human
caugcaagacaaucuuuaaaau

SEQ ID NO: 899698 - RNA, 21 nt, Human
uuucucauaaaauacucauua

SEQ ID NO: 899699 - RNA, 22 nt, Human
aggagaaggaggccccucacac

SEQ ID NO: 899700 - RNA, 22 nt, Human
ccaggagguggagauugcagug

SEQ ID NO: 899701 - RNA, 17 nt, Human
agggggaaccugggagg

SEQ ID NO: 899702 - RNA, 22 nt, Human
uuucacaaaugucuuuaacuug

SEQ ID NO: 899703 - RNA, 22 nt, Human
cccaggaggcagaaguugcagu

SEQ ID NO: 899704 - RNA, 22 nt, Human
gcuuucugggcuauagaacggg

SEQ ID NO: 899705 - RNA, 22 nt, Human
gcagcugccuaaagugcuaaga

SEQ ID NO: 899706 - RNA, 22 nt, Human
auuccuucuaaaacgcugcccu

SEQ ID NO: 899707 - RNA, 22 nt, Human
gcgguagcucaagcuuguaauc

SEQ ID NO: 899708 - RNA, 23 nt, Human
ucuuuuuaagagaucuagugacg

SEQ ID NO: 899709 - RNA, 22 nt, Human
gugugggacgggugaguggcca

SEQ ID NO: 899710 - RNA, 18 nt, Human
gaggcagcuagcaauuuu

SEQ ID NO: 899711 - RNA, 22 nt, Human
aauaguuuuauaggugggauua

SEQ ID NO: 899712 - RNA, 22 nt, Human
ggcuucauggacaaaagccuca

SEQ ID NO: 899713 - RNA, 23 nt, Human
ccugcagcugcuggggcuccacc

SEQ ID NO: 899714 - RNA, 22 nt, Human
agagaaggaaagcugacauggg

SEQ ID NO: 899715 - RNA, 22 nt, Human
ugcugagaggaaggugcacugg

SEQ ID NO: 899716 - RNA, 22 nt, Human
cugugcccaggcuggagugcag

SEQ ID NO: 899717 - RNA, 22 nt, Human
uuuacacauuauuuucagugug

SEQ ID NO: 899718 - RNA, 22 nt, Human
aaaugcagaaugauuucaucua

SEQ ID NO: 899719 - RNA, 23 nt, Human
uagcagcauuuuuagccucuguc

SEQ ID NO: 899720 - RNA, 22 nt, Human
cuauuauuagcaaaagguggau

SEQ ID NO: 899721 - RNA, 22 nt, Human
uguccagggauggggucaggga

SEQ ID NO: 899722 - RNA, 22 nt, Human
aacuggaaugaaauuuacgaug

SEQ ID NO: 899723 - RNA, 22 nt, Human
uucucagggcaucucaugaccc

SEQ ID NO: 899724 - RNA, 22 nt, Human
gcugcccaguucugcugcugcc

SEQ ID NO: 899725 - RNA, 22 nt, Human
ugcaccugagaggucucugagg

SEQ ID NO: 899726 - RNA, 22 nt, Human
uuugaaauguaucaguauaggu

SEQ ID NO: 899727 - RNA, 22 nt, Human
uuuauccauaucauuaaaaucu

SEQ ID NO: 899728 - RNA, 22 nt, Human
aagaggcaucucagcuuccucu

SEQ ID NO: 899729 - RNA, 22 nt, Human
agucauguaaucacaaugaccu

SEQ ID NO: 899730 - RNA, 22 nt, Human
uguguccauucaggcacugacc

SEQ ID NO: 899731 - RNA, 22 nt, Human
uagcaaccuauggauagagaag

SEQ ID NO: 899732 - RNA, 20 nt, Human
gggcuagguagccauuuggc

SEQ ID NO: 899733 - RNA, 21 nt, Human
acacaacaggcagucauuuuc

SEQ ID NO: 899734 - RNA, 22 nt, Human
auccugggaaguggccuccucc

SEQ ID NO: 899735 - RNA, 22 nt, Human
agcuaauguauguugaaagcac

SEQ ID NO: 899736 - RNA, 22 nt, Human
uucagcuucauuugucuuuaug

SEQ ID NO: 899737 - RNA, 22 nt, Human
cauucauuuaugaaauaucuau

SEQ ID NO: 899738 - RNA, 23 nt, Human
acugcugucuuugaagugcuuga

SEQ ID NO: 899739 - RNA, 22 nt, Human
cuggaaguggagaguggcccuc

SEQ ID NO: 899740 - RNA, 22 nt, Human
guuucccaggcuguggggcccu

SEQ ID NO: 899741 - RNA, 22 nt, Human
uucuuauucuugaaauguggga

SEQ ID NO: 899742 - RNA, 22 nt, Human
cuggcccuguaggaugugaguu

SEQ ID NO: 899743 - RNA, 22 nt, Human
aaaacauugaauugcacacuau

SEQ ID NO: 899744 - RNA, 22 nt, Human
acauaguuagcuuagagauacu

SEQ ID NO: 899745 - RNA, 22 nt, Human
gccagagguaucaaagauagua

SEQ ID NO: 899746 - RNA, 22 nt, Human
gagcuccacuuagcaaggccac

SEQ ID NO: 899747 - RNA, 22 nt, Human
auguaaccaccacacaaagcaa

SEQ ID NO: 899748 - RNA, 22 nt, Human
ucaggcugguccccacagugga

SEQ ID NO: 899749 - RNA, 22 nt, Human
uaggaaauauuugaacauagga

SEQ ID NO: 899750 - RNA, 22 nt, Human
aguguuagauucuuacucaguu

SEQ ID NO: 899751 - RNA, 22 nt, Human
ucacagacaccuuggccacagu

SEQ ID NO: 899752 - RNA, 22 nt, Human
aauguuucuggauauugugggu

SEQ ID NO: 899753 - RNA, 22 nt, Human
ccuaaguugagaagccaguagc

SEQ ID NO: 899754 - RNA, 22 nt, Human
gcaaacauucaggaguacagga

SEQ ID NO: 899755 - RNA, 22 nt, Human
uuucaaaguaaggauuuucauc

SEQ ID NO: 899756 - RNA, 22 nt, Human
guugucagguaaaacaguaugg

SEQ ID NO: 899757 - RNA, 23 nt, Human
uuguggaagggagauggcaacag

SEQ ID NO: 899758 - RNA, 22 nt, Human
ccaggacaaguguggccauggc

SEQ ID NO: 899759 - RNA, 23 nt, Human
agcagcaaaaauuuaucuuucug

SEQ ID NO: 899760 - RNA, 22 nt, Human
gcugugugcucuggucuuucuu

SEQ ID NO: 899761 - RNA, 22 nt, Human
gcccuuacaggguggucagcca

SEQ ID NO: 899762 - RNA, 22 nt, Human
aucgaggaaaggacaguuccuu

SEQ ID NO: 899763 - RNA, 19 nt, Human
caggagagcaugcacuuug

SEQ ID NO: 899764 - RNA, 22 nt, Human
aaauucaaugaucacuggcuca

SEQ ID NO: 899765 - RNA, 22 nt, Human
aacccuggcccuggaauaggca

SEQ ID NO: 899766 - RNA, 22 nt, Human
acauugaacauggcaggacauu

SEQ ID NO: 899767 - RNA, 22 nt, Human
gaauacauuggaaaucagaaua

SEQ ID NO: 899768 - RNA, 22 nt, Human
ggcagcugcugcauuacguugu

SEQ ID NO: 899769 - RNA, 22 nt, Human
ugaggucauggcugauauuucc

SEQ ID NO: 899770 - RNA, 21 nt, Human
aggguggcucugggucagaac

SEQ ID NO: 899771 - RNA, 22 nt, Human
ugcugccaccugugguagucug

SEQ ID NO: 899772 - RNA, 22 nt, Human
ugagccagauaagggcucacgc

SEQ ID NO: 899773 - RNA, 22 nt, Human
ggcugggaggccgugcugaccu

SEQ ID NO: 899774 - RNA, 22 nt, Human
uagcugcuuagaaaucacugag

SEQ ID NO: 899775 - RNA, 22 nt, Human
uuuguuauaacaauaaaaaguc

SEQ ID NO: 899776 - RNA, 22 nt, Human
uccucacaagcauccugucuca

SEQ ID NO: 899777 - RNA, 22 nt, Human
guagcuuauuagggauaauagu

SEQ ID NO: 899778 - RNA, 22 nt, Human
cugucacccacccagccuguca

SEQ ID NO: 899779 - RNA, 22 nt, Human
uggaaaaacugagacuuagaca

SEQ ID NO: 899780 - RNA, 22 nt, Human
guuucuguaagacugaauugac

SEQ ID NO: 899781 - RNA, 22 nt, Human
uucucugcagcuccuggcuggg

SEQ ID NO: 899782 - RNA, 22 nt, Human
ugggaagaugauaauucacagu

SEQ ID NO: 899783 - RNA, 22 nt, Human
ccuggaccaaacacuggccugg

SEQ ID NO: 899784 - RNA, 22 nt, Human
guccagggcuaaaucagguucc

SEQ ID NO: 899785 - RNA, 22 nt, Human
ugcauggaacggucuccugguc

SEQ ID NO: 899786 - RNA, 22 nt, Human
acaguuccugacuuuaacucca

SEQ ID NO: 899787 - RNA, 19 nt, Human
aaucagaaauaucgaggcc

SEQ ID NO: 899788 - RNA, 22 nt, Human
uucuaggggacauaauaugaaa

SEQ ID NO: 899789 - RNA, 23 nt, Human
ucagaacaaugccuuaggggcau

SEQ ID NO: 899790 - RNA, 22 nt, Human
uuccucagccaaggcugggauc

SEQ ID NO: 899791 - RNA, 22 nt, Human
guggcagcggcccaggccgucu

SEQ ID NO: 899792 - RNA, 22 nt, Human
agugcagcuauuacaacagugu

SEQ ID NO: 899793 - RNA, 22 nt, Human
uuucacaaacucagggugugug

SEQ ID NO: 899794 - RNA, 22 nt, Human
uggcuggaccugggcuggaauu

SEQ ID NO: 899795 - RNA, 22 nt, Human
cacucauauuggaacaagcuug

SEQ ID NO: 899796 - RNA, 22 nt, Human
uacuacaguauguguguuauac

SEQ ID NO: 899797 - RNA, 22 nt, Human
uaggacuuugagaauuguuauu

SEQ ID NO: 899798 - RNA, 22 nt, Human
uuacaguuuacauaagaauugu

SEQ ID NO: 899799 - RNA, 22 nt, Human
ugggucccaaacuccuagaggu

SEQ ID NO: 899800 - RNA, 22 nt, Human
ugaggaaguuguuucucuucua

SEQ ID NO: 899801 - RNA, 22 nt, Human
gcagcugugggccucggagagc

SEQ ID NO: 899802 - RNA, 22 nt, Human
gauaacauuuugaagugcuagu

SEQ ID NO: 899803 - RNA, 22 nt, Human
acuggcagcuguaggaugcaug

SEQ ID NO: 899804 - RNA, 22 nt, Human
ugggcacagaauagauggccca

SEQ ID NO: 899805 - RNA, 22 nt, Human
uaaauaugcauguauccuuauc

SEQ ID NO: 899806 - RNA, 22 nt, Human
uuacaucauguaacuggauaua

SEQ ID NO: 899807 - RNA, 22 nt, Human
uggcaggaagcaucuauagguc

SEQ ID NO: 899808 - RNA, 22 nt, Human
ugucuccaaaacaaucucagau

SEQ ID NO: 899809 - RNA, 22 nt, Human
agggcugacacaccuuauccuc

SEQ ID NO: 899810 - RNA, 22 nt, Human
uaaaguauccaguuauucuucu

SEQ ID NO: 899811 - RNA, 22 nt, Human
ucauagaaauguggccagaaac

SEQ ID NO: 899812 - RNA, 22 nt, Human
aaguucuuggaggaugaagagu

SEQ ID NO: 899813 - RNA, 22 nt, Human
ggcacugggugagggucacugg

SEQ ID NO: 899814 - RNA, 22 nt, Human
aggcagcaaugaaugaaaugga

SEQ ID NO: 899815 - RNA, 23 nt, Human
agggucugcucagugucguucaa

SEQ ID NO: 899816 - RNA, 22 nt, Human
ucauguuuguuggaaauguggc

SEQ ID NO: 899817 - RNA, 19 nt, Human
ggagaggcuggagggaugc

SEQ ID NO: 899818 - RNA, 22 nt, Human
agcauuagauuaaaaauuuaga

SEQ ID NO: 899819 - RNA, 22 nt, Human
cgugucugggcucccauggcag

SEQ ID NO: 899820 - RNA, 22 nt, Human
uccaggcuagguuuacaggaca

SEQ ID NO: 899821 - RNA, 22 nt, Human
auacacauaucagguguauaca

SEQ ID NO: 899822 - RNA, 22 nt, Human
ggaggcagaauagagugugggu

SEQ ID NO: 899823 - RNA, 22 nt, Human
uuucaguuucauggcacagcua

SEQ ID NO: 899824 - RNA, 22 nt, Human
cauuaacaaauggaagcaugaa

SEQ ID NO: 899825 - RNA, 22 nt, Human
aggcuaaggugggaggaucgcu

SEQ ID NO: 899826 - RNA, 20 nt, Human
ugccaagcucuuuagaucga

SEQ ID NO: 899827 - RNA, 22 nt, Human
cuguuuucuagggcugagguga

SEQ ID NO: 899828 - RNA, 18 nt, Human
ggcagugcagucucaggg

SEQ ID NO: 899829 - RNA, 21 nt, Human
cuuggaacggguagaacucac

SEQ ID NO: 899830 - RNA, 22 nt, Human
auucuucauguugaagcuguca

SEQ ID NO: 899831 - RNA, 22 nt, Human
aagcuauugaauuuauagcaua

SEQ ID NO: 899832 - RNA, 22 nt, Human
gauuuuauagucaggaaaaaga

SEQ ID NO: 899833 - RNA, 22 nt, Human
aacacagaagugccaagagcca

SEQ ID NO: 899834 - RNA, 21 nt, Human
uuggccugauaucuuggagca

SEQ ID NO: 899835 - RNA, 22 nt, Human
uacacaguagaguauaaugcgu

SEQ ID NO: 899836 - RNA, 22 nt, Human
ccugcucaugggucccuggcag

SEQ ID NO: 899837 - RNA, 22 nt, Human
ggcugcugaguuggccaggaga

SEQ ID NO: 899838 - RNA, 19 nt, Human
ccagcccauaguccaucac

SEQ ID NO: 899839 - RNA, 22 nt, Human
aaagccacguggccuggggagc

SEQ ID NO: 899840 - RNA, 22 nt, Human
agggcucagaaaugucuacggg

SEQ ID NO: 899841 - RNA, 22 nt, Human
augaagacuauuugaaggugcc

SEQ ID NO: 899842 - RNA, 22 nt, Human
aaagcaauagguuaggucaaga

SEQ ID NO: 899843 - RNA, 22 nt, Human
aagcaauguguuugaaaggcca

SEQ ID NO: 899844 - RNA, 22 nt, Human
gacccuuucugcaugcuuaucu

SEQ ID NO: 899845 - RNA, 22 nt, Human
uguuaguauuggcaaauuuguu

SEQ ID NO: 899846 - RNA, 22 nt, Human
agaaauacuuaaucuuugcagg

SEQ ID NO: 899847 - RNA, 22 nt, Human
ccaguaauuagacuuucaggca

SEQ ID NO: 899848 - RNA, 22 nt, Human
acuaaaacaguggcuaguagac

SEQ ID NO: 899849 - RNA, 22 nt, Human
uaguccagccuuggguguagcc

SEQ ID NO: 899850 - RNA, 22 nt, Human
aaaucaaaagacauguguuuua

SEQ ID NO: 899851 - RNA, 22 nt, Human
cugguccuugacgcgugggagg

SEQ ID NO: 899852 - RNA, 22 nt, Human
cucugugccagucugcacucgg

SEQ ID NO: 899853 - RNA, 22 nt, Human
uucaaagauggagggauagauu

SEQ ID NO: 899854 - RNA, 22 nt, Human
ugggccugacucaccugccucc

SEQ ID NO: 899855 - RNA, 22 nt, Human
aggacaggauuccuugccuugc

SEQ ID NO: 899856 - RNA, 18 nt, Human
caggccucuugaucuucc

SEQ ID NO: 899857 - RNA, 22 nt, Human
aacugaaacuuaggaaguaauc

SEQ ID NO: 899858 - RNA, 21 nt, Human
auuuauguuugggguggaaug

SEQ ID NO: 899859 - RNA, 22 nt, Human
uuacaucaugcuuaucccuuuc

SEQ ID NO: 899860 - RNA, 22 nt, Human
aaaggcauaggauguggaaucg

SEQ ID NO: 899861 - RNA, 22 nt, Human
auuuuacuacuccaauuaauga

SEQ ID NO: 899862 - RNA, 22 nt, Human
cucuuccauauuacucagggua

SEQ ID NO: 899863 - RNA, 22 nt, Human
aaagcagcacauggauaucagu

SEQ ID NO: 899864 - RNA, 20 nt, Human
uaaugcuuaacacauccccu

SEQ ID NO: 899865 - RNA, 20 nt, Human
cugggcucaagugagccucc

SEQ ID NO: 899866 - RNA, 22 nt, Human
ggcaggugaucuagagucaaua

SEQ ID NO: 899867 - RNA, 22 nt, Human
auuauguauuugguauaguuug

SEQ ID NO: 899868 - RNA, 22 nt, Human
aaguguuuauugauuggucuag

SEQ ID NO: 899869 - RNA, 22 nt, Human
gugucucuuccuuucaaguggg

SEQ ID NO: 899870 - RNA, 22 nt, Human
gaggaggaaguucucuguaggc

SEQ ID NO: 899871 - RNA, 22 nt, Human
gacaguaacuacaguucugugg

SEQ ID NO: 899872 - RNA, 22 nt, Human
aaguuucugggcaagacaaggc

SEQ ID NO: 899873 - RNA, 22 nt, Human
ggcaggguggcagaggcucaga

SEQ ID NO: 899874 - RNA, 22 nt, Human
acagaauugauggaaaucucag

SEQ ID NO: 899875 - RNA, 22 nt, Human
acagauacaaauauacaaauac

SEQ ID NO: 899876 - RNA, 22 nt, Human
acauuuagcuguacaaucuaug

SEQ ID NO: 899877 - RNA, 22 nt, Human
ugcccugaagcacccucacccu

SEQ ID NO: 899878 - RNA, 22 nt, Human
ggcucaguguuuguggaacaua

SEQ ID NO: 899879 - RNA, 22 nt, Human
uaaguucugaugucuguugcca

SEQ ID NO: 899880 - RNA, 21 nt, Human
uccaggccucaggaagggaug

SEQ ID NO: 899881 - RNA, 22 nt, Human
agccacagcccacaggacucuu

SEQ ID NO: 899882 - RNA, 18 nt, Human
acagaggcagacauguau

SEQ ID NO: 899883 - RNA, 22 nt, Human
agaggcagaaguguucaaaccc

SEQ ID NO: 899884 - RNA, 22 nt, Human
agaaaaugugaacuugugaauu

SEQ ID NO: 899885 - RNA, 22 nt, Human
gccugggucuccuccgcuuccc

SEQ ID NO: 899886 - RNA, 22 nt, Human
uacauguauugauuucucuucu

SEQ ID NO: 899887 - RNA, 22 nt, Human
ggaggaagcacacggcuuguau

SEQ ID NO: 899888 - RNA, 22 nt, Human
aagaaaagauguuugguuuuca

SEQ ID NO: 899889 - RNA, 22 nt, Human
cuuuguucugccaauggcccau

SEQ ID NO: 899890 - RNA, 21 nt, Human
uccacaauagggaaauucacc

SEQ ID NO: 899891 - RNA, 22 nt, Human
ucugcguugcucacgcugggag

SEQ ID NO: 899892 - RNA, 18 nt, Human
cccaggcuuugugggucu

SEQ ID NO: 899893 - RNA, 22 nt, Human
agaagacagagucuacauucua

SEQ ID NO: 899894 - RNA, 22 nt, Human
cagauacagguuuuuguuagau

SEQ ID NO: 899895 - RNA, 22 nt, Human
uccugagggcgauucagcaggu

SEQ ID NO: 899896 - RNA, 22 nt, Human
ugacccuggccugguggcggaa

SEQ ID NO: 899897 - RNA, 22 nt, Human
aguggcagagccaggguuggga

SEQ ID NO: 899898 - RNA, 22 nt, Human
ccugagagugagugccaccuua

SEQ ID NO: 899899 - RNA, 22 nt, Human
uuauuuauucauucugucuguc

SEQ ID NO: 899900 - RNA, 22 nt, Human
auauuuguaguggguaagaagu

SEQ ID NO: 899901 - RNA, 20 nt, Human
cagguauuacaucugcaccu

SEQ ID NO: 899902 - RNA, 22 nt, Human
ggaccugcccuggcucagaugc

SEQ ID NO: 899903 - RNA, 22 nt, Human
uuaggcaauaucauuggaguug

SEQ ID NO: 899904 - RNA, 22 nt, Human
ggcucuggugcccuggcuccca

SEQ ID NO: 899905 - RNA, 20 nt, Human
gacaggugcuaaagaggggc

SEQ ID NO: 899906 - RNA, 22 nt, Human
cccaugcacccucuaagaagga

SEQ ID NO: 899907 - RNA, 22 nt, Human
acaaagagaccaugagccaaac

SEQ ID NO: 899908 - RNA, 22 nt, Human
ugacagagagguaaguuaugaa

SEQ ID NO: 899909 - RNA, 21 nt, Human
uucaucauugguaaaaagugg

SEQ ID NO: 899910 - RNA, 22 nt, Human
auuuuuccaugauacuuaucug

SEQ ID NO: 899911 - RNA, 22 nt, Human
ggggcagauggaacagagcaca

SEQ ID NO: 899912 - RNA, 22 nt, Human
uucugcauguguuucaaauacu

SEQ ID NO: 899913 - RNA, 22 nt, Human
ccagcugucagugugaaaauaa

SEQ ID NO: 899914 - RNA, 22 nt, Human
ggccuuggugcucuguguugca

SEQ ID NO: 899915 - RNA, 22 nt, Human
uuccaggaggagguacuagagg

SEQ ID NO: 899916 - RNA, 22 nt, Human
uucuuguucuccucauuuagag

SEQ ID NO: 899917 - RNA, 22 nt, Human
gggcugggauggcuugaagauu

SEQ ID NO: 899918 - RNA, 21 nt, Human
ugccagggauuuacagagccu

SEQ ID NO: 899919 - RNA, 22 nt, Human
auucugggagguagaacugaaa

SEQ ID NO: 899920 - RNA, 22 nt, Human
cucucccccacagcagccuucu

SEQ ID NO: 899921 - RNA, 23 nt, Human
ucuggaaugguacucacuggagu

SEQ ID NO: 899922 - RNA, 22 nt, Human
aacacagguucauucugugagg

SEQ ID NO: 899923 - RNA, 22 nt, Human
gagcaggacgugggaaugggaa

SEQ ID NO: 899924 - RNA, 22 nt, Human
cugcaagguccaccugcuacau

SEQ ID NO: 899925 - RNA, 22 nt, Human
uauuagcaacguaaccucugaa

SEQ ID NO: 899926 - RNA, 22 nt, Human
ggucugagcuugagcccaugcu

SEQ ID NO: 899927 - RNA, 22 nt, Human
cugggagagccuuuccugaguc

SEQ ID NO: 899928 - RNA, 21 nt, Human
acugcaucugaagucccagga

SEQ ID NO: 899929 - RNA, 20 nt, Human
ucccaagggcugagaggauc

SEQ ID NO: 899930 - RNA, 22 nt, Human
uuuuuagaauuggcugagaauu

SEQ ID NO: 899931 - RNA, 22 nt, Human
aggcaagggggcgccaccuucc

SEQ ID NO: 899932 - RNA, 22 nt, Human
caaauucaaauuucaucagugu

SEQ ID NO: 899933 - RNA, 22 nt, Human
uagacaggaaacauuaggaugg

SEQ ID NO: 899934 - RNA, 22 nt, Human
guacuaaacagagaaccaauau

SEQ ID NO: 899935 - RNA, 22 nt, Human
ggacagugaauguggggaugca

SEQ ID NO: 899936 - RNA, 22 nt, Human
gagggagggaaaguuuaacacu

SEQ ID NO: 899937 - RNA, 22 nt, Human
ggcuggccagggcccucgcugg

SEQ ID NO: 899938 - RNA, 22 nt, Human
uggcucucaggccugcugcguu

SEQ ID NO: 899939 - RNA, 22 nt, Human
aauuacagucggagcagcacug

SEQ ID NO: 899940 - RNA, 22 nt, Human
guucucuagggcuguagacugg

SEQ ID NO: 899941 - RNA, 22 nt, Human
cagagagaggggcugccuggcc

SEQ ID NO: 899942 - RNA, 22 nt, Human
ucuuccaauaccuagauuuugg

SEQ ID NO: 899943 - RNA, 22 nt, Human
gccaggcuggcaaaaggaaacc

SEQ ID NO: 899944 - RNA, 22 nt, Human
gugagggguggcugagcaguuu

SEQ ID NO: 899945 - RNA, 22 nt, Human
uguuaaauguauuauguguucu

SEQ ID NO: 899946 - RNA, 22 nt, Human
cagggugcgccacucagaugua

SEQ ID NO: 899947 - RNA, 22 nt, Human
ucaggcugaaucauccuagcuu

SEQ ID NO: 899948 - RNA, 22 nt, Human
ugacugugccgugccccuagga

SEQ ID NO: 899949 - RNA, 22 nt, Human
ggcagaagacaggcaaaucaug

SEQ ID NO: 899950 - RNA, 22 nt, Human
ggaggcaggaaagacagguuca

SEQ ID NO: 899951 - RNA, 22 nt, Human
acuccugugggcauggcacccc

SEQ ID NO: 899952 - RNA, 22 nt, Human
agcccaagcuaugaggugaccu

SEQ ID NO: 899953 - RNA, 22 nt, Human
cauggcuugcaagcauaggaga

SEQ ID NO: 899954 - RNA, 22 nt, Human
uugaacauuggcaauuucauau

SEQ ID NO: 899955 - RNA, 22 nt, Human
uccucuccauauuuucugauuu

SEQ ID NO: 899956 - RNA, 22 nt, Human
ugugaauguuaauauuggauua

SEQ ID NO: 899957 - RNA, 18 nt, Human
uucagcagcagacacacu

SEQ ID NO: 899958 - RNA, 21 nt, Human
agcugagcccagaagacuggu

SEQ ID NO: 899959 - RNA, 22 nt, Human
aggcuggcagccaccucagcag

SEQ ID NO: 899960 - RNA, 22 nt, Human
acauucaagaugcauucacuua

SEQ ID NO: 899961 - RNA, 20 nt, Human
cugugccuaaaccuccgggu

SEQ ID NO: 899962 - RNA, 22 nt, Human
ugcuuuauucgacaucugguag

SEQ ID NO: 899963 - RNA, 22 nt, Human
uugauucugauccuuugcuagc

SEQ ID NO: 899964 - RNA, 22 nt, Human
aacagcaauagcacuauucauu

SEQ ID NO: 899965 - RNA, 22 nt, Human
uugcugugucauuuguuuaauc

SEQ ID NO: 899966 - RNA, 19 nt, Human
cuguggcugaccucuggcc

SEQ ID NO: 899967 - RNA, 22 nt, Human
guuuccuauguccauugaggga

SEQ ID NO: 899968 - RNA, 22 nt, Human
acacagauauuguacuugaucc

SEQ ID NO: 899969 - RNA, 22 nt, Human
agagaaauucucaguggaagau

SEQ ID NO: 899970 - RNA, 22 nt, Human
uaacacauuaguucuccuagau

SEQ ID NO: 899971 - RNA, 22 nt, Human
cuucuuaaagauuacacaauga

SEQ ID NO: 899972 - RNA, 22 nt, Human
ugucacaauuuauuucucuuga

SEQ ID NO: 899973 - RNA, 22 nt, Human
gacaaugugaggcgaguuuguu

SEQ ID NO: 899974 - RNA, 22 nt, Human
aucguaaagcccuauggcuuca

SEQ ID NO: 899975 - RNA, 21 nt, Human
agcuauuucagauuugagagc

SEQ ID NO: 899976 - RNA, 22 nt, Human
auagucuuagucuauaguuuug

SEQ ID NO: 899977 - RNA, 22 nt, Human
ccccaaagcugaguucccgccu

SEQ ID NO: 899978 - RNA, 21 nt, Human
agcacagcuuuaagccaugug

SEQ ID NO: 899979 - RNA, 22 nt, Human
gcuacaagucuugucauucauu

SEQ ID NO: 899980 - RNA, 18 nt, Human
ucagacaaguuagacagg

SEQ ID NO: 899981 - RNA, 22 nt, Human
gucagugccaccagccacugcc

SEQ ID NO: 899982 - RNA, 22 nt, Human
cuucuggcguuggaggucugag

SEQ ID NO: 899983 - RNA, 22 nt, Human
ugagaaccucgaagauuuugcc

SEQ ID NO: 899984 - RNA, 22 nt, Human
acugugagcagcgaccugagga

SEQ ID NO: 899985 - RNA, 22 nt, Human
accgggaaguccugcacugggc

SEQ ID NO: 899986 - RNA, 22 nt, Human
gagggcugaagauuguggcccc

SEQ ID NO: 899987 - RNA, 22 nt, Human
acuggccuaucagcaugagucu

SEQ ID NO: 899988 - RNA, 22 nt, Human
uagcauuccaucacucagcacc

SEQ ID NO: 899989 - RNA, 23 nt, Human
ucccagccucuucucuugcauac

SEQ ID NO: 899990 - RNA, 22 nt, Human
gcuccuggauguucaagucggc

SEQ ID NO: 899991 - RNA, 22 nt, Human
ggcuucacucauaauuagguuc

SEQ ID NO: 899992 - RNA, 22 nt, Human
augcugagacuggagcagcugg

SEQ ID NO: 899993 - RNA, 22 nt, Human
agggaugugggaacugcagguu

SEQ ID NO: 899994 - RNA, 22 nt, Human
guauaaaggcacagguuuucug

SEQ ID NO: 899995 - RNA, 22 nt, Human
ugcaaaaacagccuugaggccu

SEQ ID NO: 899996 - RNA, 22 nt, Human
ugucuuauggucuugggcuucc

SEQ ID NO: 899997 - RNA, 22 nt, Human
gguuuuaaccauucacaaguga

SEQ ID NO: 899998 - RNA, 22 nt, Human
ucagaaguuaauacgaggagaa

SEQ ID NO: 899999 - RNA, 22 nt, Human
uuuaaauguguucuuaguagcu

SEQ ID NO: 900000 - RNA, 22 nt, Human
agaggccagguccagaguuugu

SEQ ID NO: 900001 - RNA, 22 nt, Human
uuccaacuuugucauauauuau

SEQ ID NO: 900002 - RNA, 22 nt, Human
aacacuuuggaauagagauagg

SEQ ID NO: 900003 - RNA, 22 nt, Human
gacagggcugugggaggagcag

SEQ ID NO: 900004 - RNA, 22 nt, Human
guuguacaggcagggaaacuga

SEQ ID NO: 900005 - RNA, 22 nt, Human
cuggccagaguuggagggugug

SEQ ID NO: 900006 - RNA, 22 nt, Human
ugucuccucaacucaugcucga

SEQ ID NO: 900007 - RNA, 22 nt, Human
aggcucuggaguguggugcugg

SEQ ID NO: 900008 - RNA, 22 nt, Human
aaauacauuuacagucguggcu

SEQ ID NO: 900009 - RNA, 22 nt, Human
aauaaagacaaacaggggagcc

SEQ ID NO: 900010 - RNA, 22 nt, Human
gaggaagcauugacauaaucuc

SEQ ID NO: 900011 - RNA, 22 nt, Human
cauacauuaccuaacuuaaugc

SEQ ID NO: 900012 - RNA, 22 nt, Human
auagauguuuucuccuaauugg

SEQ ID NO: 900013 - RNA, 22 nt, Human
caggccucuccuuagucuggca

SEQ ID NO: 900014 - RNA, 22 nt, Human
aaaguugcacaacuuuguauac

SEQ ID NO: 900015 - RNA, 22 nt, Human
uguuuuaagggucaacugucac

SEQ ID NO: 900016 - RNA, 22 nt, Human
uggcuggcugucaaggaaagcc

SEQ ID NO: 900017 - RNA, 22 nt, Human
ucuggggagcagcccuggugag

SEQ ID NO: 900018 - RNA, 23 nt, Human
ccaaagucgaagucuaguccaga

SEQ ID NO: 900019 - RNA, 22 nt, Human
aagaggaagucuccauggagag

SEQ ID NO: 900020 - RNA, 22 nt, Human
ucccucacugguucugcauccc

SEQ ID NO: 900021 - RNA, 22 nt, Human
uggugacagcauggaagaagug

SEQ ID NO: 900022 - RNA, 22 nt, Human
uccuugcagacaucucucuuca

SEQ ID NO: 900023 - RNA, 22 nt, Human
gugccucccgggaccaugcacu

SEQ ID NO: 900024 - RNA, 21 nt, Human
aaacugaccuugccugagaca

SEQ ID NO: 900025 - RNA, 22 nt, Human
ucugugccuccguaacacacca

SEQ ID NO: 900026 - RNA, 22 nt, Human
gcaggccugacuguagggggca

SEQ ID NO: 900027 - RNA, 22 nt, Human
uauuaauaaauauguaggggcc

SEQ ID NO: 900028 - RNA, 22 nt, Human
uucaaaaugcacaaagggcuag

SEQ ID NO: 900029 - RNA, 22 nt, Human
acaguaacagucuauuucucag

SEQ ID NO: 900030 - RNA, 22 nt, Human
auuguacaaugcugagguuugg

SEQ ID NO: 900031 - RNA, 20 nt, Human
aggcucagauacccagggaa

SEQ ID NO: 900032 - RNA, 22 nt, Human
acauacuaugaauacauguguc

SEQ ID NO: 900033 - RNA, 20 nt, Human
uuagcaguagagugugcuuc

SEQ ID NO: 900034 - RNA, 22 nt, Human
cagaguuugcaagggcagaagc

SEQ ID NO: 900035 - RNA, 22 nt, Human
caaguuacauuagaaaucaugc

SEQ ID NO: 900036 - RNA, 22 nt, Human
ucucucagaggaagaggcagug

SEQ ID NO: 900037 - RNA, 20 nt, Human
cagggccuaagagcugaaaa

SEQ ID NO: 900038 - RNA, 22 nt, Human
uuucugcucgcucucaaucagg

SEQ ID NO: 900039 - RNA, 22 nt, Human
gcuggccauggccugcgccauc

SEQ ID NO: 900040 - RNA, 22 nt, Human
gcagaugguggaggcaagaggc

SEQ ID NO: 900041 - RNA, 22 nt, Human
aucagauauuuaaguuaucaac

SEQ ID NO: 900042 - RNA, 22 nt, Human
gucugagggguuucccaggaca

SEQ ID NO: 900043 - RNA, 22 nt, Human
accuuagaaagugacaaacgaa

SEQ ID NO: 900044 - RNA, 22 nt, Human
uauuauaauuuagggcuuggau

SEQ ID NO: 900045 - RNA, 22 nt, Human
uaccucaugcuguacagcacgu

SEQ ID NO: 900046 - RNA, 22 nt, Human
gugagggcaaauuagaaucaaa

SEQ ID NO: 900047 - RNA, 20 nt, Human
acauuuguggaucugagaga

SEQ ID NO: 900048 - RNA, 22 nt, Human
cucuucagauauacaguacucu

SEQ ID NO: 900049 - RNA, 22 nt, Human
gugagucuguggaccgggcacu

SEQ ID NO: 900050 - RNA, 22 nt, Human
gcagggacaacugugcaccuga

SEQ ID NO: 900051 - RNA, 22 nt, Human
aggcaacugagaggcccguguu

SEQ ID NO: 900052 - RNA, 22 nt, Human
agcacuguuaugggaugacuua

SEQ ID NO: 900053 - RNA, 22 nt, Human
uaucagcaagauggcaguauag

SEQ ID NO: 900054 - RNA, 22 nt, Human
agacaauauguauauuaagaau

SEQ ID NO: 900055 - RNA, 22 nt, Human
auauuuagcucauuuccagugc

SEQ ID NO: 900056 - RNA, 22 nt, Human
auuugguguucaucuuuuagug

SEQ ID NO: 900057 - RNA, 22 nt, Human
uguccuguucuugcuguguccu

SEQ ID NO: 900058 - RNA, 22 nt, Human
agcucugagaaaguuagaaagu

SEQ ID NO: 900059 - RNA, 22 nt, Human
uacaagauguacuaaaaauuau

SEQ ID NO: 900060 - RNA, 22 nt, Human
cuugcuuguuuugaagaaagau

SEQ ID NO: 900061 - RNA, 22 nt, Human
ucuguaaauccugcucagcaac

SEQ ID NO: 900062 - RNA, 22 nt, Human
aacacuuauccacauuugaaag

SEQ ID NO: 900063 - RNA, 22 nt, Human
cuggccccgguuccuaaaaacc

SEQ ID NO: 900064 - RNA, 22 nt, Human
ggcccaaggcccaggucgagcu

SEQ ID NO: 900065 - RNA, 22 nt, Human
auagcaagguaugacuggagcc

SEQ ID NO: 900066 - RNA, 23 nt, Human
uggagccugggauacaauagaug

SEQ ID NO: 900067 - RNA, 22 nt, Human
aaacagauaaugcuauaaaugg

SEQ ID NO: 900068 - RNA, 22 nt, Human
aauguacaggcuggcuaugggg

SEQ ID NO: 900069 - RNA, 22 nt, Human
uaaacaucaguacaaagacuaa

SEQ ID NO: 900070 - RNA, 22 nt, Human
acuuaaauagaacuccucaaua

SEQ ID NO: 900071 - RNA, 22 nt, Human
gacagucacuuccaggagagga

SEQ ID NO: 900072 - RNA, 22 nt, Human
agagcagcacguuguccccaca

SEQ ID NO: 900073 - RNA, 22 nt, Human
cuuucaaugucaucugugaaug

SEQ ID NO: 900074 - RNA, 22 nt, Human
ucagaagguggagguugcagug

SEQ ID NO: 900075 - RNA, 22 nt, Human
gaaugaauagguguccagaugg

SEQ ID NO: 900076 - RNA, 22 nt, Human
aagcugugugcagaugaucuca

SEQ ID NO: 900077 - RNA, 22 nt, Human
ggacaaagguagacagucucug

SEQ ID NO: 900078 - RNA, 22 nt, Human
aggcaguguauugcuagcggcu

SEQ ID NO: 900079 - RNA, 22 nt, Human
cucuguccuugcacaguuccua

SEQ ID NO: 900080 - RNA, 22 nt, Human
uugauucuucugaauuugcaga

SEQ ID NO: 900081 - RNA, 22 nt, Human
aaauagcagcuuugacagcaca

SEQ ID NO: 900082 - RNA, 23 nt, Human
uccaggcugggacuucaacuggc

SEQ ID NO: 900083 - RNA, 22 nt, Human
acaaugaauaucaugaaguacu

SEQ ID NO: 900084 - RNA, 22 nt, Human
aauugagugcagccagcccagu

SEQ ID NO: 900085 - RNA, 22 nt, Human
uagauaccugcuggaccucauu

SEQ ID NO: 900086 - RNA, 21 nt, Human
ccagccucagaucagggagcu

SEQ ID NO: 900087 - RNA, 22 nt, Human
gcugucacacauggccccagcu

SEQ ID NO: 900088 - RNA, 22 nt, Human
aucaucuucgaaaaaagucaga

SEQ ID NO: 900089 - RNA, 22 nt, Human
gcacagagggcagugagccucu

SEQ ID NO: 900090 - RNA, 22 nt, Human
uagggugguuagaaggaguaug

SEQ ID NO: 900091 - RNA, 22 nt, Human
agccuggauccuaggcucagcu

SEQ ID NO: 900092 - RNA, 22 nt, Human
ugcuuuaacgcugagggucuca

SEQ ID NO: 900093 - RNA, 17 nt, Human
cccagcuggcagugccg

SEQ ID NO: 900094 - RNA, 22 nt, Human
ucagcuccagaguugcacagug

SEQ ID NO: 900095 - RNA, 23 nt, Human
aagaacugcgaauggagaaagua

SEQ ID NO: 900096 - RNA, 22 nt, Human
cagcugauuugagaaagaauga

SEQ ID NO: 900097 - RNA, 22 nt, Human
gaggccuccucugagacaucug

SEQ ID NO: 900098 - RNA, 22 nt, Human
ccagaggucucucuauacuggg

SEQ ID NO: 900099 - RNA, 22 nt, Human
cuaacauuuggaaggcuuauga

SEQ ID NO: 900100 - RNA, 22 nt, Human
ucauaagcuagcugcaccauau

SEQ ID NO: 900101 - RNA, 22 nt, Human
cauaaauucaguucugccucuu

SEQ ID NO: 900102 - RNA, 22 nt, Human
augucuguuugcugagcccggc

SEQ ID NO: 900103 - RNA, 22 nt, Human
ugagugagacaccaaaggcugu

SEQ ID NO: 900104 - RNA, 22 nt, Human
gggugggagucuggcccucaaa

SEQ ID NO: 900105 - RNA, 19 nt, Human
uggaauguuccaaggaggc

SEQ ID NO: 900106 - RNA, 17 nt, Human
aagcauuuaauuugcua

SEQ ID NO: 900107 - RNA, 22 nt, Human
ccugggccuugaccucgugggc

SEQ ID NO: 900108 - RNA, 22 nt, Human
uuacaacagcgauuuaccuguc

SEQ ID NO: 900109 - RNA, 22 nt, Human
guuucaugguuguuugauggca

SEQ ID NO: 900110 - RNA, 21 nt, Human
ccucugugcuaaagggcuccc

SEQ ID NO: 900111 - RNA, 23 nt, Human
aguggcugagaguguuucauaug

SEQ ID NO: 900112 - RNA, 18 nt, Human
ugaggcugaggguagagg

SEQ ID NO: 900113 - RNA, 22 nt, Human
ccugucuggccaccagggcgau

SEQ ID NO: 900114 - RNA, 22 nt, Human
cacacauuucagaugcuacaau

SEQ ID NO: 900115 - RNA, 22 nt, Human
uacagaaaaacuuggaggcuuu

SEQ ID NO: 900116 - RNA, 22 nt, Human
cugccuccugccgugcagcuuc

SEQ ID NO: 900117 - RNA, 21 nt, Human
agaugcugugcuccaggagca

SEQ ID NO: 900118 - RNA, 22 nt, Human
uaaaaggagguugaagcuguca

SEQ ID NO: 900119 - RNA, 23 nt, Human
ccacagagcugccaauuccugug

SEQ ID NO: 900120 - RNA, 22 nt, Human
cagucccaggguugguucagcu

SEQ ID NO: 900121 - RNA, 22 nt, Human
aucagcuuaauucucaacaggu

SEQ ID NO: 900122 - RNA, 22 nt, Human
acaguuugaauaauuuagauag

SEQ ID NO: 900123 - RNA, 22 nt, Human
ugcaagcacucaaugcaaacag

SEQ ID NO: 900124 - RNA, 22 nt, Human
caggagacuauggcccaaggcc

SEQ ID NO: 900125 - RNA, 22 nt, Human
cccaggcuggauuucgguggca

SEQ ID NO: 900126 - RNA, 22 nt, Human
cagcuuuuggcaggaugaccag

SEQ ID NO: 900127 - RNA, 22 nt, Human
ugcagcagggcccaggcacaga

SEQ ID NO: 900128 - RNA, 22 nt, Human
auuguucagaguagggcucugu

SEQ ID NO: 900129 - RNA, 22 nt, Human
augaagcagauuuauuacucac

SEQ ID NO: 900130 - RNA, 22 nt, Human
aagcuccccgaaacccaccucu

SEQ ID NO: 900131 - RNA, 22 nt, Human
gcacauggacaauggaggugca

SEQ ID NO: 900132 - RNA, 22 nt, Human
aacaaauggaacacaaaucuuu

SEQ ID NO: 900133 - RNA, 22 nt, Human
uucagugugcuucaggacguua

SEQ ID NO: 900134 - RNA, 22 nt, Human
cagcugcuguuacugcuuauua

SEQ ID NO: 900135 - RNA, 22 nt, Human
cuguuuaaugagguguaacaac

SEQ ID NO: 900136 - RNA, 22 nt, Human
ucacauuuuaucugagauugac

SEQ ID NO: 900137 - RNA, 22 nt, Human
cuguuauucaagacaaaggcag

SEQ ID NO: 900138 - RNA, 22 nt, Human
gucugcauacaggacaugcaca

SEQ ID NO: 900139 - RNA, 22 nt, Human
cgucuaggccgugcccugaggu

SEQ ID NO: 900140 - RNA, 22 nt, Human
agaagaaacugucggggauauu

SEQ ID NO: 900141 - RNA, 22 nt, Human
aaacaaguguaaacuagucugu

SEQ ID NO: 900142 - RNA, 22 nt, Human
uaauccacggaccggcagcauu

SEQ ID NO: 900143 - RNA, 22 nt, Human
agacuucuaaauagcagcuucu

SEQ ID NO: 900144 - RNA, 22 nt, Human
uuccacuuugggucugugcagg

SEQ ID NO: 900145 - RNA, 22 nt, Human
caagccagucagcucaguagau

SEQ ID NO: 900146 - RNA, 22 nt, Human
uaagagaacuggauagauagga

SEQ ID NO: 900147 - RNA, 22 nt, Human
cauguaaagcacuucauaacag

SEQ ID NO: 900148 - RNA, 22 nt, Human
uuagaaaugucacagaucugau

SEQ ID NO: 900149 - RNA, 22 nt, Human
auaaauuaugaauggcccuuuu

SEQ ID NO: 900150 - RNA, 22 nt, Human
acagguguagaaaacagauuau

SEQ ID NO: 900151 - RNA, 23 nt, Human
agccagggcacugguggagauug

SEQ ID NO: 900152 - RNA, 21 nt, Human
cuugucugcaguguuuauagc

SEQ ID NO: 900153 - RNA, 22 nt, Human
ccagaggugagggggauucuug

SEQ ID NO: 900154 - RNA, 22 nt, Human
uaaggcauaaggaagauuugga

SEQ ID NO: 900155 - RNA, 22 nt, Human
cugcuuuguaaaauagacauaa

SEQ ID NO: 900156 - RNA, 21 nt, Human
gugguucuagagaaacagaau

SEQ ID NO: 900157 - RNA, 22 nt, Human
ugugcuuucaaaguuaaguaaa

SEQ ID NO: 900158 - RNA, 22 nt, Human
uacaaaugaguuguaugaacca

SEQ ID NO: 900159 - RNA, 19 nt, Human
gcgagaacagagcuuacug

SEQ ID NO: 900160 - RNA, 22 nt, Human
gccagaggaacgcugcgcgccc

SEQ ID NO: 900161 - RNA, 22 nt, Human
acauugaauucaaaauuacuga

SEQ ID NO: 900162 - RNA, 22 nt, Human
uuugucuugaggcuggggaagu

SEQ ID NO: 900163 - RNA, 22 nt, Human
acagccagggcauugucgccga

SEQ ID NO: 900164 - RNA, 22 nt, Human
ugaccuguguuugcuguugcuc

SEQ ID NO: 900165 - RNA, 22 nt, Human
gaggcauaaaucacaguguuca

SEQ ID NO: 900166 - RNA, 22 nt, Human
uuccaaacucauaguauggugu

SEQ ID NO: 900167 - RNA, 22 nt, Human
uccagcuccacagccucccugu

SEQ ID NO: 900168 - RNA, 22 nt, Human
auccaaaucuucacacauaaca

SEQ ID NO: 900169 - RNA, 22 nt, Human
auugucuuuaaaaauauacaac

SEQ ID NO: 900170 - RNA, 22 nt, Human
uugaaucucaucccaauguugu

SEQ ID NO: 900171 - RNA, 22 nt, Human
acaggagcccaggaugggcgga

SEQ ID NO: 900172 - RNA, 22 nt, Human
cugcacaaugcaccaucaaguu

SEQ ID NO: 900173 - RNA, 22 nt, Human
uuucuuuaucauagcaucuuug

SEQ ID NO: 900174 - RNA, 22 nt, Human
auguacaaccugcaugacaguc

SEQ ID NO: 900175 - RNA, 22 nt, Human
auucagacuaugaacacgucag

SEQ ID NO: 900176 - RNA, 22 nt, Human
gcuggccugcaaagcccggcug

SEQ ID NO: 900177 - RNA, 22 nt, Human
ucaagauaccaccauuauaugu

SEQ ID NO: 900178 - RNA, 20 nt, Human
cauuuguuagcuuucuacug

SEQ ID NO: 900179 - RNA, 22 nt, Human
aaaaucuggcaacacuaaguuu

SEQ ID NO: 900180 - RNA, 22 nt, Human
caggcccauuuguagccacuuu

SEQ ID NO: 900181 - RNA, 22 nt, Human
cuuaauuuaaaauaguucaggc

SEQ ID NO: 900182 - RNA, 22 nt, Human
ucccacagcuucgugcuucccc

SEQ ID NO: 900183 - RNA, 22 nt, Human
agaaaguuugagaacuguagau

SEQ ID NO: 900184 - RNA, 22 nt, Human
uuaagagguggucgugucugug

SEQ ID NO: 900185 - RNA, 22 nt, Human
uccuucuguagucccugucccu

SEQ ID NO: 900186 - RNA, 22 nt, Human
gcucuggcuuggggcacucguc

SEQ ID NO: 900187 - RNA, 22 nt, Human
ggcuggaaacucagguaggguu

SEQ ID NO: 900188 - RNA, 22 nt, Human
uuagaacaguagaagaaagggu

SEQ ID NO: 900189 - RNA, 22 nt, Human
aagcuguucuccagugacucag

SEQ ID NO: 900190 - RNA, 22 nt, Human
cucaaaauccauaaaaucaggu

SEQ ID NO: 900191 - RNA, 23 nt, Human
gcacugccaugugcucugcaggc

SEQ ID NO: 900192 - RNA, 22 nt, Human
caaagacacgggaaacaacguu

SEQ ID NO: 900193 - RNA, 22 nt, Human
gguggcaguuacaggggcaaau

SEQ ID NO: 900194 - RNA, 22 nt, Human
gccagcuggagacuggcagggg

SEQ ID NO: 900195 - RNA, 22 nt, Human
gucaggccaauacucuccagca

SEQ ID NO: 900196 - RNA, 22 nt, Human
ucauuuaugcaggaauggcaua

SEQ ID NO: 900197 - RNA, 22 nt, Human
ugaauacacuaaaaaucacuuu

SEQ ID NO: 900198 - RNA, 22 nt, Human
ucagcugcacuguucugaccca

SEQ ID NO: 900199 - RNA, 22 nt, Human
guccaggccaugguggacacag

SEQ ID NO: 900200 - RNA, 22 nt, Human
cuuuuacaguggaccugccauu

SEQ ID NO: 900201 - RNA, 22 nt, Human
auguacauuuguaguaauauca

SEQ ID NO: 900202 - RNA, 22 nt, Human
caugaguucaucugcuucucuu

SEQ ID NO: 900203 - RNA, 22 nt, Human
aguucuuuugugaacauaugcu

SEQ ID NO: 900204 - RNA, 22 nt, Human
ucagagaauccguaagucacaa

SEQ ID NO: 900205 - RNA, 22 nt, Human
ucuuagaaugucaacugauguu

SEQ ID NO: 900206 - RNA, 20 nt, Human
acuuuacagagaagacugac

SEQ ID NO: 900207 - RNA, 22 nt, Human
uaucacuacacuaagauacaga

SEQ ID NO: 900208 - RNA, 22 nt, Human
ugccagugggugugcagagacu

SEQ ID NO: 900209 - RNA, 22 nt, Human
gagaacagagauaauuuuacuu

SEQ ID NO: 900210 - RNA, 22 nt, Human
uauaaagaauccagaagagaca

SEQ ID NO: 900211 - RNA, 22 nt, Human
ugugcuucuugcagcuccugua

SEQ ID NO: 900212 - RNA, 22 nt, Human
cgcagaagagguugucuagucc

SEQ ID NO: 900213 - RNA, 22 nt, Human
acaaauguuacauaaguuugga

SEQ ID NO: 900214 - RNA, 22 nt, Human
aaagugcauagaguagugccua

SEQ ID NO: 900215 - RNA, 22 nt, Human
ucucccaggcugcccuguggac

SEQ ID NO: 900216 - RNA, 22 nt, Human
uguaggaaaaacaaugaucugc

SEQ ID NO: 900217 - RNA, 22 nt, Human
uaacuucuuugguuuaaagaga

SEQ ID NO: 900218 - RNA, 22 nt, Human
ccuccaggaacuugagagacac

SEQ ID NO: 900219 - RNA, 22 nt, Human
acauuuuucacauuuguagggu

SEQ ID NO: 900220 - RNA, 20 nt, Human
gccuguccugagugucaugg

SEQ ID NO: 900221 - RNA, 22 nt, Human
caugagauaauuuuucuccagu

SEQ ID NO: 900222 - RNA, 22 nt, Human
ugggcucucuuuaccucauaac

SEQ ID NO: 900223 - RNA, 22 nt, Human
uaagaggcagcauuccucgccu

SEQ ID NO: 900224 - RNA, 22 nt, Human
acuuuacaggcacuucaaguau

SEQ ID NO: 900225 - RNA, 22 nt, Human
ugaauuuaagcacugauguuaa

SEQ ID NO: 900226 - RNA, 22 nt, Human
uucaacuagauuuauacaauuc

SEQ ID NO: 900227 - RNA, 22 nt, Human
aaauaguuuagcucucauuuca

SEQ ID NO: 900228 - RNA, 22 nt, Human
uuuuaacacucagcacuaucuc

SEQ ID NO: 900229 - RNA, 19 nt, Human
uuugaaaggauuguuauuu

SEQ ID NO: 900230 - RNA, 22 nt, Human
agacauuuccuagacaucaaug

SEQ ID NO: 900231 - RNA, 22 nt, Human
ucagugcugcuuuaugacaguu

SEQ ID NO: 900232 - RNA, 22 nt, Human
aguggcugucuuccaaaaucug

SEQ ID NO: 900233 - RNA, 22 nt, Human
auguuugcauucuuauuaucgu

SEQ ID NO: 900234 - RNA, 21 nt, Human
uguuguuuuauggcuaugaau

SEQ ID NO: 900235 - RNA, 22 nt, Human
aaaaggaggucacuuuauuccu

SEQ ID NO: 900236 - RNA, 22 nt, Human
acugugugggccgcucacuggg

SEQ ID NO: 900237 - RNA, 22 nt, Human
gcagggcuaggucuucuagggc

SEQ ID NO: 900238 - RNA, 22 nt, Human
accaggaggccuggagcacaaa

SEQ ID NO: 900239 - RNA, 22 nt, Human
uaaauaucaccuggaauuguua

SEQ ID NO: 900240 - RNA, 22 nt, Human
gcugaggguaacacuucgggau

SEQ ID NO: 900241 - RNA, 22 nt, Human
uugcuuuauuggguuuacugcc

SEQ ID NO: 900242 - RNA, 23 nt, Human
agggguggucaguacccgcagug

SEQ ID NO: 900243 - RNA, 22 nt, Human
agaaggcaucagaaguguguag

SEQ ID NO: 900244 - RNA, 22 nt, Human
gggcuccaucacaggcuccauc

SEQ ID NO: 900245 - RNA, 22 nt, Human
agcucagaacugcagacaugug

SEQ ID NO: 900246 - RNA, 22 nt, Human
cccucagcuucucccugcagcu

SEQ ID NO: 900247 - RNA, 22 nt, Human
gcucuugacagcuacaucuggc

SEQ ID NO: 900248 - RNA, 22 nt, Human
ugucugguggguugacaggcag

SEQ ID NO: 900249 - RNA, 22 nt, Human
caagauggagaagcagcaaggg

SEQ ID NO: 900250 - RNA, 22 nt, Human
ccucacugucaucaguaguuau

SEQ ID NO: 900251 - RNA, 22 nt, Human
ugauucaacuuucauaacaaaa

SEQ ID NO: 900252 - RNA, 22 nt, Human
aggaagcaaaaggcagggucua

SEQ ID NO: 900253 - RNA, 22 nt, Human
uugagaaugaugagauucuucc

SEQ ID NO: 900254 - RNA, 22 nt, Human
guccugguccugccuccccaug

SEQ ID NO: 900255 - RNA, 22 nt, Human
agggaagcaggaauagcucuga

SEQ ID NO: 900256 - RNA, 22 nt, Human
ggcaguguucugguugucagga

SEQ ID NO: 900257 - RNA, 21 nt, Human
ggagauggguaucgccugggc

SEQ ID NO: 900258 - RNA, 22 nt, Human
ugucucagguacaugcguccug

SEQ ID NO: 900259 - RNA, 20 nt, Human
ugcuauauugaagugcaguu

SEQ ID NO: 900260 - RNA, 22 nt, Human
uagaaacacagagagacccaug

SEQ ID NO: 900261 - RNA, 22 nt, Human
gugucaacagccgaagauaaau

SEQ ID NO: 900262 - RNA, 22 nt, Human
acagaacuucaguaguauuccc

SEQ ID NO: 900263 - RNA, 22 nt, Human
cggccaagccggggccccgaag

SEQ ID NO: 900264 - RNA, 22 nt, Human
guacaaaggcagaauuggguag

SEQ ID NO: 900265 - RNA, 22 nt, Human
uuuaaauaggacuccugggggu

SEQ ID NO: 900266 - RNA, 22 nt, Human
uugagaaaacacagaguuuauu

SEQ ID NO: 900267 - RNA, 22 nt, Human
uguauacaggauuacucauagc

SEQ ID NO: 900268 - RNA, 22 nt, Human
ugcuuuaagagauuguuaguac

SEQ ID NO: 900269 - RNA, 22 nt, Human
ucuuucaaaugcuugaauugga

SEQ ID NO: 900270 - RNA, 22 nt, Human
acucacagcaugagcuuggcag

SEQ ID NO: 900271 - RNA, 22 nt, Human
uggguagggacuuagcuggcug

SEQ ID NO: 900272 - RNA, 22 nt, Human
agcccugagccagccuggucag

SEQ ID NO: 900273 - RNA, 22 nt, Human
gggugaggccuugcugccauca

SEQ ID NO: 900274 - RNA, 22 nt, Human
uaaagguuaguagcagggaaac

SEQ ID NO: 900275 - RNA, 17 nt, Human
ggcagcugccacuuuuu

SEQ ID NO: 900276 - RNA, 18 nt, Human
ugcagcauguucccauaa

SEQ ID NO: 900277 - RNA, 22 nt, Human
gugucaggggcagccaggaaau

SEQ ID NO: 900278 - RNA, 19 nt, Human
aacuguaauuaauacccua

SEQ ID NO: 900279 - RNA, 22 nt, Human
uaacaaggagauggugggucau

SEQ ID NO: 900280 - RNA, 22 nt, Human
aagaacaugaguuaugaugauu

SEQ ID NO: 900281 - RNA, 21 nt, Human
cggcuucauuuucuucugguu

SEQ ID NO: 900282 - RNA, 22 nt, Human
uggcagcaauuugugauguuga

SEQ ID NO: 900283 - RNA, 22 nt, Human
ccagggucacaaauaacugcag

SEQ ID NO: 900284 - RNA, 22 nt, Human
aucuguuccccuaugcucucua

SEQ ID NO: 900285 - RNA, 22 nt, Human
ucagagacuguaggagcagccu

SEQ ID NO: 900286 - RNA, 22 nt, Human
guaaagaaggcaaccugguuau

SEQ ID NO: 900287 - RNA, 22 nt, Human
cccggaaacaggugacaaucuc

SEQ ID NO: 900288 - RNA, 22 nt, Human
acaagauuuuaugacucuuuuu

SEQ ID NO: 900289 - RNA, 22 nt, Human
uggcucuguucgccaucaggag

SEQ ID NO: 900290 - RNA, 22 nt, Human
gaggaggcuggcgccgccugcc

SEQ ID NO: 900291 - RNA, 21 nt, Human
guuuucaugauagagucugua

SEQ ID NO: 900292 - RNA, 22 nt, Human
cucaggauuuacuaauuucaag

SEQ ID NO: 900293 - RNA, 22 nt, Human
ucuuggcuccuguugucaucag

SEQ ID NO: 900294 - RNA, 22 nt, Human
cacacaguaggcacucauuaau

SEQ ID NO: 900295 - RNA, 22 nt, Human
cagcagagcuuauguuggguca

SEQ ID NO: 900296 - RNA, 22 nt, Human
gcaggagagccagcaggcuucc

SEQ ID NO: 900297 - RNA, 22 nt, Human
uacuuacaugaauucaagagca

SEQ ID NO: 900298 - RNA, 18 nt, Human
uuuguacccuuuuccuag

SEQ ID NO: 900299 - RNA, 22 nt, Human
aggcagcagugauaagauagga

SEQ ID NO: 900300 - RNA, 22 nt, Human
ugccuuaaguaagacugaacag

SEQ ID NO: 900301 - RNA, 22 nt, Human
aaagcagguugcaauuacagug

SEQ ID NO: 900302 - RNA, 22 nt, Human
ugaggacaaucccuaacucaga

SEQ ID NO: 900303 - RNA, 22 nt, Human
agcagcauguugggaugugaaa

SEQ ID NO: 900304 - RNA, 22 nt, Human
ugaggccaugcccgugccggcc

SEQ ID NO: 900305 - RNA, 22 nt, Human
caggccugucugcacaugaggc

SEQ ID NO: 900306 - RNA, 22 nt, Human
cauuguauugaggauacuuaag

SEQ ID NO: 900307 - RNA, 22 nt, Human
cauuuucagcacccaucugaaa

SEQ ID NO: 900308 - RNA, 22 nt, Human
cagcaggaccauugaggcauca

SEQ ID NO: 900309 - RNA, 22 nt, Human
cagugggugaugaguccugggg

SEQ ID NO: 900310 - RNA, 22 nt, Human
gugcucauguccuuucacugca

SEQ ID NO: 900311 - RNA, 22 nt, Human
uaaugaggggaaccaucuguag

SEQ ID NO: 900312 - RNA, 22 nt, Human
gaacaguaucaguagugccagu

SEQ ID NO: 900313 - RNA, 22 nt, Human
uacagauauagggcgagcuuag

SEQ ID NO: 900314 - RNA, 22 nt, Human
agaguuuacagaaauaagcugu

SEQ ID NO: 900315 - RNA, 22 nt, Human
agaaguucuggagacggaagug

SEQ ID NO: 900316 - RNA, 22 nt, Human
augaaagcucagugcacugaca

SEQ ID NO: 900317 - RNA, 22 nt, Human
ugaaaaaccucaguccgcuuua

SEQ ID NO: 900318 - RNA, 19 nt, Human
aggguuacccgcugccacc

SEQ ID NO: 900319 - RNA, 22 nt, Human
caaggcugcuucagacuaguga

SEQ ID NO: 900320 - RNA, 22 nt, Human
uccagcuugccuggucuuuugg

SEQ ID NO: 900321 - RNA, 20 nt, Human
uagaaucuggugauguaucg

SEQ ID NO: 900322 - RNA, 22 nt, Human
gcauuuuucuaaucauuggcau

SEQ ID NO: 900323 - RNA, 22 nt, Human
agugucugagcuaucauuaggg

SEQ ID NO: 900324 - RNA, 19 nt, Human
ugugauaagcagaauucca

SEQ ID NO: 900325 - RNA, 22 nt, Human
uuuuucuagcucaaagauucua

SEQ ID NO: 900326 - RNA, 22 nt, Human
aauauaguucugguauuguuaa

SEQ ID NO: 900327 - RNA, 22 nt, Human
gugggucccuaaacacauccca

SEQ ID NO: 900328 - RNA, 22 nt, Human
ucuugggauugcccugcaguuc

SEQ ID NO: 900329 - RNA, 22 nt, Human
ucaguaauauucuuuaaaauac

SEQ ID NO: 900330 - RNA, 22 nt, Human
augaggcaucuaacauugcaaa

SEQ ID NO: 900331 - RNA, 23 nt, Human
gcagugugaauccaguguuucag

SEQ ID NO: 900332 - RNA, 22 nt, Human
uuccuuugggaaaucacuaagg

SEQ ID NO: 900333 - RNA, 21 nt, Human
auucaguuugacaucuagcag

SEQ ID NO: 900334 - RNA, 22 nt, Human
gcauggcaaauaucgagggcag

SEQ ID NO: 900335 - RNA, 22 nt, Human
uccaggcuggagugcaguggcg

SEQ ID NO: 900336 - RNA, 22 nt, Human
cuguggcuuuuccggggagccu

SEQ ID NO: 900337 - RNA, 22 nt, Human
gcuagcagguugcaucugucuu

SEQ ID NO: 900338 - RNA, 23 nt, Human
ggcacagaugcugagcaugugca

SEQ ID NO: 900339 - RNA, 22 nt, Human
uggcuucauucagcaugacagu

SEQ ID NO: 900340 - RNA, 22 nt, Human
gaaacauucagucaacaguguu

SEQ ID NO: 900341 - RNA, 22 nt, Human
uccaggcaagggaggagcaugg

SEQ ID NO: 900342 - RNA, 20 nt, Human
agccuggcaaacacccccag

SEQ ID NO: 900343 - RNA, 22 nt, Human
uuucaugucauuccauuucaga

SEQ ID NO: 900344 - RNA, 22 nt, Human
agaaggaagccaggagggugca

SEQ ID NO: 900345 - RNA, 19 nt, Human
ugccccugcagucuaccca

SEQ ID NO: 900346 - RNA, 22 nt, Human
gggcuagaauccgcgucucuug

SEQ ID NO: 900347 - RNA, 22 nt, Human
uacuacaaggccgaagcucuca

SEQ ID NO: 900348 - RNA, 22 nt, Human
gcauucaucuaguaucacucug

SEQ ID NO: 900349 - RNA, 22 nt, Human
gaaauagaagcugccaauuucu

SEQ ID NO: 900350 - RNA, 22 nt, Human
auucaagguuuauucaguuuag

SEQ ID NO: 900351 - RNA, 22 nt, Human
ucagaggacagcagcuaaauaa

SEQ ID NO: 900352 - RNA, 23 nt, Human
aagcuucuaucucugcagaagga

SEQ ID NO: 900353 - RNA, 21 nt, Human
aucugauguauaaauaccucu

SEQ ID NO: 900354 - RNA, 22 nt, Human
ugccaagcacagaggggccacu

SEQ ID NO: 900355 - RNA, 22 nt, Human
ugugaagaguagacauguggug

SEQ ID NO: 900356 - RNA, 22 nt, Human
ugugaggaguaggcugagggug

SEQ ID NO: 900357 - RNA, 22 nt, Human
gauuuaaaguagaccuuuguuu

SEQ ID NO: 900358 - RNA, 22 nt, Human
ucugagccguauggcuuggcua

SEQ ID NO: 900359 - RNA, 22 nt, Human
gggcuccaaaauccuguagccu

SEQ ID NO: 900360 - RNA, 19 nt, Human
acuucuuuucaacacagga

SEQ ID NO: 900361 - RNA, 23 nt, Human
cugagggcuggucugaagucugc

SEQ ID NO: 900362 - RNA, 22 nt, Human
agggccuggcgcguggccgccg

SEQ ID NO: 900363 - RNA, 22 nt, Human
ggcuucucucuucacauggcuu

SEQ ID NO: 900364 - RNA, 22 nt, Human
gaggguccccaugcagagcuca

SEQ ID NO: 900365 - RNA, 18 nt, Human
ggccagccccaggccagc

SEQ ID NO: 900366 - RNA, 21 nt, Human
gauaaagcagcuugccuaagg

SEQ ID NO: 900367 - RNA, 22 nt, Human
ccuggcagaaagaguuacaccu

SEQ ID NO: 900368 - RNA, 22 nt, Human
aggggagcaacauagucacucu

SEQ ID NO: 900369 - RNA, 22 nt, Human
ccuccugcacuugcuuuccuuc

SEQ ID NO: 900370 - RNA, 22 nt, Human
caacugaacugauaucaacuau

SEQ ID NO: 900371 - RNA, 22 nt, Human
ggugucuguugccuccugguua

SEQ ID NO: 900372 - RNA, 22 nt, Human
cuugggaaugcuaacagaugac

SEQ ID NO: 900373 - RNA, 22 nt, Human
gugcagcagggggaagacagug

SEQ ID NO: 900374 - RNA, 22 nt, Human
aaaguuguaauggaagaaaugc

SEQ ID NO: 900375 - RNA, 22 nt, Human
cugcaugguucaaaugagcuaa

SEQ ID NO: 900376 - RNA, 22 nt, Human
ccucugugugugcaugcaugcg

SEQ ID NO: 900377 - RNA, 22 nt, Human
aaacaggcaucacucagcaaag

SEQ ID NO: 900378 - RNA, 22 nt, Human
augugucugaccacuguauugg

SEQ ID NO: 900379 - RNA, 22 nt, Human
cccagagaaccuucugugccac

SEQ ID NO: 900380 - RNA, 22 nt, Human
gccuccggaguugcagugucuu

SEQ ID NO: 900381 - RNA, 22 nt, Human
aauucuguaacuuuacugaauu

SEQ ID NO: 900382 - RNA, 22 nt, Human
ucaagcagcuuuuacagaagag

SEQ ID NO: 900383 - RNA, 22 nt, Human
uuaggaaacaguagccuuugcu

SEQ ID NO: 900384 - RNA, 22 nt, Human
ucaaagacauggggaagcugag

SEQ ID NO: 900385 - RNA, 19 nt, Human
uggcugggcgugccuccgu

SEQ ID NO: 900386 - RNA, 22 nt, Human
gaagagcugcucagaacaugau

SEQ ID NO: 900387 - RNA, 22 nt, Human
cuguacaucccgagagccagua

SEQ ID NO: 900388 - RNA, 22 nt, Human
agcaucaacaaugaacauaaau

SEQ ID NO: 900389 - RNA, 22 nt, Human
auguacuaugcagucaacuguu

SEQ ID NO: 900390 - RNA, 20 nt, Human
ugccccaggccugcaccugc

SEQ ID NO: 900391 - RNA, 22 nt, Human
ugcuuuauucaggguuuacccc

SEQ ID NO: 900392 - RNA, 22 nt, Human
cuggcugacaccuugauagcag

SEQ ID NO: 900393 - RNA, 22 nt, Human
ugaauucuggcucuucuguuua

SEQ ID NO: 900394 - RNA, 22 nt, Human
cacauuguauuguggaaaguua

SEQ ID NO: 900395 - RNA, 22 nt, Human
caguaauaucuguugaagcuau

SEQ ID NO: 900396 - RNA, 22 nt, Human
ggcagcaacagguguguuguga

SEQ ID NO: 900397 - RNA, 23 nt, Human
ucaucuguaacagccuaugaaau

SEQ ID NO: 900398 - RNA, 22 nt, Human
gcuagccugcaguggcuauggu

SEQ ID NO: 900399 - RNA, 22 nt, Human
agcugcuguggccacaucuggc

SEQ ID NO: 900400 - RNA, 22 nt, Human
uuaaaucuguucucaugucugu

SEQ ID NO: 900401 - RNA, 22 nt, Human
ugucaaugaagucauccuugug

SEQ ID NO: 900402 - RNA, 22 nt, Human
uugguagaaugaacauucauug

SEQ ID NO: 900403 - RNA, 17 nt, Human
ucuccuggcucuaucag

SEQ ID NO: 900404 - RNA, 22 nt, Human
gucccagggaugcagacaugag

SEQ ID NO: 900405 - RNA, 22 nt, Human
gagugcaguuggggugagggga

SEQ ID NO: 900406 - RNA, 22 nt, Human
uuucuuccuuaccuuacuagag

SEQ ID NO: 900407 - RNA, 22 nt, Human
gcccagaguucaaggcugcagu

SEQ ID NO: 900408 - RNA, 22 nt, Human
gggcuggaggugagcaggacag

SEQ ID NO: 900409 - RNA, 16 nt, Human
ugacccuugaccagcc

SEQ ID NO: 900410 - RNA, 22 nt, Human
acccuaauaaucacagacuagu

SEQ ID NO: 900411 - RNA, 22 nt, Human
gccugcuuccuagccuuccaag

SEQ ID NO: 900412 - RNA, 22 nt, Human
guauugcaauuacucuucuucu

SEQ ID NO: 900413 - RNA, 22 nt, Human
ugucaggucuaaaaugggucuc

SEQ ID NO: 900414 - RNA, 23 nt, Human
aauuacaaccaagaacuggaagg

SEQ ID NO: 900415 - RNA, 22 nt, Human
uauaggaaguaauuguugccug

SEQ ID NO: 900416 - RNA, 22 nt, Human
ugagguagaagccuggguugag

SEQ ID NO: 900417 - RNA, 22 nt, Human
acuaauagagacaaacauagau

SEQ ID NO: 900418 - RNA, 22 nt, Human
gaggcagcaaaauauaucauaa

SEQ ID NO: 900419 - RNA, 22 nt, Human
uguuugaaaaguggagauuuau

SEQ ID NO: 900420 - RNA, 22 nt, Human
aaggcaaugguuucugugccuu

SEQ ID NO: 900421 - RNA, 22 nt, Human
uaaaucagggagucaucugcga

SEQ ID NO: 900422 - RNA, 22 nt, Human
ugggcuccuugggagcaaguga

SEQ ID NO: 900423 - RNA, 22 nt, Human
gaggcaagagaagccagcuuuc

SEQ ID NO: 900424 - RNA, 22 nt, Human
acagaauuaacauuugaugaau

SEQ ID NO: 900425 - RNA, 22 nt, Human
uuaguaucuggaaaucacauua

SEQ ID NO: 900426 - RNA, 22 nt, Human
gaaucaauugugaagacuauga

SEQ ID NO: 900427 - RNA, 22 nt, Human
aucuaacacuguaaacugucuu

SEQ ID NO: 900428 - RNA, 22 nt, Human
uagaaccaguccacagaauuug

SEQ ID NO: 900429 - RNA, 22 nt, Human
ucaacaauaggauauagcaggu

SEQ ID NO: 900430 - RNA, 22 nt, Human
gcaagcugugauuuaugugaau

SEQ ID NO: 900431 - RNA, 22 nt, Human
aacuugauccugcuggguacua

SEQ ID NO: 900432 - RNA, 22 nt, Human
agggcugcaucugccuggugaa

SEQ ID NO: 900433 - RNA, 22 nt, Human
aauugcauuacagaaacuuuca

SEQ ID NO: 900434 - RNA, 22 nt, Human
cuggggcuguaggaggacuuau

SEQ ID NO: 900435 - RNA, 22 nt, Human
ggagucuguuuuacaugcagga

SEQ ID NO: 900436 - RNA, 22 nt, Human
uaaagcuagccaaccacugucu

SEQ ID NO: 900437 - RNA, 23 nt, Human
ccagaaucuacucauuggaauga

SEQ ID NO: 900438 - RNA, 22 nt, Human
cugcagcuuucgcuccaucagc

SEQ ID NO: 900439 - RNA, 22 nt, Human
uggcccugcuguaucaucugcu

SEQ ID NO: 900440 - RNA, 22 nt, Human
gaggaggcuguuucucugcauu

SEQ ID NO: 900441 - RNA, 22 nt, Human
ugagacaauauccuuuguaacc

SEQ ID NO: 900442 - RNA, 22 nt, Human
acauuucucauaggagagccac

SEQ ID NO: 900443 - RNA, 22 nt, Human
uucauguguuugauagcccaga

SEQ ID NO: 900444 - RNA, 22 nt, Human
cucugccagccaaaauuuauga

SEQ ID NO: 900445 - RNA, 22 nt, Human
ucacagacuugucuccagggau

SEQ ID NO: 900446 - RNA, 22 nt, Human
agaggcugugcccaccaggcaa

SEQ ID NO: 900447 - RNA, 22 nt, Human
cagcagcaggcgcacggccguc

SEQ ID NO: 900448 - RNA, 22 nt, Human
gcauuaaaugcuagggaccuaa

SEQ ID NO: 900449 - RNA, 22 nt, Human
agggcagagcacugaauuggga

SEQ ID NO: 900450 - RNA, 22 nt, Human
auaugaaaauguuuuagcugua

SEQ ID NO: 900451 - RNA, 22 nt, Human
uacaguauuaugagugauugaa

SEQ ID NO: 900452 - RNA, 22 nt, Human
gcauggcaagaucaggagacca

SEQ ID NO: 900453 - RNA, 22 nt, Human
cuggccgccuggggccggguga

SEQ ID NO: 900454 - RNA, 22 nt, Human
aaaugccucuggguuauucuag

SEQ ID NO: 900455 - RNA, 22 nt, Human
aaagcaguaguuuucaaauagu

SEQ ID NO: 900456 - RNA, 22 nt, Human
gagcucuggguguguugucagu

SEQ ID NO: 900457 - RNA, 22 nt, Human
agcugauuccacuuuuucccca

SEQ ID NO: 900458 - RNA, 22 nt, Human
aaggaagccuugccugaauaca

SEQ ID NO: 900459 - RNA, 22 nt, Human
agcuaaacuagguaaacagcag

SEQ ID NO: 900460 - RNA, 22 nt, Human
ucagcagacuaggcagauuacu

SEQ ID NO: 900461 - RNA, 22 nt, Human
auuuucucuuuguauaugcuag

SEQ ID NO: 900462 - RNA, 22 nt, Human
cccuaagacccucaagaucucc

SEQ ID NO: 900463 - RNA, 22 nt, Human
gaagaacaccugcugcccagug

SEQ ID NO: 900464 - RNA, 22 nt, Human
uuuaggaauauuuucuuucagg

SEQ ID NO: 900465 - RNA, 22 nt, Human
aggcgcugcgcuggggccagaa

SEQ ID NO: 900466 - RNA, 22 nt, Human
acaucuucacugguuucuggaa

SEQ ID NO: 900467 - RNA, 22 nt, Human
uucauugauuuccuuggaauaa

SEQ ID NO: 900468 - RNA, 22 nt, Human
cagguccaagagauccuccuac

SEQ ID NO: 900469 - RNA, 22 nt, Human
caguguggagggagagagccug

SEQ ID NO: 900470 - RNA, 22 nt, Human
cauugagagaaucacauagaag

SEQ ID NO: 900471 - RNA, 22 nt, Human
ugcauuggguugacauacuaaa

SEQ ID NO: 900472 - RNA, 22 nt, Human
ugcugaaguccaucuguuugac

SEQ ID NO: 900473 - RNA, 22 nt, Human
ucagaaaccccaacaauggaga

SEQ ID NO: 900474 - RNA, 22 nt, Human
aucugucccugguccaagauuu

SEQ ID NO: 900475 - RNA, 22 nt, Human
guguauguguuuauagggaggu

SEQ ID NO: 900476 - RNA, 20 nt, Human
augucugaaguaauccauuu

SEQ ID NO: 900477 - RNA, 22 nt, Human
ugggugggagcgcccugucugg

SEQ ID NO: 900478 - RNA, 22 nt, Human
cuuauuucuccauccagaguca

SEQ ID NO: 900479 - RNA, 22 nt, Human
uacauuguacuuacaaauagug

SEQ ID NO: 900480 - RNA, 22 nt, Human
aguauauuuguuaagauuauuc

SEQ ID NO: 900481 - RNA, 22 nt, Human
ucuaagaauugaaguggcucuu

SEQ ID NO: 900482 - RNA, 22 nt, Human
cagcugaagagaggugcugagu

SEQ ID NO: 900483 - RNA, 22 nt, Human
uuuucaauuuugaggcaguggu

SEQ ID NO: 900484 - RNA, 22 nt, Human
uuccuaacuggccuuuauggau

SEQ ID NO: 900485 - RNA, 18 nt, Human
gcuguucuucgcacuggc

SEQ ID NO: 900486 - RNA, 22 nt, Human
ugccuguaauaaugcuaagcac

SEQ ID NO: 900487 - RNA, 20 nt, Human
augcaugcaugcacaugcac

SEQ ID NO: 900488 - RNA, 22 nt, Human
uacacaugcucagauuccugug

SEQ ID NO: 900489 - RNA, 22 nt, Human
uccuuggcagcagggagcauga

SEQ ID NO: 900490 - RNA, 22 nt, Human
agccagcugccuuucacaucug

SEQ ID NO: 900491 - RNA, 22 nt, Human
augggcucuaugucuaggagau

SEQ ID NO: 900492 - RNA, 21 nt, Human
ggcaagaaacacaaucaagua

SEQ ID NO: 900493 - RNA, 22 nt, Human
caaacauuuugagugguuucug

SEQ ID NO: 900494 - RNA, 20 nt, Human
aggcagagcgcacuuuuaga

SEQ ID NO: 900495 - RNA, 22 nt, Human
ugcugggccuuuaccuccaggg

SEQ ID NO: 900496 - RNA, 22 nt, Human
ucucuggaauuggcugaggcaa

SEQ ID NO: 900497 - RNA, 22 nt, Human
cugagggagaagucacgggcag

SEQ ID NO: 900498 - RNA, 22 nt, Human
acuuuagucuguuucauuaucu

SEQ ID NO: 900499 - RNA, 22 nt, Human
ccugccaucagaaacacucaaa

SEQ ID NO: 900500 - RNA, 22 nt, Human
ucuaaacuacgucaaaacuagu

SEQ ID NO: 900501 - RNA, 22 nt, Human
aacacaguuaguaagggaaaua

SEQ ID NO: 900502 - RNA, 22 nt, Human
ccuuaaacucugauaugauauu

SEQ ID NO: 900503 - RNA, 22 nt, Human
cuacaacauuaugcuuucuguc

SEQ ID NO: 900504 - RNA, 22 nt, Human
cuuggauaucacucagaaagau

SEQ ID NO: 900505 - RNA, 22 nt, Human
gcucuccaaacccuguggcuuu

SEQ ID NO: 900506 - RNA, 21 nt, Human
uucccagcaccuagcacaggu

SEQ ID NO: 900507 - RNA, 22 nt, Human
cugggcaggagaggugguugga

SEQ ID NO: 900508 - RNA, 22 nt, Human
uacauucaacaugucacuaugu

SEQ ID NO: 900509 - RNA, 22 nt, Human
aaagcucuuauguaaacagaaa

SEQ ID NO: 900510 - RNA, 22 nt, Human
ggucagccuuggauuugguagc

SEQ ID NO: 900511 - RNA, 22 nt, Human
agagaugagaacaugcuuggau

SEQ ID NO: 900512 - RNA, 22 nt, Human
uuucuauaacuggacuggauug

SEQ ID NO: 900513 - RNA, 23 nt, Human
ugugccauugaggcugaggcuca

SEQ ID NO: 900514 - RNA, 22 nt, Human
uauguuucugggcuugauauuu

SEQ ID NO: 900515 - RNA, 22 nt, Human
ggacugaaaucuuuccauguca

SEQ ID NO: 900516 - RNA, 22 nt, Human
ggcggggucugagcgccgcgcc

SEQ ID NO: 900517 - RNA, 22 nt, Human
ucacccagcgggcgcacacucg

SEQ ID NO: 900518 - RNA, 22 nt, Human
cuggaccagccuccgccuucac

SEQ ID NO: 900519 - RNA, 22 nt, Human
gccugggacccuuagcucuugg

SEQ ID NO: 900520 - RNA, 22 nt, Human
uguuggaaggcaagcagcaauu

SEQ ID NO: 900521 - RNA, 22 nt, Human
aggcaaaucugagacauuuaaa

SEQ ID NO: 900522 - RNA, 22 nt, Human
auguccuuccugagaucccugu

SEQ ID NO: 900523 - RNA, 22 nt, Human
agaacauaucuguuuucuaacu

SEQ ID NO: 900524 - RNA, 22 nt, Human
ugcaggguagaugcaggcugug

SEQ ID NO: 900525 - RNA, 22 nt, Human
uaacuucaaaauugccacaugu

SEQ ID NO: 900526 - RNA, 17 nt, Human
uguauguggauacacua

SEQ ID NO: 900527 - RNA, 22 nt, Human
ucuagaauuuugccauauagcu

SEQ ID NO: 900528 - RNA, 22 nt, Human
uguacacaaugauaaauuauua

SEQ ID NO: 900529 - RNA, 22 nt, Human
agaugguuaucuuuucuuugua

SEQ ID NO: 900530 - RNA, 22 nt, Human
ugcaguccaagagucuccuggu

SEQ ID NO: 900531 - RNA, 22 nt, Human
acccaggcuggaaugcaguggc

SEQ ID NO: 900532 - RNA, 22 nt, Human
uucuggagaggaacagaaaggu

SEQ ID NO: 900533 - RNA, 22 nt, Human
gccuauuuuauuaugcauguaa

SEQ ID NO: 900534 - RNA, 22 nt, Human
acccaggcuggagugcagugac

SEQ ID NO: 900535 - RNA, 22 nt, Human
ucuuuuccuucccuacagaucu

SEQ ID NO: 900536 - RNA, 22 nt, Human
ugugcaguuuuaaguggucuaa

SEQ ID NO: 900537 - RNA, 22 nt, Human
aaguuugguccuucuaagaaga

SEQ ID NO: 900538 - RNA, 22 nt, Human
acagggcuggggcacuuggcug

SEQ ID NO: 900539 - RNA, 22 nt, Human
aggcuccuuguucaucauccau

SEQ ID NO: 900540 - RNA, 22 nt, Human
ucaaaguacuacucaguucagc

SEQ ID NO: 900541 - RNA, 22 nt, Human
aggauaaaugaucuagauuuuc

SEQ ID NO: 900542 - RNA, 22 nt, Human
cagaaagccgacuuacaaugga

SEQ ID NO: 900543 - RNA, 22 nt, Human
uacagguuccaggaauuaggac

SEQ ID NO: 900544 - RNA, 22 nt, Human
aggcgcaggguuuggacccagg

SEQ ID NO: 900545 - RNA, 22 nt, Human
ugggaauguggcaaggcauaga

SEQ ID NO: 900546 - RNA, 22 nt, Human
cagcaggggaacugugggccag

SEQ ID NO: 900547 - RNA, 22 nt, Human
augucccagcugagagacaacu

SEQ ID NO: 900548 - RNA, 22 nt, Human
ccugggagccaagccucugugu

SEQ ID NO: 900549 - RNA, 22 nt, Human
aggccagauauugugcuaccca

SEQ ID NO: 900550 - RNA, 22 nt, Human
uucuuuugcaagacuauugauu

SEQ ID NO: 900551 - RNA, 22 nt, Human
uccugagcuuuacaguaaggac

SEQ ID NO: 900552 - RNA, 22 nt, Human
uugucucugggacaugguauua

SEQ ID NO: 900553 - RNA, 22 nt, Human
cuggauaaucacagaggagcau

SEQ ID NO: 900554 - RNA, 22 nt, Human
cauuacaucuuugaugcaguau

SEQ ID NO: 900555 - RNA, 22 nt, Human
agggagcugagcugugagcagc

SEQ ID NO: 900556 - RNA, 22 nt, Human
uuucucucugacugggagcuga

SEQ ID NO: 900557 - RNA, 22 nt, Human
ucccucuguucuguuccaagug

SEQ ID NO: 900558 - RNA, 22 nt, Human
uucaaagcagagggucaauaca

SEQ ID NO: 900559 - RNA, 22 nt, Human
uaauacuuuugccuuguauuca

SEQ ID NO: 900560 - RNA, 22 nt, Human
acuucuaagcucaaauugguau

SEQ ID NO: 900561 - RNA, 21 nt, Human
uccaggaguggcugggcaggg

SEQ ID NO: 900562 - RNA, 22 nt, Human
aaagacuaagaagaguauuauu

SEQ ID NO: 900563 - RNA, 22 nt, Human
ugaaauguugguaauuuuauau

SEQ ID NO: 900564 - RNA, 20 nt, Human
agaggccaguuaggagucua

SEQ ID NO: 900565 - RNA, 22 nt, Human
cagcuguggggagcuugggcca

SEQ ID NO: 900566 - RNA, 22 nt, Human
cucagggaggagcuucugggcc

SEQ ID NO: 900567 - RNA, 22 nt, Human
aaggucacacucccagagcuga

SEQ ID NO: 900568 - RNA, 22 nt, Human
agggcucaccacugugcacucc

SEQ ID NO: 900569 - RNA, 22 nt, Human
aggcccuggccugacucaaugu

SEQ ID NO: 900570 - RNA, 22 nt, Human
gaugagguaagaauguaacacc

SEQ ID NO: 900571 - RNA, 22 nt, Human
ucugccugagggagcugaggaa

SEQ ID NO: 900572 - RNA, 22 nt, Human
ggcucccuguucuauucccugg

SEQ ID NO: 900573 - RNA, 22 nt, Human
uggcagcaccagcaguguccuu

SEQ ID NO: 900574 - RNA, 22 nt, Human
cuguguguccucggacgaguuu

SEQ ID NO: 900575 - RNA, 22 nt, Human
ugacccuuggucuugcuuuucc

SEQ ID NO: 900576 - RNA, 18 nt, Human
agcuccugaacucugugg

SEQ ID NO: 900577 - RNA, 23 nt, Human
gggaccaggcccuuccugguuug

SEQ ID NO: 900578 - RNA, 22 nt, Human
ggucagcagugcagggcagagc

SEQ ID NO: 900579 - RNA, 22 nt, Human
caguggguccuaaguacaguuc

SEQ ID NO: 900580 - RNA, 22 nt, Human
agaauacaucaaucuauuuucu

SEQ ID NO: 900581 - RNA, 22 nt, Human
ccugggcagggagaccaggcuc

SEQ ID NO: 900582 - RNA, 22 nt, Human
auucuaaagcuuguggagcuua

SEQ ID NO: 900583 - RNA, 22 nt, Human
ugaggggguuaauuaggagagu

SEQ ID NO: 900584 - RNA, 22 nt, Human
ggacccagcucugagacccugc

SEQ ID NO: 900585 - RNA, 22 nt, Human
acaggcuuuuuugcucucgaau

SEQ ID NO: 900586 - RNA, 20 nt, Human
ucccucaggucauugggcug

SEQ ID NO: 900587 - RNA, 22 nt, Human
ccccagcagacucagggcaggu

SEQ ID NO: 900588 - RNA, 22 nt, Human
auagauauuagcaaaauuuuau

SEQ ID NO: 900589 - RNA, 22 nt, Human
uggcagaugcguuuucauuuuc

SEQ ID NO: 900590 - RNA, 22 nt, Human
ucagugcaucacagaacuuugu

SEQ ID NO: 900591 - RNA, 22 nt, Human
ccacaggacggaggucuggccg

SEQ ID NO: 900592 - RNA, 22 nt, Human
ucauuaauaagucuaacucucc

SEQ ID NO: 900593 - RNA, 22 nt, Human
gugguuguuuaggucguggauc

SEQ ID NO: 900594 - RNA, 21 nt, Human
aagcuguguuccacugauagc

SEQ ID NO: 900595 - RNA, 22 nt, Human
ucacaucugccuccauagcacc

SEQ ID NO: 900596 - RNA, 22 nt, Human
agcaccugcuaugugucaggga

SEQ ID NO: 900597 - RNA, 22 nt, Human
uugacaaaguuuaguaauaauc

SEQ ID NO: 900598 - RNA, 22 nt, Human
ggcaguguccagcuuccuggag

SEQ ID NO: 900599 - RNA, 22 nt, Human
gaggacauaguccagauggcaa

SEQ ID NO: 900600 - RNA, 22 nt, Human
uaacagaaauauuuccagguga

SEQ ID NO: 900601 - RNA, 23 nt, Human
uuuguacugcauuaugagacaca

SEQ ID NO: 900602 - RNA, 21 nt, Human
aaguuuguucuuguauagucu

SEQ ID NO: 900603 - RNA, 17 nt, Human
aagaaucauuagagaag

SEQ ID NO: 900604 - RNA, 22 nt, Human
acaauuugaggcuacucaauug

SEQ ID NO: 900605 - RNA, 22 nt, Human
ugcuguagucaaagcaaagcug

SEQ ID NO: 900606 - RNA, 22 nt, Human
auuugccuuggugauuuguaaa

SEQ ID NO: 900607 - RNA, 22 nt, Human
aggcacagagagguuaaaugca

SEQ ID NO: 900608 - RNA, 22 nt, Human
aagcaauauacugauaugauua

SEQ ID NO: 900609 - RNA, 22 nt, Human
cagcagcucaggcuccuuccca

SEQ ID NO: 900610 - RNA, 22 nt, Human
guagugcuuucaucuggagugu

SEQ ID NO: 900611 - RNA, 22 nt, Human
uccagagagguuucuccaugcu

SEQ ID NO: 900612 - RNA, 22 nt, Human
uugcaucaguccucaauaaaau

SEQ ID NO: 900613 - RNA, 20 nt, Human
caguccaggcugcagcaucu

SEQ ID NO: 900614 - RNA, 22 nt, Human
agagucaguuagcgaauacuua

SEQ ID NO: 900615 - RNA, 20 nt, Human
aaaaacaguaaugcugaaga

SEQ ID NO: 900616 - RNA, 22 nt, Human
aagacauguuuuaagaauauuu

SEQ ID NO: 900617 - RNA, 22 nt, Human
caggcagacuuugagaaugaug

SEQ ID NO: 900618 - RNA, 22 nt, Human
gggugcugaggaagacagcagg

SEQ ID NO: 900619 - RNA, 22 nt, Human
gcacccagaauaaggacaggac

SEQ ID NO: 900620 - RNA, 20 nt, Human
ugcaguguggaagacugaga

SEQ ID NO: 900621 - RNA, 22 nt, Human
aggauaauaauagugcucacuc

SEQ ID NO: 900622 - RNA, 22 nt, Human
ccagucuguucucaccucugag

SEQ ID NO: 900623 - RNA, 22 nt, Human
acacugaaggcuacaagguuga

SEQ ID NO: 900624 - RNA, 22 nt, Human
aaagugcuaagucacccagcua

SEQ ID NO: 900625 - RNA, 22 nt, Human
acuuugaucuaaguuucuuuga

SEQ ID NO: 900626 - RNA, 22 nt, Human
cuuccuucaauauaauuuuuac

SEQ ID NO: 900627 - RNA, 22 nt, Human
agcagguggauuuagacgggag

SEQ ID NO: 900628 - RNA, 22 nt, Human
acuuuggguaagccaggugcua

SEQ ID NO: 900629 - RNA, 22 nt, Human
aauaggaaaauauuuaacaaga

SEQ ID NO: 900630 - RNA, 22 nt, Human
aaaggcagaguuguuggaggca

SEQ ID NO: 900631 - RNA, 21 nt, Human
uuccuggggaaggagcugccu

SEQ ID NO: 900632 - RNA, 22 nt, Human
aacuaacagucauuaaaagaac

SEQ ID NO: 900633 - RNA, 22 nt, Human
ucuuggccccaacccucuauuu

SEQ ID NO: 900634 - RNA, 22 nt, Human
ugagauaagcaaggauaaaggu

SEQ ID NO: 900635 - RNA, 22 nt, Human
uuccccaguagugacaaucaaa

SEQ ID NO: 900636 - RNA, 22 nt, Human
ugcuucugaacucagcaugugg

SEQ ID NO: 900637 - RNA, 22 nt, Human
guggcaacaaaagagccuagug

SEQ ID NO: 900638 - RNA, 22 nt, Human
uuucuuuguaguagcauaauca

SEQ ID NO: 900639 - RNA, 18 nt, Human
ggcugcuccucucccuac

SEQ ID NO: 900640 - RNA, 22 nt, Human
gccaccagggggcuccagugag

SEQ ID NO: 900641 - RNA, 22 nt, Human
acccugggugagaggcaaacag

SEQ ID NO: 900642 - RNA, 22 nt, Human
ggcccagcacagugcuuggggg

SEQ ID NO: 900643 - RNA, 22 nt, Human
ucugcuuugaccuucuugaugc

SEQ ID NO: 900644 - RNA, 22 nt, Human
aacaucuuguccuuagauuaaa

SEQ ID NO: 900645 - RNA, 22 nt, Human
ugcagcagccucaucugguuuc

SEQ ID NO: 900646 - RNA, 23 nt, Human
gggaaguggggauuugaagucau

SEQ ID NO: 900647 - RNA, 22 nt, Human
uuggaaauacagcaguuacuuu

SEQ ID NO: 900648 - RNA, 22 nt, Human
ugagugaggaagcgguggagga

SEQ ID NO: 900649 - RNA, 22 nt, Human
ugagcugucaagguacagugaa

SEQ ID NO: 900650 - RNA, 22 nt, Human
uugacacaguuuucucauuaag

SEQ ID NO: 900651 - RNA, 22 nt, Human
aaucccauuguggaauuaagga

SEQ ID NO: 900652 - RNA, 22 nt, Human
agggggcucagcauggauggag

SEQ ID NO: 900653 - RNA, 22 nt, Human
cagagggcuucagguucaggau

SEQ ID NO: 900654 - RNA, 22 nt, Human
cuggcugucuuggaggaaggag

SEQ ID NO: 900655 - RNA, 22 nt, Human
cagcagcugaggcgcuggcgug

SEQ ID NO: 900656 - RNA, 22 nt, Human
gcaggugggggagaaguuguga

SEQ ID NO: 900657 - RNA, 22 nt, Human
uugauuuucaauucauugacaa

SEQ ID NO: 900658 - RNA, 22 nt, Human
cugagguauugaaguaucuucu

SEQ ID NO: 900659 - RNA, 22 nt, Human
uugcagagaucagcagguuuga

SEQ ID NO: 900660 - RNA, 22 nt, Human
aagagaaggauucugagccugg

SEQ ID NO: 900661 - RNA, 22 nt, Human
aauuacuguaauuuucuacagc

SEQ ID NO: 900662 - RNA, 22 nt, Human
uagcugccuagacagcuauagc

SEQ ID NO: 900663 - RNA, 22 nt, Human
ucagacagggcuucucaaacuu

SEQ ID NO: 900664 - RNA, 22 nt, Human
cagcucaauagccuaccuuaau

SEQ ID NO: 900665 - RNA, 22 nt, Human
acaauguucugucugacuuguc

SEQ ID NO: 900666 - RNA, 22 nt, Human
aguccuuuuguuuugagaugag

SEQ ID NO: 900667 - RNA, 22 nt, Human
guggcgaggggagguccuggcg

SEQ ID NO: 900668 - RNA, 22 nt, Human
gagaacacaugcagacugggua

SEQ ID NO: 900669 - RNA, 22 nt, Human
uugagguacaaugggucaguua

SEQ ID NO: 900670 - RNA, 22 nt, Human
ccuggaaucuggaguuggaauc

SEQ ID NO: 900671 - RNA, 22 nt, Human
augaaaugcuauuuuggcuaga

SEQ ID NO: 900672 - RNA, 22 nt, Human
aguuagaaaguaaaucauuuga

SEQ ID NO: 900673 - RNA, 22 nt, Human
ccagaauucagaaagggcauaa

SEQ ID NO: 900674 - RNA, 19 nt, Human
cccagucuagguccuagga

SEQ ID NO: 900675 - RNA, 22 nt, Human
auugaaauugaugaaauucuug

SEQ ID NO: 900676 - RNA, 22 nt, Human
auuugguguuguuuggagccua

SEQ ID NO: 900677 - RNA, 23 nt, Human
uaaguucuaugagaagagaaauc

SEQ ID NO: 900678 - RNA, 22 nt, Human
gaaugcuguagacagacucuau

SEQ ID NO: 900679 - RNA, 22 nt, Human
ugugugugggcggaacggcccc

SEQ ID NO: 900680 - RNA, 23 nt, Human
aagugcuaaguacuguaaucauc

SEQ ID NO: 900681 - RNA, 22 nt, Human
aucuuuuuaucuguuuggaaca

SEQ ID NO: 900682 - RNA, 22 nt, Human
uuuuuggaaggagauccacacu

SEQ ID NO: 900683 - RNA, 22 nt, Human
ucucuaugacaagguuugguug

SEQ ID NO: 900684 - RNA, 22 nt, Human
ggcucaguaagucagguucauu

SEQ ID NO: 900685 - RNA, 22 nt, Human
uguuccagggcgcgaagguggu

SEQ ID NO: 900686 - RNA, 18 nt, Human
aaguuccacaagagaucu

SEQ ID NO: 900687 - RNA, 22 nt, Human
gcauuuguuccgcuuugucauc

SEQ ID NO: 900688 - RNA, 23 nt, Human
auguauuuaaauuucagugauga

SEQ ID NO: 900689 - RNA, 22 nt, Human
caaggcuucagugugacaaaac

SEQ ID NO: 900690 - RNA, 22 nt, Human
agcuucuuguagaacucaaaag

SEQ ID NO: 900691 - RNA, 23 nt, Human
acuagaaaaugacuuucucccug

SEQ ID NO: 900692 - RNA, 22 nt, Human
cccuuagauaauuuccuuuucu

SEQ ID NO: 900693 - RNA, 22 nt, Human
aaauaggagcuuaagcacuucu

SEQ ID NO: 900694 - RNA, 22 nt, Human
uggcaguggcacugcccccaua

SEQ ID NO: 900695 - RNA, 22 nt, Human
gccaggaguguguggcuauguu

SEQ ID NO: 900696 - RNA, 19 nt, Human
uuacaucugcaacacuggu

SEQ ID NO: 900697 - RNA, 22 nt, Human
uugaaacugcuuauugaauuug

SEQ ID NO: 900698 - RNA, 22 nt, Human
ggcccagcuguauauuacaguu

SEQ ID NO: 900699 - RNA, 22 nt, Human
cugcaggagcaagccugggaga

SEQ ID NO: 900700 - RNA, 22 nt, Human
agaacugucacgagugacaaag

SEQ ID NO: 900701 - RNA, 21 nt, Human
ugcuccagggcagcuuccagc

SEQ ID NO: 900702 - RNA, 22 nt, Human
auguucaaguaccuuugugucu

SEQ ID NO: 900703 - RNA, 22 nt, Human
uguuuacuagccaacauggaga

SEQ ID NO: 900704 - RNA, 22 nt, Human
ggcugcagcccucgccuagcca

SEQ ID NO: 900705 - RNA, 22 nt, Human
cuggcaggcagacuucugcaag

SEQ ID NO: 900706 - RNA, 22 nt, Human
ugaggcagguggauuacaaggu

SEQ ID NO: 900707 - RNA, 22 nt, Human
agacaguugauauacuauaaaa

SEQ ID NO: 900708 - RNA, 22 nt, Human
ucuggcuguguaagguagcacc

SEQ ID NO: 900709 - RNA, 22 nt, Human
aggcuauuuccacucuucucau

SEQ ID NO: 900710 - RNA, 23 nt, Human
ugagcccaggaggucaaggcugc

SEQ ID NO: 900711 - RNA, 22 nt, Human
uacugaauggggcaguaagaaa

SEQ ID NO: 900712 - RNA, 22 nt, Human
gucagauuaauagcaauaauaa

SEQ ID NO: 900713 - RNA, 22 nt, Human
ugugaaaugaagauaauucuug

SEQ ID NO: 900714 - RNA, 22 nt, Human
augcaaauucuuugcuucuucu

SEQ ID NO: 900715 - RNA, 22 nt, Human
ccugccugcagaaaguaucucc

SEQ ID NO: 900716 - RNA, 22 nt, Human
auacaacagaaaaugauuauuc

SEQ ID NO: 900717 - RNA, 22 nt, Human
uaauauauuucugcuaagcuca

SEQ ID NO: 900718 - RNA, 22 nt, Human
aaugauuuccccuacacagaag

SEQ ID NO: 900719 - RNA, 22 nt, Human
gcagggaccaaaagaggcagua

SEQ ID NO: 900720 - RNA, 22 nt, Human
aagagacagagccauguuucua

SEQ ID NO: 900721 - RNA, 22 nt, Human
uucaauucaauucuaaauauau

SEQ ID NO: 900722 - RNA, 22 nt, Human
ucucaucuucauugucucccau

SEQ ID NO: 900723 - RNA, 22 nt, Human
agcaccagcaacuaugggcugc

SEQ ID NO: 900724 - RNA, 22 nt, Human
aaaguauuuuugacaggcauua

SEQ ID NO: 900725 - RNA, 22 nt, Human
gagcaggugccuguagcucucu

SEQ ID NO: 900726 - RNA, 22 nt, Human
gagcagcagauugucuccaugg

SEQ ID NO: 900727 - RNA, 17 nt, Human
ggacacagcucauggcu

SEQ ID NO: 900728 - RNA, 22 nt, Human
cagagcucagagcugccaggca

SEQ ID NO: 900729 - RNA, 22 nt, Human
ggcuguggcauuaggugaggcc

SEQ ID NO: 900730 - RNA, 22 nt, Human
ggaguggccucuccugugcagg

SEQ ID NO: 900731 - RNA, 22 nt, Human
auaaacugaagggaacacugag

SEQ ID NO: 900732 - RNA, 22 nt, Human
agcugccacauggugucacugu

SEQ ID NO: 900733 - RNA, 22 nt, Human
aguguuucuaaguagaugugaa

SEQ ID NO: 900734 - RNA, 22 nt, Human
caggcacaauuauuucccuuuc

SEQ ID NO: 900735 - RNA, 22 nt, Human
gagcugaguagaggcugcuccc

SEQ ID NO: 900736 - RNA, 22 nt, Human
acacaguucuuucacuguuggu

SEQ ID NO: 900737 - RNA, 22 nt, Human
uacaaucuuuauguugaguggu

SEQ ID NO: 900738 - RNA, 22 nt, Human
uuugacucuugucucuuguuag

SEQ ID NO: 900739 - RNA, 22 nt, Human
uggcucugaucagauguccagu

SEQ ID NO: 900740 - RNA, 22 nt, Human
gcugucugaguaagagaauccu

SEQ ID NO: 900741 - RNA, 22 nt, Human
ugcugggcuugaaagcugcuaa

SEQ ID NO: 900742 - RNA, 22 nt, Human
ucugugcuagaggaguuggcca

SEQ ID NO: 900743 - RNA, 21 nt, Human
uggcagggguaguaguacagc

SEQ ID NO: 900744 - RNA, 19 nt, Human
aauggacaggcaauagucu

SEQ ID NO: 900745 - RNA, 22 nt, Human
gaggccugcagcguggucccug

SEQ ID NO: 900746 - RNA, 22 nt, Human
uuauuuaaaauguagguuggga

SEQ ID NO: 900747 - RNA, 22 nt, Human
auucaaaccccauagacaacuu

SEQ ID NO: 900748 - RNA, 22 nt, Human
gagcaauacauggcaugaaauu

SEQ ID NO: 900749 - RNA, 22 nt, Human
uucagaaaugaauauugguauu

SEQ ID NO: 900750 - RNA, 22 nt, Human
auuaucagccgucccacuacau

SEQ ID NO: 900751 - RNA, 18 nt, Human
gcagagcaucaaggguua

SEQ ID NO: 900752 - RNA, 22 nt, Human
aguauauugcucuuaaucauag

SEQ ID NO: 900753 - RNA, 22 nt, Human
cagggcagggagcuuagaauga

SEQ ID NO: 900754 - RNA, 22 nt, Human
guucucucagcgauagugaugg

SEQ ID NO: 900755 - RNA, 22 nt, Human
agaaguuuguuauguaaacaaa

SEQ ID NO: 900756 - RNA, 22 nt, Human
cagugguacucucagauguuua

SEQ ID NO: 900757 - RNA, 22 nt, Human
gugugagcaucaaagccuguca

SEQ ID NO: 900758 - RNA, 22 nt, Human
aagaaacuggaauauagagagc

SEQ ID NO: 900759 - RNA, 22 nt, Human
cuccagugcgcaggacagcccc

SEQ ID NO: 900760 - RNA, 21 nt, Human
uugagcagaaauguguaugcc

SEQ ID NO: 900761 - RNA, 22 nt, Human
aggaggugagcggucauguggu

SEQ ID NO: 900762 - RNA, 22 nt, Human
guuagaaacacauucuuauuga

SEQ ID NO: 900763 - RNA, 22 nt, Human
acacuguugcuggcacagacag

SEQ ID NO: 900764 - RNA, 22 nt, Human
agcugccuuugcaucacuuuaa

SEQ ID NO: 900765 - RNA, 21 nt, Human
cauuucuaagccuggcuauag

SEQ ID NO: 900766 - RNA, 22 nt, Human
aaacauucacucucaauuuuag

SEQ ID NO: 900767 - RNA, 22 nt, Human
aggggcagccucacaauccucu

SEQ ID NO: 900768 - RNA, 22 nt, Human
uuccuaugugggcagagacaca

SEQ ID NO: 900769 - RNA, 19 nt, Human
ugacacagcuagguuugcu

SEQ ID NO: 900770 - RNA, 18 nt, Human
agagaugggaguuggaaa

SEQ ID NO: 900771 - RNA, 21 nt, Human
acaugcauagagagauuucug

SEQ ID NO: 900772 - RNA, 22 nt, Human
ucagaaguagcuccccuucauu

SEQ ID NO: 900773 - RNA, 22 nt, Human
uaacauuauacagagaggacag

SEQ ID NO: 900774 - RNA, 22 nt, Human
gcauugaaauggcaaaaagaga

SEQ ID NO: 900775 - RNA, 22 nt, Human
gaucuagaccagaagcuguugu

SEQ ID NO: 900776 - RNA, 22 nt, Human
gacccuguuucuacaaauaauu

SEQ ID NO: 900777 - RNA, 19 nt, Human
uucauucucuuauuguugu

SEQ ID NO: 900778 - RNA, 20 nt, Human
augugucuguaaacaacucu

SEQ ID NO: 900779 - RNA, 22 nt, Human
ugggcugagcacugaggaagga

SEQ ID NO: 900780 - RNA, 22 nt, Human
cacuguuuggcuccuguacuua

SEQ ID NO: 900781 - RNA, 22 nt, Human
uguggaggauucugaugccagc

SEQ ID NO: 900782 - RNA, 22 nt, Human
uacacccacauugagcauggga

SEQ ID NO: 900783 - RNA, 22 nt, Human
auauucuugaagggagauuaua

SEQ ID NO: 900784 - RNA, 22 nt, Human
cuggcucaguucuugguuuuca

SEQ ID NO: 900785 - RNA, 18 nt, Human
uccugggaacuugcuagc

SEQ ID NO: 900786 - RNA, 22 nt, Human
ggcagccucagguuuucuuuga

SEQ ID NO: 900787 - RNA, 22 nt, Human
gaagugucuccguuuuuaaagg

SEQ ID NO: 900788 - RNA, 22 nt, Human
cuguccagucuuuagcaagcug

SEQ ID NO: 900789 - RNA, 22 nt, Human
uucaacaugcuuuauuucuaaa

SEQ ID NO: 900790 - RNA, 23 nt, Human
ugucugguucaugcuuauuuugg

SEQ ID NO: 900791 - RNA, 22 nt, Human
caaggagaaaacggcuucugaa

SEQ ID NO: 900792 - RNA, 22 nt, Human
ucuccuggcucaccaggcugga

SEQ ID NO: 900793 - RNA, 22 nt, Human
cauuagaaccuauaaaaagcau

SEQ ID NO: 900794 - RNA, 22 nt, Human
cagagcuguuacuauucaugaa

SEQ ID NO: 900795 - RNA, 22 nt, Human
agugcccuggcccagcuggacc

SEQ ID NO: 900796 - RNA, 22 nt, Human
acuuuacuccccaacauaaaug

SEQ ID NO: 900797 - RNA, 22 nt, Human
auauacacuguuucaguugaag

SEQ ID NO: 900798 - RNA, 22 nt, Human
acuggggcagugggcagugguu

SEQ ID NO: 900799 - RNA, 22 nt, Human
ucacauuuuguucaaggcuagu

SEQ ID NO: 900800 - RNA, 22 nt, Human
gaaaauacuucaguguucuggc

SEQ ID NO: 900801 - RNA, 22 nt, Human
uggcugggcccccaccugccuc

SEQ ID NO: 900802 - RNA, 22 nt, Human
cugcaaggaguugacauugucu

SEQ ID NO: 900803 - RNA, 22 nt, Human
uagagaaaaccacuggugagcu

SEQ ID NO: 900804 - RNA, 22 nt, Human
acauggcagcugaugauuggaa

SEQ ID NO: 900805 - RNA, 22 nt, Human
aaagcaagucucuacaaaguac

SEQ ID NO: 900806 - RNA, 22 nt, Human
gaggccagcgcgcagcacuuuu

SEQ ID NO: 900807 - RNA, 22 nt, Human
gaggggagacagggaaaucagu

SEQ ID NO: 900808 - RNA, 22 nt, Human
ggaacuugaaaaucaagguggu

SEQ ID NO: 900809 - RNA, 22 nt, Human
gagcugccagacaugggaauga

SEQ ID NO: 900810 - RNA, 22 nt, Human
gcaguguguggugagggcugcc

SEQ ID NO: 900811 - RNA, 22 nt, Human
aagccuuggggcuccucuguau

SEQ ID NO: 900812 - RNA, 22 nt, Human
uggcugcagaucugugggacac

SEQ ID NO: 900813 - RNA, 22 nt, Human
guucauuuuuacuuugaucuac

SEQ ID NO: 900814 - RNA, 22 nt, Human
acagacaucuauccauuuaauu

SEQ ID NO: 900815 - RNA, 22 nt, Human
cagggagggaggaaaauuugcu

SEQ ID NO: 900816 - RNA, 22 nt, Human
uggcugugauuugcacgagaug

SEQ ID NO: 900817 - RNA, 22 nt, Human
cugucagguuggucucagagcu

SEQ ID NO: 900818 - RNA, 22 nt, Human
auggacaaugccaauacaguuu

SEQ ID NO: 900819 - RNA, 19 nt, Human
uacauccucuuccucuuug

SEQ ID NO: 900820 - RNA, 22 nt, Human
gucaauuaguggcaauuucaua

SEQ ID NO: 900821 - RNA, 19 nt, Human
cccaggguuuccucucucc

SEQ ID NO: 900822 - RNA, 22 nt, Human
aaugucaaacagagcagagcua

SEQ ID NO: 900823 - RNA, 22 nt, Human
uaucucuugucuguuuugcaaa

SEQ ID NO: 900824 - RNA, 22 nt, Human
ucacuuaggugcaaagggaacu

SEQ ID NO: 900825 - RNA, 22 nt, Human
ucagcucuuaacccucuggccu

SEQ ID NO: 900826 - RNA, 22 nt, Human
aaauugugcucacacugauauu

SEQ ID NO: 900827 - RNA, 22 nt, Human
gcuuuuaugcacauaaggguca

SEQ ID NO: 900828 - RNA, 22 nt, Human
cuggagaacuaguuaaacacgu

SEQ ID NO: 900829 - RNA, 22 nt, Human
cuauaauuaugcucaaaaugua

SEQ ID NO: 900830 - RNA, 22 nt, Human
gcauuucugugcauacacauga

SEQ ID NO: 900831 - RNA, 22 nt, Human
cagggagcuuucccaggacccu

SEQ ID NO: 900832 - RNA, 22 nt, Human
cuggccagcauggcugaaguac

SEQ ID NO: 900833 - RNA, 22 nt, Human
acuuuacaaacuccucacuguu

SEQ ID NO: 900834 - RNA, 22 nt, Human
uugagcuuuacaacagcuguua

SEQ ID NO: 900835 - RNA, 20 nt, Human
aggcuccuccaggaugugug

SEQ ID NO: 900836 - RNA, 22 nt, Human
aauagcugggaggcacauucau

SEQ ID NO: 900837 - RNA, 21 nt, Human
auguacauucggcaacagaua

SEQ ID NO: 900838 - RNA, 22 nt, Human
auuuggaagcuugaagauuauu

SEQ ID NO: 900839 - RNA, 22 nt, Human
uuugaaagacagaauauuuuug

SEQ ID NO: 900840 - RNA, 19 nt, Human
ccauucugucucugccaca

SEQ ID NO: 900841 - RNA, 22 nt, Human
aggcugagcugaccugguuugg

SEQ ID NO: 900842 - RNA, 22 nt, Human
gugcaggcaaaagggccaggcc

SEQ ID NO: 900843 - RNA, 22 nt, Human
ggcaggucagguccaugaccaa

SEQ ID NO: 900844 - RNA, 22 nt, Human
auauuuucacagaacuugcaaa

SEQ ID NO: 900845 - RNA, 22 nt, Human
cagggccauuggcguggcuguc

SEQ ID NO: 900846 - RNA, 19 nt, Human
ugcuauuugaagaagugua

SEQ ID NO: 900847 - RNA, 22 nt, Human
gugaggacugguaaggacugca

SEQ ID NO: 900848 - RNA, 22 nt, Human
caguaauaccccuggcucaggu

SEQ ID NO: 900849 - RNA, 22 nt, Human
cuguggcugaacucugaagagg

SEQ ID NO: 900850 - RNA, 22 nt, Human
gaagccacaacuuuuucuuagc

SEQ ID NO: 900851 - RNA, 22 nt, Human
cugcagggauugcuucuguaua

SEQ ID NO: 900852 - RNA, 22 nt, Human
agguccugaugaucucugagag

SEQ ID NO: 900853 - RNA, 22 nt, Human
gucuccugcccccggugcuugg

SEQ ID NO: 900854 - RNA, 22 nt, Human
ucauuucuccuaagugaaauau

SEQ ID NO: 900855 - RNA, 22 nt, Human
ucugggaggggcugccauugcu

SEQ ID NO: 900856 - RNA, 22 nt, Human
acuguacaacugcugagcagaa

SEQ ID NO: 900857 - RNA, 22 nt, Human
uauauaacuacuauuuugcuca

SEQ ID NO: 900858 - RNA, 22 nt, Human
ucuuuacuuguguauuguauau

SEQ ID NO: 900859 - RNA, 22 nt, Human
cauggacagugggacagugugu

SEQ ID NO: 900860 - RNA, 22 nt, Human
gcagagcaccaaagugaaagau

SEQ ID NO: 900861 - RNA, 22 nt, Human
gcucuggggaugcuucugccgu

SEQ ID NO: 900862 - RNA, 22 nt, Human
cagggccuuuuagcaucuucuc

SEQ ID NO: 900863 - RNA, 19 nt, Human
uggucuaaaugugugcccc

SEQ ID NO: 900864 - RNA, 22 nt, Human
aacaugaaacccaaacagaaua

SEQ ID NO: 900865 - RNA, 22 nt, Human
acccagccauguucaguucucu

SEQ ID NO: 900866 - RNA, 22 nt, Human
cucucagacacccauuuggaaa

SEQ ID NO: 900867 - RNA, 22 nt, Human
agaaguuuaaccaggugcuacu

SEQ ID NO: 900868 - RNA, 22 nt, Human
ugacacuugggcuuugagaggu

SEQ ID NO: 900869 - RNA, 22 nt, Human
uucuacagacuauaacugugau

SEQ ID NO: 900870 - RNA, 22 nt, Human
gaaagugcuuagagugugguau

SEQ ID NO: 900871 - RNA, 22 nt, Human
uccucuuucucaacauuaguua

SEQ ID NO: 900872 - RNA, 22 nt, Human
aaggcaggagcuguaucuuauu

SEQ ID NO: 900873 - RNA, 22 nt, Human
ugucugugauuuaggccagggc

SEQ ID NO: 900874 - RNA, 22 nt, Human
uucaaagagaaauuguauuuuc

SEQ ID NO: 900875 - RNA, 19 nt, Human
agggccugcagcucaagcu

SEQ ID NO: 900876 - RNA, 19 nt, Human
uauguuauguuguuuacuc

SEQ ID NO: 900877 - RNA, 22 nt, Human
aggcuucaauuccuuacccagu

SEQ ID NO: 900878 - RNA, 22 nt, Human
cuaucucaugcaucaacucuuc

SEQ ID NO: 900879 - RNA, 22 nt, Human
cgagcaugaugacggcuguggc

SEQ ID NO: 900880 - RNA, 22 nt, Human
accagagaaaacacagcaggcu

SEQ ID NO: 900881 - RNA, 22 nt, Human
ucagaagucaugcucagucugu

SEQ ID NO: 900882 - RNA, 22 nt, Human
gauuuacaaagcucucuagugu

SEQ ID NO: 900883 - RNA, 22 nt, Human
ggcucccucaccaccaucacau

SEQ ID NO: 900884 - RNA, 22 nt, Human
ccuuccuugucuacaaaagcuc

SEQ ID NO: 900885 - RNA, 22 nt, Human
ucugggcaauggaugcacucac

SEQ ID NO: 900886 - RNA, 22 nt, Human
gaagucucauuuggugucaguu

SEQ ID NO: 900887 - RNA, 22 nt, Human
ugucucuccugaugaucuggug

SEQ ID NO: 900888 - RNA, 22 nt, Human
augugaaaccugugaguagagu

SEQ ID NO: 900889 - RNA, 23 nt, Human
aaaguacuuaaucugcaaaccac

SEQ ID NO: 900890 - RNA, 22 nt, Human
uccacauucucuguuacagaua

SEQ ID NO: 900891 - RNA, 22 nt, Human
gccuguccacuaaacagccaag

SEQ ID NO: 900892 - RNA, 22 nt, Human
ucaggaaauacaagugacauca

SEQ ID NO: 900893 - RNA, 22 nt, Human
auccuucagcugcccuguuacc

SEQ ID NO: 900894 - RNA, 22 nt, Human
gaaacguuggcauaaguuuaug

SEQ ID NO: 900895 - RNA, 21 nt, Human
aggugcaggccucaagcccca

SEQ ID NO: 900896 - RNA, 18 nt, Human
gcugccugcauuccucac

SEQ ID NO: 900897 - RNA, 22 nt, Human
agggcucccgcgguguccggga

SEQ ID NO: 900898 - RNA, 22 nt, Human
auugacagcaggggcugucacu

SEQ ID NO: 900899 - RNA, 22 nt, Human
ugggucagaggaccucguggcc

SEQ ID NO: 900900 - RNA, 17 nt, Human
agugaggagauuggaag

SEQ ID NO: 900901 - RNA, 22 nt, Human
uaacagugugaggucucaggcg

SEQ ID NO: 900902 - RNA, 22 nt, Human
aauaauguuaugucauucuucu

SEQ ID NO: 900903 - RNA, 22 nt, Human
aaaugcaugugcuauagaugug

SEQ ID NO: 900904 - RNA, 22 nt, Human
aacaugauuuaguauaaugcag

SEQ ID NO: 900905 - RNA, 22 nt, Human
cuucaguggucauuugugauaa

SEQ ID NO: 900906 - RNA, 22 nt, Human
agaaaccucacagcaauucuga

SEQ ID NO: 900907 - RNA, 22 nt, Human
gugguccuggcaaccaugguga

SEQ ID NO: 900908 - RNA, 22 nt, Human
aucaccuggccauuggguuaac

SEQ ID NO: 900909 - RNA, 22 nt, Human
gcuccccauugaucugcaggcu

SEQ ID NO: 900910 - RNA, 22 nt, Human
aauucacaggagguauuugucc

SEQ ID NO: 900911 - RNA, 22 nt, Human
guggcagcuguguugcaguuuu

SEQ ID NO: 900912 - RNA, 22 nt, Human
guggaaaacugagaaaauugcu

SEQ ID NO: 900913 - RNA, 21 nt, Human
uggcaauggccaacagucauc

SEQ ID NO: 900914 - RNA, 22 nt, Human
aagaaagugcuuuguaaauuau

SEQ ID NO: 900915 - RNA, 21 nt, Human
gcugagacgcaaccucaguga

SEQ ID NO: 900916 - RNA, 22 nt, Human
gagagugucuggaggaagcuaa

SEQ ID NO: 900917 - RNA, 22 nt, Human
gcucugggaauucagaaagccu

SEQ ID NO: 900918 - RNA, 22 nt, Human
gagagguguguuucagauaaga

SEQ ID NO: 900919 - RNA, 22 nt, Human
ucaggcugcaucuguaagggug

SEQ ID NO: 900920 - RNA, 22 nt, Human
uccagcuuuuauuggaugagga

SEQ ID NO: 900921 - RNA, 22 nt, Human
gaaaagagacagggugggugau

SEQ ID NO: 900922 - RNA, 22 nt, Human
guucauguuuguguauugcuca

SEQ ID NO: 900923 - RNA, 22 nt, Human
aaggcugacguuuguguuuauu

SEQ ID NO: 900924 - RNA, 22 nt, Human
cuaaagauguacauuuuucucc

SEQ ID NO: 900925 - RNA, 22 nt, Human
uacagaaauacagucaggccua

SEQ ID NO: 900926 - RNA, 22 nt, Human
acaacaguagccuuuacaaggc

SEQ ID NO: 900927 - RNA, 22 nt, Human
uguauuugugauaacgaccuga

SEQ ID NO: 900928 - RNA, 22 nt, Human
acaaauugccccauuuugaacu

SEQ ID NO: 900929 - RNA, 22 nt, Human
aaguaugacauuuaagacaauu

SEQ ID NO: 900930 - RNA, 22 nt, Human
cuaaggaagugacagugggauu

SEQ ID NO: 900931 - RNA, 22 nt, Human
augagggaggcaaggagaugcu

SEQ ID NO: 900932 - RNA, 22 nt, Human
guccccagcugugacgagagcc

SEQ ID NO: 900933 - RNA, 20 nt, Human
ucacaauaugagcucauaca

SEQ ID NO: 900934 - RNA, 22 nt, Human
uuccucagaaaauacuguccaa

SEQ ID NO: 900935 - RNA, 22 nt, Human
gugccugccccacuccucagca

SEQ ID NO: 900936 - RNA, 22 nt, Human
ugcucuggaauaguccuaggca

SEQ ID NO: 900937 - RNA, 22 nt, Human
ugaagaaugugaauugguagcu

SEQ ID NO: 900938 - RNA, 22 nt, Human
ugccugucuucaggagugucac

SEQ ID NO: 900939 - RNA, 21 nt, Human
ugacauuuccaauauaaagcc

SEQ ID NO: 900940 - RNA, 22 nt, Human
cugcgugcaugucugcgugcau

SEQ ID NO: 900941 - RNA, 22 nt, Human
ucugucacuuaagaauugccua

SEQ ID NO: 900942 - RNA, 22 nt, Human
aaagguuugccgaccucugcuu

SEQ ID NO: 900943 - RNA, 22 nt, Human
aaacagcaauuacuuuugcacc

SEQ ID NO: 900944 - RNA, 22 nt, Human
cugaguccagggacagaggcgu

SEQ ID NO: 900945 - RNA, 22 nt, Human
gcuggaaguaaaaacuuacuag

SEQ ID NO: 900946 - RNA, 22 nt, Human
cacccuggaauagccccgggag

SEQ ID NO: 900947 - RNA, 22 nt, Human
uuaggcuguucuuguguuguua

SEQ ID NO: 900948 - RNA, 19 nt, Human
cagaggccagaagcacagg

SEQ ID NO: 900949 - RNA, 20 nt, Human
cuaagagguccuuccacauc

SEQ ID NO: 900950 - RNA, 22 nt, Human
uagcagggccaggcugggaacc

SEQ ID NO: 900951 - RNA, 22 nt, Human
agcaggcagccuaggaagugaa

SEQ ID NO: 900952 - RNA, 22 nt, Human
cagagcagacguugagauuaag

SEQ ID NO: 900953 - RNA, 22 nt, Human
agggaugagugaguaaacaaua

SEQ ID NO: 900954 - RNA, 22 nt, Human
uggagcugacucacaccagcua

SEQ ID NO: 900955 - RNA, 22 nt, Human
cuaggaaauuuaaaauaugauu

SEQ ID NO: 900956 - RNA, 22 nt, Human
cuggcagcauuuuuuucagaag

SEQ ID NO: 900957 - RNA, 22 nt, Human
gagagggguuugccauccuaug

SEQ ID NO: 900958 - RNA, 22 nt, Human
caaaggcugccacuguggcugu

SEQ ID NO: 900959 - RNA, 22 nt, Human
aaucacauuacagcauaucugu

SEQ ID NO: 900960 - RNA, 20 nt, Human
cacugcaaguauuuaaccca

SEQ ID NO: 900961 - RNA, 22 nt, Human
caggagcaugcugaugccagaa

SEQ ID NO: 900962 - RNA, 22 nt, Human
ggugaacauugaugugguuaca

SEQ ID NO: 900963 - RNA, 22 nt, Human
agcuccuguaguacauauuauu

SEQ ID NO: 900964 - RNA, 22 nt, Human
caaggcuaagcuuuggcuuucu

SEQ ID NO: 900965 - RNA, 22 nt, Human
ucaggggacuuaggagagaagu

SEQ ID NO: 900966 - RNA, 22 nt, Human
ugcugccacaaauucagcugcc

SEQ ID NO: 900967 - RNA, 19 nt, Human
gaaggcugaaaugaagcac

SEQ ID NO: 900968 - RNA, 22 nt, Human
uuucuagaguucaucaugguaa

SEQ ID NO: 900969 - RNA, 22 nt, Human
guaaaugugaaugucauuuagc

SEQ ID NO: 900970 - RNA, 22 nt, Human
aaucagaaagaucuugaugaga

SEQ ID NO: 900971 - RNA, 22 nt, Human
uucugaagggcuaagugucuau

SEQ ID NO: 900972 - RNA, 22 nt, Human
cagugcuguuguaagcucauug

SEQ ID NO: 900973 - RNA, 22 nt, Human
aaacagugacugguacauaaua

SEQ ID NO: 900974 - RNA, 22 nt, Human
cuucugggcagaaguuuugaga

SEQ ID NO: 900975 - RNA, 22 nt, Human
gggccccaagaaccuccuccug

SEQ ID NO: 900976 - RNA, 23 nt, Human
ucuccuccuagauacagucaugg

SEQ ID NO: 900977 - RNA, 22 nt, Human
ccccuguguuguucaaggguca

SEQ ID NO: 900978 - RNA, 22 nt, Human
aggaaugacuuguagcucugag

SEQ ID NO: 900979 - RNA, 22 nt, Human
uugcucugacuggagugcagug

SEQ ID NO: 900980 - RNA, 22 nt, Human
cagguggcagaggucucuggaa

SEQ ID NO: 900981 - RNA, 22 nt, Human
ucuacaaagguugaggugcccu

SEQ ID NO: 900982 - RNA, 22 nt, Human
cauguacagccaggguugagaa

SEQ ID NO: 900983 - RNA, 22 nt, Human
accauuuaaggaaaauguauca

SEQ ID NO: 900984 - RNA, 22 nt, Human
augucaguaguuucuuugaguu

SEQ ID NO: 900985 - RNA, 22 nt, Human
acaacuagcagguauuaauuuu

SEQ ID NO: 900986 - RNA, 22 nt, Human
uaaguguugguaauuacaauga

SEQ ID NO: 900987 - RNA, 22 nt, Human
ucaggagucugugcaguuccac

SEQ ID NO: 900988 - RNA, 22 nt, Human
gggcugagacgauggggucuuc

SEQ ID NO: 900989 - RNA, 21 nt, Human
ugucuucauaugagauggugu

SEQ ID NO: 900990 - RNA, 20 nt, Human
cauauauaccuagaagugga

SEQ ID NO: 900991 - RNA, 22 nt, Human
gcugccugaucauacaccaggg

SEQ ID NO: 900992 - RNA, 22 nt, Human
uuaucuugaguauugagauucu

SEQ ID NO: 900993 - RNA, 22 nt, Human
gugcccugacacaccuggugug

SEQ ID NO: 900994 - RNA, 22 nt, Human
ugcagggaaaguguuggcagca

SEQ ID NO: 900995 - RNA, 22 nt, Human
auacauaguucugugaaaagua

SEQ ID NO: 900996 - RNA, 22 nt, Human
caugcacagugauaucugaaga

SEQ ID NO: 900997 - RNA, 21 nt, Human
uccugcugcuccugucguguu

SEQ ID NO: 900998 - RNA, 22 nt, Human
agaacagaagggaggaaggccu

SEQ ID NO: 900999 - RNA, 22 nt, Human
uggauuucagcauauggauuuu

SEQ ID NO: 901000 - RNA, 22 nt, Human
aggcccugagcauccgagggca

SEQ ID NO: 901001 - RNA, 22 nt, Human
cauauuguaaaagguugaaucc

SEQ ID NO: 901002 - RNA, 22 nt, Human
uaugaaaagguggccaauguag

SEQ ID NO: 901003 - RNA, 22 nt, Human
ugugucuguuuugcucaccauu

SEQ ID NO: 901004 - RNA, 22 nt, Human
uucuacauucauguauuaccuc

SEQ ID NO: 901005 - RNA, 22 nt, Human
caggcacagugggguccucucu

SEQ ID NO: 901006 - RNA, 22 nt, Human
ugcaggcagcugaaaggugccu

SEQ ID NO: 901007 - RNA, 22 nt, Human
uuccuucuucauuguguuacag

SEQ ID NO: 901008 - RNA, 22 nt, Human
uggcaggcugaguuggccuggu

SEQ ID NO: 901009 - RNA, 22 nt, Human
uuucaaacuccagcucaccaau

SEQ ID NO: 901010 - RNA, 22 nt, Human
cuucuggguaauucuucuucau

SEQ ID NO: 901011 - RNA, 22 nt, Human
acauuucugagcagggagcugu

SEQ ID NO: 901012 - RNA, 22 nt, Human
aagggcugcauuugauguguca

SEQ ID NO: 901013 - RNA, 22 nt, Human
uuuccaguaaguggcaaggagc

SEQ ID NO: 901014 - RNA, 18 nt, Human
uuacuuuguauagccuag

SEQ ID NO: 901015 - RNA, 22 nt, Human
ccagaagaaaaagcugguauua

SEQ ID NO: 901016 - RNA, 22 nt, Human
uggucucugcugcagcuucuca

SEQ ID NO: 901017 - RNA, 22 nt, Human
ggaagcuguuaucaucuguauc

SEQ ID NO: 901018 - RNA, 22 nt, Human
cugacaguuuuugcuguauugu

SEQ ID NO: 901019 - RNA, 22 nt, Human
gcugccaauccagcugugggag

SEQ ID NO: 901020 - RNA, 22 nt, Human
cuuugugcuugacccauggguc

SEQ ID NO: 901021 - RNA, 21 nt, Human
ucagcagcaucugccuagagu

SEQ ID NO: 901022 - RNA, 18 nt, Human
uuucacagauucaugacu

SEQ ID NO: 901023 - RNA, 22 nt, Human
acauaauaggugccugaauauu

SEQ ID NO: 901024 - RNA, 22 nt, Human
caaaacugucuagagagagaag

SEQ ID NO: 901025 - RNA, 22 nt, Human
cagcugugcuguauuaagcucu

SEQ ID NO: 901026 - RNA, 22 nt, Human
aggauuuacaaugauucuaggu

SEQ ID NO: 901027 - RNA, 22 nt, Human
acaagauaaggugucagugugu

SEQ ID NO: 901028 - RNA, 22 nt, Human
cugcagaggguuugagcauccu

SEQ ID NO: 901029 - RNA, 22 nt, Human
aacaugcuugcuuagaaucagc

SEQ ID NO: 901030 - RNA, 22 nt, Human
cagcccaggccgacaguuccuc

SEQ ID NO: 901031 - RNA, 22 nt, Human
aggcugagguaggaggaucgcu

SEQ ID NO: 901032 - RNA, 22 nt, Human
guuuuggcucuggcauguggaa

SEQ ID NO: 901033 - RNA, 22 nt, Human
auguuuacugguuuauagaaua

SEQ ID NO: 901034 - RNA, 22 nt, Human
ggccagagggagggcacaaauc

SEQ ID NO: 901035 - RNA, 22 nt, Human
aaugcucuuuaaccuauucuga

SEQ ID NO: 901036 - RNA, 22 nt, Human
ucauucauacucuuuucuauua

SEQ ID NO: 901037 - RNA, 22 nt, Human
ucccaggcaaaggcagcucauu

SEQ ID NO: 901038 - RNA, 22 nt, Human
auauucaucguguagaaauacu

SEQ ID NO: 901039 - RNA, 22 nt, Human
gggcugagauuggugcccuguc

SEQ ID NO: 901040 - RNA, 18 nt, Human
agcaaauauuaagugcau

SEQ ID NO: 901041 - RNA, 22 nt, Human
ugggugcuucgucagcucugag

SEQ ID NO: 901042 - RNA, 22 nt, Human
ucauugagcgguucuuaaccca

SEQ ID NO: 901043 - RNA, 22 nt, Human
caagccagugauguuugcugcc

SEQ ID NO: 901044 - RNA, 22 nt, Human
ggcccagccucagacaugcccu

SEQ ID NO: 901045 - RNA, 22 nt, Human
guugaauauaccugcauuugug

SEQ ID NO: 901046 - RNA, 22 nt, Human
uuuugcugguuuaucucuauua

SEQ ID NO: 901047 - RNA, 22 nt, Human
uagcaacauaagaaacauuuug

SEQ ID NO: 901048 - RNA, 17 nt, Human
gaacagcagaggggaca

SEQ ID NO: 901049 - RNA, 22 nt, Human
cugccuugucuuguuuucaggg

SEQ ID NO: 901050 - RNA, 22 nt, Human
cccaggcuccuacuguauucug

SEQ ID NO: 901051 - RNA, 22 nt, Human
aguggagaauaugcagaaagcc

SEQ ID NO: 901052 - RNA, 22 nt, Human
ugaagccacagagcaucugccu

SEQ ID NO: 901053 - RNA, 21 nt, Human
gcagccagacgggauucaguu

SEQ ID NO: 901054 - RNA, 22 nt, Human
uugaagacuaauuuagauaaug

SEQ ID NO: 901055 - RNA, 22 nt, Human
uuucaguggaccacaguuugau

SEQ ID NO: 901056 - RNA, 22 nt, Human
uagaggcuacuagaggcaccug

SEQ ID NO: 901057 - RNA, 23 nt, Human
uccagcagagccuuccaggaggg

SEQ ID NO: 901058 - RNA, 22 nt, Human
gcaacaaguguaaacaugcauu

SEQ ID NO: 901059 - RNA, 22 nt, Human
uucuuuucuuuaggcauugugu

SEQ ID NO: 901060 - RNA, 22 nt, Human
gcauucuucgaaguaaguagug

SEQ ID NO: 901061 - RNA, 22 nt, Human
auauauaugcugauggcugcca

SEQ ID NO: 901062 - RNA, 22 nt, Human
guggcccucugauagggucagg

SEQ ID NO: 901063 - RNA, 22 nt, Human
auagcaaaaggcaccagaguga

SEQ ID NO: 901064 - RNA, 22 nt, Human
uucaaguuuuauauugaagcaa

SEQ ID NO: 901065 - RNA, 22 nt, Human
gugagguaaaaucgguaagaug

SEQ ID NO: 901066 - RNA, 22 nt, Human
accagcuggucaccugggcacu

SEQ ID NO: 901067 - RNA, 22 nt, Human
ggaagccaagguggccucuauu

SEQ ID NO: 901068 - RNA, 22 nt, Human
auuccuuuggacuccuccuugc

SEQ ID NO: 901069 - RNA, 22 nt, Human
gacccaggguauccagagcugc

SEQ ID NO: 901070 - RNA, 17 nt, Human
uggaagugaggacacug

SEQ ID NO: 901071 - RNA, 22 nt, Human
aggaagugcagggggaaguacu

SEQ ID NO: 901072 - RNA, 22 nt, Human
agaaguuuugggaaauacugau

SEQ ID NO: 901073 - RNA, 22 nt, Human
ccuggcucugguucccucagcu

SEQ ID NO: 901074 - RNA, 21 nt, Human
gcucucugcaugguggcucag

SEQ ID NO: 901075 - RNA, 18 nt, Human
cucucuggucuggauccc

SEQ ID NO: 901076 - RNA, 22 nt, Human
ggagcagcuugcaugcucaggg

SEQ ID NO: 901077 - RNA, 22 nt, Human
agaaguauuuggcuaaaagaca

SEQ ID NO: 901078 - RNA, 22 nt, Human
uaggccacgaaggagaugauag

SEQ ID NO: 901079 - RNA, 23 nt, Human
ccagcccuccaccagcucuaggc

SEQ ID NO: 901080 - RNA, 22 nt, Human
uugacaaggagccauugcaucu

SEQ ID NO: 901081 - RNA, 22 nt, Human
cauauauucugguuuucacugg

SEQ ID NO: 901082 - RNA, 22 nt, Human
ggcuuuauuaagcaggguaagu

SEQ ID NO: 901083 - RNA, 22 nt, Human
ccaggagcaggagcuggacaga

SEQ ID NO: 901084 - RNA, 22 nt, Human
uacaguuauaugugauaaguaa

SEQ ID NO: 901085 - RNA, 20 nt, Human
uugcaaagugaauagcaauu

SEQ ID NO: 901086 - RNA, 19 nt, Human
acagauggaggaaucuggg

SEQ ID NO: 901087 - RNA, 19 nt, Human
agagaaggauccuaugguu

SEQ ID NO: 901088 - RNA, 22 nt, Human
gucugccugggacgcugggagu

SEQ ID NO: 901089 - RNA, 23 nt, Human
ucugucacuuucugcuguggagu

SEQ ID NO: 901090 - RNA, 23 nt, Human
uguuccugucaaauuuucuuccc

SEQ ID NO: 901091 - RNA, 22 nt, Human
agggaagaggaccagagucucu

SEQ ID NO: 901092 - RNA, 22 nt, Human
gaacauuuaugaugcaauaccu

SEQ ID NO: 901093 - RNA, 22 nt, Human
aaguuagguugcauuggucauc

SEQ ID NO: 901094 - RNA, 22 nt, Human
uccuggguuaauuaugauucac

SEQ ID NO: 901095 - RNA, 22 nt, Human
gugugugcaagagguuuauuga

SEQ ID NO: 901096 - RNA, 22 nt, Human
auauugcauuggcuggucuuga

SEQ ID NO: 901097 - RNA, 22 nt, Human
cugagcugcggcaggcaccugg

SEQ ID NO: 901098 - RNA, 20 nt, Human
uauacuaacauauaucuguu

SEQ ID NO: 901099 - RNA, 22 nt, Human
ucucagagauuuauggaaaacu

SEQ ID NO: 901100 - RNA, 22 nt, Human
uugggcaggcacauagaguuua

SEQ ID NO: 901101 - RNA, 22 nt, Human
uaauguaaacacagagacagaa

SEQ ID NO: 901102 - RNA, 22 nt, Human
ccagggaagaccacuuccugga

SEQ ID NO: 901103 - RNA, 22 nt, Human
ucuuugcaaacuauggagugug

SEQ ID NO: 901104 - RNA, 22 nt, Human
ccacccagccagaugcaggaag

SEQ ID NO: 901105 - RNA, 20 nt, Human
aagagcugacucacaguggu

SEQ ID NO: 901106 - RNA, 22 nt, Human
aggcaguguggagggcuguugc

SEQ ID NO: 901107 - RNA, 22 nt, Human
gucugagggacagaguccuggc

SEQ ID NO: 901108 - RNA, 22 nt, Human
uucaggcccaacgcacagcuuc

SEQ ID NO: 901109 - RNA, 22 nt, Human
uuccuuggagcgcuaaagcucu

SEQ ID NO: 901110 - RNA, 22 nt, Human
ugugugcacguacauacuguau

SEQ ID NO: 901111 - RNA, 22 nt, Human
ccccaaaacuuggugacuucca

SEQ ID NO: 901112 - RNA, 22 nt, Human
uuagauaccuuuguguuguaga

SEQ ID NO: 901113 - RNA, 22 nt, Human
aggagccaggccccauggggcu

SEQ ID NO: 901114 - RNA, 22 nt, Human
ccagggaaugugggaugacucu

SEQ ID NO: 901115 - RNA, 22 nt, Human
gcacaaaagguacuucauguag

SEQ ID NO: 901116 - RNA, 22 nt, Human
agaauuugagugcuuucugugu

SEQ ID NO: 901117 - RNA, 22 nt, Human
augauauacuuccuagaacagu

SEQ ID NO: 901118 - RNA, 22 nt, Human
auagucaaccuuguaauuagcc

SEQ ID NO: 901119 - RNA, 22 nt, Human
uggacaacauagugagaccuca

SEQ ID NO: 901120 - RNA, 22 nt, Human
uuagaaaugcacccaagaccua

SEQ ID NO: 901121 - RNA, 22 nt, Human
aaggccaggucccugcagugca

SEQ ID NO: 901122 - RNA, 22 nt, Human
gccagcagggcccaaaugcugg

SEQ ID NO: 901123 - RNA, 19 nt, Human
ccuugccugucccugcagc

SEQ ID NO: 901124 - RNA, 22 nt, Human
cagagucccagaugccccuccu

SEQ ID NO: 901125 - RNA, 22 nt, Human
cuguauuucccacauucucuau

SEQ ID NO: 901126 - RNA, 22 nt, Human
ugugucagcacaguaucaauua

SEQ ID NO: 901127 - RNA, 22 nt, Human
ugaaagaugcucaaugaauggu

SEQ ID NO: 901128 - RNA, 22 nt, Human
uuauuccauuauuucacuuagg

SEQ ID NO: 901129 - RNA, 22 nt, Human
cccuuuaaaguuuuaccagcag

SEQ ID NO: 901130 - RNA, 22 nt, Human
agaaccuuggugagucuaaccu

SEQ ID NO: 901131 - RNA, 22 nt, Human
cacacuaauuuuucaagaguuu

SEQ ID NO: 901132 - RNA, 19 nt, Human
accaggccucagaggcccu

SEQ ID NO: 901133 - RNA, 18 nt, Human
agcugcagaccaggaggu

SEQ ID NO: 901134 - RNA, 22 nt, Human
cucacagaugaugucuaugugg

SEQ ID NO: 901135 - RNA, 22 nt, Human
ugggccagggcacccaguccag

SEQ ID NO: 901136 - RNA, 22 nt, Human
agucaucugaccucuucucaga

SEQ ID NO: 901137 - RNA, 22 nt, Human
ucacaagacugagcuugcuuga

SEQ ID NO: 901138 - RNA, 22 nt, Human
ggcagcaaagucacauggaaaa

SEQ ID NO: 901139 - RNA, 21 nt, Human
ccagaggccucucuuggccac

SEQ ID NO: 901140 - RNA, 23 nt, Human
agagaaaaauaucugggcacauu

SEQ ID NO: 901141 - RNA, 22 nt, Human
ugcugaggagguggcugugcuu

SEQ ID NO: 901142 - RNA, 22 nt, Human
caguugccuacuacauggcagg

SEQ ID NO: 901143 - RNA, 22 nt, Human
agcaucagagagaaguuaacua

SEQ ID NO: 901144 - RNA, 17 nt, Human
ggccacagagcuugggg

SEQ ID NO: 901145 - RNA, 22 nt, Human
uuccuaaccucuagcugcauau

SEQ ID NO: 901146 - RNA, 22 nt, Human
cccugugggaacuccugaguug

SEQ ID NO: 901147 - RNA, 22 nt, Human
ugugugccagauacaagcacug

SEQ ID NO: 901148 - RNA, 22 nt, Human
aguggggacaaugagagcaggu

SEQ ID NO: 901149 - RNA, 22 nt, Human
ucuucagguuaacuugucuuuu

SEQ ID NO: 901150 - RNA, 22 nt, Human
cugacuguaauucuguucuuaa

SEQ ID NO: 901151 - RNA, 22 nt, Human
ugugucaucuguguuacauaau

SEQ ID NO: 901152 - RNA, 22 nt, Human
ugagaaucauccagaggcuucu

SEQ ID NO: 901153 - RNA, 22 nt, Human
agcccugccauucucuggagcu

SEQ ID NO: 901154 - RNA, 22 nt, Human
uucaacauuugaaaugaaugaa

SEQ ID NO: 901155 - RNA, 22 nt, Human
ccuguauuagguagacaacuau

SEQ ID NO: 901156 - RNA, 22 nt, Human
gaguguguucuuuaugcuguga

SEQ ID NO: 901157 - RNA, 17 nt, Human
cugaggcccagggccca

SEQ ID NO: 901158 - RNA, 22 nt, Human
uacuuguagcagguggcauuua

SEQ ID NO: 901159 - RNA, 22 nt, Human
gccugguguccagaggcgagug

SEQ ID NO: 901160 - RNA, 22 nt, Human
uagcuguguaagcuugguaaga

SEQ ID NO: 901161 - RNA, 22 nt, Human
agacugaagcaauucaaccagu

SEQ ID NO: 901162 - RNA, 22 nt, Human
accagagcucuucagcacagga

SEQ ID NO: 901163 - RNA, 19 nt, Human
ugaauuaaagauuaaaguc

SEQ ID NO: 901164 - RNA, 22 nt, Human
aaagacuugggugaaguaauuu

SEQ ID NO: 901165 - RNA, 22 nt, Human
gcaucaagacgaugugaaaucg

SEQ ID NO: 901166 - RNA, 22 nt, Human
uggagaagcuguagguggacuc

SEQ ID NO: 901167 - RNA, 20 nt, Human
aggccccaggaaacucucag

SEQ ID NO: 901168 - RNA, 22 nt, Human
cauacaagcguucaauagaugu

SEQ ID NO: 901169 - RNA, 22 nt, Human
ucaggccaggagaucagauuga

SEQ ID NO: 901170 - RNA, 22 nt, Human
gcacagugauaggcaguugugc

SEQ ID NO: 901171 - RNA, 22 nt, Human
ucacaccuguaaucccaggccu

SEQ ID NO: 901172 - RNA, 22 nt, Human
uucaaagcaagacacaauuccu

SEQ ID NO: 901173 - RNA, 22 nt, Human
caggaaggcccaccuguccugu

SEQ ID NO: 901174 - RNA, 22 nt, Human
caaagagguuuugagggcagcu

SEQ ID NO: 901175 - RNA, 22 nt, Human
cauaagaauauuuaguggcagc

SEQ ID NO: 901176 - RNA, 22 nt, Human
cuagcuguaagagggauguggc

SEQ ID NO: 901177 - RNA, 23 nt, Human
aaaggucucugagccuugguuuc

SEQ ID NO: 901178 - RNA, 22 nt, Human
auguucaugauugguuuuggcg

SEQ ID NO: 901179 - RNA, 22 nt, Human
cgucuuccucuuacgaugcgcu

SEQ ID NO: 901180 - RNA, 22 nt, Human
uaaguaguagggccagaauuug

SEQ ID NO: 901181 - RNA, 22 nt, Human
auguuacaauucaaaaugcugc

SEQ ID NO: 901182 - RNA, 22 nt, Human
cuaaggaaauaugucacuugcu

SEQ ID NO: 901183 - RNA, 22 nt, Human
aguugaaaauuaagugaauuuc

SEQ ID NO: 901184 - RNA, 22 nt, Human
gugagguacaauuuuauacccu

SEQ ID NO: 901185 - RNA, 22 nt, Human
auuuguaccaucugguauacag

SEQ ID NO: 901186 - RNA, 22 nt, Human
gggugguguauuagagcugcag

SEQ ID NO: 901187 - RNA, 23 nt, Human
gcugaagagcaaaccaggcaaaa

SEQ ID NO: 901188 - RNA, 22 nt, Human
gccuccuggccuuugcuccuca

SEQ ID NO: 901189 - RNA, 22 nt, Human
caggugagcucuaucuagggag

SEQ ID NO: 901190 - RNA, 22 nt, Human
ucccaggcuaggccucugcguu

SEQ ID NO: 901191 - RNA, 22 nt, Human
ugggcuccguugccuggggcag

SEQ ID NO: 901192 - RNA, 20 nt, Human
agcagcagauguuggaggug

SEQ ID NO: 901193 - RNA, 22 nt, Human
cagcaggauagguuucuuugga

SEQ ID NO: 901194 - RNA, 22 nt, Human
auuugucucugcacuuuacuca

SEQ ID NO: 901195 - RNA, 22 nt, Human
ggcagguggaaguuggcagagc

SEQ ID NO: 901196 - RNA, 22 nt, Human
gggaggagggugcuggcuaaac

SEQ ID NO: 901197 - RNA, 23 nt, Human
ucccugggcccgugccagcggug

SEQ ID NO: 901198 - RNA, 22 nt, Human
augucuguucauuauuaacugc

SEQ ID NO: 901199 - RNA, 22 nt, Human
caauuaaagaagaccugccuca

SEQ ID NO: 901200 - RNA, 22 nt, Human
cuuauagauggcgaucuucuug

SEQ ID NO: 901201 - RNA, 22 nt, Human
acauuucucagguaagucauuu

SEQ ID NO: 901202 - RNA, 22 nt, Human
agcaaggcucggucagggugau

SEQ ID NO: 901203 - RNA, 22 nt, Human
cuggccaguguggcucugaucu

SEQ ID NO: 901204 - RNA, 22 nt, Human
ugugucagauuuaggcucaaac

SEQ ID NO: 901205 - RNA, 22 nt, Human
augcaaagcaccacacuaagau

SEQ ID NO: 901206 - RNA, 22 nt, Human
gaagaaggugccagaggcuuac

SEQ ID NO: 901207 - RNA, 22 nt, Human
aagccagguguuuaggccagcg

SEQ ID NO: 901208 - RNA, 22 nt, Human
ggguccagacacuccagaggaa

SEQ ID NO: 901209 - RNA, 22 nt, Human
gccugcucuggaauccauguaa

SEQ ID NO: 901210 - RNA, 22 nt, Human
ucccugggccacagcugugagc

SEQ ID NO: 901211 - RNA, 22 nt, Human
uugugucuaaauaaggagaccu

SEQ ID NO: 901212 - RNA, 22 nt, Human
uuuguauuuuucccagcuagcu

SEQ ID NO: 901213 - RNA, 22 nt, Human
acagugcgggcugcgguggguc

SEQ ID NO: 901214 - RNA, 22 nt, Human
uuucucaucuggaaacagugcu

SEQ ID NO: 901215 - RNA, 22 nt, Human
ugagcuagguccugugucagcu

SEQ ID NO: 901216 - RNA, 22 nt, Human
caagggaccugagauggucucu

SEQ ID NO: 901217 - RNA, 22 nt, Human
uccucuggcccagcugccucug

SEQ ID NO: 901218 - RNA, 22 nt, Human
aggcaaggugcucuugcucuau

SEQ ID NO: 901219 - RNA, 22 nt, Human
ucaggaagggcucagucugugc

SEQ ID NO: 901220 - RNA, 22 nt, Human
acuuuagaaaaggaacagagga

SEQ ID NO: 901221 - RNA, 22 nt, Human
guccugguauaauuguuuaaaa

SEQ ID NO: 901222 - RNA, 22 nt, Human
uggagagguuuaaacaaaaguu

SEQ ID NO: 901223 - RNA, 22 nt, Human
ucaguggauauuucuguggcug

SEQ ID NO: 901224 - RNA, 22 nt, Human
cugguccuugcuacccagcaag

SEQ ID NO: 901225 - RNA, 22 nt, Human
cauuugaaauaguucauucuug

SEQ ID NO: 901226 - RNA, 22 nt, Human
ucaggggcccuucccucagcag

SEQ ID NO: 901227 - RNA, 22 nt, Human
ugagacagucccaugaucugca

SEQ ID NO: 901228 - RNA, 22 nt, Human
acacagagugguuuguagaaua

SEQ ID NO: 901229 - RNA, 20 nt, Human
uuuaccaacucaccaguauc

SEQ ID NO: 901230 - RNA, 22 nt, Human
aaucacaauuacuuuugcacca

SEQ ID NO: 901231 - RNA, 22 nt, Human
cagcucugccacuuccuagcua

SEQ ID NO: 901232 - RNA, 22 nt, Human
ugggaaugcugagcccauguau

SEQ ID NO: 901233 - RNA, 22 nt, Human
aggagaaagacuggacagccaa

SEQ ID NO: 901234 - RNA, 18 nt, Human
ucucucugaagaguuccc

SEQ ID NO: 901235 - RNA, 19 nt, Human
aaacucauagacucauauu

SEQ ID NO: 901236 - RNA, 22 nt, Human
gaggaagucucucuacaagaaa

SEQ ID NO: 901237 - RNA, 22 nt, Human
aaagucaucuaggagcagauuu

SEQ ID NO: 901238 - RNA, 22 nt, Human
uuuauucauuguuucgucgcag

SEQ ID NO: 901239 - RNA, 20 nt, Human
uccucagaagacauuugggg

SEQ ID NO: 901240 - RNA, 22 nt, Human
gaagguuuucaggagccuaguc

SEQ ID NO: 901241 - RNA, 22 nt, Human
uuuaacauguaauugcugcuuu

SEQ ID NO: 901242 - RNA, 22 nt, Human
auuuuguuaucagggcuuugca

SEQ ID NO: 901243 - RNA, 22 nt, Human
ugucauacaacaauaaguaccg

SEQ ID NO: 901244 - RNA, 22 nt, Human
uguguguguuuacaguuucuca

SEQ ID NO: 901245 - RNA, 22 nt, Human
uguggacuuuauuuuagggagg

SEQ ID NO: 901246 - RNA, 22 nt, Human
ugaaauuaugcauuguuguacc

SEQ ID NO: 901247 - RNA, 22 nt, Human
gcuuugccuguagcauuggccu

SEQ ID NO: 901248 - RNA, 22 nt, Human
ucucacagugcaggucugucuc

SEQ ID NO: 901249 - RNA, 22 nt, Human
augaagcagaauuucccacucu

SEQ ID NO: 901250 - RNA, 22 nt, Human
cccuggccagcucaugucugag

SEQ ID NO: 901251 - RNA, 22 nt, Human
gggcaugagaggcaggcaagug

SEQ ID NO: 901252 - RNA, 22 nt, Human
ucacagggauggaauagaaaua

SEQ ID NO: 901253 - RNA, 21 nt, Human
agaucccugaggagagcaucc

SEQ ID NO: 901254 - RNA, 22 nt, Human
agagcauccauuuuugucacau

SEQ ID NO: 901255 - RNA, 22 nt, Human
gugcaaaaguaauugcaguuuu

SEQ ID NO: 901256 - RNA, 22 nt, Human
aaggcaauuggcuuguauaaga

SEQ ID NO: 901257 - RNA, 22 nt, Human
augaggcuuaaacugcugcaac

SEQ ID NO: 901258 - RNA, 22 nt, Human
gagcacaguaaagcagugucac

SEQ ID NO: 901259 - RNA, 22 nt, Human
aggcaccucagcugagccuggg

SEQ ID NO: 901260 - RNA, 22 nt, Human
agucagagcuauguuguuauau

SEQ ID NO: 901261 - RNA, 22 nt, Human
augacaucaacaguggugcugu

SEQ ID NO: 901262 - RNA, 22 nt, Human
augucacaguugcaacaugaau

SEQ ID NO: 901263 - RNA, 22 nt, Human
gccuggaguuguggugaagcca

SEQ ID NO: 901264 - RNA, 22 nt, Human
acccaggccauuggcaagaguc

SEQ ID NO: 901265 - RNA, 23 nt, Human
cacugcagcguggucuggcagga

SEQ ID NO: 901266 - RNA, 22 nt, Human
agaacauagauaccuaagacag

SEQ ID NO: 901267 - RNA, 22 nt, Human
uugaagauuauucuauuaaaag

SEQ ID NO: 901268 - RNA, 22 nt, Human
uguguagcuuucuucugugggg

SEQ ID NO: 901269 - RNA, 22 nt, Human
gcccagccagagcugugugaug

SEQ ID NO: 901270 - RNA, 22 nt, Human
aaauggcagugucauaaggcuc

SEQ ID NO: 901271 - RNA, 22 nt, Human
ccaggcagggcucaaggaaccu

SEQ ID NO: 901272 - RNA, 17 nt, Human
ugcugcagacccacccc

SEQ ID NO: 901273 - RNA, 22 nt, Human
uucuuuuaaaagagagcagaaa

SEQ ID NO: 901274 - RNA, 22 nt, Human
uccugaggcuaaagugcagugg

SEQ ID NO: 901275 - RNA, 22 nt, Human
uccaauauuucucauauaugga

SEQ ID NO: 901276 - RNA, 22 nt, Human
augaaauuaaucaacacauaca

SEQ ID NO: 901277 - RNA, 22 nt, Human
gacuucaaaagcugacauucau

SEQ ID NO: 901278 - RNA, 22 nt, Human
gaauauuuguaauuacuguuga

SEQ ID NO: 901279 - RNA, 22 nt, Human
acacauuuucaacacugucaag

SEQ ID NO: 901280 - RNA, 22 nt, Human
cuggaagacucaauggccugcc

SEQ ID NO: 901281 - RNA, 22 nt, Human
uuggcacucucccugcacuggu

SEQ ID NO: 901282 - RNA, 22 nt, Human
aagcagggcuuuaagcgguuuu

SEQ ID NO: 901283 - RNA, 22 nt, Human
ccagccagucccgcaugaccgc

SEQ ID NO: 901284 - RNA, 22 nt, Human
cuggcuccccuacuucuuauug

SEQ ID NO: 901285 - RNA, 22 nt, Human
ugcuugggaauguggagucaga

SEQ ID NO: 901286 - RNA, 22 nt, Human
ccguggaguugugcugaguaug

SEQ ID NO: 901287 - RNA, 23 nt, Human
aaacaaugucaucaggacuuggu

SEQ ID NO: 901288 - RNA, 22 nt, Human
caaaacauucagagagcucacu

SEQ ID NO: 901289 - RNA, 22 nt, Human
aagcauuuggcaugaaacucuu

SEQ ID NO: 901290 - RNA, 22 nt, Human
gagucucuagucugguccuggc

SEQ ID NO: 901291 - RNA, 22 nt, Human
uuaucugugauccuaaaugucu

SEQ ID NO: 901292 - RNA, 22 nt, Human
uuagaaagggugucugaaucug

SEQ ID NO: 901293 - RNA, 22 nt, Human
uccccuuggcuuggucaagagg

SEQ ID NO: 901294 - RNA, 22 nt, Human
ugcuuuuuaguacugucuuauu

SEQ ID NO: 901295 - RNA, 22 nt, Human
uaggacuuggugacucucaaug

SEQ ID NO: 901296 - RNA, 20 nt, Human
ccucucugcccugcaaggcc

SEQ ID NO: 901297 - RNA, 22 nt, Human
auaauauuugcauuacugugau

SEQ ID NO: 901298 - RNA, 22 nt, Human
uacauguaauuuucauaguaag

SEQ ID NO: 901299 - RNA, 22 nt, Human
uucuauaaaugaauguguauau

SEQ ID NO: 901300 - RNA, 19 nt, Human
guccaugcuuagaggggcc

SEQ ID NO: 901301 - RNA, 22 nt, Human
uaccugaauuaccaaaagcuuu

SEQ ID NO: 901302 - RNA, 22 nt, Human
ucucugaggaagaggcuguaau

SEQ ID NO: 901303 - RNA, 22 nt, Human
cagacagaggcuguaugagggc

SEQ ID NO: 901304 - RNA, 22 nt, Human
auuuuuuagaaccuggccugau

SEQ ID NO: 901305 - RNA, 22 nt, Human
uggcccugucugcacacaggau

SEQ ID NO: 901306 - RNA, 22 nt, Human
aagcagaaguugaucuaccaua

SEQ ID NO: 901307 - RNA, 22 nt, Human
cucaggccaauaagcuccagcc

SEQ ID NO: 901308 - RNA, 21 nt, Human
ugaaacaaucagacagagucu

SEQ ID NO: 901309 - RNA, 22 nt, Human
gcccugcugaguccggcucaga

SEQ ID NO: 901310 - RNA, 22 nt, Human
ugugaaggagaugaagggagug

SEQ ID NO: 901311 - RNA, 22 nt, Human
ugcagcagggaccucuauguga

SEQ ID NO: 901312 - RNA, 22 nt, Human
uguacaagcaaauagaccuuca

SEQ ID NO: 901313 - RNA, 22 nt, Human
ccagagguggaagauuguuuug

SEQ ID NO: 901314 - RNA, 22 nt, Human
agcugguauuuguuagggaguu

SEQ ID NO: 901315 - RNA, 22 nt, Human
gaacacagucaagggcugcugu

SEQ ID NO: 901316 - RNA, 22 nt, Human
aaaggcuucucagaaaggccuu

SEQ ID NO: 901317 - RNA, 22 nt, Human
caucaaaucugacuuuucuucc

SEQ ID NO: 901318 - RNA, 22 nt, Human
ugucuucauuccccaugaaguc

SEQ ID NO: 901319 - RNA, 22 nt, Human
aggccagcuaugacucugcucc

SEQ ID NO: 901320 - RNA, 22 nt, Human
cagugcagaacacauggaaaau

SEQ ID NO: 901321 - RNA, 22 nt, Human
auuuuguggcagaugcagaacc

SEQ ID NO: 901322 - RNA, 23 nt, Human
acugccugcuacuaugcccacgg

SEQ ID NO: 901323 - RNA, 22 nt, Human
uucuuuuaauugugggggagug

SEQ ID NO: 901324 - RNA, 22 nt, Human
ucccaggauuuuaggcucucag

SEQ ID NO: 901325 - RNA, 22 nt, Human
caccagguggaaaugucacagc

SEQ ID NO: 901326 - RNA, 22 nt, Human
ucacagugcaccagugugaagc

SEQ ID NO: 901327 - RNA, 22 nt, Human
cgccaggcuugguagcucaugc

SEQ ID NO: 901328 - RNA, 22 nt, Human
uaaagugcagacucccggaaac

SEQ ID NO: 901329 - RNA, 22 nt, Human
caggaagagguaucaccgagca

SEQ ID NO: 901330 - RNA, 21 nt, Human
ugagcccuugccucagagccc

SEQ ID NO: 901331 - RNA, 22 nt, Human
ugggcagggagcuggaaccaca

SEQ ID NO: 901332 - RNA, 22 nt, Human
gggcucagccuccucacuucga

SEQ ID NO: 901333 - RNA, 22 nt, Human
ucucuggcagaggcccuauccc

SEQ ID NO: 901334 - RNA, 21 nt, Human
acagcagacaggcuuaggacc

SEQ ID NO: 901335 - RNA, 22 nt, Human
uguaguaagugcgcaauaaaua

SEQ ID NO: 901336 - RNA, 22 nt, Human
guuauaggagcccgaacuaaga

SEQ ID NO: 901337 - RNA, 22 nt, Human
agaagccagcuucagcugcccg

SEQ ID NO: 901338 - RNA, 22 nt, Human
acacacagcgccuaccaugugc

SEQ ID NO: 901339 - RNA, 22 nt, Human
uggcucugugcuucuaguaucu

SEQ ID NO: 901340 - RNA, 22 nt, Human
ccaguguguucccugccucacu

SEQ ID NO: 901341 - RNA, 23 nt, Human
aaacuguugcuucaauguauccu

SEQ ID NO: 901342 - RNA, 22 nt, Human
ucacgugagggaccugugucug

SEQ ID NO: 901343 - RNA, 22 nt, Human
uugaggaguagaagcuuugaau

SEQ ID NO: 901344 - RNA, 22 nt, Human
agguggagaagagaugggcagu

SEQ ID NO: 901345 - RNA, 22 nt, Human
aaggcuuuugggaauuuucaac

SEQ ID NO: 901346 - RNA, 22 nt, Human
uuacagaaagguugugggauag

SEQ ID NO: 901347 - RNA, 21 nt, Human
gcagcaugagaaagccccaaa

SEQ ID NO: 901348 - RNA, 22 nt, Human
uaagaacagugacagccaacau

SEQ ID NO: 901349 - RNA, 22 nt, Human
auuuccuaggguagaugucaca

SEQ ID NO: 901350 - RNA, 22 nt, Human
uguccaguccuuggggugcugu

SEQ ID NO: 901351 - RNA, 22 nt, Human
ugagcgugcaguaguguuggua

SEQ ID NO: 901352 - RNA, 22 nt, Human
aguccaugaugaaaccagaucc

SEQ ID NO: 901353 - RNA, 22 nt, Human
auucauguggggagccuucugu

SEQ ID NO: 901354 - RNA, 22 nt, Human
uugaaauaucaaguuauuagug

SEQ ID NO: 901355 - RNA, 22 nt, Human
auuauuguuagugacaggguga

SEQ ID NO: 901356 - RNA, 22 nt, Human
uaguacuacguuuucuacuauc

SEQ ID NO: 901357 - RNA, 22 nt, Human
agcagaggacaguucuuaggaa

SEQ ID NO: 901358 - RNA, 17 nt, Human
auaagacagaagacaau

SEQ ID NO: 901359 - RNA, 22 nt, Human
ggcucccugggugcuccugcuc

SEQ ID NO: 901360 - RNA, 22 nt, Human
aucaggaaauacuuauuuauaa

SEQ ID NO: 901361 - RNA, 22 nt, Human
ucuguacuuccuuuaaacuuua

SEQ ID NO: 901362 - RNA, 22 nt, Human
acagcugggaaucagcugggga

SEQ ID NO: 901363 - RNA, 22 nt, Human
cucagccagacaugacccaguc

SEQ ID NO: 901364 - RNA, 20 nt, Human
ugauauauuacucaggggaa

SEQ ID NO: 901365 - RNA, 22 nt, Human
auguccagaggugagucagagc

SEQ ID NO: 901366 - RNA, 22 nt, Human
augcuucuccugaacaucccug

SEQ ID NO: 901367 - RNA, 19 nt, Human
gguagaagggaaguguuuu

SEQ ID NO: 901368 - RNA, 22 nt, Human
auggaaauguaacuucugauuc

SEQ ID NO: 901369 - RNA, 22 nt, Human
gaugucucucacauagaaggua

SEQ ID NO: 901370 - RNA, 22 nt, Human
ugagauaaggauguuauacucg

SEQ ID NO: 901371 - RNA, 22 nt, Human
ucacagaauaaauguacuggcc

SEQ ID NO: 901372 - RNA, 22 nt, Human
ugcugggcuucaacugccugag

SEQ ID NO: 901373 - RNA, 22 nt, Human
ucuggggaauguucauuucuga

SEQ ID NO: 901374 - RNA, 22 nt, Human
aaauaaaggaacuguuuuccca

SEQ ID NO: 901375 - RNA, 22 nt, Human
uggagguguggagucaaaggga

SEQ ID NO: 901376 - RNA, 22 nt, Human
ugcagcugaaccuagagucugu

SEQ ID NO: 901377 - RNA, 22 nt, Human
agcccugcacaguucgggagga

SEQ ID NO: 901378 - RNA, 22 nt, Human
uggcugaggagagggcggaagu

SEQ ID NO: 901379 - RNA, 22 nt, Human
cuuaucaaacuggagcaggcuu

SEQ ID NO: 901380 - RNA, 22 nt, Human
gcagaggggaagcugaggaauu

SEQ ID NO: 901381 - RNA, 22 nt, Human
guuacccagugcuguggaggga

SEQ ID NO: 901382 - RNA, 22 nt, Human
ugaggcaggaguucaggcugcg

SEQ ID NO: 901383 - RNA, 22 nt, Human
accaggaagaacaggcaaggca

SEQ ID NO: 901384 - RNA, 22 nt, Human
cacaauuuguuuuaucaguauu

SEQ ID NO: 901385 - RNA, 22 nt, Human
ugaaaugagauaauuuaagugc

SEQ ID NO: 901386 - RNA, 22 nt, Human
auaagaugagaucagcuuucug

SEQ ID NO: 901387 - RNA, 22 nt, Human
cuacagaaucuaccucaagcca

SEQ ID NO: 901388 - RNA, 22 nt, Human
guccagagguccaggaucaagg

SEQ ID NO: 901389 - RNA, 22 nt, Human
agucuauuuuugguucuucggg

SEQ ID NO: 901390 - RNA, 22 nt, Human
ucugccugccgagaacaccuac

SEQ ID NO: 901391 - RNA, 21 nt, Human
ugcagcugacacccuuuggga

SEQ ID NO: 901392 - RNA, 22 nt, Human
ugugcugucaguaucaagggau

SEQ ID NO: 901393 - RNA, 23 nt, Human
uggggagggaagucauuucugua

SEQ ID NO: 901394 - RNA, 20 nt, Human
uucaucagcaaagcacagca

SEQ ID NO: 901395 - RNA, 22 nt, Human
ucagcaagaagcugugggcuuc

SEQ ID NO: 901396 - RNA, 22 nt, Human
cugucuggauauaccuuggcca

SEQ ID NO: 901397 - RNA, 22 nt, Human
cugugggaaaggaugagauugc

SEQ ID NO: 901398 - RNA, 22 nt, Human
gcuccaggcagagccucuuucg

SEQ ID NO: 901399 - RNA, 22 nt, Human
cccaggguagcugagcuggcag

SEQ ID NO: 901400 - RNA, 22 nt, Human
ucauaacaggcugagaggauuu

SEQ ID NO: 901401 - RNA, 22 nt, Human
uugcaggguugaccaauaggcu

SEQ ID NO: 901402 - RNA, 22 nt, Human
uccuggccuagcucacccugga

SEQ ID NO: 901403 - RNA, 22 nt, Human
uuaugguaggagcugucaguuu

SEQ ID NO: 901404 - RNA, 22 nt, Human
agcugcugagccauguccugcu

SEQ ID NO: 901405 - RNA, 22 nt, Human
uaaggguucagaaugcaguggu

SEQ ID NO: 901406 - RNA, 22 nt, Human
acacagagguggccacucuuuu

SEQ ID NO: 901407 - RNA, 22 nt, Human
acugcccuguaacugccaggua

SEQ ID NO: 901408 - RNA, 22 nt, Human
guuuagaaugaaacuuuugagc

SEQ ID NO: 901409 - RNA, 22 nt, Human
acaugugaguaaauuuaauguu

SEQ ID NO: 901410 - RNA, 22 nt, Human
aaaguugauaagguaucguagu

SEQ ID NO: 901411 - RNA, 22 nt, Human
aaagacuacacgggaaagagcu

SEQ ID NO: 901412 - RNA, 22 nt, Human
ugggacagauuauaagucugca

SEQ ID NO: 901413 - RNA, 22 nt, Human
aaaaguaauugcgguuuuugcc

SEQ ID NO: 901414 - RNA, 22 nt, Human
agcccagcugcuauguaccugg

SEQ ID NO: 901415 - RNA, 22 nt, Human
ugaucaggucugaacagggagg

SEQ ID NO: 901416 - RNA, 22 nt, Human
aaguaaugguuaaauaauucua

SEQ ID NO: 901417 - RNA, 22 nt, Human
cugcuccaagccagcccugcag

SEQ ID NO: 901418 - RNA, 22 nt, Human
ccuuuaaauggauguucaacug

SEQ ID NO: 901419 - RNA, 22 nt, Human
aacaugcuuugauaaauaaaag

SEQ ID NO: 901420 - RNA, 19 nt, Human
uccugggcugcgucuugcc

SEQ ID NO: 901421 - RNA, 22 nt, Human
gucucugccuggggggaucaga

SEQ ID NO: 901422 - RNA, 22 nt, Human
cccugcaggggaccugcagccu

SEQ ID NO: 901423 - RNA, 22 nt, Human
ucuuucugaauauuugaccuca

SEQ ID NO: 901424 - RNA, 22 nt, Human
ggaauugcuaacauucugaagg

SEQ ID NO: 901425 - RNA, 17 nt, Human
acacagagauuaacaca

SEQ ID NO: 901426 - RNA, 22 nt, Human
uuggcagaggccgaggugaaga

SEQ ID NO: 901427 - RNA, 22 nt, Human
ucuguguuuaaaagauaugucc

SEQ ID NO: 901428 - RNA, 22 nt, Human
aagcaaguucucaucauuuaua

SEQ ID NO: 901429 - RNA, 22 nt, Human
acugugucuagcaccacguguc

SEQ ID NO: 901430 - RNA, 22 nt, Human
aaagcuaugaggcaugcauuuc

SEQ ID NO: 901431 - RNA, 22 nt, Human
uggcagagucucuccuuuccag

SEQ ID NO: 901432 - RNA, 22 nt, Human
aaaucucagcccuuauuuuaga

SEQ ID NO: 901433 - RNA, 22 nt, Human
ggcuccagaugucuccuggcaa

SEQ ID NO: 901434 - RNA, 22 nt, Human
uguaacaagugcuuacuuuggg

SEQ ID NO: 901435 - RNA, 22 nt, Human
uggcagagugcggcauccccug

SEQ ID NO: 901436 - RNA, 22 nt, Human
agcagauguuucagagcaggcu

SEQ ID NO: 901437 - RNA, 22 nt, Human
aaacaagguacacaguaauggu

SEQ ID NO: 901438 - RNA, 22 nt, Human
ggcuuuauuauguggccaugug

SEQ ID NO: 901439 - RNA, 20 nt, Human
auccuggaauccaaauggag

SEQ ID NO: 901440 - RNA, 22 nt, Human
gagugacaggaauauuuaucug

SEQ ID NO: 901441 - RNA, 22 nt, Human
aaauguucccaauaugaagcug

SEQ ID NO: 901442 - RNA, 22 nt, Human
guguccagaugaggagacgaug

SEQ ID NO: 901443 - RNA, 22 nt, Human
agaggagcuuuuggaaaaggcc

SEQ ID NO: 901444 - RNA, 22 nt, Human
ccuccagccuuccugaagagcc

SEQ ID NO: 901445 - RNA, 22 nt, Human
auuuucauggcuucugcucagu

SEQ ID NO: 901446 - RNA, 22 nt, Human
gcucagaggguuuuggccaagu

SEQ ID NO: 901447 - RNA, 22 nt, Human
cuaagaggaaguacucuguuau

SEQ ID NO: 901448 - RNA, 22 nt, Human
gaggcccagcauucagggcagg

SEQ ID NO: 901449 - RNA, 22 nt, Human
ugagaggucaaagggcauggag

SEQ ID NO: 901450 - RNA, 22 nt, Human
cagcugccagcuucucuccauc

SEQ ID NO: 901451 - RNA, 22 nt, Human
uuuuuguucugauuauacuggu

SEQ ID NO: 901452 - RNA, 22 nt, Human
uuccaaagugcuggaauuacau

SEQ ID NO: 901453 - RNA, 22 nt, Human
acaaagcuuagaccuaagagau

SEQ ID NO: 901454 - RNA, 22 nt, Human
ccaggaaggaucguuugggagu

SEQ ID NO: 901455 - RNA, 22 nt, Human
ccagggaagaaagaugaagugc

SEQ ID NO: 901456 - RNA, 22 nt, Human
agcacagaguugcucacugccg

SEQ ID NO: 901457 - RNA, 22 nt, Human
uuuaaggcagugaaacuauucu

SEQ ID NO: 901458 - RNA, 20 nt, Human
ugugugcaucuguauguauu

SEQ ID NO: 901459 - RNA, 22 nt, Human
ucuggcucauacaagccugcaa

SEQ ID NO: 901460 - RNA, 22 nt, Human
aguuagaauauaauuauguuaa

SEQ ID NO: 901461 - RNA, 22 nt, Human
cauaaagucucauaauucacuu

SEQ ID NO: 901462 - RNA, 20 nt, Human
acagauauuugauuuucagu

SEQ ID NO: 901463 - RNA, 22 nt, Human
uuagaagcaucaccuguucugg

SEQ ID NO: 901464 - RNA, 22 nt, Human
cuuuaguuugugauacgaagau

SEQ ID NO: 901465 - RNA, 22 nt, Human
uucugggaguuugggucggcug

SEQ ID NO: 901466 - RNA, 22 nt, Human
ccugcaagaccugagacacacc

SEQ ID NO: 901467 - RNA, 22 nt, Human
gccuccucuugagggucaggga

SEQ ID NO: 901468 - RNA, 22 nt, Human
uugagaaaggggucaauaucuc

SEQ ID NO: 901469 - RNA, 23 nt, Human
uucauguucccuccuucugguga

SEQ ID NO: 901470 - RNA, 19 nt, Human
auguuuacacucaggggcu

SEQ ID NO: 901471 - RNA, 22 nt, Human
auaucacaguaguuguuuaguu

SEQ ID NO: 901472 - RNA, 22 nt, Human
uuagcugcugauuaaauauguu

SEQ ID NO: 901473 - RNA, 22 nt, Human
gcuuccuugggaaaauuagaug

SEQ ID NO: 901474 - RNA, 22 nt, Human
ugucucuuuggguuccucuugg

SEQ ID NO: 901475 - RNA, 22 nt, Human
ugugaaauucuugaaaugcaca

SEQ ID NO: 901476 - RNA, 22 nt, Human
uccaggcucucaggugucagca

SEQ ID NO: 901477 - RNA, 22 nt, Human
cauauaaauacaacauguguua

SEQ ID NO: 901478 - RNA, 22 nt, Human
aaugcaaacagcccagaaucca

SEQ ID NO: 901479 - RNA, 22 nt, Human
auagcaaauauuuuaaugagca

SEQ ID NO: 901480 - RNA, 22 nt, Human
gcauuccugagaaugcagagug

SEQ ID NO: 901481 - RNA, 22 nt, Human
cacugaaggacaguaggaaggg

SEQ ID NO: 901482 - RNA, 22 nt, Human
cgccuucacaaggacaguauau

SEQ ID NO: 901483 - RNA, 18 nt, Human
gcacagcuaggagggucc

SEQ ID NO: 901484 - RNA, 22 nt, Human
gcaugcagggagggucuggcug

SEQ ID NO: 901485 - RNA, 22 nt, Human
ggggcugcugguauuuccaguu

SEQ ID NO: 901486 - RNA, 22 nt, Human
aucuucaagggaagaaagagua

SEQ ID NO: 901487 - RNA, 22 nt, Human
acuuacaaucaaccaccuugga

SEQ ID NO: 901488 - RNA, 22 nt, Human
uaaggaaaguacauguuuugac

SEQ ID NO: 901489 - RNA, 20 nt, Human
acagaaagcugccuuguccc

SEQ ID NO: 901490 - RNA, 22 nt, Human
uucacagauuucccugcacaug

SEQ ID NO: 901491 - RNA, 22 nt, Human
aauguguguucggggcccagag

SEQ ID NO: 901492 - RNA, 22 nt, Human
agguuuauguuuggugcaggag

SEQ ID NO: 901493 - RNA, 22 nt, Human
acagggcuccuugggcugacac

SEQ ID NO: 901494 - RNA, 22 nt, Human
agcccaugcaacaggccuagcg

SEQ ID NO: 901495 - RNA, 22 nt, Human
cauaauguaugcauuuuccagc

SEQ ID NO: 901496 - RNA, 22 nt, Human
cagagacauuaagugccaugau

SEQ ID NO: 901497 - RNA, 22 nt, Human
gcaggccacugucuccucuggg

SEQ ID NO: 901498 - RNA, 22 nt, Human
caaacauucaaguacaagucuu

SEQ ID NO: 901499 - RNA, 22 nt, Human
ccagcccuacaguaucaccugu

SEQ ID NO: 901500 - RNA, 23 nt, Human
uggcagcuguguaagagaaagca

SEQ ID NO: 901501 - RNA, 22 nt, Human
uuccaccaauucuccuccaagg

SEQ ID NO: 901502 - RNA, 22 nt, Human
caguuugugcuaggcacuauuu

SEQ ID NO: 901503 - RNA, 23 nt, Human
acugccagauugaagguuucuua

SEQ ID NO: 901504 - RNA, 22 nt, Human
ccucauguugcucgcaucugca

SEQ ID NO: 901505 - RNA, 22 nt, Human
caggggcugaaauguugggguu

SEQ ID NO: 901506 - RNA, 22 nt, Human
agugcuucuggugggcgugagg

SEQ ID NO: 901507 - RNA, 22 nt, Human
gagcugcuggccuccugcggga

SEQ ID NO: 901508 - RNA, 22 nt, Human
cuacagaguaucuaaagaggua

SEQ ID NO: 901509 - RNA, 22 nt, Human
ucucccucauuccugcuuccau

SEQ ID NO: 901510 - RNA, 22 nt, Human
aaaguauucaaaaauauuuggu

SEQ ID NO: 901511 - RNA, 22 nt, Human
agagcuggaagcugcucuuaga

SEQ ID NO: 901512 - RNA, 22 nt, Human
aauucauauggauaugcuagua

SEQ ID NO: 901513 - RNA, 22 nt, Human
aggguucagugagguguacucc

SEQ ID NO: 901514 - RNA, 22 nt, Human
uagaacuaagaguuaucauuua

SEQ ID NO: 901515 - RNA, 22 nt, Human
uauguuuuucagacguccuaca

SEQ ID NO: 901516 - RNA, 22 nt, Human
ugugaagguaaggaggggcaag

SEQ ID NO: 901517 - RNA, 22 nt, Human
acuuaggcuugguucagcuaga

SEQ ID NO: 901518 - RNA, 18 nt, Human
agcagcaauuugggauga

SEQ ID NO: 901519 - RNA, 22 nt, Human
gcagggcauagaggcacggagg

SEQ ID NO: 901520 - RNA, 22 nt, Human
uccagagggcgauggcuggggg

SEQ ID NO: 901521 - RNA, 22 nt, Human
ucaauauauuccauguuuucuc

SEQ ID NO: 901522 - RNA, 22 nt, Human
agcuccaguuuccugacugagc

SEQ ID NO: 901523 - RNA, 22 nt, Human
cuggucccugcagugugcuggg

SEQ ID NO: 901524 - RNA, 22 nt, Human
aguguaugucaaguauauacac

SEQ ID NO: 901525 - RNA, 21 nt, Human
uauuuaguuuuacaaaugugg

SEQ ID NO: 901526 - RNA, 22 nt, Human
cuaucucagauaaccugcacca

SEQ ID NO: 901527 - RNA, 22 nt, Human
ucacauuuuaguaccaugauuu

SEQ ID NO: 901528 - RNA, 22 nt, Human
aggcccuggcuggguuucuuua

SEQ ID NO: 901529 - RNA, 22 nt, Human
uuuagcaacgaagcacucgaca

SEQ ID NO: 901530 - RNA, 22 nt, Human
cucuccaaguuaucaagaugaa

SEQ ID NO: 901531 - RNA, 22 nt, Human
cacccuagcugucauuucaguu

SEQ ID NO: 901532 - RNA, 22 nt, Human
ccuggcuccgugucacgugccc

SEQ ID NO: 901533 - RNA, 17 nt, Human
agcauuuguguuaacag

SEQ ID NO: 901534 - RNA, 22 nt, Human
gaggucauuguugcauuaauug

SEQ ID NO: 901535 - RNA, 22 nt, Human
uuuaaugauagucuuacgaaaa

SEQ ID NO: 901536 - RNA, 22 nt, Human
uuaaaauuuccccaccauguau

SEQ ID NO: 901537 - RNA, 22 nt, Human
aaggacaggcacagugguggag

SEQ ID NO: 901538 - RNA, 22 nt, Human
ucuacauuuuaacaagaugccc

SEQ ID NO: 901539 - RNA, 22 nt, Human
ucauuucuguugugcaucacug

SEQ ID NO: 901540 - RNA, 22 nt, Human
augggcugugggacccuggacc

SEQ ID NO: 901541 - RNA, 22 nt, Human
ggcagguguggugaccagagau

SEQ ID NO: 901542 - RNA, 22 nt, Human
cucauguaagagagcauuaguu

SEQ ID NO: 901543 - RNA, 22 nt, Human
uuagcagcaauggcaucaacua

SEQ ID NO: 901544 - RNA, 22 nt, Human
aaggcauguguccucagagaga

SEQ ID NO: 901545 - RNA, 22 nt, Human
uggccacacugcccccacuggg

SEQ ID NO: 901546 - RNA, 22 nt, Human
uugagguacaaacaugagguuu

SEQ ID NO: 901547 - RNA, 21 nt, Human
gggcgaggccugauguggcuc

SEQ ID NO: 901548 - RNA, 22 nt, Human
guuuucaugucuauugggcaua

SEQ ID NO: 901549 - RNA, 22 nt, Human
aaggcuggucagauguggugaa

SEQ ID NO: 901550 - RNA, 22 nt, Human
agagccugugggagaugcagcu

SEQ ID NO: 901551 - RNA, 22 nt, Human
cagagagagugggguguggauu

SEQ ID NO: 901552 - RNA, 18 nt, Human
aaacauggcuuaaaggcu

SEQ ID NO: 901553 - RNA, 22 nt, Human
gcuaaauaaucuucuucugaca

SEQ ID NO: 901554 - RNA, 22 nt, Human
uacuuacagaaggaagcaauug

SEQ ID NO: 901555 - RNA, 22 nt, Human
ucuugggaccauuuacacauac

SEQ ID NO: 901556 - RNA, 22 nt, Human
cauuuacuuaaaucuuuacaag

SEQ ID NO: 901557 - RNA, 22 nt, Human
agguucuggcauugcucaguaa

SEQ ID NO: 901558 - RNA, 22 nt, Human
ugucccaguucccaggguugcu

SEQ ID NO: 901559 - RNA, 22 nt, Human
gccugugcuuaacugacgugag

SEQ ID NO: 901560 - RNA, 22 nt, Human
aauaaugagcuugucuaauugu

SEQ ID NO: 901561 - RNA, 22 nt, Human
cuucuucauaggcaguccuguu

SEQ ID NO: 901562 - RNA, 22 nt, Human
cacaugaauucacauguauuuu

SEQ ID NO: 901563 - RNA, 22 nt, Human
agcaggagcugugggaagaugg

SEQ ID NO: 901564 - RNA, 22 nt, Human
agcgcgcucuaggacaccgcgg

SEQ ID NO: 901565 - RNA, 22 nt, Human
gaggagaaauuuggggaccuga

SEQ ID NO: 901566 - RNA, 22 nt, Human
auccuuaaaggaauucugauuu

SEQ ID NO: 901567 - RNA, 22 nt, Human
gaaucaaugguagauuaaguaa

SEQ ID NO: 901568 - RNA, 22 nt, Human
uaaaguguaugccaucucucau

SEQ ID NO: 901569 - RNA, 18 nt, Human
acgugcugugccuuuugc

SEQ ID NO: 901570 - RNA, 22 nt, Human
agcugccccucauuuucaccac

SEQ ID NO: 901571 - RNA, 17 nt, Human
agcaggcacgucagcac

SEQ ID NO: 901572 - RNA, 22 nt, Human
gaagacaauucuggguggagga

SEQ ID NO: 901573 - RNA, 22 nt, Human
uggcagaccugaagguucggcg

SEQ ID NO: 901574 - RNA, 22 nt, Human
gauagcaacauagaacagaauu

SEQ ID NO: 901575 - RNA, 22 nt, Human
ccucaugauuuuuagcccauug

SEQ ID NO: 901576 - RNA, 22 nt, Human
aaaguaaagauugggaaugugu

SEQ ID NO: 901577 - RNA, 22 nt, Human
cauuuguuggucagauuguagu

SEQ ID NO: 901578 - RNA, 22 nt, Human
uauugcauuaugguaggaaagg

SEQ ID NO: 901579 - RNA, 22 nt, Human
auggaagaacgcucaggguuac

SEQ ID NO: 901580 - RNA, 22 nt, Human
cugccuccaggcucaccuugac

SEQ ID NO: 901581 - RNA, 22 nt, Human
cagugauucagacucaucauuu

SEQ ID NO: 901582 - RNA, 22 nt, Human
ugcuggcugaggccugagcggg

SEQ ID NO: 901583 - RNA, 21 nt, Human
ccagcuccaggaccuuggauc

SEQ ID NO: 901584 - RNA, 22 nt, Human
aauaaagccugucucuuuagag

SEQ ID NO: 901585 - RNA, 22 nt, Human
uguaacauauguaaaagcaccu

SEQ ID NO: 901586 - RNA, 22 nt, Human
uccauucauucauugaugaaca

SEQ ID NO: 901587 - RNA, 22 nt, Human
uaaagcacgucuauuuaaugau

SEQ ID NO: 901588 - RNA, 22 nt, Human
cuggguaccucaccgcugcugc

SEQ ID NO: 901589 - RNA, 22 nt, Human
gagggcagaaaauuaugcggug

SEQ ID NO: 901590 - RNA, 22 nt, Human
auggcucucuccuuacugcugc

SEQ ID NO: 901591 - RNA, 22 nt, Human
gucuguggcaggggagaaguuu

SEQ ID NO: 901592 - RNA, 22 nt, Human
uccacaggcaagucucuuggca

SEQ ID NO: 901593 - RNA, 22 nt, Human
aggagucacucagggcuucauc

SEQ ID NO: 901594 - RNA, 22 nt, Human
ggcagggagagcaugcugauaa

SEQ ID NO: 901595 - RNA, 22 nt, Human
auucaaauuaaguuaauucagc

SEQ ID NO: 901596 - RNA, 22 nt, Human
ggcaggagaaaggucucuucuu

SEQ ID NO: 901597 - RNA, 20 nt, Human
augauucaugaugaugucuc

SEQ ID NO: 901598 - RNA, 22 nt, Human
uagcagaguagugccuccagau

SEQ ID NO: 901599 - RNA, 19 nt, Human
cacuguccuagucgaggcc

SEQ ID NO: 901600 - RNA, 22 nt, Human
uguuaacauguguauuguauga

SEQ ID NO: 901601 - RNA, 22 nt, Human
uguuugugagaugugagguacg

SEQ ID NO: 901602 - RNA, 22 nt, Human
uacagagaugccgaagagugaa

SEQ ID NO: 901603 - RNA, 22 nt, Human
ucugugcugccauccuguggcc

SEQ ID NO: 901604 - RNA, 22 nt, Human
ggggaugagacuagagcuaaag

SEQ ID NO: 901605 - RNA, 22 nt, Human
agcucuggagccggaggauuuc

SEQ ID NO: 901606 - RNA, 22 nt, Human
augagacacaugugacuucuuu

SEQ ID NO: 901607 - RNA, 22 nt, Human
uucauguaggcugcaaugcaca

SEQ ID NO: 901608 - RNA, 22 nt, Human
cugcugggcuccucaugugacu

SEQ ID NO: 901609 - RNA, 22 nt, Human
gagggacagcuaaagagaaauu

SEQ ID NO: 901610 - RNA, 22 nt, Human
aucuagaaaguguugaagauca

SEQ ID NO: 901611 - RNA, 22 nt, Human
ugccaggcccagcuccagagcu

SEQ ID NO: 901612 - RNA, 22 nt, Human
agagcagauuucaaauauuggc

SEQ ID NO: 901613 - RNA, 22 nt, Human
acacagauuuuacauguuaugc

SEQ ID NO: 901614 - RNA, 23 nt, Human
uggacaguaggguagacagugcc

SEQ ID NO: 901615 - RNA, 22 nt, Human
uccaaaggaagaggcugucagu

SEQ ID NO: 901616 - RNA, 21 nt, Human
acuuugggaggugugaggggc

SEQ ID NO: 901617 - RNA, 23 nt, Human
agcaggaaaccgagggugauguu

SEQ ID NO: 901618 - RNA, 22 nt, Human
agaauaaaauagucugaagaug

SEQ ID NO: 901619 - RNA, 22 nt, Human
acaucagagggcucacaugauc

SEQ ID NO: 901620 - RNA, 22 nt, Human
agggaaaguaagcauuucauua

SEQ ID NO: 901621 - RNA, 22 nt, Human
guguccaguuuuuucucugcug

SEQ ID NO: 901622 - RNA, 22 nt, Human
cagggcuagggagcccuccugg

SEQ ID NO: 901623 - RNA, 22 nt, Human
uccugauggccucuggcuccag

SEQ ID NO: 901624 - RNA, 22 nt, Human
ggcugagcuuuucaugaugguu

SEQ ID NO: 901625 - RNA, 21 nt, Human
uccugggaagcacuggggugg

SEQ ID NO: 901626 - RNA, 22 nt, Human
ccagcuccucuucccaguguca

SEQ ID NO: 901627 - RNA, 22 nt, Human
uucaaugccuagaacuuagcau

SEQ ID NO: 901628 - RNA, 22 nt, Human
auccagcacuuguucaugugaa

SEQ ID NO: 901629 - RNA, 22 nt, Human
augauuuccaguuguugcuaag

SEQ ID NO: 901630 - RNA, 22 nt, Human
ucccugcuugcucucagcccuu

SEQ ID NO: 901631 - RNA, 22 nt, Human
guaaaacugcagaacuuggagg

SEQ ID NO: 901632 - RNA, 22 nt, Human
gauguguuuccaggauuuguuu

SEQ ID NO: 901633 - RNA, 22 nt, Human
ccuccuggggugaaggauggga

SEQ ID NO: 901634 - RNA, 22 nt, Human
auuguaucccccagguguuuaa

SEQ ID NO: 901635 - RNA, 22 nt, Human
agguacaggagguuggggcuac

SEQ ID NO: 901636 - RNA, 22 nt, Human
gugccagaggcagugaggaguu

SEQ ID NO: 901637 - RNA, 22 nt, Human
agcuggcauugaagaaugguua

SEQ ID NO: 901638 - RNA, 22 nt, Human
accuccagcuuuuuagagacau

SEQ ID NO: 901639 - RNA, 22 nt, Human
ggccccagggaagaaggugguc

SEQ ID NO: 901640 - RNA, 22 nt, Human
ugcuuuauaacuuaguuuaugg

SEQ ID NO: 901641 - RNA, 22 nt, Human
ucagugccaugggcagacaggc

SEQ ID NO: 901642 - RNA, 22 nt, Human
ggagucaccaaguaggagucuu

SEQ ID NO: 901643 - RNA, 22 nt, Human
gaagccagccuugucugccucu

SEQ ID NO: 901644 - RNA, 22 nt, Human
ggcagcaguccauggcccaagg

SEQ ID NO: 901645 - RNA, 22 nt, Human
ugccugucagggggagugggaa

SEQ ID NO: 901646 - RNA, 22 nt, Human
uauauuuuagacacccucacgc

SEQ ID NO: 901647 - RNA, 22 nt, Human
ugagccagcaggccuccagugg

SEQ ID NO: 901648 - RNA, 22 nt, Human
cccuggagcugcuugcauguug

SEQ ID NO: 901649 - RNA, 22 nt, Human
cugugacuagaccugcaggaga

SEQ ID NO: 901650 - RNA, 22 nt, Human
uuugaaacucugaacauguuuc

SEQ ID NO: 901651 - RNA, 22 nt, Human
acaaugaacgcuuuuuaacugu

SEQ ID NO: 901652 - RNA, 22 nt, Human
ccagagcugaugggcccagggu

SEQ ID NO: 901653 - RNA, 22 nt, Human
auguuuuauguuccacucaagg

SEQ ID NO: 901654 - RNA, 22 nt, Human
acagggccauuaucuguucuag

SEQ ID NO: 901655 - RNA, 22 nt, Human
caucacauuuaauuaaaauguc

SEQ ID NO: 901656 - RNA, 22 nt, Human
gcugugcccagcuccagcucug

SEQ ID NO: 901657 - RNA, 22 nt, Human
ucuucugaugccaguaaccaug

SEQ ID NO: 901658 - RNA, 22 nt, Human
ucacagaacaagccugguggag

SEQ ID NO: 901659 - RNA, 22 nt, Human
aaaaguuagcuauuaguaggug

SEQ ID NO: 901660 - RNA, 22 nt, Human
cccaggaguuagagguuguggu

SEQ ID NO: 901661 - RNA, 22 nt, Human
agcagcaaagccaggggauggg

SEQ ID NO: 901662 - RNA, 22 nt, Human
auucaguguaucaaugaaugcu

SEQ ID NO: 901663 - RNA, 22 nt, Human
agacgcgcagaaggaagcggcc

SEQ ID NO: 901664 - RNA, 22 nt, Human
uuugauauccuauacaaguaaa

SEQ ID NO: 901665 - RNA, 22 nt, Human
gagcagcagguggcugugaugg

SEQ ID NO: 901666 - RNA, 22 nt, Human
uccuuaaaugugaucuagauuu

SEQ ID NO: 901667 - RNA, 22 nt, Human
agaccagggucccacagagucu

SEQ ID NO: 901668 - RNA, 20 nt, Human
uacucacaaaugguuuagca

SEQ ID NO: 901669 - RNA, 22 nt, Human
uggagcagaguucagcggggag

SEQ ID NO: 901670 - RNA, 22 nt, Human
cugagagcagggacuugagcca

SEQ ID NO: 901671 - RNA, 22 nt, Human
gaguccaguucuuuccagcagu

SEQ ID NO: 901672 - RNA, 22 nt, Human
cucuccagggguagaugccuuc

SEQ ID NO: 901673 - RNA, 22 nt, Human
agucacagggggccccugcaac

SEQ ID NO: 901674 - RNA, 22 nt, Human
ggaggccaaggagggcggauca

SEQ ID NO: 901675 - RNA, 22 nt, Human
cucacagugaugucuuaugaca

SEQ ID NO: 901676 - RNA, 22 nt, Human
ugucuuacaugagucaccccaa

SEQ ID NO: 901677 - RNA, 22 nt, Human
gaacuuuaucaaaaguuguuua

SEQ ID NO: 901678 - RNA, 22 nt, Human
gagugcugcuugggauagugag

SEQ ID NO: 901679 - RNA, 22 nt, Human
uggcccugacuuggaggccuga

SEQ ID NO: 901680 - RNA, 22 nt, Human
cagcccagcagucuuagccugc

SEQ ID NO: 901681 - RNA, 22 nt, Human
augaaugcaauauuuuaugaca

SEQ ID NO: 901682 - RNA, 21 nt, Human
ggucuucaaagcuuuuacgau

SEQ ID NO: 901683 - RNA, 22 nt, Human
ugugccugacuaggugaaucaa

SEQ ID NO: 901684 - RNA, 20 nt, Human
cuccugugccucucugggcc

SEQ ID NO: 901685 - RNA, 22 nt, Human
auagcagaaaccaagcuucuuc

SEQ ID NO: 901686 - RNA, 22 nt, Human
aguguuauuuauuguuucauaa

SEQ ID NO: 901687 - RNA, 22 nt, Human
guaaucucagcuacuugggagg

SEQ ID NO: 901688 - RNA, 22 nt, Human
agcugccugcugcacucggugc

SEQ ID NO: 901689 - RNA, 22 nt, Human
cagacccugggccacagaggag

SEQ ID NO: 901690 - RNA, 22 nt, Human
uucaaaugauggcaguccuggc

SEQ ID NO: 901691 - RNA, 22 nt, Human
caggaacaggcugaugggcagg

SEQ ID NO: 901692 - RNA, 22 nt, Human
gcacacaguauaugcucauuaa

SEQ ID NO: 901693 - RNA, 22 nt, Human
agccagcuguacugccugcuca

SEQ ID NO: 901694 - RNA, 22 nt, Human
gcacugggcuccaggaaggagg

SEQ ID NO: 901695 - RNA, 22 nt, Human
uuuauugaguaucuacuaugug

SEQ ID NO: 901696 - RNA, 22 nt, Human
ccucacagccucaugcccagcc

SEQ ID NO: 901697 - RNA, 22 nt, Human
ccuucuggaagcucuaagggag

SEQ ID NO: 901698 - RNA, 23 nt, Human
gggugggccaaauuagguagccu

SEQ ID NO: 901699 - RNA, 22 nt, Human
uuuuuugcacacucugcuaaau

SEQ ID NO: 901700 - RNA, 22 nt, Human
auguguauccaucugucuauuu

SEQ ID NO: 901701 - RNA, 22 nt, Human
gucugggauugggguaaagaag

SEQ ID NO: 901702 - RNA, 22 nt, Human
ucuucagcucugaggcucuggc

SEQ ID NO: 901703 - RNA, 22 nt, Human
gacaguaagagugucuggguuc

SEQ ID NO: 901704 - RNA, 20 nt, Human
aggcuccuguaccugaggaa

SEQ ID NO: 901705 - RNA, 22 nt, Human
gaagauuucugaugaguuacuu

SEQ ID NO: 901706 - RNA, 22 nt, Human
aauucauacucuauauugcuuu

SEQ ID NO: 901707 - RNA, 22 nt, Human
aggcugugagaaguccuucagu

SEQ ID NO: 901708 - RNA, 22 nt, Human
ucugagaagcgugucucuguuu

SEQ ID NO: 901709 - RNA, 22 nt, Human
ggauacaagguguucuaucacu

SEQ ID NO: 901710 - RNA, 20 nt, Human
guggcaggcagugaaggagc

SEQ ID NO: 901711 - RNA, 22 nt, Human
cugagccaugagccugcgccca

SEQ ID NO: 901712 - RNA, 22 nt, Human
gcaaguaggaaguguccuccuu

SEQ ID NO: 901713 - RNA, 21 nt, Human
gcuggagagccaggcaggggc

SEQ ID NO: 901714 - RNA, 22 nt, Human
cuucuuuguucuguugucucac

SEQ ID NO: 901715 - RNA, 22 nt, Human
uuacacuuuggcaagcuauuaa

SEQ ID NO: 901716 - RNA, 22 nt, Human
ggaagccaguugcuuggugugg

SEQ ID NO: 901717 - RNA, 22 nt, Human
uuucuagucucgaucucuuaau

SEQ ID NO: 901718 - RNA, 22 nt, Human
ucaggcugaccagguuuugcuc

SEQ ID NO: 901719 - RNA, 22 nt, Human
cacaugugcaguuacaugaauu

SEQ ID NO: 901720 - RNA, 22 nt, Human
uccucagggcggccuccgucuu

SEQ ID NO: 901721 - RNA, 22 nt, Human
uuguacacaauucuuaacauac

SEQ ID NO: 901722 - RNA, 22 nt, Human
aucuagaagccugagccaagau

SEQ ID NO: 901723 - RNA, 22 nt, Human
acagugcuaaugaugccaagau

SEQ ID NO: 901724 - RNA, 22 nt, Human
gcacugguuacccugaguggcu

SEQ ID NO: 901725 - RNA, 22 nt, Human
agcuucuugggcuuuacacaaa

SEQ ID NO: 901726 - RNA, 22 nt, Human
ggcagcaucucauaucuucagg

SEQ ID NO: 901727 - RNA, 22 nt, Human
uuuaauuuuccucuuccuggag

SEQ ID NO: 901728 - RNA, 23 nt, Human
agcaucuggcuuccccuggaugg

SEQ ID NO: 901729 - RNA, 22 nt, Human
uggugugaggcgggaguguagu

SEQ ID NO: 901730 - RNA, 22 nt, Human
gugcugagcugcagaugcgcuc

SEQ ID NO: 901731 - RNA, 22 nt, Human
uagcuguggccuugcuggucug

SEQ ID NO: 901732 - RNA, 22 nt, Human
cuggcagggcagggguuugugc

SEQ ID NO: 901733 - RNA, 22 nt, Human
ccucccacauugaggacaugcu

SEQ ID NO: 901734 - RNA, 22 nt, Human
uuugauaauacacaagagaaag

SEQ ID NO: 901735 - RNA, 22 nt, Human
cagaggguugaugugaggcuua

SEQ ID NO: 901736 - RNA, 22 nt, Human
aggcuucaggaaauauacauuu

SEQ ID NO: 901737 - RNA, 22 nt, Human
ugagugccuaccaagugcugga

SEQ ID NO: 901738 - RNA, 22 nt, Human
gcuauuuauuaaaauagugaag

SEQ ID NO: 901739 - RNA, 22 nt, Human
ugugggcagcuggagcuguuca

SEQ ID NO: 901740 - RNA, 22 nt, Human
cuuauguacacacauauauugu

SEQ ID NO: 901741 - RNA, 22 nt, Human
uguagguaaaagcaucuagugu

SEQ ID NO: 901742 - RNA, 22 nt, Human
aggggccucgcaggaccgcucc

SEQ ID NO: 901743 - RNA, 22 nt, Human
aggggaaaugccuuggugguac

SEQ ID NO: 901744 - RNA, 22 nt, Human
gacagggaggagcagagcuucu

SEQ ID NO: 901745 - RNA, 22 nt, Human
gacuaggcucucauagagguag

SEQ ID NO: 901746 - RNA, 22 nt, Human
guccaguguguuuaucuuggau

SEQ ID NO: 901747 - RNA, 22 nt, Human
uccugucugucuuuggucccuu

SEQ ID NO: 901748 - RNA, 17 nt, Human
uggcacagaggugcuau

SEQ ID NO: 901749 - RNA, 22 nt, Human
ccacugaggggucaugguggga

SEQ ID NO: 901750 - RNA, 22 nt, Human
uuccuguccgcaauggccuggg

SEQ ID NO: 901751 - RNA, 22 nt, Human
uguguccaucugacaggagagg

SEQ ID NO: 901752 - RNA, 22 nt, Human
ugaggcagaguaagauacauga

SEQ ID NO: 901753 - RNA, 22 nt, Human
agcagccagaaauccagaggug

SEQ ID NO: 901754 - RNA, 22 nt, Human
cagaaucugagucgugauugua

SEQ ID NO: 901755 - RNA, 22 nt, Human
aagauacauuaugucucucuga

SEQ ID NO: 901756 - RNA, 22 nt, Human
uagacauuugaaugugaaauga

SEQ ID NO: 901757 - RNA, 22 nt, Human
ccugggcuuacgaccucugacu

SEQ ID NO: 901758 - RNA, 22 nt, Human
caaagugcuggaauuauagggg

SEQ ID NO: 901759 - RNA, 22 nt, Human
agugaaauuccuggucuuuguu

SEQ ID NO: 901760 - RNA, 22 nt, Human
ccuggagcacauggcaggaggc

SEQ ID NO: 901761 - RNA, 22 nt, Human
ccuggccuuaagggcagggagc

SEQ ID NO: 901762 - RNA, 22 nt, Human
ucucauaaggucagauuucaca

SEQ ID NO: 901763 - RNA, 22 nt, Human
ucccucagauuggcaauuagau

SEQ ID NO: 901764 - RNA, 22 nt, Human
caaugcaaugcaaugcaaugca

SEQ ID NO: 901765 - RNA, 22 nt, Human
cuggucaggggauggggcucag

SEQ ID NO: 901766 - RNA, 22 nt, Human
ucucugggaauuuuuuggacau

SEQ ID NO: 901767 - RNA, 22 nt, Human
augccaggaacaaacaguggug

SEQ ID NO: 901768 - RNA, 22 nt, Human
cacaccauaugauuccauuuag

SEQ ID NO: 901769 - RNA, 22 nt, Human
cagugcuggaggcuggagggaa

SEQ ID NO: 901770 - RNA, 22 nt, Human
uauuauuaaauggcagaauuuu

SEQ ID NO: 901771 - RNA, 22 nt, Human
agcagcuagaauagugccuggu

SEQ ID NO: 901772 - RNA, 22 nt, Human
gaaaagggcaagagagagggca

SEQ ID NO: 901773 - RNA, 22 nt, Human
cagaggagaauugcgggaucau

SEQ ID NO: 901774 - RNA, 22 nt, Human
augaaacaguguguauagcaaa

SEQ ID NO: 901775 - RNA, 22 nt, Human
uagaacucuggucuucucaucc

SEQ ID NO: 901776 - RNA, 22 nt, Human
aggagccugagucacagugccu

SEQ ID NO: 901777 - RNA, 22 nt, Human
cuggcuuuccuugucugcaucc

SEQ ID NO: 901778 - RNA, 21 nt, Human
gcagggacaaagcuucaggag

SEQ ID NO: 901779 - RNA, 22 nt, Human
gaaaguaacauuucuugaauua

SEQ ID NO: 901780 - RNA, 22 nt, Human
ucaggaaggcgccccaucagga

SEQ ID NO: 901781 - RNA, 22 nt, Human
ugucugaugauagugucucucc

SEQ ID NO: 901782 - RNA, 22 nt, Human
uaaacagagaugccugggucug

SEQ ID NO: 901783 - RNA, 22 nt, Human
ccucccaccauuuagagagagc

SEQ ID NO: 901784 - RNA, 22 nt, Human
uugcaacacaaaguuugauucc

SEQ ID NO: 901785 - RNA, 22 nt, Human
gucucccaauccgggacagccu

SEQ ID NO: 901786 - RNA, 20 nt, Human
gagcagcuguuugcauugca

SEQ ID NO: 901787 - RNA, 22 nt, Human
accagccugucugagucguggg

SEQ ID NO: 901788 - RNA, 22 nt, Human
gagggcagagacagugauucac

SEQ ID NO: 901789 - RNA, 22 nt, Human
gacucugggcugagccagggcc

SEQ ID NO: 901790 - RNA, 22 nt, Human
uaguggggaaggaggacaagaa

SEQ ID NO: 901791 - RNA, 22 nt, Human
gcugcaggaugaggcucugcuc

SEQ ID NO: 901792 - RNA, 22 nt, Human
ucaggaaagcugcggucaccug

SEQ ID NO: 901793 - RNA, 22 nt, Human
uagauaggugauuaggaaaagc

SEQ ID NO: 901794 - RNA, 22 nt, Human
ccaggaaggcaggccuccccgc

SEQ ID NO: 901795 - RNA, 22 nt, Human
ugucuccugggucccuuccacc

SEQ ID NO: 901796 - RNA, 22 nt, Human
cauaauuucccaagagauugaa

SEQ ID NO: 901797 - RNA, 22 nt, Human
agcaaugaccagugaucuugua

SEQ ID NO: 901798 - RNA, 22 nt, Human
gguaaaaaucacaaauacuuua

SEQ ID NO: 901799 - RNA, 22 nt, Human
ucugacccugagucuauuuucu

SEQ ID NO: 901800 - RNA, 22 nt, Human
caggccucaggggcucaggcug

SEQ ID NO: 901801 - RNA, 22 nt, Human
ggcuggucaggaaacuaggcuc

SEQ ID NO: 901802 - RNA, 20 nt, Human
ggcugugcccuuccguggcc

SEQ ID NO: 901803 - RNA, 22 nt, Human
aaaggauuaaauaaaugugcug

SEQ ID NO: 901804 - RNA, 22 nt, Human
accauagacuggaggaucuccu

SEQ ID NO: 901805 - RNA, 22 nt, Human
acugggagaaacugacaccuua

SEQ ID NO: 901806 - RNA, 22 nt, Human
acaaggcugaacagugaagccg

SEQ ID NO: 901807 - RNA, 23 nt, Human
ggccucagcgcacagaaacugcu

SEQ ID NO: 901808 - RNA, 22 nt, Human
caugagugucaucucagcagcu

SEQ ID NO: 901809 - RNA, 22 nt, Human
agugaucagcuagaucuacuug

SEQ ID NO: 901810 - RNA, 22 nt, Human
uucauggcgcuguucucucccu

SEQ ID NO: 901811 - RNA, 22 nt, Human
auaaacaguaaaugugagcagu

SEQ ID NO: 901812 - RNA, 22 nt, Human
augcauaugcauggacacucag

SEQ ID NO: 901813 - RNA, 22 nt, Human
gagaaaaugucagacuuggucg

SEQ ID NO: 901814 - RNA, 22 nt, Human
agcuggugaaccugaggcacag

SEQ ID NO: 901815 - RNA, 22 nt, Human
caaauguuaaauguguuaagac

SEQ ID NO: 901816 - RNA, 22 nt, Human
acauugauauuucaaauacagg

SEQ ID NO: 901817 - RNA, 22 nt, Human
cacuggcccauuccugucuggc

SEQ ID NO: 901818 - RNA, 21 nt, Human
ugggccugauucccaggguca

SEQ ID NO: 901819 - RNA, 22 nt, Human
aucaaugcuugccaaauggaag

SEQ ID NO: 901820 - RNA, 22 nt, Human
aggcuccauucaugugaaggca

SEQ ID NO: 901821 - RNA, 22 nt, Human
acacauuauaggcaaucaaaag

SEQ ID NO: 901822 - RNA, 22 nt, Human
ccuggauagcuacuggccaggc

SEQ ID NO: 901823 - RNA, 22 nt, Human
cagcauuucaggaggcugaggu

SEQ ID NO: 901824 - RNA, 22 nt, Human
ucugagaagcaccuucuggaca

SEQ ID NO: 901825 - RNA, 22 nt, Human
uggcagugggaagcuggaaguc

SEQ ID NO: 901826 - RNA, 22 nt, Human
gcagugauuuugcucagauaaa

SEQ ID NO: 901827 - RNA, 22 nt, Human
uagcacaguauuucucaacugg

SEQ ID NO: 901828 - RNA, 23 nt, Human
aggagccaugaguuggauauguu

SEQ ID NO: 901829 - RNA, 22 nt, Human
agagguauuagguaauucagua

SEQ ID NO: 901830 - RNA, 22 nt, Human
augaggccuuucuucacccuuu

SEQ ID NO: 901831 - RNA, 22 nt, Human
aaaggcuuagacacagaacugu

SEQ ID NO: 901832 - RNA, 22 nt, Human
aauaggaagcaccaaauucucc

SEQ ID NO: 901833 - RNA, 22 nt, Human
ugaaacauuaggaaaucauuau

SEQ ID NO: 901834 - RNA, 20 nt, Human
guuuccuauuuaccuccuca

SEQ ID NO: 901835 - RNA, 22 nt, Human
ugcacacagaugguacaugcau

SEQ ID NO: 901836 - RNA, 22 nt, Human
uuucuuuugcugagaggggcac

SEQ ID NO: 901837 - RNA, 22 nt, Human
uugggcuccuguugauccuguc

SEQ ID NO: 901838 - RNA, 22 nt, Human
uccagcuuugagauuuuaugga

SEQ ID NO: 901839 - RNA, 22 nt, Human
uuuuguuggcuuaagaaauaca

SEQ ID NO: 901840 - RNA, 22 nt, Human
acccagagucagacagccaugg

SEQ ID NO: 901841 - RNA, 22 nt, Human
ugcuggcauggucuuggugaca

SEQ ID NO: 901842 - RNA, 22 nt, Human
gcugcaggcucugcaggaauug

SEQ ID NO: 901843 - RNA, 22 nt, Human
ucacagaagagauauugacaga

SEQ ID NO: 901844 - RNA, 22 nt, Human
gaugccugcauuucaggagagu

SEQ ID NO: 901845 - RNA, 22 nt, Human
caggcauggaaaagcccagagg

SEQ ID NO: 901846 - RNA, 22 nt, Human
ccucagcugcuucccuggagcc

SEQ ID NO: 901847 - RNA, 22 nt, Human
ggggauggauuccgggucccug

SEQ ID NO: 901848 - RNA, 22 nt, Human
ugggggugacuaucucgggaau

SEQ ID NO: 901849 - RNA, 22 nt, Human
uuuguguguauauguauauaga

SEQ ID NO: 901850 - RNA, 22 nt, Human
uuuccugugacuaaucuggaca

SEQ ID NO: 901851 - RNA, 22 nt, Human
aaagguaguacuucuagaaggg

SEQ ID NO: 901852 - RNA, 22 nt, Human
aaacaaacaauuaguugugugg

SEQ ID NO: 901853 - RNA, 22 nt, Human
ucugccaucuuaauucucuuuu

SEQ ID NO: 901854 - RNA, 22 nt, Human
gcacagggcugccaggcggcuu

SEQ ID NO: 901855 - RNA, 22 nt, Human
guucuucauuacaagggaacca

SEQ ID NO: 901856 - RNA, 22 nt, Human
caucaaaguugguauauuugca

SEQ ID NO: 901857 - RNA, 22 nt, Human
agagccuggaccugagcuacaa

SEQ ID NO: 901858 - RNA, 22 nt, Human
cuucacagucuuuauuuccucc

SEQ ID NO: 901859 - RNA, 22 nt, Human
auuuuucucuuuccacugagau

SEQ ID NO: 901860 - RNA, 22 nt, Human
uauguacauguuaaagggcaaa

SEQ ID NO: 901861 - RNA, 20 nt, Human
aggcucagagcaguaguaca

SEQ ID NO: 901862 - RNA, 22 nt, Human
aaugucuucucuuguugaauuu

SEQ ID NO: 901863 - RNA, 22 nt, Human
acugaagcuuggguggaacuua

SEQ ID NO: 901864 - RNA, 22 nt, Human
uguguuuuggaaggaacaugca

SEQ ID NO: 901865 - RNA, 22 nt, Human
acugguuugucuauugucauuc

SEQ ID NO: 901866 - RNA, 20 nt, Human
caguuuacaacauaaauugu

SEQ ID NO: 901867 - RNA, 22 nt, Human
agcaagaaaaucucuguccaau

SEQ ID NO: 901868 - RNA, 22 nt, Human
auccuucaaggggcugacagcu

SEQ ID NO: 901869 - RNA, 22 nt, Human
ucucagcagccagauccagagc

SEQ ID NO: 901870 - RNA, 22 nt, Human
agcaggguuccaggaguugcag

SEQ ID NO: 901871 - RNA, 22 nt, Human
aaagaccugaaauauaaucuag

SEQ ID NO: 901872 - RNA, 22 nt, Human
ucugugcugagcucugagaugu

SEQ ID NO: 901873 - RNA, 22 nt, Human
uguguucaaucaccaaagguau

SEQ ID NO: 901874 - RNA, 22 nt, Human
guggcucuggcuuuccaggcgg

SEQ ID NO: 901875 - RNA, 22 nt, Human
caaacauugcacuuucugcuau

SEQ ID NO: 901876 - RNA, 22 nt, Human
gguccaucucuugagcccacau

SEQ ID NO: 901877 - RNA, 19 nt, Human
gcugcuggcucuggcugga

SEQ ID NO: 901878 - RNA, 22 nt, Human
aaguacaaucuuucuguaaagg

SEQ ID NO: 901879 - RNA, 22 nt, Human
cagaggccaguggacaagggcc

SEQ ID NO: 901880 - RNA, 22 nt, Human
auuuggaagcauuuccaaagca

SEQ ID NO: 901881 - RNA, 22 nt, Human
uuuacagaagagaaggaugcuu

SEQ ID NO: 901882 - RNA, 22 nt, Human
ggcaacauucuccagauccuuu

SEQ ID NO: 901883 - RNA, 22 nt, Human
cagugggauaugggggcagcau

SEQ ID NO: 901884 - RNA, 22 nt, Human
uggaggugagugugguacagca

SEQ ID NO: 901885 - RNA, 22 nt, Human
uuucaaacuuuacucuugaauc

SEQ ID NO: 901886 - RNA, 22 nt, Human
uuccauaauuaaguggagagaa

SEQ ID NO: 901887 - RNA, 22 nt, Human
gaauacaugauacaugaacugc

SEQ ID NO: 901888 - RNA, 22 nt, Human
uugcagauauuuccgaugcuau

SEQ ID NO: 901889 - RNA, 22 nt, Human
caguuacuguaugucaaagacu

SEQ ID NO: 901890 - RNA, 22 nt, Human
cugaggacauugaugaggcaau

SEQ ID NO: 901891 - RNA, 22 nt, Human
cuuagaagaaugccuaggacag

SEQ ID NO: 901892 - RNA, 23 nt, Human
aggagccaggugcagcccuugug

SEQ ID NO: 901893 - RNA, 22 nt, Human
aacaggcacuaagcaugugggg

SEQ ID NO: 901894 - RNA, 22 nt, Human
uggcagagccuugccaaacucc

SEQ ID NO: 901895 - RNA, 22 nt, Human
gaaguauuacucugaauguauu

SEQ ID NO: 901896 - RNA, 22 nt, Human
auaacagaguugggaagugaaa

SEQ ID NO: 901897 - RNA, 22 nt, Human
aguccugggucuggagaaugga

SEQ ID NO: 901898 - RNA, 22 nt, Human
cugcccugucugcagccuggcu

SEQ ID NO: 901899 - RNA, 22 nt, Human
gcugggcaaugccagagaggag

SEQ ID NO: 901900 - RNA, 22 nt, Human
cugcagcuccuucuggcaugug

SEQ ID NO: 901901 - RNA, 22 nt, Human
uucaggccucuaaagggaaagc

SEQ ID NO: 901902 - RNA, 22 nt, Human
cacagcuaggaggaaagcagag

SEQ ID NO: 901903 - RNA, 22 nt, Human
augcagggagguaagaggugcc

SEQ ID NO: 901904 - RNA, 20 nt, Human
ccacagaggacagggcugug

SEQ ID NO: 901905 - RNA, 22 nt, Human
gcugagagcacauagaaggggc

SEQ ID NO: 901906 - RNA, 22 nt, Human
cagcagcagagauacugguuuc

SEQ ID NO: 901907 - RNA, 22 nt, Human
auacaguaauugcauaggcuuc

SEQ ID NO: 901908 - RNA, 22 nt, Human
augcaaaauuaccauucuguuc

SEQ ID NO: 901909 - RNA, 22 nt, Human
agauaaaguccaaacuguguag

SEQ ID NO: 901910 - RNA, 22 nt, Human
agaagaaagauugaagguuccu

SEQ ID NO: 901911 - RNA, 22 nt, Human
aacugcaagaguaaaugucuag

SEQ ID NO: 901912 - RNA, 19 nt, Human
ugcuggagguugacagggu

SEQ ID NO: 901913 - RNA, 22 nt, Human
uggcuaacaaacaagacauuag

SEQ ID NO: 901914 - RNA, 22 nt, Human
uuaauuaaauucaugagcauug

SEQ ID NO: 901915 - RNA, 22 nt, Human
ugcuucugacuaagcugcauga

SEQ ID NO: 901916 - RNA, 22 nt, Human
cugccaaggcuggggaggacaa

SEQ ID NO: 901917 - RNA, 22 nt, Human
cugccauguuaccugcacaggu

SEQ ID NO: 901918 - RNA, 17 nt, Human
uagagcugguucaggag

SEQ ID NO: 901919 - RNA, 22 nt, Human
auauauaaccuggauaaggcuu

SEQ ID NO: 901920 - RNA, 22 nt, Human
cacauuucuaggaaauuaaaug

SEQ ID NO: 901921 - RNA, 22 nt, Human
ugcagcgguaguucucguggaa

SEQ ID NO: 901922 - RNA, 22 nt, Human
uuucuuaguccuagagugauuu

SEQ ID NO: 901923 - RNA, 22 nt, Human
uuucauucauuauacaguagag

SEQ ID NO: 901924 - RNA, 22 nt, Human
aaagcucuuacuguacuaguga

SEQ ID NO: 901925 - RNA, 22 nt, Human
uacaggguauucaaggguaguu

SEQ ID NO: 901926 - RNA, 22 nt, Human
cuuggucuugggagcagggaca

SEQ ID NO: 901927 - RNA, 22 nt, Human
ggggccaguaggagugauguac

SEQ ID NO: 901928 - RNA, 22 nt, Human
aaagcuguagaaucaucuuaau

SEQ ID NO: 901929 - RNA, 22 nt, Human
gcucaggcccagcggcuggugu

SEQ ID NO: 901930 - RNA, 22 nt, Human
caagcagguccugaaucugguc

SEQ ID NO: 901931 - RNA, 22 nt, Human
guguacauauugagucugcuga

SEQ ID NO: 901932 - RNA, 22 nt, Human
uccuggaucagcgggggcaggc

SEQ ID NO: 901933 - RNA, 22 nt, Human
aaagucuuuauuuuguaucuuu

SEQ ID NO: 901934 - RNA, 22 nt, Human
ccugcugugugacgggauguua

SEQ ID NO: 901935 - RNA, 22 nt, Human
gcauuuuaauaagauucauagg

SEQ ID NO: 901936 - RNA, 23 nt, Human
uggcugagcccacuaucuuggcc

SEQ ID NO: 901937 - RNA, 22 nt, Human
auguggccagucauguaguaac

SEQ ID NO: 901938 - RNA, 22 nt, Human
cagcucuggguaggaggaaucu

SEQ ID NO: 901939 - RNA, 22 nt, Human
ugacauuuuuguacaaagucag

SEQ ID NO: 901940 - RNA, 22 nt, Human
auagaagcaagaacagaaugga

SEQ ID NO: 901941 - RNA, 18 nt, Human
acacagguuauucucucc

SEQ ID NO: 901942 - RNA, 22 nt, Human
agcuaggggaccaagguggccc

SEQ ID NO: 901943 - RNA, 22 nt, Human
uggccccacagggccuuuucag

SEQ ID NO: 901944 - RNA, 20 nt, Human
cagagacccaggcuucagcu

SEQ ID NO: 901945 - RNA, 21 nt, Human
aaucaguguucucaggggcaa

SEQ ID NO: 901946 - RNA, 22 nt, Human
uagcaagaugaugaauuauuca

SEQ ID NO: 901947 - RNA, 22 nt, Human
uucauguccagaggaaguugag

SEQ ID NO: 901948 - RNA, 22 nt, Human
ugguauuucagcuuuuguaucu

SEQ ID NO: 901949 - RNA, 22 nt, Human
gucugaggccugaggcccuggg

SEQ ID NO: 901950 - RNA, 22 nt, Human
gugccugugccaggggugugcu

SEQ ID NO: 901951 - RNA, 19 nt, Human
gccugccuggguuucugag

SEQ ID NO: 901952 - RNA, 22 nt, Human
uuuguauaagaacauucuagca

SEQ ID NO: 901953 - RNA, 22 nt, Human
agauuggguuugcuucugugcc

SEQ ID NO: 901954 - RNA, 22 nt, Human
gcagggaugcugaggcucagug

SEQ ID NO: 901955 - RNA, 22 nt, Human
gauuacacguuuuuaaucacau

SEQ ID NO: 901956 - RNA, 22 nt, Human
ccucacaguuuggcuaacugug

SEQ ID NO: 901957 - RNA, 21 nt, Human
uggccagcugcucgucuccuc

SEQ ID NO: 901958 - RNA, 22 nt, Human
uuucuacuucuccugaaugucu

SEQ ID NO: 901959 - RNA, 22 nt, Human
gaggagaaagcagugauuugug

SEQ ID NO: 901960 - RNA, 20 nt, Human
gcuaggaaggggaaaaagug

SEQ ID NO: 901961 - RNA, 22 nt, Human
uggagggcaucuguggucaggc

SEQ ID NO: 901962 - RNA, 22 nt, Human
gcagccaggcuacagcgggcuu

SEQ ID NO: 901963 - RNA, 22 nt, Human
uaguacaguuccaucaaagcag

SEQ ID NO: 901964 - RNA, 22 nt, Human
cugaaacuccaugagaaauugc

SEQ ID NO: 901965 - RNA, 22 nt, Human
uuucuagaugcggggcuugugc

SEQ ID NO: 901966 - RNA, 22 nt, Human
ucccaaagucaagcugugucuu

SEQ ID NO: 901967 - RNA, 22 nt, Human
auguaacauugaauuauauagu

SEQ ID NO: 901968 - RNA, 22 nt, Human
uaaguaguccugauuuaaccuu

SEQ ID NO: 901969 - RNA, 22 nt, Human
ucagcacuuugaagcagaagga

SEQ ID NO: 901970 - RNA, 22 nt, Human
uucucaggguuugugcaggcuu

SEQ ID NO: 901971 - RNA, 22 nt, Human
ucugcugcagagcugcgggugc

SEQ ID NO: 901972 - RNA, 22 nt, Human
ggaacaguugcgucaugggccu

SEQ ID NO: 901973 - RNA, 22 nt, Human
caacacagguucugcaaaggaa

SEQ ID NO: 901974 - RNA, 22 nt, Human
gcccacaguuaguuugcauggc

SEQ ID NO: 901975 - RNA, 19 nt, Human
cagugcuguucauucagug

SEQ ID NO: 901976 - RNA, 22 nt, Human
aguaaaauuaauggaucagaag

SEQ ID NO: 901977 - RNA, 22 nt, Human
ucagugcuucggcgagcaccua

SEQ ID NO: 901978 - RNA, 22 nt, Human
guucuacuuucugugucuuuga

SEQ ID NO: 901979 - RNA, 21 nt, Human
gaaauacugccuuaggagcug

SEQ ID NO: 901980 - RNA, 22 nt, Human
auacaaaaauuagccgggagua

SEQ ID NO: 901981 - RNA, 22 nt, Human
ucaucuguuaugggaguuuuug

SEQ ID NO: 901982 - RNA, 22 nt, Human
cagcagcuuuugcauucucauu

SEQ ID NO: 901983 - RNA, 22 nt, Human
auggcagaaaggcaugugggcc

SEQ ID NO: 901984 - RNA, 22 nt, Human
gcuucaaagauucacaguuuca

SEQ ID NO: 901985 - RNA, 22 nt, Human
ggcauucaaagaaugguaauua

SEQ ID NO: 901986 - RNA, 17 nt, Human
ggaggcaacagacaggg

SEQ ID NO: 901987 - RNA, 22 nt, Human
ucugcagguagagcucaggaau

SEQ ID NO: 901988 - RNA, 22 nt, Human
aaagcuguuguauggcccuugg

SEQ ID NO: 901989 - RNA, 22 nt, Human
uuugaagaagcugaccuauuuu

SEQ ID NO: 901990 - RNA, 22 nt, Human
uuauagaaggagcauucacuua

SEQ ID NO: 901991 - RNA, 23 nt, Human
cugcuguguuggucucgauggga

SEQ ID NO: 901992 - RNA, 22 nt, Human
ggccuggaagaggacagagaaa

SEQ ID NO: 901993 - RNA, 22 nt, Human
ugcaaacuagcaucaacuagua

SEQ ID NO: 901994 - RNA, 23 nt, Human
cacaacuaaucagaaucucuagg

SEQ ID NO: 901995 - RNA, 22 nt, Human
uaggccacggaaagcagguugc

SEQ ID NO: 901996 - RNA, 22 nt, Human
ggucccaggcugcgggcuggug

SEQ ID NO: 901997 - RNA, 22 nt, Human
ccaggacaagccagagggacag

SEQ ID NO: 901998 - RNA, 19 nt, Human
gucagcaccauggacaggg

SEQ ID NO: 901999 - RNA, 22 nt, Human
agaaauaagagcuuuccuuggg

SEQ ID NO: 902000 - RNA, 22 nt, Human
gacacagaauuuacucccgaua

SEQ ID NO: 902001 - RNA, 22 nt, Human
uccaugguagguuucuuaaaga

SEQ ID NO: 902002 - RNA, 22 nt, Human
cagcccagaacucacgucucca

SEQ ID NO: 902003 - RNA, 22 nt, Human
gcagccaguauccucugagauu

SEQ ID NO: 902004 - RNA, 23 nt, Human
uuugaacauuucuagauuacaua

SEQ ID NO: 902005 - RNA, 22 nt, Human
ucagaguaacuacaguauagac

SEQ ID NO: 902006 - RNA, 22 nt, Human
aagagcugcacauauuuauauc

SEQ ID NO: 902007 - RNA, 22 nt, Human
aagcacaaugaacaucuuagau

SEQ ID NO: 902008 - RNA, 22 nt, Human
uagcagcuuccagagagggcag

SEQ ID NO: 902009 - RNA, 22 nt, Human
cagguccucugagaugggaggu

SEQ ID NO: 902010 - RNA, 22 nt, Human
ugaggcaguauuuuagugacuu

SEQ ID NO: 902011 - RNA, 19 nt, Human
aaaguugagaaacaaugga

SEQ ID NO: 902012 - RNA, 22 nt, Human
uguucucucuggcugccaguac

SEQ ID NO: 902013 - RNA, 22 nt, Human
aguucaaagcugcaguaaugga

SEQ ID NO: 902014 - RNA, 22 nt, Human
ucagccuggugauuccucuguc

SEQ ID NO: 902015 - RNA, 16 nt, Human
agaggccacagacaga

SEQ ID NO: 902016 - RNA, 22 nt, Human
aauucaaauuugaguuugugau

SEQ ID NO: 902017 - RNA, 22 nt, Human
ucuggaaaagcgauaaaccauu

SEQ ID NO: 902018 - RNA, 22 nt, Human
agccccuguccucucugaugac

SEQ ID NO: 902019 - RNA, 22 nt, Human
gugaaaauaaggcugguucuug

SEQ ID NO: 902020 - RNA, 22 nt, Human
agcugcugagccaggcugaugu

SEQ ID NO: 902021 - RNA, 22 nt, Human
guuuuuccugcugacuuggguc

SEQ ID NO: 902022 - RNA, 19 nt, Human
ugugucucuguguagccug

SEQ ID NO: 902023 - RNA, 22 nt, Human
uuucaucuauuugcuuugugaa

SEQ ID NO: 902024 - RNA, 20 nt, Human
cuuccacacaagaagcacag

SEQ ID NO: 902025 - RNA, 20 nt, Human
cuguccauauuugaaaaugc

SEQ ID NO: 902026 - RNA, 22 nt, Human
aaguccuuuaauaucacauagu

SEQ ID NO: 902027 - RNA, 22 nt, Human
gucuauuugggaucaugauaug

SEQ ID NO: 902028 - RNA, 23 nt, Human
uugcaaaaugagucuugagugaa

SEQ ID NO: 902029 - RNA, 22 nt, Human
uggcaaguggcauagaauagcc

SEQ ID NO: 902030 - RNA, 22 nt, Human
augaggcacaucacagccaaug

SEQ ID NO: 902031 - RNA, 22 nt, Human
uuuuguuuguguccacugcagu

SEQ ID NO: 902032 - RNA, 22 nt, Human
agcauaaguugguacagccacu

SEQ ID NO: 902033 - RNA, 22 nt, Human
agacacagauuuuggaaaagau

SEQ ID NO: 902034 - RNA, 22 nt, Human
gcuaggaagcuggggagaaguc

SEQ ID NO: 902035 - RNA, 22 nt, Human
cacaucauagagacucaaucca

SEQ ID NO: 902036 - RNA, 22 nt, Human
agcagcuucuauuuucuugguu

SEQ ID NO: 902037 - RNA, 22 nt, Human
ugaaagcugaggacaggagggu

SEQ ID NO: 902038 - RNA, 22 nt, Human
aaagcucucugaacaccagacc

SEQ ID NO: 902039 - RNA, 22 nt, Human
augcaaagcacacacagaaucc

SEQ ID NO: 902040 - RNA, 22 nt, Human
cauuagauuggugcaaaaauaa

SEQ ID NO: 902041 - RNA, 22 nt, Human
aaguuaguggauaaacagcaaa

SEQ ID NO: 902042 - RNA, 19 nt, Human
aucugagauuauaaacaga

SEQ ID NO: 902043 - RNA, 22 nt, Human
ccagaugucccucucagguuug

SEQ ID NO: 902044 - RNA, 22 nt, Human
agcuucauuccagccacuguga

SEQ ID NO: 902045 - RNA, 22 nt, Human
ggcugggccagggccuguggac

SEQ ID NO: 902046 - RNA, 22 nt, Human
uuauggaagugcaaauugugug

SEQ ID NO: 902047 - RNA, 22 nt, Human
gugugcccgggggaagcaggug

SEQ ID NO: 902048 - RNA, 22 nt, Human
ccuguguggaaggcaggaggcc

SEQ ID NO: 902049 - RNA, 22 nt, Human
uuuguaugggcagaaauuagau

SEQ ID NO: 902050 - RNA, 22 nt, Human
gcaaacauccacugcccuugua

SEQ ID NO: 902051 - RNA, 22 nt, Human
uuacacaacaucuguauuauua

SEQ ID NO: 902052 - RNA, 22 nt, Human
uggaagagaaaggaguggaucu

SEQ ID NO: 902053 - RNA, 22 nt, Human
cagcagguuaacagaggcuggu

SEQ ID NO: 902054 - RNA, 22 nt, Human
cuuuuucugauguuccaugauu

SEQ ID NO: 902055 - RNA, 22 nt, Human
aguggcugcuggaguggagaug

SEQ ID NO: 902056 - RNA, 22 nt, Human
guuccuaaccagcagagaaaca

SEQ ID NO: 902057 - RNA, 19 nt, Human
acauugaauuuucuucuuu

SEQ ID NO: 902058 - RNA, 22 nt, Human
ugcuaugcuuucccccaauguu

SEQ ID NO: 902059 - RNA, 22 nt, Human
agaagcugacagaugcagcagg

SEQ ID NO: 902060 - RNA, 22 nt, Human
uuuucaugugaugugacauuuc

SEQ ID NO: 902061 - RNA, 22 nt, Human
gaaaucaaggcuacauucaggu

SEQ ID NO: 902062 - RNA, 22 nt, Human
ccaagggcugcugaggugucca

SEQ ID NO: 902063 - RNA, 20 nt, Human
auguccuguugcugccccag

SEQ ID NO: 902064 - RNA, 22 nt, Human
aauaacuucaguucuuacauua

SEQ ID NO: 902065 - RNA, 22 nt, Human
aagcacacuuggcucuguguac

SEQ ID NO: 902066 - RNA, 22 nt, Human
cugccugugccaaugcuccuuu

SEQ ID NO: 902067 - RNA, 22 nt, Human
aucaacaugucauaaagugaaa

SEQ ID NO: 902068 - RNA, 22 nt, Human
aguaauaauagcuguaaagugc

SEQ ID NO: 902069 - RNA, 22 nt, Human
ucuuuggcuugucuccucaguu

SEQ ID NO: 902070 - RNA, 22 nt, Human
ugggaggaucucuugaggccag

SEQ ID NO: 902071 - RNA, 22 nt, Human
acaaagaaggaauuggucuuua

SEQ ID NO: 902072 - RNA, 22 nt, Human
ucauggaaacagcaaugcuaau

SEQ ID NO: 902073 - RNA, 21 nt, Human
caaguucagaagguugggcug

SEQ ID NO: 902074 - RNA, 22 nt, Human
gggggaagaaagaacauggcau

SEQ ID NO: 902075 - RNA, 22 nt, Human
cagugggaaugaaguggaggcc

SEQ ID NO: 902076 - RNA, 22 nt, Human
uaagcaguuuuucuuguauuaa

SEQ ID NO: 902077 - RNA, 22 nt, Human
gcauguuuugcaacaagugacc

SEQ ID NO: 902078 - RNA, 22 nt, Human
auguccuuuguaucccuaggca

SEQ ID NO: 902079 - RNA, 20 nt, Human
ucagagaagggacugagauu

SEQ ID NO: 902080 - RNA, 22 nt, Human
ucauugagcuguauggacacaa

SEQ ID NO: 902081 - RNA, 22 nt, Human
cauguugauuagagagcuuaga

SEQ ID NO: 902082 - RNA, 22 nt, Human
gcugugagggcuucugaggcau

SEQ ID NO: 902083 - RNA, 22 nt, Human
agaggcucuggugcagcaugca

SEQ ID NO: 902084 - RNA, 22 nt, Human
gccaggcaaauuaaggaaugca

SEQ ID NO: 902085 - RNA, 22 nt, Human
gcagcacauauaaacaaagaga

SEQ ID NO: 902086 - RNA, 22 nt, Human
aaggcuccgugacuggggcuga

SEQ ID NO: 902087 - RNA, 22 nt, Human
ggaggccaaggcagguggauca

SEQ ID NO: 902088 - RNA, 22 nt, Human
ggcacagcacaguggacccagg

SEQ ID NO: 902089 - RNA, 22 nt, Human
ccugccuucccagcuuggcuuu

SEQ ID NO: 902090 - RNA, 22 nt, Human
ugagggaggcccuuugagcaga

SEQ ID NO: 902091 - RNA, 22 nt, Human
gcaaguuggagacucaugagaa

SEQ ID NO: 902092 - RNA, 22 nt, Human
cagcauggcuugaguguuuccu

SEQ ID NO: 902093 - RNA, 22 nt, Human
ggcagaguggagugcggccucc

SEQ ID NO: 902094 - RNA, 22 nt, Human
ggagucaggagcaggcugggcu

SEQ ID NO: 902095 - RNA, 22 nt, Human
cuggccaggagguaaccagaug

SEQ ID NO: 902096 - RNA, 22 nt, Human
ugccugucuuggaguccuggcc

SEQ ID NO: 902097 - RNA, 22 nt, Human
caugcacagagcuuggucauug

SEQ ID NO: 902098 - RNA, 22 nt, Human
gggaaggacauucugggcucag

SEQ ID NO: 902099 - RNA, 22 nt, Human
aagcauagagacacaaauuugg

SEQ ID NO: 902100 - RNA, 21 nt, Human
agcuggaaucuggcugugcuu

SEQ ID NO: 902101 - RNA, 22 nt, Human
cucagggacuuggauccuggcc

SEQ ID NO: 902102 - RNA, 22 nt, Human
augccuuuggagaauccaacau

SEQ ID NO: 902103 - RNA, 22 nt, Human
caucugcugcuacaaaaagcuu

SEQ ID NO: 902104 - RNA, 22 nt, Human
agagaugacugauggcugauua

SEQ ID NO: 902105 - RNA, 21 nt, Human
aggcugcaugcaugagugugg

SEQ ID NO: 902106 - RNA, 22 nt, Human
gggaggcucagugguguccucu

SEQ ID NO: 902107 - RNA, 22 nt, Human
auguacacacacaucuuugcgu

SEQ ID NO: 902108 - RNA, 22 nt, Human
augaaaacggaccagagcuauu

SEQ ID NO: 902109 - RNA, 22 nt, Human
cucagcccuccccggggaauaa

SEQ ID NO: 902110 - RNA, 22 nt, Human
cagagcuggagggaacccuggc

SEQ ID NO: 902111 - RNA, 22 nt, Human
ugcagcaggugacaacgagugg

SEQ ID NO: 902112 - RNA, 20 nt, Human
cuguggcaucugucauggug

SEQ ID NO: 902113 - RNA, 22 nt, Human
cauggguaagacucuuuugccc

SEQ ID NO: 902114 - RNA, 22 nt, Human
uucuuucuguccauaaugagac

SEQ ID NO: 902115 - RNA, 22 nt, Human
uucucacacuuuccacugaggu

SEQ ID NO: 902116 - RNA, 22 nt, Human
gcagguggaagcagcagacuca

SEQ ID NO: 902117 - RNA, 22 nt, Human
uuauuucuugucuauguagcca

SEQ ID NO: 902118 - RNA, 22 nt, Human
uaaaaggauuagcaggaugggc

SEQ ID NO: 902119 - RNA, 22 nt, Human
gaaugagacuaugcgaguguga

SEQ ID NO: 902120 - RNA, 22 nt, Human
ucucugggguagggcccaggac

SEQ ID NO: 902121 - RNA, 22 nt, Human
caagaaucuugcagcuuagacu

SEQ ID NO: 902122 - RNA, 22 nt, Human
uuugggaaauaaaccuagagga

SEQ ID NO: 902123 - RNA, 22 nt, Human
auguagaagugggcauuauaga

SEQ ID NO: 902124 - RNA, 22 nt, Human
guccugggcccaggggcugccu

SEQ ID NO: 902125 - RNA, 22 nt, Human
aaaugcucucuaauguaauaca

SEQ ID NO: 902126 - RNA, 22 nt, Human
uucucuuucugcugggcuggaa

SEQ ID NO: 902127 - RNA, 22 nt, Human
ugcccuguggggauuuccagcc

SEQ ID NO: 902128 - RNA, 22 nt, Human
aaggcuguuguuucacaacaaa

SEQ ID NO: 902129 - RNA, 22 nt, Human
uacacauuacauaauacuaucu

SEQ ID NO: 902130 - RNA, 23 nt, Human
ugggcagcuucugcaugcccacc

SEQ ID NO: 902131 - RNA, 22 nt, Human
uuccaggagccacacaggggcg

SEQ ID NO: 902132 - RNA, 22 nt, Human
aggaaggggagaaguuaaagcu

SEQ ID NO: 902133 - RNA, 22 nt, Human
ccaggugucaugcgugugaccc

SEQ ID NO: 902134 - RNA, 19 nt, Human
uuggcagcugagauccugc

SEQ ID NO: 902135 - RNA, 22 nt, Human
caggaaggaaaggguguggaga

SEQ ID NO: 902136 - RNA, 22 nt, Human
gaucaggacauagcuauaggcu

SEQ ID NO: 902137 - RNA, 22 nt, Human
ggccaggcugcccugggagcag

SEQ ID NO: 902138 - RNA, 22 nt, Human
uaaacauguugacaucuuaccu

SEQ ID NO: 902139 - RNA, 22 nt, Human
acauuguuugagaauacagaug

SEQ ID NO: 902140 - RNA, 22 nt, Human
gcagcagcugacagugggugcc

SEQ ID NO: 902141 - RNA, 22 nt, Human
acuuuaugauacagggaagggu

SEQ ID NO: 902142 - RNA, 22 nt, Human
uccacuuuucuuccaucaucau

SEQ ID NO: 902143 - RNA, 22 nt, Human
ucacauguguuuucucaccaac

SEQ ID NO: 902144 - RNA, 22 nt, Human
uggcugugaacaaagagaauaa

SEQ ID NO: 902145 - RNA, 22 nt, Human
ucagggcccuggcaggaaacag

SEQ ID NO: 902146 - RNA, 22 nt, Human
aaugcaagaucaaaucuaacac

SEQ ID NO: 902147 - RNA, 22 nt, Human
ccucuggccaucccccauuaag

SEQ ID NO: 902148 - RNA, 19 nt, Human
gcccucaugauauucagau

SEQ ID NO: 902149 - RNA, 22 nt, Human
guucuuuugguagagugugcau

SEQ ID NO: 902150 - RNA, 22 nt, Human
agaaauguggaucguuuuaaaa

SEQ ID NO: 902151 - RNA, 22 nt, Human
aaaugucuuucuucugcuacgu

SEQ ID NO: 902152 - RNA, 22 nt, Human
ugucucugugagaucugacgau

SEQ ID NO: 902153 - RNA, 22 nt, Human
cccaagggaugcuugaguaguu

SEQ ID NO: 902154 - RNA, 23 nt, Human
ccaggcaguagcuauugaaguga

SEQ ID NO: 902155 - RNA, 22 nt, Human
ugcugcauagcagcuccugaaa

SEQ ID NO: 902156 - RNA, 22 nt, Human
ugaagacacauacaagggaaug

SEQ ID NO: 902157 - RNA, 22 nt, Human
uuggaauugaggauuuacauag

SEQ ID NO: 902158 - RNA, 22 nt, Human
uuccugugcuuauucuucucug

SEQ ID NO: 902159 - RNA, 22 nt, Human
acagucuuaugcauacacuauu

SEQ ID NO: 902160 - RNA, 19 nt, Human
guauauuuauauggcugua

SEQ ID NO: 902161 - RNA, 22 nt, Human
caggacaucgucaucaugggga

SEQ ID NO: 902162 - RNA, 22 nt, Human
accuggagucauuugaggagua

SEQ ID NO: 902163 - RNA, 17 nt, Human
ugggugguagggagagg

SEQ ID NO: 902164 - RNA, 22 nt, Human
uugauguucauaaaugauacag

SEQ ID NO: 902165 - RNA, 22 nt, Human
gaggcagcucuucugaaugggg

SEQ ID NO: 902166 - RNA, 22 nt, Human
uuugguauugcacacugucuuc

SEQ ID NO: 902167 - RNA, 22 nt, Human
aguauuuguugaaugagugaau

SEQ ID NO: 902168 - RNA, 22 nt, Human
uggcccaggggcucuugguguu

SEQ ID NO: 902169 - RNA, 22 nt, Human
gcaaugucugugcuaaaaacug

SEQ ID NO: 902170 - RNA, 23 nt, Human
ccuggcuggauucucugcauuca

SEQ ID NO: 902171 - RNA, 22 nt, Human
agaaggccuaacuugggggcaa

SEQ ID NO: 902172 - RNA, 22 nt, Human
gagaaguuagcucuguuuaggu

SEQ ID NO: 902173 - RNA, 22 nt, Human
ugaaauagucaaguauuugaac

SEQ ID NO: 902174 - RNA, 22 nt, Human
cauggcugggagacggcugagg

SEQ ID NO: 902175 - RNA, 22 nt, Human
ugugucagaaggcaauggggau

SEQ ID NO: 902176 - RNA, 22 nt, Human
ugcugagguuucugacuaugga

SEQ ID NO: 902177 - RNA, 22 nt, Human
uuacaacagacacauauucuaa

SEQ ID NO: 902178 - RNA, 22 nt, Human
uauuauuauaguuauugggaag

SEQ ID NO: 902179 - RNA, 22 nt, Human
gaaacauuuguugaguacuugc

SEQ ID NO: 902180 - RNA, 22 nt, Human
uaaaguuuauuggcaccaccau

SEQ ID NO: 902181 - RNA, 18 nt, Human
cagcaucuucauuaggcc

SEQ ID NO: 902182 - RNA, 22 nt, Human
ugcuggaaccaggaauuugaag

SEQ ID NO: 902183 - RNA, 22 nt, Human
guuccuaaaucuggaggaccuc

SEQ ID NO: 902184 - RNA, 22 nt, Human
uuccucagcuguguccuggcga

SEQ ID NO: 902185 - RNA, 22 nt, Human
uuucucucuuaaggaguuuaaa

SEQ ID NO: 902186 - RNA, 21 nt, Human
ugugaaauagcuaugcuacau

SEQ ID NO: 902187 - RNA, 22 nt, Human
ucuuagcauuucauaacaacug

SEQ ID NO: 902188 - RNA, 22 nt, Human
uuccuuggccacacuggugcuu

SEQ ID NO: 902189 - RNA, 22 nt, Human
uggcucugugaacagacgacug

SEQ ID NO: 902190 - RNA, 19 nt, Human
guucuuuucaccucugugc

SEQ ID NO: 902191 - RNA, 22 nt, Human
uugcaaauauuguuuaccuuuc

SEQ ID NO: 902192 - RNA, 22 nt, Human
aaguuugagaagcuuauagaua

SEQ ID NO: 902193 - RNA, 22 nt, Human
aacaggaauugaugggaguccu

SEQ ID NO: 902194 - RNA, 22 nt, Human
uagcauuucuggccucuacuca

SEQ ID NO: 902195 - RNA, 22 nt, Human
gguggcauacaacauagaggcu

SEQ ID NO: 902196 - RNA, 22 nt, Human
ucucuaaccuaauguggaggga

SEQ ID NO: 902197 - RNA, 22 nt, Human
ugcaggugugguuccucagcca

SEQ ID NO: 902198 - RNA, 22 nt, Human
gcagcuggagcaucuucucauc

SEQ ID NO: 902199 - RNA, 22 nt, Human
cuguagaacgauccaggcauuu

SEQ ID NO: 902200 - RNA, 22 nt, Human
auauugcagggacagucuggau

SEQ ID NO: 902201 - RNA, 22 nt, Human
aagcugugaaaucucuagugca

SEQ ID NO: 902202 - RNA, 22 nt, Human
caaaggacccauaauuaaaacc

SEQ ID NO: 902203 - RNA, 15 nt, Human
gaguggcuggugaaa

SEQ ID NO: 902204 - RNA, 21 nt, Human
ccugugcuaucagcuuggguu

SEQ ID NO: 902205 - RNA, 22 nt, Human
agcacagaaugagguggaagug

SEQ ID NO: 902206 - RNA, 22 nt, Human
agcuguuccaggccucauugcu

SEQ ID NO: 902207 - RNA, 22 nt, Human
uuugcugugggauauccaugug

SEQ ID NO: 902208 - RNA, 22 nt, Human
uggcagcaugucccggccucag

SEQ ID NO: 902209 - RNA, 22 nt, Human
cagcugcaggcugugcaggaag

SEQ ID NO: 902210 - RNA, 22 nt, Human
agaggugggagccuggucacau

SEQ ID NO: 902211 - RNA, 22 nt, Human
uccuuccuggggucucugcugc

SEQ ID NO: 902212 - RNA, 22 nt, Human
acugugugccaggcgcuggucu

SEQ ID NO: 902213 - RNA, 22 nt, Human
aggcaagcauugggaacagggc

SEQ ID NO: 902214 - RNA, 20 nt, Human
acaugaaaggaaacaggaaa

SEQ ID NO: 902215 - RNA, 22 nt, Human
cuuagaaauaaugguuucaguu

SEQ ID NO: 902216 - RNA, 22 nt, Human
cugucaccucugcccuuugccc

SEQ ID NO: 902217 - RNA, 22 nt, Human
uacaaaguuugagaaugcuuuc

SEQ ID NO: 902218 - RNA, 22 nt, Human
uuucaaguucccaguuuugugg

SEQ ID NO: 902219 - RNA, 22 nt, Human
ugccauuuagugcaucauuagu

SEQ ID NO: 902220 - RNA, 22 nt, Human
ucugucauaagugcugaaguau

SEQ ID NO: 902221 - RNA, 22 nt, Human
agccuaggguucugaugucacu

SEQ ID NO: 902222 - RNA, 22 nt, Human
acaaguuuuggaagucuuaagg

SEQ ID NO: 902223 - RNA, 22 nt, Human
uuuuucaugagacuagaaguca

SEQ ID NO: 902224 - RNA, 22 nt, Human
ccagguggugaaagugggcccu

SEQ ID NO: 902225 - RNA, 22 nt, Human
gaaugacauugagccauaacau

SEQ ID NO: 902226 - RNA, 22 nt, Human
ugguauggcuaacgaggucaag

SEQ ID NO: 902227 - RNA, 22 nt, Human
cccauuuguccaaaguauaaaa

SEQ ID NO: 902228 - RNA, 22 nt, Human
agggcugcuauguugauucaga

SEQ ID NO: 902229 - RNA, 22 nt, Human
gggaagugaggagccccucugc

SEQ ID NO: 902230 - RNA, 22 nt, Human
augcauauuggauuagcagcca

SEQ ID NO: 902231 - RNA, 22 nt, Human
ugcuggggucucuccggugccc

SEQ ID NO: 902232 - RNA, 22 nt, Human
ccaggcucuguuccccgaggag

SEQ ID NO: 902233 - RNA, 22 nt, Human
uucuugaguaucugcacagugc

SEQ ID NO: 902234 - RNA, 21 nt, Human
ggcuuuaugcucacccagccu

SEQ ID NO: 902235 - RNA, 22 nt, Human
aaguuuuaugggaagaugugca

SEQ ID NO: 902236 - RNA, 20 nt, Human
ucagguagaucuuugagguc

SEQ ID NO: 902237 - RNA, 22 nt, Human
auugagaauaugauuuaguaua

SEQ ID NO: 902238 - RNA, 22 nt, Human
ugcuccagccuaugcucuccgg

SEQ ID NO: 902239 - RNA, 22 nt, Human
uaagugagcuagcagaagugac

SEQ ID NO: 902240 - RNA, 22 nt, Human
gcuggagaccucagagaaccca

SEQ ID NO: 902241 - RNA, 22 nt, Human
agugaaauccuggucaacaggu

SEQ ID NO: 902242 - RNA, 22 nt, Human
aggcauggauguagcagugacc

SEQ ID NO: 902243 - RNA, 22 nt, Human
acuuuaaaacugaucaucagag

SEQ ID NO: 902244 - RNA, 22 nt, Human
uaaauuagggacuuuaguuaau

SEQ ID NO: 902245 - RNA, 22 nt, Human
cuaaacaagauacuaaugaggu

SEQ ID NO: 902246 - RNA, 22 nt, Human
ucugggagagcugcugucagag

SEQ ID NO: 902247 - RNA, 19 nt, Human
gaggggaggaauugacaag

SEQ ID NO: 902248 - RNA, 22 nt, Human
uuuagaaugugacuguauuuga

SEQ ID NO: 902249 - RNA, 22 nt, Human
agcauggggcuccgcaaugaac

SEQ ID NO: 902250 - RNA, 23 nt, Human
augugcacaucuccuuguccacc

SEQ ID NO: 902251 - RNA, 22 nt, Human
uuauuauguggaugaaagaugu

SEQ ID NO: 902252 - RNA, 21 nt, Human
ugacagguauuuaucuggaaa

SEQ ID NO: 902253 - RNA, 21 nt, Human
uuugaaagcccuauguuuuca

SEQ ID NO: 902254 - RNA, 22 nt, Human
ugucugugugagcaaaugacuu

SEQ ID NO: 902255 - RNA, 22 nt, Human
aaguuugugguuauacuugauu

SEQ ID NO: 902256 - RNA, 22 nt, Human
acugggaagacaagaaagauag

SEQ ID NO: 902257 - RNA, 22 nt, Human
ccauuacugaaauaaagagaau

SEQ ID NO: 902258 - RNA, 22 nt, Human
agcacacaggccaccuccacuu

SEQ ID NO: 902259 - RNA, 22 nt, Human
aucucuuugauggcuccuguga

SEQ ID NO: 902260 - RNA, 22 nt, Human
accuugaacacaagaauuauug

SEQ ID NO: 902261 - RNA, 22 nt, Human
uagauuuuaggagauuuuacug

SEQ ID NO: 902262 - RNA, 22 nt, Human
uucuccaggcuugggccagguc

SEQ ID NO: 902263 - RNA, 22 nt, Human
cccaggcuggagugcaauggca

SEQ ID NO: 902264 - RNA, 22 nt, Human
ucagaagagcuggugcugccug

SEQ ID NO: 902265 - RNA, 22 nt, Human
caaagugcuggaauuacaggug

SEQ ID NO: 902266 - RNA, 22 nt, Human
cagccucugacaccacagucgu

SEQ ID NO: 902267 - RNA, 22 nt, Human
uauuucucucacgguugccugg

SEQ ID NO: 902268 - RNA, 22 nt, Human
aguggcagguguuucguggugc

SEQ ID NO: 902269 - RNA, 22 nt, Human
caaaggcuuccacugcauccuu

SEQ ID NO: 902270 - RNA, 22 nt, Human
ucucugugagaugccuuccuga

SEQ ID NO: 902271 - RNA, 22 nt, Human
ugguccuggggugcaggcugac

SEQ ID NO: 902272 - RNA, 22 nt, Human
cagccagagaggaaggaaugca

SEQ ID NO: 902273 - RNA, 22 nt, Human
ccagcagcgauagggugagugc

SEQ ID NO: 902274 - RNA, 22 nt, Human
aaagcuuuuguuuucguaacug

SEQ ID NO: 902275 - RNA, 22 nt, Human
guccuugaggaaacagauguga

SEQ ID NO: 902276 - RNA, 22 nt, Human
gagcuacugaaauauugauuuu

SEQ ID NO: 902277 - RNA, 22 nt, Human
uaaguaaaacauucaagaaguc

SEQ ID NO: 902278 - RNA, 22 nt, Human
uuucaucugugcugccaagacu

SEQ ID NO: 902279 - RNA, 22 nt, Human
cauuggcuccugugggacauga

SEQ ID NO: 902280 - RNA, 22 nt, Human
auuucucaguaaucucagcaau

SEQ ID NO: 902281 - RNA, 23 nt, Human
aaaguugauuugcaguuuaagag

SEQ ID NO: 902282 - RNA, 22 nt, Human
ugcaucuguucagagcugucga

SEQ ID NO: 902283 - RNA, 22 nt, Human
gagcugccaagauuacaaucag

SEQ ID NO: 902284 - RNA, 22 nt, Human
aagggacuuugucagcuuucca

SEQ ID NO: 902285 - RNA, 21 nt, Human
aacuacaguuguuccuucauu

SEQ ID NO: 902286 - RNA, 22 nt, Human
ggugugggggcaaguuugagau

SEQ ID NO: 902287 - RNA, 22 nt, Human
auguucauuuuauggcgaugcc

SEQ ID NO: 902288 - RNA, 22 nt, Human
agaaguuuuguugaauguguga

SEQ ID NO: 902289 - RNA, 22 nt, Human
aaacaucuucucuugauucuuu

SEQ ID NO: 902290 - RNA, 22 nt, Human
auuucauauguaucaccuagcc

SEQ ID NO: 902291 - RNA, 21 nt, Human
acauuacagggugaugugucu

SEQ ID NO: 902292 - RNA, 22 nt, Human
cagcuguguaaacacaugugua

SEQ ID NO: 902293 - RNA, 22 nt, Human
acaaaccagcuuaagcaagaug

SEQ ID NO: 902294 - RNA, 22 nt, Human
uuucauggcuaggacuagagug

SEQ ID NO: 902295 - RNA, 22 nt, Human
augguuuaagggagaauauuga

SEQ ID NO: 902296 - RNA, 22 nt, Human
ucauuauucucuuuaauguucu

SEQ ID NO: 902297 - RNA, 22 nt, Human
ucuguggcuugggccugccugu

SEQ ID NO: 902298 - RNA, 22 nt, Human
ucuguucuauuggucuaugugu

SEQ ID NO: 902299 - RNA, 22 nt, Human
uggaaugcagugggagcuuacc

SEQ ID NO: 902300 - RNA, 22 nt, Human
aggaaagggguagguguggacg

SEQ ID NO: 902301 - RNA, 22 nt, Human
ugagccugaguucaaggcugca

SEQ ID NO: 902302 - RNA, 22 nt, Human
gaauacaugaacccuccugugg

SEQ ID NO: 902303 - RNA, 22 nt, Human
ucagcugcuucauguucugaau

SEQ ID NO: 902304 - RNA, 22 nt, Human
gggggaugcucaggaggcugcu

SEQ ID NO: 902305 - RNA, 22 nt, Human
uauugcauauuauucuaguggc

SEQ ID NO: 902306 - RNA, 22 nt, Human
uagaggugacacugagaccaua

SEQ ID NO: 902307 - RNA, 22 nt, Human
uucaagaugucuucacaauagu

SEQ ID NO: 902308 - RNA, 22 nt, Human
cauagaacagcuccuagcacau

SEQ ID NO: 902309 - RNA, 22 nt, Human
uggcuggcuuguucacugacug

SEQ ID NO: 902310 - RNA, 22 nt, Human
uuccuuggauacaaguaacuuu

SEQ ID NO: 902311 - RNA, 22 nt, Human
agcaaacaguuucuggggaucu

SEQ ID NO: 902312 - RNA, 22 nt, Human
uugaauuagacuuugcuacagg

SEQ ID NO: 902313 - RNA, 22 nt, Human
aagaacuuugauuucauugcau

SEQ ID NO: 902314 - RNA, 22 nt, Human
ccagcagagggcgcuucacacc

SEQ ID NO: 902315 - RNA, 22 nt, Human
auaacagaugcuucagcauaaa

SEQ ID NO: 902316 - RNA, 22 nt, Human
augaaugauuaaagaguacagu

SEQ ID NO: 902317 - RNA, 21 nt, Human
ucagcagcuuuugcagucccu

SEQ ID NO: 902318 - RNA, 22 nt, Human
aggcaagugcauuagaagagca

SEQ ID NO: 902319 - RNA, 22 nt, Human
ccucugcaaagaauuugucucc

SEQ ID NO: 902320 - RNA, 22 nt, Human
aagcagcauuguaaccaaugcc

SEQ ID NO: 902321 - RNA, 19 nt, Human
ccucucccaugcuuaccuc

SEQ ID NO: 902322 - RNA, 22 nt, Human
gugggcagaggagagaacauua

SEQ ID NO: 902323 - RNA, 22 nt, Human
auguauguuagacaagccuaca

SEQ ID NO: 902324 - RNA, 22 nt, Human
agcccagcuuccuucugucucu

SEQ ID NO: 902325 - RNA, 23 nt, Human
aggaggccugaaacugaggcuga

SEQ ID NO: 902326 - RNA, 19 nt, Human
uucacauuggaagaaguag

SEQ ID NO: 902327 - RNA, 22 nt, Human
aauuuauauguaauuaggcaca

SEQ ID NO: 902328 - RNA, 22 nt, Human
aaagguuuauuuguugcucaca

SEQ ID NO: 902329 - RNA, 22 nt, Human
ggaugcaggacggcauggaugu

SEQ ID NO: 902330 - RNA, 22 nt, Human
aguccaaagcagaugagggcca

SEQ ID NO: 902331 - RNA, 23 nt, Human
ugacagaccuucccagacaguca

SEQ ID NO: 902332 - RNA, 22 nt, Human
ucugccaggccugcuuccgggg

SEQ ID NO: 902333 - RNA, 22 nt, Human
uguacuauuaagaggccuaaau

SEQ ID NO: 902334 - RNA, 22 nt, Human
uccagggccuuaccucuucaga

SEQ ID NO: 902335 - RNA, 22 nt, Human
aggcacugaagaacucuuuuug

SEQ ID NO: 902336 - RNA, 22 nt, Human
gugagagcucagcugcccuggg

SEQ ID NO: 902337 - RNA, 22 nt, Human
uacagcuguugguguuuccucu

SEQ ID NO: 902338 - RNA, 22 nt, Human
augaggcaaucaugguccaguu

SEQ ID NO: 902339 - RNA, 22 nt, Human
cugcucuagguauugaggcuaa

SEQ ID NO: 902340 - RNA, 20 nt, Human
uagcauuccagaaaacucag

SEQ ID NO: 902341 - RNA, 22 nt, Human
agagaucugucuacuauuuaag

SEQ ID NO: 902342 - RNA, 17 nt, Human
ucugucuugacugucac

SEQ ID NO: 902343 - RNA, 18 nt, Human
aagcugcccucaggcagg

SEQ ID NO: 902344 - RNA, 22 nt, Human
gcuucugugguugucacgacua

SEQ ID NO: 902345 - RNA, 22 nt, Human
acagaaagauaggcacaagguc

SEQ ID NO: 902346 - RNA, 22 nt, Human
uuuccuuucuagaagccuaaau

SEQ ID NO: 902347 - RNA, 22 nt, Human
aguagucagcagauaauauagg

SEQ ID NO: 902348 - RNA, 22 nt, Human
cugccuggggaaugugaggauu

SEQ ID NO: 902349 - RNA, 22 nt, Human
gccagccaagauugagaaggua

SEQ ID NO: 902350 - RNA, 22 nt, Human
gggcuccagaggcucacccugg

SEQ ID NO: 902351 - RNA, 18 nt, Human
gaggccugagaaccaggu

SEQ ID NO: 902352 - RNA, 22 nt, Human
ggcuuggcugucucccagccca

SEQ ID NO: 902353 - RNA, 22 nt, Human
aggcucuuugagacuaccugga

SEQ ID NO: 902354 - RNA, 22 nt, Human
ccagagagagaggucaauggca

SEQ ID NO: 902355 - RNA, 22 nt, Human
aacaaguuagauuuugugucuu

SEQ ID NO: 902356 - RNA, 22 nt, Human
augucaccaguuuccaaauuug

SEQ ID NO: 902357 - RNA, 22 nt, Human
cuccagccagagugccucuguu

SEQ ID NO: 902358 - RNA, 22 nt, Human
gggagacuagugcuauguuuuc

SEQ ID NO: 902359 - RNA, 22 nt, Human
aaaugcaauucaggaagacaag

SEQ ID NO: 902360 - RNA, 22 nt, Human
augugucuugagggggauggag

SEQ ID NO: 902361 - RNA, 22 nt, Human
ugggucacucuauccugcuuag

SEQ ID NO: 902362 - RNA, 22 nt, Human
uuccaauauuuacaaugcauua

SEQ ID NO: 902363 - RNA, 22 nt, Human
ggccucugguucguggugaccu

SEQ ID NO: 902364 - RNA, 22 nt, Human
uucagaaugugaccuuauuugg

SEQ ID NO: 902365 - RNA, 22 nt, Human
ucaggaagccgguuaaauagau

SEQ ID NO: 902366 - RNA, 22 nt, Human
acagaugguuauugucauuucu

SEQ ID NO: 902367 - RNA, 22 nt, Human
auucuuacaaagcagagucugu

SEQ ID NO: 902368 - RNA, 22 nt, Human
auauagucaaacauauaugugu

SEQ ID NO: 902369 - RNA, 22 nt, Human
cugcugagcauuugcagggaca

SEQ ID NO: 902370 - RNA, 22 nt, Human
ucagugcaaaaaaugggcuaga

SEQ ID NO: 902371 - RNA, 22 nt, Human
acucuucaugcuaugcucaacu

SEQ ID NO: 902372 - RNA, 22 nt, Human
uggcaauguaggcaagaacauu

SEQ ID NO: 902373 - RNA, 19 nt, Human
cucucuccaguggcuggcu

SEQ ID NO: 902374 - RNA, 22 nt, Human
agcuggguguguaucagauaaa

SEQ ID NO: 902375 - RNA, 22 nt, Human
cauugucacccaaagcucauag

SEQ ID NO: 902376 - RNA, 22 nt, Human
aaagacaucagaaccagcugag

SEQ ID NO: 902377 - RNA, 22 nt, Human
uuaggcaaugaauuauuccaag

SEQ ID NO: 902378 - RNA, 22 nt, Human
ggaggggauuuaguagaugcua

SEQ ID NO: 902379 - RNA, 22 nt, Human
ccuggaggcagaaauaggacuu

SEQ ID NO: 902380 - RNA, 22 nt, Human
uucuccucuguuggccuucccu

SEQ ID NO: 902381 - RNA, 22 nt, Human
gugaaggccguccuuggggacu

SEQ ID NO: 902382 - RNA, 22 nt, Human
ugucaacagaucucaaagcugg

SEQ ID NO: 902383 - RNA, 22 nt, Human
gugcacacaagcaaugcacuua

SEQ ID NO: 902384 - RNA, 22 nt, Human
agcucuuacauuuaggucuaug

SEQ ID NO: 902385 - RNA, 22 nt, Human
aaacucaaauuaaacuagcuua

SEQ ID NO: 902386 - RNA, 22 nt, Human
ucaacaaauacuuaaagcagag

SEQ ID NO: 902387 - RNA, 22 nt, Human
ggugggaaggccacugaagguu

SEQ ID NO: 902388 - RNA, 22 nt, Human
cuugagaaucuugaugucuacc

SEQ ID NO: 902389 - RNA, 22 nt, Human
uccaggagauucauuaggucau

SEQ ID NO: 902390 - RNA, 22 nt, Human
agacaaagacagcaucucaggu

SEQ ID NO: 902391 - RNA, 22 nt, Human
caggagccccaggcugacaaua

SEQ ID NO: 902392 - RNA, 22 nt, Human
uuggaaggggcagaguggcugc

SEQ ID NO: 902393 - RNA, 22 nt, Human
aguggcugccaagagcaaugcu

SEQ ID NO: 902394 - RNA, 23 nt, Human
agggagcuaaaaggcuggagcag

SEQ ID NO: 902395 - RNA, 22 nt, Human
gagcugcacgcagcauccaaga

SEQ ID NO: 902396 - RNA, 22 nt, Human
gagccaggaggcagagacugca

SEQ ID NO: 902397 - RNA, 22 nt, Human
ucaaggaagggauauucuugaa

SEQ ID NO: 902398 - RNA, 22 nt, Human
ugugucucuuuguccuagagcu

SEQ ID NO: 902399 - RNA, 22 nt, Human
cuuuacaaagcaauuuugucuc

SEQ ID NO: 902400 - RNA, 22 nt, Human
cagagauggggccagcugcucc

SEQ ID NO: 902401 - RNA, 22 nt, Human
ugagcugugauuaacucugaga

SEQ ID NO: 902402 - RNA, 22 nt, Human
agcuuauuaucuuaucaagcuu

SEQ ID NO: 902403 - RNA, 17 nt, Human
ggauagugcugggcugg

SEQ ID NO: 902404 - RNA, 22 nt, Human
augaaaaguucgaucuagaagg

SEQ ID NO: 902405 - RNA, 22 nt, Human
aagggcugaaagaccuugggca

SEQ ID NO: 902406 - RNA, 22 nt, Human
cacugcuucagucagagaaauu

SEQ ID NO: 902407 - RNA, 22 nt, Human
ggccagcugagcugcugcacag

SEQ ID NO: 902408 - RNA, 22 nt, Human
ccucucuccaagggaaauccua

SEQ ID NO: 902409 - RNA, 22 nt, Human
ccugugguuuacaugacaguua

SEQ ID NO: 902410 - RNA, 22 nt, Human
ucuguuuuguaccagauacagc

SEQ ID NO: 902411 - RNA, 22 nt, Human
aggcucugugcauccuccccaa

SEQ ID NO: 902412 - RNA, 22 nt, Human
uucugauaccuugcaggauccu

SEQ ID NO: 902413 - RNA, 22 nt, Human
gcagcugcaagcacuucuggca

SEQ ID NO: 902414 - RNA, 22 nt, Human
ucuguuauucugucuauugcca

SEQ ID NO: 902415 - RNA, 22 nt, Human
aagacauuagaaucagccuguu

SEQ ID NO: 902416 - RNA, 22 nt, Human
gacaaagcgccugcucgcgggc

SEQ ID NO: 902417 - RNA, 22 nt, Human
auuuacagaagcauguaauagc

SEQ ID NO: 902418 - RNA, 22 nt, Human
caguuucuuaagacugagaucu

SEQ ID NO: 902419 - RNA, 22 nt, Human
ugugcgugguucccggggccau

SEQ ID NO: 902420 - RNA, 22 nt, Human
ucugucccugagagcucaggag

SEQ ID NO: 902421 - RNA, 23 nt, Human
cagugccauuugucuugccuaug

SEQ ID NO: 902422 - RNA, 22 nt, Human
gcuuuggucuucuagcugugag

SEQ ID NO: 902423 - RNA, 22 nt, Human
cagcagaaaauaccuguaacuc

SEQ ID NO: 902424 - RNA, 22 nt, Human
gucuggagccacccuaagcauu

SEQ ID NO: 902425 - RNA, 22 nt, Human
auuucucaaguaaaugagucau

SEQ ID NO: 902426 - RNA, 20 nt, Human
cucacuuaccuuuuucuaua

SEQ ID NO: 902427 - RNA, 22 nt, Human
aggccacagguggaagccagag

SEQ ID NO: 902428 - RNA, 23 nt, Human
aaccugaacuagggucuugcaua

SEQ ID NO: 902429 - RNA, 22 nt, Human
augaaggcaagacugaggugug

SEQ ID NO: 902430 - RNA, 22 nt, Human
gggaacuugcuaaaauacagac

SEQ ID NO: 902431 - RNA, 19 nt, Human
auucagugucucugacuuc

SEQ ID NO: 902432 - RNA, 23 nt, Human
ucucucuuagcuaugcuuauggc

SEQ ID NO: 902433 - RNA, 21 nt, Human
ucaggagagcccaucuacaaa

SEQ ID NO: 902434 - RNA, 22 nt, Human
uggaucugcucuaugaacugcu

SEQ ID NO: 902435 - RNA, 22 nt, Human
gacacagcuuucugaagagcau

SEQ ID NO: 902436 - RNA, 22 nt, Human
cauuccagagcugccucugcua

SEQ ID NO: 902437 - RNA, 22 nt, Human
uucacuguacugacugucuuau

SEQ ID NO: 902438 - RNA, 22 nt, Human
cagaacagacuuaacagggcug

SEQ ID NO: 902439 - RNA, 22 nt, Human
uaaaaagcagcugagauuuucu

SEQ ID NO: 902440 - RNA, 22 nt, Human
uccuguggucauucuucugccc

SEQ ID NO: 902441 - RNA, 22 nt, Human
ucuguccuguuuccuccugaca

SEQ ID NO: 902442 - RNA, 22 nt, Human
uacuauuuuugcaacguauaca

SEQ ID NO: 902443 - RNA, 22 nt, Human
uuccuggucccguucuucacug

SEQ ID NO: 902444 - RNA, 22 nt, Human
uccagggccaugaaguugcaca

SEQ ID NO: 902445 - RNA, 22 nt, Human
ugcuaaauaacuuacauagugg

SEQ ID NO: 902446 - RNA, 22 nt, Human
auuuaucaccaguuagcugacu

SEQ ID NO: 902447 - RNA, 22 nt, Human
uggagggcauagcuguucuuuc

SEQ ID NO: 902448 - RNA, 22 nt, Human
cugucccuucauuauucacuac

SEQ ID NO: 902449 - RNA, 22 nt, Human
agauuccagaucccaaaaauga

SEQ ID NO: 902450 - RNA, 22 nt, Human
uuuguuaaaaugcagauucugu

SEQ ID NO: 902451 - RNA, 22 nt, Human
uauacagaaccgccugaagucu

SEQ ID NO: 902452 - RNA, 22 nt, Human
gggagaugacucagugaccucg

SEQ ID NO: 902453 - RNA, 22 nt, Human
uggcagugaagcugucuuuagg

SEQ ID NO: 902454 - RNA, 22 nt, Human
uaggauuuggcuuuagucaggu

SEQ ID NO: 902455 - RNA, 22 nt, Human
uuggaaauugcaagugauuugc

SEQ ID NO: 902456 - RNA, 22 nt, Human
aguggcuuauguuuagaaucau

SEQ ID NO: 902457 - RNA, 22 nt, Human
auggaaaaggcugauuucauua

SEQ ID NO: 902458 - RNA, 18 nt, Human
agcaacaggaucccaggg

SEQ ID NO: 902459 - RNA, 22 nt, Human
aguuuuauuccaaugugcagca

SEQ ID NO: 902460 - RNA, 22 nt, Human
acaugaggaaacaaggguauau

SEQ ID NO: 902461 - RNA, 22 nt, Human
ucuguuuaugugucuaaauaaa

SEQ ID NO: 902462 - RNA, 22 nt, Human
ucugucauuucaauaugguuaa

SEQ ID NO: 902463 - RNA, 23 nt, Human
gccaggcuccggucuguggccac

SEQ ID NO: 902464 - RNA, 22 nt, Human
acauuuguuucucuagaguagg

SEQ ID NO: 902465 - RNA, 22 nt, Human
ugaaugugaugcuaaacauaug

SEQ ID NO: 902466 - RNA, 22 nt, Human
acaaggaccaugaggcagaccc

SEQ ID NO: 902467 - RNA, 18 nt, Human
aaguaacagaagagcaca

SEQ ID NO: 902468 - RNA, 22 nt, Human
guggcacaugcugcugcuucug

SEQ ID NO: 902469 - RNA, 22 nt, Human
cgagcagaauggagggugccga

SEQ ID NO: 902470 - RNA, 22 nt, Human
agggcccuccccgcucagggca

SEQ ID NO: 902471 - RNA, 19 nt, Human
cccagcuugaccaccugcu

SEQ ID NO: 902472 - RNA, 22 nt, Human
agcagggaggucuagcacgugg

SEQ ID NO: 902473 - RNA, 22 nt, Human
guuggucauaucauugaagcuu

SEQ ID NO: 902474 - RNA, 22 nt, Human
auuuuaauaagauucccaagua

SEQ ID NO: 902475 - RNA, 22 nt, Human
gcccucugaugcucaccgagga

SEQ ID NO: 902476 - RNA, 22 nt, Human
aaaugcagugguucuacuucuc

SEQ ID NO: 902477 - RNA, 22 nt, Human
ucuucacauuuuagugguuugu

SEQ ID NO: 902478 - RNA, 20 nt, Human
ucugccacugcacucugccc

SEQ ID NO: 902479 - RNA, 22 nt, Human
guccaagagauguaacgaagaa

SEQ ID NO: 902480 - RNA, 22 nt, Human
ggccugaaauaaaguagcagaa

SEQ ID NO: 902481 - RNA, 22 nt, Human
aagucaaagcuuucagaggaaa

SEQ ID NO: 902482 - RNA, 22 nt, Human
aacaggaaacaaguuguuagga

SEQ ID NO: 902483 - RNA, 22 nt, Human
uccaggcaaaaggaacugcuug

SEQ ID NO: 902484 - RNA, 22 nt, Human
cugccaggauucugugaacccc

SEQ ID NO: 902485 - RNA, 22 nt, Human
uuuuaaguuuauuccaguacau

SEQ ID NO: 902486 - RNA, 22 nt, Human
uguguauaacucuuaauucauu

SEQ ID NO: 902487 - RNA, 22 nt, Human
ucuugcuguuacagaauuaaca

SEQ ID NO: 902488 - RNA, 22 nt, Human
gaguucucaguaaaguucuuug

SEQ ID NO: 902489 - RNA, 22 nt, Human
aaagugcuuucccacauuuguu

SEQ ID NO: 902490 - RNA, 22 nt, Human
agucuucagcauagcauauggc

SEQ ID NO: 902491 - RNA, 22 nt, Human
uuuaugcuacucaauagucagu

SEQ ID NO: 902492 - RNA, 22 nt, Human
accugcaguggccacuccuaau

SEQ ID NO: 902493 - RNA, 22 nt, Human
ggcuggcgcucucccagcgcug

SEQ ID NO: 902494 - RNA, 22 nt, Human
accaggcugugaagugagacua

SEQ ID NO: 902495 - RNA, 22 nt, Human
cagcuggcguggagugauugca

SEQ ID NO: 902496 - RNA, 21 nt, Human
ucugugcugccgucaacaucc

SEQ ID NO: 902497 - RNA, 22 nt, Human
gugacagagugagaccuugucu

SEQ ID NO: 902498 - RNA, 22 nt, Human
ccagugugggcccggccuccuc

SEQ ID NO: 902499 - RNA, 22 nt, Human
cuguuauuuuauaauucaagaa

SEQ ID NO: 902500 - RNA, 22 nt, Human
ugagagaguaauugagugguaa

SEQ ID NO: 902501 - RNA, 22 nt, Human
uuccuucuauucagcuccaaga

SEQ ID NO: 902502 - RNA, 22 nt, Human
cacagauuucuggucuucaccc

SEQ ID NO: 902503 - RNA, 22 nt, Human
cugcagggagcagauggcgugu

SEQ ID NO: 902504 - RNA, 22 nt, Human
guuauauauaguauuucucuga

SEQ ID NO: 902505 - RNA, 22 nt, Human
cugagcauccagcagguacugc

SEQ ID NO: 902506 - RNA, 22 nt, Human
uuuccauauucugcgucugcca

SEQ ID NO: 902507 - RNA, 23 nt, Human
accuagaaauacguuuuacaugg

SEQ ID NO: 902508 - RNA, 23 nt, Human
uugcacugaucaauuugauaagc

SEQ ID NO: 902509 - RNA, 22 nt, Human
cuuggaaggacgggcuguaucu

SEQ ID NO: 902510 - RNA, 22 nt, Human
agacagugcuaucccaucugug

SEQ ID NO: 902511 - RNA, 22 nt, Human
ccaaaucaccagcacgaucauu

SEQ ID NO: 902512 - RNA, 22 nt, Human
caucuugccugcuauucuguug

SEQ ID NO: 902513 - RNA, 19 nt, Human
acacauguguguuaugugc

SEQ ID NO: 902514 - RNA, 21 nt, Human
gggccuggcugcgcaggacgg

SEQ ID NO: 902515 - RNA, 22 nt, Human
ugcaagugccaugugcacagug

SEQ ID NO: 902516 - RNA, 23 nt, Human
cagcagcugccugguuuuuuggu

SEQ ID NO: 902517 - RNA, 22 nt, Human
auguuagaaggaauguuaaaag

SEQ ID NO: 902518 - RNA, 22 nt, Human
auuucuagccucugaaguagga

SEQ ID NO: 902519 - RNA, 21 nt, Human
auacacauacacauaaaugug

SEQ ID NO: 902520 - RNA, 22 nt, Human
gcaccugauugauuucacugcu

SEQ ID NO: 902521 - RNA, 22 nt, Human
aagcugaaaaugagacucuaca

SEQ ID NO: 902522 - RNA, 22 nt, Human
gagacacagcagauauucaauc

SEQ ID NO: 902523 - RNA, 22 nt, Human
cuucauuaaccaaaaugcaaua

SEQ ID NO: 902524 - RNA, 22 nt, Human
uucuccuugguuuaugggacau

SEQ ID NO: 902525 - RNA, 22 nt, Human
aucacagugccuucguaaauuu

SEQ ID NO: 902526 - RNA, 22 nt, Human
cugacagaugcugcuggcagua

SEQ ID NO: 902527 - RNA, 22 nt, Human
gggcccuggggauguggacgcg

SEQ ID NO: 902528 - RNA, 22 nt, Human
ugaggggcgcuggcagguuccu

SEQ ID NO: 902529 - RNA, 17 nt, Human
agccugccccaugcugc

SEQ ID NO: 902530 - RNA, 22 nt, Human
uaaaguguuguacaaauguaug

SEQ ID NO: 902531 - RNA, 22 nt, Human
ccccacaguccgugaggagcca

SEQ ID NO: 902532 - RNA, 22 nt, Human
aauacuugaauuucaugucagg

SEQ ID NO: 902533 - RNA, 22 nt, Human
uauaaaguuucgaaagauguau

SEQ ID NO: 902534 - RNA, 22 nt, Human
ccccaugaaguagggucucuga

SEQ ID NO: 902535 - RNA, 22 nt, Human
uuuugcuugagugcacaaaaug

SEQ ID NO: 902536 - RNA, 22 nt, Human
guggguggggagcucucuggag

SEQ ID NO: 902537 - RNA, 19 nt, Human
ugucuagcugcacagcuga

SEQ ID NO: 902538 - RNA, 20 nt, Human
uguaaaacaaggugaauccu

SEQ ID NO: 902539 - RNA, 22 nt, Human
cacaccucacaccucgcaugcu

SEQ ID NO: 902540 - RNA, 22 nt, Human
gacagacugcguaguccccaaa

SEQ ID NO: 902541 - RNA, 22 nt, Human
uccagaaaauucagaaauuguu

SEQ ID NO: 902542 - RNA, 22 nt, Human
gaccuagauuaacauucuguga

SEQ ID NO: 902543 - RNA, 22 nt, Human
uaauuuaauuucaugccagccu

SEQ ID NO: 902544 - RNA, 20 nt, Human
ucuugagaacaauuucuggc

SEQ ID NO: 902545 - RNA, 22 nt, Human
cacaguguaguuaaugugacau

SEQ ID NO: 902546 - RNA, 22 nt, Human
ggccugaggcaauagucagaca

SEQ ID NO: 902547 - RNA, 22 nt, Human
guucacaaauaugcacuuacga

SEQ ID NO: 902548 - RNA, 22 nt, Human
uuuuaaugugcucugcaaugau

SEQ ID NO: 902549 - RNA, 22 nt, Human
ucuacacauuuguaaaggcauu

SEQ ID NO: 902550 - RNA, 22 nt, Human
cauuuagagaguaaaaauuagc

SEQ ID NO: 902551 - RNA, 22 nt, Human
uggggcuguccuuagucugaga

SEQ ID NO: 902552 - RNA, 22 nt, Human
aaguguuuaugguuauuguuaa

SEQ ID NO: 902553 - RNA, 22 nt, Human
ucauacacaagagcauguaaca

SEQ ID NO: 902554 - RNA, 22 nt, Human
ccugggaagagcugacaggagg

SEQ ID NO: 902555 - RNA, 22 nt, Human
gugcagaaucaguacagaacga

SEQ ID NO: 902556 - RNA, 18 nt, Human
augcauauuuuaaguugu

SEQ ID NO: 902557 - RNA, 22 nt, Human
auccccagacuuuagauuucuc

SEQ ID NO: 902558 - RNA, 22 nt, Human
uggaaaaaaauuggcuagcuuc

SEQ ID NO: 902559 - RNA, 22 nt, Human
ugaagaauaaaugguugagacu

SEQ ID NO: 902560 - RNA, 22 nt, Human
ucauguuaucuuggcucuggga

SEQ ID NO: 902561 - RNA, 22 nt, Human
aaaaguauuuauggcuauguaa

SEQ ID NO: 902562 - RNA, 22 nt, Human
guauuuuauggcaugcaguggc

SEQ ID NO: 902563 - RNA, 22 nt, Human
ucugucugcucauuuaccucag

SEQ ID NO: 902564 - RNA, 22 nt, Human
aggcugaggcggguagaucacc

SEQ ID NO: 902565 - RNA, 22 nt, Human
aaggugucaccagauuggcagg

SEQ ID NO: 902566 - RNA, 22 nt, Human
uccuggcccuguggccugcagu

SEQ ID NO: 902567 - RNA, 22 nt, Human
cagggccccagggaugucugcu

SEQ ID NO: 902568 - RNA, 19 nt, Human
uggagaggaaaugcugcuc

SEQ ID NO: 902569 - RNA, 22 nt, Human
cucuuucugauucgcugggacc

SEQ ID NO: 902570 - RNA, 22 nt, Human
uuccuugggaaaugcucguuua

SEQ ID NO: 902571 - RNA, 22 nt, Human
ucagagguggcaggggugucca

SEQ ID NO: 902572 - RNA, 22 nt, Human
cauuuguauguuccuccuuagg

SEQ ID NO: 902573 - RNA, 22 nt, Human
agccuggaagaaccugaagucu

SEQ ID NO: 902574 - RNA, 22 nt, Human
aggaagccuggcauuaaaaagc

SEQ ID NO: 902575 - RNA, 22 nt, Human
auacagcuuaugcauauaucuc

SEQ ID NO: 902576 - RNA, 22 nt, Human
cugaggccucuuuccuuggcuu

SEQ ID NO: 902577 - RNA, 22 nt, Human
agcagcauguucauuacauuau

SEQ ID NO: 902578 - RNA, 22 nt, Human
uucugcauggagaaacugaguc

SEQ ID NO: 902579 - RNA, 22 nt, Human
uucacaauaggagcaugcaaau

SEQ ID NO: 902580 - RNA, 22 nt, Human
acagggaaggagcauagaaaaa

SEQ ID NO: 902581 - RNA, 22 nt, Human
aggcccagcuugaagugggaag

SEQ ID NO: 902582 - RNA, 22 nt, Human
uagcagcucugauucugggccc

SEQ ID NO: 902583 - RNA, 22 nt, Human
cccagcucuuuuagcggcaucu

SEQ ID NO: 902584 - RNA, 17 nt, Human
ggccccggagccugaca

SEQ ID NO: 902585 - RNA, 22 nt, Human
ucaguggagagcuuccaggauu

SEQ ID NO: 902586 - RNA, 22 nt, Human
auugucagaguuugagaaagua

SEQ ID NO: 902587 - RNA, 22 nt, Human
uguucucuuccacggcgcucgg

SEQ ID NO: 902588 - RNA, 22 nt, Human
agggcuccgggccaccggccug

SEQ ID NO: 902589 - RNA, 22 nt, Human
uuucuucauucaccuucacccc

SEQ ID NO: 902590 - RNA, 22 nt, Human
cagagcagaagcgguccucaca

SEQ ID NO: 902591 - RNA, 22 nt, Human
ccagaaaaugcagaacauagaa

SEQ ID NO: 902592 - RNA, 22 nt, Human
aacacugacgacgugaacuaaa

SEQ ID NO: 902593 - RNA, 22 nt, Human
gaagacauguggauucuaguuu

SEQ ID NO: 902594 - RNA, 22 nt, Human
guggcccugucccaggccuccu

SEQ ID NO: 902595 - RNA, 22 nt, Human
gagguggccaagcgaggaaggg

SEQ ID NO: 902596 - RNA, 22 nt, Human
gacaaggcgcccagccugccaa

SEQ ID NO: 902597 - RNA, 19 nt, Human
guaacagcucuggguucac

SEQ ID NO: 902598 - RNA, 22 nt, Human
agguuauugcucuccaaguuca

SEQ ID NO: 902599 - RNA, 21 nt, Human
uuaaugcuaugcagaaaaucu

SEQ ID NO: 902600 - RNA, 22 nt, Human
aggcuggcuuggcucuccugug

SEQ ID NO: 902601 - RNA, 22 nt, Human
auugaaaggcaaaguaggaagc

SEQ ID NO: 902602 - RNA, 22 nt, Human
aaagagggacaggcgcagacac

SEQ ID NO: 902603 - RNA, 22 nt, Human
ucaucagaggcaucuggcaagg

SEQ ID NO: 902604 - RNA, 22 nt, Human
ccuuuaugauagaugcuuucag

SEQ ID NO: 902605 - RNA, 22 nt, Human
auuguguggugaaugaucagcu

SEQ ID NO: 902606 - RNA, 22 nt, Human
aggccuccagccacaugccagu

SEQ ID NO: 902607 - RNA, 22 nt, Human
agugucugugaugaggucagga

SEQ ID NO: 902608 - RNA, 21 nt, Human
ucccagagugcuugggacugc

SEQ ID NO: 902609 - RNA, 22 nt, Human
gggagacaguucagauaguuuc

SEQ ID NO: 902610 - RNA, 21 nt, Human
ccaccaggucuucugcucggg

SEQ ID NO: 902611 - RNA, 22 nt, Human
agaguuccacguacagcuuuug

SEQ ID NO: 902612 - RNA, 20 nt, Human
ucauuacagugcuaagaugu

SEQ ID NO: 902613 - RNA, 20 nt, Human
ugcagggcugccucccagcu

SEQ ID NO: 902614 - RNA, 22 nt, Human
guuuggaaguuaagugcagcag

SEQ ID NO: 902615 - RNA, 22 nt, Human
ccucaggcuucgucuuccaccc

SEQ ID NO: 902616 - RNA, 22 nt, Human
ugcagccauuuucugccaaugc

SEQ ID NO: 902617 - RNA, 20 nt, Human
caucaacaccuugucagccu

SEQ ID NO: 902618 - RNA, 22 nt, Human
ucccugugggaugaggacucug

SEQ ID NO: 902619 - RNA, 22 nt, Human
augauguaaggguaauugucua

SEQ ID NO: 902620 - RNA, 22 nt, Human
gugacagaaacagggcuagaau

SEQ ID NO: 902621 - RNA, 18 nt, Human
uacaguauuuucucgccu

SEQ ID NO: 902622 - RNA, 22 nt, Human
cagguccucgggggaggccggc

SEQ ID NO: 902623 - RNA, 18 nt, Human
uggcuucagaguaaaaug

SEQ ID NO: 902624 - RNA, 22 nt, Human
uuugcuuuugugcucuaguggu

SEQ ID NO: 902625 - RNA, 22 nt, Human
uucuuguacuggagauacauga

SEQ ID NO: 902626 - RNA, 22 nt, Human
uggcaguggcaucaccccaaua

SEQ ID NO: 902627 - RNA, 18 nt, Human
aggcaggauccuggccuc

SEQ ID NO: 902628 - RNA, 22 nt, Human
gucaauuagcuaaaauuuggua

SEQ ID NO: 902629 - RNA, 22 nt, Human
aucuuucuauuucuaaaaacua

SEQ ID NO: 902630 - RNA, 22 nt, Human
cugagccaccggcagggacauc

SEQ ID NO: 902631 - RNA, 22 nt, Human
gcuuagaagauugacccugguu

SEQ ID NO: 902632 - RNA, 22 nt, Human
ucaaaacaacacucagguguaa

SEQ ID NO: 902633 - RNA, 22 nt, Human
gagcagcacuugaggcauguca

SEQ ID NO: 902634 - RNA, 22 nt, Human
uaggaagagcuauaggucccca

SEQ ID NO: 902635 - RNA, 22 nt, Human
cgcugcagaagcguguucagga

SEQ ID NO: 902636 - RNA, 22 nt, Human
gcuguucuaggagcugugagca

SEQ ID NO: 902637 - RNA, 22 nt, Human
ugaggccaggaucccaggcucu

SEQ ID NO: 902638 - RNA, 22 nt, Human
ggcccagacccaagaguggugg

SEQ ID NO: 902639 - RNA, 22 nt, Human
cagcccuggcgcccccagaucu

SEQ ID NO: 902640 - RNA, 22 nt, Human
ugcagggaagcaaggguggcuc

SEQ ID NO: 902641 - RNA, 22 nt, Human
uaaaguguggacaguaucuaua

SEQ ID NO: 902642 - RNA, 22 nt, Human
acuccagggcuucuaugauggu

SEQ ID NO: 902643 - RNA, 22 nt, Human
cagcagaggugguucacauugu

SEQ ID NO: 902644 - RNA, 22 nt, Human
acaauguuucucuuuagucauu

SEQ ID NO: 902645 - RNA, 22 nt, Human
uguuuauugcagugcugggcug

SEQ ID NO: 902646 - RNA, 22 nt, Human
gcccugggcucccugcuccaca

SEQ ID NO: 902647 - RNA, 20 nt, Human
agaagucagcucagaaguga

SEQ ID NO: 902648 - RNA, 20 nt, Human
augaaauuccuguuuucuga

SEQ ID NO: 902649 - RNA, 22 nt, Human
ugcaaggcagcaccagcucuug

SEQ ID NO: 902650 - RNA, 22 nt, Human
ugaaauuagugaaguuacaguu

SEQ ID NO: 902651 - RNA, 22 nt, Human
cuccuugguguaguacugagca

SEQ ID NO: 902652 - RNA, 17 nt, Human
gagagcugcugcuuccg

SEQ ID NO: 902653 - RNA, 22 nt, Human
accugggaguaugcagugguga

SEQ ID NO: 902654 - RNA, 22 nt, Human
ucaggccuucagaccuggcccg

SEQ ID NO: 902655 - RNA, 19 nt, Human
augacucuuauugucugaa

SEQ ID NO: 902656 - RNA, 22 nt, Human
cagcucaaguuucccaggucag

SEQ ID NO: 902657 - RNA, 22 nt, Human
uuuggauauguuucugucuucu

SEQ ID NO: 902658 - RNA, 22 nt, Human
ucuucagugcauguuaccuaua

SEQ ID NO: 902659 - RNA, 22 nt, Human
gcaugcaaggggugugaaguga

SEQ ID NO: 902660 - RNA, 22 nt, Human
gcucugucauuuugcagacacu

SEQ ID NO: 902661 - RNA, 22 nt, Human
auugucuucuggucuuaucuuu

SEQ ID NO: 902662 - RNA, 22 nt, Human
uagcuguucccagcucugugua

SEQ ID NO: 902663 - RNA, 22 nt, Human
uuuuuggguccaggcuguaucu

SEQ ID NO: 902664 - RNA, 22 nt, Human
aaaucuguaagcaauugcucag

SEQ ID NO: 902665 - RNA, 22 nt, Human
aacuuucuuucacagaaguauc

SEQ ID NO: 902666 - RNA, 22 nt, Human
uaggaccaaguggagugcaggu

SEQ ID NO: 902667 - RNA, 22 nt, Human
uagcaucuugauuucagaccag

SEQ ID NO: 902668 - RNA, 22 nt, Human
uucugagcacguucauuuaaau

SEQ ID NO: 902669 - RNA, 22 nt, Human
uugucuguaaagacggccacca

SEQ ID NO: 902670 - RNA, 22 nt, Human
guggcagugccguuugguucag

SEQ ID NO: 902671 - RNA, 22 nt, Human
aaugucuuuaaagugcaauaga

SEQ ID NO: 902672 - RNA, 22 nt, Human
uauugacaauuugugaaacuau

SEQ ID NO: 902673 - RNA, 22 nt, Human
uuucacagcagaauuucugagg

SEQ ID NO: 902674 - RNA, 22 nt, Human
ucauuucaguccucugugugag

SEQ ID NO: 902675 - RNA, 22 nt, Human
ucuggcacuuaaaugagaauuu

SEQ ID NO: 902676 - RNA, 20 nt, Human
agcauuugaaauaugacuau

SEQ ID NO: 902677 - RNA, 22 nt, Human
uaucaugaucagcaacuaauca

SEQ ID NO: 902678 - RNA, 22 nt, Human
gcuggccaaaguguaccuggag

SEQ ID NO: 902679 - RNA, 18 nt, Human
ggcugagguugacuagaa

SEQ ID NO: 902680 - RNA, 23 nt, Human
gccugccugaccugugcaaaguc

SEQ ID NO: 902681 - RNA, 22 nt, Human
ggcucugcucacagcccgcagc

SEQ ID NO: 902682 - RNA, 22 nt, Human
agcauaauuccugacacacaag

SEQ ID NO: 902683 - RNA, 22 nt, Human
acauucuacaguuaaccauuag

SEQ ID NO: 902684 - RNA, 22 nt, Human
cagcuggcagaaccugcaucca

SEQ ID NO: 902685 - RNA, 22 nt, Human
ccuggacuugauauucucuuuc

SEQ ID NO: 902686 - RNA, 22 nt, Human
acaguucuguccuagacuucgu

SEQ ID NO: 902687 - RNA, 22 nt, Human
auggcucucuugaccuaggcac

SEQ ID NO: 902688 - RNA, 22 nt, Human
auggaaugaaaaacacaugcaa

SEQ ID NO: 902689 - RNA, 22 nt, Human
gccugcagggccugggccuacc

SEQ ID NO: 902690 - RNA, 22 nt, Human
ccuuucucuuggauaccgauug

SEQ ID NO: 902691 - RNA, 22 nt, Human
ggccaagguggagaaggcacug

SEQ ID NO: 902692 - RNA, 22 nt, Human
ccagcagcuuuauuggcucucc

SEQ ID NO: 902693 - RNA, 22 nt, Human
uuuuggugaauuuaagugcugu

SEQ ID NO: 902694 - RNA, 22 nt, Human
cuggaaggcggagguuguagug

SEQ ID NO: 902695 - RNA, 22 nt, Human
ugucugggagacugaucacccg

SEQ ID NO: 902696 - RNA, 22 nt, Human
ccacagaaaguugucuagagua

SEQ ID NO: 902697 - RNA, 22 nt, Human
ggugcugauaguaacaauaaua

SEQ ID NO: 902698 - RNA, 22 nt, Human
cugagauacuguggcgaaugca

SEQ ID NO: 902699 - RNA, 20 nt, Human
uuccaacucacaucucuaca

SEQ ID NO: 902700 - RNA, 19 nt, Human
acuggcagggcugcggugg

SEQ ID NO: 902701 - RNA, 22 nt, Human
cagcuugugaaaugucaccacu

SEQ ID NO: 902702 - RNA, 19 nt, Human
aaggcugguaccauagguu

SEQ ID NO: 902703 - RNA, 22 nt, Human
aaugucaaaauggaaugagacu

SEQ ID NO: 902704 - RNA, 21 nt, Human
cucuggagucaagagcuucca

SEQ ID NO: 902705 - RNA, 22 nt, Human
ggccucaagcuacccucucacc

SEQ ID NO: 902706 - RNA, 22 nt, Human
uuaauacuauaauuugaaguac

SEQ ID NO: 902707 - RNA, 22 nt, Human
cuccaggaaagccugaggcccg

SEQ ID NO: 902708 - RNA, 19 nt, Human
uguagcaguuuaaaacaac

SEQ ID NO: 902709 - RNA, 22 nt, Human
uaaaaaguugaaaggacuuauc

SEQ ID NO: 902710 - RNA, 22 nt, Human
uuuacaguuaagaaauguuacc

SEQ ID NO: 902711 - RNA, 22 nt, Human
uagccaggucacacuguguguu

SEQ ID NO: 902712 - RNA, 22 nt, Human
ggggcaggagguguucucuuuu

SEQ ID NO: 902713 - RNA, 22 nt, Human
acucacagcagacuaugaggga

SEQ ID NO: 902714 - RNA, 22 nt, Human
guucuaauuuggggcuccuuag

SEQ ID NO: 902715 - RNA, 22 nt, Human
cuaagcaagaaugagugcaaca

SEQ ID NO: 902716 - RNA, 22 nt, Human
gcagcauuaccaagacauggca

SEQ ID NO: 902717 - RNA, 22 nt, Human
gaggaagcugcguggcauuuca

SEQ ID NO: 902718 - RNA, 22 nt, Human
aggcucaggucucaggucuggc

SEQ ID NO: 902719 - RNA, 22 nt, Human
caagcguggcugcucugaugga

SEQ ID NO: 902720 - RNA, 22 nt, Human
auggaauggcucccugccccag

SEQ ID NO: 902721 - RNA, 22 nt, Human
ggcaaggguugaagauaaggua

SEQ ID NO: 902722 - RNA, 22 nt, Human
aucucaaaugauuacaccaagc

SEQ ID NO: 902723 - RNA, 22 nt, Human
gcuuugugaauuauuacucaca

SEQ ID NO: 902724 - RNA, 22 nt, Human
uaaaugaagcucaugggccaca

SEQ ID NO: 902725 - RNA, 22 nt, Human
gugacagauuugcugcgcaugg

SEQ ID NO: 902726 - RNA, 22 nt, Human
ucuuauaauguugaaggguugg

SEQ ID NO: 902727 - RNA, 22 nt, Human
ucuggggguuaagugaggacaa

SEQ ID NO: 902728 - RNA, 23 nt, Human
uggcacagaggaccaugcuuugc

SEQ ID NO: 902729 - RNA, 22 nt, Human
auuggucuccacuuguuuuaga

SEQ ID NO: 902730 - RNA, 22 nt, Human
uccagcucaaagugcuccuguc

SEQ ID NO: 902731 - RNA, 22 nt, Human
agacaacaugaucagcaguccu

SEQ ID NO: 902732 - RNA, 22 nt, Human
gacucagagaucccuggagguc

SEQ ID NO: 902733 - RNA, 22 nt, Human
aauuucuccaagaaugcuuaga

SEQ ID NO: 902734 - RNA, 22 nt, Human
ugcacuguaugguaucuggaca

SEQ ID NO: 902735 - RNA, 22 nt, Human
cugagcuuccaguuccuccagg

SEQ ID NO: 902736 - RNA, 22 nt, Human
ggaguggccacgacugggagau

SEQ ID NO: 902737 - RNA, 22 nt, Human
agucagagagcucucagcauag

SEQ ID NO: 902738 - RNA, 22 nt, Human
ugaguaaaagugaaucuuaugu

SEQ ID NO: 902739 - RNA, 22 nt, Human
uuucugaagguuaaggaauuag

SEQ ID NO: 902740 - RNA, 22 nt, Human
agaagccagucgcucucccgca

SEQ ID NO: 902741 - RNA, 22 nt, Human
cuugcaggcccagccuuacaag

SEQ ID NO: 902742 - RNA, 22 nt, Human
cugggcuccacuacuugcuaac

SEQ ID NO: 902743 - RNA, 19 nt, Human
guggccagggcaggggcug

SEQ ID NO: 902744 - RNA, 22 nt, Human
ccauggcaauggucagucuauu

SEQ ID NO: 902745 - RNA, 22 nt, Human
ccaggcccugcuccucacacca

SEQ ID NO: 902746 - RNA, 22 nt, Human
uauugcauccccauugugcccc

SEQ ID NO: 902747 - RNA, 22 nt, Human
auugagaaaggcuuauguuugc

SEQ ID NO: 902748 - RNA, 21 nt, Human
ugccaucucugugggaccagg

SEQ ID NO: 902749 - RNA, 22 nt, Human
aggcaggucacaugcuuggcga

SEQ ID NO: 902750 - RNA, 22 nt, Human
gcauguguuagagugugcaugc

SEQ ID NO: 902751 - RNA, 22 nt, Human
cuucacagucacccugcugugu

SEQ ID NO: 902752 - RNA, 22 nt, Human
aggcucugucaggcggagcagc

SEQ ID NO: 902753 - RNA, 22 nt, Human
gcuguaggaaugacauguaccu

SEQ ID NO: 902754 - RNA, 22 nt, Human
cuccugcuccugcuugcaagga

SEQ ID NO: 902755 - RNA, 22 nt, Human
cuguggucaugaguccuuccau

SEQ ID NO: 902756 - RNA, 21 nt, Human
uccugcugagaaacagauggu

SEQ ID NO: 902757 - RNA, 23 nt, Human
aagcuucuagggugggcaagaug

SEQ ID NO: 902758 - RNA, 22 nt, Human
agaccuggugauagcuguccua

SEQ ID NO: 902759 - RNA, 22 nt, Human
aggaaauaggaccagacaaagc

SEQ ID NO: 902760 - RNA, 22 nt, Human
aaacaguuaauugcuuucaguu

SEQ ID NO: 902761 - RNA, 22 nt, Human
uaucagugugcaucucugaaug

SEQ ID NO: 902762 - RNA, 23 nt, Human
aggauccugguacaggagcagag

SEQ ID NO: 902763 - RNA, 22 nt, Human
cacauuucuuauggauguuggc

SEQ ID NO: 902764 - RNA, 22 nt, Human
cagugaguaaguagacagcuua

SEQ ID NO: 902765 - RNA, 22 nt, Human
ccuggggcucugcacagagcag

SEQ ID NO: 902766 - RNA, 22 nt, Human
uccugggagagugggacuguau

SEQ ID NO: 902767 - RNA, 22 nt, Human
gagcagcagguggggcuggcuu

SEQ ID NO: 902768 - RNA, 19 nt, Human
ucucagaggaaaaauugcu

SEQ ID NO: 902769 - RNA, 22 nt, Human
uucaguuuuauuguacugcuau

SEQ ID NO: 902770 - RNA, 22 nt, Human
uccagcaguaaggaaaguacau

SEQ ID NO: 902771 - RNA, 22 nt, Human
ucaggcagucugacuccggagg

SEQ ID NO: 902772 - RNA, 22 nt, Human
uguauugaggauucauuuuugu

SEQ ID NO: 902773 - RNA, 21 nt, Human
gauuuaguggcuguucuaccu

SEQ ID NO: 902774 - RNA, 22 nt, Human
uaggcuuccgagucuugguauc

SEQ ID NO: 902775 - RNA, 22 nt, Human
uuacaguaaucgaguguugugg

SEQ ID NO: 902776 - RNA, 19 nt, Human
ccugggccuccaucacccc

SEQ ID NO: 902777 - RNA, 22 nt, Human
cagcauagcugauuaaggcaaa

SEQ ID NO: 902778 - RNA, 22 nt, Human
uucuguuacauggggcacagug

SEQ ID NO: 902779 - RNA, 22 nt, Human
guucugucugagcaccacagga

SEQ ID NO: 902780 - RNA, 22 nt, Human
cucugggaugaggccuaggcac

SEQ ID NO: 902781 - RNA, 22 nt, Human
augcugucccugcccuucaccc

SEQ ID NO: 902782 - RNA, 22 nt, Human
aggaauuaauaaccaguaagcc

SEQ ID NO: 902783 - RNA, 22 nt, Human
ugacacaagagcccuguuugcu

SEQ ID NO: 902784 - RNA, 22 nt, Human
ugccagagaagacccagucacu

SEQ ID NO: 902785 - RNA, 22 nt, Human
ucuguucaguugauguaguuuu

SEQ ID NO: 902786 - RNA, 22 nt, Human
uugcuaaguuauagaguaucuu

SEQ ID NO: 902787 - RNA, 22 nt, Human
aaagagcucuuacucuagugua

SEQ ID NO: 902788 - RNA, 22 nt, Human
uaggauuuauucuacaauauug

SEQ ID NO: 902789 - RNA, 22 nt, Human
aggccagagaggggaccagccu

SEQ ID NO: 902790 - RNA, 22 nt, Human
agcaauaacagaaaacuuuccu

SEQ ID NO: 902791 - RNA, 19 nt, Human
agccagugagccucugggu

SEQ ID NO: 902792 - RNA, 22 nt, Human
uagaaauggggaaguaguuagg

SEQ ID NO: 902793 - RNA, 22 nt, Human
cauagaggcaaaauggcuguac

SEQ ID NO: 902794 - RNA, 22 nt, Human
cuuagaaagaguuuucuccccu

SEQ ID NO: 902795 - RNA, 22 nt, Human
uggagcagggcaucacugugcg

SEQ ID NO: 902796 - RNA, 22 nt, Human
gcaggacucaaaucugaaggca

SEQ ID NO: 902797 - RNA, 22 nt, Human
aucaucuugaaagucuauguuu

SEQ ID NO: 902798 - RNA, 22 nt, Human
aggccugaaguguggagugggg

SEQ ID NO: 902799 - RNA, 22 nt, Human
cuuuccugagaaaggagaagga

SEQ ID NO: 902800 - RNA, 22 nt, Human
auuuuuaugacaaaccauccuc

SEQ ID NO: 902801 - RNA, 22 nt, Human
augcaacagucaguacauccgg

SEQ ID NO: 902802 - RNA, 22 nt, Human
ucaacacuuuugucuuuguccc

SEQ ID NO: 902803 - RNA, 22 nt, Human
agugccuuggguauuuugagua

SEQ ID NO: 902804 - RNA, 22 nt, Human
agagccugugauugucaucacc

SEQ ID NO: 902805 - RNA, 22 nt, Human
ugaguuaaaugagaacaugaaa

SEQ ID NO: 902806 - RNA, 22 nt, Human
gggugacagcagcuaaugacag

SEQ ID NO: 902807 - RNA, 22 nt, Human
uuuauugacccaaagcgagagu

SEQ ID NO: 902808 - RNA, 22 nt, Human
cugagaaaagacauuucuagau

SEQ ID NO: 902809 - RNA, 22 nt, Human
agaaggcaccguggccaauauu

SEQ ID NO: 902810 - RNA, 22 nt, Human
aaucgcuugguaauuuuaaaag

SEQ ID NO: 902811 - RNA, 22 nt, Human
ggaggugacuggaucaugggca

SEQ ID NO: 902812 - RNA, 22 nt, Human
uagaaaucuacuuagacuuucu

SEQ ID NO: 902813 - RNA, 22 nt, Human
ggcuggaagagacugaggacac

SEQ ID NO: 902814 - RNA, 22 nt, Human
gaucagugaacuauacugccuc

SEQ ID NO: 902815 - RNA, 22 nt, Human
uccccaggggcaucucucugcu

SEQ ID NO: 902816 - RNA, 22 nt, Human
auauauaucgaguucaugucuc

SEQ ID NO: 902817 - RNA, 22 nt, Human
cugcagggcagaagggcauaga

SEQ ID NO: 902818 - RNA, 22 nt, Human
ccaggcagagggauccccaucc

SEQ ID NO: 902819 - RNA, 22 nt, Human
cccaggagguggagguugcagu

SEQ ID NO: 902820 - RNA, 22 nt, Human
agccuggccacucagggccuga

SEQ ID NO: 902821 - RNA, 21 nt, Human
aaaaggaaggucuguuugggg

SEQ ID NO: 902822 - RNA, 22 nt, Human
aucuguaacaucaguagcagaa

SEQ ID NO: 902823 - RNA, 22 nt, Human
gaagaaguguaagucuguuuca

SEQ ID NO: 902824 - RNA, 22 nt, Human
agaauuuagcuccuuggucaua

SEQ ID NO: 902825 - RNA, 22 nt, Human
cugcuggcaagcccaguuggag

SEQ ID NO: 902826 - RNA, 22 nt, Human
uguuuauaaauuuucuugccau

SEQ ID NO: 902827 - RNA, 23 nt, Human
ugaacaguaugugggacauugag

SEQ ID NO: 902828 - RNA, 22 nt, Human
gcucccugcacucugcagcccu

SEQ ID NO: 902829 - RNA, 22 nt, Human
caugggcaguuggcagggcuca

SEQ ID NO: 902830 - RNA, 22 nt, Human
uuacagagcuggguggagagag

SEQ ID NO: 902831 - RNA, 22 nt, Human
acauuucuucccuuuagcagaa

SEQ ID NO: 902832 - RNA, 22 nt, Human
gucguggagcucacagugugcc

SEQ ID NO: 902833 - RNA, 22 nt, Human
ugucugcuaaauuacuauuaca

SEQ ID NO: 902834 - RNA, 22 nt, Human
caauaguucgguccugaaggcc

SEQ ID NO: 902835 - RNA, 22 nt, Human
acagagcacugcccugugccgc

SEQ ID NO: 902836 - RNA, 22 nt, Human
ucauuucaguucagaggccuuu

SEQ ID NO: 902837 - RNA, 20 nt, Human
aguggcagggaaauggaaag

SEQ ID NO: 902838 - RNA, 22 nt, Human
ugcaauauguugcauuguaugg

SEQ ID NO: 902839 - RNA, 22 nt, Human
agacucaugacacuuccuauga

SEQ ID NO: 902840 - RNA, 22 nt, Human
gaaauucaaaaugucaguauag

SEQ ID NO: 902841 - RNA, 22 nt, Human
acagcagguuacaguggcacag

SEQ ID NO: 902842 - RNA, 22 nt, Human
uuacauagauucauuuaguuaa

SEQ ID NO: 902843 - RNA, 22 nt, Human
uuccuucuuugugguagaaagu

SEQ ID NO: 902844 - RNA, 22 nt, Human
uagaacuaaagaacaacuuuga

SEQ ID NO: 902845 - RNA, 22 nt, Human
uccugcuggcaaggaagggacu

SEQ ID NO: 902846 - RNA, 22 nt, Human
gcccucuggcagccuuggcugg

SEQ ID NO: 902847 - RNA, 22 nt, Human
acagagagaaacaaucagcagc

SEQ ID NO: 902848 - RNA, 20 nt, Human
cuccccucuacagagggcug

SEQ ID NO: 902849 - RNA, 22 nt, Human
caguggcaggauuucagcucag

SEQ ID NO: 902850 - RNA, 21 nt, Human
agcuggccugguuugagcucc

SEQ ID NO: 902851 - RNA, 22 nt, Human
uguauguguccuaauucaagca

SEQ ID NO: 902852 - RNA, 22 nt, Human
caugcaucuggucuuggaaaua

SEQ ID NO: 902853 - RNA, 22 nt, Human
acagaauaagguuuaucucucc

SEQ ID NO: 902854 - RNA, 22 nt, Human
cucccacuccuggcucaccaca

SEQ ID NO: 902855 - RNA, 22 nt, Human
ccugagcuuuaaaagccaugua

SEQ ID NO: 902856 - RNA, 20 nt, Human
auucugcuuugaaaauaagg

SEQ ID NO: 902857 - RNA, 22 nt, Human
gaaguauuucugaguugcccag

SEQ ID NO: 902858 - RNA, 22 nt, Human
uggggguguccuggugcacaca

SEQ ID NO: 902859 - RNA, 22 nt, Human
aggcaauccccugaggauacuu

SEQ ID NO: 902860 - RNA, 22 nt, Human
cagccuguggcagaggucuaau

SEQ ID NO: 902861 - RNA, 22 nt, Human
cugaggcacuaacaaggacaag

SEQ ID NO: 902862 - RNA, 22 nt, Human
gauugaaauauaaauauguguu

SEQ ID NO: 902863 - RNA, 22 nt, Human
cuccugccaccgcgguguccug

SEQ ID NO: 902864 - RNA, 22 nt, Human
uggaagcggugcuggcccaugg

SEQ ID NO: 902865 - RNA, 22 nt, Human
guucacaguuuuauaccugaga

SEQ ID NO: 902866 - RNA, 22 nt, Human
gaaaagaacugcaugggauuaa

SEQ ID NO: 902867 - RNA, 22 nt, Human
cucagcagcugcugcugguggg

SEQ ID NO: 902868 - RNA, 22 nt, Human
auuuguauauuuaagaggguag

SEQ ID NO: 902869 - RNA, 22 nt, Human
caggccacgccccggcguguga

SEQ ID NO: 902870 - RNA, 22 nt, Human
gccuggcaggccucaugagggg

SEQ ID NO: 902871 - RNA, 22 nt, Human
agcugccugccaugccgcuggu

SEQ ID NO: 902872 - RNA, 22 nt, Human
ccacauuuugcuuugccuaggu

SEQ ID NO: 902873 - RNA, 22 nt, Human
gaugucuuugaggcucacugcu

SEQ ID NO: 902874 - RNA, 22 nt, Human
uaagguaauuguugcugaaauu

SEQ ID NO: 902875 - RNA, 22 nt, Human
auguccaguuucuacacacaua

SEQ ID NO: 902876 - RNA, 22 nt, Human
ggcuggaaugcaacuguguguu

SEQ ID NO: 902877 - RNA, 22 nt, Human
uuuugugagcccauaaaugcca

SEQ ID NO: 902878 - RNA, 22 nt, Human
ugugugaagcacucugggugau

SEQ ID NO: 902879 - RNA, 22 nt, Human
aaucuuggcaaauguagcuucc

SEQ ID NO: 902880 - RNA, 22 nt, Human
caggaggggguggaguuucgcc

SEQ ID NO: 902881 - RNA, 22 nt, Human
agcugugauuauccacuggaau

SEQ ID NO: 902882 - RNA, 22 nt, Human
auggcugggcuuuuagucagau

SEQ ID NO: 902883 - RNA, 22 nt, Human
ugugcucuugucugugacuaac

SEQ ID NO: 902884 - RNA, 22 nt, Human
ugugcccuuuccugcuccucca

SEQ ID NO: 902885 - RNA, 22 nt, Human
gucuuaaaaucagaggauauag

SEQ ID NO: 902886 - RNA, 22 nt, Human
uacauucagcaaaagaaugguu

SEQ ID NO: 902887 - RNA, 22 nt, Human
aggucugagcucagggccuggc

SEQ ID NO: 902888 - RNA, 20 nt, Human
ugcagcugcaggaggguggg

SEQ ID NO: 902889 - RNA, 22 nt, Human
aguuucacuaaggucugugugu

SEQ ID NO: 902890 - RNA, 19 nt, Human
ugagaggcuuaaggcagcu

SEQ ID NO: 902891 - RNA, 21 nt, Human
aucuuaaaaggucuuaacuuu

SEQ ID NO: 902892 - RNA, 22 nt, Human
gagcccugauuugcagcauuug

SEQ ID NO: 902893 - RNA, 22 nt, Human
ggagcaagucccaggcacuagu

SEQ ID NO: 902894 - RNA, 22 nt, Human
ugcccuggcucuccacuaguuu

SEQ ID NO: 902895 - RNA, 22 nt, Human
gcccagcugcacccuggugggu

SEQ ID NO: 902896 - RNA, 22 nt, Human
agaaugauagcuaguauuuacu

SEQ ID NO: 902897 - RNA, 22 nt, Human
gaaacaaucaucaugugauuug

SEQ ID NO: 902898 - RNA, 22 nt, Human
ucaaaucucacucugcauuucu

SEQ ID NO: 902899 - RNA, 22 nt, Human
ggcuuauauauuuucacuugcc

SEQ ID NO: 902900 - RNA, 22 nt, Human
gaugaucaucuguaaaguuaga

SEQ ID NO: 902901 - RNA, 22 nt, Human
cugucuguacaaauguggggcc

SEQ ID NO: 902902 - RNA, 22 nt, Human
gcacugggagucuguggggguu

SEQ ID NO: 902903 - RNA, 22 nt, Human
aaacuguccucccgagguuucc

SEQ ID NO: 902904 - RNA, 17 nt, Human
uuucaagguuacguucc

SEQ ID NO: 902905 - RNA, 22 nt, Human
agggaucagcagaggguguggu

SEQ ID NO: 902906 - RNA, 22 nt, Human
aaucaggcacagcgacugcagc

SEQ ID NO: 902907 - RNA, 22 nt, Human
ugaguucauuugagugaacacu

SEQ ID NO: 902908 - RNA, 22 nt, Human
ggagcaggcagggccgugucug

SEQ ID NO: 902909 - RNA, 22 nt, Human
gaaauguuuuacaaggcauacu

SEQ ID NO: 902910 - RNA, 22 nt, Human
gcagguguggauuugcauccag

SEQ ID NO: 902911 - RNA, 22 nt, Human
aaaugagguuaauacagugcuu

SEQ ID NO: 902912 - RNA, 22 nt, Human
cuugcugcugcaucugagcaug

SEQ ID NO: 902913 - RNA, 21 nt, Human
uucagaaguugagggcagguu

SEQ ID NO: 902914 - RNA, 22 nt, Human
cucagccaugcaacaugcuggg

SEQ ID NO: 902915 - RNA, 22 nt, Human
aaugccuuggagagccuagagg

SEQ ID NO: 902916 - RNA, 23 nt, Human
aggcccugccugucccucuuuuu

SEQ ID NO: 902917 - RNA, 22 nt, Human
uaucauuuguuauuauuagugg

SEQ ID NO: 902918 - RNA, 22 nt, Human
cagugcuaccccggaaguuggu

SEQ ID NO: 902919 - RNA, 22 nt, Human
aggaggcccuagagcucuagag

SEQ ID NO: 902920 - RNA, 22 nt, Human
uuuauauugggagucguuuuga

SEQ ID NO: 902921 - RNA, 22 nt, Human
cucuuuggccagaaaauguuuu

SEQ ID NO: 902922 - RNA, 22 nt, Human
cagauuaacacggagcuuaaca

SEQ ID NO: 902923 - RNA, 22 nt, Human
agaagccaaaugccagugaccu

SEQ ID NO: 902924 - RNA, 22 nt, Human
uccugggguguguuuugcugcu

SEQ ID NO: 902925 - RNA, 22 nt, Human
ugugccuggcauucugggcuuc

SEQ ID NO: 902926 - RNA, 22 nt, Human
acugucacuugcaacugugagg

SEQ ID NO: 902927 - RNA, 22 nt, Human
ucuaagaaaucagaugaugagg

SEQ ID NO: 902928 - RNA, 22 nt, Human
ucccaggcuggcaggcagcagu

SEQ ID NO: 902929 - RNA, 22 nt, Human
agguccagagguugaacggugg

SEQ ID NO: 902930 - RNA, 22 nt, Human
uuuauuauucuguucucucuac

SEQ ID NO: 902931 - RNA, 22 nt, Human
cucauccacccucacuaggaaa

SEQ ID NO: 902932 - RNA, 22 nt, Human
acuucucucauucagacauagc

SEQ ID NO: 902933 - RNA, 22 nt, Human
cugauaauuugcugacuuucag

SEQ ID NO: 902934 - RNA, 22 nt, Human
accacagucucgaagcacugca

SEQ ID NO: 902935 - RNA, 21 nt, Human
ugcuggcugaaaggcacagag

SEQ ID NO: 902936 - RNA, 22 nt, Human
gauuuacagguuagguccugua

SEQ ID NO: 902937 - RNA, 22 nt, Human
uggagcuggcagcggaaaaggg

SEQ ID NO: 902938 - RNA, 22 nt, Human
ugguaaggguauuauuucaucc

SEQ ID NO: 902939 - RNA, 22 nt, Human
ucccagcacgucugcuguuucu

SEQ ID NO: 902940 - RNA, 22 nt, Human
ggacaggaugcugaagaugaag

SEQ ID NO: 902941 - RNA, 22 nt, Human
gcacagaacacuggugaguccc

SEQ ID NO: 902942 - RNA, 22 nt, Human
ggaaggggucaccuccugauga

SEQ ID NO: 902943 - RNA, 22 nt, Human
gaaaaagugaccuugguagcua

SEQ ID NO: 902944 - RNA, 22 nt, Human
agucuacaacgcaagcaacaug

SEQ ID NO: 902945 - RNA, 22 nt, Human
agacagcugcucgcagagcuau

SEQ ID NO: 902946 - RNA, 22 nt, Human
ccacagaagauggggagagugg

SEQ ID NO: 902947 - RNA, 22 nt, Human
agugucuuacaugaauugauuu

SEQ ID NO: 902948 - RNA, 22 nt, Human
ggcuggcugugcccuguacucu

SEQ ID NO: 902949 - RNA, 22 nt, Human
gugaagccucggaaccaagcuc

SEQ ID NO: 902950 - RNA, 22 nt, Human
accugagccuagggagguugag

SEQ ID NO: 902951 - RNA, 22 nt, Human
gcacugaacuuuaaucauuucu

SEQ ID NO: 902952 - RNA, 22 nt, Human
aucuguacaagauuuuaugcgu

SEQ ID NO: 902953 - RNA, 22 nt, Human
acucuguaauucugaagcaccu

SEQ ID NO: 902954 - RNA, 22 nt, Human
gugucaauaaauagcggugugg

SEQ ID NO: 902955 - RNA, 22 nt, Human
ugcucuccugcuccucagccca

SEQ ID NO: 902956 - RNA, 22 nt, Human
uggcuuccugcacagugucugc

SEQ ID NO: 902957 - RNA, 22 nt, Human
ugaggucugcagggcugugcau

SEQ ID NO: 902958 - RNA, 22 nt, Human
auguguauguguauacacacag

SEQ ID NO: 902959 - RNA, 22 nt, Human
ugcuggaggagaagguugcuca

SEQ ID NO: 902960 - RNA, 22 nt, Human
aaggaaaugaagcugauguugg

SEQ ID NO: 902961 - RNA, 22 nt, Human
gcuuccugucccucagccauga

SEQ ID NO: 902962 - RNA, 22 nt, Human
cugugucccaguaccuugggua

SEQ ID NO: 902963 - RNA, 22 nt, Human
ucucuguagcagcuuccuuccu

SEQ ID NO: 902964 - RNA, 22 nt, Human
cccagccaagugaucugaccgc

SEQ ID NO: 902965 - RNA, 22 nt, Human
uucucauucugacucaguguag

SEQ ID NO: 902966 - RNA, 22 nt, Human
ucaaaggaauuugauuuugaug

SEQ ID NO: 902967 - RNA, 22 nt, Human
gugaccauuugacauauccuug

SEQ ID NO: 902968 - RNA, 22 nt, Human
ugcccugcuguggcucugccca

SEQ ID NO: 902969 - RNA, 20 nt, Human
ugugucuuccuuucuuuaug

SEQ ID NO: 902970 - RNA, 22 nt, Human
auugaaacaaguugcuuucuau

SEQ ID NO: 902971 - RNA, 22 nt, Human
uaucuguauucugacagucacu

SEQ ID NO: 902972 - RNA, 22 nt, Human
uuuuuauaccaccucucacuua

SEQ ID NO: 902973 - RNA, 22 nt, Human
uauuccaaaauaguuaagcacu

SEQ ID NO: 902974 - RNA, 22 nt, Human
gacauuuauuggauuuuacgag

SEQ ID NO: 902975 - RNA, 22 nt, Human
uccugggaagagaccugagcau

SEQ ID NO: 902976 - RNA, 22 nt, Human
auauaugcauguguacuuaugu

SEQ ID NO: 902977 - RNA, 22 nt, Human
ugggccccuugguuuccugagc

SEQ ID NO: 902978 - RNA, 22 nt, Human
gugcaauaaauaaauagauugu

SEQ ID NO: 902979 - RNA, 22 nt, Human
uccacagguccucuuugcaaag

SEQ ID NO: 902980 - RNA, 22 nt, Human
uucucuccagacugcagugggu

SEQ ID NO: 902981 - RNA, 22 nt, Human
uccugcagcugaagcucaugug

SEQ ID NO: 902982 - RNA, 22 nt, Human
uuucacagugcucuguaaguau

SEQ ID NO: 902983 - RNA, 22 nt, Human
ucugagagauacaaggaggcaa

SEQ ID NO: 902984 - RNA, 22 nt, Human
ucuucagagcauuucugaggua

SEQ ID NO: 902985 - RNA, 19 nt, Human
gaggaggaaaacuagugua

SEQ ID NO: 902986 - RNA, 22 nt, Human
acucagagccucgagggacugc

SEQ ID NO: 902987 - RNA, 21 nt, Human
uguaacaaaauacugcagauu

SEQ ID NO: 902988 - RNA, 22 nt, Human
ugcaggagcagagauggcugga

SEQ ID NO: 902989 - RNA, 22 nt, Human
uguauucuuaguuuuaaucaga

SEQ ID NO: 902990 - RNA, 23 nt, Human
uaccugaaguaagcauucaucca

SEQ ID NO: 902991 - RNA, 22 nt, Human
acucugagccaccagaucccca

SEQ ID NO: 902992 - RNA, 22 nt, Human
agauuuccagaccaauuucuca

SEQ ID NO: 902993 - RNA, 22 nt, Human
agcaaggggcagugaaagugug

SEQ ID NO: 902994 - RNA, 19 nt, Human
aucuuuagcaacuuucaaa

SEQ ID NO: 902995 - RNA, 22 nt, Human
ucacacacauaaucuaagauua

SEQ ID NO: 902996 - RNA, 22 nt, Human
cugugccuuuguagcugugccu

SEQ ID NO: 902997 - RNA, 22 nt, Human
ugagcagaggagugacguaggu

SEQ ID NO: 902998 - RNA, 22 nt, Human
gaauaguucuauggcugcaggg

SEQ ID NO: 902999 - RNA, 23 nt, Human
ucagugcuugggggugacgcgcc

SEQ ID NO: 903000 - RNA, 22 nt, Human
acaauguuuugaaacaucuagg

SEQ ID NO: 903001 - RNA, 22 nt, Human
auuucccaacacauuagaaaau

SEQ ID NO: 903002 - RNA, 22 nt, Human
agcagauauuuguugagcacuu

SEQ ID NO: 903003 - RNA, 18 nt, Human
ggcagggaaaagauaggg

SEQ ID NO: 903004 - RNA, 22 nt, Human
auaaucauucacauaaggugcu

SEQ ID NO: 903005 - RNA, 22 nt, Human
caggguggaagcuguagagugg

SEQ ID NO: 903006 - RNA, 22 nt, Human
ccugucugcggaggaguggaag

SEQ ID NO: 903007 - RNA, 22 nt, Human
ccugagaauaauucuccauagc

SEQ ID NO: 903008 - RNA, 22 nt, Human
aauuauauuguggugugaaugu

SEQ ID NO: 903009 - RNA, 22 nt, Human
auaguuacaaagacuuuuuaaa

SEQ ID NO: 903010 - RNA, 22 nt, Human
gaaauuaaccaccuuuggcuuu

SEQ ID NO: 903011 - RNA, 22 nt, Human
agggcuggcuaggugcguuccc

SEQ ID NO: 903012 - RNA, 22 nt, Human
uagcugccagaccauucuuacu

SEQ ID NO: 903013 - RNA, 22 nt, Human
ugcagggugcacaguggggugc

SEQ ID NO: 903014 - RNA, 22 nt, Human
guucaauuucagcauccauuga

SEQ ID NO: 903015 - RNA, 22 nt, Human
cugcaaauaggggugugaauaa

SEQ ID NO: 903016 - RNA, 22 nt, Human
auucuaaugcccuggccccagc

SEQ ID NO: 903017 - RNA, 22 nt, Human
accgggcuaauuuuuguaucuu

SEQ ID NO: 903018 - RNA, 22 nt, Human
aaguggggccuggugguacagu

SEQ ID NO: 903019 - RNA, 22 nt, Human
uucucugaaggccaugcucacu

SEQ ID NO: 903020 - RNA, 22 nt, Human
ucagaaguccccagucaaggag

SEQ ID NO: 903021 - RNA, 22 nt, Human
caacaguauagcuuuugacugc

SEQ ID NO: 903022 - RNA, 22 nt, Human
gaaacaauacuuguccucacua

SEQ ID NO: 903023 - RNA, 22 nt, Human
ugccacaguuguuugugcucua

SEQ ID NO: 903024 - RNA, 22 nt, Human
acauucaugcaccuuccuaucc

SEQ ID NO: 903025 - RNA, 22 nt, Human
cgauuuccgcuugaucugaucu

SEQ ID NO: 903026 - RNA, 22 nt, Human
cugaaaggcaguggguagugug

SEQ ID NO: 903027 - RNA, 22 nt, Human
gcugucaguuuuacccacagac

SEQ ID NO: 903028 - RNA, 22 nt, Human
ccaguccuggccaguaacauga

SEQ ID NO: 903029 - RNA, 22 nt, Human
aaagucuaaauuauucaauaag

SEQ ID NO: 903030 - RNA, 22 nt, Human
aauguucagcgagggaugcuag

SEQ ID NO: 903031 - RNA, 20 nt, Human
aacuuguuuuguuuucuaau

SEQ ID NO: 903032 - RNA, 22 nt, Human
cccaggcugccacgauuacugc

SEQ ID NO: 903033 - RNA, 22 nt, Human
agugugugcuguuccccggagg

SEQ ID NO: 903034 - RNA, 22 nt, Human
aucaaagagugagauuuuuacu

SEQ ID NO: 903035 - RNA, 23 nt, Human
ccccacuaccgugaugugcgagg

SEQ ID NO: 903036 - RNA, 22 nt, Human
cugccucuauaggaguccacca

SEQ ID NO: 903037 - RNA, 17 nt, Human
uuccuugggugcugggu

SEQ ID NO: 903038 - RNA, 23 nt, Human
ucuuuacauacugaugaguucuc

SEQ ID NO: 903039 - RNA, 22 nt, Human
ccauguggugggaaggagaaug

SEQ ID NO: 903040 - RNA, 22 nt, Human
aggacuaauuucaggggauaua

SEQ ID NO: 903041 - RNA, 19 nt, Human
uucacaagugaugucucuc

SEQ ID NO: 903042 - RNA, 22 nt, Human
aaugaguucugacacuucacga

SEQ ID NO: 903043 - RNA, 22 nt, Human
acagugauuauuaguugguggu

SEQ ID NO: 903044 - RNA, 22 nt, Human
aguguuuauggaaucuuaguua

SEQ ID NO: 903045 - RNA, 20 nt, Human
ucuuacaaucguuacaucca

SEQ ID NO: 903046 - RNA, 22 nt, Human
caggccagugggaaauagggau

SEQ ID NO: 903047 - RNA, 22 nt, Human
uguuucuugggugcucacauca

SEQ ID NO: 903048 - RNA, 22 nt, Human
ugcccacuggauaaugcaaacu

SEQ ID NO: 903049 - RNA, 22 nt, Human
ggucauugaaaucagaaggguu

SEQ ID NO: 903050 - RNA, 22 nt, Human
aaaugccuauuuguuccuucag

SEQ ID NO: 903051 - RNA, 22 nt, Human
uauguacucaucaacuauugaa

SEQ ID NO: 903052 - RNA, 22 nt, Human
uuuuucuaauggcuuaggaugu

SEQ ID NO: 903053 - RNA, 22 nt, Human
gccuggauuacaaacagccaac

SEQ ID NO: 903054 - RNA, 22 nt, Human
agcuggcagagcauuuguggcc

SEQ ID NO: 903055 - RNA, 22 nt, Human
agaauuagcugggcagauuccu

SEQ ID NO: 903056 - RNA, 22 nt, Human
ucacccagggacugugauggaa

SEQ ID NO: 903057 - RNA, 22 nt, Human
ggcaugagagguccuggggauu

SEQ ID NO: 903058 - RNA, 22 nt, Human
aaggccagauucucucuagggg

SEQ ID NO: 903059 - RNA, 22 nt, Human
gagcagcuagauaaagcccuuc

SEQ ID NO: 903060 - RNA, 22 nt, Human
aacuacuauucuuuuccaaacu

SEQ ID NO: 903061 - RNA, 22 nt, Human
ggcuccagggaguggagagaag

SEQ ID NO: 903062 - RNA, 22 nt, Human
agggaggaaggauguuccaaag

SEQ ID NO: 903063 - RNA, 22 nt, Human
cuugugcauuucauuccucagg

SEQ ID NO: 903064 - RNA, 22 nt, Human
agcaccagagcuaugggccugc

SEQ ID NO: 903065 - RNA, 22 nt, Human
acaguaaugcauacaaguuagu

SEQ ID NO: 903066 - RNA, 22 nt, Human
caaggcucugcuucuaucacau

SEQ ID NO: 903067 - RNA, 22 nt, Human
agagccagguguagucucggag

SEQ ID NO: 903068 - RNA, 19 nt, Human
uuuagaaguugaaacucug

SEQ ID NO: 903069 - RNA, 22 nt, Human
uaagaaucugcauuuuaacaag

SEQ ID NO: 903070 - RNA, 22 nt, Human
agccagacauggcuccugcucc

SEQ ID NO: 903071 - RNA, 22 nt, Human
gcaggcugaguauuacccuagu

SEQ ID NO: 903072 - RNA, 22 nt, Human
uguuagccucaugcuuaauagg

SEQ ID NO: 903073 - RNA, 22 nt, Human
auaaugcaccuuugaguauggc

SEQ ID NO: 903074 - RNA, 22 nt, Human
ggaggugacgaaaagaaauugu

SEQ ID NO: 903075 - RNA, 22 nt, Human
agcuaagauuuauuaaaggccc

SEQ ID NO: 903076 - RNA, 22 nt, Human
uucauugugaacacauucugcc

SEQ ID NO: 903077 - RNA, 22 nt, Human
caaggccuucgucuccuagcuu

SEQ ID NO: 903078 - RNA, 22 nt, Human
cugucccagauguucucagcac

SEQ ID NO: 903079 - RNA, 22 nt, Human
uauugcugacuuguucaguguu

SEQ ID NO: 903080 - RNA, 22 nt, Human
cugagaggaacaucuuaugcuu

SEQ ID NO: 903081 - RNA, 21 nt, Human
agagaaagucauggcuguggc

SEQ ID NO: 903082 - RNA, 22 nt, Human
aaacuuuaggaaggaauuuaca

SEQ ID NO: 903083 - RNA, 22 nt, Human
cauguacaaaaggcaaaugccu

SEQ ID NO: 903084 - RNA, 22 nt, Human
gcauggcaagacccugucucua

SEQ ID NO: 903085 - RNA, 22 nt, Human
cacagcugccauggcugcacuu

SEQ ID NO: 903086 - RNA, 22 nt, Human
gcccuguggauuaaugagcagg

SEQ ID NO: 903087 - RNA, 22 nt, Human
ccaggcccguucccuucuccag

SEQ ID NO: 903088 - RNA, 22 nt, Human
uagagcuguaucaaagagccuu

SEQ ID NO: 903089 - RNA, 22 nt, Human
uuugccugauucuaagagcuca

SEQ ID NO: 903090 - RNA, 22 nt, Human
ucuguggguagagugaguacuu

SEQ ID NO: 903091 - RNA, 22 nt, Human
ucugucuuuagaggccugugcu

SEQ ID NO: 903092 - RNA, 22 nt, Human
cuggccaggcuugggacagaca

SEQ ID NO: 903093 - RNA, 22 nt, Human
aacaugcaaagcuaugauguau

SEQ ID NO: 903094 - RNA, 22 nt, Human
aauuugggcgaggagggaggca

SEQ ID NO: 903095 - RNA, 22 nt, Human
auguuucagggugauagaaggu

SEQ ID NO: 903096 - RNA, 22 nt, Human
agucuauuuucagaagcaguuu

SEQ ID NO: 903097 - RNA, 22 nt, Human
cuuuuacugugaaaagaaacug

SEQ ID NO: 903098 - RNA, 22 nt, Human
ccacugcucugccaggagcugg

SEQ ID NO: 903099 - RNA, 22 nt, Human
ugucacauauauaauguucaau

SEQ ID NO: 903100 - RNA, 22 nt, Human
gcaguuaugugaaucaugugac

SEQ ID NO: 903101 - RNA, 23 nt, Human
uccaggagaauuccagggcccgg

SEQ ID NO: 903102 - RNA, 17 nt, Human
gcuuccucaugcaguuc

SEQ ID NO: 903103 - RNA, 22 nt, Human
acagaauuaaaguguuugugga

SEQ ID NO: 903104 - RNA, 22 nt, Human
cauguguagguauacaaaauuc

SEQ ID NO: 903105 - RNA, 22 nt, Human
ccugcccuucuuuccccagcau

SEQ ID NO: 903106 - RNA, 21 nt, Human
aaggcuccuccucuaggccuc

SEQ ID NO: 903107 - RNA, 22 nt, Human
aucagagaccggucaagucaug

SEQ ID NO: 903108 - RNA, 22 nt, Human
gugcugaauugugcucuuuaca

SEQ ID NO: 903109 - RNA, 22 nt, Human
cagcaagagaggcagggcaaau

SEQ ID NO: 903110 - RNA, 22 nt, Human
ucagauuuugcacgagguuuug

SEQ ID NO: 903111 - RNA, 22 nt, Human
augcauauuuucuguuggugac

SEQ ID NO: 903112 - RNA, 22 nt, Human
ggggacugccuuccacagacac

SEQ ID NO: 903113 - RNA, 22 nt, Human
ucuaugucagcaucuuucuacc

SEQ ID NO: 903114 - RNA, 21 nt, Human
gaagacaaaugggaauagcug

SEQ ID NO: 903115 - RNA, 22 nt, Human
agugugcuauugcaccaucaua

SEQ ID NO: 903116 - RNA, 22 nt, Human
ugccaagugcuuacuuggcccu

SEQ ID NO: 903117 - RNA, 22 nt, Human
agccuaggucugggucuagcag

SEQ ID NO: 903118 - RNA, 22 nt, Human
uuugaaagccuggcuuuucucu

SEQ ID NO: 903119 - RNA, 22 nt, Human
agcagcuggguccggcggagca

SEQ ID NO: 903120 - RNA, 19 nt, Human
uaaaacgugcauggcagca

SEQ ID NO: 903121 - RNA, 22 nt, Human
auuugcaauuuuacuuugcagu

SEQ ID NO: 903122 - RNA, 22 nt, Human
acugguuuuggaaaucaguaca

SEQ ID NO: 903123 - RNA, 22 nt, Human
auuagcuauaugcuaugugcca

SEQ ID NO: 903124 - RNA, 22 nt, Human
guggagcaugugaggacugagu

SEQ ID NO: 903125 - RNA, 22 nt, Human
ugccuagggccuaaccagagcc

SEQ ID NO: 903126 - RNA, 22 nt, Human
auacugaauuagguaaagcaua

SEQ ID NO: 903127 - RNA, 22 nt, Human
cccuggaggaaaaucugaggcu

SEQ ID NO: 903128 - RNA, 22 nt, Human
ucugagaacuccggguuagauc

SEQ ID NO: 903129 - RNA, 22 nt, Human
uacccaguuauuuugucuuugu

SEQ ID NO: 903130 - RNA, 23 nt, Human
ccuucuguuaaccaucugggggg

SEQ ID NO: 903131 - RNA, 22 nt, Human
aagccuaggccuacucugguuu

SEQ ID NO: 903132 - RNA, 22 nt, Human
gcccuguugucggacgucaagg

SEQ ID NO: 903133 - RNA, 22 nt, Human
gugcaggggccuccccuugcug

SEQ ID NO: 903134 - RNA, 22 nt, Human
agacaguguguguauauauggu

SEQ ID NO: 903135 - RNA, 22 nt, Human
acaaugaaagcaagaagacggc

SEQ ID NO: 903136 - RNA, 22 nt, Human
aagaugaugcagacuuugaugu

SEQ ID NO: 903137 - RNA, 22 nt, Human
aggcuccaccccgccagaccuu

SEQ ID NO: 903138 - RNA, 19 nt, Human
gucuuggcucucaaccauc

SEQ ID NO: 903139 - RNA, 22 nt, Human
gaaucaauuauccaggcuguug

SEQ ID NO: 903140 - RNA, 22 nt, Human
ugacauguaguuagaaaauagg

SEQ ID NO: 903141 - RNA, 22 nt, Human
cucugggcuuguugaccugcac

SEQ ID NO: 903142 - RNA, 22 nt, Human
cacacacaguuuuguauucugu

SEQ ID NO: 903143 - RNA, 22 nt, Human
ccaggcaaguagaagcuguggu

SEQ ID NO: 903144 - RNA, 23 nt, Human
cagguggcuccacgagggguggg

SEQ ID NO: 903145 - RNA, 22 nt, Human
cugaaggagaaggccacuguuc

SEQ ID NO: 903146 - RNA, 21 nt, Human
aggaggccaguacugcugaac

SEQ ID NO: 903147 - RNA, 22 nt, Human
ggggacccucaggacugcgucu

SEQ ID NO: 903148 - RNA, 22 nt, Human
aggcuucuuuuagaggggaugg

SEQ ID NO: 903149 - RNA, 22 nt, Human
gaguccuucuggcuggcaggau

SEQ ID NO: 903150 - RNA, 22 nt, Human
gcagguggauauugcuacuuga

SEQ ID NO: 903151 - RNA, 22 nt, Human
cuagccagaugauucccaaaua

SEQ ID NO: 903152 - RNA, 22 nt, Human
ucuguccaacacucucuagaca

SEQ ID NO: 903153 - RNA, 22 nt, Human
cccagggguaaggcgcagcgug

SEQ ID NO: 903154 - RNA, 22 nt, Human
caugugucaaaugauguagcug

SEQ ID NO: 903155 - RNA, 22 nt, Human
ucaaaucagcaagcagcuuccc

SEQ ID NO: 903156 - RNA, 22 nt, Human
ugaggcucagugagcccugcag

SEQ ID NO: 903157 - RNA, 22 nt, Human
agcccagccugauucuacaccc

SEQ ID NO: 903158 - RNA, 22 nt, Human
acagcugugaagcaagcacucu

SEQ ID NO: 903159 - RNA, 22 nt, Human
uggagguggcaucugacagcug

SEQ ID NO: 903160 - RNA, 22 nt, Human
auauuuucacugaaccaaagua

SEQ ID NO: 903161 - RNA, 22 nt, Human
aacaugaaaagcccagagaggu

SEQ ID NO: 903162 - RNA, 22 nt, Human
ucauagaagcaccagaagauau

SEQ ID NO: 903163 - RNA, 22 nt, Human
ggcacaguuuucuacauaugcu

SEQ ID NO: 903164 - RNA, 22 nt, Human
aguacacacaguagaauagagu

SEQ ID NO: 903165 - RNA, 22 nt, Human
ucuggcucugacacuacuguua

SEQ ID NO: 903166 - RNA, 22 nt, Human
gcuguucugcaccagacuucag

SEQ ID NO: 903167 - RNA, 22 nt, Human
guacauaaaggaggcucuuugc

SEQ ID NO: 903168 - RNA, 22 nt, Human
uagcucuggagucuucucagaa

SEQ ID NO: 903169 - RNA, 22 nt, Human
gguggcagucuuaagagaucuu

SEQ ID NO: 903170 - RNA, 18 nt, Human
gcuuucuguagaaaaggg

SEQ ID NO: 903171 - RNA, 22 nt, Human
uucuaacuuaacacuccuguga

SEQ ID NO: 903172 - RNA, 22 nt, Human
gauuuagugcugaaaucccugg

SEQ ID NO: 903173 - RNA, 22 nt, Human
ccugagcucugcacuuuuuaga

SEQ ID NO: 903174 - RNA, 22 nt, Human
cugaagcauaucaugccaaguu

SEQ ID NO: 903175 - RNA, 22 nt, Human
cccauuuagaguauaagagaga

SEQ ID NO: 903176 - RNA, 22 nt, Human
uuuuaaguuggauugcuaagua

SEQ ID NO: 903177 - RNA, 22 nt, Human
cagagacaguuucacagggucu

SEQ ID NO: 903178 - RNA, 22 nt, Human
cagaagcaaaugccuugcugag

SEQ ID NO: 903179 - RNA, 20 nt, Human
aggcugccaggucucacauc

SEQ ID NO: 903180 - RNA, 22 nt, Human
auguguacaaccaagcacuaaa

SEQ ID NO: 903181 - RNA, 22 nt, Human
aagcaucaacacuauauugaug

SEQ ID NO: 903182 - RNA, 21 nt, Human
gccuagggagaugggacugcc

SEQ ID NO: 903183 - RNA, 18 nt, Human
auacaagcagcagagauu

SEQ ID NO: 903184 - RNA, 22 nt, Human
uucuaaguuacuguuauggucu

SEQ ID NO: 903185 - RNA, 22 nt, Human
uuacaguuuauccaggaagagc

SEQ ID NO: 903186 - RNA, 18 nt, Human
cucagggcaucagucugg

SEQ ID NO: 903187 - RNA, 22 nt, Human
uggcacuuuacacccauuuggc

SEQ ID NO: 903188 - RNA, 22 nt, Human
uggcccugacagguccugggca

SEQ ID NO: 903189 - RNA, 22 nt, Human
cugagccaaaaagcagagcuug

SEQ ID NO: 903190 - RNA, 22 nt, Human
aaagaguucuguuugagcugaa

SEQ ID NO: 903191 - RNA, 22 nt, Human
gcugugagccgcugcugagcau

SEQ ID NO: 903192 - RNA, 22 nt, Human
ugauaguaucugauuauuucac

SEQ ID NO: 903193 - RNA, 22 nt, Human
acugcagagguggggugcagag

SEQ ID NO: 903194 - RNA, 22 nt, Human
agggcccaggacagcaucaggg

SEQ ID NO: 903195 - RNA, 22 nt, Human
gugagcuuugugguaaugaagu

SEQ ID NO: 903196 - RNA, 22 nt, Human
ccuucuagcaaaucaacauaaa

SEQ ID NO: 903197 - RNA, 22 nt, Human
uucuguuuacucagaaauacaa

SEQ ID NO: 903198 - RNA, 22 nt, Human
aucaaauuaugugcuacaagaa

SEQ ID NO: 903199 - RNA, 22 nt, Human
gcacaguaccugucacagaggc

SEQ ID NO: 903200 - RNA, 22 nt, Human
ucauuuucaaguuugaacagga

SEQ ID NO: 903201 - RNA, 22 nt, Human
uggcagagaauaaaucuugacu

SEQ ID NO: 903202 - RNA, 22 nt, Human
acaugaauauaugaaguucaac

SEQ ID NO: 903203 - RNA, 22 nt, Human
ucugggugcuacaaacaguauu

SEQ ID NO: 903204 - RNA, 18 nt, Human
gcugcugguggagggagc

SEQ ID NO: 903205 - RNA, 21 nt, Human
aggcccagagucuugggggga

SEQ ID NO: 903206 - RNA, 22 nt, Human
cuagagcagauugcagaguagg

SEQ ID NO: 903207 - RNA, 20 nt, Human
uggaagaggagaugccucug

SEQ ID NO: 903208 - RNA, 22 nt, Human
gaggcucaguuaugucaucagg

SEQ ID NO: 903209 - RNA, 22 nt, Human
uaugucuuuaguaucuuuugga

SEQ ID NO: 903210 - RNA, 22 nt, Human
agcugggcuggagcuccaagcg

SEQ ID NO: 903211 - RNA, 22 nt, Human
uggcagagagacucuccuugau

SEQ ID NO: 903212 - RNA, 22 nt, Human
caggcacuggccagucagcaca

SEQ ID NO: 903213 - RNA, 22 nt, Human
cagaggaagcagacacaucuug

SEQ ID NO: 903214 - RNA, 22 nt, Human
gccauggggcucagcugcacua

SEQ ID NO: 903215 - RNA, 22 nt, Human
ggccuugggcuggcugcaguau

SEQ ID NO: 903216 - RNA, 22 nt, Human
caucaguguugauccaccagca

SEQ ID NO: 903217 - RNA, 22 nt, Human
ugaggaggucagagucuggcug

SEQ ID NO: 903218 - RNA, 22 nt, Human
cugcagaggucuugcugauggu

SEQ ID NO: 903219 - RNA, 22 nt, Human
uucaacacaggaacaugauaua

SEQ ID NO: 903220 - RNA, 22 nt, Human
ucugggagagaguugauaaagg

SEQ ID NO: 903221 - RNA, 22 nt, Human
uuaaagaguaaucauaggucaa

SEQ ID NO: 903222 - RNA, 22 nt, Human
uugauuuauagaauguucaagc

SEQ ID NO: 903223 - RNA, 22 nt, Human
aggaacuggugggaggugauug

SEQ ID NO: 903224 - RNA, 22 nt, Human
uucuguguucugugcaaugagc

SEQ ID NO: 903225 - RNA, 22 nt, Human
ucuuagaaaugaaguucuuucu

SEQ ID NO: 903226 - RNA, 22 nt, Human
gcuguggaguacagagcugguu

SEQ ID NO: 903227 - RNA, 22 nt, Human
aggaggagguaagaaaagcaua

SEQ ID NO: 903228 - RNA, 22 nt, Human
aagagaugaagguccugacugu

SEQ ID NO: 903229 - RNA, 20 nt, Human
gguccuugucacaaggagag

SEQ ID NO: 903230 - RNA, 22 nt, Human
ucaauuacagugucaccuuaag

SEQ ID NO: 903231 - RNA, 22 nt, Human
uaggcaaguggaccagagguuu

SEQ ID NO: 903232 - RNA, 22 nt, Human
ugagguauacguugguucaguc

SEQ ID NO: 903233 - RNA, 22 nt, Human
uggccacagccucugccaguuc

SEQ ID NO: 903234 - RNA, 22 nt, Human
gagaggaagccuucuguacuug

SEQ ID NO: 903235 - RNA, 22 nt, Human
gcauucaucuuccuccaugcag

SEQ ID NO: 903236 - RNA, 22 nt, Human
gaauucuagucacacacauuca

SEQ ID NO: 903237 - RNA, 22 nt, Human
ucaggguauguucuagaucuga

SEQ ID NO: 903238 - RNA, 22 nt, Human
cuuaaagaugucaaggcuguuu

SEQ ID NO: 903239 - RNA, 22 nt, Human
auagcauacauguuguuacuug

SEQ ID NO: 903240 - RNA, 20 nt, Human
uccagagaguggcaaagcuc

SEQ ID NO: 903241 - RNA, 20 nt, Human
ucugauaacugguugugauu

SEQ ID NO: 903242 - RNA, 20 nt, Human
uuuagaagaaugagcacuuu

SEQ ID NO: 903243 - RNA, 22 nt, Human
ccagcagcuguggcuuugccuc

SEQ ID NO: 903244 - RNA, 22 nt, Human
uucuguggagguuuggaacauu

SEQ ID NO: 903245 - RNA, 22 nt, Human
aggcaguuguagagagggcucu

SEQ ID NO: 903246 - RNA, 22 nt, Human
uaauccaggguauucuaguuuc

SEQ ID NO: 903247 - RNA, 22 nt, Human
gcuguuagagaauuagaguggg

SEQ ID NO: 903248 - RNA, 22 nt, Human
agaguucuugcccuagaaaaug

SEQ ID NO: 903249 - RNA, 21 nt, Human
ccagcugucuguccuuaggca

SEQ ID NO: 903250 - RNA, 22 nt, Human
aaggcacucauucaaggagaua

SEQ ID NO: 903251 - RNA, 22 nt, Human
ugagacagcccuucugcacagg

SEQ ID NO: 903252 - RNA, 22 nt, Human
uauucuugucuuuuccagaaau

SEQ ID NO: 903253 - RNA, 22 nt, Human
ucucuuucuuuguaugucuauu

SEQ ID NO: 903254 - RNA, 22 nt, Human
aacaugcuaugugucugaauca

SEQ ID NO: 903255 - RNA, 18 nt, Human
augugcaauuuuguauuu

SEQ ID NO: 903256 - RNA, 22 nt, Human
aaggaagcagcaaugcaugauu

SEQ ID NO: 903257 - RNA, 22 nt, Human
auuuguucacaaucagggcagg

SEQ ID NO: 903258 - RNA, 22 nt, Human
gcucuggagagccauaggcccu

SEQ ID NO: 903259 - RNA, 20 nt, Human
ugcaaggccagggucaggag

SEQ ID NO: 903260 - RNA, 22 nt, Human
agagucagaaagcagacagggg

SEQ ID NO: 903261 - RNA, 22 nt, Human
aggcuccguccagucucaggcc

SEQ ID NO: 903262 - RNA, 16 nt, Human
agccaggcugccucgg

SEQ ID NO: 903263 - RNA, 19 nt, Human
gggcaguggcacuagggag

SEQ ID NO: 903264 - RNA, 22 nt, Human
ugucacauaggcaaaauguuuu

SEQ ID NO: 903265 - RNA, 22 nt, Human
cuuccucuguguccugggcuuc

SEQ ID NO: 903266 - RNA, 22 nt, Human
ccugaagcacccggagcuggca

SEQ ID NO: 903267 - RNA, 22 nt, Human
auaggucugaaaguguauccug

SEQ ID NO: 903268 - RNA, 22 nt, Human
uccuguguucaagucauucauu

SEQ ID NO: 903269 - RNA, 22 nt, Human
auucucagggaguauuuucuau

SEQ ID NO: 903270 - RNA, 22 nt, Human
uuccaugaguagcaguauuucc

SEQ ID NO: 903271 - RNA, 22 nt, Human
agagcuggcugcugcggugcuu

SEQ ID NO: 903272 - RNA, 22 nt, Human
ccaguaguuggacaaauagauu

SEQ ID NO: 903273 - RNA, 22 nt, Human
auuucaguaguccuuacuugua

SEQ ID NO: 903274 - RNA, 22 nt, Human
ccagcuggcacuguggcugccc

SEQ ID NO: 903275 - RNA, 22 nt, Human
gggucucuccuccccagcugug

SEQ ID NO: 903276 - RNA, 22 nt, Human
ugcaauaaagugcuauaaaucc

SEQ ID NO: 903277 - RNA, 22 nt, Human
uaggaccagcagggucaggguc

SEQ ID NO: 903278 - RNA, 22 nt, Human
acuccagaauccuagggucagc

SEQ ID NO: 903279 - RNA, 22 nt, Human
ggaaaucucuuuugugguguuu

SEQ ID NO: 903280 - RNA, 22 nt, Human
uucccuuccucacucuacuugu

SEQ ID NO: 903281 - RNA, 22 nt, Human
aggagaaggaagugcaucacua

SEQ ID NO: 903282 - RNA, 22 nt, Human
cagacaggguggguuucugggc

SEQ ID NO: 903283 - RNA, 22 nt, Human
gcccacaguacgaggcucaggc

SEQ ID NO: 903284 - RNA, 22 nt, Human
ucacucugagaggucacuggaa

SEQ ID NO: 903285 - RNA, 22 nt, Human
cagggcugaagaaauucaaaag

SEQ ID NO: 903286 - RNA, 22 nt, Human
cugcucucuguuccccuggauc

SEQ ID NO: 903287 - RNA, 22 nt, Human
gggcugggaauggcuaaguaug

SEQ ID NO: 903288 - RNA, 22 nt, Human
guaauaccuuucuaacacuuga

SEQ ID NO: 903289 - RNA, 22 nt, Human
aagaauaaguagaugggagaag

SEQ ID NO: 903290 - RNA, 22 nt, Human
auucauuggcuugaacuccacc

SEQ ID NO: 903291 - RNA, 22 nt, Human
aagguagguuaaccugcaggag

SEQ ID NO: 903292 - RNA, 22 nt, Human
uugaaacuaugaagacaaccau

SEQ ID NO: 903293 - RNA, 22 nt, Human
uuuauagucgucucaguaauaa

SEQ ID NO: 903294 - RNA, 22 nt, Human
uccagcuggggcaguggcuggg

SEQ ID NO: 903295 - RNA, 22 nt, Human
ucucugugugccuucaucugcc

SEQ ID NO: 903296 - RNA, 20 nt, Human
cccaggcagagcuagcggca

SEQ ID NO: 903297 - RNA, 22 nt, Human
ccagggcuggugggagaugcug

SEQ ID NO: 903298 - RNA, 22 nt, Human
caguaugucuacuggacaaagu

SEQ ID NO: 903299 - RNA, 22 nt, Human
uggaaugagcuggcuaauaacc

SEQ ID NO: 903300 - RNA, 22 nt, Human
gggaaugaccuuaauaaguagg

SEQ ID NO: 903301 - RNA, 20 nt, Human
cgcagcaguggaaguggaau

SEQ ID NO: 903302 - RNA, 22 nt, Human
gucaaucagaaaucauguuaca

SEQ ID NO: 903303 - RNA, 18 nt, Human
uauguauaacauaguuca

SEQ ID NO: 903304 - RNA, 22 nt, Human
aucagcuggaacaagugucuga

SEQ ID NO: 903305 - RNA, 22 nt, Human
cccacagggcugcugauggcag

SEQ ID NO: 903306 - RNA, 22 nt, Human
cuuccaguaguaucauucucau

SEQ ID NO: 903307 - RNA, 22 nt, Human
agucuucucauuucacaugcuu

SEQ ID NO: 903308 - RNA, 22 nt, Human
cagggaugagagauggcacaga

SEQ ID NO: 903309 - RNA, 22 nt, Human
ggugcugggaacgaggaauuca

SEQ ID NO: 903310 - RNA, 22 nt, Human
cuguuuaucuaggaguugcagg

SEQ ID NO: 903311 - RNA, 22 nt, Human
aaguguuuuggcuucuguacac

SEQ ID NO: 903312 - RNA, 22 nt, Human
aauaauacaugagauuaauguu

SEQ ID NO: 903313 - RNA, 22 nt, Human
cagcagugugcaggugugcugg

SEQ ID NO: 903314 - RNA, 22 nt, Human
uuccuucuggaggcuccagggg

SEQ ID NO: 903315 - RNA, 22 nt, Human
ugaaucaauugucuuaagacau

SEQ ID NO: 903316 - RNA, 22 nt, Human
acuucaaaugugacaaugugaa

SEQ ID NO: 903317 - RNA, 22 nt, Human
ggccaugccugugggugcaggc

SEQ ID NO: 903318 - RNA, 22 nt, Human
uaguguuccagaagcaaacaag

SEQ ID NO: 903319 - RNA, 18 nt, Human
gagcucugccucccaguc

SEQ ID NO: 903320 - RNA, 22 nt, Human
gucacaggcaguaacuaggacc

SEQ ID NO: 903321 - RNA, 21 nt, Human
uuguuuccucccaaaaugcca

SEQ ID NO: 903322 - RNA, 22 nt, Human
caggucuucuucagcacuugga

SEQ ID NO: 903323 - RNA, 22 nt, Human
aggacugggugcagagggcauc

SEQ ID NO: 903324 - RNA, 20 nt, Human
ugucagauaacuagcuguua

SEQ ID NO: 903325 - RNA, 21 nt, Human
uugcaccaugauaaauucaga

SEQ ID NO: 903326 - RNA, 22 nt, Human
guaaacaacacaaaucauuuga

SEQ ID NO: 903327 - RNA, 22 nt, Human
gaaaagagaacaucugaggauc

SEQ ID NO: 903328 - RNA, 22 nt, Human
ugagcugggcugggcugagcug

SEQ ID NO: 903329 - RNA, 22 nt, Human
ucacacagggucggaaagagug

SEQ ID NO: 903330 - RNA, 22 nt, Human
ucuguuuugcauaauguucuuu

SEQ ID NO: 903331 - RNA, 22 nt, Human
gccuggguccacugaucaugcu

SEQ ID NO: 903332 - RNA, 22 nt, Human
gcucucuuugugccacuuaagg

SEQ ID NO: 903333 - RNA, 22 nt, Human
agcaguuuauccucauaaugga

SEQ ID NO: 903334 - RNA, 22 nt, Human
cacuuuaacucacauuucagcu

SEQ ID NO: 903335 - RNA, 22 nt, Human
uuagcauucucauuugcauaaa

SEQ ID NO: 903336 - RNA, 22 nt, Human
accaggagccacaggaggagcc

SEQ ID NO: 903337 - RNA, 22 nt, Human
gcccauggacacccaagugcca

SEQ ID NO: 903338 - RNA, 22 nt, Human
gcagagugagauaugaacccag

SEQ ID NO: 903339 - RNA, 22 nt, Human
gagcugcagcggcugacgcaac

SEQ ID NO: 903340 - RNA, 22 nt, Human
ucuccuugcuacccaguauguc

SEQ ID NO: 903341 - RNA, 22 nt, Human
cuagguggugguggguugacau

SEQ ID NO: 903342 - RNA, 22 nt, Human
gcccagucucuucuggcccugu

SEQ ID NO: 903343 - RNA, 22 nt, Human
aggaggcagucugucccuuagc

SEQ ID NO: 903344 - RNA, 22 nt, Human
caacccucucgccucaauucug

SEQ ID NO: 903345 - RNA, 22 nt, Human
gguggcucuguugucaacugau

SEQ ID NO: 903346 - RNA, 22 nt, Human
gcuuucuuuucaagaauguauu

SEQ ID NO: 903347 - RNA, 22 nt, Human
aaaugcuauuugggaacaacau

SEQ ID NO: 903348 - RNA, 23 nt, Human
uuucuguuggguauauauccaag

SEQ ID NO: 903349 - RNA, 22 nt, Human
guucucaguggggagcaggguu

SEQ ID NO: 903350 - RNA, 22 nt, Human
ccaggagagcaaaggucacucu

SEQ ID NO: 903351 - RNA, 23 nt, Human
uaaauuucuugauucuuauguga

SEQ ID NO: 903352 - RNA, 22 nt, Human
cuggggcagagcccagcaauuu

SEQ ID NO: 903353 - RNA, 22 nt, Human
cugcacagggauauggggagcu

SEQ ID NO: 903354 - RNA, 22 nt, Human
agauuucccaaauacuuguuau

SEQ ID NO: 903355 - RNA, 22 nt, Human
uuauauacugugguaguacugu

SEQ ID NO: 903356 - RNA, 22 nt, Human
cucaggauagcugcgcagccug

SEQ ID NO: 903357 - RNA, 22 nt, Human
gcuguagguaaggauggcaaag

SEQ ID NO: 903358 - RNA, 22 nt, Human
agaauagaauucucauagaauu

SEQ ID NO: 903359 - RNA, 22 nt, Human
cagaaagcccuauguacagugg

SEQ ID NO: 903360 - RNA, 17 nt, Human
uguuaauuccaaugaua

SEQ ID NO: 903361 - RNA, 22 nt, Human
aaagccuucuuguaucgagcca

SEQ ID NO: 903362 - RNA, 22 nt, Human
uagaagucucucaagaaacaua

SEQ ID NO: 903363 - RNA, 20 nt, Human
ugcagaagaacguucugguu

SEQ ID NO: 903364 - RNA, 20 nt, Human
auccuuaaagagaauuucua

SEQ ID NO: 903365 - RNA, 22 nt, Human
gccuuuguaacucuuuuauugu

SEQ ID NO: 903366 - RNA, 22 nt, Human
gacagauggucaguguugaagu

SEQ ID NO: 903367 - RNA, 22 nt, Human
uaauguauaacaaauacucauc

SEQ ID NO: 903368 - RNA, 22 nt, Human
ucuccagggcagagaauagcaa

SEQ ID NO: 903369 - RNA, 22 nt, Human
uauauuguagcugaugacaaau

SEQ ID NO: 903370 - RNA, 22 nt, Human
caaugcaagcaagauggucaca

SEQ ID NO: 903371 - RNA, 22 nt, Human
ugccaggcaggacccuagaacc

SEQ ID NO: 903372 - RNA, 22 nt, Human
ccucuguccccagugcaggccu

SEQ ID NO: 903373 - RNA, 22 nt, Human
uucugaggccauuaccaauaaa

SEQ ID NO: 903374 - RNA, 21 nt, Human
auguagcuuacaagauaaagg

SEQ ID NO: 903375 - RNA, 22 nt, Human
uauuaauaugugugugcaugua

SEQ ID NO: 903376 - RNA, 22 nt, Human
caagaaacuuuauucugccaua

SEQ ID NO: 903377 - RNA, 22 nt, Human
ucuggccccauacagagggucu

SEQ ID NO: 903378 - RNA, 22 nt, Human
gugugcaggcuugaggauuagg

SEQ ID NO: 903379 - RNA, 22 nt, Human
agugucugccagcugccaggug

SEQ ID NO: 903380 - RNA, 22 nt, Human
uggcucagucauggaugaguaa

SEQ ID NO: 903381 - RNA, 20 nt, Human
cccagagguugcggcaggag

SEQ ID NO: 903382 - RNA, 22 nt, Human
cugcaucuguuagauuaucacc

SEQ ID NO: 903383 - RNA, 22 nt, Human
aaauguggguaaugggacugga

SEQ ID NO: 903384 - RNA, 22 nt, Human
ugcacacaguucucaggaaaga

SEQ ID NO: 903385 - RNA, 16 nt, Human
gcccaggacgggaggc

SEQ ID NO: 903386 - RNA, 22 nt, Human
guauugcauagaccugggauga

SEQ ID NO: 903387 - RNA, 22 nt, Human
ccauugaauccucagcugcuag

SEQ ID NO: 903388 - RNA, 22 nt, Human
uggugaggucauagagaacugu

SEQ ID NO: 903389 - RNA, 22 nt, Human
guggccuggaaaggcuggucug

SEQ ID NO: 903390 - RNA, 22 nt, Human
ucugaggggcuggaagggcugc

SEQ ID NO: 903391 - RNA, 22 nt, Human
ccaggaggcaauaucaagucca

SEQ ID NO: 903392 - RNA, 22 nt, Human
ucagagucauugcaaguagaag

SEQ ID NO: 903393 - RNA, 22 nt, Human
ggcugcuuuugcuguaagccag

SEQ ID NO: 903394 - RNA, 22 nt, Human
ugacucuguaccugucugccuu

SEQ ID NO: 903395 - RNA, 22 nt, Human
gggcuccagccacuggcugagg

SEQ ID NO: 903396 - RNA, 20 nt, Human
gcagaugagacucacagagg

SEQ ID NO: 903397 - RNA, 22 nt, Human
uguauacaggcauaagagauac

SEQ ID NO: 903398 - RNA, 22 nt, Human
ccagccuuugcaucccccaucu

SEQ ID NO: 903399 - RNA, 22 nt, Human
uucacagggcagcagcugagcc

SEQ ID NO: 903400 - RNA, 22 nt, Human
gccccagauggaggaagcuggg

SEQ ID NO: 903401 - RNA, 19 nt, Human
ugucaccuucugucaguuu

SEQ ID NO: 903402 - RNA, 22 nt, Human
aaucagaaaggcuaaggaagca

SEQ ID NO: 903403 - RNA, 22 nt, Human
aguagaaauguaagaaggauua

SEQ ID NO: 903404 - RNA, 20 nt, Human
guuauaggagagggaauuau

SEQ ID NO: 903405 - RNA, 22 nt, Human
auacaaagcuuucugucuggua

SEQ ID NO: 903406 - RNA, 22 nt, Human
uuguaacacuuuucuauuaaua

SEQ ID NO: 903407 - RNA, 22 nt, Human
guguggggcucagugggaaugu

SEQ ID NO: 903408 - RNA, 22 nt, Human
gggccuucuaguuagccccaau

SEQ ID NO: 903409 - RNA, 22 nt, Human
uuuguaaggaauauucuuggug

SEQ ID NO: 903410 - RNA, 22 nt, Human
caccaggcugcccaggacaggg

SEQ ID NO: 903411 - RNA, 22 nt, Human
aagauucuguauuucuaacaau

SEQ ID NO: 903412 - RNA, 17 nt, Human
uguaugcauaaaauuua

SEQ ID NO: 903413 - RNA, 22 nt, Human
cugccucucagccugaccgcca

SEQ ID NO: 903414 - RNA, 22 nt, Human
ucaucuugcaguguguguucug

SEQ ID NO: 903415 - RNA, 22 nt, Human
cuucccuuccuggggcaauuua

SEQ ID NO: 903416 - RNA, 22 nt, Human
uagggcagagcuuguacacgau

SEQ ID NO: 903417 - RNA, 22 nt, Human
uccugcagaucaaagccuuuga

SEQ ID NO: 903418 - RNA, 22 nt, Human
guggaggguuugcaaugugcag

SEQ ID NO: 903419 - RNA, 22 nt, Human
acagaaugcguagugcauguug

SEQ ID NO: 903420 - RNA, 22 nt, Human
cagcagguggacacacucaccu

SEQ ID NO: 903421 - RNA, 22 nt, Human
uuagaagccaggauggagcagg

SEQ ID NO: 903422 - RNA, 22 nt, Human
agaggggaggcgaaccagaguc

SEQ ID NO: 903423 - RNA, 22 nt, Human
gucuguccuuuucaucucccaa

SEQ ID NO: 903424 - RNA, 22 nt, Human
ucaggaggagcucauaaguuug

SEQ ID NO: 903425 - RNA, 22 nt, Human
ucugcagcgugcaggcuggugc

SEQ ID NO: 903426 - RNA, 22 nt, Human
uauguguaagcuguuuaucuuu

SEQ ID NO: 903427 - RNA, 22 nt, Human
ugcauaaaaaccacauacaagg

SEQ ID NO: 903428 - RNA, 22 nt, Human
uguuuacagaaggcagacuucc

SEQ ID NO: 903429 - RNA, 22 nt, Human
guccuuccccagccagcucugg

SEQ ID NO: 903430 - RNA, 22 nt, Human
uugauguagccuaagacagaac

SEQ ID NO: 903431 - RNA, 22 nt, Human
accuagaaugaagcaaugcugu

SEQ ID NO: 903432 - RNA, 22 nt, Human
ugcuuaaacauacuauuuauau

SEQ ID NO: 903433 - RNA, 22 nt, Human
uacuuagucuuucugaugaaau

SEQ ID NO: 903434 - RNA, 22 nt, Human
ccugucacauauuugcuguuca

SEQ ID NO: 903435 - RNA, 22 nt, Human
ccaggccucuggcugcuuaguc

SEQ ID NO: 903436 - RNA, 19 nt, Human
uuccugggguuccauugug

SEQ ID NO: 903437 - RNA, 22 nt, Human
agguggcagcagaaucagggag

SEQ ID NO: 903438 - RNA, 22 nt, Human
cagcagacuuacuagaauguaa

SEQ ID NO: 903439 - RNA, 22 nt, Human
ucaguuuucauuucaugagcag

SEQ ID NO: 903440 - RNA, 22 nt, Human
ugagcaguggcuccugcuggac

SEQ ID NO: 903441 - RNA, 22 nt, Human
aaaacacacuggaccaauuuaa

SEQ ID NO: 903442 - RNA, 22 nt, Human
ugaugaauuaguaacaaaugag

SEQ ID NO: 903443 - RNA, 19 nt, Human
gcaggugagccguggcucc

SEQ ID NO: 903444 - RNA, 21 nt, Human
gacauugagcgugucgcagug

SEQ ID NO: 903445 - RNA, 22 nt, Human
ucucuggggguagaacucaggc

SEQ ID NO: 903446 - RNA, 22 nt, Human
ucaaauuaguggaauaauaaug

SEQ ID NO: 903447 - RNA, 22 nt, Human
uggccuggugucugcgaggccu

SEQ ID NO: 903448 - RNA, 22 nt, Human
ucucacagcauuauccagggca

SEQ ID NO: 903449 - RNA, 22 nt, Human
aggauauaaaaagacuauuugg

SEQ ID NO: 903450 - RNA, 22 nt, Human
uacaaaugaaccaacuuugaug

SEQ ID NO: 903451 - RNA, 22 nt, Human
cuggguguucacccgaggcgcu

SEQ ID NO: 903452 - RNA, 22 nt, Human
aagcaacugccuucaauauuua

SEQ ID NO: 903453 - RNA, 22 nt, Human
uguccaggaauugacccugcaa

SEQ ID NO: 903454 - RNA, 22 nt, Human
uuccuggugaccucacugguag

SEQ ID NO: 903455 - RNA, 22 nt, Human
ggaucugguuacguaagagucu

SEQ ID NO: 903456 - RNA, 22 nt, Human
aacacuuuuuccuccugucugg

SEQ ID NO: 903457 - RNA, 22 nt, Human
gcucugucaacagcuagcugug

SEQ ID NO: 903458 - RNA, 22 nt, Human
gucuggcacauaagaggagcuc

SEQ ID NO: 903459 - RNA, 22 nt, Human
gcucccucugcucaggcacuug

SEQ ID NO: 903460 - RNA, 23 nt, Human
ucauuucacagugagcuuccuag

SEQ ID NO: 903461 - RNA, 22 nt, Human
uauuuaucaagguaggagaaua

SEQ ID NO: 903462 - RNA, 22 nt, Human
cuucagccucguuacuccugcg

SEQ ID NO: 903463 - RNA, 22 nt, Human
uacaaagauaguguuagaguaa

SEQ ID NO: 903464 - RNA, 22 nt, Human
uccaggaggcucugguugacgu

SEQ ID NO: 903465 - RNA, 22 nt, Human
agcucugggcugacaugcuccc

SEQ ID NO: 903466 - RNA, 22 nt, Human
cugugauuguuaguuccuauac

SEQ ID NO: 903467 - RNA, 22 nt, Human
ccugugggagcccaggcagaua

SEQ ID NO: 903468 - RNA, 22 nt, Human
cuguggcucucugcaggguccc

SEQ ID NO: 903469 - RNA, 22 nt, Human
uguauuuuuaggaaugcgcuau

SEQ ID NO: 903470 - RNA, 22 nt, Human
uuugaaagaauuuauguacuuu

SEQ ID NO: 903471 - RNA, 22 nt, Human
gaaaaggcagaguuccggggaa

SEQ ID NO: 903472 - RNA, 22 nt, Human
ucauucacugcccagcagugua

SEQ ID NO: 903473 - RNA, 22 nt, Human
cgcagugagucuguaaaaggcu

SEQ ID NO: 903474 - RNA, 22 nt, Human
acaacuuugacccuuguucuua

SEQ ID NO: 903475 - RNA, 22 nt, Human
acaugcauggacauguauauau

SEQ ID NO: 903476 - RNA, 22 nt, Human
gcgggcggggguucccaggucu

SEQ ID NO: 903477 - RNA, 22 nt, Human
uuucuuguacacuggaauuuau

SEQ ID NO: 903478 - RNA, 22 nt, Human
ucucugaguuuuaaggaugaug

SEQ ID NO: 903479 - RNA, 20 nt, Human
cagaugggacguggaggagu

SEQ ID NO: 903480 - RNA, 22 nt, Human
gcagaggcugggugucccaguc

SEQ ID NO: 903481 - RNA, 22 nt, Human
acuugggaugguggccagagcg

SEQ ID NO: 903482 - RNA, 22 nt, Human
cuuugguggaggggugcaggca

SEQ ID NO: 903483 - RNA, 18 nt, Human
aggccacacuccagaaca

SEQ ID NO: 903484 - RNA, 22 nt, Human
gcuuauguuuugccauugaaga

SEQ ID NO: 903485 - RNA, 22 nt, Human
aaugcuguauaucuuagcuaau

SEQ ID NO: 903486 - RNA, 22 nt, Human
cugggcucaccuguggcuggca

SEQ ID NO: 903487 - RNA, 22 nt, Human
ggccuaggaaggggauguaacu

SEQ ID NO: 903488 - RNA, 22 nt, Human
cuggaagaacuccaguucugug

SEQ ID NO: 903489 - RNA, 22 nt, Human
guacacacuauuuaaaguguuu

SEQ ID NO: 903490 - RNA, 22 nt, Human
cuuaggcaguuuaggaaagaga

SEQ ID NO: 903491 - RNA, 22 nt, Human
gugugcugagugacugucauca

SEQ ID NO: 903492 - RNA, 22 nt, Human
ugcaaucagguaccauuugauu

SEQ ID NO: 903493 - RNA, 22 nt, Human
agggcagagagaugaaugggau

SEQ ID NO: 903494 - RNA, 22 nt, Human
uccucccacauaggacaauggg

SEQ ID NO: 903495 - RNA, 22 nt, Human
gccaaauacuggaaucauagaa

SEQ ID NO: 903496 - RNA, 20 nt, Human
augugagggguugaaguggg

SEQ ID NO: 903497 - RNA, 22 nt, Human
aaggcccuuggaaaaugcagua

SEQ ID NO: 903498 - RNA, 19 nt, Human
gcccugaccuuggcugcuc

SEQ ID NO: 903499 - RNA, 22 nt, Human
cuuuggaauaaucaagcucuga

SEQ ID NO: 903500 - RNA, 22 nt, Human
agcagcaacugcuagaguggca

SEQ ID NO: 903501 - RNA, 22 nt, Human
ccagagcugcauccagcagguu

SEQ ID NO: 903502 - RNA, 22 nt, Human
guacaaguguauuuggcuugau

SEQ ID NO: 903503 - RNA, 22 nt, Human
guguccaucucuguaugcugcu

SEQ ID NO: 903504 - RNA, 22 nt, Human
ugaaaaggagccuuagguaggu

SEQ ID NO: 903505 - RNA, 22 nt, Human
ucuuucaaagcuguaguagauu

SEQ ID NO: 903506 - RNA, 22 nt, Human
aaagcuuuggguaggaauggga

SEQ ID NO: 903507 - RNA, 22 nt, Human
guuucuaagcacaugugagugu

SEQ ID NO: 903508 - RNA, 22 nt, Human
ggccaggcgaugaccccuccac

SEQ ID NO: 903509 - RNA, 22 nt, Human
uuacccagagcacuugagcuuu

SEQ ID NO: 903510 - RNA, 22 nt, Human
aaguggagccagggaaacugaa

SEQ ID NO: 903511 - RNA, 22 nt, Human
aagcugaaucugaaauagaauu

SEQ ID NO: 903512 - RNA, 22 nt, Human
cuucuagccuugaugacuggga

SEQ ID NO: 903513 - RNA, 22 nt, Human
ugucugguuugaaguccaugau

SEQ ID NO: 903514 - RNA, 22 nt, Human
gauaacauuuguauagcgcuuu

SEQ ID NO: 903515 - RNA, 22 nt, Human
cagcugaguaugcauucaagca

SEQ ID NO: 903516 - RNA, 23 nt, Human
aucaaaggauguagagaagaagc

SEQ ID NO: 903517 - RNA, 22 nt, Human
auauacuugauuuaacugagca

SEQ ID NO: 903518 - RNA, 22 nt, Human
uucugugugucucagcaagcug

SEQ ID NO: 903519 - RNA, 22 nt, Human
ugcuuuauuuuaaauaugccau

SEQ ID NO: 903520 - RNA, 23 nt, Human
cucucucuaccaugugaggacac

SEQ ID NO: 903521 - RNA, 22 nt, Human
caggcacaagaagcaaauguua

SEQ ID NO: 903522 - RNA, 22 nt, Human
uuaccuugaagagcuugagggc

SEQ ID NO: 903523 - RNA, 22 nt, Human
uggauggcuggggaagagcagg

SEQ ID NO: 903524 - RNA, 22 nt, Human
augugucuucuaagccaagccu

SEQ ID NO: 903525 - RNA, 22 nt, Human
uggguaggccaggaagcagugu

SEQ ID NO: 903526 - RNA, 22 nt, Human
uucuuccucuguaaaaggugac

SEQ ID NO: 903527 - RNA, 23 nt, Human
auuugaaacuuucuuguuuccag

SEQ ID NO: 903528 - RNA, 22 nt, Human
guuauacauauguguuaacaaa

SEQ ID NO: 903529 - RNA, 22 nt, Human
cuggcacagcuugggccccauc

SEQ ID NO: 903530 - RNA, 18 nt, Human
aagugggaaaagcaagca

SEQ ID NO: 903531 - RNA, 22 nt, Human
uagugccauucaagagguaguu

SEQ ID NO: 903532 - RNA, 22 nt, Human
caucaguguguugccuugcuca

SEQ ID NO: 903533 - RNA, 22 nt, Human
aaaguucuggggguguuucugg

SEQ ID NO: 903534 - RNA, 22 nt, Human
aguuggagugaacaugagauug

SEQ ID NO: 903535 - RNA, 22 nt, Human
uuuccuaaucccaaugacauuu

SEQ ID NO: 903536 - RNA, 22 nt, Human
acacugcagauguaauuugagu

SEQ ID NO: 903537 - RNA, 22 nt, Human
ugcaaggauauuuagucuagug

SEQ ID NO: 903538 - RNA, 22 nt, Human
aggaggaaagaaggcccccagc

SEQ ID NO: 903539 - RNA, 22 nt, Human
ugcaucauauaaugucuaugga

SEQ ID NO: 903540 - RNA, 22 nt, Human
auggcaguuuuagaacuuuuca

SEQ ID NO: 903541 - RNA, 22 nt, Human
agcccagccggauucccaguuc

SEQ ID NO: 903542 - RNA, 22 nt, Human
uuccugccuacaugccuuaugc

SEQ ID NO: 903543 - RNA, 22 nt, Human
uggccagugggguugagcagga

SEQ ID NO: 903544 - RNA, 22 nt, Human
aggcaagcuugaaauuggcucu

SEQ ID NO: 903545 - RNA, 19 nt, Human
ucaaaggcuuuuaggagac

SEQ ID NO: 903546 - RNA, 17 nt, Human
ggccuguguggcugcag

SEQ ID NO: 903547 - RNA, 22 nt, Human
ucugaagccuuuguacaggccu

SEQ ID NO: 903548 - RNA, 22 nt, Human
uccagcccaucccuagccuggg

SEQ ID NO: 903549 - RNA, 22 nt, Human
acucuccuuuugaucuucagaa

SEQ ID NO: 903550 - RNA, 22 nt, Human
ugagugagcuggggagccggug

SEQ ID NO: 903551 - RNA, 22 nt, Human
cagcuccucacgagucuugaaa

SEQ ID NO: 903552 - RNA, 22 nt, Human
cagagcugcaaaugccccuccg

SEQ ID NO: 903553 - RNA, 22 nt, Human
auguacaguuucuagacucaaa

SEQ ID NO: 903554 - RNA, 20 nt, Human
aacacagauaccaaagguug

SEQ ID NO: 903555 - RNA, 22 nt, Human
aagauguuagaggucaugcaga

SEQ ID NO: 903556 - RNA, 22 nt, Human
uuaaauagucaaaucaguggca

SEQ ID NO: 903557 - RNA, 22 nt, Human
cuucuccagccacgcccacucc

SEQ ID NO: 903558 - RNA, 22 nt, Human
augcuuuauuggagacagucau

SEQ ID NO: 903559 - RNA, 22 nt, Human
cuuaggaagcuuuugaggacaa

SEQ ID NO: 903560 - RNA, 22 nt, Human
acaguggaugacauccuuuugc

SEQ ID NO: 903561 - RNA, 22 nt, Human
cugaggcucaagggcagguggg

SEQ ID NO: 903562 - RNA, 22 nt, Human
ucucaguuuccucauauguaaa

SEQ ID NO: 903563 - RNA, 22 nt, Human
acaugaaaagacuaucugauua

SEQ ID NO: 903564 - RNA, 22 nt, Human
aaagcauguugggucccucuuu

SEQ ID NO: 903565 - RNA, 22 nt, Human
agagacccauugccggaaucac

SEQ ID NO: 903566 - RNA, 22 nt, Human
ccugcucagagcgucuugugug

SEQ ID NO: 903567 - RNA, 22 nt, Human
caaaguaauauggucccaguga

SEQ ID NO: 903568 - RNA, 22 nt, Human
ucagaggccuugguuaugguau

SEQ ID NO: 903569 - RNA, 22 nt, Human
guuauaaauaccuaauaggauu

SEQ ID NO: 903570 - RNA, 22 nt, Human
uuucacaauuuuaaggagcaaa

SEQ ID NO: 903571 - RNA, 22 nt, Human
cccaggaauuggaggcugcagu

SEQ ID NO: 903572 - RNA, 22 nt, Human
cagugccauauugaaagacauu

SEQ ID NO: 903573 - RNA, 21 nt, Human
ugcauauauaagugcauacac

SEQ ID NO: 903574 - RNA, 22 nt, Human
caccugcccuuucuugcuccac

SEQ ID NO: 903575 - RNA, 22 nt, Human
gaguccuuuugugccacaggga

SEQ ID NO: 903576 - RNA, 22 nt, Human
cuacagaagaaacuaucacuau

SEQ ID NO: 903577 - RNA, 22 nt, Human
ugagccuguccugugcauguga

SEQ ID NO: 903578 - RNA, 22 nt, Human
ugagggcugcuuccagagcuag

SEQ ID NO: 903579 - RNA, 22 nt, Human
uuucaacaucaccuagcaguuc

SEQ ID NO: 903580 - RNA, 22 nt, Human
gcucccugucucugggguccau

SEQ ID NO: 903581 - RNA, 20 nt, Human
uacaauacacaugcauauga

SEQ ID NO: 903582 - RNA, 19 nt, Human
gccacaggaugaaguuugg

SEQ ID NO: 903583 - RNA, 22 nt, Human
uauuuaauuagugauuguagag

SEQ ID NO: 903584 - RNA, 22 nt, Human
gccugccuagaauugcagcuuu

SEQ ID NO: 903585 - RNA, 22 nt, Human
ucacaaauauuuuaacaguagg

SEQ ID NO: 903586 - RNA, 22 nt, Human
aaacucaaguuucuuaauguca

SEQ ID NO: 903587 - RNA, 22 nt, Human
ccaggcuggaguguagucgcau

SEQ ID NO: 903588 - RNA, 22 nt, Human
caucuguuuuugucaauuacau

SEQ ID NO: 903589 - RNA, 22 nt, Human
ucuggcucccuggagcuccaca

SEQ ID NO: 903590 - RNA, 22 nt, Human
cccaggcacauccacucuguga

SEQ ID NO: 903591 - RNA, 22 nt, Human
aagauguucuauuuucacuuuu

SEQ ID NO: 903592 - RNA, 22 nt, Human
cuugaagacaauggcagauucc

SEQ ID NO: 903593 - RNA, 22 nt, Human
ggucucccuugcugguuggcug

SEQ ID NO: 903594 - RNA, 22 nt, Human
uuugaaaggguuaugagacuga

SEQ ID NO: 903595 - RNA, 22 nt, Human
aaugcacaaaggugucuauugc

SEQ ID NO: 903596 - RNA, 22 nt, Human
uccaggaggccucauuuccugu

SEQ ID NO: 903597 - RNA, 22 nt, Human
ggggugagguuuauguucuggg

SEQ ID NO: 903598 - RNA, 22 nt, Human
uggcccuggcugaguuagauuu

SEQ ID NO: 903599 - RNA, 22 nt, Human
cuccccaaagauaacggcuucu

SEQ ID NO: 903600 - RNA, 22 nt, Human
cugaaguuaaucagagguacaa

SEQ ID NO: 903601 - RNA, 22 nt, Human
uacuauuuggaauuuuaaauug

SEQ ID NO: 903602 - RNA, 22 nt, Human
gacagcaacacucaauucugca

SEQ ID NO: 903603 - RNA, 22 nt, Human
auguuuguguuacacucugcag

SEQ ID NO: 903604 - RNA, 22 nt, Human
cugggcaguuuauucaguucug

SEQ ID NO: 903605 - RNA, 22 nt, Human
ggcagcuuucaauaggguuaug

SEQ ID NO: 903606 - RNA, 20 nt, Human
ggguggaguugcggucugug

SEQ ID NO: 903607 - RNA, 22 nt, Human
aaaguacaugcaauucuucuga

SEQ ID NO: 903608 - RNA, 19 nt, Human
cucugggcugcaucuuggu

SEQ ID NO: 903609 - RNA, 22 nt, Human
gaagacacucugcagaguuauc

SEQ ID NO: 903610 - RNA, 22 nt, Human
guuucuuagguaaauucuuuga

SEQ ID NO: 903611 - RNA, 22 nt, Human
aauaaacaaauccuuccuuccc

SEQ ID NO: 903612 - RNA, 22 nt, Human
ccugacucuggccaggccagcu

SEQ ID NO: 903613 - RNA, 22 nt, Human
ugcaauuucaggcauauauugu

SEQ ID NO: 903614 - RNA, 20 nt, Human
cucagcucuucagggcaagu

SEQ ID NO: 903615 - RNA, 22 nt, Human
accacagugggccacaagaagu

SEQ ID NO: 903616 - RNA, 22 nt, Human
aucuuuagcauuacuuuauuca

SEQ ID NO: 903617 - RNA, 22 nt, Human
guaaguuaguuccuguguuagu

SEQ ID NO: 903618 - RNA, 22 nt, Human
cagauggaaggcauagagguuu

SEQ ID NO: 903619 - RNA, 22 nt, Human
uggcaauauccacaauuacuuu

SEQ ID NO: 903620 - RNA, 22 nt, Human
gagggaggugauacugaacgua

SEQ ID NO: 903621 - RNA, 22 nt, Human
ucaggacaguucccugcaaauu

SEQ ID NO: 903622 - RNA, 22 nt, Human
cugcuggacuacaggaagaguu

SEQ ID NO: 903623 - RNA, 22 nt, Human
gccaggaaugcauaaaugaccu

SEQ ID NO: 903624 - RNA, 22 nt, Human
gcuguggcuugcagcuggggcu

SEQ ID NO: 903625 - RNA, 22 nt, Human
aacagaacccgagugugaaucu

SEQ ID NO: 903626 - RNA, 21 nt, Human
gcucuccagggccagcccagg

SEQ ID NO: 903627 - RNA, 22 nt, Human
agugcuucuuaaaccuuucuac

SEQ ID NO: 903628 - RNA, 22 nt, Human
cagaggcugauggcuguagcca

SEQ ID NO: 903629 - RNA, 22 nt, Human
ucuucaugauacccuaagccac

SEQ ID NO: 903630 - RNA, 22 nt, Human
aucauuagaccaaacuagagcu

SEQ ID NO: 903631 - RNA, 18 nt, Human
cauugacaguauaucuuu

SEQ ID NO: 903632 - RNA, 22 nt, Human
uccuggccaaguuacucucugc

SEQ ID NO: 903633 - RNA, 22 nt, Human
ucauuucaaguucugacagcua

SEQ ID NO: 903634 - RNA, 22 nt, Human
ucucuuaauuuuggaauagugu

SEQ ID NO: 903635 - RNA, 22 nt, Human
cagaucugcuccucuguccaug

SEQ ID NO: 903636 - RNA, 22 nt, Human
gggagggaaagcuugaucuguc

SEQ ID NO: 903637 - RNA, 22 nt, Human
uugaagaccuuuagugcuaugu

SEQ ID NO: 903638 - RNA, 22 nt, Human
ucuucacugaugucucucaaau

SEQ ID NO: 903639 - RNA, 22 nt, Human
auuuaagggauuuggagaccaa

SEQ ID NO: 903640 - RNA, 22 nt, Human
ggccagcugccugaccuucugu

SEQ ID NO: 903641 - RNA, 22 nt, Human
ucuuucugaugggaagggucaa

SEQ ID NO: 903642 - RNA, 22 nt, Human
gugggcagccuccuuuauuuuc

SEQ ID NO: 903643 - RNA, 22 nt, Human
gaagcugcaauaauuguuuuga

SEQ ID NO: 903644 - RNA, 22 nt, Human
uccugagguuuuaaaacuauuc

SEQ ID NO: 903645 - RNA, 22 nt, Human
aaacucucauuuuagugcacug

SEQ ID NO: 903646 - RNA, 22 nt, Human
cccugcacacucgugucuugac

SEQ ID NO: 903647 - RNA, 22 nt, Human
auggcuuccaaggcccuccgug

SEQ ID NO: 903648 - RNA, 22 nt, Human
gggaaggagguggcuugaagug

SEQ ID NO: 903649 - RNA, 22 nt, Human
gagggccagaucccaggaggaa

SEQ ID NO: 903650 - RNA, 22 nt, Human
ugaaauguuaaucacacaaagg

SEQ ID NO: 903651 - RNA, 22 nt, Human
uuuggcugagaaguugugcuuu

SEQ ID NO: 903652 - RNA, 22 nt, Human
gucccugggaaaggagagggca

SEQ ID NO: 903653 - RNA, 20 nt, Human
uggaggccugcagguuuggg

SEQ ID NO: 903654 - RNA, 22 nt, Human
cuucacaaagcucucuuuaugu

SEQ ID NO: 903655 - RNA, 18 nt, Human
uccuaagauuugugagaa

SEQ ID NO: 903656 - RNA, 22 nt, Human
aagucugggccuccuucccaga

SEQ ID NO: 903657 - RNA, 22 nt, Human
ggcagugaacagaaaugcagaa

SEQ ID NO: 903658 - RNA, 22 nt, Human
gagaaguuguaggagaauuuug

SEQ ID NO: 903659 - RNA, 22 nt, Human
uagauacaggcaagauuaugaa

SEQ ID NO: 903660 - RNA, 22 nt, Human
cccagccucagcuuuacuucca

SEQ ID NO: 903661 - RNA, 22 nt, Human
aaauaacuuucuguguauaguc

SEQ ID NO: 903662 - RNA, 22 nt, Human
auguaaaguaucugaaaugcug

SEQ ID NO: 903663 - RNA, 22 nt, Human
uacucucaggguuaguacagga

SEQ ID NO: 903664 - RNA, 22 nt, Human
gcaaagugaaauggggcagaga

SEQ ID NO: 903665 - RNA, 22 nt, Human
ggcaucaguauggccauagggu

SEQ ID NO: 903666 - RNA, 22 nt, Human
cccugcugucaggugcugggag

SEQ ID NO: 903667 - RNA, 22 nt, Human
cuacagcagagaccagccacau

SEQ ID NO: 903668 - RNA, 22 nt, Human
aagcauaaaacguuacaacaug

SEQ ID NO: 903669 - RNA, 22 nt, Human
ccucuacagggcauagcccaaa

SEQ ID NO: 903670 - RNA, 22 nt, Human
auuuauuaccucggaguuucug

SEQ ID NO: 903671 - RNA, 22 nt, Human
gcugaggcuccucgggaggaca

SEQ ID NO: 903672 - RNA, 22 nt, Human
agcacaguaauugauauuacug

SEQ ID NO: 903673 - RNA, 22 nt, Human
gaaauacaggaaugccacacag

SEQ ID NO: 903674 - RNA, 22 nt, Human
agaaaggagcaccgugggggau

SEQ ID NO: 903675 - RNA, 22 nt, Human
cugugauguuagcucuguguua

SEQ ID NO: 903676 - RNA, 22 nt, Human
gauauaguaggacacaucauga

SEQ ID NO: 903677 - RNA, 22 nt, Human
uagcuucugggaguguuuacua

SEQ ID NO: 903678 - RNA, 21 nt, Human
ugcaggcuguuuaagaggcaa

SEQ ID NO: 903679 - RNA, 22 nt, Human
uccagccuugccacuuuucugu

SEQ ID NO: 903680 - RNA, 22 nt, Human
aaugugaacuuugucauguaac

SEQ ID NO: 903681 - RNA, 22 nt, Human
ggcugcuguacugaugucaguu

SEQ ID NO: 903682 - RNA, 22 nt, Human
agaaggccaagaagaagccuau

SEQ ID NO: 903683 - RNA, 22 nt, Human
gcuugggagaggcuuccucuuu

SEQ ID NO: 903684 - RNA, 22 nt, Human
agcugcuuagagucucuucuua

SEQ ID NO: 903685 - RNA, 20 nt, Human
ggcgccuggccucauggcug

SEQ ID NO: 903686 - RNA, 22 nt, Human
gccaaauaccauuaaccagaaa

SEQ ID NO: 903687 - RNA, 22 nt, Human
agauaacauuuauugaauguaa

SEQ ID NO: 903688 - RNA, 22 nt, Human
ucacaggcuaaauuuaugcagg

SEQ ID NO: 903689 - RNA, 22 nt, Human
uacacauacaccaaugugguca

SEQ ID NO: 903690 - RNA, 19 nt, Human
agccagaacuaguguuucu

SEQ ID NO: 903691 - RNA, 22 nt, Human
ugggaugagaagugcgaggguu

SEQ ID NO: 903692 - RNA, 22 nt, Human
guaaccugggauguagcacaga

SEQ ID NO: 903693 - RNA, 22 nt, Human
gacagugacagcuuggaaagca

SEQ ID NO: 903694 - RNA, 22 nt, Human
agugugggcccccagguuagcc

SEQ ID NO: 903695 - RNA, 19 nt, Human
ggcccuguaggaugugagu

SEQ ID NO: 903696 - RNA, 22 nt, Human
gcauucuuagggccuggggugu

SEQ ID NO: 903697 - RNA, 22 nt, Human
uuaccuaaaauagcucaauuua

SEQ ID NO: 903698 - RNA, 22 nt, Human
uaaaaugccagaccaguucacg

SEQ ID NO: 903699 - RNA, 22 nt, Human
ugcagaauauucuggugacaau

SEQ ID NO: 903700 - RNA, 21 nt, Human
agaaacugacuccuagaggca

SEQ ID NO: 903701 - RNA, 22 nt, Human
caugucuuucucaucacaucua

SEQ ID NO: 903702 - RNA, 22 nt, Human
cagcuugggucaggugccugcu

SEQ ID NO: 903703 - RNA, 22 nt, Human
accagagaggcugcagugugug

SEQ ID NO: 903704 - RNA, 22 nt, Human
uccaaggacucuugucagcugu

SEQ ID NO: 903705 - RNA, 22 nt, Human
acagcaaaggacgaacacucug

SEQ ID NO: 903706 - RNA, 21 nt, Human
gccuggcucucacuggccugg

SEQ ID NO: 903707 - RNA, 22 nt, Human
aaggcaguuugggccaccaucu

SEQ ID NO: 903708 - RNA, 22 nt, Human
uacauguaagacaugagacucu

SEQ ID NO: 903709 - RNA, 19 nt, Human
gcacaggacaucugaugga

SEQ ID NO: 903710 - RNA, 22 nt, Human
uucucacaggauuucuuuuagu

SEQ ID NO: 903711 - RNA, 18 nt, Human
aggucaggaaagcagagu

SEQ ID NO: 903712 - RNA, 22 nt, Human
accugccucagugcagcuggau

SEQ ID NO: 903713 - RNA, 22 nt, Human
uccuagaaucuuuguaagauug

SEQ ID NO: 903714 - RNA, 22 nt, Human
aaugcacacauuugguacugaa

SEQ ID NO: 903715 - RNA, 22 nt, Human
cagggcaggacagauacauuac

SEQ ID NO: 903716 - RNA, 22 nt, Human
uggcuggacagugggcagugga

SEQ ID NO: 903717 - RNA, 22 nt, Human
ccugggaggcugugggucugcu

SEQ ID NO: 903718 - RNA, 22 nt, Human
uagaagaaagugaagcugggga

SEQ ID NO: 903719 - RNA, 22 nt, Human
aacauuugcagaggaaagcuau

SEQ ID NO: 903720 - RNA, 18 nt, Human
auccugggccagucuuuc

SEQ ID NO: 903721 - RNA, 19 nt, Human
gcaggguggcagagcucuu

SEQ ID NO: 903722 - RNA, 22 nt, Human
uccacgcugugugaccuugggc

SEQ ID NO: 903723 - RNA, 22 nt, Human
aauccuggccuagcugggcuca

SEQ ID NO: 903724 - RNA, 21 nt, Human
ucacaacuuugaauuucaaua

SEQ ID NO: 903725 - RNA, 19 nt, Human
guuggcacugaaaauggcu

SEQ ID NO: 903726 - RNA, 22 nt, Human
cagggcucagggacugcagaaa

SEQ ID NO: 903727 - RNA, 22 nt, Human
agcaggcuccaggcuggccauc

SEQ ID NO: 903728 - RNA, 22 nt, Human
ugacuccaaacagaaaacgaau

SEQ ID NO: 903729 - RNA, 22 nt, Human
agccugggcaugggacgggagg

SEQ ID NO: 903730 - RNA, 22 nt, Human
cuggaagagugacuuugcauuu

SEQ ID NO: 903731 - RNA, 22 nt, Human
aacagcagggacuugaauggaa

SEQ ID NO: 903732 - RNA, 22 nt, Human
agaaggcagaugggacggagca

SEQ ID NO: 903733 - RNA, 22 nt, Human
augugcguguguacauauauau

SEQ ID NO: 903734 - RNA, 22 nt, Human
cuggaaaggguccucauucugu

SEQ ID NO: 903735 - RNA, 22 nt, Human
gcagcuucaguaggugaagaca

SEQ ID NO: 903736 - RNA, 21 nt, Human
gggggaagaggaguugcuagu

SEQ ID NO: 903737 - RNA, 20 nt, Human
cuugccaguucccuggcaga

SEQ ID NO: 903738 - RNA, 22 nt, Human
guggcugcagagccagcaagcu

SEQ ID NO: 903739 - RNA, 22 nt, Human
aaugcaaagaguugcuuaucaa

SEQ ID NO: 903740 - RNA, 22 nt, Human
ccccuucuguguccugucagcc

SEQ ID NO: 903741 - RNA, 22 nt, Human
uuaagagggugaugcuagcauu

SEQ ID NO: 903742 - RNA, 22 nt, Human
gguaauaagaucuguuacaugg

SEQ ID NO: 903743 - RNA, 22 nt, Human
ucccagccuuaucuccccuggc

SEQ ID NO: 903744 - RNA, 22 nt, Human
uuuccuuuuauaaggcuugagg

SEQ ID NO: 903745 - RNA, 22 nt, Human
gugagguaaacuguaguucaga

SEQ ID NO: 903746 - RNA, 18 nt, Human
cucucuuuccacucuuug

SEQ ID NO: 903747 - RNA, 22 nt, Human
ggaucaagaaagucagaugaag

SEQ ID NO: 903748 - RNA, 22 nt, Human
cuccuccagcuuccaguggcuc

SEQ ID NO: 903749 - RNA, 22 nt, Human
aaucacuuguaaggaauucaau

SEQ ID NO: 903750 - RNA, 22 nt, Human
aaggccauuguaauguaaauau

SEQ ID NO: 903751 - RNA, 22 nt, Human
aauuuggcagugucuugaagua

SEQ ID NO: 903752 - RNA, 22 nt, Human
gggcagcaaaucugagucuggu

SEQ ID NO: 903753 - RNA, 22 nt, Human
agguuugggaguagaaaucaga

SEQ ID NO: 903754 - RNA, 22 nt, Human
cucuuuggcguuggcagagcca

SEQ ID NO: 903755 - RNA, 22 nt, Human
ccugcuggcagaggggguuacu

SEQ ID NO: 903756 - RNA, 22 nt, Human
cuagggcuccaaagcugagaag

SEQ ID NO: 903757 - RNA, 22 nt, Human
ggcgggaggcugaggaguuggu

SEQ ID NO: 903758 - RNA, 22 nt, Human
aguccguggccagacucaagag

SEQ ID NO: 903759 - RNA, 22 nt, Human
agacaaagaaaccguagaagca

SEQ ID NO: 903760 - RNA, 22 nt, Human
gcugucuuuccccugcuccaga

SEQ ID NO: 903761 - RNA, 22 nt, Human
uccagcuuuggcucuagcuaca

SEQ ID NO: 903762 - RNA, 22 nt, Human
uucucugacccccuuaaauauu

SEQ ID NO: 903763 - RNA, 22 nt, Human
auaaauaucacuguugucccuc

SEQ ID NO: 903764 - RNA, 22 nt, Human
uagcuguuucuaaguguuguuu

SEQ ID NO: 903765 - RNA, 22 nt, Human
ccugggaggcuguuuccagccu

SEQ ID NO: 903766 - RNA, 22 nt, Human
ucucacagaucagcagggggcu

SEQ ID NO: 903767 - RNA, 22 nt, Human
gcugugcagccaagugccucug

SEQ ID NO: 903768 - RNA, 17 nt, Human
agcaacuucucccacag

SEQ ID NO: 903769 - RNA, 21 nt, Human
acaggcuuuagaaaaugacuc

SEQ ID NO: 903770 - RNA, 22 nt, Human
ucagcuggagaugagaaccgaa

SEQ ID NO: 903771 - RNA, 22 nt, Human
auguacauuuuccuaauguuuu

SEQ ID NO: 903772 - RNA, 22 nt, Human
uugaaagauauguuaaucuuuc

SEQ ID NO: 903773 - RNA, 22 nt, Human
guuuccugcccugucuuaucca

SEQ ID NO: 903774 - RNA, 18 nt, Human
ggccucuggacuggcagc

SEQ ID NO: 903775 - RNA, 20 nt, Human
agguuccuuuguggagaauu

SEQ ID NO: 903776 - RNA, 22 nt, Human
ucaggagugauaccauuuguca

SEQ ID NO: 903777 - RNA, 22 nt, Human
agcgagugggucagcguugcag

SEQ ID NO: 903778 - RNA, 22 nt, Human
gccaaaguaccuagcccucugc

SEQ ID NO: 903779 - RNA, 22 nt, Human
guuguuuucagcaguuuaugac

SEQ ID NO: 903780 - RNA, 22 nt, Human
ggcagcauauauucagugggca

SEQ ID NO: 903781 - RNA, 22 nt, Human
auuucauugaaguuaauucuuc

SEQ ID NO: 903782 - RNA, 22 nt, Human
guucuauuacucccugcuucuu

SEQ ID NO: 903783 - RNA, 22 nt, Human
agagcuguucagcagccagguu

SEQ ID NO: 903784 - RNA, 22 nt, Human
ccagcuccagguagaugggcag

SEQ ID NO: 903785 - RNA, 20 nt, Human
ugagauuuguauuauaaguc

SEQ ID NO: 903786 - RNA, 22 nt, Human
uuucagaaccgcuaaaauaaau

SEQ ID NO: 903787 - RNA, 22 nt, Human
ucacagaaggcaucacagaaga

SEQ ID NO: 903788 - RNA, 22 nt, Human
caagcuuuauccgccauguagg

SEQ ID NO: 903789 - RNA, 22 nt, Human
uaaacaucugucauguguuuau

SEQ ID NO: 903790 - RNA, 22 nt, Human
gcaggagacuggcugugguagu

SEQ ID NO: 903791 - RNA, 22 nt, Human
agggguggagaguguugccagu

SEQ ID NO: 903792 - RNA, 22 nt, Human
gugcaaaagcaauugcaguuuu

SEQ ID NO: 903793 - RNA, 22 nt, Human
uaauuauaacaguuacaucuua

SEQ ID NO: 903794 - RNA, 22 nt, Human
aguuuuauaaaggcaccucagu

SEQ ID NO: 903795 - RNA, 21 nt, Human
agagaucugaagaaccauuag

SEQ ID NO: 903796 - RNA, 22 nt, Human
cugucugaauccuaagcuuccu

SEQ ID NO: 903797 - RNA, 22 nt, Human
ugcaguggcgccaucucagcuc

SEQ ID NO: 903798 - RNA, 22 nt, Human
agggagguaggagcuucuagcu

SEQ ID NO: 903799 - RNA, 22 nt, Human
aagaguuuaccagugcugcuuc

SEQ ID NO: 903800 - RNA, 22 nt, Human
uuucugaauuccuaggauguug

SEQ ID NO: 903801 - RNA, 22 nt, Human
cagccugcuagggcaaugccuu

SEQ ID NO: 903802 - RNA, 22 nt, Human
ugagcuuucauguaugaaaaga

SEQ ID NO: 903803 - RNA, 18 nt, Human
cccagcuggugggucagu

SEQ ID NO: 903804 - RNA, 22 nt, Human
caguuuauaguuguuaugugug

SEQ ID NO: 903805 - RNA, 22 nt, Human
gugaccauaauagauuaugagu

SEQ ID NO: 903806 - RNA, 22 nt, Human
aauguuuucucugugaacacau

SEQ ID NO: 903807 - RNA, 22 nt, Human
gugggugugagugacggcgucc

SEQ ID NO: 903808 - RNA, 22 nt, Human
ugcaccaagcccagcuggagaa

SEQ ID NO: 903809 - RNA, 22 nt, Human
ucuacagggucagaguuucaug

SEQ ID NO: 903810 - RNA, 22 nt, Human
agcuuuaugggagcuuagauaa

SEQ ID NO: 903811 - RNA, 22 nt, Human
agcagggcagguaaggaucaga

SEQ ID NO: 903812 - RNA, 22 nt, Human
gaggagacauauuuuugaagca

SEQ ID NO: 903813 - RNA, 22 nt, Human
acuucuaaucagaaggucuggu

SEQ ID NO: 903814 - RNA, 20 nt, Human
gcccaugaggacugcagcug

SEQ ID NO: 903815 - RNA, 22 nt, Human
aagaaagugaugagcuacagau

SEQ ID NO: 903816 - RNA, 17 nt, Human
gcccuggagccaggcua

SEQ ID NO: 903817 - RNA, 21 nt, Human
uagcaucucuacugucauaga

SEQ ID NO: 903818 - RNA, 22 nt, Human
cugaggucucuuuccauaguga

SEQ ID NO: 903819 - RNA, 22 nt, Human
gccucccuccaccacugcaggu

SEQ ID NO: 903820 - RNA, 22 nt, Human
accauguuggccaagcuggucu

SEQ ID NO: 903821 - RNA, 22 nt, Human
aagagaggacauggugaaccug

SEQ ID NO: 903822 - RNA, 22 nt, Human
cagaggccucacuuccagccag

SEQ ID NO: 903823 - RNA, 22 nt, Human
caggcacacugucuacacugag

SEQ ID NO: 903824 - RNA, 22 nt, Human
cagcacagcuggcucuggaagc

SEQ ID NO: 903825 - RNA, 19 nt, Human
ucucccagcugagaagggc

SEQ ID NO: 903826 - RNA, 22 nt, Human
gcagagcaguacucucuugacu

SEQ ID NO: 903827 - RNA, 22 nt, Human
uuguaaacauagagauuuaggu

SEQ ID NO: 903828 - RNA, 22 nt, Human
ugacaaugauuagguagcuucu

SEQ ID NO: 903829 - RNA, 22 nt, Human
ugucuguuauugguguauaaga

SEQ ID NO: 903830 - RNA, 23 nt, Human
cugacucaucccaccaccuccuc

SEQ ID NO: 903831 - RNA, 21 nt, Human
aggcaggauucaaacacagag

SEQ ID NO: 903832 - RNA, 22 nt, Human
ccagaggcuggguucaccucag

SEQ ID NO: 903833 - RNA, 22 nt, Human
aggcccuuggacucaugcucga

SEQ ID NO: 903834 - RNA, 22 nt, Human
ugaggcaguauucuccauucca

SEQ ID NO: 903835 - RNA, 22 nt, Human
gccuauggauuggagaaggagc

SEQ ID NO: 903836 - RNA, 22 nt, Human
acauacauugccucauugguaa

SEQ ID NO: 903837 - RNA, 21 nt, Human
uucuuuccccagaggacuaaa

SEQ ID NO: 903838 - RNA, 22 nt, Human
ucuugcugagacuggcaaguuu

SEQ ID NO: 903839 - RNA, 22 nt, Human
ucucacuggguauaaaugagua

SEQ ID NO: 903840 - RNA, 22 nt, Human
gaagcagugugaacccauguaa

SEQ ID NO: 903841 - RNA, 22 nt, Human
caggcuggagugcagugucgcc

SEQ ID NO: 903842 - RNA, 22 nt, Human
gagcaggaacugaaaaugagac

SEQ ID NO: 903843 - RNA, 22 nt, Human
auucugcacauccaagaacagg

SEQ ID NO: 903844 - RNA, 22 nt, Human
ugagguagagauugugacugua

SEQ ID NO: 903845 - RNA, 22 nt, Human
ucauuucucugagucugauaau

SEQ ID NO: 903846 - RNA, 22 nt, Human
ucagggauuaaggucaaaggug

SEQ ID NO: 903847 - RNA, 19 nt, Human
gcuucuguuugggcuuaga

SEQ ID NO: 903848 - RNA, 22 nt, Human
cuggccugaucucaugcugucc

SEQ ID NO: 903849 - RNA, 22 nt, Human
cagcucagucuggagagaugca

SEQ ID NO: 903850 - RNA, 22 nt, Human
agagcagcguuuguggaacacu

SEQ ID NO: 903851 - RNA, 22 nt, Human
aucucaaacaucuuugaccaua

SEQ ID NO: 903852 - RNA, 22 nt, Human
ugugaccucaucuuaacuggaa

SEQ ID NO: 903853 - RNA, 23 nt, Human
aaugacaccucauagguaacuuc

SEQ ID NO: 903854 - RNA, 22 nt, Human
auucauaaguaaaugauuaccu

SEQ ID NO: 903855 - RNA, 22 nt, Human
cagaaacugcuuguggucaucu

SEQ ID NO: 903856 - RNA, 22 nt, Human
cugaacuuauugagugcuugcu

SEQ ID NO: 903857 - RNA, 19 nt, Human
cuggaaugagaacaugccc

SEQ ID NO: 903858 - RNA, 22 nt, Human
aaaagacaggugucugcggccc

SEQ ID NO: 903859 - RNA, 22 nt, Human
uggagcuguagccaccacccug

SEQ ID NO: 903860 - RNA, 22 nt, Human
agaaacuaagucauaacucuuu

SEQ ID NO: 903861 - RNA, 22 nt, Human
uuacagaacugucuugaaauuu

SEQ ID NO: 903862 - RNA, 22 nt, Human
aguucugguugcccaugacauc

SEQ ID NO: 903863 - RNA, 22 nt, Human
ugcugggcuguuccuguccaug

SEQ ID NO: 903864 - RNA, 22 nt, Human
cucauauucagucacugaugca

SEQ ID NO: 903865 - RNA, 22 nt, Human
gagagugucgggggccccagga

SEQ ID NO: 903866 - RNA, 22 nt, Human
cugucagcacucuacuacagau

SEQ ID NO: 903867 - RNA, 22 nt, Human
gugauaaagacgugucauaauu

SEQ ID NO: 903868 - RNA, 22 nt, Human
gccucaguguccuccuccaugu

SEQ ID NO: 903869 - RNA, 22 nt, Human
aaguucuauugucacuuuauua

SEQ ID NO: 903870 - RNA, 22 nt, Human
agcccagguugaggcugcagug

SEQ ID NO: 903871 - RNA, 22 nt, Human
aucaacaugaauuucucugaag

SEQ ID NO: 903872 - RNA, 22 nt, Human
cggaggggauacauuuucugaa

SEQ ID NO: 903873 - RNA, 22 nt, Human
ggccagaggccacagcuguguc

SEQ ID NO: 903874 - RNA, 22 nt, Human
ugaggcagugauguuuaagcac

SEQ ID NO: 903875 - RNA, 21 nt, Human
cgcagagcgaacuugcggcgc

SEQ ID NO: 903876 - RNA, 22 nt, Human
gaaggcaucucuggacuuauuu

SEQ ID NO: 903877 - RNA, 22 nt, Human
ccuuucucuuugcugaucaugu

SEQ ID NO: 903878 - RNA, 22 nt, Human
ucugcuggucaaggcugggucc

SEQ ID NO: 903879 - RNA, 22 nt, Human
cgaggccacaccugcuucuggg

SEQ ID NO: 903880 - RNA, 22 nt, Human
gaggagagagggacugucugca

SEQ ID NO: 903881 - RNA, 22 nt, Human
gagaaagcuucuuucccacagg

SEQ ID NO: 903882 - RNA, 22 nt, Human
uuaguucauagaauguaacagg

SEQ ID NO: 903883 - RNA, 22 nt, Human
aaguuccuugaaugaagcuagg

SEQ ID NO: 903884 - RNA, 22 nt, Human
acauuguauacagacuuaguca

SEQ ID NO: 903885 - RNA, 22 nt, Human
auuucuguuugcuacuauaagu

SEQ ID NO: 903886 - RNA, 22 nt, Human
acugccuuccaccuauggauga

SEQ ID NO: 903887 - RNA, 17 nt, Human
ggcugugccaggugaga

SEQ ID NO: 903888 - RNA, 21 nt, Human
cucuccagugguuccugauuc

SEQ ID NO: 903889 - RNA, 22 nt, Human
uggcacguuggauugggaguuc

SEQ ID NO: 903890 - RNA, 22 nt, Human
uccugucuaaagaccugcaggc

SEQ ID NO: 903891 - RNA, 22 nt, Human
aaaaaugaauucuucaguggca

SEQ ID NO: 903892 - RNA, 22 nt, Human
cagacccuuuucugagaggacc

SEQ ID NO: 903893 - RNA, 22 nt, Human
gaaguuaucaggauuaaaguug

SEQ ID NO: 903894 - RNA, 22 nt, Human
ucuggggcaguuacuggggccu

SEQ ID NO: 903895 - RNA, 22 nt, Human
acacucuacagagcaaucuacc

SEQ ID NO: 903896 - RNA, 22 nt, Human
auuuuugagcugugaacauagc

SEQ ID NO: 903897 - RNA, 22 nt, Human
acagggaaggauuuagugggaa

SEQ ID NO: 903898 - RNA, 22 nt, Human
ccacuugaaacuuaguggcaua

SEQ ID NO: 903899 - RNA, 22 nt, Human
agagaguugaggaagcaacacu

SEQ ID NO: 903900 - RNA, 22 nt, Human
aguguauaugugcugagaaacg

SEQ ID NO: 903901 - RNA, 22 nt, Human
cuucagaauccagaaucagaau

SEQ ID NO: 903902 - RNA, 22 nt, Human
aggugccuaucuggucucugca

SEQ ID NO: 903903 - RNA, 22 nt, Human
aaaugcauguagaauaauagag

SEQ ID NO: 903904 - RNA, 22 nt, Human
agaaacagaaccaggugucauu

SEQ ID NO: 903905 - RNA, 22 nt, Human
cugggcugcaucaaagaggcau

SEQ ID NO: 903906 - RNA, 22 nt, Human
auccugaguuccugccucuaaa

SEQ ID NO: 903907 - RNA, 22 nt, Human
aagagcuguugucugcuuacug

SEQ ID NO: 903908 - RNA, 22 nt, Human
ugcagagggagugacgguucac

SEQ ID NO: 903909 - RNA, 20 nt, Human
uaaauuagccuugaagauua

SEQ ID NO: 903910 - RNA, 22 nt, Human
gaaggcagggaauguggugcua

SEQ ID NO: 903911 - RNA, 22 nt, Human
gggcaggagagggccaccugga

SEQ ID NO: 903912 - RNA, 21 nt, Human
uacaguaaguugggugguccu

SEQ ID NO: 903913 - RNA, 22 nt, Human
uccugcagccacugcaggcaga

SEQ ID NO: 903914 - RNA, 19 nt, Human
cucugggcaagucacuuaa

SEQ ID NO: 903915 - RNA, 22 nt, Human
gcaggcagucaucuuucauauu

SEQ ID NO: 903916 - RNA, 22 nt, Human
uucuuucugggaagaguucaga

SEQ ID NO: 903917 - RNA, 23 nt, Human
aagcacagaaugguuuaggaguu

SEQ ID NO: 903918 - RNA, 21 nt, Human
cucacaggaugcaguguuacu

SEQ ID NO: 903919 - RNA, 21 nt, Human
gcagugucaugguuucaaguu

SEQ ID NO: 903920 - RNA, 22 nt, Human
caucuucaggggcuacaucugu

SEQ ID NO: 903921 - RNA, 22 nt, Human
gaggcugggggcugccuuccuc

SEQ ID NO: 903922 - RNA, 23 nt, Human
cugcaagguacaagaugcuggau

SEQ ID NO: 903923 - RNA, 22 nt, Human
aucuggaguuucaguuuucugg

SEQ ID NO: 903924 - RNA, 22 nt, Human
ugacuaauugauaacucuguaa

SEQ ID NO: 903925 - RNA, 22 nt, Human
gcuguaugugaggccacaguga

SEQ ID NO: 903926 - RNA, 22 nt, Human
cauuauggcagccaggauauug

SEQ ID NO: 903927 - RNA, 22 nt, Human
ugggccucugccacgcuccccc

SEQ ID NO: 903928 - RNA, 22 nt, Human
uagaucugauacaauucaucug

SEQ ID NO: 903929 - RNA, 22 nt, Human
cagcuguccaaacacauuaacu

SEQ ID NO: 903930 - RNA, 22 nt, Human
ugcucuaagaacucuaggaauu

SEQ ID NO: 903931 - RNA, 21 nt, Human
ugaaagaggauguggucauuc

SEQ ID NO: 903932 - RNA, 22 nt, Human
cuccucuuuggggauuuacaca

SEQ ID NO: 903933 - RNA, 22 nt, Human
gcagauggcgcaguggaaguuc

SEQ ID NO: 903934 - RNA, 22 nt, Human
ugcccaagauucuuacaucaug

SEQ ID NO: 903935 - RNA, 22 nt, Human
cucugugcgggccauggucagg

SEQ ID NO: 903936 - RNA, 22 nt, Human
ucacugcucuccaauguggagu

SEQ ID NO: 903937 - RNA, 22 nt, Human
agguaaugcaacuacuuugcua

SEQ ID NO: 903938 - RNA, 22 nt, Human
aaagcuguuaaaugcauaaugc

SEQ ID NO: 903939 - RNA, 22 nt, Human
caggaguguuugcuacaguuuc

SEQ ID NO: 903940 - RNA, 22 nt, Human
aguucccaggugaugcugaugu

SEQ ID NO: 903941 - RNA, 22 nt, Human
gcuggaguaggaccaugcuuga

SEQ ID NO: 903942 - RNA, 22 nt, Human
ggcaggaacacagauggugccg

SEQ ID NO: 903943 - RNA, 22 nt, Human
cagguuggucggcaaguacaca

SEQ ID NO: 903944 - RNA, 22 nt, Human
caauguguguguuuuucucaac

SEQ ID NO: 903945 - RNA, 22 nt, Human
gugcaagacuuccuaagcaaua

SEQ ID NO: 903946 - RNA, 22 nt, Human
ccugaggucacaacuugcuuau

SEQ ID NO: 903947 - RNA, 22 nt, Human
gaagaaauguguucaagguagg

SEQ ID NO: 903948 - RNA, 22 nt, Human
gucauccaacaagaggcucuug

SEQ ID NO: 903949 - RNA, 22 nt, Human
gcacacaguacuauaugcuaca

SEQ ID NO: 903950 - RNA, 22 nt, Human
uuuacugagugaccuagaauaa

SEQ ID NO: 903951 - RNA, 22 nt, Human
ugagcauggugggugcagagca

SEQ ID NO: 903952 - RNA, 20 nt, Human
uagaacuuuucaguauggau

SEQ ID NO: 903953 - RNA, 22 nt, Human
gaggcucaacccacagggguug

SEQ ID NO: 903954 - RNA, 22 nt, Human
ugaaaugauuauaugguguuug

SEQ ID NO: 903955 - RNA, 22 nt, Human
ccacugagcaguagcugcgucg

SEQ ID NO: 903956 - RNA, 22 nt, Human
ggccuuggaguccuccacugga

SEQ ID NO: 903957 - RNA, 22 nt, Human
uggggcuaaacacgccuggccu

SEQ ID NO: 903958 - RNA, 22 nt, Human
ggcaugagcacgaagugguacc

SEQ ID NO: 903959 - RNA, 22 nt, Human
cgcauacauagaaacacacaga

SEQ ID NO: 903960 - RNA, 22 nt, Human
guuuccgcccugggccuguggg

SEQ ID NO: 903961 - RNA, 22 nt, Human
agugugugccuuuggauaccug

SEQ ID NO: 903962 - RNA, 22 nt, Human
cuguacagauugcacacgggga

SEQ ID NO: 903963 - RNA, 22 nt, Human
uagccggguguugugucaugca

SEQ ID NO: 903964 - RNA, 22 nt, Human
uccugagcucccaugaacaggc

SEQ ID NO: 903965 - RNA, 22 nt, Human
aagcugcccuguguuagaguuc

SEQ ID NO: 903966 - RNA, 22 nt, Human
uaggaccaggggcugccaggaa

SEQ ID NO: 903967 - RNA, 22 nt, Human
ggccacagugggaaauccuggg

SEQ ID NO: 903968 - RNA, 22 nt, Human
agacuuuaacaauggguaugaa

SEQ ID NO: 903969 - RNA, 22 nt, Human
gagcagcccuagggcauaagca

SEQ ID NO: 903970 - RNA, 23 nt, Human
agcagccauagggaagcaauaca

SEQ ID NO: 903971 - RNA, 19 nt, Human
ucaaaugccaaugucacag

SEQ ID NO: 903972 - RNA, 22 nt, Human
ugcaaagucgcaaaauucuucu

SEQ ID NO: 903973 - RNA, 22 nt, Human
uugaaagaagaagcugcgaugu

SEQ ID NO: 903974 - RNA, 22 nt, Human
auuuucagaacauucauucacu

SEQ ID NO: 903975 - RNA, 22 nt, Human
agaauaaucacugaaguucaaa

SEQ ID NO: 903976 - RNA, 22 nt, Human
ccugagccucuugcacgcucag

SEQ ID NO: 903977 - RNA, 22 nt, Human
cacugcccagcgucuuaggcac

SEQ ID NO: 903978 - RNA, 21 nt, Human
agcagacacuugugaccuucc

SEQ ID NO: 903979 - RNA, 22 nt, Human
cagcucugaagaaaggugucua

SEQ ID NO: 903980 - RNA, 22 nt, Human
gcuguccaccuccagagccuua

SEQ ID NO: 903981 - RNA, 22 nt, Human
uacuuguuaggaauuucuacua

SEQ ID NO: 903982 - RNA, 22 nt, Human
uaacagcacuggcaggcacugu

SEQ ID NO: 903983 - RNA, 22 nt, Human
gcauggccaggaaagguagaaa

SEQ ID NO: 903984 - RNA, 22 nt, Human
gcagccucagggcacucagaug

SEQ ID NO: 903985 - RNA, 22 nt, Human
aaagggcugucaaauaagcaac

SEQ ID NO: 903986 - RNA, 22 nt, Human
uuucuucaguaacacaaaccau

SEQ ID NO: 903987 - RNA, 22 nt, Human
caucugugccggguguuuguca

SEQ ID NO: 903988 - RNA, 22 nt, Human
gacacagugguucugugaguaa

SEQ ID NO: 903989 - RNA, 17 nt, Human
aggagggaaauagcuug

SEQ ID NO: 903990 - RNA, 23 nt, Human
cacuccuguuucuaagccagcau

SEQ ID NO: 903991 - RNA, 22 nt, Human
acucagagucuguuugguaccu

SEQ ID NO: 903992 - RNA, 21 nt, Human
cuggcccagggaucugcauuu

SEQ ID NO: 903993 - RNA, 22 nt, Human
agugacaaaacggaacauacag

SEQ ID NO: 903994 - RNA, 22 nt, Human
uuagggcaggcaugagagaacu

SEQ ID NO: 903995 - RNA, 22 nt, Human
ugaggccugaagccugaaguga

SEQ ID NO: 903996 - RNA, 22 nt, Human
agcugcaggauuauggaaugga

SEQ ID NO: 903997 - RNA, 22 nt, Human
auggcagucagagacaggcaga

SEQ ID NO: 903998 - RNA, 22 nt, Human
ugagacaguaucgccccaaggc

SEQ ID NO: 903999 - RNA, 22 nt, Human
cagagcugagaauguugaugcu

SEQ ID NO: 904000 - RNA, 22 nt, Human
gagcugaggauacaucagugaa

SEQ ID NO: 904001 - RNA, 22 nt, Human
cuuuagauggcuuaggaggccc

SEQ ID NO: 904002 - RNA, 22 nt, Human
aagagcauuuuguaaaauccuu

SEQ ID NO: 904003 - RNA, 22 nt, Human
augucuauauagucaauaauca

SEQ ID NO: 904004 - RNA, 22 nt, Human
aaguuuaucccucucacaguua

SEQ ID NO: 904005 - RNA, 22 nt, Human
cgcagcagccccgugguaggug

SEQ ID NO: 904006 - RNA, 22 nt, Human
ccuggcuuccuucaugaccugg

SEQ ID NO: 904007 - RNA, 17 nt, Human
cugaggggagugcugug

SEQ ID NO: 904008 - RNA, 22 nt, Human
cauaagaaauuuaacagaacuu

SEQ ID NO: 904009 - RNA, 23 nt, Human
ugggagacuuuucauuuuguucu

SEQ ID NO: 904010 - RNA, 22 nt, Human
agcagcaaguguaacugaauau

SEQ ID NO: 904011 - RNA, 22 nt, Human
gaagguggcgagcggauugcug

SEQ ID NO: 904012 - RNA, 22 nt, Human
agcuggguacacguugucacaa

SEQ ID NO: 904013 - RNA, 22 nt, Human
auuuguuucagggccuugguau

SEQ ID NO: 904014 - RNA, 22 nt, Human
aaauugcugaccaaguauauuc

SEQ ID NO: 904015 - RNA, 22 nt, Human
uccugagagcagaguccaggug

SEQ ID NO: 904016 - RNA, 20 nt, Human
cauuaugguugggcacagug

SEQ ID NO: 904017 - RNA, 22 nt, Human
uuucuucuaagauuucaaacua

SEQ ID NO: 904018 - RNA, 22 nt, Human
caccagccagagugacagcucc

SEQ ID NO: 904019 - RNA, 22 nt, Human
uggccugccccgagauccuggc

SEQ ID NO: 904020 - RNA, 22 nt, Human
cacacauuaauaucaaaggcuc

SEQ ID NO: 904021 - RNA, 22 nt, Human
uacaccaguaucuuaagcauga

SEQ ID NO: 904022 - RNA, 22 nt, Human
cucuuuggauguuuaugauaag

SEQ ID NO: 904023 - RNA, 19 nt, Human
acaguccagcuguuuguac

SEQ ID NO: 904024 - RNA, 19 nt, Human
ucccaggaagcaaauguca

SEQ ID NO: 904025 - RNA, 22 nt, Human
cucuggagguugagcccagcaa

SEQ ID NO: 904026 - RNA, 19 nt, Human
aucugaaguaggugcagcu

SEQ ID NO: 904027 - RNA, 22 nt, Human
uuauuuauuguguaccuacugu

SEQ ID NO: 904028 - RNA, 22 nt, Human
gccaggcacaguucuaggugcu

SEQ ID NO: 904029 - RNA, 18 nt, Human
acauacauucugucugca

SEQ ID NO: 904030 - RNA, 22 nt, Human
cccuuucugccuucuaaaauaa

SEQ ID NO: 904031 - RNA, 22 nt, Human
ugcugcaggcagccccucuacu

SEQ ID NO: 904032 - RNA, 22 nt, Human
cgagugucugcuaugggcugag

SEQ ID NO: 904033 - RNA, 22 nt, Human
cgcucuggagaauaguagcuuu

SEQ ID NO: 904034 - RNA, 22 nt, Human
ugcaggagcugugcggugaggg

SEQ ID NO: 904035 - RNA, 22 nt, Human
uggccuguggcuuaaggucugu

SEQ ID NO: 904036 - RNA, 19 nt, Human
agugggcaaggaagaugac

SEQ ID NO: 904037 - RNA, 22 nt, Human
ggaaagaaucaagugauccugu

SEQ ID NO: 904038 - RNA, 22 nt, Human
ccaguggaauuaaaaauaagug

SEQ ID NO: 904039 - RNA, 22 nt, Human
ugucuauagaaucaugcaguuu

SEQ ID NO: 904040 - RNA, 22 nt, Human
uccccccagccuuucacaugag

SEQ ID NO: 904041 - RNA, 22 nt, Human
gcucagggccuggcugcggacu

SEQ ID NO: 904042 - RNA, 22 nt, Human
ucucacagaggcuugggcucau

SEQ ID NO: 904043 - RNA, 22 nt, Human
acuuucuauucccacagagaua

SEQ ID NO: 904044 - RNA, 19 nt, Human
gagggcucauuugaacaau

SEQ ID NO: 904045 - RNA, 22 nt, Human
ccucuguggccuuggaccagcu

SEQ ID NO: 904046 - RNA, 22 nt, Human
ucacugcucagucuguacuaca

SEQ ID NO: 904047 - RNA, 22 nt, Human
uugcuuuagaaucugcuucugg

SEQ ID NO: 904048 - RNA, 22 nt, Human
uaauaaacugcuacgcuuaguu

SEQ ID NO: 904049 - RNA, 22 nt, Human
auugacaauucuaugcagagca

SEQ ID NO: 904050 - RNA, 22 nt, Human
ccagguucaaauagcuguguga

SEQ ID NO: 904051 - RNA, 22 nt, Human
caggucccgccccgggcugacc

SEQ ID NO: 904052 - RNA, 22 nt, Human
guggucaggggcugaggugccc

SEQ ID NO: 904053 - RNA, 22 nt, Human
uuauaagacuguagugaguauu

SEQ ID NO: 904054 - RNA, 22 nt, Human
uucuagaaacacaugcaaacag

SEQ ID NO: 904055 - RNA, 22 nt, Human
aggauguggcugagacuucugg

SEQ ID NO: 904056 - RNA, 22 nt, Human
uuugaagacauuugaauacuuu

SEQ ID NO: 904057 - RNA, 22 nt, Human
cagaagugguauuaauuagauu

SEQ ID NO: 904058 - RNA, 22 nt, Human
uguuucuaucuggaucaauaga

SEQ ID NO: 904059 - RNA, 22 nt, Human
uuuguaaaggccugaauuucag

SEQ ID NO: 904060 - RNA, 19 nt, Human
ugcauaaauuauauacuuu

SEQ ID NO: 904061 - RNA, 22 nt, Human
ccuggcaggcuggggacagugc

SEQ ID NO: 904062 - RNA, 17 nt, Human
aagagaggcugagcugg

SEQ ID NO: 904063 - RNA, 22 nt, Human
cggggagggcagaggcucccuc

SEQ ID NO: 904064 - RNA, 22 nt, Human
ggccaugguuggggaagacaug

SEQ ID NO: 904065 - RNA, 21 nt, Human
uucaacaaagggaauaaguuu

SEQ ID NO: 904066 - RNA, 22 nt, Human
cagcugaguggacccuagaggc

SEQ ID NO: 904067 - RNA, 22 nt, Human
gcggguggaucaugaggucagg

SEQ ID NO: 904068 - RNA, 22 nt, Human
ucacauucuagaauguuaucgu

SEQ ID NO: 904069 - RNA, 22 nt, Human
ggaggguccacugugaggcaga

SEQ ID NO: 904070 - RNA, 22 nt, Human
aaugugcugguaacugcuuugc

SEQ ID NO: 904071 - RNA, 22 nt, Human
ugcaaacagccuugaaagaggg

SEQ ID NO: 904072 - RNA, 18 nt, Human
ugcugugcacagcccuau

SEQ ID NO: 904073 - RNA, 22 nt, Human
ccugcccagcuucaccucaggc

SEQ ID NO: 904074 - RNA, 18 nt, Human
augcuucugauagaagca

SEQ ID NO: 904075 - RNA, 22 nt, Human
ccagcccuucccaacuggccag

SEQ ID NO: 904076 - RNA, 22 nt, Human
gagcugcagacuugauacagga

SEQ ID NO: 904077 - RNA, 22 nt, Human
agaggauguucuaggcacucau

SEQ ID NO: 904078 - RNA, 22 nt, Human
acaguacauagaucucuacccu

SEQ ID NO: 904079 - RNA, 22 nt, Human
acugcaaacauaguacuugagc

SEQ ID NO: 904080 - RNA, 17 nt, Human
caucaaagaaauuucca

SEQ ID NO: 904081 - RNA, 22 nt, Human
aaguuauugcagcaauccaagu

SEQ ID NO: 904082 - RNA, 22 nt, Human
gugagcaguuuguuccagaauc

SEQ ID NO: 904083 - RNA, 22 nt, Human
gcuguccaugucuggccucagu

SEQ ID NO: 904084 - RNA, 22 nt, Human
gauggccuuguuuucucccuuc

SEQ ID NO: 904085 - RNA, 22 nt, Human
ugcaaaugggaaacccagcagu

SEQ ID NO: 904086 - RNA, 22 nt, Human
ugacagagcuggagaauaauuu

SEQ ID NO: 904087 - RNA, 22 nt, Human
aggcagccuauggggagcucag

SEQ ID NO: 904088 - RNA, 22 nt, Human
cagcaauaguguguuuguuuca

SEQ ID NO: 904089 - RNA, 22 nt, Human
ccugagaguaggugucucuuua

SEQ ID NO: 904090 - RNA, 17 nt, Human
ggcucugggugucacau

SEQ ID NO: 904091 - RNA, 22 nt, Human
aacauaaauuugaaguggcaaa

SEQ ID NO: 904092 - RNA, 22 nt, Human
acauugaacaguacaaaugauc

SEQ ID NO: 904093 - RNA, 23 nt, Human
ggcuggcccggggcugcuccuga

SEQ ID NO: 904094 - RNA, 22 nt, Human
agacacaguguugaaggcuagu

SEQ ID NO: 904095 - RNA, 22 nt, Human
uucauauuuucugcuugcucac

SEQ ID NO: 904096 - RNA, 22 nt, Human
ggacugaggcccacuugaggga

SEQ ID NO: 904097 - RNA, 19 nt, Human
auucuucucaaauauccau

SEQ ID NO: 904098 - RNA, 22 nt, Human
cagcaggugcaggugcggccgc

SEQ ID NO: 904099 - RNA, 22 nt, Human
cugggcugugguguggcccaaa

SEQ ID NO: 904100 - RNA, 22 nt, Human
ucuuccaaugguuucuagauuu

SEQ ID NO: 904101 - RNA, 22 nt, Human
gccuuaauacagauggguggug

SEQ ID NO: 904102 - RNA, 22 nt, Human
acaguguuguauuuaguuugau

SEQ ID NO: 904103 - RNA, 22 nt, Human
uucaugaacgaacauauguaua

SEQ ID NO: 904104 - RNA, 22 nt, Human
ugaguuuuguaauauucaagau

SEQ ID NO: 904105 - RNA, 20 nt, Human
agauacaguuuaauuacucu

SEQ ID NO: 904106 - RNA, 22 nt, Human
auggccagucaagccucuggcu

SEQ ID NO: 904107 - RNA, 22 nt, Human
gggcuguguacuaugaggaggg

SEQ ID NO: 904108 - RNA, 22 nt, Human
ucuauuuuauacucaaaucuuc

SEQ ID NO: 904109 - RNA, 22 nt, Human
ccuucaaauuuagaacaaguga

SEQ ID NO: 904110 - RNA, 22 nt, Human
uucaaguuaaugauucugguuu

SEQ ID NO: 904111 - RNA, 22 nt, Human
aggacuucuagugguacuguga

SEQ ID NO: 904112 - RNA, 21 nt, Human
caaggacagguugcagggcaa

SEQ ID NO: 904113 - RNA, 22 nt, Human
gcuucuaauuuuuuacagaaua

SEQ ID NO: 904114 - RNA, 22 nt, Human
cagaggcagccgggggagaacg

SEQ ID NO: 904115 - RNA, 22 nt, Human
augcacaaacccacaauuaguc

SEQ ID NO: 904116 - RNA, 22 nt, Human
ugguggcacaagggagagaauc

SEQ ID NO: 904117 - RNA, 22 nt, Human
auuacaacuacauaaucucaga

SEQ ID NO: 904118 - RNA, 22 nt, Human
auuucucaggguccagguccca

SEQ ID NO: 904119 - RNA, 22 nt, Human
cuguggauuuaggcagagcuga

SEQ ID NO: 904120 - RNA, 22 nt, Human
cagggugccucccgcucgccgg

SEQ ID NO: 904121 - RNA, 22 nt, Human
ccagguguggggaggacucaca

SEQ ID NO: 904122 - RNA, 22 nt, Human
cagugagguagacagcuuuuuc

SEQ ID NO: 904123 - RNA, 22 nt, Human
gcacaugacuuugaggaaacca

SEQ ID NO: 904124 - RNA, 22 nt, Human
uuccuucuuccaaacccaucau

SEQ ID NO: 904125 - RNA, 22 nt, Human
cuugggcacaucccugguauuu

SEQ ID NO: 904126 - RNA, 22 nt, Human
uuauaacacugccuugucacca

SEQ ID NO: 904127 - RNA, 22 nt, Human
agccagaggaacuugaugacug

SEQ ID NO: 904128 - RNA, 22 nt, Human
agacccuguuaguuccagucuu

SEQ ID NO: 904129 - RNA, 22 nt, Human
cacugcagaucagaggcugaga

SEQ ID NO: 904130 - RNA, 22 nt, Human
cagcaauaacucaaagccauuu

SEQ ID NO: 904131 - RNA, 22 nt, Human
uuuauuguugggucuuaagcug

SEQ ID NO: 904132 - RNA, 22 nt, Human
cuaaaauuaucaagauaauucc

SEQ ID NO: 904133 - RNA, 20 nt, Human
cucagcuaaacaacacugac

SEQ ID NO: 904134 - RNA, 22 nt, Human
uggggagaaaugucuuuguucc

SEQ ID NO: 904135 - RNA, 22 nt, Human
uauugauaugcagaacugacuu

SEQ ID NO: 904136 - RNA, 22 nt, Human
cucauaaacauuauucauuauu

SEQ ID NO: 904137 - RNA, 22 nt, Human
guuuuguucaugaacauugggu

SEQ ID NO: 904138 - RNA, 22 nt, Human
gucaaacagccuccuguucuaa

SEQ ID NO: 904139 - RNA, 22 nt, Human
auguuccugguauaucaugacc

SEQ ID NO: 904140 - RNA, 22 nt, Human
uggcaugccuugucagacagug

SEQ ID NO: 904141 - RNA, 22 nt, Human
gcuguaggaagacagaaugcag

SEQ ID NO: 904142 - RNA, 22 nt, Human
cauuaauauuguucuucuuuag

SEQ ID NO: 904143 - RNA, 22 nt, Human
uugccauugcaaaguacuauga

SEQ ID NO: 904144 - RNA, 22 nt, Human
aaagacuggaaggugaggcugu

SEQ ID NO: 904145 - RNA, 22 nt, Human
ugagguagggaaggcugguauu

SEQ ID NO: 904146 - RNA, 22 nt, Human
uuugggcucuugcugaccuggg

SEQ ID NO: 904147 - RNA, 22 nt, Human
uuauuuacuggauggccuuggg

SEQ ID NO: 904148 - RNA, 22 nt, Human
gcuggagaaacugcagcugagg

SEQ ID NO: 904149 - RNA, 19 nt, Human
cugggacuccugauaccuu

SEQ ID NO: 904150 - RNA, 22 nt, Human
agcacagagcucggggaaugga

SEQ ID NO: 904151 - RNA, 22 nt, Human
uuauggaauggagaaagucugc

SEQ ID NO: 904152 - RNA, 22 nt, Human
augcagggaaaagagauauuau

SEQ ID NO: 904153 - RNA, 22 nt, Human
uggagagucucugagccagggc

SEQ ID NO: 904154 - RNA, 22 nt, Human
ucuacaguuuucuugggaguug

SEQ ID NO: 904155 - RNA, 22 nt, Human
ugcagggccuucuagaccaugg

SEQ ID NO: 904156 - RNA, 22 nt, Human
uucaaugccuuucucuaagcuc

SEQ ID NO: 904157 - RNA, 22 nt, Human
gcucugagacaguagagauggc

SEQ ID NO: 904158 - RNA, 22 nt, Human
aucagaacaaaagaacaguuua

SEQ ID NO: 904159 - RNA, 21 nt, Human
uuugccuucacgaagcauccu

SEQ ID NO: 904160 - RNA, 22 nt, Human
uaacacagaguaaguggucaau

SEQ ID NO: 904161 - RNA, 22 nt, Human
auaucauaaaucggugcaugaa

SEQ ID NO: 904162 - RNA, 22 nt, Human
aauggcaguaguugcaugagag

SEQ ID NO: 904163 - RNA, 22 nt, Human
cagcaaucgggugauaugcaau

SEQ ID NO: 904164 - RNA, 22 nt, Human
acacuucuauucccugcacaaa

SEQ ID NO: 904165 - RNA, 22 nt, Human
gcagcaggcacggucucgacau

SEQ ID NO: 904166 - RNA, 22 nt, Human
ucucuguguguuggcuguauau

SEQ ID NO: 904167 - RNA, 22 nt, Human
aguuuuauuaaauccacagaag

SEQ ID NO: 904168 - RNA, 22 nt, Human
uuggacagaauuuugugugugu

SEQ ID NO: 904169 - RNA, 22 nt, Human
ugcauauuuucugauucagaag

SEQ ID NO: 904170 - RNA, 19 nt, Human
caguuuaacuaauuuuauc

SEQ ID NO: 904171 - RNA, 22 nt, Human
uggcuacauuuguugaucacuu

SEQ ID NO: 904172 - RNA, 22 nt, Human
uaacacuguaaaccuagauguu

SEQ ID NO: 904173 - RNA, 17 nt, Human
gaauccuucucuguucu

SEQ ID NO: 904174 - RNA, 19 nt, Human
aggcccagcgcugggggcu

SEQ ID NO: 904175 - RNA, 22 nt, Human
gaugaaauuguuuugauacuuu

SEQ ID NO: 904176 - RNA, 22 nt, Human
auucaagguuggcucaggaauu

SEQ ID NO: 904177 - RNA, 19 nt, Human
caagugaagccugggaugg

SEQ ID NO: 904178 - RNA, 22 nt, Human
uuucagacuccaaauucauaag

SEQ ID NO: 904179 - RNA, 22 nt, Human
gugugagcagguuugaccuaag

SEQ ID NO: 904180 - RNA, 22 nt, Human
aaguccugccaccuauaagccu

SEQ ID NO: 904181 - RNA, 22 nt, Human
acauuguugugcaauuauaguu

SEQ ID NO: 904182 - RNA, 22 nt, Human
uggcagugaaccaaggcuccaa

SEQ ID NO: 904183 - RNA, 17 nt, Human
ggcuggagcagcucccc

SEQ ID NO: 904184 - RNA, 20 nt, Human
ucugccacgucuggugacug

SEQ ID NO: 904185 - RNA, 22 nt, Human
aaacaguuuauaacaugauacu

SEQ ID NO: 904186 - RNA, 22 nt, Human
cugagagucaguggaguggugu

SEQ ID NO: 904187 - RNA, 22 nt, Human
ucuauuuaccaaauguaguucc

SEQ ID NO: 904188 - RNA, 22 nt, Human
ucuguacaugaguugagaauca

SEQ ID NO: 904189 - RNA, 22 nt, Human
gucagcucagcaggugggagug

SEQ ID NO: 904190 - RNA, 22 nt, Human
uagacaaugccaucuugugguu

SEQ ID NO: 904191 - RNA, 22 nt, Human
uucugcaugguuggggagaagc

SEQ ID NO: 904192 - RNA, 22 nt, Human
gcuggcuggaaugggagaagaa

SEQ ID NO: 904193 - RNA, 22 nt, Human
uagagcuuggacugcauuuucg

SEQ ID NO: 904194 - RNA, 23 nt, Human
uggcccugugcaugcugcuuccc

SEQ ID NO: 904195 - RNA, 22 nt, Human
agcaugcaggaaccacauggca

SEQ ID NO: 904196 - RNA, 22 nt, Human
cuaccgguccacgguuuaaaug

SEQ ID NO: 904197 - RNA, 23 nt, Human
uuucacauuuacuguuagauggc

SEQ ID NO: 904198 - RNA, 22 nt, Human
acagcuggaguguuggugaggu

SEQ ID NO: 904199 - RNA, 20 nt, Human
augcauauauguggugucug

SEQ ID NO: 904200 - RNA, 22 nt, Human
uuccuggggcuuagcaauggag

SEQ ID NO: 904201 - RNA, 22 nt, Human
gccugccccuuccugggcaggg

SEQ ID NO: 904202 - RNA, 22 nt, Human
uggugcugucuacuuugugcag

SEQ ID NO: 904203 - RNA, 22 nt, Human
cucauaaaagcuuuguuuacac

SEQ ID NO: 904204 - RNA, 22 nt, Human
acagaauucuaguauguggcuu

SEQ ID NO: 904205 - RNA, 22 nt, Human
uguguaggauuuccuggagccu

SEQ ID NO: 904206 - RNA, 22 nt, Human
ucaguggaacugucugggugag

SEQ ID NO: 904207 - RNA, 21 nt, Human
aauucccagaaacagcacaag

SEQ ID NO: 904208 - RNA, 22 nt, Human
gcuacacaaaaggagagugagu

SEQ ID NO: 904209 - RNA, 22 nt, Human
uuggucuucagagaucuggugg

SEQ ID NO: 904210 - RNA, 22 nt, Human
uuucuuccaaaggcacguucuc

SEQ ID NO: 904211 - RNA, 22 nt, Human
aaugucaacacaagagaaaugc

SEQ ID NO: 904212 - RNA, 18 nt, Human
acagcagguuucauucuu

SEQ ID NO: 904213 - RNA, 22 nt, Human
auaauggcaugacaguuauaua

SEQ ID NO: 904214 - RNA, 19 nt, Human
gcacgcuggcuugauaggg

SEQ ID NO: 904215 - RNA, 22 nt, Human
cccacacaaaucauggggagaa

SEQ ID NO: 904216 - RNA, 19 nt, Human
cagagcagugguuccugaa

SEQ ID NO: 904217 - RNA, 23 nt, Human
cuggaagugcuuuuauagcuuug

SEQ ID NO: 904218 - RNA, 22 nt, Human
guaauagaugaaacaaugugga

SEQ ID NO: 904219 - RNA, 22 nt, Human
uagggagaaacaccaauuuauu

SEQ ID NO: 904220 - RNA, 20 nt, Human
ccccuucaucuacagccuga

SEQ ID NO: 904221 - RNA, 22 nt, Human
uuacuaguauaugucaagcaac

SEQ ID NO: 904222 - RNA, 22 nt, Human
aggaggccccuccuggguugcu

SEQ ID NO: 904223 - RNA, 22 nt, Human
auucuuauuaaauagccagaag

SEQ ID NO: 904224 - RNA, 21 nt, Human
ggccugagcaccuguccaccu

SEQ ID NO: 904225 - RNA, 22 nt, Human
uuucuaaggccagagacugcug

SEQ ID NO: 904226 - RNA, 21 nt, Human
ugucagcacgcaugaggccag

SEQ ID NO: 904227 - RNA, 22 nt, Human
gcucccagauuucagccuugug

SEQ ID NO: 904228 - RNA, 22 nt, Human
uucucuaaaugugaaccggcuu

SEQ ID NO: 904229 - RNA, 22 nt, Human
ccagagggacguuaccaguuca

SEQ ID NO: 904230 - RNA, 22 nt, Human
augcuacagcaucucucaucag

SEQ ID NO: 904231 - RNA, 22 nt, Human
gcccugcucuuuugcccaccca

SEQ ID NO: 904232 - RNA, 22 nt, Human
auuuucuauguuguaauuguua

SEQ ID NO: 904233 - RNA, 22 nt, Human
ugcaucuuuagucuuaugucug

SEQ ID NO: 904234 - RNA, 22 nt, Human
cugggacccacaccuggaaucu

SEQ ID NO: 904235 - RNA, 22 nt, Human
acagugaugagccggcugaggc

SEQ ID NO: 904236 - RNA, 22 nt, Human
gccugcucuccggaucccugau

SEQ ID NO: 904237 - RNA, 22 nt, Human
agcugccagggacugggcaugg

SEQ ID NO: 904238 - RNA, 22 nt, Human
cccaggcugucuguccuuugcu

SEQ ID NO: 904239 - RNA, 22 nt, Human
uaggacaggugaggggcugugg

SEQ ID NO: 904240 - RNA, 22 nt, Human
caaacauuuucuacuuccagga

SEQ ID NO: 904241 - RNA, 22 nt, Human
gcugggcugagaaguuaagcaa

SEQ ID NO: 904242 - RNA, 22 nt, Human
acauucuagaagucuuugcaau

SEQ ID NO: 904243 - RNA, 19 nt, Human
ucaagcagucugauuuagg

SEQ ID NO: 904244 - RNA, 22 nt, Human
gucaacaguauuaggacauuug

SEQ ID NO: 904245 - RNA, 22 nt, Human
uuucaugucugaauucuuuagu

SEQ ID NO: 904246 - RNA, 20 nt, Human
cuacacaggguucgcugggc

SEQ ID NO: 904247 - RNA, 22 nt, Human
gaaaucaggaugauguuccaga

SEQ ID NO: 904248 - RNA, 22 nt, Human
ucugaggcuauguucaggcuaa

SEQ ID NO: 904249 - RNA, 22 nt, Human
uguuuaauucaccaucauguuc

SEQ ID NO: 904250 - RNA, 22 nt, Human
acauuacauaagauuguaaccu

SEQ ID NO: 904251 - RNA, 22 nt, Human
caaaugcauagaaagaugaaac

SEQ ID NO: 904252 - RNA, 22 nt, Human
augaaccuugauuuguucaucu

SEQ ID NO: 904253 - RNA, 22 nt, Human
acagaaguccccaugaagaagc

SEQ ID NO: 904254 - RNA, 22 nt, Human
acaugucucuucugaaagacaa

SEQ ID NO: 904255 - RNA, 22 nt, Human
gccagguccccucauggcuccu

SEQ ID NO: 904256 - RNA, 22 nt, Human
gacuacaggccggcaucagaga

SEQ ID NO: 904257 - RNA, 22 nt, Human
aauaugaauuauuguuacaagu

SEQ ID NO: 904258 - RNA, 19 nt, Human
gaggucagcaagaaguauu

SEQ ID NO: 904259 - RNA, 22 nt, Human
caucauuucacuuagaugaagu

SEQ ID NO: 904260 - RNA, 22 nt, Human
guuucuuaauagcaggggccaa

SEQ ID NO: 904261 - RNA, 22 nt, Human
aucauuuaaaacaagucucuau

SEQ ID NO: 904262 - RNA, 22 nt, Human
aggaugugagccagccuggccu

SEQ ID NO: 904263 - RNA, 22 nt, Human
uagaggugagauuguggugcug

SEQ ID NO: 904264 - RNA, 22 nt, Human
aaugugaaucuuccuuuuugau

SEQ ID NO: 904265 - RNA, 22 nt, Human
uguuuacugcauucuauuugcu

SEQ ID NO: 904266 - RNA, 22 nt, Human
gcugucugucucugucccacca

SEQ ID NO: 904267 - RNA, 22 nt, Human
ucagaagccggaagugcuccuc

SEQ ID NO: 904268 - RNA, 22 nt, Human
cagcaggcugcgauugcucauu

SEQ ID NO: 904269 - RNA, 22 nt, Human
cauuauggaagugaagagcucu

SEQ ID NO: 904270 - RNA, 22 nt, Human
cugagggccugaggaccuagau

SEQ ID NO: 904271 - RNA, 22 nt, Human
cuuuggaaggaagaccuuucag

SEQ ID NO: 904272 - RNA, 22 nt, Human
uccaggcugauccaugaagaau

SEQ ID NO: 904273 - RNA, 22 nt, Human
uggcuuuaggccaaagccuaac

SEQ ID NO: 904274 - RNA, 22 nt, Human
cuccugucagaagcauccugag

SEQ ID NO: 904275 - RNA, 22 nt, Human
uuucuagaaugacucaucugag

SEQ ID NO: 904276 - RNA, 22 nt, Human
ucagaugcuaaagauggaauua

SEQ ID NO: 904277 - RNA, 22 nt, Human
caggcagaagaaguggaaggac

SEQ ID NO: 904278 - RNA, 17 nt, Human
caguaguggcacuggag

SEQ ID NO: 904279 - RNA, 22 nt, Human
ucacauuuuauaucucugguuu

SEQ ID NO: 904280 - RNA, 22 nt, Human
caggguguggucugcauucgga

SEQ ID NO: 904281 - RNA, 22 nt, Human
gucacuguauccagguuccagc

SEQ ID NO: 904282 - RNA, 22 nt, Human
cacagcugaccacccugcuccc

SEQ ID NO: 904283 - RNA, 22 nt, Human
cagcuguuguuaugucugcagg

SEQ ID NO: 904284 - RNA, 22 nt, Human
ucagggcaaagggcagaguuug

SEQ ID NO: 904285 - RNA, 22 nt, Human
aguagcagaaggucuugaaggg

SEQ ID NO: 904286 - RNA, 22 nt, Human
ugcugggauuacagucaugagc

SEQ ID NO: 904287 - RNA, 23 nt, Human
ugguggcagaaguagcagaugac

SEQ ID NO: 904288 - RNA, 22 nt, Human
cugggugaauuugaaggaaagg

SEQ ID NO: 904289 - RNA, 22 nt, Human
acacagaagaucucuuaaugcu

SEQ ID NO: 904290 - RNA, 22 nt, Human
ugaaagcauuagucuaagguag

SEQ ID NO: 904291 - RNA, 22 nt, Human
uagguuucagaggugccgggaa

SEQ ID NO: 904292 - RNA, 22 nt, Human
cacagggcagugauuguccaca

SEQ ID NO: 904293 - RNA, 22 nt, Human
uguuuacuuaaauguuuucaua

SEQ ID NO: 904294 - RNA, 22 nt, Human
ugugugcauguuaaugagaaaa

SEQ ID NO: 904295 - RNA, 22 nt, Human
aucuacaaccccucaaacugug

SEQ ID NO: 904296 - RNA, 22 nt, Human
acaauuagcugugugucuaucu

SEQ ID NO: 904297 - RNA, 17 nt, Human
gacagcugguuccuggc

SEQ ID NO: 904298 - RNA, 22 nt, Human
cuguccuggugcuggggauccc

SEQ ID NO: 904299 - RNA, 22 nt, Human
guucagcuaggaauggagaugc

SEQ ID NO: 904300 - RNA, 22 nt, Human
caaacauuuguuggaaccccug

SEQ ID NO: 904301 - RNA, 22 nt, Human
gcccugggauuggguggaggcu

SEQ ID NO: 904302 - RNA, 22 nt, Human
cugugaugauggaaacuuucuu

SEQ ID NO: 904303 - RNA, 22 nt, Human
augucuuuaaacuugaguuguu

SEQ ID NO: 904304 - RNA, 19 nt, Human
aaaaagaggcuauaauauu

SEQ ID NO: 904305 - RNA, 22 nt, Human
gaagagcuggaauccagucugg

SEQ ID NO: 904306 - RNA, 21 nt, Human
gcuggcucucugacgugcuuu

SEQ ID NO: 904307 - RNA, 22 nt, Human
acaguuucuccauuuacaccuu

SEQ ID NO: 904308 - RNA, 20 nt, Human
caggccagagguuugauggc

SEQ ID NO: 904309 - RNA, 22 nt, Human
gaacaaauucucaucaacuugu

SEQ ID NO: 904310 - RNA, 22 nt, Human
agcagaagaaagccacaugacu

SEQ ID NO: 904311 - RNA, 22 nt, Human
uuccaucugcuagguaaaugaa

SEQ ID NO: 904312 - RNA, 22 nt, Human
uccacagugguugaacuaguaa

SEQ ID NO: 904313 - RNA, 22 nt, Human
aguggggccggugaggccgagg

SEQ ID NO: 904314 - RNA, 20 nt, Human
cacaggccccaagaccugua

SEQ ID NO: 904315 - RNA, 22 nt, Human
gcagcaaucccaagucugagug

SEQ ID NO: 904316 - RNA, 22 nt, Human
aauguaaaguugggcacaaaug

SEQ ID NO: 904317 - RNA, 22 nt, Human
aucuaauuuucacucauuugcu

SEQ ID NO: 904318 - RNA, 22 nt, Human
uagaaucuggaaggggcuauuc

SEQ ID NO: 904319 - RNA, 22 nt, Human
gcugauagacugaauguuggga

SEQ ID NO: 904320 - RNA, 22 nt, Human
cggccaggcacaguggcccacg

SEQ ID NO: 904321 - RNA, 22 nt, Human
uuuguuuucuguaggccuuucc

SEQ ID NO: 904322 - RNA, 22 nt, Human
aggcuccagcccaaggcugcag

SEQ ID NO: 904323 - RNA, 22 nt, Human
cugugaggcggguggaguggag

SEQ ID NO: 904324 - RNA, 22 nt, Human
uauugcauaaaaucagguuaga

SEQ ID NO: 904325 - RNA, 22 nt, Human
agagacugugccagccccaugc

SEQ ID NO: 904326 - RNA, 22 nt, Human
gccuggccugaacuaggaggug

SEQ ID NO: 904327 - RNA, 22 nt, Human
accugaauuugaaauguuuauu

SEQ ID NO: 904328 - RNA, 22 nt, Human
cucauuaaaggaaaucaccugc

SEQ ID NO: 904329 - RNA, 22 nt, Human
caagguuucgaguucccaacca

SEQ ID NO: 904330 - RNA, 22 nt, Human
gcucugcccugggccguuguaa

SEQ ID NO: 904331 - RNA, 19 nt, Human
gggaaugauggaagacuuc

SEQ ID NO: 904332 - RNA, 22 nt, Human
gugccuguaaguuguaugggcu

SEQ ID NO: 904333 - RNA, 22 nt, Human
acuguccauucacucauauuca

SEQ ID NO: 904334 - RNA, 22 nt, Human
cugggcucaaauccuggcccug

SEQ ID NO: 904335 - RNA, 18 nt, Human
cuccagagcugugagaca

SEQ ID NO: 904336 - RNA, 22 nt, Human
ggacccagguagggaggaagau

SEQ ID NO: 904337 - RNA, 22 nt, Human
acagcaguggugcacugagcca

SEQ ID NO: 904338 - RNA, 21 nt, Human
ucaggcaggcgcagagggaag

SEQ ID NO: 904339 - RNA, 17 nt, Human
ggagaucuggcagaggg

SEQ ID NO: 904340 - RNA, 22 nt, Human
agagacuggaguuacgaguuca

SEQ ID NO: 904341 - RNA, 17 nt, Human
ggcugcaguccaggagg

SEQ ID NO: 904342 - RNA, 22 nt, Human
gaguguggugaacaggagcacc

SEQ ID NO: 904343 - RNA, 22 nt, Human
ucuuuuauagugaauuuucuug

SEQ ID NO: 904344 - RNA, 22 nt, Human
ugguauaauacaguaaguguug

SEQ ID NO: 904345 - RNA, 22 nt, Human
agagucaguuaugucaagugcu

SEQ ID NO: 904346 - RNA, 22 nt, Human
cuggcugaauccuagucucaua

SEQ ID NO: 904347 - RNA, 22 nt, Human
uuauaaagguuugugcauauuu

SEQ ID NO: 904348 - RNA, 22 nt, Human
acuaaaguaucuccuauuucau

SEQ ID NO: 904349 - RNA, 20 nt, Human
ugugcaggagagugaggcug

SEQ ID NO: 904350 - RNA, 22 nt, Human
caauguuuucaacugacaagua

SEQ ID NO: 904351 - RNA, 20 nt, Human
acaacaaacuugcuuaagga

SEQ ID NO: 904352 - RNA, 22 nt, Human
uggaauguagcaaguguuguca

SEQ ID NO: 904353 - RNA, 22 nt, Human
cagggucaggaggaucuggcuu

SEQ ID NO: 904354 - RNA, 22 nt, Human
cagagccaggucuaggagucuc

SEQ ID NO: 904355 - RNA, 22 nt, Human
gcaggcuuugacuuggggcaac

SEQ ID NO: 904356 - RNA, 20 nt, Human
gucuuauuuaacacaugacu

SEQ ID NO: 904357 - RNA, 20 nt, Human
aaaugcugugcuguugccau

SEQ ID NO: 904358 - RNA, 22 nt, Human
uuagcagcggucaguuuugaag

SEQ ID NO: 904359 - RNA, 22 nt, Human
agggaaggcuuuugacauuucc

SEQ ID NO: 904360 - RNA, 22 nt, Human
acuugaaaggaagcucuaaaac

SEQ ID NO: 904361 - RNA, 22 nt, Human
aauuucaaguggcaucuuugau

SEQ ID NO: 904362 - RNA, 22 nt, Human
uucccuucuaguuuugagagac

SEQ ID NO: 904363 - RNA, 22 nt, Human
ggauucuacugaucagcaccac

SEQ ID NO: 904364 - RNA, 22 nt, Human
acauugaaccaguagacacaaa

SEQ ID NO: 904365 - RNA, 22 nt, Human
auauagucacacuuugcaggca

SEQ ID NO: 904366 - RNA, 22 nt, Human
aggacccaagcacaguuccugg

SEQ ID NO: 904367 - RNA, 22 nt, Human
uauauccauuugucugcuaauu

SEQ ID NO: 904368 - RNA, 22 nt, Human
caguguuuguggaauucaggug

SEQ ID NO: 904369 - RNA, 22 nt, Human
uaucaaaguuguccugugaagu

SEQ ID NO: 904370 - RNA, 22 nt, Human
gagggaugcagaaacagaggcc

SEQ ID NO: 904371 - RNA, 22 nt, Human
cuacaggcucagggagcccucu

SEQ ID NO: 904372 - RNA, 22 nt, Human
uaagacuaguugaaugguuuuc

SEQ ID NO: 904373 - RNA, 22 nt, Human
auagaauccugcagcaagccuu

SEQ ID NO: 904374 - RNA, 22 nt, Human
caacuucaccaggguuccuaga

SEQ ID NO: 904375 - RNA, 18 nt, Human
ugaucuuucaugauucca

SEQ ID NO: 904376 - RNA, 22 nt, Human
ucugaaagcuagaaaaugcucu

SEQ ID NO: 904377 - RNA, 22 nt, Human
aagucucugacucacacaaugu

SEQ ID NO: 904378 - RNA, 21 nt, Human
auacagugguaugaauguagg

SEQ ID NO: 904379 - RNA, 22 nt, Human
ugucuccucauacugucauauu

SEQ ID NO: 904380 - RNA, 22 nt, Human
agaauauaaagauaauucuguu

SEQ ID NO: 904381 - RNA, 22 nt, Human
caggcuggucccagagcauugc

SEQ ID NO: 904382 - RNA, 22 nt, Human
gaggcaggguguugauuacaga

SEQ ID NO: 904383 - RNA, 22 nt, Human
ugcagcauuaguacaagucuca

SEQ ID NO: 904384 - RNA, 22 nt, Human
gucaggacaggcucuggacuga

SEQ ID NO: 904385 - RNA, 22 nt, Human
uggcccugcuggccaaaggcua

SEQ ID NO: 904386 - RNA, 22 nt, Human
aagaguuuucuauaaucuuggc

SEQ ID NO: 904387 - RNA, 22 nt, Human
cagcagcuccucugcggcuaug

SEQ ID NO: 904388 - RNA, 22 nt, Human
ucaagagagugcugcuuggggu

SEQ ID NO: 904389 - RNA, 22 nt, Human
acaugcaugaaauccauaaaca

SEQ ID NO: 904390 - RNA, 22 nt, Human
aagaagguguggaaagaugcuc

SEQ ID NO: 904391 - RNA, 22 nt, Human
ccuucugcuggucaucccagug

SEQ ID NO: 904392 - RNA, 22 nt, Human
gggcuuggaguaggcugaugaa

SEQ ID NO: 904393 - RNA, 22 nt, Human
cagaauguauaugaucuaaggu

SEQ ID NO: 904394 - RNA, 22 nt, Human
aaugcuuauggguuccauaaua

SEQ ID NO: 904395 - RNA, 22 nt, Human
uagacauuuucccuacccucau

SEQ ID NO: 904396 - RNA, 22 nt, Human
ggaugcugucuaagcugaggac

SEQ ID NO: 904397 - RNA, 22 nt, Human
uggagcaggugggaugucguga

SEQ ID NO: 904398 - RNA, 22 nt, Human
ucucagcaaggaaagaggcagg

SEQ ID NO: 904399 - RNA, 22 nt, Human
aaugucuacauucugaauucgu

SEQ ID NO: 904400 - RNA, 22 nt, Human
gcuccuggugcuguagagauuu

SEQ ID NO: 904401 - RNA, 22 nt, Human
ucuggccccuggucucuggugu

SEQ ID NO: 904402 - RNA, 21 nt, Human
acaaacugaaaugaguuuccu

SEQ ID NO: 904403 - RNA, 22 nt, Human
ugcucugggggaagccagcugu

SEQ ID NO: 904404 - RNA, 22 nt, Human
cauggcuucgcgcguccccgcu

SEQ ID NO: 904405 - RNA, 22 nt, Human
acaagagauuaucuacagauga

SEQ ID NO: 904406 - RNA, 22 nt, Human
cagcuuuuuagaaucuagggca

SEQ ID NO: 904407 - RNA, 22 nt, Human
ccagagguccugcucacuggug

SEQ ID NO: 904408 - RNA, 22 nt, Human
cuguaaaacugcuuaaguaugc

SEQ ID NO: 904409 - RNA, 20 nt, Human
ugagggaguauugauuuccc

SEQ ID NO: 904410 - RNA, 22 nt, Human
ucacugcugcugccaugaugga

SEQ ID NO: 904411 - RNA, 22 nt, Human
caggcucagcaggagccugacc

SEQ ID NO: 904412 - RNA, 22 nt, Human
gugggagagaccccgcuuaggg

SEQ ID NO: 904413 - RNA, 21 nt, Human
agggagcuuuagguagaaguu

SEQ ID NO: 904414 - RNA, 21 nt, Human
ugacauuuaguagcauuguca

SEQ ID NO: 904415 - RNA, 22 nt, Human
ggagagaggcuggccgugauga

SEQ ID NO: 904416 - RNA, 22 nt, Human
aaguguuuaacggugauugagc

SEQ ID NO: 904417 - RNA, 22 nt, Human
cagugggugccaucgugcccuu

SEQ ID NO: 904418 - RNA, 21 nt, Human
agacagcagucuccaaacccc

SEQ ID NO: 904419 - RNA, 21 nt, Human
ugacaacagaacugggcaagc

SEQ ID NO: 904420 - RNA, 22 nt, Human
cuucagugauugcagaaagccu

SEQ ID NO: 904421 - RNA, 22 nt, Human
cugggcugcuguccacuagggu

SEQ ID NO: 904422 - RNA, 22 nt, Human
gagagguggugaggacuugucu

SEQ ID NO: 904423 - RNA, 22 nt, Human
aggcuggaugugccucaccgag

SEQ ID NO: 904424 - RNA, 21 nt, Human
aguuacaaguuuauucagagg

SEQ ID NO: 904425 - RNA, 23 nt, Human
ggugguggugagucacgggcuca

SEQ ID NO: 904426 - RNA, 22 nt, Human
gugguaggcacagagaacaaga

SEQ ID NO: 904427 - RNA, 22 nt, Human
acauucauugagcaacaacaau

SEQ ID NO: 904428 - RNA, 20 nt, Human
cagucccaauccagggccag

SEQ ID NO: 904429 - RNA, 22 nt, Human
acaguucucuugucacuuccuc

SEQ ID NO: 904430 - RNA, 22 nt, Human
uccaggcaaaaaccaacuacag

SEQ ID NO: 904431 - RNA, 22 nt, Human
ugccugcugccuuucaucccaa

SEQ ID NO: 904432 - RNA, 22 nt, Human
acacccaggcuggcgugcagug

SEQ ID NO: 904433 - RNA, 22 nt, Human
cccaggguugccugccucugcu

SEQ ID NO: 904434 - RNA, 22 nt, Human
ucugaggcuaagagacagaggc

SEQ ID NO: 904435 - RNA, 22 nt, Human
aggcuucuucugccugucuuug

SEQ ID NO: 904436 - RNA, 22 nt, Human
cuucccuucugugcagggcaga

SEQ ID NO: 904437 - RNA, 21 nt, Human
ugcaguauguauuuguaucca

SEQ ID NO: 904438 - RNA, 22 nt, Human
gcccagcagaucucagugucuc

SEQ ID NO: 904439 - RNA, 22 nt, Human
auucagugccaaggagaacuug

SEQ ID NO: 904440 - RNA, 22 nt, Human
aaguuccucuucucugcaggga

SEQ ID NO: 904441 - RNA, 23 nt, Human
auggagcugguacuagcuaccuc

SEQ ID NO: 904442 - RNA, 22 nt, Human
uguagaugagucagggugcacc

SEQ ID NO: 904443 - RNA, 22 nt, Human
uuucacacuagucagaauacca

SEQ ID NO: 904444 - RNA, 18 nt, Human
ggcagcaagaagggaggg

SEQ ID NO: 904445 - RNA, 22 nt, Human
uggaaugaaaaguacuucagaa

SEQ ID NO: 904446 - RNA, 22 nt, Human
gagcuagaauuaggccaauuuc

SEQ ID NO: 904447 - RNA, 22 nt, Human
acagaauuuaaagcucuagacu

SEQ ID NO: 904448 - RNA, 22 nt, Human
gauaaagggggaccaaaugacu

SEQ ID NO: 904449 - RNA, 23 nt, Human
uugcuucugugcaauucaguacu

SEQ ID NO: 904450 - RNA, 22 nt, Human
uucauucauguauugucuaugg

SEQ ID NO: 904451 - RNA, 22 nt, Human
cuucugggauuaauuuuuccug

SEQ ID NO: 904452 - RNA, 22 nt, Human
aacucuuaauuuucaugaaaug

SEQ ID NO: 904453 - RNA, 22 nt, Human
agcauagagcaggaaguuaaga

SEQ ID NO: 904454 - RNA, 22 nt, Human
gguggccauggucagguagcgg

SEQ ID NO: 904455 - RNA, 22 nt, Human
aaguggaggccgaguucacgca

SEQ ID NO: 904456 - RNA, 22 nt, Human
cucuagaggcuugaaugggcga

SEQ ID NO: 904457 - RNA, 22 nt, Human
auauuuauaaggcaggcaagua

SEQ ID NO: 904458 - RNA, 22 nt, Human
ccaggaagcggugagggcugcc

SEQ ID NO: 904459 - RNA, 22 nt, Human
uucuguuacuugcaaccacagg

SEQ ID NO: 904460 - RNA, 22 nt, Human
gagcaacuucaauaguacuauu

SEQ ID NO: 904461 - RNA, 22 nt, Human
guagaaauauuuaucucugaga

SEQ ID NO: 904462 - RNA, 22 nt, Human
cugccgagugggucaugaggca

SEQ ID NO: 904463 - RNA, 17 nt, Human
gcacauguguucuuuua

SEQ ID NO: 904464 - RNA, 22 nt, Human
uccacagugguggaauuguuca

SEQ ID NO: 904465 - RNA, 22 nt, Human
aaauaagaggacagauguuugg

SEQ ID NO: 904466 - RNA, 22 nt, Human
gggcuggaccgcucgccucccu

SEQ ID NO: 904467 - RNA, 22 nt, Human
acaggcagauuaaggguaggca

SEQ ID NO: 904468 - RNA, 22 nt, Human
gcagggucugaggccacagagg

SEQ ID NO: 904469 - RNA, 22 nt, Human
augucacauuggagcugcugga

SEQ ID NO: 904470 - RNA, 22 nt, Human
ccaaaauaacagcccaauucac

SEQ ID NO: 904471 - RNA, 17 nt, Human
uucaaagcuuaucaagg

SEQ ID NO: 904472 - RNA, 22 nt, Human
augcugaggacaaagagaucaa

SEQ ID NO: 904473 - RNA, 22 nt, Human
ggcucaggggccaggccugucc

SEQ ID NO: 904474 - RNA, 22 nt, Human
ggauauaugcauguuaucauuu

SEQ ID NO: 904475 - RNA, 22 nt, Human
ggcuguggucauuaggagguug

SEQ ID NO: 904476 - RNA, 22 nt, Human
uucuccaaggauacaguccugu

SEQ ID NO: 904477 - RNA, 22 nt, Human
ccacuuaagagaacagcuauag

SEQ ID NO: 904478 - RNA, 22 nt, Human
aggcuccagccaaugggucugu

SEQ ID NO: 904479 - RNA, 22 nt, Human
cacaugaccacucuuuacuucu

SEQ ID NO: 904480 - RNA, 22 nt, Human
acagggccucagcugauucugg

SEQ ID NO: 904481 - RNA, 22 nt, Human
ucaccauccucaccuagaaaug

SEQ ID NO: 904482 - RNA, 22 nt, Human
uauguauccguguguguacaga

SEQ ID NO: 904483 - RNA, 22 nt, Human
uagguagcuuuggcguuucuug

SEQ ID NO: 904484 - RNA, 22 nt, Human
aucuuuagagucaucugagugu

SEQ ID NO: 904485 - RNA, 22 nt, Human
uagaaccuauuagaaauguauu

SEQ ID NO: 904486 - RNA, 22 nt, Human
agacucuuggagaagagcuaua

SEQ ID NO: 904487 - RNA, 22 nt, Human
auuuacagguagaauuuuaagu

SEQ ID NO: 904488 - RNA, 22 nt, Human
ucagcaguuuuauaugcagcuu

SEQ ID NO: 904489 - RNA, 22 nt, Human
uuuggaauuggaaagugcugug

SEQ ID NO: 904490 - RNA, 22 nt, Human
cacugugucuggagugagcugg

SEQ ID NO: 904491 - RNA, 22 nt, Human
gcucuugaaaaucaaaagggaa

SEQ ID NO: 904492 - RNA, 22 nt, Human
gcaaagcugggugugaaugcac

SEQ ID NO: 904493 - RNA, 22 nt, Human
acaaagauguuuaaagcauuua

SEQ ID NO: 904494 - RNA, 22 nt, Human
acuggaaaugagaugauaucag

SEQ ID NO: 904495 - RNA, 22 nt, Human
uucaagcagggauuggugaugg

SEQ ID NO: 904496 - RNA, 22 nt, Human
aguggacaaccaugcugagauu

SEQ ID NO: 904497 - RNA, 22 nt, Human
ucuaacauuguuuuucacagau

SEQ ID NO: 904498 - RNA, 22 nt, Human
augaaugcuuauuaaauugaaa

SEQ ID NO: 904499 - RNA, 22 nt, Human
ggccuugggaggagggucagaa

SEQ ID NO: 904500 - RNA, 22 nt, Human
gcugguccacauccugguacgu

SEQ ID NO: 904501 - RNA, 22 nt, Human
ggaagaaaugcucuucuaugcg

SEQ ID NO: 904502 - RNA, 22 nt, Human
aggccuuaccauagcuguagca

SEQ ID NO: 904503 - RNA, 22 nt, Human
ugcagcagaaguguucuucucu

SEQ ID NO: 904504 - RNA, 22 nt, Human
agugcaugcgcuugggaggggu

SEQ ID NO: 904505 - RNA, 22 nt, Human
auucugaugccuggguacugcc

SEQ ID NO: 904506 - RNA, 22 nt, Human
augaggcagcugcuggagaacg

SEQ ID NO: 904507 - RNA, 22 nt, Human
ggaaggcagugaaggggcugau

SEQ ID NO: 904508 - RNA, 22 nt, Human
gcaaacugguagcucgccugcc

SEQ ID NO: 904509 - RNA, 22 nt, Human
aguggcaucuaaguuuuagaaa

SEQ ID NO: 904510 - RNA, 22 nt, Human
gagugucagcagggcagagcac

SEQ ID NO: 904511 - RNA, 22 nt, Human
cuacaaaguaccacagacuggg

SEQ ID NO: 904512 - RNA, 22 nt, Human
ugcagggaacuuggacagcuag

SEQ ID NO: 904513 - RNA, 22 nt, Human
ugguuuguauauguuugugaga

SEQ ID NO: 904514 - RNA, 22 nt, Human
uccugggacucuuuaucagaga

SEQ ID NO: 904515 - RNA, 22 nt, Human
uauauucuuucaccuucuuccu

SEQ ID NO: 904516 - RNA, 22 nt, Human
uccuggguggugguaggagcag

SEQ ID NO: 904517 - RNA, 22 nt, Human
gcauuucagagaaaaucugcuu

SEQ ID NO: 904518 - RNA, 23 nt, Human
gcugagguacauuuacaggaaga

SEQ ID NO: 904519 - RNA, 22 nt, Human
augcuacagaguuugaauaugu

SEQ ID NO: 904520 - RNA, 22 nt, Human
agucaggcagcugagcuuuaug

SEQ ID NO: 904521 - RNA, 22 nt, Human
cuaaaugucucagagggagaca

SEQ ID NO: 904522 - RNA, 22 nt, Human
agccuggcacugccccauccau

SEQ ID NO: 904523 - RNA, 22 nt, Human
acuggccaggcagcaguagcuu

SEQ ID NO: 904524 - RNA, 22 nt, Human
uggcaguggauaggggagcggu

SEQ ID NO: 904525 - RNA, 22 nt, Human
ccacagugguuguggcaugugg

SEQ ID NO: 904526 - RNA, 22 nt, Human
cuccugggucauugccagcaaa

SEQ ID NO: 904527 - RNA, 22 nt, Human
uucaacagauauuuauugagca

SEQ ID NO: 904528 - RNA, 22 nt, Human
ccuguaggaacgccuucauuug

SEQ ID NO: 904529 - RNA, 22 nt, Human
gaaaucuacgauuagugaaaau

SEQ ID NO: 904530 - RNA, 22 nt, Human
ucuucuuuggaugaaagaauau

SEQ ID NO: 904531 - RNA, 22 nt, Human
uuagugucuucuucauccucug

SEQ ID NO: 904532 - RNA, 22 nt, Human
aguuauaggugguuuugagaau

SEQ ID NO: 904533 - RNA, 23 nt, Human
acagccaguucaccucuccuugg

SEQ ID NO: 904534 - RNA, 22 nt, Human
aaauugcuuauaaagaugaaug

SEQ ID NO: 904535 - RNA, 22 nt, Human
ugucaccaugccagcuucugcc

SEQ ID NO: 904536 - RNA, 22 nt, Human
gccuggcugggcaccaggggag

SEQ ID NO: 904537 - RNA, 22 nt, Human
ugugaaagcaagucuaguucuc

SEQ ID NO: 904538 - RNA, 22 nt, Human
aaaaacacaacugucuuucucu

SEQ ID NO: 904539 - RNA, 20 nt, Human
ucuuugugucagauggacag

SEQ ID NO: 904540 - RNA, 22 nt, Human
gcacuuuguggauuguauuucc

SEQ ID NO: 904541 - RNA, 22 nt, Human
gauggucaggucaucucaugga

SEQ ID NO: 904542 - RNA, 22 nt, Human
ggguggggcccaggaaaucuau

SEQ ID NO: 904543 - RNA, 22 nt, Human
uacauagauuuugaaacuggac

SEQ ID NO: 904544 - RNA, 22 nt, Human
aaugucuauuaaacugucauaa

SEQ ID NO: 904545 - RNA, 22 nt, Human
cugcuuccucccuguaaaggca

SEQ ID NO: 904546 - RNA, 22 nt, Human
uacaaagaguuuggucucuaga

SEQ ID NO: 904547 - RNA, 19 nt, Human
agggccugagcagauguug

SEQ ID NO: 904548 - RNA, 19 nt, Human
uuccaucuaucuucuuacu

SEQ ID NO: 904549 - RNA, 22 nt, Human
aggggagacuggaaucuaacau

SEQ ID NO: 904550 - RNA, 17 nt, Human
ugcagcaaaugggggac

SEQ ID NO: 904551 - RNA, 22 nt, Human
uucuaacuggcuugacaguuuc

SEQ ID NO: 904552 - RNA, 22 nt, Human
cuuacaaauacacuuaggagag

SEQ ID NO: 904553 - RNA, 22 nt, Human
cccagcauccucagggagcggg

SEQ ID NO: 904554 - RNA, 22 nt, Human
caguugaggacucaccuuugaa

SEQ ID NO: 904555 - RNA, 22 nt, Human
ggcagugagucccggagaggcc

SEQ ID NO: 904556 - RNA, 22 nt, Human
uuucagaaauggcacugaaauc

SEQ ID NO: 904557 - RNA, 22 nt, Human
auucacaauagcagcuugcaug

SEQ ID NO: 904558 - RNA, 22 nt, Human
aaacuucaaggauuugcaaauc

SEQ ID NO: 904559 - RNA, 22 nt, Human
uccacaggaaagcaccucccau

SEQ ID NO: 904560 - RNA, 22 nt, Human
cagaggcugaugugggaugggc

SEQ ID NO: 904561 - RNA, 22 nt, Human
caggccugguugagcccugaga

SEQ ID NO: 904562 - RNA, 22 nt, Human
uauuuugcaaaccugaguuuga

SEQ ID NO: 904563 - RNA, 22 nt, Human
uuuggucaaauauuauccugag

SEQ ID NO: 904564 - RNA, 22 nt, Human
gccaucuugagccaggaaguga

SEQ ID NO: 904565 - RNA, 22 nt, Human
cuggaagguaacaaggccauua

SEQ ID NO: 904566 - RNA, 22 nt, Human
uaucuuuaaugcuuggagguua

SEQ ID NO: 904567 - RNA, 22 nt, Human
aaguccauuaggccccugccug

SEQ ID NO: 904568 - RNA, 22 nt, Human
acuuguuuggagccagcuguaa

SEQ ID NO: 904569 - RNA, 22 nt, Human
cuaaacaaugaacaaagcacug

SEQ ID NO: 904570 - RNA, 20 nt, Human
ucugugcaccugcuacaagg

SEQ ID NO: 904571 - RNA, 22 nt, Human
accaaauaggcuuccuggguug

SEQ ID NO: 904572 - RNA, 22 nt, Human
aggcccaguguggcuuccugga

SEQ ID NO: 904573 - RNA, 22 nt, Human
uuugaaaucuaaucaaggaaca

SEQ ID NO: 904574 - RNA, 22 nt, Human
caggguguauaguguagaaguu

SEQ ID NO: 904575 - RNA, 22 nt, Human
ccaagaggggaagggccgcagc

SEQ ID NO: 904576 - RNA, 22 nt, Human
guccagagggcugcaggaugcu

SEQ ID NO: 904577 - RNA, 22 nt, Human
caggggacauuaaagcuccaua

SEQ ID NO: 904578 - RNA, 22 nt, Human
acauguguacauauauaugugc

SEQ ID NO: 904579 - RNA, 22 nt, Human
cuuccucugcggcgccgggcgc

SEQ ID NO: 904580 - RNA, 22 nt, Human
ucagcuggagacugcucaauga

SEQ ID NO: 904581 - RNA, 23 nt, Human
cagugugacgaggugaggcaggc

SEQ ID NO: 904582 - RNA, 22 nt, Human
agaaauguuacaguuguuauuu

SEQ ID NO: 904583 - RNA, 22 nt, Human
cagagucauugacuuccaggag

SEQ ID NO: 904584 - RNA, 22 nt, Human
guggugagauugcuggaucaaa

SEQ ID NO: 904585 - RNA, 22 nt, Human
auugaacagaaaccaucagagu

SEQ ID NO: 904586 - RNA, 22 nt, Human
ccucucccacguggcagaggcu

SEQ ID NO: 904587 - RNA, 22 nt, Human
uggcacaguuaaaguuguagaa

SEQ ID NO: 904588 - RNA, 22 nt, Human
caggugggaccaugauagggca

SEQ ID NO: 904589 - RNA, 18 nt, Human
uagaauauaggucauucu

SEQ ID NO: 904590 - RNA, 22 nt, Human
uaauggcuaaaauucagaagaa

SEQ ID NO: 904591 - RNA, 22 nt, Human
ggcagggcuugucucugugaug

SEQ ID NO: 904592 - RNA, 22 nt, Human
caccccuguggagcaugguggc

SEQ ID NO: 904593 - RNA, 22 nt, Human
ccugcucugguuuagucagucu

SEQ ID NO: 904594 - RNA, 22 nt, Human
agcuccuccugugccaggccag

SEQ ID NO: 904595 - RNA, 22 nt, Human
uuuauuuaccuuauguccucca

SEQ ID NO: 904596 - RNA, 22 nt, Human
ugagccaggucucacucaccuu

SEQ ID NO: 904597 - RNA, 19 nt, Human
aggaggccaugccacuaga

SEQ ID NO: 904598 - RNA, 22 nt, Human
aaucuggucuaagugaggauag

SEQ ID NO: 904599 - RNA, 21 nt, Human
agagcacagguggacaaugcu

SEQ ID NO: 904600 - RNA, 22 nt, Human
uugaucuucaucgaaauauugu

SEQ ID NO: 904601 - RNA, 22 nt, Human
caggugggcguggcgagaaggc

SEQ ID NO: 904602 - RNA, 22 nt, Human
agcagcagugugguuuggggaa

SEQ ID NO: 904603 - RNA, 22 nt, Human
caggaggccaacugugggacuu

SEQ ID NO: 904604 - RNA, 22 nt, Human
cugggucucaggaguucugagg

SEQ ID NO: 904605 - RNA, 22 nt, Human
acaugcaugugaauauggacac

SEQ ID NO: 904606 - RNA, 22 nt, Human
cuguucacagaauccuccccug

SEQ ID NO: 904607 - RNA, 22 nt, Human
gcuggguggaucggaggcucug

SEQ ID NO: 904608 - RNA, 23 nt, Human
aagugcuauguuuauaagagcug

SEQ ID NO: 904609 - RNA, 22 nt, Human
uuaaugaaugugugcuaacguu

SEQ ID NO: 904610 - RNA, 22 nt, Human
cagggaugguaaauauguaaag

SEQ ID NO: 904611 - RNA, 22 nt, Human
uguuaucacuuagacaugcuag

SEQ ID NO: 904612 - RNA, 22 nt, Human
uaacauguuaagaaauuagaua

SEQ ID NO: 904613 - RNA, 22 nt, Human
ucccacugugaauccaaggccu

SEQ ID NO: 904614 - RNA, 22 nt, Human
caugcauauuacuagcacagca

SEQ ID NO: 904615 - RNA, 20 nt, Human
aagauacuccagaaauuaaa

SEQ ID NO: 904616 - RNA, 22 nt, Human
agaagccauguuuaguaggaug

SEQ ID NO: 904617 - RNA, 22 nt, Human
ccuggggaauagagucaagggg

SEQ ID NO: 904618 - RNA, 22 nt, Human
uuugaucagcaagauaaauaga

SEQ ID NO: 904619 - RNA, 22 nt, Human
uucauguuggcauguuuuuagg

SEQ ID NO: 904620 - RNA, 22 nt, Human
ugauccccuucccaguaagccu

SEQ ID NO: 904621 - RNA, 22 nt, Human
guggagcaaucagagggucagu

SEQ ID NO: 904622 - RNA, 22 nt, Human
ucuuuucacaaaggagcuggag

SEQ ID NO: 904623 - RNA, 22 nt, Human
uucuggcagauugcguaauaaa

SEQ ID NO: 904624 - RNA, 22 nt, Human
aauugcauaaaauucaacucug

SEQ ID NO: 904625 - RNA, 22 nt, Human
cccaggcuccuagaggcccaga

SEQ ID NO: 904626 - RNA, 22 nt, Human
ccccuggguccaggcuucucug

SEQ ID NO: 904627 - RNA, 22 nt, Human
gucuuuaguugaaacauguggu

SEQ ID NO: 904628 - RNA, 22 nt, Human
aauaguuaagcaacuuuuucca

SEQ ID NO: 904629 - RNA, 22 nt, Human
augaaucaaaguucauuugauc

SEQ ID NO: 904630 - RNA, 22 nt, Human
guuccuuguaauuuguuaagga

SEQ ID NO: 904631 - RNA, 22 nt, Human
uacuucauuccuuuguaaaaug

SEQ ID NO: 904632 - RNA, 22 nt, Human
gucuggccugccagcucuggug

SEQ ID NO: 904633 - RNA, 20 nt, Human
cagagcuguuauggaugaug

SEQ ID NO: 904634 - RNA, 22 nt, Human
ggcucuggugugaagcagccuc

SEQ ID NO: 904635 - RNA, 22 nt, Human
uguauguaaaguuuguaauaga

SEQ ID NO: 904636 - RNA, 22 nt, Human
augcccaggcccauaccuagau

SEQ ID NO: 904637 - RNA, 22 nt, Human
acagugaaugagaauggagaaa

SEQ ID NO: 904638 - RNA, 22 nt, Human
gaggcagcugaagcuucaaaga

SEQ ID NO: 904639 - RNA, 22 nt, Human
caggugccucaggaugagacaa

SEQ ID NO: 904640 - RNA, 22 nt, Human
aggcagggucuugcuauguugc

SEQ ID NO: 904641 - RNA, 22 nt, Human
ggaaggagcauuugccaguuua

SEQ ID NO: 904642 - RNA, 22 nt, Human
gugucccacucuggaggugaag

SEQ ID NO: 904643 - RNA, 22 nt, Human
aaagguaacugggguuuugcca

SEQ ID NO: 904644 - RNA, 22 nt, Human
uuuuguauagucaaagacaaga

SEQ ID NO: 904645 - RNA, 22 nt, Human
uggaagagggagcuggguggcc

SEQ ID NO: 904646 - RNA, 22 nt, Human
ucuuugcacugugcaagcagaa

SEQ ID NO: 904647 - RNA, 22 nt, Human
ccccagccagcuuguaguagaa

SEQ ID NO: 904648 - RNA, 22 nt, Human
uuucaaacauuccugggagacu

SEQ ID NO: 904649 - RNA, 22 nt, Human
ugugccuggcccagugguguca

SEQ ID NO: 904650 - RNA, 19 nt, Human
gaaaacaugggugaggguc

SEQ ID NO: 904651 - RNA, 22 nt, Human
uucagaaaucgaguuucauguc

SEQ ID NO: 904652 - RNA, 22 nt, Human
cauggcacugagcagguaugca

SEQ ID NO: 904653 - RNA, 22 nt, Human
gcagggcaaugaucccgagagg

SEQ ID NO: 904654 - RNA, 22 nt, Human
aaaguaugauuggggauuauuu

SEQ ID NO: 904655 - RNA, 22 nt, Human
ugaaagaacuagcaucuucaag

SEQ ID NO: 904656 - RNA, 22 nt, Human
aguagcagugacagcugaggua

SEQ ID NO: 904657 - RNA, 22 nt, Human
ucaggagugcagcaguuuggag

SEQ ID NO: 904658 - RNA, 22 nt, Human
augaaggauagggcaaaauuuu

SEQ ID NO: 904659 - RNA, 22 nt, Human
caugcuuugggucagaaaugcc

SEQ ID NO: 904660 - RNA, 22 nt, Human
gaaaugauuuuaguuuaucaug

SEQ ID NO: 904661 - RNA, 22 nt, Human
uuuccacaucaccaugagguga

SEQ ID NO: 904662 - RNA, 22 nt, Human
ugagccagagagguugaggcua

SEQ ID NO: 904663 - RNA, 22 nt, Human
cauagacauucagcacucacua

SEQ ID NO: 904664 - RNA, 22 nt, Human
uacugauauuuucaacuagaag

SEQ ID NO: 904665 - RNA, 22 nt, Human
cugucuccgcccucuugguagg

SEQ ID NO: 904666 - RNA, 22 nt, Human
aaagagcaagcugagauuugaa

SEQ ID NO: 904667 - RNA, 22 nt, Human
ugaaguauccaucuuguucuag

SEQ ID NO: 904668 - RNA, 22 nt, Human
auggagugggccaauuuuagug

SEQ ID NO: 904669 - RNA, 22 nt, Human
agagccaguuacaacuguggag

SEQ ID NO: 904670 - RNA, 22 nt, Human
ccuguucuguggcucucaaagg

SEQ ID NO: 904671 - RNA, 22 nt, Human
cacuuuaaaacugacagcccuu

SEQ ID NO: 904672 - RNA, 22 nt, Human
agaugugggcaauggaauggag

SEQ ID NO: 904673 - RNA, 20 nt, Human
gcagcugugcauucuuagga

SEQ ID NO: 904674 - RNA, 22 nt, Human
cugggcucagcaggccaaggcc

SEQ ID NO: 904675 - RNA, 22 nt, Human
uagaugaccuuguguuaggcaa

SEQ ID NO: 904676 - RNA, 22 nt, Human
cuagggucuguuuuccaggugu

SEQ ID NO: 904677 - RNA, 22 nt, Human
auuuccuaacagaggcaacagu

SEQ ID NO: 904678 - RNA, 22 nt, Human
agcugccaucugaagaacugca

SEQ ID NO: 904679 - RNA, 22 nt, Human
auucugaguacaacaagauguu

SEQ ID NO: 904680 - RNA, 22 nt, Human
aggaacaagggagccuuuucuc

SEQ ID NO: 904681 - RNA, 22 nt, Human
gagggcugugaaggagcggguu

SEQ ID NO: 904682 - RNA, 22 nt, Human
uaugcuguauucuguauguuag

SEQ ID NO: 904683 - RNA, 22 nt, Human
gcugccucugcacagcucacuc

SEQ ID NO: 904684 - RNA, 22 nt, Human
aggaccaccgguccauccaccc

SEQ ID NO: 904685 - RNA, 21 nt, Human
ccuggcucuguguuuauuaug

SEQ ID NO: 904686 - RNA, 19 nt, Human
aauggcagaugccauaucu

SEQ ID NO: 904687 - RNA, 22 nt, Human
cagcucugggugacaggagggc

SEQ ID NO: 904688 - RNA, 22 nt, Human
uggaauguuugacuuauucagu

SEQ ID NO: 904689 - RNA, 22 nt, Human
ucugcaagugacccgggcccag

SEQ ID NO: 904690 - RNA, 22 nt, Human
uuacaguugcuacaaaggauaa

SEQ ID NO: 904691 - RNA, 22 nt, Human
ggaagcugcauaacuagcgugg

SEQ ID NO: 904692 - RNA, 22 nt, Human
aacaggagaggggaauguagag

SEQ ID NO: 904693 - RNA, 22 nt, Human
augcaauguuacagaauguacu

SEQ ID NO: 904694 - RNA, 20 nt, Human
uccaggcuccuccacuuagu

SEQ ID NO: 904695 - RNA, 22 nt, Human
caccagggcucugagcucugaa

SEQ ID NO: 904696 - RNA, 22 nt, Human
ucauaagugguuuauaugcuug

SEQ ID NO: 904697 - RNA, 22 nt, Human
agggcuccuaugccccauggac

SEQ ID NO: 904698 - RNA, 22 nt, Human
aauucuauaggcaagcuauuuu

SEQ ID NO: 904699 - RNA, 20 nt, Human
uucuggaggcuacaagucug

SEQ ID NO: 904700 - RNA, 23 nt, Human
uccaagaaguagggccuggacuu

SEQ ID NO: 904701 - RNA, 22 nt, Human
cuggcccucagacucaugggca

SEQ ID NO: 904702 - RNA, 22 nt, Human
ugcaguguuuuucagggcauau

SEQ ID NO: 904703 - RNA, 22 nt, Human
cagaugcuaaguuaucagcagg

SEQ ID NO: 904704 - RNA, 22 nt, Human
uauugcauacuuaaauuuccgg

SEQ ID NO: 904705 - RNA, 22 nt, Human
aagguauuauugucuauguacu

SEQ ID NO: 904706 - RNA, 22 nt, Human
cacugcauggaugauggcugua

SEQ ID NO: 904707 - RNA, 22 nt, Human
uuuggaaggugaggcaugaagg

SEQ ID NO: 904708 - RNA, 22 nt, Human
uggcagcugucuguggggucuc

SEQ ID NO: 904709 - RNA, 22 nt, Human
cugcagcaguacucagcagcca

SEQ ID NO: 904710 - RNA, 22 nt, Human
ucauuaaaaugcagauucugac

SEQ ID NO: 904711 - RNA, 19 nt, Human
acauuuaaauucagaucuc

SEQ ID NO: 904712 - RNA, 22 nt, Human
caguuacauaaaugauaaaaug

SEQ ID NO: 904713 - RNA, 22 nt, Human
ggcaaaaaccauaauuacuuuu

SEQ ID NO: 904714 - RNA, 22 nt, Human
uuccugugaaauauagguccau

SEQ ID NO: 904715 - RNA, 22 nt, Human
auggcagagggauugaacagcu

SEQ ID NO: 904716 - RNA, 22 nt, Human
gcacugcaucuacuggcaagua

SEQ ID NO: 904717 - RNA, 22 nt, Human
ugcagggccaugguggcggcug

SEQ ID NO: 904718 - RNA, 22 nt, Human
agcauaaacucagggacacaca

SEQ ID NO: 904719 - RNA, 22 nt, Human
uucauuacuuaggcaggcauuu

SEQ ID NO: 904720 - RNA, 22 nt, Human
cugggacauauugcuaguguug

SEQ ID NO: 904721 - RNA, 22 nt, Human
agcuggcuccagaaggagucgu

SEQ ID NO: 904722 - RNA, 22 nt, Human
agagugggugaucucuguuguc

SEQ ID NO: 904723 - RNA, 22 nt, Human
ugagaccuguaaugagaaauug

SEQ ID NO: 904724 - RNA, 22 nt, Human
aagcccagaugggagcauuuca

SEQ ID NO: 904725 - RNA, 19 nt, Human
acagagcucucugcuucug

SEQ ID NO: 904726 - RNA, 22 nt, Human
uagaaucugauggcccgucugg

SEQ ID NO: 904727 - RNA, 22 nt, Human
ugguucccuuaacagcuguaua

SEQ ID NO: 904728 - RNA, 22 nt, Human
ugcaaacacuucaacgugcauc

SEQ ID NO: 904729 - RNA, 22 nt, Human
aaguaacaaugcuguugaauug

SEQ ID NO: 904730 - RNA, 18 nt, Human
uccagcaggucugaggug

SEQ ID NO: 904731 - RNA, 22 nt, Human
aaacccaggguuuugucuuccc

SEQ ID NO: 904732 - RNA, 22 nt, Human
uagaaacaugagagaaacucuu

SEQ ID NO: 904733 - RNA, 22 nt, Human
uuuagagcugugcugccacaug

SEQ ID NO: 904734 - RNA, 22 nt, Human
uauuccaguucaccuuuucauc

SEQ ID NO: 904735 - RNA, 22 nt, Human
uggauaaauggugcuaucaccc

SEQ ID NO: 904736 - RNA, 22 nt, Human
aggaacugaugagcagccaggg

SEQ ID NO: 904737 - RNA, 22 nt, Human
agaacuuacauuauagagcugu

SEQ ID NO: 904738 - RNA, 22 nt, Human
gcaccugcaggaugagccaggg

SEQ ID NO: 904739 - RNA, 23 nt, Human
uuucaacaaugcuuagagaaaac

SEQ ID NO: 904740 - RNA, 22 nt, Human
ccaucaaugacuaauaaaauag

SEQ ID NO: 904741 - RNA, 22 nt, Human
cugggucuuuuucuuccauuga

SEQ ID NO: 904742 - RNA, 22 nt, Human
uagguuccaugagggaggcaaa

SEQ ID NO: 904743 - RNA, 22 nt, Human
ggaggggugagaauggcugccu

SEQ ID NO: 904744 - RNA, 22 nt, Human
ggagugaaucacuagaugcaga

SEQ ID NO: 904745 - RNA, 17 nt, Human
agcugccagggagugug

SEQ ID NO: 904746 - RNA, 22 nt, Human
cucaggagagucuuauaucucc

SEQ ID NO: 904747 - RNA, 22 nt, Human
aaagccagcucugagcugcacc

SEQ ID NO: 904748 - RNA, 22 nt, Human
uggaugcuguaggacacgcucu

SEQ ID NO: 904749 - RNA, 22 nt, Human
gaagcugaugaggaccagauug

SEQ ID NO: 904750 - RNA, 22 nt, Human
ucagccugcuccaagugcugcc

SEQ ID NO: 904751 - RNA, 22 nt, Human
gcuggagagugaggggagcaag

SEQ ID NO: 904752 - RNA, 22 nt, Human
ugcagcacuugccaaacuaacu

SEQ ID NO: 904753 - RNA, 22 nt, Human
gcccuggauggcaggagccauc

SEQ ID NO: 904754 - RNA, 22 nt, Human
ggaggccacgguuuagcaccga

SEQ ID NO: 904755 - RNA, 22 nt, Human
acauuuguaggacagaggaaga

SEQ ID NO: 904756 - RNA, 22 nt, Human
agauacaacuguuuaaacauua

SEQ ID NO: 904757 - RNA, 22 nt, Human
cuaguggaaacuaacuggaauu

SEQ ID NO: 904758 - RNA, 22 nt, Human
aagauacauuguuuuugguagu

SEQ ID NO: 904759 - RNA, 22 nt, Human
acagccagaggagccaggcugg

SEQ ID NO: 904760 - RNA, 22 nt, Human
gggugcaggcagcccaggcagg

SEQ ID NO: 904761 - RNA, 22 nt, Human
uucuguggucucccaugucugu

SEQ ID NO: 904762 - RNA, 22 nt, Human
cugaggccagaacccgacccug

SEQ ID NO: 904763 - RNA, 22 nt, Human
aaggauagucacauuuuuaugu

SEQ ID NO: 904764 - RNA, 22 nt, Human
agugacagucucagagaucagg

SEQ ID NO: 904765 - RNA, 22 nt, Human
aggcugagcaaagggccuuacc

SEQ ID NO: 904766 - RNA, 22 nt, Human
uuguauuuccuauaaccuuucu

SEQ ID NO: 904767 - RNA, 22 nt, Human
aagacauuacuggaaucugacu

SEQ ID NO: 904768 - RNA, 22 nt, Human
ugugcccauuacacagaggcau

SEQ ID NO: 904769 - RNA, 22 nt, Human
ggaaaaggccauuguuucucug

SEQ ID NO: 904770 - RNA, 22 nt, Human
auacacuaaucaugugcucagu

SEQ ID NO: 904771 - RNA, 22 nt, Human
aauagcuuucucaugacuucac

SEQ ID NO: 904772 - RNA, 22 nt, Human
uguacauugucacucaucaagu

SEQ ID NO: 904773 - RNA, 22 nt, Human
ucuuucauucuagucugagguu

SEQ ID NO: 904774 - RNA, 23 nt, Human
cagugggcuucuaacugcuccug

SEQ ID NO: 904775 - RNA, 22 nt, Human
aaugguuuuuagugagaucgau

SEQ ID NO: 904776 - RNA, 22 nt, Human
ucaaugcaugugacaaagagua

SEQ ID NO: 904777 - RNA, 22 nt, Human
auucugggaguguaggaugguu

SEQ ID NO: 904778 - RNA, 22 nt, Human
agccaagagacagaugcccacc

SEQ ID NO: 904779 - RNA, 22 nt, Human
gccuucccaagacgccugaguu

SEQ ID NO: 904780 - RNA, 22 nt, Human
agauguuuguaaacacacugcu

SEQ ID NO: 904781 - RNA, 22 nt, Human
aggaaaauuaucaugagagcca

SEQ ID NO: 904782 - RNA, 22 nt, Human
ggaggccaggaaggcucggaga

SEQ ID NO: 904783 - RNA, 22 nt, Human
gugauucucauguuccugaagu

SEQ ID NO: 904784 - RNA, 20 nt, Human
uuuuucugggcuuccauagc

SEQ ID NO: 904785 - RNA, 22 nt, Human
ugccuguguggucugcgcauua

SEQ ID NO: 904786 - RNA, 22 nt, Human
acugagaaauuuccagacuugc

SEQ ID NO: 904787 - RNA, 22 nt, Human
uacuucaugaguuaauaugcag

SEQ ID NO: 904788 - RNA, 22 nt, Human
cagcccacgucagggccacuca

SEQ ID NO: 904789 - RNA, 22 nt, Human
agucacuugauucuccugagcu

SEQ ID NO: 904790 - RNA, 18 nt, Human
caaauucucauugauuuc

SEQ ID NO: 904791 - RNA, 23 nt, Human
gggcugcuccaggccaaggcugg

SEQ ID NO: 904792 - RNA, 22 nt, Human
augggcaguuaggaggccagga

SEQ ID NO: 904793 - RNA, 19 nt, Human
aguuggggcagggaagaga

SEQ ID NO: 904794 - RNA, 22 nt, Human
uuccuguuguguuagagucaau

SEQ ID NO: 904795 - RNA, 22 nt, Human
uagagauggggucuugcuauga

SEQ ID NO: 904796 - RNA, 22 nt, Human
aagauuuagggccaguuuacau

SEQ ID NO: 904797 - RNA, 22 nt, Human
ucugagcagagcaucauuucag

SEQ ID NO: 904798 - RNA, 22 nt, Human
gagcuuaaauggcuaaauauaa

SEQ ID NO: 904799 - RNA, 22 nt, Human
auaaaacuuauuagaauugugu

SEQ ID NO: 904800 - RNA, 22 nt, Human
cggagaggugggggcagcaucu

SEQ ID NO: 904801 - RNA, 22 nt, Human
gacagaggcuggagcaccuccu

SEQ ID NO: 904802 - RNA, 22 nt, Human
ucaaaugagaggcagggcagcu

SEQ ID NO: 904803 - RNA, 22 nt, Human
augccaagaaucauaugccagg

SEQ ID NO: 904804 - RNA, 22 nt, Human
gccagccacuucagcuauggcu

SEQ ID NO: 904805 - RNA, 22 nt, Human
uuuacaaccucauauucugaug

SEQ ID NO: 904806 - RNA, 22 nt, Human
ccagggcagugggagaaggugc

SEQ ID NO: 904807 - RNA, 22 nt, Human
ggcuucaucucguugacaccuc

SEQ ID NO: 904808 - RNA, 22 nt, Human
auuagcaagguucaugagaaga

SEQ ID NO: 904809 - RNA, 22 nt, Human
cagcugugaauugucuuaucua

SEQ ID NO: 904810 - RNA, 22 nt, Human
agaauccugaugaaaaggagag

SEQ ID NO: 904811 - RNA, 22 nt, Human
ccaggcucugagccucacucuu

SEQ ID NO: 904812 - RNA, 22 nt, Human
agucuagcuuaggagccuagcu

SEQ ID NO: 904813 - RNA, 22 nt, Human
cuuccuugugguccuucucauu

SEQ ID NO: 904814 - RNA, 21 nt, Human
uucagcaguccucuagagaua

SEQ ID NO: 904815 - RNA, 22 nt, Human
agccaagguaucaugagaggca

SEQ ID NO: 904816 - RNA, 22 nt, Human
gccugcucugacauccauccca

SEQ ID NO: 904817 - RNA, 22 nt, Human
gcugaggccaggccccaccgga

SEQ ID NO: 904818 - RNA, 22 nt, Human
agacauuuuacauucuuccauu

SEQ ID NO: 904819 - RNA, 22 nt, Human
auuaagaguuacaaauagagua

SEQ ID NO: 904820 - RNA, 20 nt, Human
uccaagcccuccuuccauuc

SEQ ID NO: 904821 - RNA, 22 nt, Human
uuagaagucaucuagucuaaaa

SEQ ID NO: 904822 - RNA, 22 nt, Human
ggcaaccugagcuuguggagaa

SEQ ID NO: 904823 - RNA, 22 nt, Human
uuaagaagugauuuuccucauu

SEQ ID NO: 904824 - RNA, 23 nt, Human
aggcuggcuucaggagccucucc

SEQ ID NO: 904825 - RNA, 22 nt, Human
acuguagugaugauaauuaagu

SEQ ID NO: 904826 - RNA, 22 nt, Human
gucccagaggacagggucacau

SEQ ID NO: 904827 - RNA, 22 nt, Human
acauguuuaaguuuguuauaug

SEQ ID NO: 904828 - RNA, 22 nt, Human
gcugcccugacaagcuacuccc

SEQ ID NO: 904829 - RNA, 22 nt, Human
ugcaggaguccaaucaggagac

SEQ ID NO: 904830 - RNA, 22 nt, Human
cuaggcagcuuugggugugaag

SEQ ID NO: 904831 - RNA, 22 nt, Human
cucugccaagaugacagguaag

SEQ ID NO: 904832 - RNA, 22 nt, Human
uggugcaggccaagcugcgagc

SEQ ID NO: 904833 - RNA, 22 nt, Human
acucaugguagcacaggcugug

SEQ ID NO: 904834 - RNA, 22 nt, Human
uucguguggagauguuucugca

SEQ ID NO: 904835 - RNA, 23 nt, Human
aagccccaaggaacuuccuggga

SEQ ID NO: 904836 - RNA, 22 nt, Human
acuguggcuaauucauuugguc

SEQ ID NO: 904837 - RNA, 22 nt, Human
ggucccaagugcuuuuccugca

SEQ ID NO: 904838 - RNA, 22 nt, Human
uccugccuuagagcaaggaaaa

SEQ ID NO: 904839 - RNA, 22 nt, Human
agccuggcggucgucggucagg

SEQ ID NO: 904840 - RNA, 20 nt, Human
acauggaaggucaaacuauc

SEQ ID NO: 904841 - RNA, 22 nt, Human
uucaugaauauauugaauuagc

SEQ ID NO: 904842 - RNA, 22 nt, Human
uaggaaaugaaugcaggcuccc

SEQ ID NO: 904843 - RNA, 22 nt, Human
uguuucuugauaaagcagaaaa

SEQ ID NO: 904844 - RNA, 22 nt, Human
gaggaaggaaugcaguguaugc

SEQ ID NO: 904845 - RNA, 22 nt, Human
ggccaggagcugcacagggcuc

SEQ ID NO: 904846 - RNA, 22 nt, Human
auguaguugaagugcuauaaag

SEQ ID NO: 904847 - RNA, 22 nt, Human
gacagacagagaaugggcuuga

SEQ ID NO: 904848 - RNA, 22 nt, Human
ggccagguaagagugcagccgc

SEQ ID NO: 904849 - RNA, 22 nt, Human
aaagauguccaaguaaaguuaa

SEQ ID NO: 904850 - RNA, 22 nt, Human
ucacaggccuggggcagagggc

SEQ ID NO: 904851 - RNA, 22 nt, Human
gcagggcagccacaggcccccu

SEQ ID NO: 904852 - RNA, 22 nt, Human
ccagcucccgcaggcugcacag

SEQ ID NO: 904853 - RNA, 22 nt, Human
cccaggagguggaguucacagu

SEQ ID NO: 904854 - RNA, 19 nt, Human
ugccaaauccaugcccagg

SEQ ID NO: 904855 - RNA, 22 nt, Human
guguguggcauguccuauuuug

SEQ ID NO: 904856 - RNA, 20 nt, Human
uagaaucuacuauuuggccc

SEQ ID NO: 904857 - RNA, 21 nt, Human
cuggaggguagaguugggcug

SEQ ID NO: 904858 - RNA, 21 nt, Human
aaaggccauaaucacggagca

SEQ ID NO: 904859 - RNA, 22 nt, Human
cauuagaagaacaguuauauua

SEQ ID NO: 904860 - RNA, 23 nt, Human
agagggugcaacauggggaucua

SEQ ID NO: 904861 - RNA, 22 nt, Human
ggagcugagguaacagugagug

SEQ ID NO: 904862 - RNA, 22 nt, Human
ugccuggcacagagcagguggc

SEQ ID NO: 904863 - RNA, 23 nt, Human
agcaaauaaucugcuugcuuuuu

SEQ ID NO: 904864 - RNA, 22 nt, Human
guucauauuuaacuaagauagg

SEQ ID NO: 904865 - RNA, 22 nt, Human
ccagagccccugagcuucccug

SEQ ID NO: 904866 - RNA, 22 nt, Human
cugccaggcagggagauggcug

SEQ ID NO: 904867 - RNA, 22 nt, Human
ggcgggagauggggccguucag

SEQ ID NO: 904868 - RNA, 22 nt, Human
uuggaaaagugaaacuagaugc

SEQ ID NO: 904869 - RNA, 22 nt, Human
uacaguaauaaaaugagcuaca

SEQ ID NO: 904870 - RNA, 21 nt, Human
cauauuaaaucggugccuuua

SEQ ID NO: 904871 - RNA, 23 nt, Human
agcuggaggcugucuacucccaa

SEQ ID NO: 904872 - RNA, 22 nt, Human
cagaagcaagggccaaagucuu

SEQ ID NO: 904873 - RNA, 22 nt, Human
uucaaaagacucagauguagcg

SEQ ID NO: 904874 - RNA, 22 nt, Human
ggcuguagucagugacauggua

SEQ ID NO: 904875 - RNA, 22 nt, Human
guugaauaucguguucuuguuu

SEQ ID NO: 904876 - RNA, 22 nt, Human
uuuaguucauaaaaccagggug

SEQ ID NO: 904877 - RNA, 23 nt, Human
uuggaaauggggagaacagauuc

SEQ ID NO: 904878 - RNA, 22 nt, Human
gcugagcuagaaaaggaccaca

SEQ ID NO: 904879 - RNA, 22 nt, Human
ugaaacauaaaguuaucuucag

SEQ ID NO: 904880 - RNA, 22 nt, Human
agccacaaugccaaccucuacu

SEQ ID NO: 904881 - RNA, 22 nt, Human
cagggccuucguaaguguccgg

SEQ ID NO: 904882 - RNA, 22 nt, Human
uaugacuuauuucaucaguucu

SEQ ID NO: 904883 - RNA, 22 nt, Human
uguuucaagcaauagcauuuca

SEQ ID NO: 904884 - RNA, 22 nt, Human
guuucaaagcacagcucacauu

SEQ ID NO: 904885 - RNA, 22 nt, Human
ugggaggaaugucacugagcca

SEQ ID NO: 904886 - RNA, 22 nt, Human
uggcucugucacugugagcuau

SEQ ID NO: 904887 - RNA, 22 nt, Human
aggaggguucucuggacagagg

SEQ ID NO: 904888 - RNA, 22 nt, Human
cuuucacagccuucguucugaa

SEQ ID NO: 904889 - RNA, 22 nt, Human
cucugaagccccaaauaguccg

SEQ ID NO: 904890 - RNA, 22 nt, Human
uccaaaaaacguuugaauaguu

SEQ ID NO: 904891 - RNA, 22 nt, Human
ugagcccagagcccuuguaggg

SEQ ID NO: 904892 - RNA, 22 nt, Human
cauguguaaggcucacaggcag

SEQ ID NO: 904893 - RNA, 22 nt, Human
uuuccucacacagaagaucuug

SEQ ID NO: 904894 - RNA, 21 nt, Human
uuucacaaaaguaugugacaa

SEQ ID NO: 904895 - RNA, 22 nt, Human
uuuccugucuuuugugaaggau

SEQ ID NO: 904896 - RNA, 22 nt, Human
aaggcuguuuauuagaaaaagu

SEQ ID NO: 904897 - RNA, 22 nt, Human
aggccuagaggaauggccaggg

SEQ ID NO: 904898 - RNA, 22 nt, Human
aagugccugaccuagccuggag

SEQ ID NO: 904899 - RNA, 22 nt, Human
aggcccagcuggacaaacugcu

SEQ ID NO: 904900 - RNA, 22 nt, Human
aacaaagcaccacugagucagu

SEQ ID NO: 904901 - RNA, 22 nt, Human
cggagcuggcgucuguguggac

SEQ ID NO: 904902 - RNA, 22 nt, Human
acacagguuccaucuccaccuu

SEQ ID NO: 904903 - RNA, 22 nt, Human
aggagccaaggaaaacaguauu

SEQ ID NO: 904904 - RNA, 22 nt, Human
gugauuucuaaucaucugaaug

SEQ ID NO: 904905 - RNA, 23 nt, Human
uuuuuaguuacaccucugccacc

SEQ ID NO: 904906 - RNA, 22 nt, Human
guuagaaagugucugcuugggu

SEQ ID NO: 904907 - RNA, 22 nt, Human
gagggaaaauaaaauugcagua

SEQ ID NO: 904908 - RNA, 22 nt, Human
agcaaauauuuuguugaagugc

SEQ ID NO: 904909 - RNA, 22 nt, Human
augcuuuauugcuucugggcac

SEQ ID NO: 904910 - RNA, 22 nt, Human
auucaagagcccauguuuccug

SEQ ID NO: 904911 - RNA, 20 nt, Human
uccugugugucucaucaacc

SEQ ID NO: 904912 - RNA, 22 nt, Human
ugugugucagucuuguuuaggg

SEQ ID NO: 904913 - RNA, 22 nt, Human
ccagagggccuuuggaguuauc

SEQ ID NO: 904914 - RNA, 22 nt, Human
gcagccucaaacuccccagcuc

SEQ ID NO: 904915 - RNA, 22 nt, Human
aacuucaguugagaaaggcaug

SEQ ID NO: 904916 - RNA, 22 nt, Human
aggcucugaggcagauuuucgu

SEQ ID NO: 904917 - RNA, 22 nt, Human
caauuauucagugacuuaagag

SEQ ID NO: 904918 - RNA, 22 nt, Human
cugcuccaggaacagagcugcu

SEQ ID NO: 904919 - RNA, 22 nt, Human
uuguacaaauaggaaccucuga

SEQ ID NO: 904920 - RNA, 20 nt, Human
cugggucuccuucugcuuaa

SEQ ID NO: 904921 - RNA, 22 nt, Human
gaacacugaggacacugagaau

SEQ ID NO: 904922 - RNA, 22 nt, Human
ggagaaaggcauagcagaaccu

SEQ ID NO: 904923 - RNA, 22 nt, Human
ugggguccagugccaccccaag

SEQ ID NO: 904924 - RNA, 22 nt, Human
aagggggcggcagccaguggaa

SEQ ID NO: 904925 - RNA, 22 nt, Human
ugacacagaauuuggcuaucac

SEQ ID NO: 904926 - RNA, 22 nt, Human
ugugggcuguacugagggcagg

SEQ ID NO: 904927 - RNA, 19 nt, Human
agugagcauccagagaggu

SEQ ID NO: 904928 - RNA, 23 nt, Human
caggagauggcugcugugucagc

SEQ ID NO: 904929 - RNA, 22 nt, Human
uaggccaggaaucagcaagcuu

SEQ ID NO: 904930 - RNA, 22 nt, Human
ucccugugccuauaugugcuga

SEQ ID NO: 904931 - RNA, 21 nt, Human
ugagagacugguggauacagg

SEQ ID NO: 904932 - RNA, 22 nt, Human
caggagaugacagggaagaacc

SEQ ID NO: 904933 - RNA, 22 nt, Human
aaacuaaugaagugaagacgcu

SEQ ID NO: 904934 - RNA, 22 nt, Human
ucagagguaaaaacucacugua

SEQ ID NO: 904935 - RNA, 22 nt, Human
cuggaggaauaauggcaucuug

SEQ ID NO: 904936 - RNA, 22 nt, Human
uccuggagagugggcgagcaca

SEQ ID NO: 904937 - RNA, 22 nt, Human
agcuguuuguacuuagauagua

SEQ ID NO: 904938 - RNA, 22 nt, Human
cucugggccaugcuacugcucu

SEQ ID NO: 904939 - RNA, 22 nt, Human
cacccaggcaaggauucugcaa

SEQ ID NO: 904940 - RNA, 22 nt, Human
aagcacacaucucuggcugggu

SEQ ID NO: 904941 - RNA, 22 nt, Human
aauaacaggcucaucagaugcu

SEQ ID NO: 904942 - RNA, 22 nt, Human
aaugucuuucuugguucugguu

SEQ ID NO: 904943 - RNA, 22 nt, Human
ggagacaauggaggccaaaaga

SEQ ID NO: 904944 - RNA, 21 nt, Human
gggagggauggaaaugauguu

SEQ ID NO: 904945 - RNA, 22 nt, Human
gggaggagcuuggagauucacu

SEQ ID NO: 904946 - RNA, 22 nt, Human
acagcuuuguguuaaugggaag

SEQ ID NO: 904947 - RNA, 22 nt, Human
gaaagguuucaucuacuuuuca

SEQ ID NO: 904948 - RNA, 22 nt, Human
gccaaaggauucuauggagaua

SEQ ID NO: 904949 - RNA, 22 nt, Human
agcagggcagcuuuuuucagaa

SEQ ID NO: 904950 - RNA, 22 nt, Human
acaugagauuagcucacccacu

SEQ ID NO: 904951 - RNA, 22 nt, Human
agacccagaaagcagcugcauu

SEQ ID NO: 904952 - RNA, 22 nt, Human
gacagaacucaaacaugagaag
